United States Patent 7,319,142 (NUCLEOTIDE AND AMINO ACID SEQUENCES FROM XENORHABDUS AND USES THEREOF) - sequence listing, part 2

SEQ ID NO: 3626 - DNA, 726 bp, Xenorhabdus bovienii
  Coding DNA location: Contig name=SeqID_16892; Position on contig =46727..47452bp; Strand=-
atggcaattttaaacgcagaaaatctggcaaaggcttataagggtcgcagggtcgttgaggacgtcagtctgaccgtcaaatcaggcgaaatcgtgggtttgcttggccccaatggcgcaggtaaaaccacgaccttctacatggtggtcggcattgtgccacgtgatactggcaccatcaccatcgatggtgaagacatcagcctgctaccgctgcatgaacgcgcccgccgagggataggctatttaccgcaggaaccttccattttccgtcgtctgagcgtatttgacaatttgatggcagtcttggaaatccgcaaggatattacacaagaacaacgaaaagaacgggcagaagaattgatggaagagtttcacatcgctcatctgcgtgacaatctgggacagtcactttccggtggtgaacgccgtcgtgtggaaattgcccgtgctctggccgccaacccgaaattcattcttctggatgaaccttttgctggcgtcgatcccatctccgtactcgatatcaaaaagatcattcaacatctgcgggactatgggctgggagttctgattacagaccacaatgtccgtgaaacactggatgtctgcgaacgcgcctatatcgtcagccaagggcagttgattgcccacggctccccggaagatattctcaacaacgagcaagtcaaacgcgtttatctgggtgagggttttcgtctttaa

SEQ ID NO: 3627 - DNA, 534 bp, Xenorhabdus bovienii
  Coding DNA location: Contig name=SeqID_16892; Position on contig =47459..47992bp; Strand=-
atgaacaacctaatccgtaataccgttattgccagtaccctgtttgcagtcagcctgcccgtactggcattgaaagaagatacgaaacagcccattacccttaattctgacaggcaatctttggatttaacggggaacgtagccacatttacggataatgtcagcgtaaaacaaggctcaatcgacattcatgcggataaagtcgtcgtcactcgcccagaaggggatgcgaaaaaaacggttattgaagcctacggtaatccggcgactttctatcagttacaagatgacggcaaacccatcaaagggcatgcctcaaaaatgcgctatgagatggataaagagctgatgacgctgacaggtaatgcctatcttgaacaactcgacagtaacatcaaaggcgataaaatcacctatctagtgccaacacagcaaatggaagcctttagtgacaaaggtaaacgcgttactaccgtcctgttgccttctcagctacaggaaaaaggcaccagtgttaacaacaagagtaaataa

SEQ ID NO: 3628 - DNA, 630 bp, Xenorhabdus bovienii
  Coding DNA location: Contig name=SeqID_16892; Position on contig =47973..48602bp; Strand=-
atgccaaagggttatcaatataagactaaaattgaaaagagaatgagcagaattcaatcctggctgatcggaacactggcattgatcgcgcttgcgctgattggctggaatttatccaatttaaatgaaaacgcttcatcgccgattgtggatgatggacatcccacttatcaaacacaggaagccacttcttttgtctatgatcccgagggcaagctggcttacaaactggtggcagatgacgtacagaactatacggaaaccaaactgacttggtttactaaacccatattgacaacctttgcccccaatagcacttccgaaacaccgacatggacagtacgcgcaaataaagcaaagctgaccaacgataaaatgctctatctgtacggcgatgtccagctggatagcctgaccgatgcatcacaactgcaacggatcacgacagaaaatgcgaccgtcaatctggtgtctcaagatatcttatccgacgaccaagtcactctgattggtgtcggcctgaaatctgttggcatgaaaatgcgtggcaatctgcgaaacaaaactgctgaattgattgaaaaggtgacgactcactatgagatcccaaatgaacaacctaatccgtaa

SEQ ID NO: 3629 - DNA, 564 bp, Xenorhabdus bovienii
  Coding DNA location: Contig name=SeqID_16892; Position on contig =48580..49143bp; Strand=-
atgagtcaaaaaacgtatctggacacctgttatggcccggtcaacgaagaaattatcgaaaaagccagtaaaatccgtctactgatttgtgatgttgatggtgtgatgtcagatggcctgatatatatgggcaatcagggtgaagaactgaaagcctttaacgttcgtgatggttacggcatccgttgtctgattacctcaggcattgaagtcgccatcattactggccgtaacgctaagttgctggaagatcgcgcagaaacactgggtattacacatctttaccaaggacagagcgataaggttttggcgtataaggaactgttagataaactaacgttacagccagaacaggtcgcttatattggtgatgatcttatcgactggcctgtgatggcacaagttgggttatcggctgcggtttctgatgcccatccactgctgctgccaagggcggattatgtgactcggattgcaggtggccgtggtgcagtcagggagctttgtgatttggtacttttcgctcagaataagctggaagatgccaaagggttatcaatataa

SEQ ID NO: 3630 - DNA, 987 bp, Xenorhabdus bovienii
  Coding DNA location: Contig name=SeqID_16892; Position on contig =49246..50232bp; Strand=-
atgacgtgggaagtaaaaatgtctaagatcgattttcaacaagcaggtaaaaaagtattacaggtcgaactcgacggattggcagaactggaacaatatattaatgaagatttcagccgggcctgtgagttgatgtttagttgtgaaggaaaagtcattgtcatggggatgggcaaatccggtcatattggacgaaaaattgccgccacatttgccagtacgggtactccctctttctttgtccaccccggtgaagccagccacggcgatctcggtatggtgacatcaaaagacatcgtgctgacaatctccaactccggtgaatccaatgaaatccttgctttgatccccgtcctcaaacggcaaaaagttccgcttatctgtatgacaaacaacccaaacagtagcatggggaaagctgccgatatccatctgtgcatcaaaacgccacaggaagcctgcccgcttgggctggcgcccaccaccagcacgacggcgacacttgtcatgggggatgctctggccgttgcgctcttacaggcccgtggttttaccgctgaagattttgccctttcccatccgggcggcacactgggacgcaaacttctgttactgaccagtgatttaatgaccaccggcgatgatattccccgtgttccttataccgcgacactacgtgaggccttggttgaaatcacccgtaagaaactgggaatgaccgtcatctgcgatgacgatatgcagatcaaagggattttcactgacggggatttgcgccgtgttttcgatatgggaaccgatttaaaccatgcaaacatctctgatgttatgactgccggcggtgtccgcatcaagccccatacactggccgttgatgccctgaacctgatgcagtcacgccacatcacttccctgctggtcactgacggtgaaaaattgctcggcgtactgcatatgcatgacctcttgcaggcgggtgtagtataa

SEQ ID NO: 3631 - DNA, 978 bp, Xenorhabdus bovienii
  Coding DNA location: Contig name=SeqID_16892; Position on contig =50239..51216bp; Strand=-
atgtttctgactattgccctgctcattaccgggttgattttactggtgtatggctctgatagattagtatatggtgctgcggtttttgcccgctcactgaaaatacccccctatatcgtcggcttgacaatcatgggaatcggcacttcactgccagaattgatggtgtctatcacagcagctcaagatgggctaccgaacatggctataggcaatgccattggttccaatattaccaatctgctactgattactggcgctgcgtcactcattcgaccgatcacggtgaaatcagatatcctgcggcgggagttgccgctgatgttgctgattactgcatttgtaggctatattctggccgacagctacctgaaccgcctggacggtatcgtcctgttacttaccggcttgttctttatcgccctaatgatcaaaatgacaacagtttcccaagatgatgacctagacagctatacgcaggaacgagatgcagaattacccatcgaaggtaacaaaggcatcgcacttctctgggttgttttaggattgattatcctccccatttctacccgcatggtgattgacaatgcggcggtggttgcacgtatttatggcatcagtgagctggttattggcctgacaattctggcggtaggaaccagcctgcctgaacttgccacttcgattgcggcggccattaaaggcgagaatgacatggcgatgggcaatatcatcggctcaaatgttttcaacatcaccctcgtattgggtatccccggtatactttcacccagcgtcatttcacctcaggccttttcccgggacttctgggtcatgatggctgccagtgtgttattcacgatattctgtctggggaaaaagcatcgattgaaccgattaaacggcgtcctgttactgggctgttttatcgcttattttgtcgtactttttgtttctaattattacggtactgattaa

SEQ ID NO: 3632 - DNA, 804 bp, Xenorhabdus bovienii
  Coding DNA location: Contig name=SeqID_16892; Position on contig =51448..52251bp; Strand=+
atgagtcaacaaacagcaaatcttattgagatctgcggcatgtatttcactcgtggtcaacgcccgattttttctgatattaatctgaccgttccaaaaggaaaagtgactgccatcatggggccttcaggcatagggaaaactaccttgctgcgcctgattggtgggcagatccgccctgaacgcggcgagatctggtttgatggcgataatattccggcattgtctcgccaacgcctctatgctgcccgtaagaaaatgagcatgttatttcagtcaggtgcgttgtttacggatctgaatgtctttgacaatgtcgcctttcctttgcgtgagcatacccaattgcccgaagcgttgattcacaccacggtgatgatgaaactggaggctgtcgggctgcgtggggctgcgcacttgatgccatcggaattgtctggcggcatggctaggcgggctgcattggcgagggcgatagcactcgatcccgatctcattatgttcgatgaaccttttgttggtcaggaccccatcacgatgggcattctcgtcaaattaattgatgagcttaaccatgcgctcggtgtcacctgtgttgtggtttctcacgatgtacctgaagtattgagtattgctgattatgcttacattgtggctgagaagacggtcattgcagaaggtacaccggagcagttaagaatgaatcaggatcatcgggtacggcaattccttgatggcattgctgatgggccggtgcctttccgtttccctgcgggggattacaaaactgagttattaggataa

SEQ ID NO: 3633 - DNA, 783 bp, Xenorhabdus bovienii
  Coding DNA location: Contig name=SeqID_16892; Position on contig =52262..53044bp; Strand=+
atgttaacacgggcactggctgcgctgggcaaacgtgcgatcgaggttgcggcctcattcggccgtgctggctttatgcttttcagtgcaatcattggtaagccagaacccgccaaacaatggaaattattatgtcagcagctgtatagcgtcggtgttcagtcactgctgatcatcgtggtttccggcttgtttatcggtatggttctgagtttacagggctatctggttttaacgacattcagtgctgagggtagcctgggcatgatggtggctctgtcactgctgcgtgaattggggccagtcgtcacggcgctgttgtttgctggtcgggcgggttcagctttgaccgcagaaattggtttgatgaaagccacggagcaaatttccagcttggaaatgatggcgattgatccgctgcgtcgggtaattgctccgcgtttttgggctggttttatcagtatgcctttactctcgctgatctttgtcgccgttggaatcatcggaggcgcgatagtgggcgtggattggaaaggcattgatgctggttttttctggtcttcgatgcaatcggcggtggattggcaaaaagacttgctcaactgttttcttaagagcgtagcttttgccattacggtcacatggattgcactgttcaatggttatgatgctatcccaacatcagaagggatcagcagggcgacgacgcgcacagtagttcatgcgtcgttggcagtattgggtttggattttgtgctgacagcactgatgtttgggaactaa

SEQ ID NO: 3634 - DNA, 513 bp, Xenorhabdus bovienii
  Coding DNA location: Contig name=SeqID_16892; Position on contig =53049..53561bp; Strand=+
atgcaaaacaagaaaaatgaaatttgggttggatgttttgtcttgattgcactggttgcaatcgtctttttatgtttgaaagtagctgatgttcggtcatttggtagccagacaacctatcgcgtatctgctgcatttgacaatattggtggactgaaagtgcgttcacccgtaaaaattggtggggttgtgattggtcgtgtagggcgaatctggctggatcgcaaaacctatactccacaggttgaactggatcttttcactcagtacgacaatattccaagtaccagctcgctttctattcggacatcagggctattgggcgagcaatatgttgcaatgaatgtgggtttttatgaccctgatatgggggtatccatgttgaaagggggagatcgtattgaggacaccaaatctgcaatggtgcttgaagatttgatcggtcagttcttatataaaagcggtgacggtggtcaggcaaaatctgattcagctccggcaccggcacattaa

SEQ ID NO: 3635 - DNA, 630 bp, Xenorhabdus bovienii
  Coding DNA location: Contig name=SeqID_16892; Position on contig =53595..54224bp; Strand=+
atgtttaagcgattacttatggttgcgctgctggtggttgcaccattggccagcgcagttgatcaaaccaacccttacgcattgatgaaagatgcagcagaaaaaaccttcacccgtttgaagaatgatcagcctcaagttcaggcaaacccagaagttctgcgtcaaattgtgcgtgaagaactgttgccttatgtgcaggtaaaatatgcaggggcactggttcttggaacttactacgggcaggcgacgcctgaacagcgcgaagcctatttcaaggcgtttgaatcttatttagagcaggcatatggtcaggctctggcgatgtatcatggccagaactaccagattgcgccagaacagccattggagggcaagacgatagcggctatccgggtcactattactgatgaaaatggtcagccgcctgttcgcttggatttccagtggcgtaaaaatagcaagacaggttactggcaggcttatgacatgattgcggaaggcgtaagcatgatcacgaccaagcagaatgaatgggcagatatcctgcggcagaaagggattgatgctctgacagaacagttgaaaatcagcgcgaaaacgccaatcactttagaaaagaaaaagtga

SEQ ID NO: 3636 - DNA, 336 bp, Xenorhabdus bovienii
  Coding DNA location: Contig name=SeqID_16892; Position on contig =54226..54561bp; Strand=+
atggaaaaccgggaaataagccaaacgtctgatgacggaaagataagttgggaacaaacaggaagtacactatttcttcacggtacactggatcgtgacagtttacttccgctttggcagcaaaaagacagcgttctggctgagatcaaaaatattgatgtttctcggcttgagcatgtggattccacgggactggcgttgtttgtccgcttaaaaggagacatgcagcaacgtggcaaactattaaccttttctggcataagtgaacgcttggagacattgatagcactttatggcctgaaaagtctctttggtgctaacacgcctgacatgtaa

SEQ ID NO: 3637 - DNA, 255 bp, Xenorhabdus bovienii
  Coding DNA location: Contig name=SeqID_16892; Position on contig =54693..54947bp; Strand=+
atggatactgatgaaattaaagaagtgctgatgaaagcattggtacttgatgacgttatcgttagcggtgatggcagccattttcaggtgattgcagttggcgagctttttgatggcctgagccgtgtcaaacaacaacagactgtttacgcccctctgatggaatacattgctgataatcgcattcatgccgtgtcgatcaagacttatacacctgcaaagtggcaacgtgaccgcaagcttcagggattttga

SEQ ID NO: 3638 - DNA, 1263 bp, Xenorhabdus bovienii
  Coding DNA location: Contig name=SeqID_16892; Position on contig =55001..56263bp; Strand=+
atggataaatttcgagtgaaagggcctacctgcttatcgggtgaggttactatttccggggcaaaaaatgccgcattacccattctgtttgcagcgctgctggcggaagagccagttgaattacagaatgtgcctaaattaaaagatattgataccaccatcaaactgctcaaccgtttgggaaccaaagtaaaacgcaatggctctgtttttgttgatgccagtaacgttaacgaatactgcgcgccttatgaactggtcaaaacgatgcgggcttccatttgggccttggggccgctggtcgcgcgtttcggtcaagggcaggtatcactgccgggtggctgtgccattggcgctcgccctgttgatctgcacatttctgggctggaacagctcggtgcgaaaattgttctcaatgaaggttacgtcaaggcttccgtcgatggtcgcttgaaaggtgccagtattgttatggataaagtcagtgtgggtgcgaccgtcaccatcatgaccgcagcgacactggcggaagggacaaccatcattgaaaacgcagctcgtgagcctgaaatcgaagatactgccgattttctgaatacactgggcgcgaaaattaccggtgcaggcaccgatcgcattgtgattgaaggtgtagagcgtctgggaggcggtgtttatcgtgtgctgcctgatcgtatcgaaacaggaacgttccttgtcgctggtgccatttcccgtggcaaggtgatttgccgtaataccaagccgaacacattggatgccgttttatccaaactgcgtgaagccggggcagacattcaggtgggagatgattggattagccttgatatgcacggcaagcgaccaaaggcggttacattccgcaccgccccgcatccgggcttcccgacggatatgcaggctcaattcagcttgttgaacatggttgccgaaggtgttggcatgatcactgaaactatctttgaaaatcgcttcatgcacattccagagttgattcgcatgggtgcgcgtgcagaaatcgagagtaatacggtagtttgtcacggtgttgaaaatttatctggtgctcaggttatggcgactgatttgcgtgcctctgcgagcttggtattggctggctgtattgctgaaggcaccacggtagtcgatcgtatttatcatattgaccgaggctacgagcatatcgaagataaactgcgtggtttaggtgcgaatatcgagcgtattaagtcgactgattaa

SEQ ID NO: 3639 - DNA, 150 bp, Xenorhabdus bovienii
  Coding DNA location: Contig name=SeqID_16892; Position on contig =56229..56378bp; Strand=+
gtgcgaatatcgagcgtattaagtcgactgattaaattgaactcatattatccttcgcccgaactgggcgaaggattgaataagcgaaaagcagcggagttgtcggctatactcttcatcttgcaagctgctacaggcgttaaatgctaa

SEQ ID NO: 3640 - DNA, 1059 bp, Xenorhabdus bovienii
  Coding DNA location: Contig name=SeqID_16892; Position on contig =56384..57442bp; Strand=-
atgctgatcaagttattgcgctccatatcgataggactactcattgctgcaatcttattggttaccataccttcactacgccccaatgggttaaaacatctcctgagtgacaatagtcgcaacggcaaaccatacagtttcaatcaaggagttcgtcgagcggctcccgctgttgtcaatatctacagcagtaatctgggtagtttttctcatgaaggccgggaacttcgccccttgggttctggcgtcatcatgaatgaccagggctatatcctcactaacaaacatgtcatcaataaagccgactctattattgttgcattacaagatggtcgattctatgaggcgctgctggccggctcggatgctccaaccgatctggctgtcttaaaggtcaatggtaaaaatctccccgtgatcccgatcaatcacaatcgagttgcccatgtaggagatatcgtgctggcaatcggcaatccttacaatttagggcaaaccatcactcaaggtattatcagtgcgacagggcgtgttagcctcagccctacacgccgccagaattttctacaaacagatgcttcaattaatcagggaagctccggcggtgcactggtcaatacgctgggggaattagtcgggatcaatacgctgacgtttgataagtcagaatttggtgtcacgcctgaaggcttggggtttgccattcctaccgaacttgccacgaaaatcatgcataaactcatccgcgatgggcgggtcatcaggggatatattggtatcacagtccaagatttaccccgtattcgctcgtcagacagcaatatcaaccaaatgtcggggttgcgggtttttgaagttgcaccgagaagcccggctcaaaaagtggggatcaaagtgggagatatcattactaatttcaatcaccaacccgcgatttctccggcagagacgatggatcaagtcactgatatccgccctggcagtatggttcccatcaccatgctgcgtgatgggcaatccctcaccttcaaggttatggttgaagaatttgacggctga

SEQ ID NO: 3641 - DNA, 1458 bp, Xenorhabdus bovienii
  Coding DNA location: Contig name=SeqID_16892; Position on contig =57553..59010bp; Strand=-
atgaaatttcctgacaggataggtcttttaagtacgatttccctttctggcttaggtattaagagaacgtattcaatgaaaagaaaaaacacattgctcagcgcacttgcgatcagtattggattatctttagcttcagttccagtggtaggtaacgcagctttacctgccgcagtggcttctcaggaattaccgagcctcgcgccaatgctggaaaaagttcttccttccgtagtgactgtgcatgtctcgggcacagaagttcaaaatcagcagcagcttcagttaccagaagactttcaatttttctttgggccaggttttcctccacaggagcaaagaagccgtccattcaaaggattaggctctggggttattatcaatgccaataaagggtatgtgctgaccaatagccatgttatcgagaaagccaataaaatccgagttcaattaaacgatggccgtgaatattccgcaaaactcatcgggcgtgacctacagactgacatcgcacttttacagctgcaagatgccaagaacctgacagccattaaattcgccgattctgatcaactgcgtgtaggggattattccgtcgccatcggcaacccattcgggctggggcagaccgtaacatcggggatcatctctgcccttggccgcagtggcctgaatctggaaggtttggaaaacttcatccagaccgatgcctctatcaaccgaggtaactcaggtggagcattgatcaacctgaaaggggaattgatcggcattaacactgcgatcctcgctcccggcggcggtaacatcggcattggttttgccatcccaagtaacatggccagcaaccttgcagaccagctcattgcccacggtgaagtcaagcgcggcctactcggtatcaagggaaccgagatgacagcagatgtcgccaaggcactcaacgttgatgctcaacaaggtgcattcgtcagcgaagtcattcctaaatcggctgcggctaaagctgacatcaagccaggggatgtactggtctccgttgacggcaaaaaaatcaccagcttcgctgaattgcgtgcgaaggttggtacaaccgctcccggtaaagcaatcaagattggccttctgcgtaaagggaggccaatggaagtgaccgtaacactagaaaataatgtaactcaagaaaccaaagctgaaaacttgagcgttgccctgcaaggtgcaattctgagcaacagcacagtgaaaaacacacaaggtgtgaaagtagataaaattacccagaattcacctgccgcaatgtctggcttacagaatgatgatttgattataggagccaataacgagcgaattcggaatatcagcgagctgcgtaaactgcttgagacaaaaccacctgttattgccctgaacattttacgtggtgatgataatatctacttgttactgcgtaattaa

SEQ ID NO: 3642 - DNA, 132 bp, Xenorhabdus bovienii
  Coding DNA location: Contig name=SeqID_16892; Position on contig =59016..59147bp; Strand=+
ttgggaattacgcttattgggataggttttaagcataattgtttcgatgctgttatgactctcaattattcagcaaagttcactaacaatgtcgttttgccgtgtttctttacaggtatttacgtgaattaa

SEQ ID NO: 3643 - DNA, 465 bp, Xenorhabdus bovienii
  Coding DNA location: Contig name=SeqID_16892; Position on contig =59224..59688bp; Strand=-
atggtattgagacattgtggaacactattgccgaacactgaagttaataaaggggttgccatgacttgggaatatgcactgattgggttagttattggttttatcgttggcgcactggctgtccgctttggcagttcaaaactgcgtcagcaaaatgcagcacaggccgaactggagaagaatcgggcagagttggaagaatatcgtaaggagctggtcagccattttgcccacagtgctgaattacttgataatatggcacgcgattatcgccaactgtatcagcacatggccaaaagttccaacgaactgatgccaaacatgccaatacaggataatcccttcaattatcgcctgactgaatctgaagccgataaaagtaaagtcaccgccaatatgcctccacgggactattctgagggtgcatccggcctattccgcccaattcaagataaaaaacagtaa

SEQ ID NO: 3644 - DNA, 120 bp, Xenorhabdus bovienii
  Coding DNA location: Contig name=SeqID_16892; Position on contig =59784..59903bp; Strand=+
atgatacgtcgtgagttattggcgaaattgagagaggatatggaaaaaagtatgaaaaattggaacaaatataacgaactcaaacagaaaagattagcgcgatttttaccagtacaatga

SEQ ID NO: 3645 - DNA, 1128 bp, Xenorhabdus bovienii
  Coding DNA location: Contig name=SeqID_16892; Position on contig =59944..61071bp; Strand=+
atgttaccgattacaccttcgtctctctatcaatctgcactgtcagaaggccagtaccaacctgatgaagtgcagcgtaataccgttgcccgcttggatattatgcatcacgatctcagtaatcgttctccggagcatgttttaccttcaagtggactgaaaagcatactgggcaggttatttggcggcttatcaacagagcagcagcggccggttcaggggctttatatgtggggcggcgtcgggcgtgggaaaacatggttgatggatatgtttttccagagcctgccaaccgaccgaaaactacgtctccattttcatcgttttatgttgcgggtacatgaagaattaaccgttttacaggggcacgaaaatcccttggatgtgatagctgatggctttaaggcgcagactgatgtgctctgcttcgatgagttttttgtttcggacattacagatgccatgatcctcggtaccttgctggaagctctgtttaagcgaggaattgccttggtggcaacatcaaatattccacctgatgaattgtaccgaaatggcttgcagcgcgcgcggttcctgccagccattgagcaaatcaaaaaatactgcgatgtgatgaatgtggatgcgggtatcgattatcggttgcgcacgctgactcaggcgcatctttatctcacgccattatcggaagataaccgacaggaaatgcatcgcatgtttcagcgtctggcgggacggaaaggagaaccgaatccggtattggagattaaccatcgcagtatgcctgccatcagcagtgttgacggggtgctggccatcaatttcaaaaccttgtgtgacgatccccgcagtccgttggattacattgcgttgtcgaagctttatcattctgtcctgctgcatgatacgccagctatgactgcattggatgaaagcgcagctcggcgttttcttgcattggtggatgaattctatgaacgccatgtaaaactcatcatcaatgctgaagcgccgatggagcggatttatcaaggggaattgctgacatttgaatatcggcgttgtctgtcccgcttgcaggagatgcagagtgaggaatatttgaaacttcctcatttgccctga

SEQ ID NO: 3646 - DNA, 174 bp, Xenorhabdus bovienii
  Coding DNA location: Contig name=SeqID_16892; Position on contig =61232..61405bp; Strand=-
ttgccatctgcgtcaacaacataccagtcgcgttttacggtttctggtttagctgtaaaagttttcattaaagcttacccaattataagttacacgttggtgaacactcgatgttcagaaactgtttttgaggttcacacgacttttgtccagcaaacctaccccttcgaatag

SEQ ID NO: 3647 - DNA, 429 bp, Xenorhabdus bovienii
  Coding DNA location: Contig name=SeqID_16892; Position on contig =61338..61766bp; Strand=+
atgaaaacttttacagctaaaccagaaaccgtaaaacgcgactggtatgttgttgacgcagatggcaaaactttaggccgtcttgcaactgaaatcgctagtcgcctgcgcggcaagcataaagcggaatatactccgcacgttgatactggtgattacatcattattgttaacgccgaaaaagttgctgtaactggcaacaaacgtgctgacaaaatctactatcaccacactggccacatcggtggtatcaagcaagcgacctttgaagagatgattgcccgccgtcctgagcgtgtcattgaaatcgcggttaaaggcatgctgccaaaagggccactgggtcgtgcaatgtaccgtaaactgaaagtttacgcgggcagcgagcacaaccacgcggcacagcaaccacaagttctggacatttaa

SEQ ID NO: 3648 - DNA, 393 bp, Xenorhabdus bovienii
  Coding DNA location: Contig name=SeqID_16892; Position on contig =61782..62174bp; Strand=+
atggctgaaaatcaatactacggcactggtcgccgcaaaagctcctccgctcgtgtctttattaagccaggtagcggtaacatcgtaatcaaccaacgtagcctcgaagtttacttcggtcgtgaaactgcacgcatggttgttcgtcagccactggagttggttgacatgttaggcaaactggatctgtacatcactgttaaaggtggtggtatttctggtcaggcaggcgcaatccgtcacggtatcacccgtgcactgatggcttatgacgagactctgcgttctgatcttcgcaaagctggcttcgttactcgcgatgctcgtgaagttgaacgtaaaaaagtgggtctgcgcaaagcacgtcgtcgtccacagttctccaaacgttaa

SEQ ID NO: 3649 - DNA, 261 bp, Xenorhabdus bovienii
  Coding DNA location: Contig name=SeqID_16892; Position on contig =62050..62310bp; Strand=+
atgacgagactctgcgttctgatcttcgcaaagctggcttcgttactcgcgatgctcgtgaagttgaacgtaaaaaagtgggtctgcgcaaagcacgtcgtcgtccacagttctccaaacgttaatttgttgccacggctgtggcgatgggttaaagttgaaacccgtcatttatatggcgggtttttttatcatctgattttccttcctttggtgaatagccttttttcccaaaaactagcgtattacagaaataaataa

SEQ ID NO: 3650 - DNA, 279 bp, Xenorhabdus bovienii
  Coding DNA location: Contig name=SeqID_16892; Position on contig =62332..62610bp; Strand=-
atggctaaaaatgtcggtcgagccggaaaacagagtcattaccgaacgtttgttggcagcgacagccatgaaaacctccaagtttatctaaacaaaggaacgaacagcccttcagtgaaaaacggctattctcgctcatattctcatcctgtttcgcacttattatccgagggtatattgaaacccctgccaaatcaggctcattcatggataaggcaaaaaattatcactagtctaccagattttgcacattttgtggggaagtacattgagaattaa

SEQ ID NO: 3651 - DNA, 642 bp, Xenorhabdus bovienii
  Coding DNA location: Contig name=SeqID_16892; Position on contig =62542..63183bp; Strand=+
atggctgtcgctgccaacaaacgttcggtaatgactctgttttccggctcgaccgacatttttagccatcaagtgcgaattgtgctggcggaaaaaggagtcagcgttgagattgaacacgttgaagcaggcaatttgcctcaggatttaattgatctgaatccttatcagacggttcctactctcgttgatcgtgaattgactctgtatgattctcgcatcattatggaatatctggatgagcgttttccacatccaccactcatgcctgtatatccggttgcacgtggtagcagccgtttgatgatgtatagaattgaaaaaaactggtattccctgatgtataaaattcagggagggaatactcaggaaaccaatgctgcccggaaacagcttgctgaagaattattggccatggcgcctattttcagagacatgcctttcttcatgagtgaagagtttagtctggtggattgctacctttcgccgctgctgtggcgtttgcctgtattaggtgtagagttgtctgggccaggtgcaaaagatatccaggtctatatgcagcgtgtatttgaacgtgacgcatttttggcttcactgacggaagcagaacgtgaaatgcgtttaccatcacggggctaa

SEQ ID NO: 3652 - DNA, 483 bp, Xenorhabdus bovienii
  Coding DNA location: Contig name=SeqID_16892; Position on contig =63187..63669bp; Strand=+
atggagatgattcaaatgtctccacgtcgtccttatttattgcgggcgcattatgaatggctgctggataatgaaatgactccgcatcttgtcgtggatgtcaccctgtatggggtgaatgtcccgatggaatatgcgaacgatgggcaaatcatcctgaatatttcgccgagggctgttggcaatctggaattgactaacgatgaagttcggttcaatgcccgctttggtggtgtagggcgtcaggtctctgttccaatggcggcagtgattgcggtttatggtcgtgaaaatggagcaggaatgatgtttgagccggaatctgcctataaggtaggtttcgaaccggaagattcggatgctcctatagcggataatctggtgcttatcagtgacgctaaaattgctcgtgataatggttcatcggatgacgaaccccctcaacctccaaaaggtcgtccaactttgcgtgttgtaaaataa

SEQ ID NO: 3653 - DNA, 507 bp, Xenorhabdus bovienii
  Coding DNA location: Contig name=SeqID_16892; Position on contig =63783..64289bp; Strand=-
atgcgcttactcacacagatacttttattctctttcatatccttaatgagctcaccctcaattgctcatttatcgacacaagcggaaatcctgcaacaagtgcgagaaagaggtgtaaatgccgttgttgcggaattaggagaaagtagaaaaagggatgaaatcgcctataacattacaacaggtgaaagtcagtggctgagagttgcatttacgctatcccccaatatgcattccgaattttcgaaacaactcctttgctctttatcttttgccttaattaataaccctgtagaagtcttatcgctgtcgaaaaaatataattcattctcatcagatcagatctgcgatataccgccaactttaaaaggcttggacgaaaggacaagttttattgaaaagctgtctaacagcctgaatgcagccagaaaatctaattccggaaaaaataatgaaaatatagaaaattgcctgtggagactatggagactagctcaaactttatag

SEQ ID NO: 3654 - DNA, 1566 bp, Xenorhabdus bovienii
  Coding DNA location: Contig name=SeqID_16892; Position on contig =64606..66171bp; Strand=-
atggcgaaagcatactggaaaactggtcacaatgggtcaataaattcgcgctggttaaacctaaatccagtgatgtcagtgcattgttggggcaccgcagccgttcttccgcagaattacgggttcaggcgcagtaaggagtcaaaaatgagtcagaacgtttatcaatttatcgacttacaacgtgtcgatcccccaaaaaaaccgttgaaaatccgcaaaatagaatttgtggaaatttatgagcctttttctgaaatgcaagttgaggcacaggcagatcgctgcctttcatgtgggaatccctattgtgagtggaaatgccctgtgcacaactatattccgaactggctgaaactcgcgaatgaaggccggattattgaagcggcggaactctcccaccgaacgaacagcctgccagaagtctgcggacgagtttgtccgcaagatcgcctgtgtgaaggtgcctgtacgctgaatgatgactttggtgctgttaccatcggcaatattgaacgttacattaacgacaccgccattgcgatgggctggaagccggatatgtcagacgtgatcccgacaggcaaacgtgtggcagtgattggagccggccctgcggggctggcctgtgcggatgtcctaacccgcaacggcgtacaagcggtagtttacgatcgccaccctgaaattggcggcttgctcacgtttggcattcctgctttcaaactggaaaaagaggtgatgatccgccgccgtgaaatcttctccgaaatgggtatcgaattccgcttaaacacggggataggcaaagacatcacgcttgctgaactcaccgagcaatttgatgctgtgtttctgggcgtgggaacttatcagtctattcatggcggactcgagaacgaagatgctgacggagtctatgacgccctgcccttcttaatcgccaatacccgtcatttaatgggctaccccgcgttaccgaaacagccttatgttgatatgaaaggtcagcgcgttctggtacttggaggcggtgatacagcaatggattgcgtgcgcacttctgttcgccaaggcgcaacccatgtcatctgtgcttatcggcgggatgaaggcaatatgccaggctcccgtcgtgaagtgaaaaatgccaaggaagaaggtgtggattttcagtttaaccttcagccgctcagtattgagatcagtagcgcaggtcaagtttgcggcgtcaaagtcgcgaaaacacaacttggcgaaatggacgaaaaaggccgccgtcgagctgaaatcattcagggctccgaatttttgatcgaaactgatgccgtaatcacggcgtttggtttcaaacctcacaacatgcactggctgaacgcgcatcagatcaatctcgatcagcagggacgtattgttgctcctgaagccagcgatcttcccttccaaaccagcaatcctaaaatattcgcaggcggggacgccgttcgtggctccgatttagtggttactgcgattgcagaaggtagaaaagcggcatccggtattctcgactatcttgaggtttaa

SEQ ID NO: 3655 - DNA, 4458 bp, Xenorhabdus bovienii
  Coding DNA location: Contig name=SeqID_16892; Position on contig =66035..70492bp; Strand=-
atgttgtatgataaattgcaggaaaaagataactgtggctttggattaattgcgcatattgaaggggagcaaagccacaaggttgtgcgcacggccatacatgcgctggctcggatgcagcatcgcggcgcaattctggcagacggcaaaacgggcgatggctgcggcttattaatgcaaaagccagatcggttttttcagatgatcgccagcgatcagtcatggcggctcgccaaaaactacgctgtcggcatgctgtttttaagtcaggatgccaaaattgcccaatcatgtcgtgacattgtcgaacaagaattacaaaacgaaaccctgtccattgtgggttggcgggaagtccccatcaaccgcgatattttgggcgagattgccctgtcaagcctccctcgtattgagcagatttttgtcaatgccccggccggatggcgggcgcaagatctggaacgccgtttgttcgttgcccgacgccgtatagagaaacgcatcactgatgacgatttttatgtttgcagcctgtccaatctcgtcacgatttacaaaggactgtgcatggctgctgatttgccgcgcttctacctcgatttggcggatttgcggatggaatcttctatctgcctatttcaccaaagattttcaaccaatacagttcctcgctggccgctggcacaaccgtttcgctatctcgcccacaacggggaaatcaataccatcaccggcaatcgcgaatgggcaagagcaagagcctataaattccggacaccactaatccccgacttacaaaccgctgcgcctttcgtcaatgaaactggctcagattccagttcactggacaatatgctggaattgttcctcaatggcggcatggatttaattcgggcaatgcgcctgctagttcctcccgcatggcaaaataatcctgatatggatgatgacctgcgtgcattcttcgacttcaactccatgcacatggagccgtgggatgggcctgctggcatcgtgatttccgatggacgctatgcagcctgtaatttggatcgcaacggcctgcgccccgcccgttatgtgattaccaaagataagctgatcacttgtgcttccgaagtgggcatttgggactaccaacctgatgaagtcgtagaaaaaggacgcgttggcccaggtgagttaatggtaatcgacacctatgaaggccgcattctccattccgctgaaaccgataatgatttgaaaatccgccatccttacaaagagtggctggaaaaaaacgtcaaacaactgatcccatttgagaaactgccggaagatcaaatcggtcagcgtgatttagatgatcggatgctggcgatttatcacaaacaatttgcctacagcaatgaagagctggatcaaattatccgtgcactcggtgagaatgggcaggaagccacgggctcaatgggggatgatactccgtttgcggtactttccagccgtccacgcgtcatttatgactattttcgtcagcaattcgcccaagtcaccaatccccccatcgatccactgcgtgaagctcatgtcatgtcgctggcgacccgtattgggcgggaaatgaacgtcttttgtgaagcggaaggtcaggcgcatcggctgagttttgagtcccctgtgctgctctattctgattttgtgcagctcacgacacagcaagaatcctactatcacgctgaaacactggatttgacgtttaatccacaggaaaccaacctcaaaagtgctgtcgcaacgttgtgcagacaagctgaagaactgatccgaaacggggcggtattgctggttctgtctgaccgcaatatttcaccagaaaaattgcctattcccgcccccatggctgtcggagctatccagcactgtctggttgagaaaagtctccgctgtgatgctaacctgatcgtagaaaccgccagcgcccgcgatccacaccattttgccgtgctattgggctttggtgccactgcggtttacccctatctggcgtatgagtcactgggaaaaatggtggacgatggcacgatcaacgcgccatatgtccgcgttatgctgaactatcgcaacggcatcaataaagggctatataagattatgtccaaaatgggcatttccactatttcctcttatcgctgctccaaattattcgaagccgtcggcctgcattccgatgtgacagatctttgtttcaatggcgttgtcagccgtattgaaggggcagatttcaacgattttgaacaagatctgcgtaatctctccaaacgggcgtggttacatcgccataccattgatcaagggggattgctgaaatatgtccatgatggggaatatcacgcttataaccccgatgtcgtcaatacattgcaggcggctgttcacagtggcaaatacagtgattaccagaaatattcccagttagtgaacggccgccccgccacgactctgcgagatctgctcgccatttcctctaaagaagaacccatcgccattgaggaagtcgagccagacgaatccctgttcaaacgttttgacacggctgccatgtcaattggagccctaagccctgaagcgcatgaagcactggctgaggcgatgaatacgctgggcggtttttccaattccggtgaaggaggggaagatcctgcgcgttatggcacgaagaaagtgtcccgcattaaacaagtcgcttccggacgtttcggggtaacacccgcgtatctgagcagtgctgatgtgatccagataaaagttgcccaaggagcaaaaccaggggaaggcggccagttgccgggggataaggtaacgccttatatcgccaaactacgttattccgtgccgggtgtgacgctgatttcaccaccgccgcatcacgatatttattctatcgaagatttggctcagttaattttcgaccttaagcaagtcaatccgaaagcgctgatttcagtcaaactggtttcagaaccgggagtaggaactatcgctacgggtgtagcaaaagcctatgcggatttgatcaccattgccggttatgacggaggaaccggcgcaagcccgctgtcatcagtgaaatatgccggctgtccatgggagctgggtctggtagaaactcaacaggcgctagtcgccaatgggctacgccataaaatacgccttcaggttgatggcggattgaaaacaggcgtggatatcattaaggccgccattttaggtgcggaaagtttcggcttcggcacggggccaatggttgccctcgggtgtaaatatctgcggatctgccatctgaataactgtgccactggcgtggcaacgcaagatgaaaaattgcgcaagtctcactatcatggtctgcctgagcgcgtgatcaattacttccgtttcattgcgcaggagacacgtgagctcatggcgcaactgggcatacgggaattaacggatctgattggccggacagacttacttcaaatattggaaggcatttctgccaagcaaagtaagctcaaccttgagccgctgctgaaaacagcacaaccccacgaaggcaaggatctgcattgtactgaagataacccgtcatttgatcagggtattttgaataaagatatcatcaagcaggctatgccttatgtgaaaaattcacagagtaaaaagctctattttgatatccaaaatactgatcgttccgtcggagcctcactgtcaggtgaaatcgcagagttgcatggtgatcaggggctcgcagccgatcccataaaattatacttcacaggaacagccggacaaagttttggcgtctggaatgcgggtggcgtcgaattgacattaactggcgatgccaatgattacgtcggcaaggggatggcgggaggtcaaattgtcattcgacctccggttggttctgcattcagaagtaacgaagcgaccatcatcggtaatacctgtctttatggtgcaacaggcggaaaattgtttgccgccggaaatgcaggcgagcgctttgccgtacgcaactcaggtgccatcacggttatcgaaggcatcggtgataatggctgtgaatatatgaccggtgggatcgtctgtgttctgggcagcacaggggtgaattttggcgctggcatgactggcggattcgcttacgttcttgatgaatttgatgatttccgcaagcgagtcaacccagaattggtcgaagtactctcaatagataccttggccattcacaaagaacacttgcgtggattgatcaccgaacacgtccgattgactggctcccagcatggcgaaagcatactggaaaactggtcacaatgggtcaataaattcgcgctggttaaacctaaatccagtgatgtcagtgcattgttggggcaccgcagccgttcttccgcagaattacgggttcaggcgcagtaa

SEQ ID NO: 3656 - DNA, 117 bp, Xenorhabdus bovienii
  Coding DNA location: Contig name=SeqID_16892; Position on contig =70635..70751bp; Strand=+
atgttatgtcactgcataaggacactgcataaatatgagtcggagaattatccgacaagtgattttcagtggattcccaacttagcgagaaaaatagagcaggtcaaatcgtgctag

SEQ ID NO: 3657 - DNA, 2337 bp, Xenorhabdus bovienii
  Coding DNA location: Contig name=SeqID_16892; Position on contig =71149..73485bp; Strand=+
atgaagcggatcaggagatttgcccagtattatgtcgatttgatgatgaaattagggctggtgcgtttttcgttactgcttgcatctgttctcattatccttgcgatggtgatacagatagcaatcactttacactggcgtggagaagtacaacgaactgatttaattggttccatcttttttggtttattgatcacgccttgggcggtttattttctttccatcgtggtggagcaacttgaagaatcccgccaacgtttatccagcctggtcgcaaaactggaggaaatgcgtcagcgggatgccaaattgaacctgcaacttaaagaaaatattgctcaattaaatcatgaaatcaatgacagagaaaaagcagaaaaaacgcatctggtactgttggataaattaaagtcggaaatggaacagcgtgaaaaaacccagagtgcacttgagcagcaatcgattctgctgcgttcatttcttgatgcttctcccgacttggtttattaccgtaatgaagacaatgaattttccggttgtaaccgtgcgatggaactgctgacgggcaaaagtgaaaaacaacttatcggcctgacaccgacggaggtttacgacaaagaagtcgccagtaaggtgatggaaaccgatgaaaaagtgtttcgtcacaatgtatcgttgacttacgaacagtggttggtttatcccgatgcacgtaaagcctgttttgaactcagaaaagttcctttttatgatcgcgttggaaaaaggcacggtctgatggggtttgggcgcgatataacggaacgtaaacgctaccaggacgcgttggagaatgccagcagggataagacgacctttatctcaacgattagccatgagcttcgtacgcctttgaatggcattgttggtctgagtcgcatcctgatggacactgatctgacgccagaacagtgtaagtatctgaaaactatccatgtcagtgctatcactcttggtaatattttcaatgatattattgagttggataaaattgagcgccgtaaagtccagcttgataaccagcagattgacttcacgggctttatggctgatttggaaaacctgtcagggctactggcgcagccgaaaggcattcggtttgtactggaaccggaattaccattgcccgccaaaattttgactgatggcacccgtttgcggcaaatcttgtggaacctgatcggcaatgccgtgaaatttactcagaaaggcgagattcgggttcgtatctggcgtgaaggaggcgagcggctgttatttgaagtcaccgattccggaattggcattccttctagtgagttggaaaaaattttcgccatgtattatcaggtaacagacagtgcgggtgggcgcccggcaaccggaaccggtatcgggcttgccgtctctaaacgccttgcccaaagcatggggggagatattgtcgtggaaagcacagtggatcaaggctcctgttttacattgtctattgttgcccctgctgttgatgaaaaatcagaaggacaagaagagagcgaattgccattgcctgcactcaacatcctgttggttgaagatattgaactgaacgttattgttgcccgctccgttctggagaaattgggaaatagcgtcgatgttgccatgaatggtcatgacgcattgatgatgtttgatcctgatgaatatgacttagtgttacttgatattcagttgccggatatgactgggctggatattgcccgtcaattacaccagcgctatccaagccagtcacttcctccattggttgcgttgactgccaatgtgttgaaggataaaagagaatatcttgatgtgggaatggatgatgtgctcagtaagccgctctctgtcaaggagttaaccgccgtgatggagaaattctggggtaaggcgcctaagcctgaacagacattacaggagacaaaggttgtgaagaagaacgaagatttacttgatacagagatgctcaatcaatatatcgatttggtcgggccaaaaatgattgctgataacctgaaaatgtttgaaaccatgatgccaagttatcttgccttgttggattcaaacatgaccgcgagggatcagaaagggatcacggaggaggcccataaaatcaagggagcggcgggttctgttggattacgtcacttacagcaattggcacagcagattcaatcacctgatttacctgcatggtgggataacgttcaagaatgggtggatgagttaaaattggaatggagaagtgatacggaaacattgagaaactggttaactgacgctacaaaaaaataa

SEQ ID NO: 3658 - DNA, 666 bp, Xenorhabdus bovienii
  Coding DNA location: Contig name=SeqID_16892; Position on contig =73710..74375bp; Strand=+
atggagataaatatgaaatgcgttgcagttatattaagtgggtgcggagtctatgacggaagtgaaattcacgaatcagtcctgactatgctctctttaagtcgcttgggtgctaaagtgtcttttttttcacctgatgaattacaacatcatgtaattaatcaccttaatggaaaggaggaaaaagaaactcgccacataatgcaggagtctgctcgaataacacgcggaaatatccagcctttatctcaggttgatattaataccttggatgcgctgattattcctggtggttttggcgtcgctaagaatttgtgtaatttcgcatttaaaggatcagaatgtgaaataaataaaaatttattaagtatagtgcgttctatgcatcagcagggtaaacctatggggttcatgtgcattgctcccgtcatggtagctaaaatattaggcaggccgataaaagtaaccatcggtaatgacccagaaactgcggcacaaatagaggcaatgggaggaattcacattgagtgcccagttgatgacattgttattgattttaaaaacaaaattgtaacaactccagcctatatgcttgcggaatctctatctcaggctgaacaaggaattgataaattggttcgcaaaatattggaaatgattgagtaa

SEQ ID NO: 3659 - DNA, 717 bp, Xenorhabdus bovienii
  Coding DNA location: Contig name=SeqID_16892; Position on contig =74380..75096bp; Strand=+
atgaaaaatcctttttcaatattgtggccctggttgaaaaaaattgtgcttacgatcacaattctgtggttcgttgctgtaattttgttttcgtttctgccggtgccgttttctatggtaatggcagagcgtcaaattagcgccttaatgtcaattaatttatcttatgtttcccgttcctcatggatggatcagaatcaaatttcaccttatatgacattagccgtcattgcggccgaagatcaaaagtttccaaaacattggggattggattttgaggctatcgaaacggcgatggcacataataaaaaatttcagaagcggatacgtggcgcttccactattacccagcaaaccgccaagaatttgttcttgtgggaagggcgcagttgggtgagaaagggattggaagcagggatggccgttgttttggaattgttatggtcaaagaaacgtattttgacggtctatctcaatattgctgaatttggtcatggcatttttggtgtggaagaggcggcacggcattattttggtaaatcggccaatcgtttgactgcctctgaagcggcattactggcagcggtgttacccaatcctcatcgttataaagttgatgcgccttcagcttacttgttgcagcgtcagcagtggattttgcggcaaatgcggctgctagggggagaaagttatctgaaacaaaataaattgagatag

SEQ ID NO: 3660 - DNA, 576 bp, Xenorhabdus bovienii
  Coding DNA location: Contig name=SeqID_16892; Position on contig =75167..75742bp; Strand=-
atgcggctattttctctattaatagtattttgcagtgcaatgttattgcagggatgtattggtgccgccgtcgtgggttctgccgcgattgcgacaaaagcgggtagtgatccccggtcaattggtcaacaggttgacgatggcactctggaagcccgcgtcagtaatgccatcagcaaagatccacaaattaaggcacaagcccgcataattgtgactgtttatcagggtagagtgctgctaactggacaaagcccggatctgcaactgggtgatcgggcaaaacagctcgcctcaaaggtcgaaggcactgaagcggtatataacgaagtccgtcaaggtaatcctgttgacctgggtacggcctctgtagacacttggctgacaaccaaagtacgttccaagattttagccagtgattcagtgaagtcatcgaatatcaaggtcgtcactgaaaatggtgaagtctttttgtttggtattgtcaccagacaggaaggtacagatgctgcgaagatagccagtgaaaccagcggtgttaagcgcgtgacaacggcattcacttatctcaattga

SEQ ID NO: 3661 - DNA, 660 bp, Xenorhabdus bovienii
  Coding DNA location: Contig name=SeqID_16892; Position on contig =75754..76413bp; Strand=-
ttgaaagatgaagggtatataggctatcactctctacataaaatagattatcaatatataggtcataacgtgctggatagaattaaagtctgctttacagaaagtattcaaactcaaatcgcagcagcagaagcattgcccgacgcgatatcacgcgccgcaatgatgatggttcaatcactgctgaatggcaacaaaatcctttgctgtggcaatggcggctctgccgcgacagcacagcgttttgccgccagtatgataaaccgatttgagacagagcggccaagcctgccagctctgtctctgaatgctgataacgtggtgatcacttccatcgccaacagtaaacagccagacgaaatctacgccaaacaggtcagagcgctgggacatgctggagacgttctgcttgccatctctacgcacggaaacagccgggatatcatcaaggcggtggaagcggctgtcacgcgcgatatgacgattgtcgcactgaccggttatgatggtggtgaactagcaggcttactgggaccacaggatgtagaaatccgcatcccttcgcatcacagtatcagaattcaagaagttcacatgctgacaattaactgtctgtgcgacttaatcgataatacgttatttcctcatcaggatgactaa

SEQ ID NO: 3662 - DNA, 363 bp, Xenorhabdus bovienii
  Coding DNA location: Contig name=SeqID_16892; Position on contig =76456..76818bp; Strand=-
atgaaaaaaccaagcatcaatcgctatgcgcaaggacgctattacgagcagcaggttaaacagtttctgcaacaacaggggcttgtctttgttgcagagaatgtgaaaattcggggtggggaaattgatctgattatgcgtgataaacagacatgggtatttgtcgaggttcgtttccgccaaaacgcaacatatggtgatgccattgctacaattacccagagcaagcgcagaaaaatattgtatacagcttctgtctggctgtatcaacgcaacgagtgtctggaaacggcctcgtgtcgctttgatatttgtgcaattacaggtcagaaatttgaatggctaaaaaatgccttcacctga

SEQ ID NO: 3663 - DNA, 1857 bp, Xenorhabdus bovienii
  Coding DNA location: Contig name=SeqID_16892; Position on contig =76924..78780bp; Strand=-
atgaccgatttaaaattgagcatctttgaaaaaaacatcactggatacagtatgcttccctcaatttttgtgcgtttcaaaactggtttagtctgcacagcgctgctgtcgactatgattattgcagggtgtaccacgccagaacagcaagggcaaccaccttctaagccacaagacaagatcagcgcagagattaaccgctatcagtccattattgatgcaactcacaatcaaccgtctttggatgttatccgcgcttatattgcgctggaaacacataccgcagacgacgctgctcaccagaaaaacattgatgatacatggcaggcactgacgcatctttccccgcaacagttgggcgaactggtgattaatgccaatgagtatacgcttcagggctggctcgacctactcaatgcctatctcgtcaataaacaagatctagataagctacgtactgccatcaatgactggcgtacccgctatccagataacccggctatgcggagcttgcccacttcgctgcaacaaatgctgctcaagccaaaggacagccatgccattatcgggctattcctccccctgagcggtcaggcaaaagtgttcggtgaggcaatccgccaaggcttccttgatgcacaaaaaggactgccacagccaactttgcctgtaaatgctaccgtatcagcgccagaagcagggatagcagcaaatacgactgaaacggctgaagccgcactatcatcttctccagcctcagcaacttcaaccactattgctgctgctccggtcaacgatcagccggtgaaagtttatgacaccaacagccagccacttgccaacctgctggcacaagctgaacaagatggtgttacgctggtcgttggaccattgctgaaaccgaatgtggagcaattggtacaaattaatacgccattgaacattctcgcgctcaacgaactggacgtttcacaatcgcggtctaatatctgctatttctccctgtctcctgaagatgaagctaaaaatgcggctttgcatctctggcagcagcaaaaacgcaatccattggtattagtgccacgtaccgagctaggtaatcgagtaaccaaagcctttgcagaagaatggcagaaattgggcggtaatgtggctttacaacagactttcgggacactgggtgaaatgaagcaatccatcaaccggggtatgggcattcgtctatctggtacgcccattccagtcagcgcttacctgccaggtgcgggggcatcacagctcaaaacgaacggagcagtgatcgccacaagcgcccctacaaattctgccggtggtgccgtcgatgccgtttacattgcagcgacaacggatgaactgaccctcatcaagccaatgatcgatatggcaatcagttcccgtaagaaacccgcactctatgctaattcacgcagtaataaggcgggtgtagggccggatttccgtctggaaatggacggtatgcagtttagtgacattccattgctgacaggcgtcaatttgccattaatgcaacaggccgccagtaaatttgccaatgactattccctgatccgtctctatgccatgggcatagatgcatggtcactggccaatcagtttacacagctacagcaaggcaccggattccatatgaagggggcgtcgggagagctttccgtcacaaataattgtataatattacgccagctggcgtggatgcagtttaacaacggccgtatcactatcgagaataatgcggccaataatattgacgccactgtcgacaacaccgttaataaaagcactgacagcagtaactcagtacaattaatgccgtaa

SEQ ID NO: 3664 - DNA, 873 bp, Xenorhabdus bovienii
  Coding DNA location: Contig name=SeqID_16892; Position on contig =78793..79665bp; Strand=+
atgaatcaaaccaatcgagcagtggttacgacatccacgctatatgttgtgccaacccctatcggaaaccttggggatatcactcagcgcgcacttgaagttcttaaacatgtcgatctaattgcagccgaagatacgcgacacactggcctattgcttcaacattttgccattaatgcgcgcatgttcgcacttcatgatcataatgaacagcagaaagcagatcaaatacttgcgaaattagagcaaggtttgagcattgctctcgtgtctgatgcaggaacaccattaatcaacgatccgggctatcacgttgtccgccgttgccgtgaagcgggcattaatgtggttccactgccaggtccctgtgcggcgatcaccgcgctgtctgctgccggattgccttccgatcgtttttgctacgaaggttttctgccggcaaaaagtaagggacgccgggatacactgcgcgatttggcgcaggagccgcgaacgctgatcttctatgaatcgacacatcgtctgttggacagtttagaagatatggtggaagtgtggggcgctgatcgttatgtcgtgctggcgcgggagctgaccaaaacgtgggaatccattaagggcatgcctgtgggtgagcttttggcatggatcagagaagatgaaacccgtcgccggggagaaatggtactgattgttgaaggctatcgtaaaccggcggaagattgcctgccgccagaagccctacagacactggcactgctgcaaaaagagctgcccttgaagaaggcggcggcattggcggcggagattcatggcgtgaagaaaaatgcactgtatcgccatgcccttgagcaaatcgaagaaggtgtgtga

SEQ ID NO: 3665 - DNA, 150 bp, Xenorhabdus bovienii
  Coding DNA location: Contig name=SeqID_16892; Position on contig =79695..79844bp; Strand=-
ttgctctctgttgcactagtcgtaggttttcaccccccagacgttatctggcaccctgccctgtggagcccggactttcctcccctttacatctcccgaaggagagcggtaaagcagcgactgtctagtcaactccggcgcggattataa

SEQ ID NO: 3666 - DNA, 264 bp, Xenorhabdus bovienii
  Coding DNA location: Contig name=SeqID_16892; Position on contig =79826..80089bp; Strand=-
ttgaccgataagccgggttctgtcgtggacaatcattcatctaggccagaacttgcgcgctggctcaagcaacctacccgggttcagtacgggccgtaccatgtgaacctctatttggtcttgctccgggtggagtttaccgtgccacggactgttgccagccgcgcggtgcgctcttaccgcaccctttcacccttacctgatcccacccttatttttgcaaacaaaagtgggccatcggcggtttgctctctgttgcactag

SEQ ID NO: 3667 - DNA, 702 bp, Xenorhabdus bovienii
  Coding DNA location: Contig name=SeqID_16892; Position on contig =80190..80891bp; Strand=-
atgataataactagaacagcaaaccaatgcggtaaagccgattatggctggctaaaatcccgctatactttttcattcggacactatttcgacccaaaatttttgaactatggagcactgcgtgtccttaatcaggaagtccttgcgcctaaggctgaatttcagccaaaagcgtatccccacgtcgatattctgaatattatcctgcaaggggaagcccaataccgtgacagtgagggaactcatattcatgcacgccaaggagactgcctgctgttttccgcccgtcagggcattctctacagtgagcataatatcagcgatgaaatcccgctgacacgcctgcaactctggctcaatgcctgcccggaacaggagccacaaccgttgcaacgcacagtactgccaaaccgaccattaacattactggcctctccttcgtcagaaaacaagagcatgtacctgcgccaacaggtatgggtaagctatctggtgatcaaggccagtgatacacaaactctgcctttgcggggaaaaaatgcttacctgcaatccatccgtggcaatgcaaagatcagcggcagcaatcatgccagcgtggaaatcaaatgtggggatggggtatttattcaggaagaactgctgctaaaactgcgggcagacacaccatttcaggggctgctaatcgatttgggtggctga

SEQ ID NO: 3668 - DNA, 897 bp, Xenorhabdus bovienii
  Coding DNA location: Contig name=SeqID_16892; Position on contig =81050..81946bp; Strand=+
atgggtaaagaacgagcgcttacattggaatccctgcgcgtcatggatgcgatagaccgacggggaagttttgcggcagcggcggatgaattagggcgcgtgccttctgcattaagctataccatgcagaaattggaagatgagctggatgttgtgttgttcgatcgatcgggccatcgcacgaaatttaccaatgttggccggatgttgttggagcgggggcggttactgctcgaagcagcagataagcttacggcagatgcagaagcccttgcccgtggatgggaaactcacctgactatcgtctgtgaggcgttgtttcccgttgtatcgctgttcccccttgtggataaactggcgaaaaaatcgaatacacagttctcattaatgacggaagtgctggcaggggcttgggaacggctggaaacggggtatgctgatattgttatcgcaccagatatccatttcaggccatctgcggaaatcaattcacgcacgctttattccatcaataacgtctatgttgccagtgtggatcatcctatccaccatgaaccagaacctttgtctgatgccacgcgggtcaagtaccgtggaatagcggttgctgatacggcaagggagcgccctgtgctgacagtgaaattattggataaacaagcgcgattaactgtcagtacgctggaggacaaacgtcgtgcactgttggcgggtttgggggtagcaacgatgccatacccgatggtagagcaggacattgccgaaaaacgactacgggttattggttcggaatacagccatgaaaccaacatcatcatggcatggcggcgcgatagtatgggcgaggccaagtcgtggtgcctgcgtgaaatacccaaactgtttatgaagcaataa

SEQ ID NO: 3669 - DNA, 492 bp, Xenorhabdus bovienii
  Coding DNA location: Contig name=SeqID_16892; Position on contig =82032..82523bp; Strand=-
atgattaacaaattgtgctttttagctcatttattagtcattgaaaatataaacagacattttattatcattgccttctgtatcttggagacgttcatgaaaaaatttgaagatagtggcctgctgacggcgcgcattttaatatcagtcctgttcattatcgcaggatatgggaagctgggtgaagcttatgcggggacacagcagttcatggaggcaatgaagattccgggaattttactgccactcactatcttacttgaactgggtggtggccttgccgtactgttcggtctgctgacgcgtaccactgcagtatttacgtttattttctgtattctgacagcatttctgttccataacgatttttcagatggcatgaaccaaacgatgttcctgaaaaatatggctatcggtgcaggttatctgctactggcgatgatggggcccggaaaattcagtattgaccgcgtactgaataaaaactggtaa

SEQ ID NO: 3670 - DNA, 138 bp, Xenorhabdus bovienii
  Coding DNA location: Contig name=SeqID_16892; Position on contig =82783..82920bp; Strand=-
ttgtacaagcctgttaccgaggctactaccatcgtgtctgtcggggttgggatcatgcggctagttacccgacaaggcgcagcagtaggactgaatggggggttcgtgcatacaggagtcacttgggaaaacggataa

SEQ ID NO: 3671 - DNA, 138 bp, Xenorhabdus bovienii
  Coding DNA location: Contig name=SeqID_16892; Position on contig =82857..82994bp; Strand=-
atgaatttatttatgacgacaccatctaatgcatccttaaaaatactaattatttcatactcacgacacgtatcttgtacaagcctgttaccgaggctactaccatcgtgtctgtcggggttgggatcatgcggctag

SEQ ID NO: 3672 - DNA, 492 bp, Xenorhabdus bovienii; identical to SEQ ID NO: 1438
  Coding DNA location: Contig name=SeqID_16892; Position on contig =83020..83511bp; Strand=+

SEQ ID NO: 3673 - DNA, 354 bp, Xenorhabdus bovienii; identical to SEQ ID NO: 1741
  Coding DNA location: Contig name=SeqID_16892; Position on contig =83448..83801bp; Strand=+

SEQ ID NO: 3674 - DNA, 138 bp, Xenorhabdus bovienii
  Coding DNA location: Contig name=SeqID_16892; Position on contig =83912..84049bp; Strand=+
atggtttttttcaagactaaagattacaacctcaccaaaaggatcttaatttgtcaaacccatagacaaatcctccccattattagcaatggctatagattccaacgaatcactaaatggtgcgtttattttctatag

SEQ ID NO: 3675 - DNA, 96 bp, Xenorhabdus bovienii
  Coding DNA location: Contig name=SeqID_16892; Position on contig =84181..84276bp; Strand=-
atgcttagcaatattttatataaactcggtattcccatatactatatgcggaagttcctgctgttacatggttccatgaaatggatttataattga

SEQ ID NO: 3676 - DNA, 333 bp, Xenorhabdus bovienii
  Coding DNA location: Contig name=SeqID_16892; Position on contig =84292..84624bp; Strand=-
atgtctactgttacattttttatttttgaagatatcgtgaaaatttttaatatagatgaaatttttacattctcatggagaacatttgcaattttttcctcttatccttttcttctttatttttgcattattcctgtttattatggattttctttaaggatgccaaaaaatattaaatacctgttgttgattagtgtgtttggtttaattttgagcattcctatatcttggtatttggactataaatttaagagtttaggttattcagtctgttataaattatcatggaatgcaccaagtaaatatgtaaaagatacaaaattatgtaactaa

SEQ ID NO: 3677 - DNA, 138 bp, Xenorhabdus bovienii
  Coding DNA location: Contig name=SeqID_16892; Position on contig =84777..84914bp; Strand=-
atgcaattgattcgtcacggtcataattttagttccctttctatagaaagattgaatcgccccgtgtttaccggagggttatttgtttatgaattatgcgaccatattaagtttggcggttatatcaagtttgtctag

SEQ ID NO: 3678 - DNA, 1140 bp, Xenorhabdus bovienii
  Coding DNA location: Contig name=SeqID_16892; Position on contig =84891..86030bp; Strand=+
atgaccgtgacgaatcaattgcatgatattacagtggccgttacacgctcaaaaggcgaagattttactatagaacctgcccgtatccgcggccctcgttataatgaaattcttgtccgtatggtcgctacagggctctgtcatacagacctcatcgtgcgcgatcaatattaccctgttccactacccgcagtgctgggtcatgaaggcgctggcattgttgaagaagtcggccctcaggttaagacattaaaagtgggcgatcatgtggttcttacttatggtgcctgtggccattgtcaccattgttttgaggggcatggagcctattgcgacgatttttttgggctgaactttggtggttcggatctttctggtcaaacagcaattgaagacatgcatggccagcctttgcatgatcatttttttgcacaatcgtccttcgctacttatacgattgcaaaggagaataatgcgattaaagtgcctaagacagcaccacttgcaatgctggggccgcttggctgtggtattcaaaccggtgcgggtgcggtcatgaattcgctgaaagtcacaccgggcagtagttttgtcagctttggtgcgggtgcagtagggttaagtgctgttatggccgcacgagtagttggtgcaaccaagatcatcgcggttgatgttgtcacttcacgcctcgaactggccaaaaaacttggagcaacccatacggtcaatagtaaagaacaagatgttgttgccgcgattattgagatcactggtagcgggacagattttgcgcttgaatcaacgggacggacggatgttcttggtcaggcgattgaaactcttgccagccttggtattattggtgttgttggcgcacctaaacttggcacaaaggctgaatttgacgtgaataatctgcttttaaaagggcgcagtattcgcggcatcgtggaaggcgatagcatcccgcagatatttgtcccgcagcttattgaactttaccagcagggacgttttccatttgacgaactgattaagttttatccgctagataagatcaatgaagcggcgaaagacagcgaaatgggaaaaactttgaagccagttcttctgatctctgagattgataccttatga

SEQ ID NO: 3679 - DNA, 96 bp, Xenorhabdus bovienii
  Coding DNA location: Contig name=SeqID_16892; Position on contig =86068..86163bp; Strand=+
atgtttgcaaaaatcaaagactggaagcgcatcgcgacccggtatgaccgatgtgctcacacttttatgtctgctactcgtaatcttctggcttaa

SEQ ID NO: 3680 - DNA, 144 bp, Xenorhabdus bovienii
  Coding DNA location: Contig name=SeqID_16892; Position on contig =86207..86350bp; Strand=+
ttggttctcaaacccctacttgagagaaactatccaaatactacatcggcatataaccttgtcgttgctggctcatgcgtaagttgttcccacctatgtctattaccccctaataaatcccaagaggctaaccatacggcgtga

SEQ ID NO: 3681 - DNA, 279 bp, Xenorhabdus bovienii
  Coding DNA location: Contig name=SeqID_16892; Position on contig =86309..86587bp; Strand=-
atgaccatcatgaataagtcacagcgacagcagcgagaatggcgaaaacaacagttattactggaaatacagcagcaacggcaatcactttcagagtgtacccaacactggcttgatatcattcaggcttatgacagaggctggcagaccctgcttgccttcaagccttatgtcgccattggctcgggtatcgcactgatctatggcatatgccatcccatgaagttttatcgctggtcacgccgtatggttagcctcttgggatttattagggggtaa

SEQ ID NO: 3682 - DNA, 402 bp, Xenorhabdus bovienii
  Coding DNA location: Contig name=SeqID_16892; Position on contig =86571..86972bp; Strand=-
atgacccaaccaccccgttcacaaggccctggcaaagggatatttgatactttacagcgagtggcagcgattgttgttggcatggttgaaacccgtatccgactcatagccgttgagttggaagaaaatacggccacgctggtgcagttgctgctgctgattgggttcacgctattatttgcgacctttggcctgatgtgcctgttaatattgatattctgggtcatcgatcctgtttatcgggcaacggcaatggccattaccgcaggaattctgctgattctcgccgtgtttagtgcaatatggacgatcaggaaaaccagaaagctgacttttttcaattcaacccgtgaacagctaaaaatagatcgcaaaatgctggaggatgaccatcatgaataa

SEQ ID NO: 3683 - DNA, 306 bp, Xenorhabdus bovienii
  Coding DNA location: Contig name=SeqID_16892; Position on contig =86974..87279bp; Strand=-
atgccgcagaagaaaaactctgaagatttacgtactgaattgcaatcccttgcggatacgctggaagaagttctcaatagttccagtgacaaatccaaggctgaattggaaaaactacgcagtaaagcagaaaaaacgttgaaagatgcgcgagtcacactcagtgacgtcagcgataagttggtcgatcaaacaaaagaaattgcaggccgtacagataattacgtccgtgataatccgtggacaagtataggaatcggtgcggcagttggtgccgtgttgggtattttactggcaaaacgctga

SEQ ID NO: 3684 - DNA, 132 bp, Xenorhabdus bovienii
  Coding DNA location: Contig name=SeqID_16892; Position on contig =87475..87606bp; Strand=+
atgttttggctcgataccacagggaaaagccagcctttgtattggcaggagaaaaattttcacgacaggatattactgagggggatggttagcgcgtttcttacgccagatgaccgtcaggctgccaattaa

SEQ ID NO: 3685 - DNA, 669 bp, Xenorhabdus bovienii
  Coding DNA location: Contig name=SeqID_16892; Position on contig =87547..88215bp; Strand=-
atggaaattgtaacagacctgatttatgcactttggcaccaagattatgaaacactggctaacccatcattcgtatgggcaatctacatcctgctatttacgatcctgtttctggaaaatgggatattgcctgcggcttttttaccgggcgatagcctgttgatattagttggcgttttgatcgcaaaagatgccatgagcttccccgcgacgatattcattctcaccgccggagcaagccttggttgctgggtgggttatcttcagggacggtggcttggtaataccaagttggttcaaggctggctgtcacatcttcccactcactattaccaacgcgcacacaatctgttccaccgccacggtttatccgcactgctgatcggtcgtttccttgcctttgtcagaaccctgctgccaacactggcaggaattgccgggctgaaaaacggacgtttccagattttcaattggttaagtgggttcctgtgggtcatcatattaactactttaggttatgctcttggcaaaagtccgcttttccgtcaatacgaagaatatgtgatgaattttctcgttctgttaccactgggtttgctactcattggcttaattggcagcctgacggtcatctggcgtaagaaacgcgctaaccatccccctcagtaa

SEQ ID NO: 3686 - DNA, 168 bp, Xenorhabdus bovienii
  Coding DNA location: Contig name=SeqID_16892; Position on contig =88161..88328bp; Strand=+
gtgtttcataatcttggtgccaaagtgcataaatcaggtctgttacaatttccatcaaatgttcctaaaacgcggattaaggattacatcttacttttatggtgcatttctggtgcatttctgttgggtactttgaaaatacaaaatattaagtaccgattgtcataa

SEQ ID NO: 3687 - DNA, 111 bp, Xenorhabdus bovienii
  Coding DNA location: Contig name=SeqID_16892; Position on contig =88323..88433bp; Strand=-
atgaatgttcaattggtcaccaaaatttcctgtttcgctactgctgattttgttagagtgtccctgttagttcttatgccatcttgcaagaagctcaagggtattttatga

SEQ ID NO: 3688 - DNA, 141 bp, Xenorhabdus bovienii
  Coding DNA location: Contig name=SeqID_16892; Position on contig =88582..88722bp; Strand=+
atgacgaaaagtaacccattaataatattggagacagtacagattctcatcgttgttgttaaaatgatgattcaatataatttattgaataaaaagagtaattactgtttttttattatgcttcacaccacaccgttgtag

SEQ ID NO: 3689 - DNA, 138 bp, Xenorhabdus bovienii
  Coding DNA location: Contig name=SeqID_16892; Position on contig =88739..88876bp; Strand=+
ttgccattccgatcacacaaatgtaagcaatttgttatcaaacattgtgttgtctgtatatttcaattaattattcgttttagtttttttcatttccctattccggggaagcaaacacaaaaacaacaggctcattga

SEQ ID NO: 3690 - DNA, 1248 bp, Xenorhabdus bovienii
  Coding DNA location: Contig name=SeqID_16892; Position on contig =88903..90150bp; Strand=+
atggaaaaacaacaaaaaggctttgtgcagtatattgtacagggaagtcttgtcactcaaattattattggattaattgcagggatattattggcatggctgttaccttctgcggctcagtcggctgatttgcttggctctctcttcgtgagtgctctgaaggctgttgcccctgtgttggtgtggatattggtgatgtcctcgattgcaaaccataaaaaaggacaaaaaaccagtattcgcccgatcttgctcctttacctgattggaacattcggtgccgcggtcgtggcggttatcggcagtacgttgtttccgtcaacgctgatactggtgactaatgatgccaaaatttcaccgccagacaatatcgttgaagtcatgagggggattttgcttaacgttgttgttaatccgattgatgcaatattaaaaggcaattatgttggcattctggcatggtcaattggtttaggtattgctttacgtcatgccaaggaatcgaccaaatctttgatgcaggatctggctgaagccgtcacacagattgtgcgtgttgttattcgtctggcacccatcgggatcttcggtctggtggcttcaactattgctacaaccggcttcgaagcactgcttggctatgctcgactgctggccgttctgcttggctgtatgattatcgttgccttagtggtcaatccgctgattgtttactggacaatccgccgcaacccttatccgttggtttttgcctgcctgcgtgaaagtggtgtgacagcattctttacccgcagttctgcggctaacattcccgtcaatatggcaatgtgtcgccgcatgaatctgaatgaggatacctattcagtttctatcccattgggggcaaccatcaatatggcgggtgcagcggtgacgattacggtgctgacgctggcggcagtcaatacactggatatgacggttggcctgccaactgcgattttgctgagtgtggttgctgtgattggtgcgtgtggatcatcgggagtggcgggtggctctttgctgttgatcccactggcgtgcagcatattcggtatttccaatgaaatcgccatgcaagttgttgcggtcggtttcattatcggtgtgttgcaggattctgctgaaactggcctgaattcttccactgacgtgttgtttaccgctgcggcttgtcaggcagaagatgcccgccttaatgcggatcagttatcccagcgtcgttaa

SEQ ID NO: 3691 - DNA, 2022 bp, Xenorhabdus bovienii
  Coding DNA location: Contig name=SeqID_16892; Position on contig =90234..92255bp; Strand=-
atgagcaattaccctcacctgctggccccgttggatttgggctttaccaccctgaaaaatcgtgttttgatggggtcaatgcatacagggcttgaagaacatcccgatggtgcccgacgactggcacagttctatgcagaacgggcggctggcggtgtagcattgattgtaaccggcggcatcgccccaaacgaacagggagttgttacagccggtgcaagtattctgaataatgaagataccctgcctcatcatcaagtcatcacggatgccgtacatcaggcgggcgggaagatagccctgcaaatcctgcataccggacgttacagctaccagaaaaatcttgtcgctccttctgccattcaagcaccaattaatccttttaagccccgtgaaatgtctgaggaagatatccagcagacgatcagggatttcgcacgttgcgcccaactcgcccaacaggccggatatgatggtgtcgaaatcatgggttcagagggctatctcatcaatcagtttctggtcgcccgcactaatcaccgacaggataagtgggggggaaacttcgaaaatcgtatgcgttttgccgtggaaattgttaaagctgcccgcgccatcacaggagagcactttattattatctatcgtctctccatgctggatttagtggaagaaggctctgactggcaagagatcgaacaactggcgaaggaaattgaaaaagctggcgcttccatcatcaataccggcatcggctggcatgaagcgcgcattccaaccatcgcaacaatggtgccgagagccggctttagttgggtaactcaaaaattgatgggaaaagtcagcattcctttgattaccaccaatcgtatcaatgatccccatgtagctgaacagacactgagtgaaggctgtgccgatatggtttccatggcgcgccctttcctcgctgacgctgaatttgttttaaaagccgagcaaaaccgcgctgacgaaatcaacacgtgtattggctgcaaccaagcctgcctggacagaatatttgtcgggaagttgacgtcgtgtctggtcaatccacgcgcctgccatgaaactgaattcattgcagagccagtgaaagcgcctaaaaccatcgcagtgattggcgccggccctgcggggttgtcctttgctgtcactgctgccagccaagggcatcatgtcacgctatttgaacgtgacaataagattggtgggcaatttaatatcgccaaacagatccccggcaaagaagaattctacgaaacgctgcgctattttgatcgccaattggcattgaacggtgttgaggtaaagctcaaccataccgcaacagccagtcagcttgcgtcgtttgatgagatcatcattgccacgggcatcatcccacggacgccagatattgatggcatcaaccatgaaaaagtgctgacttaccttgatgtactgaaacataaacgcaatgtagggccacgtgtcgccattatcggtgcagggggtattggcttcgatacggcagagtacctgagccacaatggacaaagcagcagcctgagtagccacgcgtttagccaagagtggggcatcgatcaaacactttcccatcgtggtggattacagccagaaggcgcacaaatggaacgctccccacgaaaaatttatctgctgcaacgtaaggattcgaaagtcggcgaaggtctgggaaaaacaaccgggtgggttcaccgcgccagcctgttgatgcggggcatcacgatgctgaacagcgtacagtacctgaagattgatgatcaggggctgcatatcagtcgcaacggtgaacaacaatgtctcgaagtggacaatgtgattatctgcgcagggcaggagccattgaaagatctttatcaaccactgcaaacgatggggaaaaatgtgcatgtgattggcggtgccgacgtcgcggtagagctggatgcccgcagagcaattgatcagggagccagattggcgtttaagatttaa

SEQ ID NO: 3692 - DNA, 261 bp, Xenorhabdus bovienii
  Coding DNA location: Contig name=SeqID_16892; Position on contig =92479..92739bp; Strand=+
atgccgatgatatttgaatctttcatggagtatgcgtttgaacaacttagcggtgttgccgtggaatttcgtacccattttctgaatcaccagagccgcagagctatcgagcgtctgggggcaaaacgggatggtattctgcgcagtcacttgcgtgcaagggatggctcaataagagacacttgtgtatacagcatgcttgccagcgagtggcctgccattaaaattcatcttttatggctaatggcaaagccacgctaa

SEQ ID NO: 3693 - DNA, 936 bp, Xenorhabdus bovienii
  Coding DNA location: Contig name=SeqID_16892; Position on contig =92772..93707bp; Strand=-
atgaattatctacaacaacctgcttcttcaggtatgaagctgtttgctgatcttgtcggaaagcgtgttacccccggtgaatactggcattcttccagttatcgaactaaattcgctctgcgcagcatttttacgcctatttctacacttaagcttttgaataaaattgctaagaccccgctttataatgatattttaaaaaagcaacccagtttgccctgcaaattgcatcgcccatatttgagcatcaatttcaagcgtaaacagattgtttgtgcacttaatgaacattaccagatattatttgaacaattagagccggctattatcaacaaaatatttgatactcatgcttatttgctggcaacggttcagggtaaaaatgaatcattcatgatatatattgattcattggataatctgaataaagaaggtgagctttcgttatatattaccacagcagaaaatgtcgttctggcgaaatgcgcattcactttattgacgattaagggtaagcaaacattattcattggtgtattgcaaggcccggctaaaatggataattctctggatattatccgccatgccaccaaagaatgttatggattatttcctaagcgtttgttgattgaagctatctgccgttttgcctctcatgcaaattgtgagcagatcttggcggtcagcaacgagacacatatttatcgcagtatccgctattggcataaaaagaaagataagatggtggccgattataacgccttctgggaatccctgaatggtatcaggaaggaaaataatgatttccatctgccatcagccatagaaaggaaatccctggaagagatcgccagcaagaaacgcgccgaatatcgccgccgttaccaactactggacgagcttgataaccatatcaaagtagcccttactgattaa

SEQ ID NO: 3694 - DNA, 435 bp, Xenorhabdus bovienii
  Coding DNA location: Contig name=SeqID_16892; Position on contig =94098..94532bp; Strand=-
atgtatataaagcaagccaccgaaacggatttcgcgattcttatccagatttgggaagcctctgtgcgtgctacccatgattttctgcctgaaactataattgaagagctacgtccccttatcttgaatgattacttacccaatttaatcatctataaggctgtaaatgaccaacatatcatcgaaggatttgtggcagtcgatcaacagcgagtagaaatgctatttatttcaccacaggcacgaggtaaagggatcggcaagatgctgctggcgtttgcaatgactgaattgcagatcaacgaactggatgtgaacgaacagaatgaacaaggtgttggcttctataagcatatggggtttcaggtttttgctcgctcagaagtcgatgggcaagggaatccatttccactattgcacatgaaactcgcgtaa

SEQ ID NO: 3695 - DNA, 183 bp, Xenorhabdus bovienii
  Coding DNA location: Contig name=SeqID_16892; Position on contig =94455..94637bp; Strand=+
atgggtagcacgcacagaggcttcccaaatctggataagaatcgcgaaatccgtttcggtggcttgctttatatacatcaattatctccgcatatttcacagttattcgatgtcagattgtgtgttttcacggctatcctagaattaaaaatgattcagtacaatcgatttaacagaaagtaa

SEQ ID NO: 3696 - DNA, 387 bp, Xenorhabdus bovienii
  Coding DNA location: Contig name=SeqID_16892; Position on contig =94717..95103bp; Strand=-
ttgacggcggggcaagcccacgaaagtcgatccgccatccctttgctcgacggcattggtatacagcgcaaaaatggtttcatgaaacggcgcggcaaagcggtgctggcagataaaggctattcgggcggaaaactccgcggttatctgcgtaagttgcggataaagagcattattccgtataaaatcaatgaaaaaggcagtactgatggtcgcacacaatttgatgagcaggcttatcgtgaccgtaatgttgtcgaacgttgtttcggttttcttaaaggaaatcggcgtatcgcaacccgttacgaaaaaaccgctcgaaactatttgtccagggtgaaattaggctgtattcgactcttttacaggcggttatctaattaa

SEQ ID NO: 3697 - DNA, 459 bp, Xenorhabdus bovienii; identical to SEQ ID NO: 2969
  Coding DNA location: Contig name=SeqID_16892; Position on contig =95100..95558bp; Strand=-

SEQ ID NO: 3698 - DNA, 1152 bp, Xenorhabdus bovienii
  Coding DNA location: Contig name=SeqID_16892; Position on contig =95625..96776bp; Strand=-
gtgaaactgctgcgcaacaatgacagtgcatttgtacctgtcgcaggcttgacggtatttgcgattgcttctggttacttaatgagtttaattcctttatcgatggcaagtttcagcatcgatacgagttatgccagctggttggccagtgcttattacgtgggtttattaataggctcaattatgattgaacctgttattgccaaaataggccaccgcttttcatttattagttttttgctgcttttagccgcgacggttgtagtcttgcctttttttccgaataaagagagctggttggttattcgctgcgtggcggggatcgccgttgcagggatttttgtcgtggtagagtcttggttgttgatgggtgatagccccaaagagagagccaagcggctgagtttttacatgacttcactttatggcggtacaacactgggtcaactggctattggctttatagggactcagggtatagtgcctttcatggtggtgctggctctgctattgttggccaccttgccgccattacttataagtcaagggcaacctcccgctcttcatcatcagagcttatcgctgaaaaaaattgtccaattcagcaagccagcgatagtcggttgtatcacgtcaggggttgtcatgggtacgatttacggcctgatgcctttatcattaagccaaagccacttcgatggtgaacaagtcggcgtattaatggccgcgactattttaggcggaatggtgattcagcccattgtcagtaaactgtctgtcataatgagcaaaacgttgttactggcaatggtttcactactcggtgtatttgcgatgggaatgacctacctttctgaaaattatattgtgatgatcgtggccttggggcttctggggatgtcctcttttgcactctatccgatcgccatcacgcttgcctgcgataaactggattcatcttgtattgtggctacaactcaagtgatgctgttaagttacagtatcggctccgccattggccccctgagcgcagggaattttatgttgcaacacaatggattaatgaatttctttttcattgtcttactggccgcggctatttatatgctactggcgagcctgcgccgtaaagaccatatcttggcaaactag

SEQ ID NO: 3699 - DNA, 105 bp, Xenorhabdus bovienii
  Coding DNA location: Contig name=SeqID_16892; Position on contig =96746..96850bp; Strand=+
atgcactgtcattgttgcgcagcagtttcactactgtcgtctccacataaaaaaatcagctggatatgcgctgcttctcatcaagattttgctgaatggcggtaa

SEQ ID NO: 3700 - DNA, 225 bp, Xenorhabdus bovienii
  Coding DNA location: Contig name=SeqID_16892; Position on contig =96887..97111bp; Strand=-
atgtttattaatggctttagttgtaggctaaagccattaaatatacgtttgtattcccgcttaaaaaattcgtattcgcttagcccaacattgattggtgatttcctacactctttcatgaatcttttcattcatgagtatcagtttttctcattgtatctctcaggagtaaagggctatagtccgcagcgctcaaggtccttgagcgacttacctactgcttaa

SEQ ID NO: 3701 - DNA, 1230 bp, Xenorhabdus bovienii
  Coding DNA location: Contig name=SeqID_16892; Position on contig =97111..98340bp; Strand=-
atgacacgcagggtagtcattaccggcatgggcggaattacggctttggggcacaactggcaatccgtgtcttccggcctgaaagcggggaaaaacgcggttcagcacatgtcagcgtggtctgagtatgatggcctgaatacgctgctcggcgcgcctgtcaccgatttttcattgccagatcactatacccgcaagcgcatccgctctatggggcgagtgtcacttatgtcaacacgtgccactgaatcggctcttgagagggctggcctgttggataatccgatattgacccatggtgaaaccggcattgcctatggttcctccacgggcagtaccaagcccgtcagcgaatttgccactatgctgactgaaaagcatacgcacaacatcacgggcacaacctatgtccaaatgatgccacacacgacagccgtcaatacggggctgttcttcgggctgcgcggcagggtgatcccaacctcaagtgcctgtacgtctggtagtcaggccattggttatgcatgggaagccatccgtcatggctaccagaccgtgatggtggccggaggagcagaagagttgtgtccatctgaagcggctgtatttgatacgctgtttgccaccagccagaaaaatgatgcccccaaaacaaccccatcgccgtttgatactcaccgtgatggtctggtgattggtgaaggcgcaggaacattgatcctggaagaactggaacatgccaaagcgcgcggggcaaaaatttacggtgaaattatcggttttgctaccaactgcgatgcttcccacattacgcaaccgaaatcggaaaccatgcagctatgtatggaaatggccctgaaatcggctgggcggcagtcgtcagatatcggctacatcagcgcacatggtacagcaaccgatcggggtgatgttgcggaaagtcaggcgactgccaatgttttcggccgcaatacgcctatttcttcactgaaaagctatttcggccatacattgggcgcttgtggggcactggaagcctggttgagccttgagatgatgaatgaaggctggttcgcgccaaccatcaatctcaatgaaatcgatcccgcctgtggcgaattagattacatcatgcaccaatcccgtgagatccagacagaatttatccaaagcaataactttgccttcggtgggattaatacctcgattgtgttccgacgctggccttaa

SEQ ID NO: 3702 - DNA, 729 bp, Xenorhabdus bovienii
  Coding DNA location: Contig name=SeqID_16892; Position on contig =98337..99065bp; Strand=-
atgcgttcagttctagtgaccggtgccagcaaggggatcggcagggcgattgcctgtaagctggcatcagacgggtttactgtcgtcgttcattatcaccgtgatgccgcaggtgcagcaaaaacactggaacagattcaggcaaatgggggcaatggccgcaccttgggttttgatatttcagatcgcaccaccagccgcgaattgctggagcaagatatcgaaatgcacggtgcttactacggcatcatctgtaatgcgggaattgccaaagatggtgcgttccctgccttggaaggcagtgattgggatagtgttatccataccaatctggatggtttctacaatgttattcatccttgcgtaatgccaatgattggtctgcgtcaaggggggcgtatcatcacattgtcttccgtttccggcttgatgggaaaccgtggacaagtcaattacagtgcagccaaggcggggattatcggtgccaccaaagcgcttgccattgaactggcaaaacgaaaaatcaccgtaaactgcattgctccgggtctgattgacacggacatgatccaaatggaagaacccgcgctgaaagaagccatgaacataatcccgatgaaacgtatgggacacgttgacgaagttgccggccttgccagctatctaatgtcagacatagcaagctatgtcacccgtcaggtaatctcagtcaacggaggtatgctatga

SEQ ID NO: 3703 - DNA, 477 bp, Xenorhabdus bovienii
  Coding DNA location: Contig name=SeqID_16892; Position on contig =99065..99541bp; Strand=-
atgtctgactatttatcggtcgatcgttacattcctcacgaagcgcccatgatattgctggaaaatgttatcagcgtttccagcgacagtgttcattgtcaggtcaccgtcagcaaaaacagcgtcctgtcaccctttctcaatgcagaaggtcatctgccgggatggtttgccattgaaatcatggcacaaactatcggcgtctggtctggctggcatcgccatgcaaagaaagaagaagactcagctttgggcatgttgctgggtggccgtgctatacgttgcctgacgccctttttcgcgaatggtcaagtgttggacattcacatgaatttattactgcaagatgaaaaattcggcagttttgaaggtgacatcagtggtaatggtgaaattctggcgacaggacgcctgaacacctatcaacctgaccaaacagaacttaaaaaattatttcaacaggatggagtagcataa

SEQ ID NO: 3704 - DNA, 1170 bp, Xenorhabdus bovienii
  Coding DNA location: Contig name=SeqID_16892; Position on contig =99541..100710bp; Strand=-
atgatttatattgctgccgtgggtatgctcaatgccttgggtaataatgcagacgacattgcccagaatctggtgctcggaaaatcgcccgggatgtatgcgcggtcggactggttgcaacccgatgaaagctgctttctgggcgggattgaggaagtcgaattgccgatcattcctgaaccgttgttcatgcacaatagccgcaacaatcagttactgctggcggccctgatgcagataaaacctcaggtagagacggccattgctttccacgggcgggatcgcattgccgttatcatgggaacgagtacgtctggccttgatgaaggtgacaagcacgtcagccgtggaatcaaacaactgcctgatgcaaattatcactattaccagcaggaactgggtgatccttcccgtttccttgccagctaccttaatattgaaggccctgctttcaccatttctacggcctgttcatccagctctcgcgccattatcagtggtcagcgactgattgaaatgggcttggtagatgttgccattgtggggggcgccgacacactcagccgtatgccaatcaatggcttcaatagcctcgaatcactttcccgtacccagtgtgcgccattttgtgaaaaccgtcagggcattaccatcggagaagcctcaacgctgctgttgttgaccaaagcgcctcagcccgttgccctgctcggtgtgggagaatccagtgatgcatggcatatgtccgcaccacatcccgaagggaaaggagccattgatgccatcaacatggcattgaataatgccaaactatccccgcaggacatcggttacatcaacctgcatggcacaggaacaacattgaacgaccagatggaatcactggtgattaaccagcttttcggtgaaaacacgccatgcagctcgaccaaacatctaaccggtcatactttgggagccgcgggtgcctgtgaagcggcgctttgctggatcttgctgactcgtgagttacctctgccagcacaggatttttcccgctcagagagagataaatcactgccagcctgcggcctgttgagtcagccacaagcattggcaaaacccatcgtgatgtccaattccttcgcctttggcggaaacaataccagcctgatactgggagccgcataa

SEQ ID NO: 3705 - DNA, 564 bp, Xenorhabdus bovienii
  Coding DNA location: Contig name=SeqID_16892; Position on contig =100714..101277bp; Strand=-
atgattcggttattcatcctgtcactagtttgtctgctggcagcctgctctaacttcccccagaacggctcgcccagtgcatggttgaaaccgggagtccgtgtgtctctgcccgcgccggctatcacgcctgccattcatgaacaacagttgctgaccgcaacagtgaaagggaaagcgcagtcgttgattgtgctgctcaatgccgatgaacaaaaactctctctggccggattatcctcactgggtatccgcctgtttaagctggattacgaccgtaatggcattcacgccgagcaatccatcgttgtaccggagatcccacccgcgaatcaggttttagccgatatcatgctcagttactggccgatttcgtcttggcaaccgaaactgcctactggctggacactaagcgataccgtcaatcgccgccagttgaaggataaccacgggcaagtgatcacagaaattcattacgatactcaaaacgagcaacgacgcccgatccgtgtccaacaatttatttttggttatgaaatcgccattcagcatctggaagagtaa

SEQ ID NO: 3706 - DNA, 2325 bp, Xenorhabdus bovienii
  Coding DNA location: Contig name=SeqID_16892; Position on contig =101274..103598bp; Strand=-
atgacgaagaacaacacttcaaattctgaaccacgcctactaccgatattctggttgctgatatgcggtatcctgctggtgtcgctggtcgtgctcttgccgcaatcaaggctatcgaccagtgtactggcattattaccggcacaaagtgcgggagatatgccacccgcattgaaagatgagtttatgcaacgcctcgatcgccaattggtatggatggtcagcccgggacaaaaagaggatgcagctccggctcaattctggctggaacagttacaaaaagcgccttttctggcggcggtcaaaggaccaatggctcaagaccaacaacaggcatgggggcgtttttactatgagcatcgcaatgccatgcttgatcctgctacgcgtgacaggctgcaagaaaacggcaaccgtcaggctgactggatattgtctcaagtctattccgcattttcaggcgtcagtgggcaagagctaaacaatgatcccttgatgctggtgagaggctcacaattggcactccagcaaacctccagccggctgcgactccaaaacggctggctggtcgccaaagatgaaacgggaagaaactggtatctgctgcatggagaactcaaaagctcctctttcgatatgcagcaggggcatgatgcagtgattgaactggctgagttgcagcaatccctaaagaacgttttccctgatgccgaagttatttcacggggaacgctgttttacagcgattatgctagccagcaggcgaagcatgacatttcaacgctaggcagtgcgactgtactcggcgtactgttgttgatttatggcgttttccgctctctgaaaccgttgctgctgtgcgttctgtccgtcagcataggcgctttggccggaaccgtgctgacattggccatattcggtgaactgcattttatgacgctggtgatgagtatcagcattatcggcatttctgctgactatgcgatttattacctgaccgagcggatggttcatggacaggaaacaacgccgtggcaaagtatgcagaaagtcttgcctgctttactgatggcactggcaacggcggtcattgcttacctgatcatgatgttcgcccctttccccggtttacgccaactggccgtgttcgctgccgcgggtttaaccgcctcttgcctgaccgttgtctgctggtatcccagactgaccaaaaatctgccagtacgcccgatccccgccatgatcacacttatgcgctggctggcattgtggcgacgccaacgcctgttttacatcggattacctgtttttctggcacttttcgccctgctgggaatttcccgcttacaggtgaatgatgacattgctcagttacaggcgctaccacaggatattcatcaacaggaaaaacgtatcgcagaactgaccagacagagaagtgatcaaaaatggttcgtgatctacggcgagagtgcagaacaaacattacagcgcctcgaatcattcattcccaaactggatgccgaaaaacagcatggcacgttcaagaattaccagcgcctgccattgtcttcccttgcacagcaacaacgggatctggcgcttatccaaacagccacgcccaatatcatggcacgcctgacagatacaggcctgccggcgaaacaacccgacctccatccgatgaccgtcacccctgacgaatggcaaaacagtatcattagcgaaggctggcgtctgatgtggacaacgctgccagacggccaaagtggggtattgctgcctgtgaatggcgttaaggacagtgtgcggatgcgtcaattggctgaacaacagaacggtgtcagttgggtagaccgtaaactggcattcgatgagatgtttcagttttatcgcaccatgcttggctggctgctggcaggttcagtgatcattatcacggtaagttatatcatgcggcttggcctgcgacgtggcctgatcagtgtgttgccgtcattgctgtctctcggatgtgggctggctacccttggcttcagtggtcatagcattaacctcttctccatcctcgcgttggtactagtacttggcattggtatcaactatacgctgtttttcagcaatcctcgtggcacaccactgacttcactattagccattagcgtagctatgtgcacttcgctactcacactgggcatgctggtattcagcagcactcaggcaatcagtagctttggcattgtgttatgcagcgggatattcacggcctttctgctgtcaccgttggcgatgcctgaacggcaaaaaaggaataaaaaatcatga

SEQ ID NO: 3707 - DNA, 600 bp, Xenorhabdus bovienii
  Coding DNA location: Contig name=SeqID_16892; Position on contig =103570..104169bp; Strand=-
ttgctggcagccaatttattcaatttagcccataacgtggcacaggccaccacccttgacgagttgcaacaacgttttgcaaaccaacctgtggttcgagctaaattcacgcaagagcgccagattgacggcatgcctcaacctctgcactccagtggtgaaatgctggtttcaccacataaagggctatggtggcaccagcaaaaaccgtttcctctgacgatgctgctggacgatagccgaatggtgcaggttatgccggggcaagcaccacaagtcatcaccgctgaatccaatccacagatgtttcagtttaatcacttgatgcgagcactgtttcaagctgaccgtgctgtgcttgaagaaaactttaaaactgacttcaaagatctgggacaggaaaaatggcaattgatactgacccccaaaacctcgccgttggacaaactgtttaccaccattacgctgcaaggtcaggcaaatctggattccattctgctgactgatcgccaaggcgatcgcaccgaactgttttttacccaacaccgactgacgccgaagacactgagtcatgacgaagaacaacacttcaaattctga

SEQ ID NO: 3708 - DNA, 423 bp, Xenorhabdus bovienii
  Coding DNA location: Contig name=SeqID_16892; Position on contig =104193..104615bp; Strand=-
atgctaacagatccccgttttaccgctgaagtcgaattaaccgtgccattccatgattctgatcccatgggggtcgtatggcacggcaattatttccgctattttgaaattgctcgtgaagcactactgaaccaattcaattacggctatcgccagatgcgtgaatcaggttatgtctggccaatcgtagacacccgcgttaaatatcgagagtctctgcaatttgaacagaaaattcgggtcagagcgactattgaggaatttgagaaccgcctgaaaattgcgtatcacatttttgatgcagtaagcggcaggaaaaccacaaccggttacaccattcaagtggcggtagaggaaaatacccagaaaatgggttttgtcagcccagatatcttatttgaacgcatgggagtcagaccttga

SEQ ID NO: 3709 - DNA, 1716 bp, Xenorhabdus bovienii
  Coding DNA location: Contig name=SeqID_16892; Position on contig =104618..106333bp; Strand=-
atgtcgttaaatgcacacgccattacgccatgcgtgatcattccctgttataaccacggcagcacaatgcccaccgtgctggcaaggcttgcccctttcaagctccactgttttattgtggatgatggcagtgccgccgacacccggcacagtcttgaagcattagtaaaaacgacaccagatgtgaccctaatccgccttgagcgcaatcagggcaagggcggcgcggtgatggcaggtctaaaggccgcagcaaatgcaggatatagccatgccttacagcttgatgccgatgggcaacattgcatcgaagatatccccaagtttctggataaagcccagcagcatccagccagcctgatttccggcagcccgatgtatgatgcctctgtgccaaaatcccggctttacgggcgctacatgacccatttctgggtctgggtggaaaccctttctttctcaataaaagacagcatgtgtggctttcgtgtttatcccttagcccccacgctgcaattattgtcccaaaaagagattggccgccggatggattttgatatcgaaatcatggttcggctctactggcaagggacggaaagtgaatttgtgccgaccaaagtcacctatcccgcaaatggtctgtcccacttcgatgccttgcgcgataacctcagcatttcttggatgcatacccggctattttttggcatgttaccgcgcattccttccttgttatggcgtaaccgccgccattggtcggacattcaggaacgtaaggggctgcatggcatgaagttcatgctggccgtgtaccggcttctgggacgacgcccctttgagtggctactctatcccgtcgtcggttatttctgggcgacaggtggcgcgcagcgtcaggcatcaagacagtatcttgaacggctgaaacagaccttacatcaccagaagatcccccttccccacggccttaacagttatcgccactacctgcgttttggtgtcgccatgctggataagattgcaagttggcgtggcgatttgaaatggggcaaagatgtcgaatttgccgaaggttcagaagcggtactcctgaatgggaacacggacggtaaactgcttttggtttcacatctgggagatattgaagtctgccgcgccttagcacaacatgctggcaagcaaaccattaatgcgctggtgtttactgaacatgcccagcgttttaagcagattattgaagaagtttcccctcaggcaggcattaatttattgcctgtcaccgatgtcggggcagataccgctattatgctgaaagagaaaattgatgcgggtgaatgggtggcgattgtcggtgatcgcgttgccatcaatccctcccgtacccatacaccgcgtgtggtatggagccagtttcttgggcatccggccccttttccacaagggccatttatccttgcatcggttttgcgctgcccggtgctgctcatgtttgcccttcgccaaaacgatcagttcgaaaacagtcagctaaaaattcattgcgaacctttcgccgatccgctgaaacttccccgtaaccaaagagagcaggcattacagcaggcagtggatcactatgcctcccgcctggaacattacgccctgcaatctccactggattggtttaatttttttgatttttggcaactgcccgccgatatgaagggtaaggaataa

SEQ ID NO: 3710 - DNA, 405 bp, Xenorhabdus bovienii
  Coding DNA location: Contig name=SeqID_16892; Position on contig =106324..106728bp; Strand=-
atgcccaaagcaagcgctcatggcctgcattacaggagctatttaatgaagcccgttgaaatttaccgtgagcaacccgctccgaatgaggccattgtacacctctatttagatccggccctggattggttccgtgggcattttcctattcagccgatcttgccgggcgtcgctcaaatcgattgggttatgcattatgcccaaaccctgctggctccgggttggtctttttcttcgattgagatggtgaaattccaactgcccctgcaaccggggaatcgactgcaattgaacatgatatggactgaagaaaaaaaccttctgatcttccattatggcgtggaaaatccgaacagcggtgaacttcatccagccagccaagggaaaatcaagctatgtcgttaa

SEQ ID NO: 3711 - DNA, 1386 bp, Xenorhabdus bovienii
  Coding DNA location: Contig name=SeqID_16892; Position on contig =106670..108055bp; Strand=-
atggctggtacgccaacaggtgaaaaaacgatgaaaacacacgccatatcgcaatggctatcgagggatgattgccctgatagccctatcagctggcaaggcaacgacagcattactctgcgcactctccgtcatgatgtcatggcactctacctgcgtatggcagaaaacacagcgacccgctgggcactgtgttttgaagacagctaccatttttgtgtcggcctgctggcaacactgcatgctggcaagatccccgtgatcccggggcattgccgtgaggcacagctacaagagcaacaatcgctgtttgatggtgtattgactgatttgcccctgaccttatcatgcccttgctggcagctattcccgaatgaagggaagattgatttacctgaaaccgtactgcccggaatcgcgcccgatgcggttttagtactgtttacttctggctcaacaggtgttcccaaacagataatcaaatccgtgtcagtcatggatcaagaaactcaatggctggcttccctgtggggaaaaatactgcaatcctgtctcatcagagcctcggtcagccaccagcatttatatgggctgactttccgcatctggctccccatgtcacttggcctgccatttgagcgcacgatggtggaatttcctgaacaactgaccaacaatccacgctgtgccttgatcagtagcccggcatttcttcagcaattggatcaaaatctccctgccccagattgctcttttgtcgtttcagcaggaggccctttgcatttttcggatgcagagcaggtcatgcagtggttgaacattactccccatgaaatttacggctgtaccgaaacggggattatggcttggcgcgcacgcaaaacggatgataccgtttggacgacattttctggcgtttcctttgaaaaagaggatgagatgggaatgcgtgtctattctcccctgctctctgatcctgatggcatggcgttggatgatcggctctcctttgatgcccaaggtaatttcaccttaatggggcgtcgggaccgaacagtaaaaatcggtgaaaaacgcatttccctatccgacattgagcgtcgattacgtgaaatggatgggatcgcggataccgccgtattgaccgtcaaacgcggtaaacgttgtcacattggggcagttgtagttttggatgatgaaacctatgcccattaccagcaacaggggatcacacggttttcccgatattggcgcagacaattaaaactttggctggagccggttgcattaccccgttactggcgggtggttaaaaccattcccctgaatgcccaaagcaagcgctcatggcctgcattacaggagctatttaatgaagcccgttga

SEQ ID NO: 3712 - DNA, 504 bp, Xenorhabdus bovienii
  Coding DNA location: Contig name=SeqID_16892; Position on contig =108022..108525bp; Strand=-
atgatcagctacgggcagtttcatgccatgctggtggtcatcattctattttttgtcctgcgcttgctgttgatccgggcatcttcccacaatcaatcgccaaccggatgggatactggctggatcttatccattgccggaattatcttgggattagccagtttctttctacgcagccaccaactgttgatgtattaccctgtggtggtaaatagtgttttgctcaccttattcggcagttcactgcgttatggccctccggttgtggaaaggatggcgcgtctgaaagaagcggatttaccgcctgaaggggttgcttacacacgtaaagtaacccaaatctggtgtctgtttttcattttcaacggcacggtcgcgctgggtacttgcttgtacaacgatatgaagctgtgggcattgtggaacggcatggtgagttatctattaattggcctgcttatcgccattgaatggctggtacgccaacaggtgaaaaaacgatga

SEQ ID NO: 3713 - DNA, 135 bp, Xenorhabdus bovienii
  Coding DNA location: Contig name=SeqID_16892; Position on contig =108572..108706bp; Strand=+
atgcggaacaataaaatcaaacgattcaatgaacgacctcagggcttgctgtttgttttgactatgatgattattgttcgttcagtaattgctcaacggcctcaacaacatcctgtacagtgcgtacggatttga

SEQ ID NO: 3714 - DNA, 249 bp, Xenorhabdus bovienii
  Coding DNA location: Contig name=SeqID_16892; Position on contig =108642..108890bp; Strand=-
atggaaaaacaacaaatttttcaagaagtctcacaacttctggtcaaactgtttgaactctcccctgagcagatcacgcctgatgcccgtctctatgaggatctggaactcgatagcattgatgccgttgatatggtcgttcacttgcaaaagaaaacaggtaaaaaaatcaaacctgaatcgttcaaatccgtacgcactgtacaggatgttgttgaggccgttgagcaattactgaacgaacaataa

SEQ ID NO: 3715 - DNA, 258 bp, Xenorhabdus bovienii
  Coding DNA location: Contig name=SeqID_16892; Position on contig =108905..109162bp; Strand=-
atgcaagaattacaaactgaaataaaagaaatcattatagataccttgaatctggaagatatcactccagccgatattgaaaccgaagcacccctgtttggggagggtctggggttggattccattgatgcgctggaactgggtttagccatcaaaaatcgctatggcatcgtcttatccgctgaaagtgaagaagtacgccagcactttcattccgtcgctacactggcagcctatattcagttacagcaagcataa

SEQ ID NO: 3716 - DNA, 795 bp, Xenorhabdus bovienii
  Coding DNA location: Contig name=SeqID_16892; Position on contig =109178..109972bp; Strand=-
atggagcagaaaacggcaattaacatgattgaacgcattaattgggtttggcgcctgactatgacaggggtttgttttgccttgtttggtatcggcggcttattactttcgctcatctggtttaatttgttactggtttttcaacgcaatgccgataaacgctgccgcctggcgcggcacagcatttctgcctgttttcggctgtttttttttctgacaagaaaagtaggcgtgctcgattatcatttcgatggcattgaaaaaattcgcacggataaaggctgcctgattgtcgctaatcacccaacattgctggattatgtccttctggcatcaaccttaccggatgtggattgcatcgtgaaatctgcgctgttgcgcaatccttttgtcagtggtgtgatccggtctgcaaattacctcattaatagcgaagcagagagtttactgcccatatgccgtgaacgtttaactgcgggtcataatattttgatttttccggaaggaacccgcacaattcctgaccatcccatcacactccaacgtggcgctgctaatattgccgtacggtgtggatgtgatttacggatcgttcatatcatatgcagccagaaaatgctggataaaaaaagtaagtggtatcaaattccaccgaaaaaacccatttacaccatcaccgtcggtgaacagctcactcatgaaaattttgctgtcgatgctgagagcgggcaagccgtcgccgctcgtcaacttaatcgtcagttgacccatttattaaccccctcaaatcactag

SEQ ID NO: 3717 - DNA, 720 bp, Xenorhabdus bovienii
  Coding DNA location: Contig name=SeqID_16892; Position on contig =109974..110693bp; Strand=-
atgaagttgacattggatattacagattggcaagctattgcgccggggctttctactccagaggagtggaaagattggtctattggctcacccgcaacgattgatggctcacgttcattggcaaaatgtacacaattacccatgatgacagcccgccgcctgagttctggcagccgtcttgccgtggattgtggtctcagtattctgcgccgaaatgaagtagacgcggtcgtctataccagccgtcatggtgaattggagcgtaattatcagatcttggtgaatctggcacaggaagaatgtgtttctccaaccaattttgccatgtcagttcataattcttcggttggcaatttaaccattgtcgccaaagcacctttggtctcttcttctatttcagcaggcgtcgatagctttcaacaaggactgctagaagtgctgacgttgttccatgcgggttatggcaaagtgctgctcgtcgattttgatggctatctccccagtttttatcacgatgtgataggtgcgaagacacccacttatccgtttgcggttgctttgcttctgcaacaggggaaaagtctgcattgcgaaaaacagccttcatcgaatactgaacccgagcttccccagagcctccagtttctccacggttggttgagtcacacacagggatttaccgttaccggggatcactgccaatggcaatggaatcgctga

SEQ ID NO: 3718 - DNA, 1074 bp, Xenorhabdus bovienii
  Coding DNA location: Contig name=SeqID_16892; Position on contig =110707..111780bp; Strand=-
atgacccaaccccataactatgacaaagatgaatgcagtgcacttgaagcgattactgaagctcaacgtattgcttttgctcctatgctgtttcagacagccgtcaacctgcgcgatttcggtattttatcttttttggataaaaatcataaacaaggggcaactaaagacgaaatctgtaacgattcagaattagatagctatggtgtgggtattttgctggatatgggattaagtggcagaattattcttaagcgcgatgagcgctatttcctaagcaaaattggtcactatttattgcatgacaaaatgactcgcgtcaatatggacttcacccaagacgtctgttaccaaggcctgtttcacctgaaagaatcactgcaaaaaaataagccggctggtttgaaagtatttggtgagtggccaacgatttaccctgcactcagtcaattgccagagcctgccaaaacaagctggttctcatttgatcatttttattctgattccgctttcaatgcggctttaaaaactattttcgctctgaatcccaaattgatttatgacgttgggggaaatacaggaaaatgggcattgcgttgttgccaatatgacagtagagtcagcatcactattctagatttaccccagcaaattgaattggctgaaaaaaatatactcagccaaggtatggccgaccgtatttccggctatcctgtcaatatgttatcagattgtgaactccccaaagaggcggatatctggtggatgagccagttccttgactgcttttctgaaactcagattattggcattctacgcaaaatttcagcggcaatgaaaccagatgcccgggtttgcatcatggaattattctgggattgtcagccttttgaagcggcagcgtatagccttaatgccacttcactttattttacctgtctggcaaacggcaatagtcgtttttacagcattgaggattttactcaattcctccataaagctggatttatagtagaaagtcagattgatcagttagggcttgggcatacattactgatctgcaaaaagcagtaa

SEQ ID NO: 3719 - DNA, 222 bp, Xenorhabdus bovienii
  Coding DNA location: Contig name=SeqID_16892; Position on contig =111881..112102bp; Strand=-
atgaatgacgtttctccgggtattatcgatggtcttctcaaaaaccgcagccacgatgttaaaatacgcattacctatactgataaaaactatactatccactatgtcagtagccagaatttgaaagcacatgacggaaacattcaccgtaattacaatcgctggatcaatagcctagataacgatattcaattacgtctggcagctatggctaatcaataa

SEQ ID NO: 3720 - DNA, 306 bp, Xenorhabdus bovienii
  Coding DNA location: Contig name=SeqID_16892; Position on contig =112032..112337bp; Strand=+
atgcgtattttaacatcgtggctgcggtttttgagaagaccatcgataatacccggagaaacgtcattcattacccatttacgtttttgccccgcttccaaaatggctttcttcactgtcggcagtgaattttttgtcatgattgttgtttgtggcgttaatatcggggcagtacgagcacagccggcaagcatggcgacacaggccaaactgattaatagcttagatgtcattttcatggattttctctggttagataagtgcataaaacttgttaatgtatgcgtttcgcgcagcctatattaa

SEQ ID NO: 3721 - DNA, 159 bp, Xenorhabdus bovienii
  Coding DNA location: Contig name=SeqID_16892; Position on contig =112424..112582bp; Strand=+
atgatttatgcaatattaatgataaatgttcgattggtagtgctaattggtagatatttttatgtgattttaaaaattggtagggtaaaatttattttacaattttattatctaagtgttaatgaaatgttttttcattcacctctcttattattataa

SEQ ID NO: 3722 - DNA, 99 bp, Xenorhabdus bovienii
  Coding DNA location: Contig name=SeqID_16892; Position on contig =112545..112643bp; Strand=+
atgaaatgttttttcattcacctctcttattattataaatattacgaatttattggtgtttatatatttatattttttatgattgttgtctttaagtga

SEQ ID NO: 3723 - DNA, 303 bp, Xenorhabdus bovienii
  Coding DNA location: Contig name=SeqID_16892; Position on contig =112645..112947bp; Strand=-
atgcgaactgaaacgcttcctcgcgattgcaccggccgcttggtcgcccagtgtaggctgcgccaaagtagtggggggttgacctcgctaaaaacgtttttcaggtttgtgtctggctggacgatggttctttgcctggaacaaaaaaatatgttccagtcaaaaccattgaacagcaagatatcaatgcgctggaaaaacgccatgttgagggacgatttatccagtgcgccttatatctccgtccttcagaggctgtcaagttcgtcaatatttaccttaatctacaaaccgaatcattaa

SEQ ID NO: 3724 - DNA, 1554 bp, Xenorhabdus bovienii
  Coding DNA location: Contig name=SeqID_16892; Position on contig =112866..114419bp; Strand=-
atggctcaacgtgggtattacctgttttgctacgtgcgcattcgtgctgttactaggtggattgtggtatggctactggatacgccaagaaggcctgcaacttacacacatcgctatcgtcatctggtcgatagccgcatttttgctgttccatctcagtatgacatccgaattgataggagacattcgatgataaattcccttcctctttacgacggtgattgcttcgtgcaggttaatgatgacgttgctgctaagctcgatgggtttgaactccgacttctcgcaagccgcgttgtcgcgatccgtgacaatcaattcttcgatctacaaaacctgattgcggggggaggtgccattacacgaaacgacaatccatacgacctacgacgccaaaatctcgcggtgctgtattacgatctcagccgtcatggcgaactcgaattgcgtgagtctgatgctgacggtgctcgccttgctgtgctcacgccgaaagttaccgttgcggcctcgtcatcacctatccaagcagtacggttatcgcccagcgatcgcctcgcgttcctgccgttcgaagagacgcgcaacgtgccgaatatagcagccgacgcgatccataatatagctacacaacttacactgtcgcactggccagcgaaccggactcccgcccgctacaaagcgaatctgtcgactgagagcgtactgcgctttgtgcctgacatgtcagagtatcctgacgtgcggcatgtgacgaccgaccactttgatctagacgggctcgcatctgtctacgcactgatcgcgcctgagcacgcgcagagtcatggacaacttctcgtcgacgtcgcacggttcggtgatttttcgtgtggccatagcacgaaagcgcgccgactcgcattcgcgctgaacacaatcactgagcaagcattgcacgccgcgggtacggtaccaaacgaaagtgtgcgcattacggcacttttccgcacgctgctaccggcattgcgtgacttgctggatgcttctgtgatccgcgatgcactttggcgtgacgccgagcagcatcacatggaaacggaagcgctactcgacagtccgaacgtgacgattgagcagtatcctgagattgatcttgcggtattccgtctacctacttctcatgtgccatatgtgcgcgtaccgcaacgttacttcgggttttcgcctattgccttccacaaccgcacgccgttatcgacgatcgcgctcgtcacacaggacgatgtggtcgtccatcagcgctatgaaggatgggtggagttacattccgctgcgccacggccacgccgtgatctatcgattttagcgcgggcgttacagtcagccgaaacggaagattgccgctggcactacgacggtgtgcaacacattatgccacggcttggacgcgacggcgcaccgctgagtagcttgtcggtagagacgatcgtatgcgaactgaaacgcttcctcgcgattgcaccggccgcttggtcgcccagtgtaggctgcgccaaagtagtggggggttga

SEQ ID NO: 3725 - DNA, 279 bp, Xenorhabdus bovienii
  Coding DNA location: Contig name=SeqID_16892; Position on contig =114477..114755bp; Strand=+
atgacaatagcggtaagtgcctgcaataccacaatgacagcaagcgcagcgctatgtatcgcccgtgatgttgttgcacgacgcagcaacggagtattcacgggtggttcctgtttgagcagcgtcatgctcatcatgcgacctactgtacccgtcgtcactgtgaatgactgcacattattgatcatgcctattgtcgcccatccggcgatcccgaacgcatgcagagccttaaatagagcgattccggttaccgggtccatgatgagtcctcattaa

SEQ ID NO: 3726 - DNA, 1404 bp, Xenorhabdus bovienii
  Coding DNA location: Contig name=SeqID_16892; Position on contig =114786..116189bp; Strand=-
atgagttctaacaatgccccctcttggggggaactgctttccggacgcaacggcttgctttcaatcgcgcttgcagggggagtcgcgctacatgcgatcaatatctatatcgcgacgacaatcctaccgtccgtcgtacgagacattggtgggcttgagtactatgcatggaacaccacactgttcatggtcgcgtcgattattggcgcgccattgtccaaaaacgtgctaagccgtttcggaccgcgtgctgcttatcttgtcgctctcattgtgttctgtggggggacactcgtgtgcgcaagtgcaaaagacatgttgtggatgcttgttggacgatttgtgcagggcttcggcggtggcatcctgtttgcactcagctacgcactcatccgtatcgtattcgatgggcggttgtggccccgcgcgatggcgatggtgtccggtatgtggggtatcgcaacgctctgcggccctgcaatcggcggtatctttgcgcactcagacacttggcgtcttgcatttatcgcgcttttgcctgttgccgccgtgcttgctgtgatcgtactcgcccagctgccagcctatgagaaatctagtgcacagacggaacgggccgcaattggcaagattctgctgctcggtgtatcggtacttatcatatcgatcgccagcctgtcgaaggagatttttgcaaacatcgccggtgtcgcagctggcctcgtgatcgtcgtgttgattgcgcgcgttgatcgtaagtcgaaaattaaactgctgccgaccggcgcttacgatatacgcgcgtctcttggtgcaatttatgcgtgtatgagcctgcttgtaatcggtatgacgagcgagatattcgtaccgtattttctgcagaccatccacggttatcagccgttaatcgcgggctatgcgactgcactgatggcggcaggttggacggttggctcactattcagctccgggcgcagcgcacagactgcgcaggcgctggtgcggcgtggcccaattctcgttgtgcttgcgctcatcgtactcgccatcatcatgccatcgcagcacctgctcggcccagtttctagccttaccttgatgtgcatagcgctcgcagcggttggtgccggtattggtgccgcctggccgcatctgctcacacaggtgtttacaaacgcgcctgctggccaggaagatcttgcgtcgacgtcgatcacgaccgtgcaactgtatgcgacagccattggttctgcatttgcaggcatcgtagcgaatcttgccggattctctgacccaggcggtttggctggcgctcagagtgccgctatgtggctgtttgcagtctttgcaattgctccggtggtcgctacgtttgtcgtacgccgtgtacgcctcacataa

SEQ ID NO: 3727 - DNA, 864 bp, Xenorhabdus bovienii
  Coding DNA location: Contig name=SeqID_16892; Position on contig =116227..117090bp; Strand=-
atgctgaccttcgaactgattaatcttgatattaatcccacagacgcggaacaggtcactcgtacgttatccgaacaatgcacagcggccggctaccgattgaatatggcagaagcagacaatacaacgccggatgggatatttgtgctttcgcgtggtgcgccgactgcgataaacagcaagcgactggctgaagttgggcggattgctgtcgcgcagatcggtatcgatccggagaataccggcggtgaagcatctgcggtatggcacgaatatcctcagagcatgttctgctatcctctctcgcttgagatgaaatctgtggacgcgtcagccgatgtcgcacgcgactggctcgcaggcttcgctacgtttactgcctgcatcaagatgtggcgacgcttacgcgacaaacctgaagatggccgaccgcgcgagctacgtgtgaaccatatcaacatcctcgcacaggatctcgacaaatctgtcgatttctaccatcggatcttaggcgcttcctattgctacaacctaggtccaaagaaggttgtgatggagctaaacggcttcgatttctttatcgaacaaacagatactgttacctacccacccggctaccattttggcgtgcgcacagaccccgaaggggtcaagtcaatcgcagcaatagtaggggcggacggcgatatcaagatcgtaaagggcaacggcccaactcttggctatcattcggggccggatcgtgtgcgtaccgctttctactttgaagatccggacggtcttgtaatcgagatctattctccggaaattgaaatgcttgagagcaacccgcatctcatctcacagcatttttcgcaggcctga

SEQ ID NO: 3728 - DNA, 1053 bp, Xenorhabdus bovienii
  Coding DNA location: Contig name=SeqID_16892; Position on contig =117093..118145bp; Strand=-
atgagcgagctagtcactgagacaatctatgagtcgacaaacgataaagttgcactgacttcagtcatcgacttggtgaaattgtccgatcaataccggcaatcggcagtcctgcactatgccgttgccgaaaagctatttgatttaacgcaggaaagctgcacatcggccaaggttgccaaaaatttcggcatggtcgagggtaaggtgtcaatcctgttaaacgcgcttgttgctctcggacttctaaggaaggacggcaacgagtttttgaacactgagttgactacgcgatacttgacaagtacgagttccgactacataggcgcgattgttgagcatcagcatctgcaatgggagaactggccccggcttggagaaattctgcgcagcgaaaagccactcaatttccaacaggaaagtcgtttcatgcgcgatgagcgtgctcgcgacgcgtttaatgacgcgatggtacgtctgagccagcccatgcgtgatgtcgtgagcggcctcagtgtctttgcgaacgcgaatacgtcgatcgaccttgcaggtggacacggtacctacatcgcggaggcgttacaccgtcatccacagctaacaggccagatatgggatctaccaacgacccgcgacgctgcgcagaaaacgattgaagcatacggcctcaatgggcggctcgagttttgtgagaaaaacctgcttgacgctctcaactttgagaaagcagccgccgacgtcgttatgttgaacgattgccttcactactttgatgaaacagaggcgcttgcagtgatccgttacgcatcctgtcttgtgaagccagggggtgcactcttgatcctcacaatgacaatggatgaaaatcttgtcacgcccccgctatctgctgacttctcgctccacatgatggttaacaccaatcacggcgagctacatcctacgcagtggatagctcgtgctgtacatggaaatggcttgtctatcagcgaacacgcaattggccgctacacacttctcatcggtcaacgccctgctagtgaggtataa

SEQ ID NO: 3729 - DNA, 984 bp, Xenorhabdus bovienii
  Coding DNA location: Contig name=SeqID_16892; Position on contig =118237..119220bp; Strand=-
atgaaacctatgctcgccgacaaccctaaccatctcagtgaccgtgcagcgatggcgctgcccgaaaatctattcgttgcgcgcatgcccacgacagtgttttcaatgcatctcgatctactgcaacttgagccggcagagtggatcgcaatcgcgcagaatccgtccacatcatttgaacgccgttacgcagcgggtacattgctcagcttttcgggcgatccacgtatccgtccgcttgatccagaaatgtgtgacgtacccggcgcaagcgtttggctcggcactgcaccggagcaggttccacaggtcgttgccgaatggcagcgtgtcggcgtaatcgaggaatggatagctaaggaatgcccatgctacaacgtggaaatcaaggcattccggattatgcgttatccagtcaccaatctcgaatatcggctctttcttgagcaaacgagagcgccatggtttccgacgtcttggttcttaggtgtctatccgggcgaacgggcaaatcatcccgtctggtctgtccctccggaagcagcagaagcgtatgcagattggctgagcgaggcgacgggtcggcgttttcgattgcctagagaagccgaatgggagtacgcagcttctggaggcactggttccgagtatccgtggggtaacgagttcgatccttacgcagccaatacagtcgaagccgggcctttgtcgacaacgcctgtcggtatctttcctcttagtcgtagcgcgtttggcatcgacgatctcgccggcaatgtcgaggaatatgtcgccgatgattactccccctaccctggtggcgatgtgattaacgatgacctcgcaagcactcagggtagctatcggatcgcacgtggtggcagcttcacgcgctttggtgatctggcacgctgtgcacgtcgtcacggccgctaccagcgtgacatctacgcgatgggttttcggctcgtggagtcgctttga

SEQ ID NO: 3730 - DNA, 696 bp, Xenorhabdus bovienii
  Coding DNA location: Contig name=SeqID_16892; Position on contig =119236..119931bp; Strand=-
atgagcagtgacaccaaaccacattacattgatgctcagcggacaatcgttcctgttgacgttccaagcacggcaccacgtgattatgaagaagtgttacgctcggattttgtatcgagttataacgaagggcgcgacgcctggaccgaagaggctgcaatgcagcaggcaagtgtgatcttgcatgctcatctcggtcgctcttccgatgtcctggacgctggcgcaggtcgcggacgtgatactgggttcttactcgcacaaggtcatcgggtcaccgcggttgacctcgtcgaacttcccgagtgggcacaactagtgcggaactggggtagccaggtgcaattccgcataacgccagtgactgagctagacggtgagaacctttttgatggtgtgctcgacaatggctgcctacatcaccaacatccagatgcatacattgagtatctcaggcgcatccacgaccttttacgcccagccgggctcttcacaatatcagtgtttgagtcgaaagagccgggtcggctgtacgcaaataaaatgcgacggctttatcgcgagttcacagattctgagcttaccgagttgctgcgcgtcgcgcattttactcttgtcagtgtgcaccgtgtaccgcgcccaacagccggactgaactatttggttctgacagttagaaaatctggttcctactaa

SEQ ID NO: 3731 - DNA, 1698 bp, Xenorhabdus bovienii
  Coding DNA location: Contig name=SeqID_16892; Position on contig =119928..121625bp; Strand=-
atgatcacccatcatgcaccgatcagcgggattgccgcctaccgcgataagtacgtcttaacagctggctacgataaccaggtcatcctgtgggatgctaacacccaacgtccgctcgcccgtgcgatgcacgatcaccttgcgaatcagggcgtattctcacccgatggtgcttacgccgttacctcatcatcagattatagtgcccggctctggactgtacccgacctgcggttggtcgccgtgttcgccgatcatgaagacgatgtagaaatgagcgtatttcatccggataagcctctggtcgcaaccgcttcacgcgaccatcacgtccgggtgtacgatttcagtggcaagctgctgcacacgttcaaaggccattcagctgacgtcatctcggttgcatggatgcataatgccgacgaactgatctcgtcaagcgacgatggtacgatcaagcgttggtcacttgagaaaaactgcctcgtcgctgacatcgatctcggtggcatcgagaccgacactatcgctatcgcagcagacggacgcatcttcgctggcaacgacgaaggagagataatttcaatcggtactgacggctcgcaggtgacgttcagggcgcatgatgcgggtgtgaagcgtctcgtgctcgaccacaaccggagccttctagtgtcactgtcatacgaccgcacaatgcggctatggcaagtggggccatttggacagttggaagagctcgtgagcgcgtcactgccgcctgaggtatggccgcgttcatgctccttcgaaggtgacgatcacattgtgttcgccactttccaatcaggctatcgtctgtacaactggaaaaccgatgagtgggatttgactgagctagcgccgacacacgtcgtcaatgcagccgtgtcagtcgacggccaacaatggacgattggtgatgcaggcatcgtgcgggtcgaccagcgtgagcacgcatgcatgggtagtctgtgcaactttctcacgcccgtaggtgacgtgatcctgacaggtgggcagctcggcaaagtgtttgatgcgcgtacgggtcgtgagttgtaccagcatcgctccccactaaactgcggcgtatcgttcaagcgcaatggcatcgaccatgcggtgatcggtgcgtacacgggcgaaggtattgtgctgcgtatcgaaggttcgcaggtaacgcacattgctgacctgccactgcatggtaacgccgttaagggtgtcgccatctctggtgatctgcttttctccattgcggctgatgcgtcagcagcttggtatcgcgtgtcgacacttgagcaggtgtgcacgcttaagcgtgcacacgagaagatcgcgaatggctgtacaggccttaatgacggctattttgcgtcggtgagccgtgatctgaaattgcgaatatggtcaccaaatcaccaggcggatatcatcgcgactcctcacacgcattcgatcaaatgtgttgctgcgggagttaacggtcgctatatcgcgactggcagctataacggccgtgttgctatttacgaccgtatcgataacctctgggtgatcaatgtgtgggtgacgaccgcgggcgtgtcgtctctcagctacgatccgatcacacatgtgtttcttgcgagttcatatgacggcaatgtctatcacatcccgctggagtacatatga

SEQ ID NO: 3732 - DNA, 123 bp, Xenorhabdus bovienii
  Coding DNA location: Contig name=SeqID_16892; Position on contig =121655..121777bp; Strand=+
atggtgtttgccgatcttcgtgcgccgatagcgatgattcgtactattgagggacactccggtttgtcgcacatgcctgatccgaatcccgcttctcttgctcagcctgtggttagttcatga

SEQ ID NO: 3733 - DNA, 669 bp, Xenorhabdus bovienii
  Coding DNA location: Contig name=SeqID_16892; Position on contig =121870..122538bp; Strand=+
atgaagacgattaatcgtacctctcatgctcttaacgaaatggcggatttcgccaagacacttggacactcacatcgattgaccttggttgaggcaatctttcggcacgaaagctcggtagagcatttggcggagatatccggcctctccatcaccaatacttcacaacatttgcagcaattgcgacgtgcaggattcgtccaaacccgtcgcgaaggcaagcatgtcctgtatcggattggtgacggcccagttgcgaatatactggccgcgttacgagactatcttgcttatcagcaaaccgagatgcagcgtgttgtctccgacagcgtccatcatccggagcacttagaaggtgtctctgttgaagagctgctccgcagacaggaggaaggggtactactactggacgtgcgctcggaagaggattacgccgtaggacacattccgggagccatcaacattccaacagaagcgctcgtacaccatcttggagaactgcctcgcaatcaggatatcctcgcttattgtggtgggcgatattgcgtgctctctattcaggcggtctcattactgcgatctaaaggattcaaagccctacgccttggggatggattcccaggatggcgagcagcaggtttgcgtgtggaggtttctccaataggttga

SEQ ID NO: 3734 - DNA, 1209 bp, Xenorhabdus bovienii
  Coding DNA location: Contig name=SeqID_16892; Position on contig =122692..123900bp; Strand=-
atggctaatccctaccgcgaacttctcacaacccccggagccatggggttagtgatcgcgagttccattgtccgtctgccacaggcaatgatcggcatcggcatcattaccatgttggtgcagcagacgggtatttattggctggctggctcaatcgctggcacatttgccctgacgaatgcgcttatcggcccgcaggtatcgaaactcgttgatcagcggggccagagtcgagttctgccctttatgaccgccttcagcattggtatgctgctggcgctgataattgctgtctatatgagtgctccgactctactgctttttattcttgcggcattggtgggcacgatgccaagcatgcccgctatgataagagcacgctggacgcagcttttccgtggcaagccgcaattacacacggccttttccctggacactgttctaactgaactcgcttttataatcggcccaccactcaccattggcctgagcaccagttttttcgccgaagccggacctcttgttgccgtgttgctgctagccatcggcgtgacagtatttcttctgcagcgggagacagaaccgaaggtcgtcgtaggcatcaggaggaacgcaagctcgaccttacttatccccggcgttcgtaccatcgttctggcgctcctggcgatgggtgtgattggcggatcaattgatgtggctgtagttgccttcgccaacgcacaaggctggctagcgtctgctagtttcatcctggcagcctatgcgctcggctcaatgatcgcgggcctgacgttcggcgcattaaggatttccttaccgattgaaaagcagttcttcattggggtactggtaacttcagtcacagctgtattacctattttctcaccggatgtctacatcctttctgggatgctctttatggcaggagtgtcatttgcaccaacgatgatcatcgtcatgaatcttggtacgatcattgttccaccgtccaggatcaccgaaggactcacgtggatgacgactggcatcagcatcggcgtagcactcggtagcgtacttgcgggcatggtaatcgacatctatggcgcgcgggcagggttcggtgtaaccattgtcgcggggttgatcatggtggttatcgtgcttttggggctgcgtacacttcgtgccacgtcagcggtttgcgccgagccgaccttcctgtaa

SEQ ID NO: 3735 - DNA, 180 bp, Xenorhabdus bovienii
  Coding DNA location: Contig name=SeqID_16892; Position on contig =123893..124072bp; Strand=-
atgattgagcgttacgctcatctacatgcaagtggggttattacaaatgctgtaactacctcatttgcttgctcgattaaatgcacccttcaatcgccggtaaaccatcccaaaagtttgcatcccgttcaacgggatactcatcagcgtcgaattataaactggagaaaccatggctaa

SEQ ID NO: 3736 - DNA, 144 bp, Xenorhabdus bovienii
  Coding DNA location: Contig name=SeqID_16892; Position on contig =124069..124212bp; Strand=-
atgggcagaaatataccagcatttttagctgcgagctatctgggacaggcattggtagggttggttatgtgtgataacactggtgagatgattcgactgatgcgcctcatctatataatagagcgcttttgtaagaggcgatga

SEQ ID NO: 3737 - DNA, 135 bp, Xenorhabdus bovienii
  Coding DNA location: Contig name=SeqID_16892; Position on contig =124185..124319bp; Strand=-
atgaaatcggatagaagtcctcttgctgagtattctcaaagatcattgtttatctctactgcagaaaagaaacattctggtttgcttggccatgaatcttgtttttcatgggcagaaatataccagcatttttag

SEQ ID NO: 3738 - DNA, 102 bp, Xenorhabdus bovienii
  Coding DNA location: Contig name=SeqID_16892; Position on contig =124475..124576bp; Strand=-
atgtcatacgggtcagggtcagttcatcttcaggtaaagccagcaatgattatctttctgtcggcgaaagaacctgtttccttgacatatagttttttatag

SEQ ID NO: 3739 - DNA, 543 bp, Xenorhabdus bovienii
  Coding DNA location: Contig name=SeqID_16892; Position on contig =124570..125112bp; Strand=+
atgacatatttcagtgagcaggatgttgctctgattaatgcacacagaaaatctgaaaataaaatggggtttgctgttcttcttttttgtttgagaagcatcggttttattccggatataaattcaccacaccccgtttcattattgaaaagcatcgccagcaggctcaatttgtcggatgaattctggcaggattatgctttggggcgtgataccacctggagggagcatttaacggaactataccgttatattaatctgagaacgtttacaaaacagatccagcaggattgtatcggtcatcttatcccgctcacgacacgtaccgataaaggtatcctgctggctgaagaacttttggactatcttcagcaaaactgcattattatttccggtatggaagtgttggatcgcatctgtgcagaagcgatggccagtggcgacaaacaagtatttacagcactgaatacccagcttactccgaagcataaaacggcgctcgacagcctgttgccctcaccaaataatcagctaactgggtag

SEQ ID NO: 3740 - DNA, 813 bp, Xenorhabdus bovienii
  Coding DNA location: Contig name=SeqID_16892; Position on contig =125135..125947bp; Strand=+
atgtatacccttggtgaattcgtcgcaggtaaagcctgttccgataacaaacgggaaaatgcgtgttattttgaaagtacggctgaaacaaagccagtcagcgacggggataatactattgaattaaagatcactattcctgaaagaccctttattgctaaagaatatccaattggtcatgaaaaagatccgtttgaaaaaaataaatttgaatcggaaattcagggtagaattgcaagaaaaacttatccaaggcaaggatgggctagtttatgtggcccagcggcatttttttattgcttacagaaggataggccagatatttatgagcaatctgcccgtgagctatggaaatatggtaagactaaaataggtagattagacattaaaccgggtgatggttgccgccaccctagcggttctttctataataacggagaaccaacaatttcaggtttagattggataacattagcgagcttaagagactcagaaaatgctatttttagctataatcaagttgaagctgaaacagcgggagttacaatgtgggggaaattaaccgaatggtttgagaaagcaggttatgagaaaatttttgataatataagtattttttcccatagtaatatcaatgatataataaatttaaacgattatataagaaaagggtatattgttgtaagtttaatatcggttggaatgctaaaaggatcagctggtgaaacttcaggtaaaaatcattggattgtatgggaaggtgaagttagctcaaaaggaaagtcaataaatctaaataagaattcaaaatag

SEQ ID NO: 3741 - DNA, 615 bp, Xenorhabdus bovienii
  Coding DNA location: Contig name=SeqID_16892; Position on contig =126028..126642bp; Strand=+
atgcctatcatagcacccatacctcgaaatgaacgacagaaaatgaaaaagcttatccagaaaacccaaaataaggattatgctcgccggatgatggcattattaatgttacacaagggggatacggtttctcacgttgccaaaaccctttgtgcctcacgttcttcggtcaatcgctgggtaaattggtttacattatatggactggacggattaaaaagcttaccgccgggcaggccggccatctggaatttagagccacttctcgctgtggtttctttcttattaaaacactccccacaacatttcggttatctccgctcacgctggagtcttgagcttatcacacataaaatcaatgtattactggatatatcactctctcaaagtaccctttatcgctacttttatcgggcggggatcgtctggcgaagagccgcacccacgttaagattgtctgatcctgaacatgatgaaaaaagggcaaaaatcaccgggtcttatccaatgcctcagagcaacatcctgttttttatgaggatgaggtggatattgaccttaacccaaaaatcggggcagattggtgtttcaagggacaacaaaagcatgttgtga

SEQ ID NO: 3742 - DNA, 411 bp, Xenorhabdus bovienii
  Coding DNA location: Contig name=SeqID_16892; Position on contig =126573..126983bp; Strand=+
gtggatattgaccttaacccaaaaatcggggcagattggtgtttcaagggacaacaaaagcatgttgtgacccccggaaagaaccagaaacactatcttgcgggctgcctcaacgcgaaaacgaaagaaataacttatgtcgggggcttaagaaagaactcggatttatttattaagttgttagatacacttaataatcaatatgttaatgcaaagacgatcaccttgattttagataactatggcattcataaaagtcagaaagtcatcgcgtggctggcaaaaaatcctaaatttaatctcttgtttttaccggtctattccccttggttgaataaaattgaacgcctgtggcaatccctgcatgaaaccgtgacacgaaaccattgctgccaatttatggggcagtga

SEQ ID NO: 3743 - DNA, 885 bp, Xenorhabdus bovienii
  Coding DNA location: Contig name=SeqID_16892; Position on contig =127171..128055bp; Strand=+
atgtctaatttagaagaactttactgctgcgtcgatgacttttgccaaaaatttattcctctctggcatcaacagttaattgaaaatggcttgctcaaacgtcgccgcgaagcttccctttctctcagtgaagtgatgacgctcctcattttattccacatgagccattatcgtgattttaaaacgttttatattcagcatgtcaaacactaccttaaagccgattttcccaggttggtcagctacacccgtatgttaaccttaaagcacagggcgctcattcctctctgtgcttttttttcgtcacgcaaggctgaaacccaggggatcgcctttattgattcaaccaaaattgctgtttgtcacaacctccgtattccccgtcatcgcgtatttgagggcgtcgcacagcgagggaaaacgagtacaggctggttttatggctttaaacttcatttggttatcaatgattgtggtgaacttttagcggttaagctgacctcaggaaataaagatgatcgtcatcccgtcaaagcactggtacaagggttaacagggtgtttgtatggcgataaagggtatttgtcacaggccttgtgcgatgaactggaagcagaaggaataacgttaatcactcatgtccgtagtaacatgaaggcaaaagcgttatctctctgggataagctgatgttaagaaagcgatttttgatagaaacggtcgtggatcagctcaaaaatatttctcagatagcgcattcaagacaccgtagtcagctcggttttttattggaaatcgtcgctggcttaatagcttatacattccaacctaaaaaaccgagcttgaatttacgggattgtgatatcgctatttttaaacgaagctga

SEQ ID NO: 3744 - DNA, 123 bp, Xenorhabdus bovienii
  Coding DNA location: Contig name=SeqID_16892; Position on contig =128148..128270bp; Strand=-
atggaaacagtttgtcttgtacaagcagaaacaagtaagatggatataatgaaaaaaaatatttctcatttttattttattggtttaaaaaccaaccctccaaatgtatgttttaaaaaataa

SEQ ID NO: 3745 - DNA, 1038 bp, Xenorhabdus bovienii; identical to SEQ ID NO: 1289
  Coding DNA location: Contig name=SeqID_16892; Position on contig =128453..129490bp; Strand=+

SEQ ID NO: 3746 - DNA, 201 bp, Xenorhabdus bovienii
  Coding DNA location: Contig name=SeqID_16892; Position on contig =129491..129691bp; Strand=+
ttgcgtataacatggaatcctagcgattataaaacccctgttctgacagcaacagaaaaagactatagccgtattcagactcaaggaatgcctatacatgccggagaaataactataaaaatatctggtggtgtttatggcaatatgtttacaaaagtaggtaaatttaataaaatctacacaataaaagtgaaagaatga

SEQ ID NO: 3747 - DNA, 654 bp, Xenorhabdus bovienii
  Coding DNA location: Contig name=SeqID_16892; Position on contig =129829..130482bp; Strand=+
atgaaaaaactactcgaattgcgccaacaaaaaactgatttaacccaacaaatgcgctcgctgctgaccagagccgaagacgaaaagcgctccctgaccacagatgaagcgaaacagttcgacgacttgcgcagccagtctgatgtactcaatgctgaaatcgctcgttatgaggtgctgtctgatgaagaacgcaatcaggtaaagaatcagacagccaatgaaaaactcagtaatgacgagctacgcaattatattctgaccggagaaacgcgttccttgtctacaggcgtcccggtagacggcggttataccgttatccctgagttgaacaaacaaatcatgcagcaattggctgatgaatctgtcatgcgccaaatctgtactctcaaaaccacatgcagcaacgaatataagcagttggtttcggtcggtggcgcagcagtggcacacggggaagaaggtaagacacgctgcgagactgccacaccgaaaatggaagaagtcagcatcaaactgttccctatttacgcctatcccaagacgacccaagagattatcgactttagtgatgtggataatgccaacgcacgacgaacgaccgccaccaaatcaggatgtccatacccactaacggcgagaaaacccctttaa

SEQ ID NO: 3748 - DNA, 1776 bp, Xenorhabdus bovienii
  Coding DNA location: Contig name=SeqID_16892; Position on contig =130394..132169bp; Strand=-
atgccacaaagtgcagctttggctgcgtgcatttctacgccgtggaataagcctgttctgccaataaccagaccgttcccaacttatgcggagcaataccagaaagaagaagaaaatcggacgattgccaatgcgatcaaagaacgcgctcgcgttcagcggctattaagaaaacaaccgtctattgttcgcctcgatgttcaatacaaagctagtgttttagaaaaggagcagggggtgccacgcgccgaggcttttttatctaagacattcgttgaccgtatcttgcctagagttacgttggtgaccaaccgttaccaaattcaggaaatttcagcggataacgcgctgtatatggcgcggtttaaccgtattcctgatatgtcgcgggaagatctcgaactgctggcaaatgatattgctgaatttgttactcagaagttgcaaacagtggcagacgacatgctaccagaagacggtgatctgaaacgggcgcatgttctctatatgcgcgccgccgctatcaccaaagcctatcgtcaagacgctccttactgggataagttaactggccgcttttttgatgaaacgcaggttatcgcggccatttctcgcatgacctcagataaatggtggttaggtcgcctgcgccgtctggcggcagagtggcgcgaacacttgcagatctccattaaccgcgtcagcaaaaaatccagtacttacgccagcaaaacaacgatttccgaatggaaggagcagaagcaccgcacgaaagaatttatcaagtcgatggaactggaagacgaagaaggtaaccgcattagcctgattgataaatattatggcagtgtggccaatcctgcgatccgccgtactgaaatgatggtgcgcatccggggcttcgaaaatatctgtaatgaactgggctatgttgctgagttctacacactgaccgccccctctaaatatcacgccactacccgccacggacaccgtaaccgcaagtggaacggatgcagcccggcagatacacaacaatatttaagtggtctctgggcaaaaatcagagccaaactccaccgtaacaatttacgtatctttggcatccgcgttgctgaacctcatcacgatggcacaccccactggcatatgctgttttttatgcagccagaccaagcggatcaggtgcgcgccattatcggtgagtatgccttgcaggaagaccgccacgaactgcggactgaaaaagccctgaaagcccggtttcacgccgagaagattgatccagagaaagggtcagcaacgggctatgtggcgaaatacatttctaaaaacattgatggctacgcgatggacgacgagcgggatgatgaaagtaaccgccccattaaagatgccgcgatagctgcgagtgcttgggcagcacgttggcgtatccgtcagtttcaatttgtcggtggtgctccggtaacggtttaccgtgaactgcgccgcatggcagaccatgatgcagcgatgggcttaagtatcgaatttgccgctgtgcatgatgcggctgataacggcgactgggcaaattatatcaatgcacagggtggcccgtttgtacgtcgtgacgatttggttgcgcgtctgtggtatgaaacggagcaagaaactaacgctcatggtgaggatgtgatccggattaaaggggttttctcgccgttagtgggtatggacatcctgatttggtggcggtcgttcgtcgtgcgttggcattatccacatcactaa

SEQ ID NO: 3749 - DNA, 117 bp, Xenorhabdus bovienii
  Coding DNA location: Contig name=SeqID_16892; Position on contig =132161..132277bp; Strand=+
ttgtggcatctctggctggaatttgctgaattggcggcgcggttggggttgtacgccgctggttataggtacgggtttcactcaccaaccccagcagacactggactacatgcctga

SEQ ID NO: 3750 - DNA, 468 bp, Xenorhabdus bovienii
  Coding DNA location: Contig name=SeqID_16892; Position on contig =132238..132705bp; Strand=-
atgaatttatttatgacgacaccatctagtattcactttgttaatcttgatgaaactgatttttccaccattaaaaataataaaaaccgttgtattggtgttttaaatagttgctgcgaggacgttaatgtcgaaatactcgatagattaaaccaatgctttattgttagatgtgtgggtgttgaaaatatttttgataatcaaaatttaccgaccaactgtaaaaaaggtgactatgtagtgctttctcaggagggggggtatgattggcttgatgatatcgagcatcgaatcactgtatcaattgatgaagtttattatcttcggaacgggctggataatcccgatgaaaccaatatctcattttatgaatattcattattaacgcctgagcattttttttatgaaggtgctaatgagaatgcccatcaggcatgtagtccagtgtctgctggggttggtgagtga

SEQ ID NO: 3751 - DNA, 492 bp, Xenorhabdus bovienii; identical to SEQ ID NO: 1438
  Coding DNA location: Contig name=SeqID_16892; Position on contig =132731..133222bp; Strand=+

SEQ ID NO: 3752 - DNA, 354 bp, Xenorhabdus bovienii; identical to SEQ ID NO: 1741
  Coding DNA location: Contig name=SeqID_16892; Position on contig =133159..133512bp; Strand=+

SEQ ID NO: 3753 - DNA, 105 bp, Xenorhabdus bovienii
  Coding DNA location: Contig name=SeqID_16892; Position on contig =133622..133726bp; Strand=-
atgcctctccttttgtggcgaatttcttgcggatgcgctttccctttttgccatcagagcgatcttctgcgtagaaatcagcaatccattctccggtattcctga

SEQ ID NO: 3754 - DNA, 276 bp, Xenorhabdus bovienii
  Coding DNA location: Contig name=SeqID_16892; Position on contig =133740..134015bp; Strand=-
gtgcggggtgcaactgtttcgacacgcttagttcttgaaagcttcccagatagcctttgctctctgtatttggaaaacagttgtgcagtgaattcgatagcaagtggatcacccatgcactcgcttgcccaaagcatcgttgttcgtcgccttgctccgtcgcctaacgtaacgccatgtgctttataccaaatttcgactaaatcacgtaatctacgggtgtctttggcattgctttctatccacggtttgccattgagtttatctaactcatag

SEQ ID NO: 3755 - DNA, 768 bp, Xenorhabdus bovienii
  Coding DNA location: Contig name=SeqID_16892; Position on contig =133879..134646bp; Strand=+
atgctttgggcaagcgagtgcatgggtgatccacttgctatcgaattcactgcacaactgttttccaaatacagagagcaaaggctatctgggaagctttcaagaactaagcgtgtcgaaacagttgcaccccgcacggtaaaccttgaattatcctactttcttgctgtttttaatgagttaaaaagattgggagaatgggaaggcgataacccccttgagaatgtcagggcgttcagaactgatgaatcagaaatggcttttctaacccatgaacagattgctgacttatttaaagcctgtgaagagagcagtgctcaagatttatctttagtagtaaagatagctctatcaactggtgcaagatgggcagaagcggaaacgttacaacgctcacaaataacgcagaataaaattaccttcattaaaaccaaaggcaagcgcaatcgaactgtacctattagccaagatttgtatgacgagatttctaataagagcagtaagaaagggaaactgtttaccccttgctattacgcattcagatcagcaataaaccgggctaagattgaattaccagacggccagctatctcacgttctaaggcacacttttgccagtcattttatgatgaacggtggcaacattttggtactgcaaagaatccttgggcatacagatataaaaatgaccatgcggtattctcacttcgcacctgagcatcttgatgatgcagtgagacttaatcctctatcgcggaagactatatga

SEQ ID NO: 3756 - DNA, 714 bp, Xenorhabdus bovienii
  Coding DNA location: Contig name=SeqID_16892; Position on contig =134643..135356bp; Strand=+
atgaaaaaattattcaaggagcacgggcactactttattttagttatcattatctttattgctgttatttctctcattctttacttttatacgttcaacagttctctatctaataacagtggagattggggagcgtttggttctttcgttggcggaatttgggggcctttagctacaattggaagtattgcagttcttataagaacactcagaacgatgcagaaccaactaaaagaatcggaaataataagaaatttcgggcatatcttagaattattgaaggctctgaatagcataatgaatagagttataagtaatcagaaagaagctgacaataatggtctatataaatggatgactgatagcatagagccgattgttgatgacagcagtcatactcaagaaaaactgttggacataggccgtaaagcggcaagacagaatagtgatatcaaaaatggctgcatagttctcacagaaattctacgaaagataaaaaatatagaaaatcaagaatcacaacaaactgcaaaaattatgctgcaaagtagtctctctgaaacccaccgttttttgctctattgcggggctaatgagcagaattttgaaattagtcaggaattagaatcttatggcttttcagacttgccctctagtcttaacaaaaagatttattgtgagaaatttcttgatgaagatggagaccccacttaa

SEQ ID NO: 3757 - DNA, 168 bp, Xenorhabdus bovienii
  Coding DNA location: Contig name=SeqID_16892; Position on contig =135274..135441bp; Strand=+
atggcttttcagacttgccctctagtcttaacaaaaagatttattgtgagaaatttcttgatgaagatggagaccccacttaaagtgtcgcaaaagtgtcgcgacaaaaaagaaacatcgaataatattgcactttattttaatttaacatgttgttttttattttaa

SEQ ID NO: 3758 - DNA, 1122 bp, Xenorhabdus bovienii
  Coding DNA location: Contig name=SeqID_16892; Position on contig =135639..136760bp; Strand=+
atgaaagaattagtggatgtcttttctgattttccagacccacgttgtcagggaaaggtcaaacaccgttttattgatatcttagtgatcgcggtatgcgctgtcattgctggggctaacgcctggactgatattgaacagtacggtcaactcaaaaaggattggctgagttcatttcttccgctcaaagagggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatggccacggacgtaccgtcagacggcgcggatgggttctgccactgacatcagaaacaaaacacttaaggtcttggccagatattcaagctcttctggtaacagaaacgatacgacaagaacactattctgacacggtgacttctgactttcgttattatttaagcagttgtcatgattctcccgcctttcagttaggtgcaatacgaaaacattgggctatcgaaaatagtttacactgggtactggatgtcactttccgagaagatgattcacggatgagagagcgggtcgccacaagaatatttgcccaattacgtaaaatggcactcaatattgttaaacgagatatcaatagtaaattgagtttgagtgcgcgaagaaaatcagcgggatgggataacggttatatggaagcactgttatttaatcaattttag

SEQ ID NO: 3759 - DNA, 138 bp, Xenorhabdus bovienii
  Coding DNA location: Contig name=SeqID_16892; Position on contig =136747..136884bp; Strand=-
gtgataaatatcacggacaaagatacgacaacggctcattgccgtagcagtgttaatcggttatacctcacgctactgccagaaggtatcctatggcaggggttacgcatgaaattttggtcggctaaaattgattaa

SEQ ID NO: 3760 - DNA, 264 bp, Xenorhabdus bovienii
  Coding DNA location: Contig name=SeqID_16892; Position on contig =136996..137259bp; Strand=-
atgaataacgttaaaaatgactggcatcaagccgatattattgctgcattacgtaaacgtggtacaaccttagcggctgtttctcgtgaatctggcctcagttcatctacactagcaaatactctcagtcgtccgtggcctaaaggcgaatggattattgctaactatctcgaaatacatccctcagaaatctggccgagtcgctattttgattcatatggccgattaattgagcgtcacgctcgcaataaactactggaataa

SEQ ID NO: 3761 - DNA, 396 bp, Xenorhabdus bovienii
  Coding DNA location: Contig name=SeqID_16892; Position on contig =137650..138045bp; Strand=-
atgcaaatcagtgccggacttcctaaagaccttcagggccagtggccatccgtacacagcttaatcgaagtggtcagcgagaggggagagaaaggggaaattcaccgtgattcacgctggtatatcagttcgttaccgctggagcctgaagtggccgcgaaagcgatcagacgacactgggctattgagaatgaattacattgggtattagatatgacctttcgggaggataccttatcgctaaaagatcctgagggtgcggcacaaatggcactcttcaatcggattgcattaaatgtcattaaacagcataccaggatgaaagacagtcatgcagcaaaacgccggagggctgggtggtcaggcgaatttcgtaatgagcttatatttggttaa

SEQ ID NO: 3762 - DNA, 201 bp, Xenorhabdus bovienii
  Coding DNA location: Contig name=SeqID_16892; Position on contig =137989..138189bp; Strand=+
gtgtacggatggccactggccctgaaggtctttaggaagtccggcactgatttgcataacagcgcgaagttctgtacgtccatgtcctttatttttctctgtaaattcaacccgttcatcactatcgtagtggctggcaaaacgcgattttacaaattggtaaagagtactttgattgcctttaataccgacgatagctaa

SEQ ID NO: 3763 - DNA, 177 bp, Xenorhabdus bovienii
  Coding DNA location: Contig name=SeqID_16892; Position on contig =138321..138497bp; Strand=+
gtgaagcagagtgagttcaggcggtggcttgagtcccaaggggtagaaatcaagaatggaaagaatcacttgatactcttaaatggagacgcaaggagtgccatgccaagacatccgagtaaagagattaacgaaaaattaaggttagcaatccttaaacagttaaaactcaaataa

SEQ ID NO: 3764 - DNA, 420 bp, Xenorhabdus bovienii
  Coding DNA location: Contig name=SeqID_16892; Position on contig =138548..138967bp; Strand=+
atgattatgcgatatcccgtaaatatcgaagaagacggaacgaacctgtttgtatcgttccctgatatacctgaagcgttgacgtgtggcgatgatttggctgatgcaaaagtgatggcctatgatgcgttactgactgccttttccatgtactttgacgatgaaagtaaggaaattccgttaccgggtaatacggtaacagagcatcatattgatattcctgctagcgttgcggctaaaattcttttgcttaatgcaatggtaaggtcgggtgttagccgttcggaactggggcgccgtgttggaattcaaaagcagaacgtcaagcaattgctggatgtttatcacgcgacaaaaattgacactgtagaaaaggcgctatcaagtttaggttacgaattaatattgacggcggcttaa

SEQ ID NO: 3765 - DNA, 105 bp, Xenorhabdus bovienii
  Coding DNA location: Contig name=SeqID_16892; Position on contig =139351..139455bp; Strand=+
atgataataaaagaaaaattccattttacgtggaaaagtagatcatggagaaaagccgcgctgaactgtgggattcaaactgggtgcggctttgttggatattag

SEQ ID NO: 3766 - DNA, 777 bp, Xenorhabdus bovienii
  Coding DNA location: Contig name=SeqID_16892; Position on contig =139474..140250bp; Strand=-
atgattcacatgattgattacaacgttgcatctgactctgatttactagcagaactgaataagctatctggtgatagctctgttggagtatcaagaagaaagaaggagtttctttatatcatcaggaaattgggaactgacgaatatcccatagcagttctatcaggtgatttagatggtaaaaaaggaacactaatcttactgaccaatactaacattcatttcgtaagaattagtcttttcaaaaaagtacatcatgataagttccctgtagtatcaataacagggtgtgaagataagaaaggactattatttgcaaaaatcgttttccacatcgacgatcaagaatacgttttcagtaacattgagaaaaagcctcttgaaaaatttatctctcgcatgtggagatcttggggttatgaatcagctccagataaacagactgtatcacaaccctctgaatcacaaacaacagcaagcactatcccctcaaaagaccctaagcaacctattttagatacaagctctttagtcgaaaaattagaacttattgaagagttgaaagattttgaagtcatcaataccaaagagtttaatacactaaaaaattatatcttggctgcgaatcttgatcatagtttagctactgtgaacatagaaactctggctaaggacttggatagattaaatgattttgttaatgatggcgttattacaaaaaaagatttttcagcccaaaaacaagcactattagaagcgctgccaactagcaagtaa

SEQ ID NO: 3767 - DNA, 102 bp, Xenorhabdus bovienii
  Coding DNA location: Contig name=SeqID_16892; Position on contig =140321..140422bp; Strand=+
atgattgggatagggaacgtaaaaaatcttgtgagacatttttgcgacactgactatagaaaacaaaaaagccacttgttaaaaagtggcttaatgcactga

SEQ ID NO: 3768 - DNA, 141 bp, Xenorhabdus bovienii
  Coding DNA location: Contig name=SeqID_16892; Position on contig =140606..140746bp; Strand=-
atggaaagcaaaaaaaagtgccaatctaactctgttagagtacgacaaagtacgataagtaatcagaataatttatcaaaaaaacgaccggaatcactaaaacccaagttagcttaccaccaaacggttaaattacgttaa

SEQ ID NO: 3769 - DNA, 783 bp, Xenorhabdus bovienii
  Coding DNA location: Contig name=SeqID_16892; Position on contig =140799..141581bp; Strand=+
atgaacaaacatcatttgtcagcggctatttttgaccatcatcaaatagaagataaattcttttcatctatcagccaaatgcatgcgcatatcagtgaacatgttcgagcctatgtgactgggcttggaacttatgctttaaattttttgttagtgacagatggtcacatgaaaacagaagaggcgctgaaaacggctattcagttgatggatgaaaatgtgagtgtcccttttggtatttttgctgtggagcctgacagcaaaactctagaagtgatccagcaggccgggtttgtgcccgatcccgatagtatgacgacggctatgcggctggatttggctaattggcagatgagcgagggtgcatttttggcgtatgaaatcagaaatgttgatcattgtctggcagactgggctatcccgatagaaagtgcgtttgaaacaggaaatatgctttcaggacaataccaggtatgtcatcaagctgctttggacgcaggaaaatgtctgcaacattatgcattatatgtggatgggcagccgctctgtgctttaacgttgtcgagggtggataatattgttcgtcttgatgatattggcacagtagtgggaaagcaggggaagggatatgcttctgctttaataaattatgttctgcgtgaggccaaacagcatggtgcgggcgcgtgttatctggatgcttcccatgatggtaatgcgctgtatcaaaggattgggtttaagccattgtttgaatatcagggatttatccgtgagtcataa

SEQ ID NO: 3770 - DNA, 1953 bp, Xenorhabdus bovienii
  Coding DNA location: Contig name=SeqID_16892; Position on contig =141634..143586bp; Strand=-
ttgcctctattaaagaaagcagcaatacaagaaaacttattgttggcatatttgtttcgccgaccgataccaaccaatactctgaagtgtggataccgtcttatggagcaaaacccgcagtcacagctaaagctacttgtcacccgaggtaaggagcaaggctatctgacctatgctgaggtcaatgaccatctgccggaagatatcgtcgattctgatcagatagaagatatcatccaaatgatcaatgacatgggcattcaggtgatggaagaagcacctgatgctgatgatctcatgttggcagaaaacacaaacgataccgatgaagacgcggcagaagctgctgctcaggtgttatccagtgtcgagtcagaaatcggacgcaccaccgacccggttcgtatgtatatgcgtgaaatgggtacggttgagctactgactcgcgaaggtgagattgacattgcaaaacgcattgaagatggcatcaaccaagtacagtgctctgtcgccgaatatcctgaagcgatcacatatctgctggagcaatacgaccgtgtagaagcaggcgagagccgtctgtctgacttgatcactggcttcgttgatcctaacgcagaagaagatctttcaccgacagccactcacattggttcagaacttcctcaggcagagcttgatgactctgacgatgatgatgacgaagaaagtgaagacgatgctgacagcgaagatgataacagcatcgacccagaattggctcgccagaagtttcaggaactgcgcgaccaatatgaaacgacccgtcagtcaatcaagagttacggtcgcagccatccgaataccgcagcagaaattttaacgctgtccgaagtattcaaacaattccgtttgataccgaaacagttcgattatctggtcaacaatatgcgttccatgatggatcgcgtacgtcttcaagagcgtcaaatcatgaagatgtgtgttgaactgtgcaaaatgccgaagaaaaacttcatcaccctgttctctggcaatgaaacgactgatacttggttcaccgcagcaaaagcgatgaacaagccgtggtctgataaattgtcagaagttgaagacgatgtgatgcgtagcctgcaaaagctgcgccaaattgaagaagaaaccggcctgactattgagcaggtcaaggatatcaaccgtcgtatgtccatcggtgaagccaaagctcgccgtgcgaaaaaagagatggttgaggccaacttgcgtctggttatttcgattgcgaaaaaatataccaaccgtggcctgcaattccttgatctgattcaggaaggtaatattggtctgatgaaagcggttgataaatttgaatatcgtcgtggttacaaattctcaacttacgcaacatggtggatccgtcaggcaatcacgcgttctatcgctgatcaggctcgtaccatccgtatcccggtacatatgattgaaaccatcaacaaactcaatcgtatttcccgtcagatgttgcaggaaatgggtcgagagccttcgccggaagagctggcagaacgtatgttgatgccagaagacaagatccgtaaggtactgaaaatcgccaaagagccaatttcaatggaaacaccagtaggtgatgatgacgattcacatctgggggatttcattgaagataccacactggagctgccgctggattctgcaacatcagaaagcctgcgttctgccacccacgatgtgctggctgggctgacagcgcgtgaagcgaaagtgctgcgcatgcgtttcggtatcgacatgaacaccgaccatacgctggaagaagtgggtaaacagtttgacgtaacccgtgagcgtattcgtcagatcgaagcgaaagccctgcggaaactgcgtcacccgagccgttcagaagtactgcgcagcttccttgatgactga

SEQ ID NO: 3771 - DNA, 114 bp, Xenorhabdus bovienii
  Coding DNA location: Contig name=SeqID_16892; Position on contig =143610..143723bp; Strand=+
atgcggcatttaagccgtgaattctgtgtcttcgtactaaaattttggtttagaacctatttcatcaggctatattgcaataatcaccaattgccatataaccgagtaatatag

SEQ ID NO: 3772 - DNA, 1749 bp, Xenorhabdus bovienii
  Coding DNA location: Contig name=SeqID_16892; Position on contig =143742..145490bp; Strand=-
atggctggacgaattccacgcgcatttatcaatgatttattagcaagaaccgatatcattgatttgatcgatataagagtgcctctcaaaaagaaaggcaaaaatcatcaagcgtgctgtccttttcataacgaaaaaaccccttcatttactgttaatagcgataaacagttttaccattgctttggttgcagtgcgcatggaaatgccattgattttctgatgaattatgacaggctcgattttgtcgaatctatcgaagaactggcggctatgcacgggctggaagtgccctatgaagcaaactcaggcggcggtcacatcgaacgccaccaaagacaaaacctttatcagttgatggatacgataaacagtttctatcaacattcactgacggcgcccaacggccaaccagcccaacaatatttactcagacgcgggctcagtgaagaggtcatccaccgtttctccgtcggctttgctccggctgggtgggataacgtcctgaaacagttttcccataatgcagaagaccggaagcagttaaacgacgcgggaatgctggtcacaaacgacaatggccgcacctatgaccgtttccgcgagcgtgtgatgttcccaatccgcgaccgtcggggtcgtgtgattgcattcggtggccgagtactgggagatgcgcttcccaaatacctgaactcaccggaaacagaaattttccataaaggccgccagttatatggcctttatgaagcacagcagaaccataattccctttcaaggctattggtggttgaaggttatatggatgttgtcgcgctggctcaatttggcattgactacgccgtggcttcgttaggaacatctacgactgccgaacacattcagttactttttcgaacaactgataatgtcgtctgttgttacgatggagaccgtgcaggccgtgatgctgcctggcgggcgctggaaacggcgctaccctatctgaatgatggccggcaattacgttttatgttcttgcctgatggcgaggatccagattcactgattcgcaaagaaggacgtgaagtatttgaacaaagaatggaaaaagcgctgactttgtctgtgtttttgttcgaatcactgttaccacaggttgatttgagtaccccggaaggaacgactaagatcagctcgcttgctatgccgttgatcagtcaagtcccgggagaaacgctgcgactctacctgctgcaagaacttggtaacctgttaggaacacctgatacaacacaattggaacgatttttggcaaaacttgtcaaaagagataccagtgcatatcaggcgctaaaactgaagccaacaacaatgcgtatcttgatcgcattgctggtacaaaatccgcatttagcgacattagttccttcattacaaggattgttttcagctcagatagcaggattaccgttattcattgagcttgtcgacgcatgtcttgcacaaccaggcttaacaaccgggcaacttttagagcagtatcgcgataatgagtacgcaaaacagcttgaaaaactcgccgcatggaacgatatacaggtagatgagattgctgaaaaaacttttagcgatgcgctgaatcatcttttcgcatcagcgcttgatgaacgtttcagctttctgattgccaaagaaagaacagaaggcctgacaccagaagaacgtgaagaagtcagattaatcacggagtccggtggcagaaaataa

SEQ ID NO: 3773 - DNA, 216 bp, Xenorhabdus bovienii
  Coding DNA location: Contig name=SeqID_16892; Position on contig =145606..145821bp; Strand=-
atgccagtaattaaagtacgtgaaaacgagccattcgacgtagcactgcgtcgctttaagcgttcttgcgaaaaagcaggcgtattagcagaagttcgtcgtcgtgaattctatgaaaaaccaacgactgaacgcaagcgcgctaaagcttctgctgttaagcgtcacgctaaaaaactcgctcgtgaaaacgcacgccgcactcgtttgtactaa

SEQ ID NO: 3774 - DNA, 135 bp, Xenorhabdus bovienii
  Coding DNA location: Contig name=SeqID_16892; Position on contig =145812..145946bp; Strand=-
atgtttcaattttcctcggcactttacaaagccgtgttcattgaagtaaaattccgcaccattttaaagacggctggcactatcccgccagcgacaaacccgatttctattgaggtgataggcacatgccagtaa

SEQ ID NO: 3775 - DNA, 204 bp, Xenorhabdus bovienii
  Coding DNA location: Contig name=SeqID_16892; Position on contig =146137..146340bp; Strand=-
ttgcgattccggtttcatcgcaggacgtttctatacctaaaactcgcattttactattcgtctcgtcactattcgatttattactatttcatgtattactattcgattcgttactctatcgacgctatgctattcgtatgttttgcatccacctcaacgggcgtcagtgtatcactatccgtttataaccacatccgtctataa

SEQ ID NO: 3776 - DNA, 1038 bp, Xenorhabdus bovienii
  Coding DNA location: Contig name=SeqID_16892; Position on contig =146292..147329bp; Strand=+
atgcgagttttaggtatagaaacgtcctgcgatgaaaccggaatcgcaatttatgatgataaagccggtctgctagccaatcaactgtacagtcaggtaaagctgcatgcggattatggcggtgtcgtgcctgaactggcgtcccgtgaccacattcgtaaaacggttcccttgattcaggccgcgttgaaggaagcaggtctgacgagcaaagatatcgatgctgtagcttacaccgcaggcccaggtctggtgggagcgctgttggttggggcaaccatcggtcgctcattggcctttgcgtgggatgtccctgccattcctgtgcaccatatggaaggccacttgttggcaccgatgttggaagaaaatacacctgagttcccttttgtcgcgttgctggtttctggcggccatactcaactgatcagtgtgaccggtattggtgagtacaaactgttgggtgaatctgtcgatgacgcagcaggtgaagcattcgataaaacggcaaaattactggggctggattatccgggggggcctgtactttctcgtatagcacagcagggcgaggcaggtcgttttgtcttcccgcgaccaatgacggatcgtccagggctggatttcagtttctctggcctgaaaaccttcgccgccaatacgattcgcaatcatattcatggtcatgatcccagcgaagatgaacagaccaaagctgatattgcccgggcctttgaagatgcggttgtggatacactggcaattaagtgtaagcgagcactggaacaaactggcttcaaacgtttagtgatggcaggtggtgtcagtgcaaaccggacattgcgtaccaaaatgcaggaagtgatggaaaaactggggggagaagttttttatgctcgccctgaattctgtaccgataatggtgcaatgatcgcacttgccggtatgattcgtctgcaagggggcactgaaggtgctctgggtgtgacagtgaaagcacgttggcctctggctgatctcccttctttgcaaaaatga

SEQ ID NO: 3777 - DNA, 999 bp, Xenorhabdus bovienii
  Coding DNA location: Contig name=SeqID_16892; Position on contig =147395..148393bp; Strand=-
atgcttgtcataaggatatcaataatgcttacagaaatgaccactgtctatcgtaaatctattgcactgtttacttttgttgacagtaaagccccgacatatttaagcactcaagatggcaaaaccgcagaacaacttgctaagctatgtcatgtttccgtcgatagatttcatcgactactcaattacatgcagtcacttggtgtattactggaaaaagacgataaattttatcttaccgaacagtgctcatcactaagcgatccgaatagccttgagacattgcatataaaatttgaattaaatccaatctgttggagttcttggacaaaatataacgcttccttaaatgaagaaaatgataaatcgtcttttgaaattcattatcatgagaagttttttgattatttaggtcatgagcagaataaagttcttaaaaataccttcgataacttaatgtcaaaagttaccaatataatgaatgaagatattattaagcatattccgctgcataatatttcatcagtcattgatgtcggtggaggaaaaggcgctttagccaaagaaattaaaaaaaatcaccccaatatcaactgtgctgtcatggaccaatatgactttagtcaacaagaatcagaaggcattactttcatcaatggcaatttcttttccgctattcctgcaggatatgatgcctactgcatgaaaaatgttttacataattggccggatgagaaagtcgttgacattctaaagaattgttatcaagccatgcataaagattcaaccctatatatcatcgatatgattaaagaacgtaataatgcagaagcagaatcctttgatttatacatggatgttcttctgttaggtaaagaacgctatcaatccgaatttgaagcgctggcaaaacagaccggattcaccatcactaacatgtacaaaatgagcatttccaaaacaggggcaccaccacatgtcattgaaattagaaaataa

SEQ ID NO: 3778 - DNA, 189 bp, Xenorhabdus bovienii
  Coding DNA location: Contig name=SeqID_16892; Position on contig =148405..148593bp; Strand=-
atgattacatttattatttttatattaaataaaaatggcggatatcaatattttttaataactctatcaaaaataatcataaataaatttaaacacaatgaattaaaaataatattccttagttaccatttaataagatttagaataaacaattcttcaaataaattaaataacgacctcataagttaa

SEQ ID NO: 3779 - DNA, 99 bp, Xenorhabdus bovienii
  Coding DNA location: Contig name=SeqID_16892; Position on contig =148736..148834bp; Strand=+
atgcagggcggtgctttcagagtcgctttaatggaaaaggtaggcagccccttgcgggggctatctgttattactcgtcttgctgttcctgctctttaa

SEQ ID NO: 3780 - DNA, 804 bp, Xenorhabdus bovienii
  Coding DNA location: Contig name=SeqID_16892; Position on contig =148806..149609bp; Strand=-
atgaccgctaattcttctataaatacgatatccatcacaaccttttccccgtttttcggttcaccggataccacttccggtcaaatgtgcgtattatccattgttagagttaagaaaacgacccttattcattggagatatcttatgagtgctatcgcacttggcatgatcatcttcgcgtacctatgtggctccatatccagcgcgatattgatctgccgtttggcaggactacccgatccccgccagaatggttccggtaacccgggggcaacaaatgtactgcgcatcggtggcaaaggtgctgcactggcagtgcttatctgcgatgtcctgaaaggaatgattccggtttggctggcgtacaaactcaatatccaacccacctatttgggcattatcgccattgccgcctgtttaggccacatttaccccgtgttcttccgcttcaaaggcggtaaaggcgttgcgactgcgtttggggcgattgccgccattggttgggatcttatgggattaattgctggtacatggctactgaccgtgctgttaagcggttactcatcattgggtgccattgtcagtgcgttgatcgctcctttctacgtttggtggtttaaacctgaattaacctttcccgtcgcgatgctttcctgtctgatacttctgcgccatcacgataatattcagcgcctttggcgtgggcaggaaagccgtatttggcagaagctgaaaaagaaacaggaaatgacggataaagaaaaaatccaagctgttaaagagcaggaacagcaagacgagtaa

SEQ ID NO: 3781 - DNA, 363 bp, Xenorhabdus bovienii
  Coding DNA location: Contig name=SeqID_16892; Position on contig =149575..149937bp; Strand=+
atggatatcgtatttatagaagaattagcggtcattactacaattggtgtttatgactgggaacagacaattaaacagaaactggtgttcgatatcgaaatgggatgggacaacaaacgtgcgtcttccagcgataatgtcgaacactgtctggactatgccaaagtcagcgaagcggtggtccactatgtggaaagccagcgttttgccttggttgagcgggtggcagaagaggtggcggatattttactgaatcaatttcattcgccctgggtaaaaatcaaagtcagtaaaccgggcgctgttgctcaggcaaaaagtgttggtgtggtgattgaacgtagtttaaatggtttagtgtaa

SEQ ID NO: 3782 - DNA, 1182 bp, Xenorhabdus bovienii
  Coding DNA location: Contig name=SeqID_16892; Position on contig =150039..151220bp; Strand=-
gtgaaagtttatttggttggcggtgctgttcgcaatcaactcttgggtctgcccgttacagaaagagattgggtgatagtcggaggcaggcctgaagagcttttatctcaagggtatcaacaggtcgggaaggatttcccagttttcctgcatccaaaaacccatgatgagtacgcgctagcacgcacagaaagaaaatccggtcaggggtataccggttttacctgttatgccgctcccgacgtgactttggaagaagatctgctgcgtcgagatttgacgattaacgccattgcacaaactgccgaaggcgagttgatcgatccttatcatggtgctgatgatctcaagcatcgcattttgcgccatgtctctggcgcattttcagaagatccattgcgtgtactgcgtctggctcgttttgccgcttactttgctcacctgagtttctcaattgcgccggaaactcagtcactcatcacaaaaatggtgaagagtggcgagttgtcatccctgacgcccgaacgggtctggcgggaaaccgaaaaggcacttacgtcaccctcaccgcaaatctactttcaggttttacgtgattgtggtgcgctggcgattcttttcccagagatcgatcgcctgtttggtgtagcccccatttcctcatgggagaaagccccccttcaaatggatgcaggcattcatgcattgaaggccttacacatggccactcaattgagccaagaaatcgatattcgtttcgcctcattgtgcgcgcacaccgaagccatgcaggttaagcagatgtgcgaacgactgcgcattcccaatgcagcacgcgatcttgctgtcattgtggcgcagtaccacaattgggtacacactgccgagcagttgcctccagaaaccctgctggcattgtttaatgccgtggacgcatggcgcaagccccaacgaattgagcagttgattctttgtagccaagctgacacccgtgcatatgccgaactggaagcatcccgctatccgcaggggcgttatttgcgtgacgcctttaccactgtcagtcaggtgaatgtccaagacgtaattgctcgtgggttccagggcgctgagatccgtaccgaattagataggcaacgccagctcgccatcaccaaatggaaacaacactctactggttaa

SEQ ID NO: 3783 - DNA, 621 bp, Xenorhabdus bovienii
  Coding DNA location: Contig name=SeqID_16892; Position on contig =151236..151856bp; Strand=-
atgcaaaaactacatcgattatttatcctgttcctgggttttactctaccgttatccgtacatgctgaagaaaaacgttatgtttctgatgagttatcagcttacattcgtagcggcccaagcaatcaacaccgtatcatgggttcgctgaattcaggtgaagaagtcaccttgctgagtaataattcagaaaatggttactcacaagtcaaggatagcaaagggcgtataagctggatcttaaccaatgaactgagcaccattcccagcctgcatgaacgcattcctgctatggaacaagagatcaaaactctgacgagtaagctggctaatattgataatgactggaaacaacgtaccgcagatatgcaaaacaaagtgtctgccagcgataagattattaatgatctaaaaaaagaaaatgccaagatccagaacaaactaactgtagctgaaaaaaaggtagatatggctaatttacagctagatgataaacaaagagaaattatcttacagtggttcatctatggtggcgcagtcgcagggatcggcctcattctgggtcttgtactgccacatattattccacgccgcaaacgcaaagatcgctggatgagctaa

SEQ ID NO: 3784 - DNA, 138 bp, Xenorhabdus bovienii
  Coding DNA location: Contig name=SeqID_16892; Position on contig =152054..152191bp; Strand=-
ttgacagacaattttaactctacctctacagaacgcatatgtttatctctcaatttatactgcgggttccgcaggagaacacgcttctccctgcgagtaacttcttttggggaatgttggggtaaagagaaaaaataa

SEQ ID NO: 3785 - DNA, 942 bp, Xenorhabdus bovienii
  Coding DNA location: Contig name=SeqID_16892; Position on contig =152154..153095bp; Strand=+
atgcgttctgtagaggtagagttaaaattgtctgtcaagcccgatgctataccggcagttcgccagcaattgtttcagttttcccaccattatttttcaccacaacacctgactaatatttactttgagacgccagataatcaattgcgtcgctgggatatggggctgcgtatccgtggttttgatgggcactatgaaatgaccatcaaaacagccggcaaagtgttgggtggattgcaccagcggcctgaattcaatgtgccacttcatcatcctgaactggatttggctcagtttcctgcccatatctggcctgaaaataccgatattacacaattacaggctcaactgattgcgttgttcagcactgattttacccgtgaaaagtggatagtgaaccacggacagagtgaaattgaagtcgcattggatcaaggtgtcattcgttctggtcatcgaacggccgctatttgtgagtttgaactggaactgaaaaaggggaatgtggcagatattctgttactggcagatagactggcattgcaggagggtctgcggctggcgaataagagcaaagcggcgcagggatatgcccttgcgtatggtttgactcagaccgatttatcgcaggttcccgaaacgttgggatggcaacagccattatctgttcttctgcctgaaattttagctcagtggcaggagcaggaagaaggatggctggcaggtatacctgaaggaaaaacaggattagagcaggttttggtgtgggtagagcagcttatagaacaacaggcggaagctttgcctgtatttgactcattgcctgcattaaaagtggctttatcagcagtgaatgcagatgcagaaacattgtgttacagcgcatcatggctgcaatgtaagctggcgttaactcagtggttgatggctcaagcacgataa

SEQ ID NO: 3786 - DNA, 2841 bp, Xenorhabdus bovienii
  Coding DNA location: Contig name=SeqID_16892; Position on contig =153156..155996bp; Strand=+
atgttgccactttcagtgcctttggctcaccaattacagcatgtcgttgctaatttccaacaatcagcgggaacaataaaatcctttgcgccacatgaacaggcggtgttgtctctgagtgattttgtggcggaaaatctgctgttacatccgacatggcttgatgaaatccgtcagaatcctcctcaaccggaggaagggcaacactatcctgattggttaaatcaggcgctgtctgtggcaagtgatgaaaattccctgatgcgaattctgcgcctgttccgtcaccggatgttggttagaattgcgtggttgcaggcgctacaaggcagtacgacagaacagatattgcaacaactgagtatgttggccgaagttttgattgtggcagcccgcgataggttgtatctgcgttgctgtcaggattggggaactccaaccaatcttgaaggcgtagcacagccgttgttaatccttggtatggggaaattgggtggcggagaactcaatttttcctccgatatcgatctcattttttcctatcccgaaaatggtgtgacacaaggtggacggcgcgaaatggataattcccagttttttactcggctggggcagaaactcatcaaagtgctggatcaacaaacggtggacggatttgtttatcgtgtagacatgagattgcggccgtttggtgatagcgggccactggtgttcagtttttcggcactggaggattattatcaggagcaaggacgtgactgggagcgttacgctttggtgaaagcgcggatcttggggtacgacgagcaggtgtattgccaggaactgcgccagatgttgaggccgtttatttttcgccgttatatcgatttcagcgtgattcagtctttgcgtaatatgaagggcatgattgagcgggaagtgcgccgtcgaggtttaaaagacaacattaaactgggcgcaggtgggatccgcgaaatcgaatttatcacacaggtatttcagctgatccggggagggcgggagccgagcctacaatcccgttcattgctgctaacattgaaagccattgaagtattggcattgttaacaccggaacaggtgagggagcttgaagaaagttatctgtttttacgtcggctggaaaacttgctgcaatccattcgtgatcaacaaacacagactttgccggaaagtacgctggatcgcgcccgcttgtcttggggcatgggttttgtagattgggatgggttgttggcggaaacagagcacagaatgcatgctgttcgaagcatcttcaggcaactgatcggtgatgaaactgacgaaaatgtcgaagaagccagtcatgtgccgtttaagagtgtatggcaggaggctttgaacagaggtgaattgatgacgcttgttcctcatcttgatgaggcggatgctcagaaaatgctcgatgtgattgccctgtttcgtcacgatgtcagtaagcgcactattggcccacgggggcgtgatgttctcgatcggttgatgcctcgtctgctggcaaaaattggggtgagggaagataccaatacggttttggaacgaatggttcctttgctgctcagtatcgtcagccggacgacttatttggagttgatgctggaatcagaacaggtgatgactcacgttatccgtctgtgtgctgcttccccgatgattgccagccagcttactctccatcctttattgctggatgaactgctcgatcctaaatcgttgtatgaaccgttgccactcgaagcctatcgggatgaattgtatcaatatttactgcgcattcctgaagatgatgaggagcagttgctggaggcgttgcggcaattcaagcaagcgcagttattgcggattgccgcagaagacattgcgggtgtactgcctgtcatgaaagtcagcgatcacctgacttatctggcggaagcgattatcgggactgtggtacagcaggcgtggaaccagatggtaaaacgttatggtgcaccagcgcacttgtcccagcagccaggactgggttttgccatcatcggctatggcaagttgggaggatgggaactgggttatggttctgatctggatctggtgtttttactggattgcccaatggacgtagtgactgatggagaacgcgccattgatgcccgtcaattttatttgcgccttgcccaacgcattattcatttgttcagtacccggacggcttcgggagtgctgtatgatgttgatgcccgtttgcgtccatccggtgaatcgggcatgttggtcagtaccctcgatgctttcgatgattatcagaaacatgaggcgtggacatgggaacatcaggcattaattcgggcgagaatggtatttggtgatgagaaaatgcggggtgattttgaacgtattcgacgtgaaaccctatgcaggtctcgcgatccggatctcttgtgtcagcaagtgcgtgaaatgcgcgagaaaatgcatcgtcatttaggtagccaccaacatgaccagtttgatatcaaggctgatccgggtgggatcacggacattgaattcatcgcccagtatcaggtactgcgctatgcaccggaaaacgcaaagctgacccgttggtctgataatgtacgcattttcgaattaatggcgaactataacattatggatggacaggaagcgatggcgctgacgcaggcttatatcaccatgcgtgatgaactgcatcaccttgccttgcaggccttacccagtcgtgttcctgccgaaagcttcagccagcagcaaatattggtgcgcgatagctggcagaaatggcttggtcgctga

SEQ ID NO: 3787 - DNA, 1425 bp, Xenorhabdus bovienii
  Coding DNA location: Contig name=SeqID_16892; Position on contig =156109..157533bp; Strand=+
atgaaagtaatactccctgattttcaccgcgcaggtgttttggttgttggcgatgtgatgttagaccgctattggtgcggcctaaccagccgcatttcaccggaagcaccggttcccgtggttaaggtggacactatcgaagagcgccccggcggagcggctaacgtcgccatgaatattgcgtcgctgggggcacattcacatctgatcggtctgacgggcattgacgatgctgcgcgggcattgaatgaaaaactcagtagtgtgaaagtccagtgtaatttcgtcgctgtccctacgcatccaactatcacgaaactgcgtgttttatcgcgtaaccagcaattaatccggctggattttgaagaaggcttccaaaatgtggatgcccagccaatgctggaaaagatccagcaatccctgcctcatgtcggggcgttggtgctttcggattatgccaaaggcgcactgagtcagattcagacaatgatcaaactggctaatgaagcccatgtgcctgtactgatcgatccaaaaggcagtgattttgagcgctaccgtggcgcaacgttgctcacaccgaatatgtcagaatttgaagcggttgtggggcactgtaaggacgatgacgaactggtggagaaaggcacaaaactggttcaggatctggaattgaaagctctgcttattacccgttctgaacgaggaatgagtttactgcgagtagggcagccacctttgcatctgccaactcaggcacaggaagtctttgatgtgaccggggcgggtgatactgtgattggcgtattggcagcggcgctggccgcaggaaaaccattgaatgaagcctgttatcttgctaatgcggcggcaggtgttgttgtcggcaaactgggaacctccactgtttcgccagtggaattggaaaatgcagtgcgtggccgagcagaaaccgggtttggtgtgatgagcgaagcacaattgaaaaacgtggtggcacaggcgcgtcagcgcggtgagcgaatcgtcatgaccaatggctgtttcgatatcctgcatgcagggcatgtttcttacctgtccaacgctcgcaaactgggcgatcgcttgatcgttgccgttaacagtgatgcttctaccaaacggctgaaaggggaaactcgacccgtgaacccgttggatcagcgcatgattgtgttatccgcactggaatcggtggattgggttgtggcattcgaagaagatacaccacagcgtttaattgcaggtgttctgccggataccttggtcaaaggcggtgattatacgccagaagagatcgcgggcagtcaggaagtctgggcggctggtggggaagtcatggtattgaattttgaggatggtatctcgaccagcaatatcatcaaagctatcaaaaaccagtaa

SEQ ID NO: 3788 - DNA, 384 bp, Xenorhabdus bovienii
  Coding DNA location: Contig name=SeqID_16892; Position on contig =157567..157950bp; Strand=+
atgtttcttgcgggacataaacggcatcgtctaatctatgagggagaattgtgtacagcggcaattctcctcacgcattattccgcctgctcagttttcttttcaattcctgcctgcgggtttccgatacggacctccagttcgtccagacgttgttccattgcggccagtttttcacgggtacgcagtaaaatttgggtctggatatcaaactcttcacggttgacgagatctagcttgctcagttgggattgcaaaacagtacgcaattttttttctacatcatcaccaaactcttttacgccttttggcatagaattatggatttggcgggcaatttgttcaattttctttggatcgagcatgataagcatccttttgtga

SEQ ID NO: 3789 - DNA, 294 bp, Xenorhabdus bovienii
  Coding DNA location: Contig name=SeqID_16892; Position on contig =158076..158369bp; Strand=-
atgggttaccagaatcagggcaattttgaggagttaatgctgcaaaaaaatacggcaacaaaacaacaggcgagcgcaagcgctcgattgatgctgttattctctcccatccggactatcaccgtcggctccagaatcacactggatctgctgacctctgttttatccatcgttgttctgagacatctgcgaacaacaaaaaagataactgcaaacagagcgctcgcgggcttaatgaaatcaccagaaagttctttcactttaccgccggtagggactttcaccctgccctga

SEQ ID NO: 3790 - DNA, 654 bp, Xenorhabdus bovienii
  Coding DNA location: Contig name=SeqID_16892; Position on contig =158393..159046bp; Strand=+
atgaatcagacgctactttccttatatggcacaccatttcagcgtgttgaacgtgcagtcgctgctttacgcgcaggccgcggagtgatggtactggatgacgaaaatcgtgaaaatgaaggtgacatgattttcgctgccgaaacgatgaccgtagaacaaatggcattgaccatccgtcatggcagcggaattgtgtgcctttgcctgaccgaagaacgtcgtcaacaactgcaattgcccatgatggtggaaaataactccagtcagtatcagaccgcttttaccgtcaccattgaagcagcacaaggggtgacaacgggagtttctgcggcggatcgcattaccactattcacgccgccattgcagagggtgcacagccaaatgatctgagtcgaccagggcatgttttccccctgcgggcgcagccgggaggggttttgacccgtcgtggtcatactgaagcgaccattgatttggttaaactggcaggttttaagccagcaggtgtgctgtgtgaactgacgaatgatgatggctcaatggctcgtgcttctgaagtgattgaatttgcaaaacggcatgatatgccagtcgttaccattgaagacttagtagactatcgccagcaagtagcgaaggttgccagctag

SEQ ID NO: 3791 - DNA, 168 bp, Xenorhabdus bovienii
  Coding DNA location: Contig name=SeqID_16892; Position on contig =159005..159172bp; Strand=-
gtgtgtggactgcggcctttcaagcgtacactcaatataactgatatattctatcccgatacgttttctattccgaacagctttctatttcacccaagaaaacaatatggcagaaaacaatatgacctagctggcaaccttcgctacttgctggcgatagtctactaa

SEQ ID NO: 3792 - DNA, 195 bp, Xenorhabdus bovienii
  Coding DNA location: Contig name=SeqID_16892; Position on contig =159203..159397bp; Strand=-
gtgagtagcggttatcttcaagggcattcattggactaccatgaccaacgaataaagcgggtattctcaggagactcattttcgtccctcatacaacaaattaaacattctagattacgtcgattgtcaataatgacaaaaatattatggcaagattacgacttttcttccttgaatacagccaatcaaaaataa

SEQ ID NO: 3793 - DNA, 777 bp, Xenorhabdus bovienii
  Coding DNA location: Contig name=SeqID_16892; Position on contig =159319..160095bp; Strand=+
atgagtctcctgagaatacccgctttattcgttggtcatggtagtccaatgaatgcccttgaagataaccgctactcacgtgcttggtttgaactagggaaaaaattgcccagaccgagagccattctggtgatttccgcacattggtacactgatgggacggttgtgacagccatgactcagccaagaactatccatgattttggcgcttttcctcaggcactgcacgatatgcagtatccggctcaaggttttcctgagttggcggtgttggtacaagatatccttgagcccattgaggttgaaaccgattttgaacattggggtttggatcacgggtcttggggtatcttggcaaaaatgtatccagatgcagatattccagtgattcagttgagtatggatcgcaaccaacccgcttcttttcattatgaaatcggcaagaaattagcggtactgcgagatgaaggtgttctgatcatgggcagcggtaatgtcgtgcataacctgcctgccgaaaaactgggagtcgagccttattcttggtcgctgtcttttgagcagtttgtccgcgaaagcttgactagccttgaggaaccacatcccttgttccatgcattggacagggaagatggcaaattatccaacccaacgccagaacatttcctgccgctgttttatgtgatgggaacatgggacaaaaaagagccgatttcaacccctgttgagggtattgaagatggctctttgagtatgttgtcgattcaagtcggataa

SEQ ID NO: 3794 - DNA, 1161 bp, Xenorhabdus bovienii
  Coding DNA location: Contig name=SeqID_16892; Position on contig =160130..161290bp; Strand=-
atgaaacgcattggtattaccgagcgcccggactggcgcgaaaaagcagcagaatatggttttaactttcacaccatgcatgaccagccctactggagtgaagaagcatattaccaattctctctgagccagattgaagaaattgaagatgctacgacagagctgcaccaaatgtgtttgcaggtggtggaaaaggtcgtcaatagtgaagagctactgactaaattccagatccctaaacattgctgggagtttatccgttcttcatggataaccagccagccttcgctctattcccgtttggatttcgcctatgatggcaaaaacccgcccaagctgctagaaaacaacgcagataccccaacttcactgtatgaatctgccttctttcagtggatttggctggaagatcagctcaacgctggaaatctgcctgctaatgcagatcagttcaatagcctgcaggaaaagctgattgagcgttttgggcaattacgtgaaaagcatgggtttggcctgctccatatggcttgctgccaagatactgaggaagaccgtggcaccattcagtacttgcaggactgcgcctcagaagcgggtattccgacggaattcctgtttattgaagacatcggtctgggtgaaaaagggcagtttaccgacttgcaagatcaagtgatcggcaacctgtttaaactgtatccgtgggagtttatgctgcgtgagattttctcaaccaaactggccgatgctggcgtccgctggctggaacctgcatggaagagcattatctccaacaaggcgctgctgccgatgctgtggaaaatgttcccgaatcatccgaacttgctgctggcttattttgccgatgaacactacccagaaatggatagctatgtcattaagcctttattctcccgtgaaggtgccaatattcgcattatcaagcaaggcagggaaatcgccagtgccgatggcccttatgggaaagaaggcatgatcgtacagcaattccatgccctgccaaaatttggcgatagctatacgctggtcggcagctggctggtcgatgatcaatctgcgggtatttgtatccgtgaagatcgtgagttgattacgcaagatctttcacgattttacccgcatattattttagactaa

SEQ ID NO: 3795 - DNA, 723 bp, Xenorhabdus bovienii
  Coding DNA location: Contig name=SeqID_16892; Position on contig =161297..162019bp; Strand=-
atgggattagctcttattcaaatacctccaaggtggatgccccctatgacaatgaaacggacaaaagagataaaccacgatactttccgtaaaacgtggcgaaattatcgtttggcacctgtggcactcgctatcagtgcggttttcatgctatcggcctgtgaacagaacgatgaaactgtatcactctatacaaatgccgatgagtgctcccaggcaaatccttctcaaagtgagcaatgcaagaccgcttacaacaatgctctgaaagaagcggaaaaaaccgcaccgaaatatgcctcacgcgaggagtgtgttgctgagtttggtgaacaacaatgtacccagaccccagctcaagctggagttggaacccaggctcagtctcaggctcaaagcagcagcgggagtttttggatgccattgatggctggctacatgatgggacgtttgatgggcggtagttctacaccatcacaaccgttgtttacgtcaaaatccgcctccagcccagccaacggcaagtttgttgatgctaccggcaagagttatggctctgccgccgcaggcggtcgcaccatgacggtaccaaaaacggcgatggcaccaaaaccagcgacgacaaccaccgttacccgcggcgggttcggtgattccgtagcgaagcagtctaccatgcagcgctcatctgccagttccacttcccgctctatgggtggttaa

SEQ ID NO: 3796 - DNA, 1365 bp, Xenorhabdus bovienii
  Coding DNA location: Contig name=SeqID_16892; Position on contig =162152..163516bp; Strand=-
atgaaaaaattgctctctctttttatcgctatgaatctggtaggtttcagcactttaagccatgcagaagatctattacaaatttacaagcaggcgaaagaaactaaccccgaattgcttaaggcacaggctgaccgcaattcaattgttgaaaaaattaatgaagtccgtagccctttgttaccacaactggggttgaatgcaggtgttgactatggcaaaagttttcgcagtaaaacagactcagaaaactatggtacaaatgcaaaactgcaactgacgcaaacgattttcgacatgtcaaaatggtatcaactgaatcaggctgaaaaatcagcaggtatcgctgatatcagttaccaagtcgcccagcaaaagttaattttggatacagccaaagcttattttgatgtcttaagtaaaattgatgcgttaacgtataccgaagcacagaaagcctcgctgtaccgccaattggatcaatcaagccaacgctttaaggtcggcctggttgccattaccgacgtccaaaacgctcaggcccaatacgataccattcttgcgctagaagtttcagatcgtaacaatctggaaaactcgctggaaggactgcgcctgatgacaggaagctactacccacaactggcttcattgaatattgtgcaattcaaaaccaatcaacctaatcccgttgattctgtgctgaaagaagccgaaacccgcaacttaagcctgttgtcagcacgtttgacacaggatctaaaacgcgaatttatcaaagatgcgcggacaggctacatgcctaccgttaatttgacggcaagcactggggtcaccaacaaacatgaccgtggtgcccaacgaagtgattcctacgatggcggtaacagcgttggtttatcattaagcctgccactttatagcggtggtctcaccaattctcaggtcgaacaggcaaaatataactttatcagtgccagccaggacttggagaatacctatcgcaaggttattcaggatgttcgctcctcctccaataacctttctgcttctatcagcagcattacagccaataaacaggcagtcgtttcgacacaaagttctctggattcaatggaagccggttatcaggtaggaacccgcaccattgttgatgttctggatgccacaaccaagctgtatcaggccaaacagagcctgtccaaggcgcgttatgactatctgattaatcaactagtgaataagcaagcgcgtggcaccttaaatgaagatgatctggtggcactcaataatattctaggcacaaagatctcaacggatgccagcaatattattaaagagatgaaaacaccaacaactcgctga

SEQ ID NO: 3797 - DNA, 216 bp, Xenorhabdus bovienii
  Coding DNA location: Contig name=SeqID_16892; Position on contig =163410..163625bp; Strand=-
atggcacaaacagcctccctagcttactggcattctctgctaaaatcagtggtattggtctgtacacagaggcaaattaagcaaaatagctgcacaacaaggaacgcaaatgaaaaaattgctctctctttttatcgctatgaatctggtaggtttcagcactttaagccatgcagaagatctattacaaatttacaagcaggcgaaagaaactaa

SEQ ID NO: 3798 - DNA, 636 bp, Xenorhabdus bovienii
  Coding DNA location: Contig name=SeqID_16892; Position on contig =163734..164369bp; Strand=+
atgagtgaaaatcttgtttcaccgctcacgtttacgacgcaggatgttgaaattatctcccgaaaaacgctctaccgtggttttttcaaaatgaccgagtatcaattcaggcaccgcctgtttcgaggaggatggagcgataacatcaagcgggaagtttttgaacgaggccatgcggctgttctgctgccttatgatccggtacgtgacgaagtggttttgattgaacagatccgcattccagcaattgaaaccagtgaaacgccttggttgctggaagtgattgccggcatgattgaagaaggcgaagacgttgaacaggtagtttgccgggaagcgatggaagaggccggtcttgaagtcaaacgctgtcagcctgccctgagctacctttccagcccgggaggaacgacagaacgtatggcgatttttgtcggtgaagttgatgctgccacggcttcaggaatacatggactggctggtgaacatgaagacattcgggttctggttgtcagccgtgagcaggcctaccagtgggtggaagaagggattattgataatgctgcttcggttattgcaatacaatggctagctctgcaccatgaaaaactcaagacagcatggttagggaaataa

SEQ ID NO: 3799 - DNA, 237 bp, Xenorhabdus bovienii
  Coding DNA location: Contig name=SeqID_16892; Position on contig =164344..164580bp; Strand=-
atgcccagtagcgcatcgcctttacttgcgaaaaggtgcgtatcagtgatttgcagtattctggctgtggctccctccgccacaggtactttaagcaggctttccaaatggtttccttttcctgtcagtcataagaattattctagcgtttctttacaaaaaagatctgctgactgggacacacttcccgttttccagcataaattaggaattatttccctaaccatgctgtcttga

SEQ ID NO: 3800 - DNA, 816 bp, Xenorhabdus bovienii
  Coding DNA location: Contig name=SeqID_16892; Position on contig =164498..165313bp; Strand=+
gtggcggagggagccacagccagaatactgcaaatcactgatacgcaccttttcgcaagtaaaggcgatgcgctactgggcatcaatacttaccgcagttaccatgccgtactggatgcgatccttgagcagagtattgatattgacttgatcgttgctacaggtgatttggttcaggatcagacgatcggcgcctaccagaattttgctgaaggtattgcccgtctgcctgttccctgtgtttggttgcctggtaatcacgattatcagccgacaatggtcgatgtgctggcggcggcaggaatttcaccttccaaacagatactcattgggcagcattggcagctggttatgctcgacagtcaggtgcagggcgttcctcatggtgaattgacggattaccagattgaatggttgcaaaaatgtctggatgagcataatgatcgcaatacgattgttatgcttcaccaccatcctgtgccatcggggtgcacatggctggatcagcatagtttacgcaatgccccggctctggcagaatccctgaaggataaacgacaggtaaaagctatattgtgcgggcacattcatcaggaactggataaaatgtggaatggcatccgtgttatggcaacgccatcgacctgtatgcaatttaagccacattgtactaattttatgcttgatacagtagctccgggatggcgttatcttgaactgtctgtggctggcaatcgggaagcgaaactgcaaacgcaggttcacaggctgaagagtaatgaattttgcccggatttagattcggacgggtattaa

SEQ ID NO: 3801 - DNA, 609 bp, Xenorhabdus bovienii
  Coding DNA location: Contig name=SeqID_16892; Position on contig =165313..165921bp; Strand=+
atgtcaacgttactttatttacatggtttcaacagttcgccacaatctgcgaaagcaaatgcgctgaaaatgtggttacaccagcagcacccggaaatcgacatgctcgtgccgcaattgcctccttatcctgaagacgcggccagtttgctggaagatttggtaatgactcgcgccggcgaaaatatcggtctggtaggctcttcgtttggcggttatctggccatctggctttcacaatgctttggcctgcctgccgtagtcgtcaatcctgcggtgcgcccatttgaccttcttcagaattatcttggggaaaacgtgaatccctataccgaagagcggtatactctccagcaaagccacatttatgatctcaaagtaatgcacattgacctgctggaatcgccagatcttatctggttattgcagcaaacaggagatgaagtgctggattatcgtcaggccattgcttacctgatgcaatgcaggcagacggtcgaatcaggtgggaatcatgcttttattggtttcgaacattacttccctcaaatcatcaacttcttggggctaaccagcggcaataacaaaaaaattgccaaaaataggtaa

SEQ ID NO: 3802 - DNA, 1896 bp, Xenorhabdus bovienii
  Coding DNA location: Contig name=SeqID_16892; Position on contig =165997..167892bp; Strand=+
atgactcaatctagttacaacgcagaggccattgaagtcctcagtggcctggagccagttcgtcgccgcccaggaatgtacaccgatacaacccgtccgaaccatctggcacaggaagtgatcgataacagcgtggacgaagctctagcgggtcacgcaaaacatattgaagtgatccttcacagcgatcagtctctggaagtgatagatgatggccgtggtatgccggttgatatccatcctgaagaaaaagtttctgctgttgagttgatcctcactcgcctgcatgcagggggaaaattctccaataaaaactatcagttttccggtggcctgcatggtgtcgggatctctgtggttaacgccctgtccagaagagtggaagtgactgttcgccgtgacagccaagtccatcagattgcctttgaaaatggcgataaagtgcaggaactggaagttatcggcagttgtgggaaacgtaatacggggacgagtgtccatttttggccggatgagagttatttcgatatcccccgtttttctgcatcgcgtttaacccacttgctgaaagcaaaggcggtattgtgtccgggtgttgagattgtctttaaagataaactcgctggtacagaacaaaaatggtgctatgctgatggtctgactgattatctgctggaagccgtcaatgggttggtgacattgccacaggcaccattcgtgggggtattgcgcggggataccgaagcggttgactgggcgttgctttggctgccagaaggcggtgaattgctggccgaaagttacgtcaacctgatcccaaccatacagggcggaactcacgttaatggcctgcgccaaggtttgctggatgccatgcgtgaattttgcgaattccgcaacatactgccgcgcggagttaaactctctgccgatgatatctgggatcgctgtgcttacgtgttatccctcaaaatgcaagatccccaatttgccggccagaccaaagaacgcctttcttcacgtcagtctgcggcctttgtttccggtgtggtgaaagacgccttcagcctgtggctgaaccagcacattcaagacgcggaacaacttgctgaaatggcgattgccagtgcacagcgcagaatgcgtgcggcgaaaaaagtcgtgcgcaaaaagctgaccaatggccccgctctgccaggcaaactggcggattgtacctcgcaggatctgaaacttaccgaactatttttggtggaaggggattcagcaggcggctctgccaagcaagcccgtgatcgcgaatatcaggcgatcatgccactgcgcggaaaaatcttgaacacatgggaagtatcttcggatgaagtgctggcttcgcaggaagtgcatgatatctccgtcgctattgggatcgatccggacagtgatgatctcagccaattacgttacggcaaagtctgcatattggcggatgcggattccgatggtttgcacatagcaacgctgctgtgcgctttgtttgtccgtcactttcttacgttagtgaaacgtgggcatgtctatatggcgatgccgccactgtatcgcatcgatcttggcaaagaagtgcattatgcactggacgaaggggaaaaggccgccatactggaacgtttaagccgtaaacgtggcaagccgaatgttcagcgcttcaaagggttgggggaaatgaacccaatacagttgcgtgaaaccacactggatcccaatactcgccgtctggtgcaattgactatcgacgatgacaattatcaggaaaccttctcagtcatggatatgcttctggcgaaaaaacgctcggaagatcgccgcaattggctacaggagaggggaagttccttcgatattgaagtatag

SEQ ID NO: 3803 - DNA, 2256 bp, Xenorhabdus bovienii
  Coding DNA location: Contig name=SeqID_16892; Position on contig =167932..170187bp; Strand=+
atgagtgagataactcacgatggtgtggagcgccagccgctgcacacgttcaccgaaaacgcctatttgaattactccatgtacgtcatcatggacagggcgctgccttttatcggtgatggtttaaaacctgttcagcgccgtattgtgtatgcgatgtcggaactggggctgaacaacagcgccaaattcaaaaaatccgcccgtaccgttggtgacgtgctcggtaaataccacccacatggtgatggcgcctgttatgaggcgatggtattgatggcacagcctttctcttaccgctatccgctggtggatggtcagggtaactggggggcgccggatgatccgaaatctttcgcggcgatgcgttataccgaatctcgcttgtccaaatatgccgaattgctgctgagtgaacttggtcacggcacggtagattgggcaccaaactttgatggcacgttgcaggagccgaaaatgctgcctgcgcgtctgccgaatatcctgctgaacggcacgacgggtattgctgtcggcatggcgacagatatcccgccgcataatgtccgcgaagtagtcagtgcgctggttgctatgttggataatcccaattgttcgcttgatgatgtaatggaatacatcaaagggccggattatcccacagaagcggaaatcattacgtcaaaagaagatatccgcaagatctacaaaaatggccgtggctcggtgcgtatgcgtgcggtgtggtcaaaagaagagagtaatgttgttattacggctctgccacaccaagtatcgggtgcgaaagtgctggaacagatcgccagtcagatgcgggcgaagaaactgccgatggtagatgatctgcgtgatgaatccgatcatgaaaatccaacccggctggtgattgtgcctaaaaacaatcgtgtcgatgttgagcaggtgatgaaccacctgtttgtgacgaccgatctggaaaaaagttatcgcgttaacctcaacatgatcggactggataaccgtcccaacgttaaaggtttggttgagatcctcagtgaatggttggttttccgccgcgagaccgtgcgcaatcgcctgaattatcggctggaaaaagtccttaagcgcctgcacatcctggaaggtttgctgacggcctacctcagcattgatgaagtgatccacatcattcgcaatgaagatgaaccgaagccagtgctaatgcaacgttttgaactaactgaaacccaagccgaagcgattctggaactgaaattgcgtcacttggcgaagctggaagaagtcaaaattcgtggcgagcaggatggactggcaaaagagcgtgacaaacttcaggcgatcctcggttctgagcgtaaattgagtactctgctgaaaaaagaaattattgctgatgctgagaactatggagatcatcgtcgttcgccgttgaaagaacgttctgaagcgaaggcgatgagtgatcacgatatcctgccttcagagccgattacggttgtgctgtcagaaatgggctgggtacgcagtgcgaaggggcatgaaatcgatcctgctggtttgaattacaaatcgggtgacagcttccgtagtgcagcacgtggtaagagcaaccagcccgttgtctttatcgatacgacagggcgcagttattctgttgatccgttggatttaccctctgccagagggcagggtgaaccgctgacgggtaaattattggcattaccggcgggagcatctattgagcaccttctgatagctaaagaagagcagaaattcttgatggcatctgatgcgggttatggttttatctgtacattcagtgaccttatagctaaaaaccgtgcgggtaaggcgcttataaccctgccagaaaatgctaaggtcatgcagccactggagatcaccaacgagcaggatgatatgttgctggcgatcaccaaagagggtcgtatgctgatgttccctgtggcggatcttcctcagctttcgaaaggcaagggcaataaaattgtttccattcccgcagcacaggcggcttctggggaagatatgttgagctggttgttagtattaccagtacaatcctcaatcacgctctactttggcaagcgtaagttactgcttcgtccagaagacttacagaagttccgggctgagagagggcgcaagggaacctcgttaccacgtggattacagcgtgttgagcgtattgaagtggggatgccccggtcatag

SEQ ID NO: 3804 - DNA, 732 bp, Xenorhabdus bovienii
  Coding DNA location: Contig name=SeqID_16892; Position on contig =170276..171007bp; Strand=+
atgttagcaatcattcgtggaattattgtttttctgttatcaatcctgatatgtctatttggtagtatctactgtttattcagcccccgtaatccgggtcatgtcatgacctttggtcatgcatttggcaaattgcacaaagtatttggcattaagatgctgaagcgcattcctgaagaggcgaagcaatatgggccaagcatctacatcggtaatcaccagaacaattacgacatggttaccatgtcgaatgccgtacagccccgcactgtaaccgtgggtaaaaaaagcctgctattcattcccttttttggtccgctttactggctgacgggcaatattttgatcaacagagaaaaccgttcaaaagcacacggtacgatttcacaggttgttcaacaaatcaaaaaaaggcatatttctgtctggatgttcccagaaggcacccgcagccgtggccgtggtctgctgcctttcaaaacaggtgcttttcatgcggcgattgcagccggcgtacccatcgtgccagtctgtgtttcttccacacatgatcgcatcaaattcaatcgctggaataatggcactatcattgttgaaatgctgccccccattgatacgacgaaatatactaaagagcaggttcgtcagctggcagagcattgtcgtcaaatgatgcaagccaaaattgaagagctgaataacgaagtcgaagtaatggataagcgcagataa

SEQ ID NO: 3805 - DNA, 1422 bp, Xenorhabdus bovienii
  Coding DNA location: Contig name=SeqID_16892; Position on contig =171285..172706bp; Strand=+
atgtcactgagtcggcgccaatttatacaggcttctggtttggcaatgtgtttaggtgcgctcccttttgcggttcgggccaataaagatcaacaaacggcactgccgctcccccccttactggaatcccgtggtggccaacccctgtttttagccctgcaaaagacccattggtcttttgatggcaaaaataaggtgcaagtttggggcatcaatgggcgatatttagggccaaccattcgggttcgtaaaggggataacgtcaagctgatatatagcaatcgtttgtctgaacctgtctcaatgactgtaggagggctgttggttcccgggacattggtaggaggctcggcgcgcctgatatcgtcaaatgaaaattggtctccgattatccccattaaccagccggcagcgacttgctggtatcatgccaacacgccaaaccgaatggcacagcatgtttatgccgggcttgcaggtatgtggctggtggaagatgaagacagccgcagcttacctctaccgaaaaattatggcgttgacgattttcctgtcattttgcaggacaagcggttagataattttggtgtacctcagtataacccggcgatcaatcaaggttttcttggcgatacattgcttattaatggtgttgaaaacccttttattgaggttgccagaggctgggtcagattacgtttattgaatgcttccaatgcccgccgatatcaattgcaactcagtgatggccgtcctttctatatggtaggtactgatcagggattattgcctgctcccgtgacggtacagcaattgtcacttgctccaggggaacgccgtgaggttttggtcgatatgtcgaaagtggatagcgtagccattaccgcaggagagtcggcaggcatgcttgatcgtctgaaagggctgtttgagccttcaaccaaattgctgtcaacgaccgtcctgactatcaaggccagtgggctgctttctctcgtgacagatcaattaccgacgcagctagtggtggataccacggaaattaactcatccatccataatcgtcagtttgttttgggggatgcgactcaggggatcaatggggtattgttgaataggaatcgaatcgacatcagcagccagcaaggtgcgtgggagcgctgggttgtcactacttcggctccgcagcctttccatatccaaggggggagattcaaggtcatcagtcataatggaaatcgaccacttccacaagattatggctggaaagatacggtttggattgagggtagaaccgaattgttggtgaatatgatgcagccgtcttatgaggtctttcctttcaagtactacagtcaaatattggaaatggcggatgacggagtggctggccaaatggttgtcactccagccacgagctaa

SEQ ID NO: 3806 - DNA, 111 bp, Xenorhabdus bovienii
  Coding DNA location: Contig name=SeqID_16892; Position on contig =172687..172797bp; Strand=-
atggccccatccgctctgacagggcttcgaggcatttttcttattccaacatcaggcaaagcagtggtggttattattattggttttttccttagctcgtggctggagtga

SEQ ID NO: 3807 - DNA, 96 bp, Xenorhabdus bovienii
  Coding DNA location: Contig name=SeqID_16892; Position on contig =172763..172858bp; Strand=+
atgcctcgaagccctgtcagagcggatggggccattatttcagaaaatcagggtgctcctgatgacgcgatcacttgcttggaacttggtgcatga

SEQ ID NO: 3808 - DNA, 195 bp, Xenorhabdus bovienii
  Coding DNA location: Contig name=SeqID_16892; Position on contig =172833..173027bp; Strand=-
atggcattttccataccaataactcgatccatagccatcgcagcaatcaagctgatattcattaagtcaccttacaggcaaataaatagtatgaaaattttggacactatacggaaagggctactctcagtcgataagattagcaatttattcagaacaaatagtgtgttcatgcaccaagttccaagcaagtga

SEQ ID NO: 3809 - DNA, 486 bp, Xenorhabdus bovienii
  Coding DNA location: Contig name=SeqID_16892; Position on contig =172966..173451bp; Strand=+
atgaatatcagcttgattgctgcgatggctatggatcgagttattggtatggaaaatgccatgccgtggactctaccaggtgatttagcctggttcaaacgcaatacactcggaaaaccggttgtgatggggagggtaacttacgaatcgataggacgccctttaccgggacgcttgaatatcgtgataagcagtcagccagcacgtgatgatagcgccacttgggttcgcactatcgaagaggctttggccgcagccggtgatgttgatgaaattatggtgatggggggaggcaaaatttatgagcagtttattcctctggcccaccgtatgtatctgactcacattgatgcggaagtgattggtgacacccatttccccgattacgcacccgatgagtggaattcagtctttaccgaatatcatgatgcagacgagcacaactcacacggctattgctttgaaattctagaacgccgtgaatga

SEQ ID NO: 3810 - DNA, 819 bp, Xenorhabdus bovienii
  Coding DNA location: Contig name=SeqID_16892; Position on contig =173567..174385bp; Strand=-
atggctacctaccttattggcgatattcacggctgttatcatgagtttcgcgctttattacaacaaattgcttttcatcccagcaaagatacgttatggctcacgggcgatctggtcgcccgtggccctgattcgctggaggtgcttcgctatatcaagcaactcggcccagcggttaaactggtcttgggcaaccatgaccttcatttgctggccgtttacgctaaaatcagccgtaataagccgaaagaccaactagataaattactctcagcaccggatgttgatgatttgattaattggctaagaaagcagccaatgctacagattgatgatgaactaaaactggtcatggcacatgcaggattggccccccaatgggatttagacaccgccagaatatgtgcccgtgaagtggaagccattctccgcagtgacagctaccctttgtttctcaatgccatgtacggtgatatgcccaataactgggatcccgaactgagcgggcttgctagattgcgttatagcaccaatgcactaacacgaatgcgttactgctttccaaatggtcaattggatatgatctgcaaatcgaaacccgaaaatgtctctgccccactaaaaccctggtttgaattgccgcataacatccctgaagaatattctattgcattcggtcactgggctgcactggagggcaaaggtacgcctatcggcatctatgcgctggatactggctgctgttggggaggtaaattgacaatgctgcgttgggaagataagcagtatttcagccaatcatcactgctaaatcgttaa

SEQ ID NO: 3811 - DNA, 378 bp, Xenorhabdus bovienii
  Coding DNA location: Contig name=SeqID_16892; Position on contig =174388..174765bp; Strand=-
atgctcaacgaaccaagaattcatattcaagtacagagtacttacgtagaaagccaatcagaaccagagcaacagcgttttgtgtttgcttatacgatatcaattcacaatcttgggcattcccccgtgcaacttatcagtcgttattggcgtataaccaacagtgatggacaccgaacagaaattcagggtgaaggggttgtaggaaaacaacccgtgatccttcctggaacagattatcgctacagcagcggggctattctggaaacgcctttaggcacaatggaaggtcattatgaaatgcgtgatcatgatggtcgcccatttcgtgtcgccattcccgtgttcagactggctattccaacactgataaattaa

SEQ ID NO: 3812 - DNA, 825 bp, Xenorhabdus bovienii
  Coding DNA location: Contig name=SeqID_16892; Position on contig =174794..175618bp; Strand=-
atgaataataaagtccatcaagggcactacgcccgtaaacgcttcgggcaaaactttttaaccgatcagtttatcattgaaagtattgtcgatgcgatgaacccacagcctggtcaggctgtcgtggaaataggccctggtctgggtgcactgaccgagccagtgggtgagcgcatggataaaatgactgtcgtcgaacttgaccgtgatctggcagctcgcctgcatgttcatcctaagctaaaagataagctgaccatcattcagcaggatgcgatgaccgttgattttggccaactggccaaggaacaggggcagtccctgcgtgtatttggtaatttgccttataacatctctacaccattgatgttccatcttttcagctatactgatgctatcgctgatatgagttttatgctgcaaaaagaagtggtgaaccgtctggtcgctgggcctggcagtaaagcctacgggcgtttgagtgtaatggcacaatattactgtcagattatccctgttcttgaagtaccacctactgcatttacgccagcccccaaagtggattcagccattgtgcgtcttatgccgtacaaagctatgccttatccggttaaagacattcgcatgttagcccgagttactactcaggcatttaaccaacggcgcaaaactatccgcaatagccttggcgatctcttttcagttgagcaattgtctgaactgggcgttgatccgggcacacgggctgaaaacatttctgtcgagcaatactgtaagatggcaaattggttatcatctcaggcaaaaactgccagaaatcaataa

SEQ ID NO: 3813 - DNA, 1002 bp, Xenorhabdus bovienii
  Coding DNA location: Contig name=SeqID_16892; Position on contig =175611..176612bp; Strand=-
atggtagcgatgcacaacaataaacccatcattatcacccccggcgaaccagccggggttggccctgatttagtcattgccctcgcacaaaaagagtggcctatccaactggttgtatgtgctgatcctgagttgatgctctcacgagccaagcaactcaacctgccccttcaactacaaccttactcccctgaatacatttccccaacacaggccgccggaaccctgactattctgcccgtttccctccattcacctgtcattgccggtgaattgaaccgggaaaacggtatttatgtcacggaaacgctggcaaaagcctgcgagggttgtctgaatggcgagttttctgcactggtgacaggcccggtccacaaaggtgtcatcaacgaggcaggcgttccttttaccgggcatactgagttttttgctgaccacagccaatgctcaagggtagtcatgatgctggcaacagaagagctacgggtggctctggcaacgacgcatctgccgattatggatgttcccaaggcgattacgtttgattcactgagagaagtagtcactattctcaaccatgatctgaaaaccaaattcggtatccgccgcccccatatctatgtttgtggcctgaatccacatgcaggggaaggtggacacatggggcatgaagaaatcgacgtgattattcccgcattggacagcctgagggcagaaggtatctggctagaagggccgctgccggccgataccctgttccagcctaagtacttggatcatgctgatgccgtactttcgatgtatcacgatcaagggttacccgtgttaaaatatcaaggttttggcagagccgtgaatgtcactctcggactgccatttatccgaacgtctgtcgatcacggcacagctctagagctggcagggacaggccaagcagatgtgggaagttttattaccgcattaaatttagcaattaagatgatacaaaacagtaatgaataa

SEQ ID NO: 3814 - DNA, 1308 bp, Xenorhabdus bovienii
  Coding DNA location: Contig name=SeqID_16892; Position on contig =176590..177897bp; Strand=-
atgaagaactggagagcgctcattctcggattgatgttttcagtgaatactgtcgcaatggcagcaccacaggaactcaatagggttgctgccgttgtcaacaatggtgtcgtactggaaagtgatgtcgacgagcaattacaatccgttaaactcagtgcaaaacatgctggtcagcaaataccggatgaaaaagccttgcgtcaccagatccttgagcgtttgattatggatgacatcattttgcaaatggcaaaacagatgcagatcactatccccgatcaagtcttagattccactatctcaaacattgccgcccagaaccatatgggtctggatgaattgaaaaaaaatctgactgccgagggtctcaactttaatacctaccgcaatcagatccgcaaagagatggttattgccgaagtacgcaataatgaaattcgtcgccgcgtcactatcctcccacaggaagttgaggcgctggccaagaatcttagcagcgaaaataaccagaataccgagttgaatgtcagcaacattctgattccactgcgagaaaatccaagtcaagcacaggtagaaaaagcgacggcgatcataaacaagattttatctgaactcaagaatggcgccgattttggtaagctggccatcacctattccggcgatacacaggccctgaaaggtggcaatatgggttggagaaaattgcaggaattaccctctctgtttacagaacagctccagtcagcacataagggacaaattattggcccaatccgttccggcgttggtttccatatcctgaaaattaatgatatccgcggtagcaatatgccgccggttgcggccactgaagttaatgcccgtcatattctgctgaaaacttcacctattatgaccgatgatcaagcccgcagcactctgatgaaactcagagaagaaatcttaagtggtaaaaccacatttaacgcagcagcagaaaagcattctgaagatccgggcacagccatgcgtggtggtgaactgggctggaatgtgccaagtacttatgcgccagctttccgtgatgccttagtgaaactcaaaaaagatgaactcagccagcctgttcactctactttcggctggcacttaatccaactgattgatacccgcaaggttgacagaacggactcggcacagaaagataatgcctaccgtctgctgttaaaccgtaaactcggtgaagaaacacaaaactggatgcaggatttgcgtgcctccgcttatgtgaaaattttagatggtagcgatgcacaacaataa

SEQ ID NO: 3815 - DNA, 117 bp, Xenorhabdus bovienii
  Coding DNA location: Contig name=SeqID_16892; Position on contig =177875..177991bp; Strand=+
atgagcgctctccagttcttcatacgtttcccatcatatcaatcccgccttggcggggttattgtgtttacattgtgtttgcatcatgtttatcagtatcagaatgcgcgctggtaa

SEQ ID NO: 3816 - DNA, 1986 bp, Xenorhabdus bovienii
  Coding DNA location: Contig name=SeqID_16892; Position on contig =177973..179958bp; Strand=-
aacctgaacagtaaagacacggacatggaacacggcaagtaccagatggttggccgtcaaggacgcggtaacgcagataagttgatggtacgcgatgaaaaccgctataccattatgaataacgggatatttacctcatgtctgccaggcaacgatagctggagtgttgttggctccgaagtcatcctcgaccgtaaagaagaagtggctgagatctggaatgcccgtttcagggtggccaacgtgccggtattttacagcccatacctgcaactccccattggtgacaaacgccgttctggttttctgatccccaatggtagctattccaataaagaaggcgtgcaattcaagctgccgtattactggaatattgccccgaattacgatgccaccattacgccgaatctgatcagtaaacggggtcttaagctggataacgagttccgttacttaacaaaagccggagcgggtacagtcgcttttgattggcttgggcatgaccgcctgtatgcggatgataaaaagcttgataaaaacctgtcagatcgggagagcaataaccgctggttattctattggaaccacagtggcgtactcaatcaagcatggcgtttcagtgctgattacaccaaagtcagtgattccaaatatttcactgattttacctcgcaatacggcaccagtaccgacggttatgccacccagaaattcagtattggctatgcccaacagaactgggatgcaaccttggcaagcaagcaattccagatctttactgccggaaaagataggaaagcttaccgtgcagagcctcaacttgatctgaattactacaaaaatgatctggggccgtttgatttccgaacccacgcccaagttgccaaattcaccagcgtaggcaaagattacccagaggcaacacgttggcatgtggaaccgactatcaatctgccgctctccaatcgctgggcaagcctcaataatgaatttaaattgatggcaacccactatcagcaagatgttcctgctacgatacagaactctgcgctagagaagacagtcaaccgtgtcctgccactgtttaaatccgatgcgaagatggtgtttgagcgcaccatgtatatgaacaaggattacactcagacactggaaccccgtgttcagtacctttatgtaccttataagaatcaagataacattaacaacttcgattcttccctgttgcaggctaactattccgggctgttccgagaccgcttcttcagtgggctggatcgcatttcatctgccaatcagtttaccagtggcatcaccacccgcatttatgatgaagatttagttgaacgttttaacctatctgtaggtcaaatctactactttgaaagtccgcgtacccaagatactgactccaaagactcaaacaaaaatatcctcaacaccaaaaaaagtacgggtgcgacaacatgggccggagatgttgagtggaaaatcaatgattcatggggatttaaagggggtctgcaatacgatacccgtctgaacagtgtggcaatgggcaatacggtagtggaataccgcaatgatgcagaacgtctggtgcagttgaattatcgttttgttaaccgcgactatattcaagccacacttggaagccaagcgccgtcattccagcagggcatttcgcaggtcgggctagtggcaagctggccgctggcggatcgctgggcgttcgtgggttcatattattacgataccaaagagaaacagccggcaagccagctggttggcctccaatacaacacctgctgctgggcggtgaatgtcggttatgaacgtaaaatcgtcagctggaaggacaacagcagtgaatatgacaacaaatggtcattcaatgttgaacttcgtggcttaagcagcaatcaaagtttgggtagccagaagatgctggagagaggtattctgccttaccagcgcgcattctga

SEQ ID NO: 3817 - DNA, 559 bp, Xenorhabdus bovienii
  Coding DNA location: Contig name=SeqID_16893; Position on contig =1..559bp; Strand=-
ttgagtcagcataatgaatggctcgacggttttctccgaaaacgacacagtgtcagcaagctagttgtccatttgatattcacgacaaagtatcgccggacactttttgatggatgcatgattgaacaactacgggaggctttcacttcagcagccacaaagctcgaatgtgacattattgagatggacggtgagcaagatcacgtacacctattgattgcttacccaacccactcccccatatctctctcttcctgccaaccatctcccccatcaaccagtagcggctcgcgcccagctaaggtatcattgcccgctatactattggccacgccctttacaattgaatttatggcaaaagaacaaactgatcgcaccacactggatttgttcgcagatgaacgcaggccagggcgaccgaaaacgaatccgctgtctagggatgagcagctcaggatcaataaacgcaaccagttgcgcagagataaagtcaaaggactgcgtcgagtggaattgaagctcaatgaagatgccgtcgatgctttaaaccatctggcaa

SEQ ID NO: 3818 - DNA, 102 bp, Xenorhabdus bovienii
  Coding DNA location: Contig name=SeqID_16893; Position on contig =512..613bp; Strand=+
gtgtcgttttcggagaaaaccgtcgagccattcattatgctgactcaattgaaatattcctgtcgcctgttactatcattgaactctatcaatgagcgctga

SEQ ID NO: 3819 - DNA, 1200 bp, Xenorhabdus bovienii
  Coding DNA location: Contig name=SeqID_16893; Position on contig =616..1815bp; Strand=+
atgttaagagccacaaaggtacgcatttaccccacactcgaacaggctgaatatcttaatgcccagttcggtgcggttcgttttgcgtacaataaggctctgcacataaaaaaacatgtctacaaacgtgatggggtgagtttaagcccacgtaaagatcttaagccgttgctggcgacggcgaaaaaatcccgcaaatactcgtggctcaaggcgtatgattccatcgcgttacagcaggcggtcatcaatttaaatacggcttttgataacttcttcaatccaaagttgcgggcaaaattccctgtctttaagcgcaaacacggaaaacaatccagttatcactgtgttggcgtgaaggtgttgaatgaggcaataaaaattcccaagttgactccgatagaagcgcgtatccatcgtgaaatcaacggtgaagttaaaagcattaccctatcgcgaacacccacaggaaaatactttgcctcaattctctgtaaagatggcaaagaacctcccgttcctcctgatgtgatcgatgcagacaaaagcaccggatgtgaccttgggttaacccacttcctcatctgttctgatggtcggaaacaggccaatccccgctatttaatccgtgccagtaaaaacctgcggcgcaagcaaaaagcgctctcccgaaaacgaaaaggcagtaaaaatcggggtaaagcacgtttaattgttgcccggtgccatgaaaaagtggccaatgcccgtggggattttcagcacaaattgtcccgacaactcattgacgaaaaccaagcggtgatagtcgagacactgaaaacaacccatatgctcaaaaaccgcagactggctcgtcatattgctgatgcgggctggcacagctttgtgacgaagctagaatacaaagccaaagaagcggggaaacatctggtcaggcttgacccgtggtatgcgagttcgaaaacctgccattgttgcggtcaccaagaatcggaaatgcccttaagccagcggtactgggtatgtgcagtgtgccagacggagcatgacagagatatcaatgcggcgttgaatatccagcagcaaggcctatttgaattacaggcggcgggtctcgtcgtctctgcccatggaggccagcgtcagacttgtcacggacaagccgcggcctgtgaagtgggaagcctcgcccgatag

SEQ ID NO: 3820 - DNA, 429 bp, Xenorhabdus bovienii
  Coding DNA location: Contig name=SeqID_16893; Position on contig =1834..2262bp; Strand=+
atggtcattactaaggaaatagccggacagccaaccaacaccaataataataacatcctactcattgattcattgcactgggttgcatcaaaagctatatatttcaatgaatttcaagaaattcctcttgttattttttctgaaggttgtgttatccgcgaatgtgctataaaaacgttggagaatgtagataaaccgtatttctttgtgtacgtaagctcctcatttgaaaacataaaaagtgcagtagaacacggattaggggttagcctattgccactcagagcactaaccaatgatttgtatgtattatcctccgaacatggcgtacctagtgttccagcaattaagcttgttttacatattgcagctcaaggggatttatatgaattctttgctgattatctacgccgctcattatcagaatag

SEQ ID NO: 3821 - DNA, 99 bp, Xenorhabdus bovienii
  Coding DNA location: Contig name=SeqID_16893; Position on contig =2219..2317bp; Strand=+
atgaattctttgctgattatctacgccgctcattatcagaatagtatccagaatttcagtttgtgtaaattcgaaaaggaattctcattccttcggtaa

SEQ ID NO: 3822 - DNA, 102 bp, Xenorhabdus bovienii
  Coding DNA location: Contig name=SeqID_16893; Position on contig =2458..2559bp; Strand=+
atgaaaaacacctacataaaattaaaacaaaaaagaagaaggtacaataagtacttgatgttagtgttattgatgacaatattttccgagccttctgattaa

SEQ ID NO: 3823 - DNA, 591 bp, Xenorhabdus bovienii
  Coding DNA location: Contig name=SeqID_16893; Position on contig =2594..3184bp; Strand=-
ttgtcaaaacagacagaaaaacagcgcgctaaacgcaaacaaatcattgatgctgccatctcctgttttatagagaaaggatttcatgcaacatccacagcagaaatctgcaaggcagcaggcatgagtccaggtaatctttttcactattacccaaccaaaaacgccattattgaagctatcgcagaagaagacagccatgactataacgaaattttgcataccaatgatgatgaaaactcggttatggcaacaatagaaaagatgatgacaagcctgatccacctgtataaccaacccgattatgcacgactcagcatcgaaattatcgctgaagctagccgtaaccctacaattaataagatatttatcgaaaatgaaaaaaaagtcagggaacgtttagcgctattaatccgtaaggggattgaaacaggggaaattgataaacagattaatgcggaacagacggcatcctggctaatgataaccgccgggggtgcgatagggagagagttggtagagccgaattttaagtggcttgagagcatgggttcttttacctacatgataagaaaaatttttacgtcataa

SEQ ID NO: 3824 - DNA, 141 bp, Xenorhabdus bovienii
  Coding DNA location: Contig name=SeqID_16893; Position on contig =3247..3387bp; Strand=+
atgttattatacagactaaatgtttattcttcttatttaatcgtcagaaatagttttatgagtattacactcataaaaatgcttaaatgttatttatgtccggctgttaatttgcacaaaaacatgccggacataaaataa

SEQ ID NO: 3825 - DNA, 3084 bp, Xenorhabdus bovienii
  Coding DNA location: Contig name=SeqID_16893; Position on contig =3392..6475bp; Strand=-
atgaaatatcagttatccgaatgggctatcagaaaacctattcccacgattgttatttttctggcactcactgtcgctgggttattttcctttttgaaattacctatcaatgcaaaccccgttattaattttccggttgtgactgtgactgtcacacaaaatggctcatcgccttccgaattggaaaatgcagttacacaacccatagaacgcgcagtttctggattgccgggcattcgacatattaactcaacgataacggatggcgtatccatcacgattatcgagtttgatttgaaaattgatccgcatgttgccacaaatgatatccgggagcagattacacagattcgttcggaattaccccaatcaatagatgaaccgctgataagccgtattgatgtagagggtagtgctatactgaattacgcagttcagtcaaaagataagaatttgactgaattatcttggtttgttgatgacaaattaagtaaaaagttattaatggtgccaggcgttcagaaaataacaaggctgggtggaaccaataaggaaattttgattgaacctgatccggtaaagatggctgcattgaagatcagtgttgcggatattaaccagttattacttcaaaataacgtcaatattcctggcggaaaaatggtcgtcgcaggacaagatcatactattcgtattttaggtgcaaagaatgaaatagattatttacgccaattaaaacttcctttagcaaacgataattggataaaactgggcgatattgccacggtcagagattcacataaagaaaccatcaccattgcccgcttaaatgatgaacctgttgtgggtttcgccgtattccgcgctaaaggttcaagtgatacagaggtagaaaaaggggttgtacgggcattacaggagactggaagagagtatccggatgtcaatattaaacttgtttcatcaaatgtaaaatatacggtggcaagttataatgcaaccatgcagacactgatagaaggcgcagtattaactgtcattgtggtatttttctttctcaaaagctggcgagcgacattgattgcagccattgcattgccattatctatactaccggcattttttatcctacatttatttggttacactctgaatagtatcactttattagcattaacattggtgataggtattttagttgatgatgcgatcgtcgaaatagagaatatagaaaaatatattgaaagaggtgaaagaccttatattgccgctatcaaagcttcagatgcaatagggtttgcaatagtcgcgattactattaccattgtcgctgtttttctgcccgtcagttttattggtggttttatcggtaaatattttgtccccttcggcattaccgtatcagcggcagtattatcatcattactggtcgccagattggtgactccactgatgtccgcctatctgctacagcctaaaaaacaccagaaaacggataaaacagagacaccgaaatggataaagaaatatctttctatcctggaaaaaacattaaaattccgcaaaacagcgttgctgctagccatcgtctttcttttgggatcattagccctggtagcactgttaccatcaggttttatgcctaaagcggatatcagtatcaccacaatagaagttgaagcaccacccggaacccaagcagcgcaaagtgatgaaacgttgcagaagattattaaaaaactgcaaggccgcccagaaattatcgatattttttctgttgctggcgttgatggctcctctggcgagattagccagaataaaagtaacattattataaacttagtacctacgggtgaacgtgactggtcacaaaaagaatttgagcaatcattggttcctatcttaaatgagattccagatattcgatataactttggcaatagtagtggcagccgagatatttcgattgttctggccagtgaaaacccaaaaattttgtctcagacaataaaacagttacgtcaagagatgatgcagttggagggattgaagaatatccagctcttgcaacccttgccaagacgggaaattatcataacgcctaatgttgatacagcagccaaagctggcgtgacaaccgatgcaattggcactgtgattagaacggcaacaataggtgaaatcaattccagagtcgctaagtttaacttaccagataggcaagtcccgatccgcgtcttattatccaaagaagacagggataatctgaccgtattaaatgatctgtacgtgaatagcacatcgaacgtcaatgttcctgtgaaatcggtggcaaatatctcttttgcctcaggccctgacaaaatagaacgaattgccagacagcgtaaagcgagtattgatgcagatcttaatggtattgcggttggcacagcgtttatgcaagtcaatgaattaccgacaatgaaaaaattgccgccggaggtcaaaagagtcgagtatggtgaagttgaatatatgaatgaaatgtttgatcgtttcacgacgaccatcatgctcagtatcatgatggtgctggctattcttattattctgttcaaagattttttacagccaatgacgattttaattgcgctgccatttgctatcggtggtgcgattatcgcattgcttatttatggtgccgccattgatctgcccgttattatcggcatattaatgttgatgggcatagtctcaaaaaattcaatattattggttgaatttattctcgaaaaatcccgcaacggtatgccacgaaatgaagccattattcaggcaggcagagagcgtgtcaggcctattataatgacaacgattgccatgattgccggcatgatcccgctggtcattaccagcggcgcggatgccagtttccgggcgccgatggcaatctcggttattgggggactactcagttcaactttactcagtttactgtttgtaccggttatttacagttatatggatgattttaaaaactttattactccacaccttaagaaatttacctcagtaacgaaagacgatctcgattatcactga

SEQ ID NO: 3826 - DNA, 1107 bp, Xenorhabdus bovienii
  Coding DNA location: Contig name=SeqID_16893; Position on contig =6477..7583bp; Strand=-
atggcaagaaatcttctatctcttcttggcgtttgtttttccatgttcattttcagtacaaatgcccagtcaccccaagagcagatgcatgtgtcaaccacgaccatgcaggctgtacagttcactccctctgtcaaaatattgggatcagtagtagcaaaaaatgagattgtgataagcccggcgctccctcagcatatcatcacagaagtgttggttgaagaaggcgactatgtcaaaaaaggtgatgtgttagctacattagaaacactggttcaggatgaaaaagtcaaacaagccaaagcggaactggaaaaagcgctggctttgataaaacagaatgaagcgacgagtaatcaggcacagtccgaacttaatcgtgcaaaaccgctggtaaatacaggggtcatttctgccagtgaatttgacaaatacaaaatgcaggcaaattcatccttatccgccttaaatgcggcaaaagcagaatatcggcagttacaggcacaattagaaggggaaaaaacccagcgggcgaaaacaaccatatttgcacccaaagaaggcgttatcagtgaacgaactgcgatggcaggtatgataaccgatagcagtcaactgtttaaactgatcgaaaataacctgcacgaattctcggctgaagcctatatttctgatttaaaacaaataaacacaggaatacctgcggctatttctctcacttccggcagcaaaataaccggtaaagtgagatatatctcgccgaaaattaatcccgttacccaaataggaaaaataagaattgcgctcgaaaatgtccccgccgatgtcaaactgggggatttcggccatgccttatttcagcttaaaccagaaaaagtcaacgccattccttatagtgctgtcaatatgggaaatgaaaataaaccgagtgtctatgttgtcggtaaaaataatgccgtagagaaaaaagaaattaatacagggcgtatttttgataactggattgagataaaatccggcttatcgccaaaagataaaatcattgtttctgcatctccattcctacaagaaatggatactgttgccattatgccacagggaaaataa

SEQ ID NO: 3827 - DNA, 156 bp, Xenorhabdus bovienii
  Coding DNA location: Contig name=SeqID_16893; Position on contig =7727..7882bp; Strand=-
ttgggcaatgatatcgacgggataatggcggcgtttgaacgcgtttcggatcaggaacatcactctggactcattcaaaaacaggagagcttacctgatattacgttaatgcgacagaaccgacagctttgccgctatgaaaatgtacacagttaa

SEQ ID NO: 3828 - DNA, 261 bp, Xenorhabdus bovienii
  Coding DNA location: Contig name=SeqID_16893; Position on contig =7882..8142bp; Strand=+
atgtgtccgtgggtatctgacctacgtgctgagcttacgcaatctggaggaaatgagggcagaacgggggatcttcgtcgaccacgccacatcgctgggtgttacgtctggtacccctgctcagcaaggctttccggaaacgcaaaaagcctgttggctcccgatggcgaatggatgaaacgtacattaaagtcaaaggccagtggaaatacctttaccggtcggttgataccgacgggcagaccattgatttcctgctga

SEQ ID NO: 3829 - DNA, 210 bp, Xenorhabdus bovienii
  Coding DNA location: Contig name=SeqID_16893; Position on contig =8052..8261bp; Strand=+
atggatgaaacgtacattaaagtcaaaggccagtggaaatacctttaccggtcggttgataccgacgggcagaccattgatttcctgctgacggctaggcgggatgccgaggcggctctacgctttttctgtaaagcgatacgccagtacggcagaccgactgtggtgactattttgttttctttagcaaaaactttgctcgtgccttaa

SEQ ID NO: 3830 - DNA, 990 bp, Xenorhabdus bovienii
  Coding DNA location: Contig name=SeqID_16893; Position on contig =8318..9307bp; Strand=-
atgaaacaattatctatcacagccctggtattttctcacacctcggtgacatcggttgctatgccgattgaaatactcaccatcgccgccaatgccattggcggccccattccccatgtccgcattatctcgccagcaagccaggaaatgaacggaaccaatagcctgttgactgaacccgccccgacttcccattccgatctctatcatggccaacaacccgatattattctggttggctccctgggtttcccggtatggcagccgcaatactgctcaccggaaataatagagtggctcaaggcgatggatgaaaagcacattcctatcgtttcagtctgctcaggcacattcatccttgccaaagccgggttactgaaaaccagcgcaacaatccaccctcatttttcccgcgaattcaaagatctatttccccatattcccctgtatgccgacaaaaaaatcacccgtgacaataaccgtttctgcatttccagcgcctatgggtgcagcaaaagtatgatgagtattgttgagttgatttacggacaatatgccagagaacaatgttcacaattcttgtttggcgaaaatgaccccaaaatttcgtctgattccgtcagttttgccccttatcgtcaacattcagattctctcatccacaaactacaagattggatgcacacctcaccttccgaaattttatccgtagccgacttagccaacaaaatccacctttgtgaacgacaaatgaaacggcgcttcaaaatcgccaccggaaaaacccccatccagtatatccagcagatacgtctgtcacaggccaagcactggctggaaaaatctcagaaaaccatcgaagaaatcagccatgaagtcggttacgaagatacccgttatttcagggagttattcaaacgctgcaatggtctgacgccaaaagagtatcgccaaaaatatcaccatagtggaagtttttctgtgggctag

SEQ ID NO: 3831 - DNA, 2163 bp, Xenorhabdus bovienii
  Coding DNA location: Contig name=SeqID_16893; Position on contig =9420..11582bp; Strand=-
atggttgacgcattttcctttacgagtgatgcaggcacggatgatctcaccaataatcacgcactggattgtgtcgcctatctgggaacacaatttcataaggtcgcctccgtcagacaattgcatcatgcgctgggtctggattccctgacgctgacagactggcagctacgcgaggctatcgatgccatcggcctgcacagcaaatttgatcgtctgacagccgataccgcagccacgttgcctttaccggcactgattgaattagatcagtgctggtgggtgctgctcgaggtcagcccagaccagtttaccgtgctcaatcccatcacggaaaaacaagaaatacgcccattgcacggcacacagacgacacctgaagaagctaaacacagtgagtataaaatcctgctggtggcagataaatttctgaccaaacagcaagttaaattcggtttgagctggttttatccttcgattttcaggcagaaaaatcagttgcgggatattttcctgttcgccattgtgctgcaactttttgcgctggcatctcctttgctgtttgaaaatgtcatcgacaaagtactggtcggacgcagcttatccagcctgcatgttcttggtctggcgatgctggcgctagccgtagcagaacccttgtacggttttctgcgcaataccgtgttcggacatatggcaagccagatcaacgcggaactctccggcaggctttaccgccatctggtgggattgcccctgccctatttcaagcaacgccaaaccggacaaattatcgcgcgcgtcagagaaatggcacaaatccgccaattcctgaccggctccaccctgatgttgctgctcgacctgatcttcatcatcctgttccttggcgtcatgttccattattccactctgctgacctggatcgtaatcagttcactggcactctatttcctgctttggatcgccatcgggcctctcatccgacgcaaggtagaaaccgaatatgaagccgatgcccatgccaccagtttcctgacggaatccgtcatgggcatcgaaactatcaagaccacggcaacggaaaaacgctttctgtaccagtggcaaaaagtgttaagccagcaattgatccgacgtttttccgcccagaaaagtgggcttgcggccggacaggggatcgctttgatccagaaagtcgtagcggcattactgctatggtggggggtcagaagcgttcttaacggcgaattatcccccggagagttaattgccttcaatatgctggcaggacacgtcacccagccgatcttacggctggcgcaagtctggcaggatttccagcatactttgatcgctttgcgacgggtcggcgatattcttgatgagccaatggagagtagcaaacaggggctggcagcttcccctgaacttgccggccagattgagttcaggaatattcgcttccgctatcacacagatacgcccgaagtactggcaaatctgtcactgaccatcaaagcaggcgaatttatcggcataacggggccatcgggttcaggtaaaagtaccctgacccggttgttacagcgtctgtatgtgccgcagcatggtcaggttctggtcgatggtatggatttggcgatcgccgatcccgtatcactccgacgtaacatgagcgtggtattgcaggaaagcattctgttttccggcagcattgcggacaatatccgtctgtgcaaacccagtgccagcgatgaagaagtctaccgagcggcgaccttggcgggtgcaactgacttcatcaatgaatttccgcataaatttgcccatcctgtcggggagaaaggaagcaacctttccggcgggcaacggcagcgtatcgcattggcaagagccttattgaatgatcccaaaatcctgattctggatgaagcgacttccgcgctggattatgaatctgaggcagccattatgagcaatctggacgaaatccgccgcaaccggacggtcatcagcattgcccatcggctgaatacgatccgccatgcggataaaatttttgttttagatcaaggaacaatcgtcgaatcgggctcccatgatgacctattgcaacaaaacggactgtatgcacaactttggcatcaacaaacagagtga

SEQ ID NO: 3832 - DNA, 1356 bp, Xenorhabdus bovienii
  Coding DNA location: Contig name=SeqID_16893; Position on contig =11585..12940bp; Strand=-
atgtttaaggccatcttacgcaaagggattaaaaacctacgtactccttcgcccgattatgattttttacccacacatctggccttgtcacaacgtcctccttccccgtttgcccgttatacggcgatcaccttgagtatcggggtactggtggtactgttatgggcgtatctgggaaaattggatgtacaggcaaccgccaccgggcgtctgatagcttccggccgttcccaaatcattcaggcttatgaacaaagccgtctgctctctattcatattcaaaatgggcagcacattgaaaaaaatgcccctctgcttacgctgaatacgctcggcgttaatcaggacgttacacgcctgcttgaacaacgtgaatatctgatcgaagagaaaatccgctatcaggcactgctcgggaaacatgatcccgaatcactgcctctctttcagcagcagactctctcccaacaagaaaaaatccaggcgcattacgagcacgaaaagcatgaattcgatgccattatcaccaatctttatgctgaaatggacgtcaatctctcttctcaaaaagccaaaaacggggatattcaggctctgaccaacctgcgtgaaaatatcaatcagcgcttgcaggcacgaaaaatattgagccagaagcaggtgattagccgagtggaatatctggaacaagaaaaagaattgctggaaacacaacggataatcactcaacaaaaagcagaactaggcatcttgatgacccaatacaagagcctggaagagcggttaaaggggatcaacacgcaaaaagagcgggaatggtttgagaaaaaaaagcaggcagagatgcaactgggcgtgctgaaacaagagctttcaaaaatgcaggaacgagaagcccttgagatcgtgcgttcccctgtggcaggtacggttcagcaattgagcgtccataccctcggcgcggttttacagcctgcacagaatttgatggtgattgtaccggatgaccatgtgcaactcgcggaaatccagatcctgaataaagatgtcgggtttgtccgccccggccagcatgtgacggttaaagtggatgccttcccttatacccgctatggcaccatcgaaggcgaactgctcagtatttcacgggattccacgaccgatgagcgcctgggtctggtttttccagcgcaaatcagcctcagacagaacaatatcatcgttgatggtaagcctgtcgaaatcaccgccgggatgtccatcaccgcagaaatcaagaccgaccaacgacgggtgattgattacctgctcagtccgattcaggaatatcagtctgaagcgttgagggaaaaataa

SEQ ID NO: 3833 - DNA, 2058 bp, Xenorhabdus bovienii
  Coding DNA location: Contig name=SeqID_16893; Position on contig =12933..14990bp; Strand=-
atgatatctaatggcaagcccatcgttatacccgataaaaacataaataataatgatgattatctttttactttaaataaattaaagaaagaacatcatatttctattaaaaataaacgttcaataaataagaaattaaacacgttatctttacccgctattctgttcgatggtaatgggcatccctttattttagcaaaacatgatgaacagcgagtgttgattcaaaaacctaatcaggaagcgcctgagatattggataaagaaaactttatccgtttatggagcggacgctggataaaaataaaacaaaaaagtaaccaatttaatatccgctggtttattcccgaatttatccgacaaaggaaaaatctgactgaaattctgctgttttcgttcattttgcagattttagcgttgatttctcctctggtcgtgcaggttgtcatggacaaggtactcgttcatcaggcgttatctaccttagatgtgttgatttttggtctggtggttgcgagcctgattgaagtggttctgcgtgggctacgcgaatatcagtatgcccatacagccaatcgcattgatatcaaactggggttaaagctggttcggcacctgcttggtctgcctttgctgtttttcaaattccgccaagtgggagcaattgtgacgcgggtacgtgaactcgaaaccgtacgagagtttttaaccggttccatgttcaccctgtgtattgatgtcctgttcatgttcgtatttatttacgtgatgagcctgctatccggcactctgactttgctgtttttggctaccatccctttctatggcctgctggcatggtgggtcacgcccaaaatcgagaaagccgtcgaaaagcaattcactcatgctgcgatcaatacctctttcctgaccgaaaccgtcgccggtgccgagacactgaaaagccttgcagcggaaccccgctttatccggcgctgggatagccagaccgagaatatggtgagtaccagttatgatgtgcagcaatgggataaccgctccagccatcttgtgatgctgttacaaaaagtcaccagtgcggtcattatctggcttggtgcctccgaagtactctccctgcacatgaccatcggccagttgatcgcgttcaatatgatggtaagccatacccagcaacccctagccaagttagtgcaactctgggggcaatttatccgttcacgcattgccattgataaactgggggatatgttgaacctgccgacagagcagcagtcaggcaaagagcgagtctcattgcagggtgctatttcattctctgatatcgtatttcgctatcagcccgatctctccccaaccatcaaccgttttacgctggatattcgggcaggagaaacgcttggcgtagtaggaacatccggttctggaaaaagtaccctcgcgcgcctgttacttcggctttataccccggaacatggcaccatcacactggatggcattccattgcaagagttcaatattgaatctctgagacagcaaataggcatcgtgttacaagaaaattttctgtttaataaaaccgtacatgaaaacattgcccaatcacgacccgatgctcctctgtctgatattattgaagcggccaggctggcgggtgcacacgattttattctcaagctgccgatggggtacgacaccatcatcgcagaaggcggccaatccctctccggtgggcagcgacagcgtctagccattgccagaaccctgctgtctgatcccaccattctgatccttgatgaagccaccagcgcactggatgatgagtcacaatcgattattcaatccaatatggcaaacattgcgcagggcagaactgtcattaccatcgcccatcgactctccacggtacgccaatgcgaccgaatcattgtgctgcaccaaggtcaaattattgaacaaggtagccatgaacaactgctacagcagggcaagcagtatcgaaaactctggcaattgcaacaggaactgaaacaggaggtgacttcccatgtttaa

SEQ ID NO: 3834 - DNA, 111 bp, Xenorhabdus bovienii
  Coding DNA location: Contig name=SeqID_16893; Position on contig =14947..15057bp; Strand=+
atgtttttatcgggtataacgatgggcttgccattagatatcattattattaatttaattaatgatattgttgttttttctatttcattcataggggtaaatttattttaa

SEQ ID NO: 3835 - DNA, 102 bp, Xenorhabdus bovienii
  Coding DNA location: Contig name=SeqID_16893; Position on contig =15313..15414bp; Strand=+
ttgagtttgggcagcgttcaaaatctgcgtgtactcattcttaattttttaacaaatgttgtgttcatgttatttttgtctggtatttcctattcaagttga

SEQ ID NO: 3836 - DNA, 366 bp, Xenorhabdus bovienii
  Coding DNA location: Contig name=SeqID_16893; Position on contig =15554..15919bp; Strand=+
atgtctgaaaaattcgttcaaaccatttcaagtgttaattataataaaggcgtgttctctctttattttgttggacaagagcccaaccgaatggcaaatggcatactggctgaaaacgatcaggaattacaattaaagcaagtgattcacatgcctgcatccggctttatgtatatggtttccatggtgaaaagtatgcttgaagaccctcggatggaagccgaaatgaataagctgatcgcagcagggttcttgcctgtacctgaaatgagtgaaggtgaaatgccagccgagccggaaacggctgttgcagagaccgttgagcctaaaaaacgcccagcccgcgacgcggaaaaatcaaaataa

SEQ ID NO: 3837 - DNA, 462 bp, Xenorhabdus bovienii
  Coding DNA location: Contig name=SeqID_16893; Position on contig =15961..16422bp; Strand=+
atgatgatcacacatcaacccgcaacgctgagtgacactgaaatacaggcaatgataggtggggtgatgttgctttgtcagcattcacccttacaccgacgctatttagttgctgagtggcaacagcgtatctttccttcattccagctcaatcagttttgctattacgaagatgaacaccaacgcccagttgcattttgtaattgggcttttttgtctgatagcagtcgggatgcgatcctttccggtgaacgggagatttcgcaggaagactggcgttcaggacaacatatcttttttccggaaatgattgccccttttgggcatgcgaagggtatcgcccgtgatcttcgccggcgtgtctttgcagcatggaaggggcaaaaagcctgtactgtccggggaatgctggacacacaaaatgaccactgtatccgtcgggtacagtggtttaccgtttaa

SEQ ID NO: 3838 - DNA, 14151 bp, Xenorhabdus bovienii
  Coding DNA location: Contig name=SeqID_16893; Position on contig =16450..30600bp; Strand=+
atgggaaaatcatccaaccgaagtgcggcatatgcctttaccggtaaatatgaagatgataatgatggaaatacaatacacgccatcggcattggcggcgtcattaacgcctatggcgggaatgatcacattgtagtgggttccgttggtgcaacagtcaatacgacatgggggcacgatactgtcgtgggggcggccgggtatctggatattaacgatacgagcggtactctgacggtaaaaggaggctcaggttatacctccatcaataaaacaagcgatggcacgatagattttgctggcgctgccggtggactgaaaatcaatcacacaggtgataaaggtcgaatcgattattctggcgcgtctggctacaatggcatcacccgcaagggattggaaggaaatttcacttttaagggcgcaggggcgtataacgaactctggcatgaaaccaatcagggaaatttctattttgccggcgcggggggtggaaacaagattgatcgcacatggttcaaccgttatcaggggtctaacggtgatctgacctttgaaggcatcggtgcggcaaacatcatcagctccagagtcgaaagtggtgatattttttttgcgggcgcaggagcggctaacaatcttgtccgcagaggaaaaattggcaacgtcactttaacgggcgcaggggcttctaaccgtattgaacgtacccgccagacggatgatgtctattctgaaaccagaggcgatatcaagttcgaaggcgctggcggttataacagcctgtactctgatgttgcgcacggtgatatccgttttgcaggagtggggggctataaccagattacccgcaagggcacagcccatgacttcgataacgaaggcatggaatatgccaaagccgaagacattgtgttgaaaaatgcgaccctgagtggtaagtggattggctacaacgagcaggtgacgggtcttaaatcggcacaggaagcgaacacttatctgtttgcgtttgctgatggcatgtataccaaagtcaacaaagttcagctccgtaatgatcctgaaaccggcaaactgatctatcactcgacggcttggtacaagaatgggaaccatcttaaagaccttgagaagcaggatatctctggtgaaggtggttttgcgggcgtcaatattgacggtgcttacaccctgtcaaatctgaccgttgaacaccagcaatctgttaccgtccatgctgttgaggaaaaactggctgaagaccaatggatgaatcatggcgatggcgtgctggttaatgtagcagatgtcacattgtcaaatgctaaaatgggtggctatgcgattgacagtaagggaggcaccgccgatgtacaggtggtgaaatccaaccataaatcgaacacttatatctatgccaagcgaatcgataaatataccaaaattgtggttattgaactgaggaacgatccaaaaacaggcatgctgcaatataacgcacaggcttggctcagtttggaagatcgcatggcgaaactggcgaacgaagatatttcttctgctaatggctatcaagccgtgccggcgggtatctatactctgagcgatcttcattacagtgctaaggcagtacgtacagcttcagggcgcgtatctggcatgcacgaatacagtgatctggcgttattcaaagcgccgacgagcagcggtaaaagttccggtgatgttcactatacaggcgcaggtggcggtaacgttatccactccaacgttacccgtggcaatgtctactttaatggggcaggcatcgccaatgtgattgaacatacttctgagtttggtaacacggaatttaatggcggcggatcggcgaacgtcatagtcaaaaaaggcaaagaaggcaacctgactttcaacggtgtcggaattgccaacgtcatactgcatcaagggttgcgtggtgacatggacgtgaatgccggaggagcggccaatatactggttcgcgtcggtgatggccgctatctcgctcatcttttggcggtcggcaatatctccattcacaagggcaacggcaacagccgcatttcaatgggcggtggtttcaatacccacacccaaatcggtcatggcgacgcattctggtctggtgtcggtggcttcaatgtcttgactcaaatggggaaaggtcatgtttcctccattctgctgggcggtgctaacgtcctgaccaaagtcggtgaaggcgatcttgaatccgccatgttaggcggcgccaacatcattacccatatcagcaattatcgtgaaacgtccaacacgaaagccatcgcactgggtggtgccaatgtcctgactaaaaagggcaagggagacgtattgtctgtcatgggcggcggtgccaacgtgctgacccatgttggggatggcaaaaccaccggtatcctgctgggcggcgtgaacattctgaccaaagtcggcaacggcgataccacgggcatcatgttgggtcttggtaacattctgactcatgtcggcaatgggcagacgctgggcgtgatggcggcggcgggtaacattttcaccaaagtgggcgaggggacaaccatcgcggctatggtgggggcaggtaacattttcactcacgttggtcagggaaatgcctgggcactgatggggggtatcgggaatattttcaccaaagttggcgatggtgacgcactggcattaatgctggctgccggcaatgtgttcacgcacgttggtgatggtatgagcgtggctttgatggttgccaaaggcaacattgcgactaaagtcggtcatggtgaagtgctttctgccatgattggcgagggcaatatccttacccagattggtaacggtgacacctttgccgccatgctgggtaaggcgaacattctgactaaagtcggcaatggtctgacagccgggctgatggtgagtgaagccaacatttatacccatgtgggtgatggaaccagcatcggcctgtttgtgggttctgtcaacgtgatgaccaaagtgggtaatggaaccacccttgcggccatgtttggcaaagctaatatcatgacgcatgtcggcgacggtttgactggtgtccttgcattgggcaaagccaacatcatgacaaaagtcggcaacgatttcatgggggttgttgcggcttctgaggctaacgtggtgacccatgttggtgatggtactacagcagccgtgctgcttggtaaaggcaacgtgttgaccaaagtgggtgacggaaccaccgtgggtttactgatttctaaaatcggcaatgtcatgacccatctgggtgatggaaccaccatcgggttcgccaagggtgaagccaacatcatgaccaagttgggtgatgggttgggaatcaatgccgtttggggcaaggccaacatcatgacccatattggcgagggtgatcgttataactttgccaaaggtgaagcgaatatcatcactaaagtgggtgatggccaggaagttaccgtagtgcaaggtcaagccaacattgtgactcatgtgggcaagggcgatgattacacgggtgcttggggcaaggccaacgtgatcaccaaagtgggtgacggacgtaatgtcgtacttgccaaaggcgatgccaatattgtgacccagattggtaatggagacagtttcaatgcactgtggagtcagggcaatgttgttaccaaagtgggtgatggcatgcaagtcacggcagccaaaggtaagggcaacatcacgacgactgtaggcaatggcctgagtgttaccaccgttcacggtgatttgaatgtcaataccaaagtgggtgatggcgtttccgtcaatgtggcctggggcaaactcaacgtcaatacccgagtgggtgatggcctgaatgtttccgtcatgaaaggtcaggcaaatgccaatatccgtgtgggtgacggcttaaacattaacgcctcttatgcacgcaataacgtggtgattcaggtgggtaatggcgatttttatagtcttgccgttgcggaaagtaataccgagagcaataagctgggtgccttatttgacaacgtgaagcagacactgcttggcgtggcgggcagtaagggtattagctatctggttaatggcgacgaagccaacacatcgggaactcataagggacgcggtgccattaatctgcccgaagtttccgcgctgaatggtttccagttgactgaaatggagcaggtcaaatctgatttgcagaatagcctgaaaggttcggtgacgggcgttgataccccggacactgacagtatccagaataccttgggcaatgaaaaacggttgagctctaatcagtcgcgcaatctcattgtcaatggagactttgagcagggcgcagacggctggcaatccaccaatggtattgaagcctattatgctgcacagtcctatggcctcagtaatgagggtcatggcgaacgtgttagtgagctcgatgcttatacccatgctgataaggattctaataccagtatttatcaggatattagtgatctcacggtgggcgaatccatcacgctgagttttgattttgcaaaacgcgccgatatttctgctgacaacggtatggaagtactgtggaacggaaaaaccgtattctcaatttccgcaggtaacgcggaatggcagaataaaacattgtcattaaccgcacaggagggcagcaaccggctggagtttaaaggcacaggcacaaatgatggtctgggctacattctggataatgtcgttgccaaatctgagctgccagacagtgccattgctggccatgtgcagcaggacgccgccgcacagaatgcgttacaggataaagaaaaagcagaagcggatcgccagcgtttggaacaggaaagggatacacaactggccgccgtttctggctctcgagcgcaattagaagccacggatctggaggctttgaatgggaatggacaagaccagtgcgatgcaataaataatgaagccgaagctgttaccgaagaattggcggagaaagtcaaagggctggcaacactggatagctacggcaagcatcatgggaaatccggtgaacagtggcgtgctcaatttgcgggtggtttgttaggacaggttcagacacaactgaatcgtgcaaacgacacagcacagcagcagttggatcgctcacagcacgcggcttcagaacgtttcggtgatctcagggacgcggtggccaaatcagaagccggagtcagcaaaggcgagcaacaccagcagcagtctcagaaagagattgaacagacccgcaccaatgccgaattcaggaagcagcaagccttaagccaaaagaaacaggctgaacacgctgaaagtgacgctaaggccgcagtgcagaaagccgaacagcgtggtcaacatgaagtttctgaggcaggcagccaaactgcacgggtgcaatctgatgtcaaagccgcaaaacagagtgataactacaaaccgaaccacgcgggtgcagcaggcagtggcttgtcaggcactgcctatgagtcccatgccgctgaaaaccagcctgagcggataaaaacggataatcctatcggttttgcaccgaaagatgagacaaataccgggttcagtaaggaattacaatatctggatgaagacctcgacgagctgactgaggcaaaagcagcattgaatcgcttacagatcaatgcagcaaaacgcggtaaaagtaccggggctaccctgatatcggcttatacagaaacgtctgccagtcagcctgtcagcaagaccgcagatgtgcctaccgaatgggtcagaaacacgccgaaaatttccggtctggatctcagtggcctgcaagcgctgggtgaaacccatgttcagcagggatctactgatgcacccgaagcgcctgccactgccataagagcacaaaaagttgcagatgtttaccgttggctggacagtgacaacaatattgccacagatacctatattccggtgcctgggtttgatcgcggtgatgctgatattcccgataacatcagacagaggttggtgacctttgttgagggataccttgaggggactgacaataatgtgccgaaagagcaagtcgctccgctggcgaaactgttcgttgatgccacgattgattgtaactgggataagcgtgtcgaattcgtctctaagctggaacaatatggctatagttttgagcctgtccatggtgataaaagcatcgtgtcgttctggtctggcaaaaacttcaagcaataccgcaatgttcttgatgccgtgcagaccgacggcaagaaagtggtctacgatattgatgtgaaaggcaactcttttgccatcgaactgaacaaaaccctgatgcgttggggcaacgtatatctcgattctgacaatgccgaacataacgcattacaaacggccattaatgcttcggcacggagcaacaccgggttctggagctccctctatgccaccggatctcgtgatgacgtgtatgtcattgcagaagggggattgcgtcttggcaactatttctggaatgttgaactgccggtactacgtcaattgcagcgtgaagggctggtgggcgaaatccgtctgctggataaacctgcccgtgaatatcagggcgcagcacctgaaactattggccgcaggctgacggaagccggcgtttctgtgaaggcacgttttgattctctcagcattggagaacaggaaagactacttacgctgaatccggcagggtataagcccgatacactgattgatctcgacataaaactgagcgccatcgacaacatgttgaatcaggcattgccattctacggactgcggacagagcgcaacctgctggtacgtgaagctgatgatgaaggctttgaagtgcgccggtggccgggtcatgacggtgatgatttcaagacgatcatggtggaagatgcggaagatccggctcagatcaaggctattgagcgtttcatcctcgccaactacgacgattacggaaaactgccggatgccttgtatttggtggcagaccagattgtttcccacgagcaggggcgtacccgtatcgtggctaaaaaagtggatggcagttggaactacaagccgaagactgacttgatgtctgtcagtgagtttaaggatgcggcttccgttaagggtaaaatccttggtgacagttaccgcaacgtactggaagcgctcggcagttacgaaaaagccctgcaaaacggtgcagactatgacttggatgccgtggaaaaactcatcagcctgcaccagcaagttgaaggctatctattagggcatcctgattcaaaacgcttacccgccatgacaaacctgctatcacaaatcaatgtgcgcatggaagaatcgcgggtactggcggaacctacgctgacaagtacgggcaagggcagtttcagtgagttgtataacaaactcggcaatgccaatctcaaagattcgaagcatctttatattgatgaacagggtgattttgttacccgtggtaaatccaatattcagctagtgatgaaagcggaagagacggaaaaagcggtcaggcagatcaaagtagctgtcaccagagaatatggtcaggaagtggcagaaaccgtcttctcaaacctgaaaccccaagatttgtcgaaagatggcaacggcatcgatgtgtctggcttgagaaaggtgcatcaggcaattgaacagcaactgtctccggtcagtgccactctgtttgtctggaaaccgagcgatcacagccgactgggacatgccgccctgcaaattgggcaaggacgtattcaggttagcgcagaagatgccggaggcttcaatgagaaaaactatgtgagctggtggccgaaaggcggtaaatcgaccagtcctggacacatttttaatgtttccacggcagaaaatccagacgtgaggttacgttggcgtgatctcagccagccggcttctcagaatgagacgctgaaatttgatgtcggctctgaagaaggggataactttggcttgaaggatggtacatacaagctggagaaatttattgaaaaactacaggctgccaaaggcgttgatgcaaaattcgaggatatcagcgagggctttgccatgtctgcgctggctaaccctaacctgcttaaatcagccggtatacctgagcatatttcccgaccgtttatcgaacaatgggaaaatggcaacattgacatgcaggacattggccgagattttgccgaagcactgcggacagccgcgaaacagaaaatcacgcctgagctaactgaaaaacgcatcactaatatcgttcgtcagtttgccgaacgtgaattgagcgacattcaggatttcaaggccagcgaagccgatcagggacgtgtattccgcatcaatctggcaggcttggatgccgcggcaatgcaggcagaatggaacaaaattagccagaaccctgatgcccgctatcaaatattgaacggtaactgttcaagtatcgtagccaaagtgctcaaggcaggtggagccgataaagtgatcggtcatacatggcggccaaactttggtatctggaccccaaccgaattattcaattatgcgcagaaactgcaagaagcgcagattgagagaatagccaataagccgaaacgcattgttggtgaagatctggaagcgctgaaccagcaggctaaaaaagacaacgtgctggaaaaagttgccattgacaacgacggcaaaccaccgcgtgacagagaacccttcaatccagtaacccgcttcctgaacaatgagctttacggcgctaaggaagatcgccgcaatgtgcatggttacactcaaacggcgctggacacggctgtgaccaacggcacggcggataaagtcacgttacggggcgacgctgggcgtctgaccggctattaccatcagggcgaacagaagcctgatgtagcaaccgaaccgaatgcagcgaaaaaagtagtcctgttcattcatggttctggctcctctgcggaagaacaagccagtgtcatccagaaccaataccagaaacagggtatcgatatgctcgcggtgaacatgcgaggttatggttccagtgatggtcgtccgagcgaaaaagggctgtatcatgatgcccgcacgatgttccgttatttggtcaatgatcgtggcgtcaggccggaaaatatcattattcatggctattctatgggtgggccaattgcggctaatcttgcccgttatgccgaacggaacggacaaaccgtttctggcttgctgctcgatagaccaatgccaagtatgaccaaagcgattactgctcacgaagtgccaaacccagcaggaatgacgggcgtactggcaaaatcggtcaatggccagttctcagtagagaaaaacctgcaggggatctcgaagcaaaccccaatcatgttgctgaccgataatgaaggtttgggtgaagcgggagaaaaactgcgcgctaaactggttattgatggctatcaggtatcgggtgaacataccttctatggtcatgaggccagcagccgcttgatgaaccaatatgctgaacagattgtgacaggtttgtttgatgtgaagcgtcagccggatgaatcaacggcacttaaaggtatcaagagtgatctgaagcgctatggtgaagcgctggaacctcagaaaggtgcaccgggtaaaacgaaagatatccgtgcgacgcaagacttccttaccggttatcagcaagggcatgcagagcagaccgttgatggtttccgttcagacatgaacatcaaacaactggtggatctgctggttaaaggtaactggacagcagaacaaaaaggctcactggcttgggaaattgagagcagagccttgaagattaccttccagcctcaggctgagaagcataatcggctgttcaatgacgttgtttcggccggggttgctgacaccaaggcgaacaagcatcttgcaccacaattactgttattgaacctgtcgaatgacggttttggcgggcgttgtgacccattgtcaaaactggttctggttgcgaaacagctggaaaacaatggtcaggatggcgttgcccgtaaactgttggaaaaaatgtattctgcggctgcagtacttagcaatctagagctgtattcagacactgaacgcggcaatgccagtaaattattgggttctctggctgctcttcatgcccggaacccgatgcatgacacttctatgaaggtgtggcaggagaagctggaaggtaagcaggccttgaccgtcaatggcgtgattgggaaagtgactgccgcaaatgcggatggcaaacccgttctgcttgagttggatgcaccaggccatgcgatggctgcatgggcgaaaggcagtggtgagaatcgcgtttatggtttctacgatccgaacgcaggtattgtcgaattttcgtctgcggagaaatttggtgattaccttactcgcttcttcggcaaatctggcctgaacatggagcaaagctacaaactgccaaaaaatgacgcgggtgaaattaccttcaaccgtgtagttgtgatggatggcagcgtactggcaacttacagcccgacacgggctgacaagaccaccatgcagggtatccttgatctgaatatctttgatgagacgccaataaaagcccattcaggtgtggaaattacccatgaggtgaaagtaccactcaaggacaatctcccggaaggcgttgaccgtgtggttaacaacgagaatgtcgaatattgggaaccggcttttgtcaaaccgcaggcagaagggggtgacagtcgctttaacggtcaggtcatcatccagacggaaaatgatcccgtcgcggccaaggctgccgcacgcttggccggtaagcacccagactccagtgtgattgtgcaacttgatgctaatggtcaatatcgggtggtgtatggtgatcctgcgacgctgtctggcaaactgcgctggcagatcgtcggacatgggcgtgatgaatcagtacagaatcacactcgcatgagtggctacagtgccgatgaacttgcgttgaaactgaaacagttccgtaccgacttcaagcaggccggctcgcctgatcatatcagtcttgtcggctgctctttgatcagcgatgacaaacgcgatggctttgcccgtcactttatttcagagttggataagcagggcatccgaaccacagtatcggcacgcagcagtgaagttgcggtagacagcattggccgtaaattcacgcgcaatgccgaagaacagtgggttcacaaactcgtggataacaagattgtactgggctggaatgacaagggagagctggaaacccacgctgaacggatccgcaggggtatctctgaaagcgacattaacttgtcccgtatcggtcacatggatactgatgtgaaagcgaaaggtgcgattgcagaaaatacagaaacattccacgccccggaacagcacaagaaggtgaatgatgattcatcggccacgtcaccggcgaagtcatccaacaataaactgagctattccggcaatattcaggtacaagcgggtgatggcgaatttaccgctatcaactggggaacgaccaacgtcggtatcaaagtcggtacaggtggcttcaagtcactggcctttggtgataacaacgtcatggttcacatgggtcacggtgacagcaaacacagcgtcaatattgccggttatcaggcactggaaggtgcgcaattctttatgggtaaccggaacgtcagcttcaataaggggcgtagcaacgatctgatcgtgatgatggataaatccattccaacccctccgttgatcaatccatttgatggggcttcccgtatttctggtgtcttgcagggcattgccggctcctttgattcaccagattggctgagcgcccaagatcagcagtggacactggagagcgcgaaaaaatacgtcagcgacctgtcaggtctcgatctgaccagcagtgtcgattacaacacgctgaccgatctcgatgcggagaatgaacgaagcagtcgtggcctgaaaagtgatatcgaaaccacactgaacaagaaatacaatcagtggttgggcaggaagggtaatactcgtgaaatgggcaacgtcagtcgggcggataaattccgtcaggcgaatgaaaaactggcctttaacttcgccgttggcgggcagggtgccgatattcaggtaacgacgggtaactggaactttatgtttggtgacaatatccaatcgatcttggataccaacttgggttcactgtttggcctgatgacacaggaatacacgtccacgggtatggctaaaaccacgtttactttcagcccgacggacttaccacgtcagcttaaaaacaagctgctcggcaatctggcgggtgtcagtgcagatacgacactggcagatatctttggtgttgattacaccgcagatggtcatattgtttcccgttccaatcaatcggttgatggcgttgcgattctgcgtgaaatgctggaagtgatcggtgaattcagtggcgatcaactacaggcatttactgatccggcaaaactgctcgacagcttggaagccgggctgaatatgggggcagatggagttaaatcttttgcggaaagccacggcctgaaagcaaaagcgcctgatgaaaacaaagagggacatgtatcaatcagtgaaaagggtaaacctgttcaggaagctgaagaattaccgtcagatcgtgcctttggctttaacctgccaagcctgttcaccaccttgttcaagcaggataagcaggttgagatggcatcactggtcgctgatctgaaagagaatctgaccgccgatttgctgaatatgcaggacaaaatgtttgacttcctgcgtaacagcggccatctgcaaggtgacggtgatatgcatgtctctctcggcaactacaactttaactggggcggagacggcaaagaccttggcgcttatctgggggataacaacaacttctggggcggtcgtggtgatgacgtctattactccgtaggaacctccaatatcttcaccggtggtgaaggtaatgatatgggtgtcctgatggggcgtgagaacatgatgtttggtggtgcgggcaatgatgttgccgtactggccgggcgcattaactacgcctacatgggggacggtgatgatcaggtctttgtcttcggtgaaggcggtgtgattgatggcggcaaagggcgcgattatatcgtggcttccggtaacttcaataacatccattcaggagaagggcaggattatgttgttgccattggtaacaacaatcaggtgggtttgggagcaggcaacgattttgccaccgtattcggcaactataacaacattgatggcaacgccggcaataacgcgatcaaactgatgggttatcacgcggagatcaatggcggtacgggcgacgatcatctgattgccgatgtggtctccaagttcagccaattgaacggcggcgatggcgatgacctgctggttctgggcgggtaccaaaaccacttcaagggtggcacgggcgtcaatagctttgtggtcagcggggcggtgattgacaacgtggttgaagatatcaaacgcggcgacaagatcattttcaacaaccccaactggcaaaagctgtggttccagcgcagcggttacgatctggttctgctgactggccgtgatgtgacagacacctcggcacaagggaagtttgaggcgatgggttctgtgaccttcaacgattacttcaatggcaaccgtgcggatattgtcacccaaatgggagacaaagatgcacagggtgaacgtgaatatacggcactctctgccaattcggtggattcgttggttcaggcgatgagcgggtttgcgccaaatatgggcgacaccggctttattgatacacttgatagtcagacgaaatcgactattttgaccgcttgggcggacaccacaagcggaaaatccaaactggcctaa

SEQ ID NO: 3839 - DNA, 288 bp, Xenorhabdus bovienii
  Coding DNA location: Contig name=SeqID_16893; Position on contig =30709..30996bp; Strand=-
ttggataatcatgactacagtaactatcaggttaagtttatcagcgaaactccgtggaaaagcgggttccgccatgaagcggaatttatcaccaatcctccaagccctcttattttctattgctggagtcatgaagattatgaaaatgccgccaataaagcgggattaaaacattttgaatggcgaaaaccgatgataatggaaagtgatattgagcgctatcctcccggattctgggataatcaccagaacaatagttgggaagttggatttatgtgtcaattttaa

SEQ ID NO: 3840 - DNA, 168 bp, Xenorhabdus bovienii
  Coding DNA location: Contig name=SeqID_16893; Position on contig =31149..31316bp; Strand=-
gtgatattgagaagcaacccccgggtttttgggatgattatcaacgtaactgtcttgatacagcgcttgtttgtcaactttaacaaaataatcctccgtaaaattacgggggattttcccattatatttagcttgcatagcaagcaaccaaatagccaaattatttaa

SEQ ID NO: 3841 - DNA, 738 bp, Xenorhabdus bovienii
  Coding DNA location: Contig name=SeqID_16893; Position on contig =31234..31971bp; Strand=-
atgacagataatatcttatataatcctattgcacatctctacgaaaatttttcagactcaagtcctcatatcgacgtggaaattcggactatcatgcatctggcaggtgaagtacaaggaaagtccgtgttggatttagcatgtggatatggtctttttagtcgtaaattcaaaaaacttggcgcttcaaacgttattggtgttgacatatcagataaaatgatacaaatagccaaaaataaatcacggcaatatcaagatgacatagaatttcatattagaaatgtctgcaagatggaatcatttgggaaatttgatctcatcgttgcagcctggttattttgtcacgccgagtcatttgaagaccttaaaacgatgttccgtgttgttgccgaccatcttaaaccttccggcaaactcatagcttatacattcgaacctgattatcggctagaaaaagggaactatgaaaattatttcataaaagttcttagtgaagaacctgtaaaagatacaacgcttttgaaagctgaattcactaccactcctcccagcccttttacaatgtatcgctggagccgcgaacagtatgctgctgcaatcaatgaagcgggtttaaaacattttgaatggcataaacccatgttgcaggaacgtgatattgagaagcaacccccgggtttttgggatgattatcaacgtaactgtcttgatacagcgcttgtttgtcaactttaa

SEQ ID NO: 3842 - DNA, 120 bp, Xenorhabdus bovienii
  Coding DNA location: Contig name=SeqID_16893; Position on contig =32002..32121bp; Strand=-
atggtaatcaacaaaaataattatataaaattctttattgtcactttaacatatacaacagagaaaccatcatcaaatattacatcaatactaaataacaaatcccatagaaagaaataa

SEQ ID NO: 3843 - DNA, 165 bp, Xenorhabdus bovienii
  Coding DNA location: Contig name=SeqID_16893; Position on contig =32427..32591bp; Strand=+
ttgaatctacatagaaatttagtggatttaacgttaacattagtaatgtcaataaatttagcgtgtaatttcaatatgataataggtaaatttaatatactaaaaatagaattaatgataaagatgagcctatttaatatatattttttacttggttttttatag

SEQ ID NO: 3844 - DNA, 276 bp, Xenorhabdus bovienii
  Coding DNA location: Contig name=SeqID_16893; Position on contig =32665..32940bp; Strand=+
atgtcaaagggatattttttaacagtcagcgataaaacaacttgtggtggtgaaattcttacgggaaccagcaacattaaattttatgggcggcaggctgcaattgaaggctccacagttacctgtgggagatactcaggaaattatgtcattgtgggaggagtcggttcttttttagataaaggagcgaaactggcagggactttggatagtcaaagtacttgtccctgtaacgctagtcttatttgctccattcctgatagctatcagaaatag

SEQ ID NO: 3845 - DNA, 267 bp, Xenorhabdus bovienii
  Coding DNA location: Contig name=SeqID_16893; Position on contig =33187..33453bp; Strand=-
atgaagataataaataatacacaaagtaatatcatagtttctgttaataaatggggcgatgatggacaaacgggtcggtttacggtatcacctggcagccgtgaatcatgggatcgcactgatgagcgcggttttgtcatggcaatactgaaagagggtgtacaagattccttttatatttttgctgatagttacatcaagattttcgacagttatgtcactgatagtggcagaagaatcaaacccgcaactgaccgatattattag

SEQ ID NO: 3846 - DNA, 129 bp, Xenorhabdus bovienii
  Coding DNA location: Contig name=SeqID_16893; Position on contig =33671..33799bp; Strand=+
ttgtatttatttttattattgtgttatataaataattatcatttaataattttattatgtgataactatttttcattatacgctattgttaagttatcgtttaatttatgtgtagatgaagttaaataa

SEQ ID NO: 3847 - DNA, 210 bp, Xenorhabdus bovienii
  Coding DNA location: Contig name=SeqID_16893; Position on contig =33902..34111bp; Strand=+
atgaaaatagataattgtctgattttttatgattgtttttatataatgcgacaggagtatttatctatggaattctatctaaatagagttgttagattttttattgcattatttattttattattatcatctttcgttctaaatgcttttgctggaaatgaagcaccttatgcacagtatataaaaaagacaaattttgttattccctga

SEQ ID NO: 3848 - DNA, 108 bp, Xenorhabdus bovienii
  Coding DNA location: Contig name=SeqID_16893; Position on contig =34098..34205bp; Strand=+
ttgttattccctgacatcaaaagggaatttgattttattatcagtccacatagcgtgtggactgatactgtaattatttttttgctaaaaaacgatgaattgccctga

SEQ ID NO: 3849 - DNA, 870 bp, Xenorhabdus bovienii
  Coding DNA location: Contig name=SeqID_16893; Position on contig =34171..35040bp; Strand=-
atgccatttagtttgtcactgccgacctgtcatggtattaaacatcacgatattaaacgttgtatcaatgacattaaattcaggcagactatgaactcaaataatcaattaaattatcattttcacacgccggaaaacccacagtcatcaacccccattgtcttgattcatgggctttttggcgatttgagcaatttggggatattggggcgtgatttgcagcaacattatccggtcattcagattgatgtgcgtaaccacggtatttctccgcagatggaaaacatggattaccgcgatatggcacaagatgttttatctctccttgatgagctgaatgtggcaaaagccattattatcgggcattcaatgggaggtaaaattgccatgaccatcacggcggttgcgccggagcgtattgaacaaatcgtggttatcgatatagcgccagtgacttacctgactcgccatcacgacagcatttttgctgcactaaaccaagtcacggaagcaggtgctcagactcggcaggctgcgacggaaattatgcggaaggatattcatgaggatggcgtgattcaatttctgctgaaatcattccgtcaaggagaatggaaattcaacctaccggttttgcaaaaagaatatgaaaaaattatcggctgggaagcgattcctgcatggcccaaaccagcgctgtttattcgtggcggaaattcggattacattaccgaagcctaccgcgaagatatcatgcgccaatttcctcaggcgacagcatgggttatagcgggttgcggtcactgggtacatgcggaaaaacctgaagcggtactcagggcaattcatcgttttttagcaaaaaaataa

SEQ ID NO: 3850 - DNA, 534 bp, Xenorhabdus bovienii
  Coding DNA location: Contig name=SeqID_16893; Position on contig =35211..35744bp; Strand=+
atgaaaacgatagaagttgatgaagacctttaccgctttattgcaagccaaaccctgcatatcggtgaaagtgcatctgatattttgcggcgcatattgaaagtggacgccgggcagccagtacaaactacaccgcctgccagagaatctgtctctgtcagcaaagtgccggctgcacgctcccgtgatgttgttcgcattgttcgtgaattattgctttctgacgagtatgctgaaaagaaaaaatccgttgagcgtttcatgtcgatcctgtccactctgtacagcttgaacagcgaaagctttgcgaaaacaacagaagccatgcatggccgtacccgtacctattttgcgggagatgagcaaactctactggccagtggtaatcacactaagccacgtcatatccctggcacacctttctgggttatcactaataccaataccgaccgtaaacgcagcatggttgaacacgttatgcaggatatgaaatttccggcaaatgtgattgaaaaagtgtgtggcactatttaa

SEQ ID NO: 3851 - DNA, 102 bp, Xenorhabdus bovienii
  Coding DNA location: Contig name=SeqID_16893; Position on contig =35781..35882bp; Strand=+
ttgattaaactgcactggcgaataagccagtgtagcctttcaggagaaataaagtggcaactcatccaagagcggggcagcctgcccagcagcatgatttaa

SEQ ID NO: 3852 - DNA, 1641 bp, Xenorhabdus bovienii
  Coding DNA location: Contig name=SeqID_16893; Position on contig =35834..37474bp; Strand=+
gtggcaactcatccaagagcggggcagcctgcccagcagcatgatttaatcaatattgcacagctcacatcccagtattacaccctacagccccatcccgaaaatccggctcatcaggtcaaatttggcacttccggtcatcgtggcagttctggccgcaacagctttaatgaagcgcatattctggcaatttctcaggcgatagtggaagtccgtgcacagcaggggattactggcccatgctatgtaggcaaagatacccacgcactgtctgaagcagctttcatttctgtgctggaagtcctgaccgcgaatggtgtggaggtgattgtgcaggaaaataatggttttacaccgactcctgctatttcccacgctattttgtgctacaaccgtcaggggaaaaaccgggcggatgggattgtgattacgccatcccataacccgccagaagacggcggtattaaatataatcctcctaatggcgggcctgccgatactgatttaacttcaatcattgaaaagcgtgccaacgcattgctggcgaatgacctgaatggggttaagcgtctgccttatgagcgggtactgaagagtgaatatctgcatccacaggatttggttgatccttatgtgacatccttgggggatgttgtggatatggcggccatacagcaggcagggttgaaaatcggtattgatccgttgggtggttcaggtattgcttactggcagcggatcggtgagtactacaatctcgatttaacgctggtcaatgataaggtcgatcagacattccgttttatgacgctggatcatgacggtgtgatccgcatggactgttcatcacgctgggcgatggcgggtctgctggaactgcgcggtaagtttgatttagcctttgctaatgaccctgattacgaccgccacgggattatcactccagccggtttgatgaatcccaaccattatctggcaacggctgtggattatttattccgtcaccgtccacaatggtctgaaaaagttgctgtgggcaaaactttagtttccagtgccatgatcgatcgcgtagtcgcggatctgggacgcgagctgctggaagtgcctgtcggttttaaatggtttgtcgatgggttatatcgaggcgagctgggctttggtggtgaagagagtgctggcgcctccttcctgcgttttgacggtacgccgtggtcaacggataaagacggtattatcctctgcctgttagcggcggaaatgacggcgactaccggagagaatccgcagcagcgctatgacaaactgggtgcacgtttcggtacgccaagttatagccgtattcaggctccggcgagccatcagcagaaagccttgctgtccaaactgtcaccggaaatggtcaaggcgaacacactggccggcgatcccatcactgcacgcctgactaccgcttccggtaatggtgcttctattggtggcttaaaggtgatgagcgacaacggctggtttgcggctcgtccttcaggtacggaagaagcctacaaaatttactgtgaaagtttcctcggcgcagaacatcgcgagaagattgagcaggaagcgctggaaattgtcaatcaggtgtttaccgccggttga

SEQ ID NO: 3853 - DNA, 123 bp, Xenorhabdus bovienii
  Coding DNA location: Contig name=SeqID_16893; Position on contig =37549..37671bp; Strand=-
atgtgcaatatgaggctcaccttgtttcttatgatggtagctaaccaccataattactatgatacaagtgctgcgggtgtggcattgattactgcgggggctttaatggtcgctttgggataa

SEQ ID NO: 3854 - DNA, 117 bp, Xenorhabdus bovienii
  Coding DNA location: Contig name=SeqID_16893; Position on contig =37621..37737bp; Strand=+
atggtggttagctaccatcataagaaacaaggtgagcctcatattgcacatttaagcgagactttgttaataagcgaaggccccttgtttcaccttccacgccagcaccaatattga

SEQ ID NO: 3855 - DNA, 1014 bp, Xenorhabdus bovienii
  Coding DNA location: Contig name=SeqID_16893; Position on contig =37786..38799bp; Strand=+
atggcatcaaataagaggagggttattatgtattatgtcggaatagatgtcagtaagaataaactggatatttgtttgttatatgatggagttaaaggtaaacgcaaaacaaaatcccttctgaataatgaacattcagcctgtatgttaatagcgtggctagctaaatatattcctgccctgcaacaagtcaatatcgttatggaagccaccggagtctatcatgaacggttggcttattcccttcatcaggctgggggaaggattgcaatagccaaccctttacgcgtgcgtgattttgctaaaggtatggggatactgactaaaacagacaaagtagatgcctatattttagcctgttacagtgccttaaaacaacccgatgtctggcaacctcctcctatagaaattcgcgaattgaaggctctcctatgccgtcgggatgcgttattagaagatatccagcgtgaacgtaaccgatatgaaaaaagcggctcaacccataccccaaaaagggttattgagtccatagaggcaatgatgcatcacatgaaaaatgagttagccgagcttgaggctcttattgccgagcatataaaccagcaccctaatttaaaaaaagattttgaacttttaacctcaataaagggggttggaactcagattggtcttaacatgctgattatcttacgtacgaatacctttactcgtgcaacgcaagtcgctgcatatcttggtgttattcctattgcaaagcagtcaggtacatcggtgcatggtcgagtgcgcttatctaaaacggggcctgctaaaatccgtgctaagttgtttatgtctgcactcactgcagttcgttttaacccccacataaatgatttatataatcgattggttaataaagggaaggcaaaaatgttggctttaggcgctgcgatgcgtaagttagttcatttgtgctacggagtattaaatacgcagcaatcatatgatgaaaactatgctattagaacttga

SEQ ID NO: 3856 - DNA, 408 bp, Xenorhabdus bovienii
  Coding DNA location: Contig name=SeqID_16893; Position on contig =38781..39188bp; Strand=-
atgagcacatggttgatttatgccctgctatctgcactcacggcagcgctggtcgctatttttggcaaaatcggtctacaaaatctggatgccaatacagcaacagcaatccgagccgttatcatggctctgtttctggtaggcgttgtcgtcgttcaaggaaaattgaatcttatcggcgaaattctggtcaatcgcaaggcactgctgtttatcttgttaagtggcattgcaggcgcgctttcctggctattttattttctggcgatcaaacagggtcatgtttcccaagtcgctcccatcgataaactgagtgtcgtatttgcggtgatcctggccgtgatcctatttggtgagaaaatttcactaataagctaccgtcttgatggtcaagttctaatagcatag

SEQ ID NO: 3857 - DNA, 123 bp, Xenorhabdus bovienii
  Coding DNA location: Contig name=SeqID_16893; Position on contig =39179..39301bp; Strand=+
atgtgctcatattcaatcaatcccattggtaacagcaagggagtgcatgatattcccattattaatacagattcaagaaaatacgatgcccatttttacctactctttttagtttcattataa

SEQ ID NO: 3858 - DNA, 2895 bp, Xenorhabdus bovienii
  Coding DNA location: Contig name=SeqID_16893; Position on contig =39479..42373bp; Strand=+
atggaatctcacttttggaaaaaggcttacctgatcctattaagcagtttattttttctactactcactagctgtgataacaaaaataatttacccaaaatcaccgaggaaccgatggcttatatcccgaataacatacctgctaaagtcaccactgctgacgatcttcaggcttcagcacattgggtcgataaacggacactattatggccagagggagcagataagcctcatgtccgtttatattacaaccgacataacaaggtagagccgaatgatgaaggaaactttactgatagttatctggtgctgacaccgacgactctaagcaaaaagacagccgaaagattccctcatttagcggcgctgcctgcattccaattgccagagaacacggatgttgatcggttgattaccggtgatctggtagcattggcgaccaatgaagaaggcttgttattatcggcaactcaagtacaaattgctggtgtgctggacgaccgctttgccggcaccgcagaaacactagagtatggcgcactgataaacgacacggaagtgactttccgcctgtgggcgccgacggctcaaaatgtggatctggttatttataatgaagataaacaggccatcgccaatcatacaatgaatcgcgatgcggagagtggctcttggtcatggcagggtgatacgaatttgatcggggcttactaccgctatgctttaaccgtgtatcatccgtattcccgcaaggtggaacgctatgaggttaccgatccctattctcatagcctgtctacgaattcggaatatagccaggtcatcaatctggatgacgaagcactgaagccacaaaactgggatgacctgagcatgccgcatccgcagaagacatcggcagatattgcgcgtatggccctctatgaagcgcatatccgggatctctccgttgcggacagcacagtaccacaagcttggcgtggtaagtatctggctctcacggctaacagcagcgatatgttcaaacacctaaaggcattgagtcaggccggaatgactcatatagagctgttgcccgtgtttgatatcgcttctattaatgaatttagtcataacgtggttgatcttaatcagcccttcaatcggttatgtcaagtcaacacaacggtgaaaaatagccgcttcgctgattattgcaaccgttccctgaccgtgagggaagtattgcaggcgttacaacgcggtgacagtgccagcaatccgcaagtacaagagttaaacgaaatgattgcagaaaccgactcctataactggggctacgatccgttccattactcagtaccggaaggctcttatgccactcatgcagaaggctcagtgcgtattaaagagtttcgtgccatggttcaggccatcaagcagcaactggggatgaatgtgatcatggatgtcgcgtataaccatactaatgccgctggccctgcacatcgaacttcggtgctggataaagtcgtgccttggtattaccaccgtttggatgaaattacgggcaatgttgaaaataatacctgttgctctgataccgcacccgaacaccggatgttctccaagcttatcgaagactcattagtgacttgggttaagcactataagatagatgcgttccgctttgatttaatgggctaccatcctaaggctcagattgtctcggcgctggcaaaagtccgcacaattaatccctcggtctattttttcggtgagggttggaattccgggcaggacgatcggttcgaaacggcttcacagattaatcttaaaggctctggtattggtactttctcggatcgattgcgggattcggtacgcggtggcgggccgtttgattctgctgataatattcgtattaatcagggaatgggtaacggtgcaggaacattacctaacgaaattgccgtattagatgcgaatgaagctcgtcatttggcggatctggtccgtcttgggatggcgggtaatctggctgactttgtcatgatcgataaagatgggaaagtgaaagcgggtcgggaaattaactacaaaggtgtcgctgcgggttatgccgctgatcccattgaagtgattaattatgtctctaagcacgataatcagacattatgggacatcatcagctacaaagctgcttatcaggcggatctggcgacaaggcttcgtatgcaggccatttctctttccacagtactcctcgggcaagggctggctttcgatcagcaagggtcggaattactacgctcaaaatcgtttactcgtgattcttataatgcaggcgattggtttaaccgtgtcagttataactacaaagataacaactatgatgttggtatgccggggaaacgggatgacggtgataattatgcactgattcatagagtgaaaaatcaggtgaaaaaaccaggccaaagtgagttattacagatgatggttttctatcaggaactgttacgtctgcgtcaattttcacctttgatgacccttggtaagggggaatcagtcaagcaacgtatcgattttcgtaatgtggggccacatcagcaactcggattactggtcatgaccattgatgacggcaacactaccgatgatgatcgtgatttgcggtttgatggtttagtggtggtgattaatgctgcgtcaaaacccgtcacggtgagagatctcaatactcatggtttgaaattaaatgatattcaaagcagattagggaatgcatctttagctgccggaatcaaaataaccgaagatggcatggtgacaatgccagcttggtcagcagcggtgctggttttaccacagaagggtatccgaggtacgggtttacctgtccgtagaaaataa

SEQ ID NO: 3859 - DNA, 666 bp, Xenorhabdus bovienii
  Coding DNA location: Contig name=SeqID_16893; Position on contig =42394..43059bp; Strand=-
ttgatcgttgaagatgaaaaagagatcagacgtttcgtcagattggctctggaaggcgaaaactggcgcgtatttgaatgtgacacactgaaacgcggtttaattgaagccgccacccgcaaacccgatttgctgatccttgacttgggattgcccgatggtaatggcattgatctgatccatgatatccgccaatggagcagcattccgatcattgtgctttccgcacgcgataatgagcaggataaagtagcggcgctggatggcggcgctgacgactatctgagcaaaccttttggtatcaacgaactgcttgccagagtcagagtcgccctgcgccgtgccaccaaagccaatcagcccgatccggtgattcattttgccgatatcagtgttgacttaatcaatcgtcgggtcttaaaaggccagaaggagcttcatcttacgccgacggaatatcgtctgctgaccgaattgctgaccaacagcggcaaagtgctgacccaacgctatttgctcaatcacgtctgggggccgcattatgtcgagcatagccattacctgcggatatacatggggcatctgcggcaaaaactggaagaagaccctgcccgtcccaagcatttactgacagagactggtgtgggttatcgatttatgccctga

SEQ ID NO: 3860 - DNA, 2718 bp, Xenorhabdus bovienii
  Coding DNA location: Contig name=SeqID_16893; Position on contig =43083..45800bp; Strand=-
atggatcagattgaacccctgcgccccaatccggatgacttgctgacactggcaaacgaaaaaccccgtggcaaactaaaaatatttttcggagcctgtgcaggagtaggtaaaacctatgccatgttacaggaagcgcagcggctgctgtctcaggggctggatgttattgccggtgttgtcgaaacccatgaacgacaagaaaccgcagcactgctgacaggcttaccccaattgccaccaaagcatattcgctatcatgagcgcagaattgccgcatttgacattgatgcggccattgcccgtcatcctgccattatcctgatggacgaactggccttcagcaatcctcacagcagccgtcatcccaaacgttggcaagatgtggaagagttgctggaagcaggtatcgatgtcctgaccaccatcaacgtgcaacatctggaaagcctgaacgatgtggtcggcgccattacgggcattcgtgttcgcgaaaccattcccgatcacatatttgatcatgccgatgacgtcgtgctggttgatattccaccggatgatctgcgccagcggcttaacgacggcaaagtctatatttccggtcaggccgaacgggctattgagcatttcttccgcaaaggaaacttgatcgcgctgcgtgagttagcattgcgccgcacggcagaccgtgttgatgatcagatgcgtgctttccgtgatacacggggaaaagaacctgtctggcacacacgggataacctgttgctgtgcattggctgtaatgcaggcaatgaaaagctgatccgaaccgcggctcgtctggcggcaaaactgagttgtaaatggcatgccgtttacgttgaaacccccaaattacaccggctgccagaaatcaagcggcgtaccatcttgaaagcattgaagctggcacaggagctgggagctgaaactgccacgctttccgatcctcatgaagaaagagctattctgcgttatgcaagagagcacaatctcggcaaaatccttgttggccgctattatggctcacatttgaattcatttagtgataaatggtttggttttaaatggcgctctgatttcgttgaacgtttaggaaaactggggcctgatctcgatctcatcattgttgcgctggaagacaaaaaacgctgggataaagagcaacgagataaccgggcattccatgaaaaatggcgcgtccagattcacggcttcctcatggcgattatactctgcaccttaatcaccctgttctcccatacctttttactcacccttgataaagccaatctggtaacactctacctgctcggcgtcgttattattgccctgttttatggccgctggccttctgtctttgccgcctttatcaatgtcatcagtttcgacatcttttttgtccagccgcaatggtcactggccgtcacagacatgcaatatctgcttacctttaccgtgatgttgatcgtgggagtagtcgtgggaaacttgaccgcaggtatacgctatcaagccagagtggcccgctaccgtgaacagcgaacgcggcacttatatgaaatcacgcgtgaactcagccgtgccttgaatgaagaagacgttgcccgtatcagctatcactttttgtccaacagctttcaggcaaaaacgggcttgctgctgccggatagcgacgcacgtttatatcaggtgaaatccaataacggcggacaaatgcagatcgatgaggcgatagctaaatggagttttgacaagaaacagcctgcaggggcaggaaccgacacattacccggcgtaccctatcagctatttcctatcgccacggcttcacaggtatttgctgtccttgctatcgaatcgcctaacttgcgccaattattagtaccggaacaacagcggttattacaaacgttcaccgggcttatcgccaacgccctggaacgtttgcacctttcccgtcgtgcggaatccgccaagctagagaccgaacgggagcaattgcgaaattcactactggccgcactttcccacgatttacgcactccgttgacggttctgtttgggcagacagagatactgatgctagatttatccactgaaaattcgcctcatacccaacaggttaaccaaattcgtcaacagatcctcagcacctcacgtttggtcaataacctgctggacatggcacgtattcaatccggcggtattcaacttaatcttgaatggcagtcactggaggaaattgtcggtagtaccctgcgctcattagaatataccctcagccgctacacggtagaactttccctgccagccaatttattattgcattgtgacgcatccttactggaacgagtcttcattaatttgctggaaaacgccattaaatatacccatgaacagacaccattaggcatacgagcaaccaccgaacacaaacaggtacatattgaaatttgggatgcaggctccggtattccacaaggacaagaacaattcattttcgacaaattctcacgcgcccgtaaagaatccgccattcccggtgtgggattagggctagcgatttgccgtgccatcattgaaattcacggcggccgtatatgggcaactaacaataaaaaaggtggagccagtttccactttgttctaccgttagatgaggcgcccaaaattgaagaaatcattgaggaaacgtga

SEQ ID NO: 3861 - DNA, 579 bp, Xenorhabdus bovienii
  Coding DNA location: Contig name=SeqID_16893; Position on contig =45807..46385bp; Strand=-
atgattgggttacgcgcttccatcgtcctactgacattcctgactttaatcactggcatcgcctatccgttgctgataacgggcatagcaaacgccttatttccccatcaggccaaaggtgcgttgattgaacacaatggcaaactggttggttcagaattaatcggtcagtcatttacccaagccatctattttcatggacgtccgtctatgacgtcggaacagccttacaatgccctgtcatctggaggaagtaacctctcgacaaccaatcccgccttgactcaccaaatacaccagcgggttactcaggtacgtttattcaatcattcagaaaacaacgccattcctgtcgatctcatcaccgcatccggcagtggtttagatccccatatttcccccaatgcggctgaatttcaggcacaacgtgtcgccactgcccgccacttatccataaatgtgattaacaaattgattcaagcgcatactgcatatcctccactggaatatatgggtgaacccgtggtaaatgtactggagcttaatctggcactggataacctgaaatcacaaggctga

SEQ ID NO: 3862 - DNA, 2067 bp, Xenorhabdus bovienii
  Coding DNA location: Contig name=SeqID_16893; Position on contig =46396..48462bp; Strand=-
atgaaagacaaacaacaagcattatttgagcccgctttaatacgccatgcacttatcgacgcagtgaaaaaatgccatcccgctatccaatggcgtaatcccgtcatgtttgtcgtctatctgggaagctgcctgaccaccgtgttgtggctggggatgttaacggaacagctcaccggtaatgcactctttaccggctccattgccttatggttatggttcactgtacttttcgctaattttgccgaagcactggcagaaggccgtagccaagcccaggcgtccagtctgaaaggcgtaaaaaaaactacgtgggcgacccgattagcttccgctagccgtgatgcagcaaaggaaaaagtcacttcagaccatctacgcaagggcgatattgtgctggtggaagtgggcgaaattatcccctgtgatggtgaagttcttgaagggggtgcttccgttgatgaaagcgccattacaggagaatcggctcccgtgatccgcgaatctggcggtgattttgcttcagtcactggcgggacacgggttttatcggattggctgattatcgaatgttctgtcaatccgggcgaaacctttttggacagaatgatttcgatggttgaaggtgccaaacgacgcaaaactcccaacgaaattgctctcactattttgctcactgcgctgactattattttcctgctggcctgtatcagcctactgcccttttccttgttcagcgttcaaaccaatcaatcaggcgatcccatcagcatcaccgtgctggttgccctgttagtctgcctaatccccaccaccatcggcggattactttcagccattggcgttgcgggtatgagccgcatgttgggcgccaatgtcattgccaccagtggacgcgcgattgaagctgccggcgatgtggacgttttgttgctggataagacgggaaccattactctcggtaatcgtcaggcatcccagtttttacctgcaccgggcgtaactgaagaacaactggccgatgctgcgcaactttcctcactcgctgacaaaacaccggaaggacgcagcatcatgattttggcaaaacagcgcttcaatatgcgcgagcgcgatctgcgcgcactcaacgcgacattcattcctttctcagccatgacacgtatgagcggcgtcaatataggcaaccgcatgatccgcaaaggcgcagtagatgccatccgccgttatgttgaggccaatcacaatcaatttcccgatgccattgatctattggtgcagcaggtcgccagtaaaggtgcaacgccattggtcgttgcggagaatcagcgtgttttgggtgtggtcgctctgaaagatattgtgaaaggcggcatcaaagagcgtttcagtgaaatgcgcagaatggggatcaaaacggtgatgatcacaggtgacaatcacctaaccgccgctgcaattgcagcagaagccggtgttgatgattttctggcagaagccacgcccgaagcgaagctcgccctgatccgacaatatcagtctgaagggtgtctggttgccatgaccggtgacggcacaaacgacgcccccgcgctggctcaggcggatgttgccgttgctatgaattcagggacacaagccgcaaaagaggctggaaatatggtggatttggactccaatcccaccaaattgattgaagtggtgcatatcggcaaacagatgctgatgacccgtggctccttgaccacatttagcatcgctaatgacattgctaaatattttgccatcattcccgctgcatttgcggtcacttatccccagcttaatgccctgaacatcattcatcttcattcgccggaatcggcggtgttgtctgccgttattttcaacgcgataatcattatcgttctgcttcctttggcgctaaaaggcgtcagttaccgcgcgatgaacgcactgtcactcctgcgccggaatctttgggtatacggccttggtggactgatcgtcccctttatcggtatcaagctcatcgacatattgctcactattctggctttcaaataa

SEQ ID NO: 3863 - DNA, 1707 bp, Xenorhabdus bovienii
  Coding DNA location: Contig name=SeqID_16893; Position on contig =48483..50189bp; Strand=-
atggtagtatccgcttttttgctgattaccagtttcttggtcattctctttgtattgagcaaacccctaggcagtctgatcgcaaatctggtcgaaggagaattaccccgctggctaacaagtgcagaaaacagcctgtggcgttgctgtggcttgcaaaagcccggcggccacgtcaaggagatgaactggtggcaatatgcactcgctatcatcacattcaacatcatggggttgctgctactctttattctgttgataagccaagaacatctgccgctcaatccacagcattttgccggtatgaaatgggatctggcactcaacaccgcaatcagttttattaccaacaccaactggcaggcctacagcggtgaaaataccctcagttacttgagtcaaatggcgggtttgactgttcagaatttcctgtcagccgccacggggattgcagtagctttcgccttaatgcgggcattttcccgtcagggcgttaagacactaggcaatgcctggatagatattacacgcattacactgtatctattgcttccgctgtcgataatcattgcacttatcttcgccagtcagggcgttatccaaaatttctccccctatgcgcttgcccacacccttgaaggacaacaacaacttattcccatggggccggttgcttctcaggaagccataaaattactgggtacaaatggcggagggttctttggggcaaactcagcccacccctttgaaaacccgaatgccctcagtaactttgtgcaaatccttaccattttcctgatcccctgtgcactgtgtttcgcgttcggtcttgtggtcggggataatcgacaggggcatgctttgctgtgggcgatgacgattgtctttatcatcgccgttacgattgtgatctatgccgaaatcatgggtaatccccacttcatccaggctggtgccagcagtaatctgaacatggaagggaaagagtcccgctttggtatccttacctcctctctttatagcgtcgtcacaactgcggcttcctgtggggctgtaaatgcaatgcacgattccttcacggcactgggtggcatgataccactctggttgatgcaaattggtgaagtcatctttggcggcgtaggctccggcttatatggcatgctgctatttgtcctactggctgtgtttatcgccggtttgatgattggccgcgctccagaatacttgggcaagaaaatcgatgtccatgacatgaaaatggtcgcgctggcaattttggttacgccctcccttgtcctgttaggaaccgctctggcaacttcaatcgatgcaggacgcgttgcgatcatgaaccccagcgcccacgggttcactgaagtgctttatgctctctcatccgctgccaataacaacggcagtgcatttgctggtctgaatgccaacagtatgttttataacctgctgttgggggcaatcatgtttctaggacgctttggtgtgattttgccagttctggccatcgctggctccatgattagcaagaaacgccagactatcagtagtggaacactgccgactcacggctctctattcactggattactgattctggtggttttgctgatgggtgcactcacctttattcctgcgctggcgcttggccctgtcgcagaacatttacaactttggcaagcaccacgataa

SEQ ID NO: 3864 - DNA, 234 bp, Xenorhabdus bovienii
  Coding DNA location: Contig name=SeqID_16893; Position on contig =50190..50423bp; Strand=-
ttgctagactttccttgggtaccttatcaattaatccctcttatatttttatactttttttacgctttcataatctcttttaacaacttctttgcatggctcttcttatgctgtaaccacctagtgaataaggatataagcacaatgaatacattcataattatcggcgtatttctggcagtgtcattactgttctatctgatttacgcgttattgaatgcggaggatttttaa

SEQ ID NO: 3865 - DNA, 225 bp, Xenorhabdus bovienii
  Coding DNA location: Contig name=SeqID_16893; Position on contig =50603..50827bp; Strand=+
atgaggagggtcttaatgtctacatatcgtgaatattcttggcatcaggttctcttgcggcgtactggcgctgtaacattgggcgtcattgcgcttcctgttatgctatttcgtcgggatcgtgcccgtttttacagttatctgcgtaaggtatggataaaaaccagcgataaacccgtatggctggagagctcggaaatggccgcaggtattcgaaatcgctaa

SEQ ID NO: 3866 - DNA, 195 bp, Xenorhabdus bovienii
  Coding DNA location: Contig name=SeqID_16893; Position on contig =50824..51018bp; Strand=-
ttgctcccaagattgttgcttatatgcaccacatcaagaatcgcatcaatagcaacaaatagcgataaaagcaaaacacctcgtcagcataaacaggcaaggtgtcaaaatactctatcaggggaaaaaataagaatggaaagtgacaaaccagagcaatacagtcatgttacttacataatgatgccgtcttag

SEQ ID NO: 3867 - DNA, 795 bp, Xenorhabdus bovienii
  Coding DNA location: Contig name=SeqID_16893; Position on contig =51022..51816bp; Strand=+
atgacaggtaagtattttatggcgaaagcgctcaatgacgggggaagtgtgatgaacaatgttgaattggaacatgtgctcaatacggaactgaatgtccgtgaatttcaggattatgcccccaatggtttacaggtggaaggccgtccccatattcagcgggttattacaggtgtgacagcatgtcaggctctgttggatgaggcggttcatctcgaagctgatgcggtcatcgttcatcatggatatttttggaaaaacgaatcacccgttatccgtggcatgaaacgccgccgtctacaaacactgctcagcaatgatatcaatctgtatggttatcatcttcctttggatgctcatcctacattgggtaacaatgttcagttggcgcgtcagatgggggtaaaaatcatcgggcagattgattccctgcttcctcatggagcatttgaccaaccgattacccccgcagagttgactgagcggcttgaaaaaagattagaacgcaaagtactgcattgtggcgataatgcaccggaagaaattcgtacactggcatggtgtacgggaggtggccagagttttattgagcaggcggctgagtttggtgtcgatgcctttgtgacgggggaagtatcagagaagactatccatgttgcccgtgagatggggctgcatttttatgcggcagggcatcacgcgacagagcgttatggtatcaaagtactcggtgaatggctggcgaaccattatgggttggatgtcacttttgttgatattcctaatccggcttga

SEQ ID NO: 3868 - DNA, 111 bp, Xenorhabdus bovienii
  Coding DNA location: Contig name=SeqID_16893; Position on contig =51803..51913bp; Strand=-
atggtgataaacaggttctgcgaaaacaaattgggaaaaaacaacggggctaccgttctgatagccccgcctgacaaattgataagttgcgaacaaatcaagccggattag

SEQ ID NO: 3869 - DNA, 1164 bp, Xenorhabdus bovienii
  Coding DNA location: Contig name=SeqID_16893; Position on contig =51907..53070bp; Strand=-
atgctaacctttcgggctataaataattcatcagaagaaaatatcatgcacactagaccatcgctttggctcgctatcaccttgatgatgtttccacagatcgtggaaaccatctatagtcctgccctaaccaatattgccagtggattttctgtcaatgcagaacaggctgcccaaaccctgtcactctatttctttgcttttgccatcggtgttgtcgtatgggggcgtatgtgtgatgtcattggcaggcgtcctaccatcattgcaggattattgctctatggcgcagcttccttactggcactgttaaccgaacacttctggctattactggctgccagaatgttatccgcctttggggcagctgtcggttctgtctgtacgcaaactatcatgcgtgatacttactgcggcgaagaactatcacggattttttccatcatggggattgctttagctgccagccctgcgattggcatgatcagcggctctatactaaatcattttgggggttataaagcggtatttgccggactggccattctgtctgctatcctaatgggctggtctgttattcgcttaccggaaacccggccagtaaatgtgccaaaaattgccctatttggcaccgccgtcaccatgttcaaagatatttcgatttggcgaaatgcgtttctcatcgcatttttcaatatttgcctgttcagctattaccagttagctccctttcgctttcagcaattcggactatcacaggcacagttcggttataccggcctgctattcactttcggcgttgggctaggttcactattgaacaagcatctgttaaaaaaacagtggctatcggaaaaattaatctctcttgccgcgatgattgttttattaagtgggatcggcgtttacctgctcgaaaatagctggctatttatctttcccatgctgggcattgttaccgcctacggccttgccattcccaatattttagcatcggcactgaacaactatgtagatcggctgggtacagcaggcgccttactggggctattttattatctcttgctgggcggcggtttggcgctggctggctggagtcaggcattgggcagcatactgatctgctgtggcgtatcaaccgtgcttttaacaagaaaatggtga

SEQ ID NO: 3870 - DNA, 852 bp, Xenorhabdus bovienii
  Coding DNA location: Contig name=SeqID_16893; Position on contig =53079..53930bp; Strand=+
atgtctttttatgataataaaggcagtttatttatgtattcggacataaagttaaaggatattaatatggcgtggctgcgacaaagtgatcattttgatcctgatggtttgaaatatagtttgaatgtgcccgtgataggcattgcggcagagatggggcagcacgattcaggctttcatcagcatgatatggggcaactgttgtttactcagcagggttgcatcaagatcacgctggcaaatcaactctctatcctgcctccgacccgagttgcatggataccgccaaagacattgcatcgggcggaaatgcgtggctccgtaggatatcgctccatttatctggatatttccgggatagagtggatttcgaggcagagtgaaatcttgcaaaccacaccattgctacgggtgattttagaacgtattgcaatatctccttttgataccgattggcgtcagggaaagggagcgcatttattggcggtcttttttgatgaaatgagtgatgcaggtaaagaaccgactttattaccactaccttctgatcggcgtctggcacgtttgccgtttgaacaatttcctccgccattacaaatacttgccactcatgttggcgccagtgagaaaactatcacccgaatatttctgcgtgaaacgggaatgaattatcaacagtggcggcagcaatggcggctgataaaagccattgagttacttgctcaggataaaactctgtcttatgtcgcacaggagctgggatttgctaatgatagtgcgtttgtgacattttttcgcaaaaatatgggaagaccaccgagggagtatatggccggtgcttgcaggcgataa

SEQ ID NO: 3871 - DNA, 1284 bp, Xenorhabdus bovienii
  Coding DNA location: Contig name=SeqID_16893; Position on contig =54030..55313bp; Strand=-
atggctgataaaaaagctacgttgaccataaatggtgcagctgctatcgaactagacgtactaacgccgaccctaggttctgaagtgattgacgttcgtaccctcggctcaaagagcttctatacctacgatcctggctttacttctacggcctcctgtgaatcaaaaatcacctatattgatggtgacgaaggcattttgctgcaccgcggtttcccgatcgatcagctcgcaacgggatcaagctatctggaagtctgttatatcctgctgtatggcgaaccacccacgcctgaagagtatgaaacattcaaaaaaacggtgattcgtcatacgatgatccacgaacagatcacccgtctgttccacggtttccgccgtgattctcacccaatggccgtactttgtggtgtgacaggtgcactggctgccttctaccatgatgcactggatgtccataaccctcaccaccgtgaaattactgcttaccgtttgctgtccaaaatgccaactgtagcggcaatgtgttacaaatattctatcgggcagcctttcgtttacccacgtaacgatctttcttatgcagccaatttcctgcacatgatgttctcaacaccttgtgaagaatataaagtcaatccagtgctagaacgcgccatggatcgcattttcattctgcatgcggatcacgaacaaaatgcttcaacttcaacggtacgtaccgcaggttcttctggtgctaacccattcgcctgtattgcagcgggcatcgcatccctgtgggggcctgcgcacggtggcgcgaacgaagcctgtctgcgtatgctggaagagatccagactgtcgaacatattcctgaatttatcgctcgtgccaaagataaaaacgattctttccgcttgatgggctttggtcatcgcgtttataaaaactatgatccacgcgcaacagtaatgcgtgaaacctgccatgaagtgctgaatgaactgggcctgaatgacagcctgctggaagtcgcgatggagttggagcgtatcgccctgaatgatccgtacttcattgagaagaaactgtacccgaatgtcgatttctactccggtattatcctgaaagcaatgggtatcccatcctccatgtttaccgtgattttcgccattgcccgtactattggctggattgcgcactggactgaaatgcacgatgaaggcttgagaatcgctcgtccacgccagctttatactggccatacccaacgtgatttcaaaagtcagttagagaaataa

SEQ ID NO: 3872 - DNA, 99 bp, Xenorhabdus bovienii
  Coding DNA location: Contig name=SeqID_16893; Position on contig =55382..55480bp; Strand=+
atggcattgtgctaccggagagaatttaaaatcaggctggtatcacattatataacgctgaaatctcattacgggcgacaacgatttttaggttgttaa

SEQ ID NO: 3873 - DNA, 186 bp, Xenorhabdus bovienii
  Coding DNA location: Contig name=SeqID_16893; Position on contig =55469..55654bp; Strand=-
ttgacaaggattaaacatttatcttacatatatgacggtatatattgtttaccgtcgttttccggcggaaaagtaaacttcacgaaaaacaaaagttatgcaaaagtactcattagacacaaaatgacaacattttatgttaagaatactttaaacataacacccagaaactttttaacaacctaa

SEQ ID NO: 3874 - DNA, 213 bp, Xenorhabdus bovienii
  Coding DNA location: Contig name=SeqID_16893; Position on contig =55716..55928bp; Strand=+
atgttaacaatcatattgtgtgggaattgtaataagtatgtgaagtacctatactgccgtaaggtctccggattaccctgctgcaggagcatccagcgtagccaaatcacaacttttgatgaacatgtaaggattgttaatttaattatgttgtgtctttgtatcctcttagcgctgtctgattcccgcccaggaccggaggatggaaaataa

SEQ ID NO: 3875 - DNA, 411 bp, Xenorhabdus bovienii
  Coding DNA location: Contig name=SeqID_16893; Position on contig =55918..56328bp; Strand=+
atggaaaataaaaaaagctgtgtgggcaaaattgtgaaaaaacaaagacctgtcaacctcgatttgcggacgattaaccaacccgtctccgcgataacttcgatcttgcaccgtatctcaggcgtcattacctttatcgcagtcggcattttgctgtggttgctggggatgtcactgtcttcgcaagagggcttcctgcaagcatctgaaatcatgactggcttcttcgctaaatttatcctgtgggggatattgacggcgttggcttaccatatttgtggtggcatccgccatgtattgatggattttggtttcttggaagaaaacctcgctaccggtagtgcttctgccaaagtagcaatagtgatcgcggttattctgtctattctggctggggtattattatggtaa

SEQ ID NO: 3876 - DNA, 348 bp, Xenorhabdus bovienii
  Coding DNA location: Contig name=SeqID_16893; Position on contig =56322..56669bp; Strand=+
atggtaagcaacgcatccgcattgggtcgcacgggtattcaggactggctgctgctgcgtgcatctgcaatcgttattgttttatacgtcctttaccttgttggttttgtagcaacaacgtcagacatcacctatgaagtctggcgcggtttcttctcttcatctctcactaaagtgttcaccgtgctggtactgctttccattctggttcacgcatggatcgggatgtggcaggtgctgacggattatgtcaagccactcgcactgcgtttggtgctgcaactggtcattattgttgcgctgttggtttatttgatttacggaacaattgttgtgtggggtgcataa

SEQ ID NO: 3877 - DNA, 1767 bp, Xenorhabdus bovienii
  Coding DNA location: Contig name=SeqID_16893; Position on contig =56670..58436bp; Strand=+
atgaaactgccagtaagagagtttgacgctgttgttattggtgcaggtggcgcaggtatgcgtgctgcactgcaaatttcacaaatgggtttatcctgtgccttgatctccaaggtattcccaacccgttcacataccgtttcagcacagggcggaattacggtcgctctgggcaatacccatgaggataactgggaatggcatatgtatgacacggtgaaaggctccgattatatcggtgaccaggatgccattgagtacatgtgtaaaactggccctgaagctattctggaattggagcacatggggctgccattctcccgtctggataatggccgtatttatcaacgtccatttggtgggcaatccaggaattttggtggcgagcaggctgcccgcactgccgctgctgctgaccgtacgggtcacgctttgttacatactctgtatcagcaaaacctgaaaaataacacgacgattttctctgaatggtattcactggatctcgtcaaaaatcaggatggtgctatcgttggttgtactgccatctgtattgaaacgggcgaaatcgtctatttcaaatccaaggcaaccattctggcaactggtggcgctggtcgcatttaccaatccacaaccaatgctcatatcaataccggtgatggtgttggtatggcgctgcgtgccggcgttcctgtacaagacatggaaatgtggcaattccacccaacgggcattgcgggtgccggcgttctggtaacagaaggctgccgtggtgaaggtggttatctgctgaataaaaatggtgaacgcttcatggagcgttacgcgcccaatgctaaagatctggcaggtcgtgatgtggttgcacgttccatcatgatcgaaatccgtgaaggccgtggctgtgaaggtccttggggacctcatgcaaaattgaaactggatcatctgggtaaagatgtattggaatcccgtctgccgggcatccttgaattgtcccgtacttttgctcacgttgatcctgtgaaagagccgattccggttattccaacctgtcactatatgatgggaggaattccaaccaagatcacgggtcaggcgctgactgtcaacgaaaaaggcgaagatgtcatcattccaggcttgttcgctgtgggtgaaattgcttgtgtatctgtccacggagcaaaccgtctggggggtaactcattgcttgatctggtggtattcggccgttctgctggcttgcacctgaaagagtgcctgatggagcagggaaccagccgtgacgccagtgagtctgatgttgacgcagcactgcaacgcctgaaccgctgggataatacccgctccggtgaagatccggttgaaatccgtaaggcactgcaagcctgcatgcagaacaacttctcggtattccgtgaaggtgatgcgatggcaaaagggctggaagagctgaaagtgattcgtgaacgtctgcaaaatgcccgtctggatgatacttcatcagaatttaatacccagcgcatcgaatgtctggaactggataacctgatggaaaccgcatattcgaccgcagtgtctgcgaattatcgtacagaaagccgtggtgctcacagtcgttttgactacccagagcgtgacgatgcgaactggctgtgccatagcttgtatttaccgcaaactgagagcatgactcgccgtgaagttaacatgcagcctacgctgcgtgaagctttcccgccgaaagtgcgttcttactaa

SEQ ID NO: 3878 - DNA, 816 bp, Xenorhabdus bovienii
  Coding DNA location: Contig name=SeqID_16893; Position on contig =58375..59190bp; Strand=+
gtgaagttaacatgcagcctacgctgcgtgaagctttcccgccgaaagtgcgttcttactaattgcgttgctgatgttccagttgcggagaaagagattatgaaacttgaattttcgatttatcgttataatccggatatagacaacgcaccccgtatgcaggattacacgctggaagtagaagaagggcgtgacatgatgctgctggatgcgcttatccagttaaaagagcaggacccgaccttatcattccgccgctcttgccgtgaaggtgtttgcggctctgacggtgtgaacatgaatggtaaaaatgggctggcttgtgttactcccgtttcggtactgcgccggggtaataagaaaattgttattcggccattgcctggtttacctgttgttcgtgatctggttgttgatatgagccagttctacacgcaatatgaaaaaatccgtccttatttgattaacgatggtaaaaacccacctgcgcgcgaacatctacaatcaccggaacagcgtgaaaaactggatggcctctatgaatgtatcctgtgtgcctgctgttcgacgtcttgtccgtcgttctggtggaacccagataagtttattgggccggcaggtcttttggctgcgtaccgtttcctgattgacagtcgtgatactgaaacggcttcacggttggatggcctgaatgatgcgttcagcgttttccgctgccatagcatcatgaactgtgtcagcgtctgtcctaaagggctgaacccgacaaaagcgattggtcatattaagtcgatgctgctgaaacacagcgcataa

SEQ ID NO: 3879 - DNA, 417 bp, Xenorhabdus bovienii
  Coding DNA location: Contig name=SeqID_16893; Position on contig =59047..59463bp; Strand=-
atgagcggtgttgataaaaggttcatttggacgtgcttaatgcatgttctttattggggttttcctacccttcaaggaacctttaaaaactggatatcggtttttaaaggttcctttatttcaaaacatgcgccgtcattcgcagtaggcaatttatcatttttcattcttaatgccctccatcagcttgatatttctttcaaaattgtggagggcaacattatatgcattatttacacgcgatttatgcgttatttatgcactatattttacttatgcgctgtgtttcagcagcatcgacttaatatgaccaatcgcttttgtcgggttcagccctttaggacagacgctgacacagttcatgatgctatggcagcggaaaacgctgaacgcatcattcaggccatccaaccgtga

SEQ ID NO: 3880 - DNA, 2808 bp, Xenorhabdus bovienii
  Coding DNA location: Contig name=SeqID_16893; Position on contig =59522..62329bp; Strand=+
atgcagaacggcgcaatgaaggactggctggactcgagctttctggctggtgcaaaccagtcttacatagagcaaatctatgaagactatataaccgatcctaactccgttgatgcaagttggagagaaatattccaacaattaccggatacaggacttagcggggaacaacttcactcacagacgcgcgattacttccgtcgtctggcaaaagatgccacgcgttatcacacttcagtcagcgatccagcaatggatgcaaaacaagttaaagttttgcagctcattaacgcattccgcttccgcggccatcaaagtgcgaatcttgacccattgggattatggaaacaggaacctgtacccgatctcgatcctgttttccataatttaacaaaagcggattttgaagaaacgttcaatgttggctcgtttgccattggcaaagagacaatgaaactggctgatctatatgacgccctgaaacgcatttactgtggttcaattggtgcagaatatatgcatatcaccaatacggaagaaaaacgctggattcagcagcgtctagaatccgtggcggtaggttcacagttcagtgcggatgaaaaacatcgtttcttggcggaactgacagcagcggaaggcttagaacgctatttgggtgctaaattcccgggggcgaaacgtttctcccttgaggggggtgatgcgcttatcccaatgctgaaagaactgatccgccatgcgggaaaacagggtacccgtgaagttgtgctgggaatggcccaccgtggtcgtctcaacgttctggttaatctctttggtaaaaagccggctgatctgtttgacgagtttgcgggtaaacacaaagagcatctcggtacaggtgacgtaaaataccatcagggcttttcctctgatttcgaaactgaagggggattggtacatttggcgttagccttcaacccatctcaccttgaaattgtcagccctgtcgttattggttcagtacgtgctcgccgtgaccgtcttgatgaaggtcaaagcaacatggttctgccagtaaccattcatggtgacgctgctgtaatagggcaggggattgttcaggaaacactgaacatgtctcaggctcgcggctatgaagttggcggtactgtccgcatagtggttaacaaccagattggtttcactacctctaatccgaaagatgcccgttcaacgcaatactgtactgatattgtgaaaatggtacaggcgccgattttccacgttaatgcggatgatccggaagccgttgccttcgttactcgtttggcgcttgatttccgtaataccttcaaaagtgacgtgatgattgatctggtttgctaccgtcgccacggtcataacgaagctgatgagccaagtgcaactcagccactgatgtatcagaaaatcaaaaaacagccaacaccacgtaaaatctatgcagataaactcatagcagaaggcctgctggcagctaacgatgttactgagatggccaatctgtatcgtgatgcgctggaccatggtgagtgcgttgtggatgaatggcgtcctatgggaatgcattcatttacgtgggagccttacctgaaccacgaatgggatgaggattatccacataaagtggagatgaaacgtctgcaagatctcggcaaacgtatcagcactattcctgctgaagttgaaatgcactcacgtgttgcgaaaatttacggcgaccgtgcagaaatggccaacggcaataagctgtttgactggggtggtgcggaaacactggcttacgctactctggttgatgaaggcatccctgtgcgcctatcgggtgaagatgcgggccgtggtacattcttccaccgtcatgccgttatccataatcagccgaatgctgctgtttatgtccctctggcaaatgttcacaatagccagggtgtattcaacgtatgggattctgttctgtcagaagaagcagtactggcgtttgaatacggttatgcaacgacagaacctcgcgctttgacgatttgggaagctcagttcggtgatttcgccaacgtggcacaggttgtgattgaccagtttatcagctccggtgaacagaaatggggccgtatgtgtggcctggtcatgctgttgccgcacggttatgaaggtcaaggtccagagcactcatcagcacgtctggagcgctatctgcaattgtgtgcagagcagaatatgcaggtttgtgtaccatcaactccggctcaggtttatcacatgctgcgccgtcaggctctgcgtggtatgcgtcgtccgctgattgtcatgacacctaaatcactgctgcgtcatccattggctgtctccagtctggatgaactagctaacggtaaattcgagcctgtgattggtgaaatcgacgccttggatccaaaaggtgttaaacgcgttgtactttgctccggtaaagtttattacgatctgttggagcagcgtcgtaagaacgagcaggctgatgttgccattgtgcgtgttgaacagctgtatccattcccacgtcagaacttgcagactctgcttgagcattatgctcatgttcatgacttcgtctggtgtcaggaagaacctctgaaccaaggggcttggtattgcagtcaacataatttccgtgaagtgatcccatttggggcttctttacgttatgcaggtcgtccagcatctgcttccccggcagtgggttatacgtctgttcaccagcagcagcagcaagcgctggttaatgatgccctgaacgttgaataa

SEQ ID NO: 3881 - DNA, 1215 bp, Xenorhabdus bovienii
  Coding DNA location: Contig name=SeqID_16893; Position on contig =62343..63557bp; Strand=+
atgagtagcgtagaaattctggttccagaccttcctgaatctgttgcagatgccactgttgcgacatggcataaaaaagcaggtgacactgtacaacgtgatgacgtgttggttgaaattgaaactgataaagtcgttctggaagtacccgcgagtgaagccggtgttctggaagctattttggaagaagagggtgccacggtactgtccaagcaactgctcggtcgtatccgtttgagtgatagcacgggtattcctgctgaagtaaaagaaaaaacagaatcaacaccagcacagcgccagactgcttctttggaagaagaaagcaacgacgtattaagtcctgcggttcgtcgtctgattgcagagcatgatttagatcctgctgcaattaaaggcagtggcgttggtggccgtatcgttcgcgaagatgtggaaaaatatatcactgcgcataaaaaagagagtggcaaagtggctgaagctgcaccagcacagtcttctcagctgccacatcgtagtgagaaacgcgttccaatgactcgcctgcgtaaacgtgttgcagaacgcctgcttgaagcgaaaaacaacactgcaatgctgacgacgttcaacgaagtcaacatgaagccaattcaggaattgcgcaagcagtacggtgacgcgtttgaaaaacgtcatggcatgcgtctgggcttcatgtccttttatgtgaaggcagtcgttgaagcactgaaacgctatccagaagttaacgcttctattgatggcactgacgtggtttaccacaactattttgatatcagcattgcggtatctacacctcgtggtctggttacaccagtactgcgtgatgcagatgcactgggcatggctgatattgagaagagcatcaaagagctggctattaaaggccgtgacggtaagttgaccgttgaagaactcactggcggtaatttcacaattaccaacggcggtgttttcggttctctgatgtctacaccgatcattaacccaccacaaagtgcgatcctcggcatgcatgccatcaaagatcgcccaatggcagtgaatggtcaggttgagattcttccgatgatgtatttggccctgtcttatgaccaccgtctggttgatggacgtgagtctgtaggcttcctggtaaccatcaaggaaatgctggaagatccgacacgtttgttgctggatgtatag

SEQ ID NO: 3882 - DNA, 147 bp, Xenorhabdus bovienii
  Coding DNA location: Contig name=SeqID_16893; Position on contig =63511..63657bp; Strand=-
atgaccagcccgggggctggcctgcatatacattttttacatcaacattgctttacttcagactgggcagaatttaacaccctccaccccgatggtgatgctatacatccagcaacaaacgtgtcggatcttccagcatttccttga

SEQ ID NO: 3883 - DNA, 1167 bp, Xenorhabdus bovienii
  Coding DNA location: Contig name=SeqID_16893; Position on contig =63720..64886bp; Strand=+
atgaatttacacgagtatcaggcaaaacaactttttgcacggtatggtttaccagctcctgctggttatgcctgcaccacaccgcgcgaagcagaagaagcagcatccaagattggttcaggtccttgggtcgttaaatgtcaagttcatgcaggtggtcgcggtaaggctggtggcgtgaaagtcgtcaacagcaaggaagatatccgtgcttttgctgaacaatggctgggtaaacgactggtaacttaccagactgatgcgcagggtcagcctgtacatcagatcttggtggaaggggcaaccgatattgccaaggaactctatcttggtgctgttgttgaccgtggtacacgtcgtgtagtgtttatggcctctaccgaaggtggtgtcgaaatagaaaaagtggcggaagaaacgcccgaactgattcataaagcaatcatcgacccactggctggccctatgccgtatcaaggccgtgaactagcgttcaaactgggtttaaccagtaaacaagttggtcagttcactaagattttcatgggattggcaaatctgttccttgagcgtgatctggctatggtcgaaattaaccctctggttattacaacccaaggtgatcttatctgtctggatgggaaactgggtgcagatggtaacgcaatgttccgtcaggctgaattgcgtgaaatgcatgatccttcacaggaagatccgcgtgaagcccaggcagcacaatgggaactgaactatgttgcgcttgatggcaacattggctgcatggtgaatggtgctggtttggcaatgggaaccatggacattgtcaaactgcacggtggcgccccggcaaacttccttgatgtgggtggtggtgcgacaaaagaacgtgttaccgaagcattcaaaattatcctgtcagatgaaaatgttaaagctgtttttgtgaatatttttggtggcattgtccgctgtgacttgattgctgacgggattattggtgctgtggaagaagttggtgttcacgtaccggtagtggttcgtctggaaggaaacaatgctgaattgggcgcgaagaaactggcagacagtggtttgaacatcattgcagcaagcagtttgacagacgcggctaaacaggcagtcgcagcagcggggaataaataa

SEQ ID NO: 3884 - DNA, 876 bp, Xenorhabdus bovienii
  Coding DNA location: Contig name=SeqID_16893; Position on contig =64886..65761bp; Strand=+
atgtctattttaatcgataaaaacaccaaagtgatctgtcagggatttactggcagtcagggtactttccattcagaacaggcgattgcctacggtactcaaatggttggcggtgtgacaccaggcaaaggtggcactgagcatctggggcttcctgtattcaataccgtacgtgaagcagtggaagcgactggtgcgacagcttctgttatttatgttcctgctccattctgtaaagactccattctggaagcgattgatgcaggcatcaaactgatcattaccatcacagaaggtatcccaactctggatatgctgacagtgaaagtaaaactggatcaagcaggtgttcgcatgatcggtcctaactgtccgggcgttattacgccggatgcgtgtaagatcggtatcatgcccggccatatccacaaggcaggtaaagtgggtattgtatcccgctctggtacattgacttatgaagccgttaaacagacaacggatgcagggttaggccaatctacctgtgttggtatcggcggtgacccaattccaggctcaaactttattgatattctgaaactgttccaagaagatccgcagactgaagctatcgtcatgatcggtgaaattggtggtacagcagaagaagaagcagctgcttacattaaagagtatgtcactaagcctgttgtcgcttacattgcaggtgtaactgcgcctaaaggtaaacgtatgggccatgctggtgcgattattgcgggtggtaaagggactgcagatgaaaaatttgctgcattggaagcggctggagtgaagacggttcgcagtctggctgacatcggtgacgcagtaaaaggtttattagcaggcaactag

SEQ ID NO: 3885 - DNA, 99 bp, Xenorhabdus bovienii
  Coding DNA location: Contig name=SeqID_16893; Position on contig =66270..66368bp; Strand=-
ttgcggcaacccgactccgtaaacggaagtctcgtaactaccagcaataaatgcctaaaacacaacaatgaattattaagtaaatcagatattcagtag

SEQ ID NO: 3886 - DNA, 1572 bp, Xenorhabdus bovienii
  Coding DNA location: Contig name=SeqID_16893; Position on contig =66403..67974bp; Strand=+
atgtttgatattgtcgaactgtcacgattacagtttgccttaactgctatgtaccatttcttgttcgtgccattgacgctcggtatggcgtttttgcttgcgatcatggaaacggtatatgtcctttctggcaaacagatctacaaagatatgacaaaattctggggtaagttatttggtattaactttgctctgggtgttgcaacgggtttgaccatggagttccagttcggaaccaactggtcatacttctcacattacgttggtgatattttcggtgcaccgctggctattgaaggcctgatggcattcttcctcgaatccacattcgttggtctgtttttcttcggatgggatcgtctgagcaagaaacaacatctggctgttacttggctggttgggctgggctctaacttctccgcattgtggattctggttgcgaacggttggatgcaaaacccgattgcgtctgatttcaattttgaaaccatgcgtatggaaatggtgagtttcagcgaattggtgcttaaccctgtggctcaggtgaaatttgtacacactgttgctgcgggttatgtgacaggcgcggttttcgtcttgggcatcagctcttactatctgcttaaaggacgcgatattccgttcgctaaacgatcttttgcgattgcatcaagttttggtattgctgcgatactgtctgtcattgttctgggtgatgaatctggatacgaaatgggggacgtacagaaaaccaaactggctgccattgaagctgaatgggaaactcaaccacctccagcttcattcactctgattggtattccggatcaggataaaatggaaaataaatactctattcaaattccttatattctgggtctgattgccactcgttccactgatacacccgttgtcggcctgcgtgacttgatgggccagcatgagcagcgtatccgtaacggcattaaggcgtacgaattactggaagagttgcgttctggcaatattgatccaacggttcgcaatgcatttaatgaaagtaagaaagatcttggttatggcatgctcgtgaagcgttatacccaagacgtagcaaatgcgacagaagaacagattaaatccgctgcgaaagattctatcccacgtgtagcgccactctactttgcattccgtattatggtcgcttctggttttctcatgttgctggttatcggtctggcattcctgagtgttattcgtaatcgcatcggtcagcagaaatggttgctgcgtgcagcgctgttcagcatcccactaccgtggattgctattgaagcagggtggtttgttgcggaatatggtcgtcagccgtgggcgattggtgaaattctgccaaccgcagttgctgcttcgacacgcagtgttggtgatctgattttctcaatggtactgatttgtggtctgtacactttgttcttgatcgcagaaatgttcttgatgttcaaatttgctcgtctgggtccaagtagcctcaaaaccggacgttaccattttgaacagaaaaccgcttcttcagccaacaatattgagtaa

SEQ ID NO: 3887 - DNA, 1140 bp, Xenorhabdus bovienii
  Coding DNA location: Contig name=SeqID_16893; Position on contig =67989..69128bp; Strand=+
atgcttgattatgatgtattacgatttatatggtggctgctgattggtgtgttgctgatcggtttcgcagtgactgatggtttcgatatgggagttggtgttctgctgcggatcatcggtaaaaacgatactgaacgccgcatcatgattaactcgattgcccctcactgggatggtaatcaggtttggttaattacagccggtggcgcactgtttgctgcatggccgatggtatatgctgctgctttctctggtttttatgtcgcgatgatcttggtattggctgcgctgtttttccgtcctgtcggttttgattaccgttcaaaactggaaaatagtcaatggcgcagtatgtgggactggggaatcgttattggtagctttgtaccgccgctagttattggtgttgcatttggtaatctgctgcagggtgtaccgctggcgatagattcctatatgcgattgtcctatgaagggtcattcttcgggttgttgaatccttatggcttgttggcgggtatcatcagcctgatgatgatcgtgacacaaggtgctacttacctgcaaatgcgtacaaccggtgagttgcatctgcgttcgcgcactgccacacatgtctgtgcattggtaacagtagtcgccttcctggtggcaggcgtatggttgatttatggcatcgatggttatgttgtgacaggagggttggatgttaatggcccatctaacccactgcataaagaagtcgcgcatcaggcgggggcatggctgattaactttaataaatatccggcgctgtgggcagtaccggcattgggtgtcattcttcctctgctgactatgctggcgacacgaatggataaaggggggtgggcattcctgttttcatcattgaccgttgcctgcatcattctgacttcgggaattgcgatgttcccatttgtgatgccatcaagcattgatccgaatatcagcctgactatgtgggatgcgacatccagtcagtggacattgcaagttatgtttgttgttgcacttatcttcgttcctcttatcttgtcgtacaccacctggtgttactataaaacttttggacgtttggataagaattatattgaaaacaacaaaaattcactgtactaa

SEQ ID NO: 3888 - DNA, 156 bp, Xenorhabdus bovienii
  Coding DNA location: Contig name=SeqID_16893; Position on contig =69125..69280bp; Strand=-
ttggtagcatttatcagccaacattatttttcgccactctcagttgctttttttgattcgctctgctcaagtgccaaggctgcaatgatagcgaaactacaagctaagagcgttccgagaatccaagcaaaataccacatgcgctatgctccttag

SEQ ID NO: 3889 - DNA, 288 bp, Xenorhabdus bovienii
  Coding DNA location: Contig name=SeqID_16893; Position on contig =69257..69544bp; Strand=+
atgttggctgataaatgctaccaactcatggataaggggcctctgagggcccttatcctcatcatggctctggcgcttgcctcatgtgtattctgggatcctgcacgttttgctgctaacaccagttcacttcatgtgtggcagggtgttttactgatttgggctgtttgttctggtgttacctttggtgtcggatttcatcctaaacagattatctggcggcttttttttcatccattacctgcatttttcattcttctctttggcttatatcatttttttaagtaa

SEQ ID NO: 3890 - DNA, 396 bp, Xenorhabdus bovienii
  Coding DNA location: Contig name=SeqID_16893; Position on contig =69679..70074bp; Strand=+
atgttgttccgttggcctatccgtgtttattacgaagacacagatgctagtggtgtggtctatcacgcgcaatatttagccttttatgaaagagctcgtactgaaatgttgcgtgaaaaaggcttccatcaaaagtatatgctggatgagcagattggctttgttgttagtcgcatgactgttgactaccggaaaccagctagattggacgacttgctggttgttgaaagcgaaattacgaatattcgtggcgcttctctgacatttactcaacgaattgttgattgcaatggtgtagctatcagcagcgcagaatctctggttgtctgcgtgaattcatctcaaatgaagcctattgcgcttccaaagtctattgtcgcggagtttaagcagtga

SEQ ID NO: 3891 - DNA, 681 bp, Xenorhabdus bovienii
  Coding DNA location: Contig name=SeqID_16893; Position on contig =70080..70760bp; Strand=+
atgaatatccttgatttatttctgaaggcgggctttttagtgcagttgatcatgttaatcttgatcggcttctctattgtttcttgggcaatcattattcaacgaacgagaattcttaatgctgccacccgagaagcggaagcatttgaggataagttttggtcgggaatcgaattgtcccgtctttataaagaaagtcagtcacgccgtgattcgttaaacggtactgaacagattttccattctggttttaaagaatttgctcgtttgcatcaagtgaatagccatgtaccagaagctgttatcaccggggcttcccgtgccatgcgtatttcaatgaaccgtgaactggaaacagtggaaaatcacattccatttttggggactgtgggttccatcagcccttatattggcctgtttgggacggtttgggggatcatgcacgcctttatcgccttgggtgcagtgaagcaggcaactttgcaaatggttgctcccggtattgctgaagccttgattgcaacagcaattggtctgtttgccgccattcctgcggtgatggcctacaaccgtctgagccagcgcgtcaataaactagaacaaatctacgataattttatggaagaatttctggcgattttgcatcgtcaggcttttactcctaataccaataagtcgtaa

SEQ ID NO: 3892 - DNA, 432 bp, Xenorhabdus bovienii
  Coding DNA location: Contig name=SeqID_16893; Position on contig =70785..71216bp; Strand=+
atggcgcgcactcgtagtcgcagacgtgagctaaaatccgagatcaatatcgtccccttgctggacgtgttgctggtgttgctgcttatctttatggcaacggccccgattatcacgcaaagcgtagaagttgacttacctgatgcggtggattctaaggcagtttccagctctgataatccgccggtcattatggaagtttctggtattgggcaatacaatatgatcgttaatcaggaacgtctggaattgttacctgaacagcaaatcattgttgaagctcaagccttgatgaaagccaatcctaaaacagttttcctgattggtggttctaaggaagttccttatgacgaaatcatcaaggcgctgaatatgcttcgtcaggcgggtgtaaaatcggttggtttaatgactcagcccattggggcctga

SEQ ID NO: 3893 - DNA, 1122 bp, Xenorhabdus bovienii
  Coding DNA location: Contig name=SeqID_16893; Position on contig =71243..72364bp; Strand=+
atgtcgagcgtgggaaagacaaacgagcaaaataataggctgaatcgcgccattatcatttcggttatacttcacattatcctgatcgggtttctgatttggggttcgctgatgcaaaaaacagaaatgggaggcggcggagctggtggtactgtcattgatgctgttatggtcgatccgaatgcagtcgttcagcaatacaatcagcaacagcaacagcaggctaatgcaaaatcggctgagcagcagcggaagaaaaaagctgaacagcaggcggcggaattacgggtaaaacaggctgaggagcaggaacgcttgaagtcggcagaagaagagcgaataaaagcacaacaggcgtctgaagaacagaaaaaacaggctgatgccgccgcttcgaaagcccgtgaggaacaaaaacttgcggaagaagctgctgctaaggcgaaagcagaaaaagaaataattctaaaggaacaggcagaggctcggcagaaggcagaggttcaggccaagaaagaagcggaagagactgcgaaacgcaaagccgcatctgaggcgaaggctaaagcagaagccgaagctcaggccaaagcagaggctgaagccaagaccaaagctaaagcggaagccgagtctaaggtaaaagccgaagccgaatctaaggcaaaatcagaagccgaggcagaaaccaaagcgaaaacagaagctaaggccaaagccaaggccaaggcagaagcgacaaaacaggctcaggaagttgatgacctgctgggtgggttaacgtccagtgcacctaagcagggcggggcgtctgcggctggtcaaggtggcggcaagaaaagcggcccttcacagtcggatatcaataattacaaggggcaaattcagactgcaatccagcagaatttccatgacccgagtttgtatctcggacgtacttgtgagttaaggataaaattggcaccggatggcctgctgattgatattaaggctggtgcgggtgaccctgcgttatgcagggcagcggttgcggcggctcgtcagactaaaattccacgaccaccgagtaaagagatttatgagcatttcaagaattcctcactggatttcaagccccagtaa

SEQ ID NO: 3894 - DNA, 289 bp, Xenorhabdus bovienii
  Coding DNA location: Contig name=SeqID_16893; Position on contig =72534..72822bp; Strand=+
atgaagcaaacttttaaacagtcgtttaaaatagtattaggctttttgatgatgtgggcagcgcttgctcatgcggaagttcgcattgaaattacacaaggtgttgattctgcacgtcctattggagtcgttccatttaaatggacaggtgcagccaatgctccagaagaaattggttcaattattgctgcggatttgagaaacagtgggaagttcaatcccattgattcaaaccgtatgccacaacaacccacaactgcatcagaggtaacacctgctgcatggtctg

SEQ ID NO: 3895 - DNA, 603 bp, Xenorhabdus bovienii
  Coding DNA location: Contig name=SeqID_16894; Position on contig =33..635bp; Strand=-
atgaaaaagttgatgttaagattggcgttttttatttctgtcagtgtttttgctgttagtagcgtgtttatttcagggtgcagcagtagtcagccgcaaaaaacttactaccagctaccggctttaacgagtacatcacaggaaagtcgattaggtgtcaaagatgaacgacaattatgggtaaaaggagtgactcttgctgattaccttgcatcaccgggtatcgtttatcaaacaggggacgtgatctatgtcaatgcttcgaatcacttgtgggctagcccattagaacaacaattacagcaggttttgatcacggaactaagcgcggcatttccacaaaaactcgttgccggacaaccgctggagaaaaatgcggatacactgaatatcacaataaccgcttttcacggacggtatgacggaaaggtgatgattcaaggatattggatgttatttaatcagaatggtgtgattaaacggccattcaatcttgagttgaaacagaaaatagatggttatgctgaattagtacgcactttggcaacaggttatagtcagttggctcaatccatcgctagtcagatagcctctcctgtctaa

SEQ ID NO: 3896 - DNA, 1665 bp, Xenorhabdus bovienii
  Coding DNA location: Contig name=SeqID_16894; Position on contig =635..2299bp; Strand=-
atgaggagtcgtaaggtgacggataaagaagaagatctgactcaggccagaatcagtaaactcaagagttggtcacctgtatggattgtgccaattatcactgtgctaattggcgcctggatattgttttatcatttcagtcatcaagggcctgaagtgacattgatgacatccaatgctgagggcattgaagcaggcaaaaccaaaataaaaagccgtagtgttgatatcggtatagttgaacgtgtgtcactgagtgataacttaggccaagttatcatcaaggctcgcctgaatgatggtatggagcggctattataccaagatactgcgttttgggtcgttaaacctcaaattggccgtgaaggtatttctggcttgagtacattactgtccggggtatttattgaattacagccaggcaatcaaggtggtgaagagaataaattttcattactggattcacctccgctggcgtctcctgatgcaaaaggtatgcgtctggtcttaatcagtgaaaaagcagggcagttaactcccggtgaccctgtgctatttcgggggtatcgggtaggttcggttgaaaccagtacttttgatcccaaatcgcggttaatgcgctaccaaattttcgtcaatgcaccctatgatggattgttgacctcgggtgtcagattctggaaagacagcggtgttgccttcgacatgtcctcacaggggctacgggtcgaggttgcatcattatccactctgtttggcggcggtgtcagttttgatgtaccgaaaggttgggatttgggcaacccggttaaagaaaaagaaactttcaaactttatgacagtgagaaaaatatccaaaactcactctatacaaagcataaagacttattgttgtttttcgctgattcagttcgtggcttgcagctgggagcgccagtcgaatttcgcggcatacgggtgggaactgtggcaaaagtgcctttttacactgaaggcgttagacagcgacttgataatgacttccgtattcccgtattgattcatattgaacctgagcgttttgagaaagagattggtagtggtttttatactgataaggaacttgaggaaattattgcgcgcggcctgagagcctctttgaaatcaggaaacttactgacaggggcattgttcattgatttggacttttaccccaatgaggaaaaatggacaggtccatatgaaatcgcaggttatgaaattttgccaacagtaagtggtgggttggctcaaatccagcaaaaagtcattatggcactggataaaattaataatatgccgattgagcccgtatttgttcaagctacccggacattagaagaaagccagaaaaccatcaaggcagctcgaaaaacaatggatgaattaaatcgcatccttgcgagcaaagaagctcaggggcttcccaaagatatacaaaatacactgcaagaattaaaccgcagtatgcagggcattcaacccggatctccggcttacaataagctgattgataatatgcaacggctggatcaagtcttgcgtgaattgcaacctgtcttgaagacacttaacaataaaagcaacgcattggtatttgaagctgaagagatgaaagatcctgaacccaaaaaggcgcgtaactaa

SEQ ID NO: 3897 - DNA, 1302 bp, Xenorhabdus bovienii
  Coding DNA location: Contig name=SeqID_16894; Position on contig =2286..3587bp; Strand=-
atggccttgttgatttgctacaggagaaacactttgtgttccaataatcatcagcatgacaagctggttttgtgtccccagtgtgacatgctggtggccgtgcctaacttggaacaagggaataaagcggcttgcccccgatgtgagactttgctgacagcaaagtggaaagagccacgtaatcagccaacaggctatgcagcgagtgcattattgatgctgttcctcgccagcctctttccgtttgttagcatgaatatcgcgggtattgtcagtgaaatatcgctgcctcagatcccgaaagtgatgtttagcgaagactattcaagcatagcagtgtttttcctgatttttgttcagctcgtacctgcattttgcatggtcgccattattcttttgtgtcagaacattaagatggcgcgtcgcttgaaaattgagctggcgcgtattttatttcagatgaaaacctggtgcatggcagagatcttccttgcaggagtgttagttagctttgtcaagttaatggcttatggcgacattggtattgggttgagtttcctgccttattgtctattctgcctgtttcaggtcagagcatttcaatgtcttgacagacactggttttggaatgaaatagagccagcacctgaagtgtgtatacctttacaggcaggtaaaccgggtttggtgcaaggtgtcaggcggtgccagtgttgtaccgccatcttgccagcccagctgccgcagtgttcccgctgccatactacgggacatgcccgtcgtcgccatagcctccaatacactatggcactattgataacatccgccatactttatattccagcgaacctgctgccgattatggtgactcaggcattgagtagccatattaactccaccattctggaaggcattattctactttggagcacaggttcttacccggttgcaatggttattttcatcgccagtattatggtgcctatactgaaaatgctggctatcagttggctgtgctgggatgcgaagagtcagagcagtcatgattctgaaacgatgcattttatctatgaaatggtcgaatttgtcgggcgctggtccatgattgatgttttcgttattgcggtgctatcagcgctggttcgcatggggcagttcatgagtgtctatcctgccaccggagcagtcctgtttgctctggttgttatcttgacgatgtttgcgtcaataacatttgatccgcgcttaacttgggacaaagccaatcataaatttgagttacagaaaaatgaggagtcgtaa

SEQ ID NO: 3898 - DNA, 174 bp, Xenorhabdus bovienii
  Coding DNA location: Contig name=SeqID_16894; Position on contig =3531..3704bp; Strand=+
atgctgatgattattggaacacaaagtgtttctcctgtagcaaatcaacaaggccatactcttgatctttcaaattgctgctgcgttcactcaccccagccacatagtgatctatgcgcccgggggatttcttcacttaccgccgcgctgcaaattgaaatttattggaaatag

SEQ ID NO: 3899 - DNA, 1911 bp, Xenorhabdus bovienii
  Coding DNA location: Contig name=SeqID_16894; Position on contig =3715..5625bp; Strand=-
atgtcattgattaatctctccggtgcctggttatcattcagtgatgcgccactgttggataatactgaactgcatatagaagaaaacgaaagagtgtgtctggttggtcgcaatggagcagggaaatcaaccctgctgcgcgtactggcaaaagagcagccattggatgatggtcaagttatttatgagcaggatttgattgttgcccgtttacagcaggacccaccccgtgatgtagaaggcacggtatttgattttgtgtcggaaggggtaaaggaacaggcggattgcatcaaggcatttcatcatgcttcccgtctggtggaaactgatcctagtgacaagaacctcaatcggctagcagaattgcaggaagtactggatattcagggactttggttactggatagccggatcagtgatgtcttgaaacaactttctttgccagcagaagcaaaattgtcctcactttccggtggctggttgcgcaaggccgcattgggaagggcgctagtcagctcgcctagagtgctgtttcttgatgaaccaacaaaccaccttgatattgatacgattgagtggttggaaaattttttgaaagacttcaacggaagccttgtttttatttcccatgaccgctcattcattcgcagtatggcaacgcgcatcattgatttagatcgcgggaaactgacttcgtggccaggaaattacgataaataccttgaaagcaaggaagaggcattgcgggttgaagaattacaaaatgccgaatttgataaaaagctggctcaggaagaagtctggatccgtcagggcattaaagcacgacgtacccgtaacgaagggcgggtaagggcgttgaaagcgttgcgtgtagagcactccgatcgtcgtaatgttatgggtacggcgaaaatgcaggtcgaagaagcgacacgttccggtaaaatcgtgtttgaaatggaaaatgtgaattaccagattggtgataaaacattggtcaagaatttctcggcgcaagttcagcgtggagataaaattgctttagttgggccaaatggttgtggcaaaacgacattattgaaactgatgctgggagatttgtcgtcagagagtgggcgcattcactgtggaacaaaacttgaagtggcttactttgatcagcatcgtgccgcattagacccggacaaaacggtcatggataaccttgcagaaggcaagcaggaagtgatggtgaatggacgctcccgtcacgtactgggctatttgcaggacttccttttccatcctaagcgagcgatgacgcctgtgcgggctctctctggtggcgaacgtaaccgactgttgctggcgcgcctgttcctgaaaccgagcaacttgctcattcttgatgaaccgaccaacgaccttgacgttgaaacgctggaattactcgaagaattggttgatggctatacaggtacggtgattctggtcagccatgatcgtcaatttgttgacaattccgtgactgaatgctggatttttgaaggcaatggcgaaatcaataactatgtaggaggttattacgatgcccaacaacaacggacgcagactatctccctacaccagtcttcagagaaaaaaaacagtatcgaaacgaaggcagtcaagtctaaagaaacatctaaacgggcaagcaataagataagttaccatttactgcgagagttagaacaactaccatcattattagaaaccttagaggaagaaatagaacaattgcaatcccaggtcggtgattctgaattcttcaatcaaccacacgcagtcacacaaaatgttctgaatgaattggcaaataaagagcaaaagctggaaaaagcttttgatcgctggcaggaactggaaatgataaaaaatggatga

SEQ ID NO: 3900 - DNA, 2118 bp, Xenorhabdus bovienii
  Coding DNA location: Contig name=SeqID_16894; Position on contig =5630..7747bp; Strand=-
atgaactctctctttgccagcacggcacgtgggctggaagaattattaaaaaacgaattggaaatgctgggagcgcaatcctgcaagattgcccaaggtggggttcattttcaaggtgatgatcgggtgatgtataaaagcttgctctggagcaggctggcatcacgtatcctgatgccgcttaacgaattcaatgtttatagcgatttggatctctatcttggggttcaatctattgactggagcgaaattttttccgtcgatagcacattctcagtgcatttcagtggcacgaatgaggaaatcagaaacacacaatatggcgccctgagagtgaaagacgccattgttgatagctttgtacgtaaaataaagcaacgtcctgatgttgccaaacaacagccggatattcgcattgatgtttttctgaacaaagaaaaagcgacactgtcgcttgatttgagtggagaagggttgcatatccgtggctaccgtgatttggctggtcaagctccgctgaaagaaacacttgcggcggcggttgttttgcgctctggctggaaagcgggaacgccgctgattgatccaatgtgtggttcaggaacgttattgatagaagcggcaatgatggccgcagatggcgctccaggtttgcatcgtcagcattggggattcacatcatggctgaaattcgatcaagaaatctggcgtgaaatgatggctgaagcgcaggtacgtttccgtaaagggctacaggaaacgacttctcgcttttttggttcggatattgatcgtcgggtcatggatatggctcgctcaaatgcccgcagagcaggcgttgcccacttaattcagtttcaacaaggggatgcgagtaagctggaaaacccattgccggagggcgctgtgggaacaatactgagcaacccgccttatggcgaacgtcttgaaagtgagccagcactggttgccttgcacagcatatttggacgaataatgaaaagccgcttcccaggctggcgtctctcattattcagtgcttcgccagagttgttgagttgcctgcaactgcgcgctgaacgcgagtttaaggctaaaaatggcccactggattgtgtccagaaaaattatcaactttcggacaaaccgcaatcactggatgccggtattgcagatgattatgctaaccgtttgcgcaaaaatgagaagaaactcagtaagtgggcaaagcagcagggtattgactgttatcgtttatatgatgcagatttacccgaatacaacgttgcgattgatcgttatgcggacaaagttgtcgttcaggaatacgcgccacctaaaaccgtagatgccaacaaagcccgccaacgcttattcgatgtgatcagtgcaaccatgaatgtgctcgaattgtcatctaatcaactgatcctgaaaacccgccagcgtcaaacaggcaaaaatcaatatgaaaaaatggccgaaaagaaagaattctttttggtgaacgaatatggtgcgaaattctgggtcaacttgacggattatctggataccggtctgtttcttgatcatcgtattgcccgcaaaaaattgggtgaaatgagccaagggaaagatttccttaacctgtttgcctatactggttcagcaacggtgcatgctggattaggcggtgcgaggtctacgaccacggtggatatgtcccgtacttatcttgaatgggcagagaagaatctacaggctaatggcttgtctggacgccagcatcgtttgattcaggctgattgtttgggatggctggcgcaaagtcgcgagcaattcgatttgatctttatcgatcctccgacattttctaactctaagcgaatggaagactcattcgatgttcagcgtgatcacattccactcatgaaacagcttaaatgtctgcttcgtcgtggcggaaccctgatgttctccaacaataagcgaggtttcaaaatggactttgccgaacttgagaaattagggctggttgcggaagaaatcacagagaaaacggtatctcaggattttgcccgtaaccgccagattcataactgctggctactgcgtcacgctggcgaggaaaaataa

SEQ ID NO: 3901 - DNA, 99 bp, Xenorhabdus bovienii
  Coding DNA location: Contig name=SeqID_16894; Position on contig =7802..7900bp; Strand=-
atgtatagagacgtgacagagttatcattcagtatgcccaaaaaatgttttttattttttgataaggtgagcaactttatgacatgttgctggtattag

SEQ ID NO: 3902 - DNA, 1113 bp, Xenorhabdus bovienii
  Coding DNA location: Contig name=SeqID_16894; Position on contig =7873..8985bp; Strand=+
atgataactctgtcacgtctctatacatacccagtgaaatcaatgcgtgggttgcagctctcgcactcctttaccggtgaaagtggtttgatgtttgatcgcaactttatgattaccaaaacagatggcagtttcatgacagctcgcctgtatccccaaatgctgctatttaccccttccatgctcaataacggtatttacttgagagcgcctaatggggaaagtgcaacgatactctacagcgattttaaagaagaacgccatcctaccgaagtttggggcaatcattttactgcgttggtcgctcccgatgaggtgaatacctggctgggtggcttttttgatacacctgtgcaactccgctggctcagtgaagagttaacccgccgagtgaaacaattccctgatatctcactgtcatttgctgatggttttccctacttaattattaatgaagcttcttttcatgcgttgcagcaacgttgtcccgccagtatcaaaatagaacaattccgtgccaatattgttgttacaggcgcagcacctttcgaagaagatagctggcagaccatccagatcggcaatattatttttgacctgccaagaccatgtagccgctgtattttgactacagtaagcactgaaaaaggccgtaaaaatccgaaaagcgaaccactggctacattgcaatcattcagaactgccaaagagaatggggcagttgattttggacagaatgccattgtccgcaataatgggattattcgcgtaggtgatagcgtcactattttagagaagaaaacacctcgtgaatatggctgcggtgagcaagcaaaagatttgaatatacagaaagcaattgggcaagctatttcaattgaattcaacggtcagcgttttactggaaataatcagcaaattattttagaacagttggaaaaacaaggtattaaaatcccctattcatgtcgcgcgggaatttgtggttcctgtaagatatctctgattgaaggtaatgtgtcaccattaaaatcgaccgctatcaaagataatgggaaaattctggcgtgtagctgcattccccaaaatgatttggttattgaattaaactaa

SEQ ID NO: 3903 - DNA, 99 bp, Xenorhabdus bovienii
  Coding DNA location: Contig name=SeqID_16894; Position on contig =9157..9255bp; Strand=-
atggcagagcgatttaatatattaagccattttgttaatatcacttgtcatttatcaccattcaacagtaacattcagaacattttttgtttaaattga

SEQ ID NO: 3904 - DNA, 552 bp, Xenorhabdus bovienii
  Coding DNA location: Contig name=SeqID_16894; Position on contig =9239..9790bp; Strand=-
atgaaaattagacctgatgatcagtggcgctggtactttgattccgagcacagccgtgtcatgctcgatctcgctaatggcatggttttccgttcccgttttcctgccaaaatgctgactgattatgcaatcacgatggaagaaatgcctttttctgtcgatgatgcagcactttattatgctttcgaagaacatttccgttgtattaatattgcatcagagctccgggctgaattagcattgaatggcgtagttgcattccgttttatgaaaccacaaatgccaaaaagctggtatttttccagtttctctgtaatgacaaaaccggaacagggggaaattgttcaagttcgtttacaggattgcggtactgaagtgctattcatggtggcagaagtcggtgatagcgccagcttgtgtttattagcacaacaaaagttagaacttaatgatcgagtgatgaatttttgtgatccaattaagataatgaatgaccgtttaatgccttatactgaacccactcgggaaacgatatatggcagagcgatttaa

SEQ ID NO: 3905 - DNA, 123 bp, Xenorhabdus bovienii
  Coding DNA location: Contig name=SeqID_16894; Position on contig =9809..9931bp; Strand=-
ttgggggtttatttctactctcaactcgtctatattttgtctgatagattaatttttttatcagtttttctggttttccactatggtagtgttatttattttgaaccaaacaagctattttga

SEQ ID NO: 3906 - DNA, 1206 bp, Xenorhabdus bovienii
  Coding DNA location: Contig name=SeqID_16894; Position on contig =9952..11157bp; Strand=-
gtgatttatttgaaaaaatcaccaaggcgcttgagagctgagttgtcgtttttcctccggcgttggccggaggatgtttgccagcaaattgaaaaatatcttcccgcacatttacattttgacaggatctctttaagatgctcggcgcttatttcacagtcgccccgacctgtcattacgcccgcaggagattgcatgtattattcgctactacggaaggcattgttccagcttgatcccgaacaggcacacgagcttactttccgccagctcaaacttgttaccggtactcctttcgaatttcttatccgccagtcagttgccactaaacccgtcacttgtatgggcttatctttcaaaaatcctcttggcttggccgcaggccttgataaaaacggtgattgcattgacgcatttggtgcaatgggttttggttttgtggaaatcggaacggtaacaccgcgcccacaggttggaaatgacaaaccaagattgttccgcgttgttgaagcggaaggcatcatcaatcgaatgggttttaataaccttggtgttgataatttagttgagaatgtcaaacgggcaaaatacgatgggattattgggatcaatattggcaaaaataaagataccccaatagagaatggcaaagacgattatttaatttgtatggataaaatttatcctcacgcaggttatattacgattaacatttcgtcccccaatactccaggtttgcgaacgttacagtatggtgaagcgttggatgatctcttatctgcgattaaaaataagcagagtgaacttcagcagaaattccaaaagtatgttccgattgctgtgaaaattgcaccagatctgacagaagaagaattaatacaagttgcagacagtttaatgcgccatcgcattgatggcgttattgctactaataccacactggatagaaagctcattgaagggttgaatcactgccagcaggctggtggattaagtggtcgtcctgtgcaacttcgcagtacagaaataattcgatgcttttctcaagaattaaaaggtaaaatacccattattggtgttgggggaattgattccctagttgcggctagagaaaaaatggaagtagggtcttctttgattcagatattttctggttttatctataaagggccaaaactaatcaaagatattgttaatcatatctga

SEQ ID NO: 3907 - DNA, 2619 bp, Xenorhabdus bovienii
  Coding DNA location: Contig name=SeqID_16894; Position on contig =11117..13735bp; Strand=-
atgacacaacagcgactcgttaaacaccgtctggattatcaagcaccagattacacgattacggacatcgatctcgactttgatctgcatgccgataaaacaactgtgacggcaatcagtcaagtaaaacgcttgaaccatgatactactccattgattttggatggagaaaatctcactctgaaaagcattcatattgacgataaggcgtgggaacattatcacgagcaggatggcaaattatccattgagcagttgccagcccagttcaccctgacaattgtgaatgaaatttatccatcagcaaacacggcgcttgaagggctgtatatatctggcgatgctctatgtactcagtgtgaggcagaaggtttccgcaatatcacttattatctggatcgtccggatgttctggctcgttttactacccgtattgcagcagatatatccaaatatccctatctgttgtccaatggtaaccgaattgggcagggagagctgagtgatggccgccattgggtgaagtggcaagatccattcccaaaacctgcctatctgtttgccttggttgcgggagatttcgatgtcctgcgtgatacttttgttacccgcagtggccgcgaagtcgcgttggagttgtttgttgaccgtggtaatttggatcgcaccgattgggccatgacatcgctgaaaaattcgatgaagtgggatgaaactcgctttggtttagaatatgaccttgatattttcatgatcgtagccgttgatttcttcaatatgggcgcgatggaaaacaaggggctgaacgtttttaactccaagtatgttctggcaaaaaccgaaaccgcgacagacaaagattatcttggcattgaagccgtgattggtcatgaatacttccataactggacaggaaataggatcacgtgtcgtgactggttccagttgagcctgaaagaagggctgacggtattccgtgatcaagaattcagctctgacttgggctcacgatctttcaaccgtatcaataacgtgcgtatcatgcgtgcagctcagtttgccgaagatgccagtccaatggctcacccgatccgtcctgaccaagtgatggaaatgaataatttctatacgttgaccgtctatgaaaaaggctcggaagtgattcggatgattcacacactattgggagaagaacaatttcaggcgggggtgcagctttatgtacaccgtcatgatggcagtgcagcaacctgtgatgattttgttcaggcaatggaagatgcttcaaacgtcgatttgacgctattccgccgttggtacagtcagtcaggaacaccgatactgaccgttcgtgatgagtatgatgcagaaaaacagcagtatactttgcatgtcagccagatgacaccgccaacgtctgaccagaaagagaaacagccgctgcatatccctctggacattgagctttatgatgagcacggcagtgtgatcccattacgccgtgatggtcagccaatacatcatgttttgaatatcatcaatgcagaacagacgtttgtgtttgatgatgtgccatcattgcctgttccttctttattacgtgaattctctgcgccagtgaaactggattacccatacagtgatacacaactggcatttttgatgaaacatgcgcttaatgaattctcccgctgggatgcagcacagtcactgctggctaattatgtgaaactgaatgttgcccgttatcagcaatccctgacattggagttgccaatgcatgtgattgatgctttccgtgcggtattattgaatcaagatattgatccggcattggcagcacaaatcttgaccttgccgtctgaaaatgaaatggcagaattgttcacagtgattgatccaaaatccattcatgacgtgcttcatgcaataacgcgtggattggccaacgaaatggcggatgaattcactgcggtttaccacagtattcacacaggtgcataccgagttgatcatcaagatattgcgaaacgggcgttacgcaatacctgcctctattatctggccttcattgatgacaaggaacaggtggatcaattagtggcggcacaatattatcaagctgataatatgaccgataccgtcgcagcgctgtctgccgctatgtctgctgagttgccttgcagttaccaattgatggatgagtttgagcagcgctggcatcaggatggtctggtcatggataaatggtttgccctacaggcaactaatcccgctttcgatgcacttgataaagtccgtagcttgatgaacaaccgttctttcagtttgagtaatccaaaccgggtttattcgttgctgagaacgttttttgctaataaccttgtggcatttcatgctgaagatggccgtggttatcaattcctgcaagaagttctgactgaattgaacagccggaacccgcaagttgcgtcacgtttgattgaaccgttgattcgttggaaacgttatgatgaggcacgccagtccttgatgcgtgctactctggagcagttgaaagtgttagaaaacctgtccggtgatttatttgaaaaaatcaccaaggcgcttgagagctga

SEQ ID NO: 3908 - DNA, 114 bp, Xenorhabdus bovienii
  Coding DNA location: Contig name=SeqID_16894; Position on contig =13757..13870bp; Strand=-
ttgaaaggatggaatctctatggcagcgttagagattggaaaatttctatggaaacggagtatgctagcatcttatggctgaagttatacagatgttatcaatatgccgattaa

SEQ ID NO: 3909 - DNA, 192 bp, Xenorhabdus bovienii
  Coding DNA location: Contig name=SeqID_16894; Position on contig =13873..14064bp; Strand=+
atgaaacctcttttttcggatgttaatcaattattaaataaaggtgtaaatgatgtaagcaggatattagtactttcgtgcaaattgtcatctcatatctcatgtaacatgatattatctgcagatggattaaccttaatcgttactgtccggaaaaatatatgcggttatgtggctttaataacaaaataa

SEQ ID NO: 3910 - DNA, 1215 bp, Xenorhabdus bovienii
  Coding DNA location: Contig name=SeqID_16894; Position on contig =14136..15350bp; Strand=+
atgactttagacgctaccccgattatcaaatcactgcttgatactgatgcctataaatttcatatgcagcaagcagtgtaccaccattacaggcatattcctgtcgttgcggaatttcgctgccgtggtgatgaactgctcggcgaatatgccgagacgttacgccatcagattgacatgatggctgatctaacactgacagaacgtgaagctaattatcttgccagccttccgttctttaaagaggattacctgaactggttcaaatcattccgttttaatcctgaacaagtcaaaatatccgttaccgatgaaggtcaactggctatccgtatctcaggcttatggcatgaggttattctgtgggaagtccctttattggcactgattagcgaactggttcatcgccaccgttctccggaaataaaaccggaagtggccgtcagccagctcaggaaactgattgagctattccatcaagacgcggctgaaaaaaatatcgatctggccggtttcaaactgatggactttggtacccgccgtcgtttttcacacgaagtacagtatgccatcgtcaatgagctgaaaaacaatttcccttatctgatcggaaccagtaattaccaactggcagaacagcttagtctggctcctcttggtacacaggctcatgaatggtttcaagctcatcagcagattagcccggagcttgctaacagccagcgagcagcattgcaaacttggctgaatgagtatccagctcagctgggcattgccctgacagattgcattaccatggatgctttcctgcgggattttgacaaaacctttgctaccgcctaccaaggcctgcgccatgactccggtgatcctatcgaatggggtgaaaaagcaattgcccactaccaatcactgggtatcgacccaatgacgaaaacactggtattttcggacagtctggacttgcagaaatccttgaacctgtatcgccgtttccacaagagaatcaacgtcatgtttggcattggcactcggctgacctgcaatattccgggggtaaaaccactgaatatcgttatcaaacttgtggaatgcaacggcaaaccagtggcaaaactttcggacagccctggaaaaaccatctgtgaagatgatgaatttgtcgataggttacgtagagcgtttgacattccctacatagaaaaagcagtataa

SEQ ID NO: 3911 - DNA, 102 bp, Xenorhabdus bovienii
  Coding DNA location: Contig name=SeqID_16894; Position on contig =15329..15430bp; Strand=-
atggggaaaaacagggaaaagcggctttttacttgcgtaaccagcatgaagctggttacgcaagggacaattaacgaagattatactgctttttctatgtag

SEQ ID NO: 3912 - DNA, 1401 bp, Xenorhabdus bovienii
  Coding DNA location: Contig name=SeqID_16894; Position on contig =15557..16957bp; Strand=+
atgagcgttgcgcctgtagtcgatgtactgcaaggccgcgtcccggttgacagcgaagtcaccgtccgcggttgggtacgtacaaggagagattctaaagctggtatctcgttcctcgccgtctatgacggttcctgctttaatccagtacaggccgtcgttaatagtaatttacctaattatcaggatgaagttctgcatttaaccactggctgttctgtggaaatcaccggtacagtcgtggcatcacaaggcaaaggccaaagctttgaactgcaagccaccaacgtggttgtagtcggcatgatagacgatcctgatacttacccaatggcggccaaacgccacagtatcgaatatttgcgtgaagtcgcacacttgcgcccacgcacaaacctgattggtgcggttgctcgcgttcgccatacactgtcacaagccctgcaccgttttttccatgagaaaggcttcttctgggtatcttccccgctgattaccgcatcggataccgaaggcgctggcgagatgttccgcgtttctacattggatctgcaaaacctgccacgtaccgataaaggcgacgtggatttcagcaaagatttcttcggacgtgaagccttcctgaccgtatcgggtcagttgaacggtgaagcttacgcctgtgcattaagcaaaatctataccttcggcccgactttccgtgctgaaaactccaataccagccgtcacttggcagaattctggatgcttgagccagaagtggcttttgccgatctgaacgatatcgccagtcttgccgaaaagatgctgaaatatgtcttcaaggcagcattggaagagcgtgctgatgatttagcattctttgcagaacgtgttgacagtgaagttgtcagccgtttagagaaatttgttgattccgatttcattcaattggattacaccgatgccattgaaattctggagaattgtggccaggaattcgagaaccctgttttctggggggttgatctgtcatcagaacatgaacgttatctggcggagaaacatttcgaagcgccagtgatcatgaaaaactatccaaaagacatcaaagccttctacatgcgtatgaatgaagatggcaaaaccgttgcggccatggacgttctggcaccgggcatcggtgaaatcattggtggctctcagcgtgaagagcgtttggatatgctggatcagcgcatggaagaaatggatctgaataaagaagattactggtggtatcgtgatctgcgccgttatggcaccgttcctcatgcgggttttggtttaggcttcgagcgtctggtcgcttatgtgactggcgtgtccaacgtgcgtgatgttattccattcccacggacaccaagaaacgcaagtttctaa

SEQ ID NO: 3913 - DNA, 117 bp, Xenorhabdus bovienii
  Coding DNA location: Contig name=SeqID_16894; Position on contig =16957..17073bp; Strand=+
atgaatcagctcaataattgggcaaaaattaatccattgaaaagccaacgaaagttggcttttttcattttatggttcaagccggacgaaaaaagttccctaaaatttacattttga

SEQ ID NO: 3914 - DNA, 1143 bp, Xenorhabdus bovienii
  Coding DNA location: Contig name=SeqID_16894; Position on contig =17250..18392bp; Strand=+
atgagggtaataataatgaaacgcaatcttcttgcagtggtaatcccagctctgctggtcgctggtacagctaacgcggctgaaatttataacaaagacggcaacaaaatcgacgtttacggtaaagtagacgttcgtcatatgttcggtaagtctaaagactacaaagcagacaaagaacatggtgatgattcccgcgcacgtctgggcgttaaaggcgaaactcagatcaatgatcagctgactggttttggtcgttatgaaaccgagtggaaatctaacggtacagaagcagcaggcagcggctataaaactcgtctggcctacgctggtctgaaatttgccaactacggttcactggattacggccgtaactacggtgtaatttatgatactgctgcatggactgacgttctgcctctgtttggtggcgattccatggctcaaactgacaactacatgaccggtcgttctactggcctgttaacttatcgtaacaatgacttcttcggtctggttgatggtctgaactttgctctgcaatatcaaaccaaaaaccacgaaaataccattaacgatcgtaaaaaattatcagaagctaatggcgatggttacggcctgtctacttcttatgatgtcggttacggtatcactctgggtgctggctattcaaactctgcacgtaccaaaggccagaaagattctgaagcatcaggtaaacgtgctgaagcatgggatatcggtgcaaaatatgatgccaataacgtttatctggcagcattgtatggcgaaacccgtaacatgactagattcggcaaagatcttattgtcgaagacaacgattttggcaaaagcatcgctaacaaaactcagaacattgaattggttgcccagtattacttctctgacttcggtctgaaaccatctctggcttatgttcagtctaaaggtaaagatctggatctgggtgaaagtgaaaacagaaacaaccaagatctagttaaatacgtttctgtaggtacttactactacttcaacaaaaacctgtctactttcgttgattacaaaatcaacctgttgaacaaaataagttcactagaaacgcaggtatcagcactgacaacgtatttggtgtgggtctga

SEQ ID NO: 3915 - DNA, 237 bp, Xenorhabdus bovienii
  Coding DNA location: Contig name=SeqID_16894; Position on contig =18503..18739bp; Strand=-
ttgattttattttcacgaggatcagctttaaagctatccgctaaaccaagaatagggtcggcaggtgctgctgtaattttttcaaacatttttttgattccaagactcggagagttaagcccaaaaaataagttatacgctgctcagggtaactccaagaaactcgtttgccaacaatttgtagcaaaaagaagacaatcttgtgaagtagtttacggagtgaaaaaaaggtcataa

SEQ ID NO: 3916 - DNA, 1191 bp, Xenorhabdus bovienii
  Coding DNA location: Contig name=SeqID_16894; Position on contig =18651..19841bp; Strand=+
atgtttgaaaaaattacagcagcacctgccgaccctattcttggtttagcggatagctttaaagctgatcctcgtgaaaataaaatcaatctgggtatcggtgtttacaaagacgaaactggtaaaacccctgtcctgaccaccgttaaaaaagcagaaaagctcctgctggaaagcgaaaccaccaaaaattatctggcgattagtgggttacctgaatttggccgcgtcactcaggaactgctcttcggcaacaccagcgctatcattactgacaaacgtgcccgtactgtacaaagcccgggcgggaccggcgcactgcgcactgctgctgattttattgctaaacagaccaatgcaaaacgtgtctggatcagtaatccgacatggccaaaccataaaggcgttttctctagcgctgggttagaaatccgcgaataccaatattacaatgcagaaaagcacgctctggattttgatggcatgctgactagcctgtctgaagctcaagcgggtgatgttgttctacttcacggttgctgccataacccgaccggtatcgatccaacggctgaacagtggcaaaaactggcagatttatctgcggcaaacggctggctgcccgtgtttgatttcgcttatcaaggttttgccagaagtttagatgaagatgcagaaggcctgcgtatttttaccaaaaaccataatgaactgatcgttgccagctcttactccaaaaattttggcctgtacaatgagcgtgtaggtgcctgcaccatcgttgcaactgacagcgataccgcagaaaaagcattcagtcaggcgaaatctattgttcgtactaactactctaacccaccggcacacggcgcttctgttgttactgcaattctgtctaatgacgaactgaaagcagaatggatccaagaactggcgactatgcgtgaacgcattcgtcgtatgcgccagctgtttgtgaacaccttgcaggaaaagggtgcgaaacaagactttagctttattattagccaaaatggtatgttttcattcagcggtctgactaaagaacaagttgaccgtctgcgtgaagaattcggtatttatgcggtcagctctgggcgcattaacgtagcgggcttaacactggagaacatggttcctctgtgtgaagctattgttgcagtactctag

SEQ ID NO: 3917 - DNA, 633 bp, Xenorhabdus bovienii
  Coding DNA location: Contig name=SeqID_16894; Position on contig =19926..20558bp; Strand=-
atgaattaccacattatccctgtaactacggtgatgcaaaattgtacgttgatctggtgtgaggaaactctggaagcggcaattgttgatcccggtggtgaggctgaaaaacttatttctgaaatagagcgacgtggattgaaattaacgcaaattctgttaactcatggccactatgatcatgttggcgctactgttgacgttgctaaatacttcaatgttcctgttcatgggccacataaagcagatgctttttggatagaagcgctggaagttcaatgccagatgtttggtgttgaggcatgtccatcttttacaccagaacgctggttggatgaaggggatacattgcagattggtaatatcgaattctctgttttgcattgcccagggcatacaccagggcatatcatctttgtcaatcataccgataaattaatatcaatgggagatgtgttgtttaagggcagtattggccgcacggattttccgggtggtaattatgatgatttgattcaatccattaaagaaaaagtaattccattaggtgatgatttccactttattcccggacatgggccgatgtcaacattgggtcatgaacgtaaaactaatccattcctgcaagattga

SEQ ID NO: 3918 - DNA, 549 bp, Xenorhabdus bovienii
  Coding DNA location: Contig name=SeqID_16894; Position on contig =20604..21152bp; Strand=-
atgaatgatattgactatagccgccgaaagtggcttggtgtaggtgcagctgcgttggggttaagtttattacctcaacacgcattggccgcattgacaacgccacgtcctagaattttacgttttgataatttgcacacgggggaaacactcaaagcagaattttttgatggtcgccgttataacaagtcagaattggctcgtttgaattatttattccgcgattatcgccaaaataaaatcaaatctattgatccgaaactgtttgatcagatttatttattgcaaatgatgataggaataaataaacctgttcaattggtgtctggttatcgttcattggcgacaaataatatgttgcgtcaggctagcggtggtgtcgcaaaacgtagctatcatacccgtgggcaagcaatggattttcatatcgatagtgttcagctcgcgcatattcgtaaagctgcactgaagatgagagcggggggcgttgggttttacccaaagagtaattttattcatatagatacaggcccagtcaggacgtggtaa

SEQ ID NO: 3919 - DNA, 96 bp, Xenorhabdus bovienii
  Coding DNA location: Contig name=SeqID_16894; Position on contig =21457..21552bp; Strand=-
atgaatgaaagaagaaaatttaaaattaatatctgtacagtgagggaaatagcgctattttcctcactgttattttctccttatccagtcttttga

SEQ ID NO: 3920 - DNA, 1719 bp, Xenorhabdus bovienii
  Coding DNA location: Contig name=SeqID_16894; Position on contig =21562..23280bp; Strand=-
atggcgaagaacacggtcagtttactgaaagtttcttttatctgtagcgcgttggcggtatcagagggaacctttgcaagtcaacaaaatggactgatagtaaatgatacccaacaattttcagaggaacaaaaaaagaaagacgtagttgcttcaccggatcagattattcctatatctgcagtgaattctattgaagcaaatcgaaaacagatacaaagttggttgccgcaacaagtaaaaccaatattcattgaccgtttggcaacgttatatgcagtcaataaaatgaaaccgctatggcaagataaaaatacggttcaacagtttgaacagcaattatttgaactatcattggccggggttcaaccccagtttggaaagtggctgactcaacttcattctgctgaattaagtgatatggggcgtgatattatcttatcagatgccatgttgggttatctgcattttgtcaataatgttaagagaaaaggggagccgtggttatacagtaaaaattcttataagcttgatttaccgccttctgatttaattgataaatggcaacagcatattactgataatcatgtactttcttacatcactgcgttatcaccagataaccctatgtataaaaatatgcgtaaggagatgctgaaacaattggctgataaacaacagttgtctgaattttcaatgaaaggaacattaagaccggggcaaaatagtgaaagtgttgtggcgttaagggaaatattaattcgttccgatacgttggattcgttaacagtcaaacctgaaaacaaggtttacaataaagaattagtggctgccgtaaaacgttttcaagctttacatggattatcggctgatggtgttattggacagtcgacgaaagtatggctgaatactacgccacaaacccgcgctcgaattatggcattgaatatacagaggctgcgtattattccaggtaatattcctacgggtcttctggtcaatattcccaactactcattattttattacctggatggtaaagaagtattgaattctaaagtcgttgtcgggagaccgagcagaaaaacgcctatcatgagcagtgagctgaataatgtggtgattaatccaccgtggactgttcctaccagtatgacacggaaggatattgcacctagagcaatgcgtgaccctagttattttcgtagtcgtggttataccgttttttccagttggagcaatgatgccaaggttatcgatccttcatcaattaactgggaagtgactacgccaaataattttccttatcgtatacggcaggcgcctggtccaactaattcactagggcgttttaagttcaacatgccaaactcagaagcgatttatttgcatgatacgccaaatcaggcttcatttggccgggaaatgagagcggtcagttcaggttgtgtacgtgttaataaggctcctgaattggctaatatgttgttggggaatgcaggttggaataaggatcgggtaagtaattccttaaaaacgtggacaacagcatatgtgaatattccgaagaaaattccggtatttctctattatcaaacggcgtgggttgatgaaggaggagtgcctcaataccgcgcagatatttatgattatgatatgagtgccagagagcaatctgagcttttacccgagatcctggcaactcgaaatgatttataa

SEQ ID NO: 3921 - DNA, 714 bp, Xenorhabdus bovienii
  Coding DNA location: Contig name=SeqID_16894; Position on contig =23536..24249bp; Strand=-
atgcggaaagtgacgttagcattaagtgcgattgcacttgcttttggcctgaatggtatggctcaggcaaaaatgtttatgcctgagcaggttagctcaggagtaacaaccgtagatttggcccagcgtcaggctgtgcattgggtctcagtagcgcagattgataaaagtttgcagaatcagccccccattgctgtagggtttgatatcgatgacactgtattgttttccagtcctggtttttatcgtggtaaattgaagtattcaccaaatgacaaaagttatctgaaaaatccagcattttgggaaaaaatgaataatgagtgggataaattcagtatgccgaaacaaattggcattgaattggttcagatgcacttaaaacgcggtgatgatatttatttcattacagggcgtacagaaaccaaaacagaaaccgtcactaaatatttgcaggaagggttgcacattccggccgataaaatgcacgccgttattttcgcaggtgatgagccaagtaagaatgataaagtcagttggatgaaaaatcataaactgaaaatctactacggtgatgcagatgctgatattgctgctgcgcatgaactgaatatcagaggtattcgtattctgagagcatcaaattcttcttatcagcccctgcctaaagctggccgctttggggaagaagtagtcattaaatccgagtattaa

SEQ ID NO: 3922 - DNA, 228 bp, Xenorhabdus bovienii
  Coding DNA location: Contig name=SeqID_16894; Position on contig =24164..24391bp; Strand=-
gtgaactgttttttacacataaaaagtaataattacattcacagaaataacattagattattgtgcggtatatctcattttgattctataagaacatttattatttcacgttgctgtaatcaatatagagtaaggaataacaatgcggaaagtgacgttagcattaagtgcgattgcacttgcttttggcctgaatggtatggctcaggcaaaaatgtttatgcctga

SEQ ID NO: 3923 - DNA, 864 bp, Xenorhabdus bovienii
  Coding DNA location: Contig name=SeqID_16894; Position on contig =24411..25274bp; Strand=-
atgattttatcaaaaaaaataaatcattttttgagtgttgccgaatgcggatcttttaaaaatgcgtctaaaaatattcatataagcccacctgcactatgtaaaagtattgctgacattgaggatacattagggttcaagttatttaatcgctctaatgtaggtgtgactttgacagaagaagtcgtaaatttgtataaatatttactaccaatacgtgatgatgttgaaaatattaaatcaagtttaccaaccatactaacagaaaaagaaataaaagtaggaacagacagttataatcaggcgttcaagaaattgttaagtaaaattattgaaaatgaatatgttgatctattgagtgaaatgtattattttgatgaacatagaattaaattactttcagggaaattggatttttttatctccactcatccaccaatagaagataaattagaacgaattacatataaagtacatgaacgtgaaactgaggtatttatcatatcaaaatcgttatttaataaaaataattcattgactaatgtggttcgtaatgaaaaaatgatactccactctggaacaacaaagcatccatgctttgatgaaatgttgaaatacagaaaagaacataaaattaacactcagatgttggtttttcctgatataagtcatattatagagtttgtttgttttggtatcgggtattcaataatcaataattctattttaaatgtagattatttaaatagcgttggagttaaaatcatcccaaatacattattttcgtctgagacatttagttatatttattatttaaaaagaaaagaattagagctaagaaaatttattaattatttaaattga

SEQ ID NO: 3924 - DNA, 1164 bp, Xenorhabdus bovienii
  Coding DNA location: Contig name=SeqID_16894; Position on contig =25714..26877bp; Strand=+
gtgacaaattctgttcatagaaatgaacatcagaaacaaaataactcaccaacccatgttgaatgccatacagaatggggaaaattacgacatgttattgttggtcgtgctgataatgcttgtattcctccgccagaacccgcatttatggcacgtattccagaaaattcggatatgcgtgggcgttatggaccaagaagccaagaatcaattgacgcagccaatgagcaactggatggattagcatcaatattaacctcgcgtggaatacgcgttgatcgtccaacacccttggatttcaattctcctgtgcaaacccctgatttcactcaaggaacaatgtttggttgccagccaccaagagacgtgctgattactgttgggcgggaaattcttgaagcaacaatgagtttcagatcccgtttttttgaatacttatgttatcgaccgcttatttcaacttatttgaaagaagatggaggaatgcgacacgaatcggcaccacgcccccgactatcagatgccagttatcggcatggttatttatcggaagcaatcagcatgaaaacccgaaaggaatgggtgaaaaaaaaagaatttgtcacaacagaagaagaacctatttttgaagcagctgacattttccgatgtgggaaagatcttttcgtacaacatggttttaccactaatatgaaaggggttgattggctaaaacgtcatttctctgattatcgtattcatccaatcaattttcctggtgatccttttccaagtcatattgattgtaccttactgcctttgcgccctggtttgatcttaagtaatccagtcagacctttattacctgaatttaaacagttctttatccataatgactggcaaattattgaagctgcatccccagcacatagccaatcaccgccattatgctattcgagtgtatggctttcaatgaatctcctgtcacttgatgaaaaaacagtatgtgttgaagaaaccgaaattcatcaaatggaacaattggataaattaggatttgaaatcatccccattccttttcggaacgcatatccttttggtggaggattacactgtgcgacaaccgatatttggcgagaaggaaatcttgaagattatttccctgcagaaagttatttatgttaa

SEQ ID NO: 3925 - DNA, 1098 bp, Xenorhabdus bovienii
  Coding DNA location: Contig name=SeqID_16894; Position on contig =26970..28067bp; Strand=+
atgaataacatagaattcaacacatcatttttaaaacaatcgccaacctcctttcataacagagactttcagtattttttgaaaagagtacccgaagattttttagttgaagaggtaccgaaattctataaaccttctatgaaaaaacagatctggcatttccaattatgcaaagaaggcatgacaacatctgaagcaattacgaacatttccaacatattgggaataccggaaaatcatattggctatgccggattaaaagatgaagatggagtaacaagccagaggatttctattcaatccttaccgaataatgtagatatcaatgccatcaattcccgtttagatatggtatcaggcaaatggctctcattacataaaattggctgttttgaagaaaatataaagattggccagttagtaggtaatagttttcgtgttgttatccgtaatttacataatcatattgctcatacattggcaaaacaatcatcacacaaccatgcttttattaattattatgatacacaacggtttggtgtacccggagggccatctaccacacatcttattgggcaatctttccatcaaggagaatgggaaaaagcgttattattagtacgtgaatcggcttctccagaagcacagacagcccaaaaatggcaaggcaagccagtcaattttttccatcaattagatcccagacggctctctttttattacgcttcttacggatcttatcaatggaaccatcttgtggcacaagaattccaacgagatcatgaagggttacgggtgatacgctcatcaataccctatattttgcccaatgcttattctgacattatggcatttgcagcagcgatgccctggtatccatttagccggattgaaatcattgatggaaaaaaaacagaaaagcaaagcctgcgtcctacagttgttcatacctatgtaaaaattgtcgaactcactgatgatcatgaatttcctgatcgttccagtttgacggtagagttttttcttccatccggctgttacgcaacgatggcaatctgccaatttgtctatttagcaaatgctcataccactctttag

SEQ ID NO: 3926 - DNA, 1344 bp, Xenorhabdus bovienii
  Coding DNA location: Contig name=SeqID_16894; Position on contig =28084..29427bp; Strand=+
atgcgtatattattactgatcccgccctatattccttcctattttaatgcaggtcatcacctacctttatttcaagtcgcaacttatatcagggaaaaaaatccatcttggcaagtcacggcactagacggtggcacacttaatctgacttggcatgatttagccaaagaattggcaaaaggttataattttattggtttatttaatgattttgatgcagtagatgggtttggccgtactgtcatgtattgtcgagaaattttgccgcaggtaaagatgtttactttcgggcgactttcaaaacaggttcctgactggttcaaacaatttggctttgaaggtattgctttcagtggtgattatgaaagcagtgtcgaatcttttcttttaaattatggccctaatactggcagtattcccggccttatagtgaaaacaccagagggttatttacaaggtaatgccggccatatgttaagcccggaagagtggatattacccgatacactggaaatcccctacgccgcttatgatcgaatgtataaaaacgatttgaataaattctgtggtattcctgatcgacgtgaactcgttattcctgtcgcccgtgggtgcccggttggttgtgaattttgtgatgtaccatcaatgcagggaaaaagtgaacgacggctctcagttgatcgcgtgattaaatatataaccgaccaacaacagattcagccatttgattacatctctttttatgctcccacttttacattgaatcgccgatgggtaaaagagttatgtcataagttcatcgagttgaaattacctgttaaatggaaatgcgttaccacaatttatcacctgaatgaggaattgattgcactgatggcgcaagctggctgtataagaatcagccttggtgtagaaaccatttcggtttcgcaaaatttacaattgccacgaataaagctgaatacagaagccaagattcaagaattattggcaatcgccaaacataatggaatagaaatcaacgcattcattattcttggattacctggcgatacgatggaggcttcaatcaaaacaattgaatggttgatcgcagaaggcgctagagtccgaccaaccgtctacaccccttataatgaactgcacgaaggctcttcacttgcagaagtcggtaaatacaaccgccaaatcttccatgaaacaccccaatcacccatggaacgcctaaaaggctattcattgctatttgccaatgacaaagatcgcccgactgaagtgatgaaaaaaatagcgttacaggtaacagatgagaaagatcaaatatcaggaggatccctatga

SEQ ID NO: 3927 - DNA, 630 bp, Xenorhabdus bovienii
  Coding DNA location: Contig name=SeqID_16894; Position on contig =29424..30053bp; Strand=+
atgaatatccggcgatattcccccgattttaagcaaaaaaaagagccgtttgaatggttctgttccgatcgttttttatccccaaaagttttcgcacggttacagtcagaattcccacaaaacggttatcgtaaatctcatcgtgaagaaggtgatgaaaaatactatagcacttgggatctattggccattgataatggtgtccctgtcttggatacatggaataacctgacaacggcctggaaatctatgttgataaccattctgagtgaaggttatcgcaattattcttcaacattgacggggcgtgatctcacagaaacccatctgcatgtgcgttttaccatttatcatgaaaattgctggctggctccccattgtgatcgcacagataaagtcatcacccagaccctctattttccaaccggtgccatagagggaggagaattacttattctcggctcttccgatcctgatgatataaaggaaacggtagctcctgctcctaatcgttcagtgatcctcctgccttccccatattcttggcacagtgttcgtaaagtggtatccggttcacaacatgcacgccgcgcgctccttcttcattacgttagttctgataataaataa

SEQ ID NO: 3928 - DNA, 612 bp, Xenorhabdus bovienii
  Coding DNA location: Contig name=SeqID_16894; Position on contig =30068..30679bp; Strand=+
atgtttaatttattactgcctgagacattgacggataccccttatcactggggaatagtatcaccatttattcacaacgatattgcaaatagcttgatggaaacttttcctgataatggctttattgttgctgagaaaatagcgggagaacccaatgataaaaaaatgtacagtctagaaacattacagcttgaaaaagataccccactttctccgatatggcatgaattcattcaatatctgcgaagcgatcaatatagagatcggatgggagcactcattggaaaagacctcagctcgacgatgttgaatttaacattatggcgctaccgttcttcccaatggttaggtccacacacggataaaccggagaaaatagtcactcaaatctttaacttcaaccggaattggtcatctgactggggtggatgtctgcgtattttacgttctgacgattcacaggatgttgatcgcgaaattccaccagaactgaacacatcagctattctgcaccgctcagaccattcatggcatatggtgacacccgtctctgatacggcgcctgtcgggacttatcgtcgcgtgctgactgctgtttttatttctaactaa

SEQ ID NO: 3929 - DNA, 1311 bp, Xenorhabdus bovienii
  Coding DNA location: Contig name=SeqID_16894; Position on contig =30707..32017bp; Strand=+
atgcacaagattgaagtcactggtggcagtccattatcaggccaagtgcaggtatcaggatttaagcatgcatttcccccgttgttcagcctggcattgtcatcaaatcaaccatctttgatcaaaaatgtgcctgatattgcagatatcaggatattgggaaaaatcggtcaattgcttggcgccgatatagtgtatgagccagaaaagcgcgccatgtatattgatccccgcagcttgaacaatagcaatatccctggcgatttaagcgctttgattcatggagcctggtatcttgctcctggattactcgcccgtaccggccatattgtattaggtgaaaccggtggttgcaaaattggaggagggcaagaaggagaacggccaattgaacaattatgctctgttttgcaaagattcggggctacagtaaaagcagaggaaaatattattcaagcaactgcacagcgtttctcctctgcccgaatcgatatggctgattttgccgtccctgaagaaggaacggacaaactgaccggcccactttattctggcgcaaccaaagcagcattgctgtgtgcagcaagagctgaaggtatcagtgaaattatcaatccctatcctaaaccggacgttgtggcattagtggaagcaataaaatgtcagcaagttgccatacagtgggaaaaaaaccgaatcattattgaagggaaacctgaagcgggtggttttgaaactactatcgggcctgatttgatcgaagtaatgacttatctaacgctttcgacttactgccacgcgccaatttccattaccaacgtatcgcggaagcacattgaaacagggctttccgctgaaattgcctgtttggagaaactgggttatctgcttcaatggcagggtaataatctctccatcgctcatgtatccccagcttcccgattggatattcaagtcacttcccacggaatatttagtgataatcaaccctttatggctcttttgttgatggcgtctgagcagggcggtagcctaaccgagcaggtttgggttaagcgttttcaatacatcgaagaattggaaaaaatgggggcaaaaatcatacgcagtggaagaactgtagaaattatgcccggtgtccccggcaaaagtggcataacagtgaatgctaccgatttgcgtggtgccgccgctttggttatcgcagctttacagatatcgggcaaaacgcaaataggcggtgttgatcatcttgaaagaggctaccccgacttgttggggcaactgcggttattgggagccaaggtttaa

SEQ ID NO: 3930 - DNA, 1095 bp, Xenorhabdus bovienii
  Coding DNA location: Contig name=SeqID_16894; Position on contig =32041..33135bp; Strand=+
atggcagatataacatcaatcaattatccattgcctctggcccctgagcgcccttctcgcacaagagaatttctggagcatggcacaaacttgcgcagtggtgaattacatcatacagcgttgacgaagatgatacaggatattgatattcctccacagcgacaccagttttatccttacccacaaattgagcataaccgtgctgcaaaaatgctggggattgattcttcctgtatttatttcactccaggatcagatattgccattggcctgatattgcgtctgattgcacgtacaacaggcagattaattattccaatacctaactattttggttggattgatcatgccaatcttaatcagatcaacatattaccgatttatttcaatgatcaatgtactgagaatttctgtctcaaaacattattgggcaccattcaaactacaccgccatccattgttgccatttcaaatcccaatagcccgacgggcatagaatttgatgatgaaacaatattagcgatttctaactcttgtatacgacagggtcatttgctggtcattgatgagtgtttcatggcatttggcaacattgatcatttagccgttttaggccagcctgaacatatcatctatgttcgttcattctcaaaaggctacggcctagcaggtgcccgtatcgccgccgtgatagcttctccaactattattgatattttgtctcaagaaagaacggaagccgctatctcaggaagcgcttgggcagtactccaaggtattttggtaaaggaataccaaatcaaacaaatctgccaatccattattcaggcaagggaatatgtcattggaaccataatgaaactacgcccgaattggcagatccttccttccggcgccaatttcattaatgtcaaaatctgtggtgacagtcctgctcaactggtgaaaacagcagccttgggtggattttacatccgtgatatgagttcacaagaaagaatggatggatacatcaggattggtattggtgaattggcattgatggtgaaattcctcaaacaacttttcccttcggaatataaatatagtgaataa

SEQ ID NO: 3931 - DNA, 696 bp, Xenorhabdus bovienii
  Coding DNA location: Contig name=SeqID_16894; Position on contig =33138..33833bp; Strand=+
atgagaacacatttcaaccatgtcaataaactgtgcatttgcccgatacatcatgctgatatcctgaatgggcgaatattgcgtaccaaccataccgataacaatagtcgtggaacacttatccgttgtggtatacaacgagggaaagaaaaggccagtttaaatacattatctgggatattacccataaatagttgggtagatttgcgtacacctgaagaatatgaaccgcaattcaatagtcatgatcttcctgaaataataaaatatctggctctccccattcgatttaaaccaccagaaaaccatctttctcatatcgtcaaacaatctgattatgtcgatctttatttcaccatgagtacggcagcatggtccattgcacaaacagtgacagaattactccatgctggcaatgttgtactccattgcagtctgggaaaagatcgtacagggcttgtagcggctgcggttctctatcaactcaaattttctaccgcagacatcgcacatgattttgctttatctgccagattcctccgtcgtcaatatcaattgattcaagataaagcacaaagaaacggtgttcccaaccatcttcaagcccgtcgttatgaattattggggcatacgattattcctctacttgataaatggagaaaaataactgaactaaacaggaatgatcatgattaa

SEQ ID NO: 3932 - DNA, 540 bp, Xenorhabdus bovienii
  Coding DNA location: Contig name=SeqID_16894; Position on contig =33820..34359bp; Strand=+
atgatcatgattaatgatatgcatcgtattttaattattggctctccgggagcaggaaaatcatcttttgccaaaagattgaatgatatttgctccattcctctatttcatcttgataaagaatattggtgtgaaggatgggttgctccttcagcagaagagtggcaacagaaattgttactcttaacgaataaaccaagatggattattgatggcaattatggttccagtttgtcacaacgcttaaagaaagcagatacagtcattcatctctatatgccaacctatgtttgtttatttcaggcagtaaaacgtgttttaaagtggtatggaaagcaaagaccagatatggcttctggctgccacgaaaaagtgaatttaaatttttttcgtcaaatcctgaactatcgcaaacaccaatttaaaaaagacaaattattgttggccgattttaatggcgtctatattcgtctcacctcacgggcgcaagtagaagaatttttaaataacatggctaaatattacaaactcaatcattaa

SEQ ID NO: 3933 - DNA, 1230 bp, Xenorhabdus bovienii
  Coding DNA location: Contig name=SeqID_16894; Position on contig =34423..35652bp; Strand=+
atggcgctgaatattcagggacgcctgtttttagtggcaatggccatcggtagtatgggcggtgggatctggcgacccatagcaattttttacttagtgttggttcaggagttaaacattgtagaagttggcctggcaatgacaatcggtgccataatagccctgctcattgctggtttcccagcaggcttactggctgataaattggggccatcccactcaaccctgataggaagcctactgcgatttattgcctttccttggatgatggttgtttcaacaccgtggcagatagccgttattgttatgtttgtttcaattggtgaacgtattttctggtgtgccaatccagccgcaataaggacactatttcctgctaaaaatacccaactcaatgtatttgccattataaacagttgccgaaatatcgggcttggctgcggtgcattgctatccatgttctttattggcaaggacggaatgtctaataatattgctgacttcataattttgggtaattcactcggttattttatttcaggaatgattattttcatgatcactcaaaaagcagccaagaaaattaacgaagacactcaagaagcggttcaggaagacaagatgaaaatttcatctttttcgatcattaacgataaaaaatacctggttttcgtctttttggttggcatattgctactagcaggaaaaagcattgagattgtattaccttactatttccttattgaacgcgcccttccctcttggtttgctgtttttgtttttacagggctgtgtttcggtattccctgctttcagaaggttgcattaagattaagcaataaatttggttgtctgaaatcactggcctggtcaggttttttacaaactgtggcgtatggcatcattttctttcttaatggcgatcttttattacaatttatcttaatttttatcgtgaccattctgcttagtctttctgaagccattctcggcgcgcagataggtgtagcaatattaatgttttcccgctctggttatgaagggcgttattcttccattctccaatttgcatttggcggtgcaaccgtcgttgcaccctggttattcactcaacttctcagtttttccaccaccttattatggggaagtatcatattatatgttacattggctggcatcggatttcttattctcaataaatatcaaagtgacagagccatcattctctga

SEQ ID NO: 3934 - DNA, 1344 bp, Xenorhabdus bovienii
  Coding DNA location: Contig name=SeqID_16894; Position on contig =35700..37043bp; Strand=-
atggatgggaatgaaatgactaagcaactgatatcagataattggttcactgaaattaccaaggctctaaaggaatattggcagaaccgtgaggttggttttcttatcgattactcagataatctggatacactgaaagccctgatgtttgaattacaaacatgtggcgccaaaataaaggcaataatatctgtatcagatgagtcttggcgccccaaaggggtattgtgctggcatattgtgaatattaatcaacgccccctgaaagagattttggaaaaccaatgtatgagtataaaacattggttggataaaatagatccagaaagaaatatcacttttttagggggtgtcagattaccgctttctcaatttgcagaccgacctgtttatggttggcagaaacccgaatgggcgcaatttgaagataaaatctatattgatgacagccttcgtcggtggggaattaatacacctgcttatcagatcatcgatcctaatattaatgatgcagtggcggcatttcaccttctcaataaaggaaaaggcgtaatattggccattgatggctcggagtcatttagcgcaggggcaaatggtttggcttggatcaaggatcatcatgagattgcccatgttttggataaattccgcgataaaaccagaaaacttcgggtagctgaatttatacaaggaattccgtgcagtattcttgcgatggtactgccaaatggtgttgctgtttttgatccgatagaaatactgaccgtctttgaaaaaacgaccaaccatctgctgttttgtggatcatctaatcgctggcaatcaggaaaagcagaggatgtcatgcgtcactgtacgcgtctagcagggcagaaacttgcagaagaagtcggctatcgcggtattttcagccttgatgggatatggacaggcagcgatttttttgcgacagaaattaatccgcgccatgcttctggattggggttacgtcgtgcagcccctatgtttccttgttatctatttaaccgggcggttcaggaaaatagcccttttattatgaatatcgactccgttcgagtagaaatgacattacgtggtatggtacgaaattattcaggccaagatattatcatattagataaagatgaaaaacagcaaagagtaatagaaattgaagccaatgataatatgattgtgcttggtgttccttctgaaggaatcgatgcacttattcactgttcactgaatcaggaaaaattgcttggcaatattgttgctgaactggctagcaaagtttctgatctcgattacattagttttgtcaaccgtgatataaactaa

SEQ ID NO: 3935 - DNA, 165 bp, Xenorhabdus bovienii
  Coding DNA location: Contig name=SeqID_16894; Position on contig =37086..37250bp; Strand=-
atgccatcacgccaatttcacttgtatatacagagttgttgctcttggttaccgttcaatattggtgctggcgtggaaggtgaaacaaggggccttcgcttattaacaaagtctcgcttaaatgtgcaatctgaggctcaccttgtttcttatgatggtagctaa

SEQ ID NO: 3936 - DNA, 1014 bp, Xenorhabdus bovienii
  Coding DNA location: Contig name=SeqID_16894; Position on contig =37244..38257bp; Strand=+
atggcatcaaataagaggagggttattatgcattatgtcggaatagatgtcagcaagaataaactggatatttgcttgttatatgatggagttaaaggtaaacgcaaaacaaaatcccttctgaataatgaacattcagcctgtatgttaatagcgtggttagctaaatatattcctgccctgcaacaagtcaatatcgttatggaagccaccggagtctatcatgaacggttggcttattcccttcatcaggctgggggaaggattgcaatagccaaccctttacgcgtgcgtgattttgctaaaggtatggggatactgactaaaacagacaaagtagatgcctatattttagcctgttacagtgccttaaaacaacccgatgtctggcaacctcctcctatagaaattcgcgaattgaaggctctcctatgccgtcgggatgcgttattagaagatatccagcgtgaacgtaaccgatatgaaaaaagcggctcaacccataccccaaaaagggttattgagtccatagaggcaatgatgcatcacatgaaaaatgagttagccgagcttgaggctcttattgccgagcatataaaccagcaccctaatttaaaaaaagattttgaacttttaacctcaataaagggggttggaactcagattggtcttaacatgctgattatcttacgtacgaatacctttactcgtgcaacgcaagtcgctgcatatcttggtgttattcctattgcaaagcagtcaggtacatcggtgcatggtcgagtgcgcttatctaaaacggggcctgctaaaatccgtgctaagttgtttatgtctgcactcactgcagttcgttttaacccccacataaatgatttatataatcgattggttaataaagggaaggcaaaaatgttggctttaggcgctgcgatgcgtaagttagttcatttgtgctacggagtattaaatacgcagcaatcatatgatgaaaactatgctattagaacttga

SEQ ID NO: 3937 - DNA, 1368 bp, Xenorhabdus bovienii
  Coding DNA location: Contig name=SeqID_16894; Position on contig =38316..39683bp; Strand=-
atgaaaatcagggatgtgatttgcacagtattcgggttatcgctgtatctggttttaatatcgcttttctccgtattcgtttggcttgtttacccaagcagccataggaagaatattttttatatcatcaaattacggcagggaaatattatgagagtacttgttctcaatcgtcgccctattgtagaaaaaatcgcattatggtttgcccagacaaatgccgaggtttttcttgtaacaccgaaagtattgatgccgacatcggcaaattcatctgatagggggcatcaatatttcaaggaaatttattctgttgataattacgattcacctgctgtaaatgaattgattatgaaggtagtcgaagaaaagcatattgaacgcattgtttccgcaacagaaattgacgtattacgcgcagcgcaggtgcgccgaaaaatgggtttaattgggcaggatgaagtctcggcactctcttaccgtaacaaatggatcatgaaatctcggctccaaaaacatgggataccggttgctagaatgcagcaagtcgttgatcggcagtgggttgaggagtttgcccataaatacggttttcctatcgtgattaaacctgtagaggggggtggatcggttggtgttcagatcattcaccatatcgggcagttacagcacatcgatttcgagcaattgaaacaaggttaccttgttgaagaatggattgaaggagaatttttcaccattgacgggttaatgagaaatggcatgatgcttcactgctggccttcgcgtacgactgccaatttttcggccgtcagtgggaattccacgctgctgagttggatgttattagcggatgatcctctgacagcgcagttatccactctggtgtcacgagttatcatggctcttccgcctacacctgatactacggcatttcatgctgaagccttcttttgtgaaaagacacagcgtcttgttttgtgtgaaattgcatgtcgcccaggaggagcagggcatgtgcctgtctatgaaatggcatttggcttgaatttgtataaagaaactttgctgggccaagcgggattgtgctcacaggaaacctatcgagatgtttatcctcacgctatggcgggatttgcttggtttcctcccaaagaggcgatttttggctatgctcctgaaagctgccctgttgacggcatcaatggctatcagcttatggcgtgttccggccagcgttatcaatcacctcactccatatctgatcacatcgccaaggcgtttgctttgcagccagttgattgtgatccggctaaagtgattaccgaggttgatgtgtggtggaaaacaaatgtgatctggaattaa

SEQ ID NO: 3938 - DNA, 1890 bp, Xenorhabdus bovienii
  Coding DNA location: Contig name=SeqID_16894; Position on contig =39577..41466bp; Strand=-
atgataaattggctgaatacactttctgaatatgatgatgcggtagcttctggctcaggaatcccaattataaggccagaaaaaccctcgcaagaagcgcgctggcatcaggtgatggctgaaatgtatgcagaggaatttcgcataagccacaacaaggatgtcgcaatattgaacattggcgaaaatacggactctatggccttattatatacaaaagtcatgggctatcgtgttatcccagttaacgacattcataacataaaattgctgatacaggagattagcgaaaaagatattcttatcatagcaatggcgtatgaactgaaagtaggtttggttgccagcatattggaaacggtcgctcaggctggaaaaaacataggttttctgtgtggaagagatctatccagccttagctatttagtggctaaatcattgcttcaaccttcactttcagaacagcgtgaatgcttgatcgatgccccaaaacacaaatatacaaatgatgaaaacgatcttgagcaactcattcttttgctttcccagccatcaatgctgaaaacaatcagaagccatggtgaagggagtcatgcaaaattgccttcactgaccgtttgtgggctgctggaagaaacagaatttcctctgatgccttcgtgtggatgctcaagaatggcgcggcggtgtaaacgtgctcatggaaaaacacacgtattttatggtctggatattcgggcttatgtcattaactatatttgttgtaatggcttcaatattgcagaggaactttatccctccccagtatcaatgacactggcattgacagaaggatggtcagccgctgttttggcacctatccgcccattgatcgctcctgattatcttttgacgctatttagacagatggcacaagaaaaagtaccgcttgggcaaatcgcggctgcacttaatgacgcttgtgctgcattaggacagccttttacctttgtgcttcttggtgatccggctttacagttggcgttacaagatgtaagccagcatcaaccggcagataaatgtgaccgtgtggaaacagaaacaacctgcggagctattggatggattaaggctgtattggaagaaggcattcatgggcatcgtttgctgcgatccattgatgcgtggttaggccgcactgtggttgacaagttatccagcctgcgcgagaagctgacaaatattgaacggatggcactatttaccctgaaaaaacaagaagtttcttataatccagatgattataaacaactcttgcgaaataatgcacttatccaaatcttaattagccagtgggaaaaaatactagtttctttattgcatgaaggccgtgaaagttttgatgcttttgatttgcttcattatgatcaactgctcaatgtggtgagaacagccgaaccatgccagcggtgtgggacaccgatagaaatttctttattcggtaattcagaggcaacgacgggaagcagtgaaacttatctatgtcgggtgtgtggcccgctttccgctcatcgtcacggaggcatttacctggagaatctgacggaaatcttgagcgcccggcaaggagagaaggtggcggctaaaatacggctctatgttcctcattctgacaatccggtctctcatcgaatacatctcgaactgcgtggatatgataaatccacggggcaatgttttgcttctgaaataaaaacaacggagttacggcatgacgatgtcgtaatatttgatattaaattggatgaaaatcagggatgtgatttgcacagtattcgggttatcgctgtatctggttttaatatcgcttttctccgtattcgtttggcttgtttacccaagcagccatag

SEQ ID NO: 3939 - DNA, 666 bp, Xenorhabdus bovienii
  Coding DNA location: Contig name=SeqID_16894; Position on contig =41527..42192bp; Strand=-
atggctgaagtgcttaatctaaacgctttaaagagaatgaaactcaaccatgatccttcaccgtgggcaatgtgtgataacacatttcagaaaacgatctcggctgatatgtttccggtaagccactggacttaccattcacagcgcaaactcgcagaggctcttggcaagacaggatcagatgaatggtatcaacataacgtaaaaacccgtcctcttttggaattaggtgaaacagagccttacgcacccgatgaactggcagatatctggttggtggtggcgggggatcttctgtcagatgattatcgtgaatgcatcagtgatgtcagcgaatatgatgttagtaaattacagtttcaagcacatttttgggagtttggctctggttctttctttcaacctcatgtggataaaccccataaaatagttacccatttgatgtatctgacggacgattgggttccagaaatgggcggatgtctgcaattgctacgctctgctgatccaaaagatgttgttgttgaaattgctccgaaaaagaacacctcagcgattattcgcagaacagattcagcttggcatgctgtcacatcaattcccaaagaaatgcagttagtgagaaaggtcttacaagtatggttctgggataagccggttgtctga

SEQ ID NO: 3940 - DNA, 936 bp, Xenorhabdus bovienii
  Coding DNA location: Contig name=SeqID_16894; Position on contig =42237..43172bp; Strand=-
atgatcgactatagttcacgtttcctgaaaacctctggcttgtgggtatcccgattggctgtcgggagcagtcattttggtttgggagtcagtagaaaagaagtcatgcatattgtttccacggcgttggatattggtgtgaatttctttgatacagcagacgtttacggaaaaggtgaaagtgaaatagcgctgggtagggcgttatatgggtatcggcatgatgttgttatcgcaacaaaatttggtcatgatgaaacggcaaggggggcaagccagaccgtaatgacacaatccctgaacaacagcctgaagcggttgaatacagattatatcgatttatatcagttacatgcaccggatttatcaactcctatcgaagaaactatctcaactcttcaagcatgggtaaaagaaggaaaaattcgaagttacggtatttgcaatgtgaagtcatcagaaatcaaacattactgctgtaccgcacagacaatgggaggcgctttactgactagcgtacaaaatcccttgaatatactgaactacccagattatgaagaaataaagccttctcttaaggaatttcagcttggcttgttggcctcacttcctttggcccgtgggctgctgggaggacattatcgtactgtgctggatgttccctgtacgcatccattgtctggttataaaggtcttggttatcgcaatattcggacaaaaaatgcaatcggccgactgatgcatgctgcaaaacaattaaatcgtcccccgtccgtattggcactggaagtgatactggcaagcgaagatctagtttccgttctggttgggatcagtaattccaatcagctactttccctgattgatcttaatccatcattgattcagcaagaaacgattgattatctccttgggcgacgcccagagctgggttaa

SEQ ID NO: 3941 - DNA, 216 bp, Xenorhabdus bovienii
  Coding DNA location: Contig name=SeqID_16894; Position on contig =43172..43387bp; Strand=-
atgaaaaatacaaagaaagatgtgaatgatcttctggatgatttagtttctaaacctgaagtgcaagctcgctgggaagatgtccctgagcaagtaatgcaagaatatcaactgacacctgcacaatatcgagcgctttctgaaggaaatatagatgccctgatcaatgaaggattggctgatagacatgtccagcaaatgagggttagttggtaa

SEQ ID NO: 3942 - DNA, 636 bp, Xenorhabdus bovienii
  Coding DNA location: Contig name=SeqID_16894; Position on contig =43862..44497bp; Strand=-
atgagtggaaaccaaaaacattggtcacaagttgagtatttacattcaacagtaaccaaccccaatataaagattaaaggcacgcacagttattatagtcactgttggagtgatagttttgagaagagtgttgttcgttatctttatggtgatgaaatcagtcttgggtgggaacctttaggtgtcgttgataagctttacataggaaattatgtctgtatcgcatcagaagctgtcattctgatgggaggcaatcatactcatagaatggactggttttctgtctatccttttttggaaggtattaaagaatcctaccaacattccggtgatacgattttgtctgatgggtgttggattggtatgcgttcaatgatcatgcctggcgtcacgattggagagggagcggttgttgctgcggggagtattgtcacgaaagatgtttctccgtataccgtagtgggtggaaatcctgcccgattcattaaatatcgttttgaaccctctgttatatcgagattgttggcgttgaaaatctatgatctggatgaagagatggtggaaaaattacttccttatttgaaaggggatgatatagactcccttgaatcagcttattattctattaatcaataa

SEQ ID NO: 3943 - DNA, 675 bp, Xenorhabdus bovienii
  Coding DNA location: Contig name=SeqID_16894; Position on contig =44798..45472bp; Strand=-
atgtttctatcgtgcaaagaggtcatattggatatgatctcttttaatccattgggtatagatagaaaaataaggagtgaattaatgataaatcctaaagacattatcttttttccagagccagatcctaatgaaaatccttgggtgcatggtaaacctgctgaagaggtgataggtgttgtggcatataatcctgaatgggtagttacatggcagcaactctctgcgtctatcaagaaagcactgggaaacattgtcttgcatattgagcacgttggttcaaccgcagttcctggtcttgcagccaagccggttattgatatcgatctgattgtgctagatccaattcaggaacaaacttatgttccggcgctggagcagcttggttatgacttaacggtgcgtgaaccgagtttttatcaacatcgctgcctacggttagcaaaaccacgagtcaaccttcatgtttttggtccagattgccctgaacacattcgccatattttgtttcgcgattggctcagagaacatcctgaagattgccaacgatatatgactgcgaagataaacgccaaagataatgtcagtcaggtaatgcactataatcagagaaaagaacaggttgtacgtgagatttaccagcgtatatttcaaagtcagggattattgtcataa

SEQ ID NO: 3944 - DNA, 4452 bp, Xenorhabdus bovienii
  Coding DNA location: Contig name=SeqID_16894; Position on contig =45488..49939bp; Strand=-
atgattgaacgcggtaaatttcgctcactgacgctagttaactggaacggtttttttgctagaacgtttgatcttgacgaactcgtgaccaccttatccggtggtaatggtgcaggtaaatccaccacgatggcagcgtttgtgacagcgttgatccctgacttgacgctgcttcatttccgaaacaccacggaagctggcgcaaccagtggctcccgtgataaaggcttgcacggtaaactgcgtgccggggtctgttattccacgctggatgtcgttaactcccgccaccagcggatcattgcgggggttcgcttacagcaggttgccgggcgtgaccgcaaggttgatatcaaacccttcatgatccagggtgtccctgcatcggtacagccaacgcagttattgaccgaaaatattggcgaacgtcaggcgcgggttctgccattaaatgagctgaaagagcgccttgatgagatggaaggtgttcagttcaaacaatttaactctatcactgattaccattccctgatgtttgatttgggggtgattccaaaacgtctgcgttcggccagtgaccgtagtaagttttaccgtttgatagaagcatcgctatatggtggtatttccagcgccatcactcgctcactgcgcgattacttactgccagaaaacagtggcgttagaaaagcgtttcaggacatggaagcggcactgcgtgaaaaccgcatcacgctggaagcaatccgcgttacccaatctgatcgcgatctgtttaaacatctcatcacggaagcgacagcttatgtttctgctgactacatgcgtcataccaatgagcgccgtatccatctggatgaagccttggccttgcgcagtgaattgtttggtagccgccgtcaattagtggctgaacagtatcgccatgttgaaatagcacgggagcttacggaacagagtggtgcatcttctgatttggagatggattatcaggcggctagtgatcatctgaatttagttcagacggccatgcgtcagcaggagaaaatagatcgttatcaaggagatattgaagagctgacttatcgcctggaagaacagactgaagttgtcgaagaagcgaaagagttacaggcagaatatgacactgtgtctgaggcggctgaacaggaagttgatgaattaaaaagccagcttgctgattaccagcaggcgttggatgttcaacaaactcgctcgatccaatatcaacaggcgctgcaagcactggaacgtgcccgtgagctttgtcagctccctgatttattgatagagaatgctgatgagtggcaggaaacttatcaggccaaagaacaacaagcgactgaaaccttgctggcgctggagcagaagctgagtgtggcagatgctgcccatagtcagtttgagcaggcttatcaactggtgaaaaatattgttggtgaggtgagccgtagcggagcatggcaaagtgcccgtgaagtactgcgcgaatggccatcccaacgccatctgacggatcgtgttcagcctctgcgtattcaattagctgaattggaacagcgcctgaacagccagcaaaatgcagagcgcttactgggggaattctgcaagcgccacaaccagcaatatcagccggaagatttagaagcgttgcagggagaattggaagcccagttggaagagttaagcctgaatgccagtgaaagcggcgagcgccgtatgcagatgcgtcagcaactggaacaacttaagcagaaaattcagggattgacaacacgtgcaccagtttggctgacggcacaggatgcattgaaccaactttgtgaacagagcgacgaaacgttcgaaagtgccaatgatgtcactgaatacatgcaacaattgctggagcaagaacgcgaaactaccgtcgaacgtgacgatgtagcagcacagaaacgtgagcttgaaaagcatattgagcgtttgagccagccaagtggtgccgaagacagcagattgcttgcattagcggaacgttttggtggtattttgctgtcagaaatttatgatgacatcaccattgatgatgcgccttatttctccgcattgtacgggccagcccgtcatgccatagttgtgccggatctttcgttggtaagtccacatctggaagcactggaagattgcccggaagatctctatctgatcgaaggtgatccgcaatccttcgatgatagcgtcttggatttcgaagagcggaaaaatgctgttctggtgaaatcatcggatcgtcagtggcgttattcccgttatcctgacgttccgctgtttggaagggctgcaagggaaaatcgtctggaaatactgaaccttgaacgtgatacgctggcagaacgctatgcaacgctttcgtttgacgtccagaaaatccagcgcgcctatcaggctttcagccgttttgtgggcaaacatctgtcagttgcatttgatgacgatccagaagctgatattcgtagcttgaatcagcagcgaattgaactggagcgcgaactctctcaatttgaagcacagactcaacagcatcaccagaaactggctcaggtaaaagagagtctgtcagcgctgaaccgcctgatcccacaaattaccctcttgctggatgaaacgctgatcgaccgtgtggaaacggtgcgtgaagaaatgagtgaagcacaagatgcggctcgttttttgcaacagcatagtcatgcactgaacaaactcgaaccgctggtttctgtcctgcaaagcgatccacagcagcatgagcagttaaagcaggattatgagacggcgaagcacacccagaataaagcgaaacagcaagcttttgctttgacggaagtggtgcagcgtcgtgcacatttcagctatagcgattcggtaggaatgctcagtgacaatgctgatctgaatgataaattgcgccagcgccttgaacatgcggagtctgatcgcagccgtgcccgtgaacaattgcgccagcagcaatcacaatacgcccaatttaatcaagtattggcctcattgaagagttcctatgacactaagcaggatatgttgaaggaacttgagcaggagatgaaagacatcggtgttcaggccgatccgaatgcagaaagtcgtgcccgtgaacgtcgcgatcagcttcacactgccttgagcaccaatcgttcccgcatcaaccagcttgagaaacagatcgcattttgtgaggccgaaatggaaaacctccagaagaaattgcgtaaatctgagcgtgactattatcagaaacgcgagcaggtggtttcttcaaaagccggctggtgtgctgttatgcggatggtgaaagataatggtgtcgagcgtcgcctccatcgccgcgaactggcctatatgaatggagatgaactgcgttcaatgtcggataaagcgctgggggcattgcgtctggcggtggcagataatgaacacctgcgtgatgcactgcgtttgtctgaagatcccaaacgtccagaacgtaaaattcaatttttcgttgctgtttatcaacatctgcgtgagcgtatccgccaagatattatccgtaccgatgatccggttgatgccattgaacagatggaaattgaactggctcgtttgacggaagaattgacggcgcgtgaacaaaaactggcgatcagttccaagagtgtggccaatatcattcgtaagacgattcagcgcgagcagaaccgtattcgaatgttgaatcagggattgcaggctgtttcttttggtcaggtaggaggagtgcgtttgaacgtcaatgtacgtgaaagccattcaatcttgctggatgtgctttccgaacagcaggagcaacatcaggatctgttcaagagccagcgtctgactttctcggaagcgatggcgaaactttaccagcgtctgaacccacaaattgacatggggcagcgtttaccgcagaccattggtgaagaattactggattaccgtaactacctcgaattggacgttgaagtcaaccgtggctctgatggttggctcaaagctgaaagtggagcattgtctacgggtgaagccattggtacagggatgtcaattctggttatggtcgtgcagagttgggaagaggaatcacggcgtctgcgtggtaaagacatatcaccatgccgtctgttgttccttgatgaagcggcgcgtttggatgcgaaatcaatcgccacgctgtttgaactgtgcgaacgtttgcagatgcagttaattatcgcagcgccggaaaacatcagtccagaaaaaggtacaacgtataaattagtacgtaaaatatttaataatcatgaacatgtgcatgtcattggtctgcgtggttttggacaggatgctcccgccattgaacagcctcaacccatcttggaagagtaa

SEQ ID NO: 3945 - DNA, 750 bp, Xenorhabdus bovienii
  Coding DNA location: Contig name=SeqID_16894; Position on contig =49936..50685bp; Strand=-
atgattacggagccaaggtgcaggcacatgtcatcgacacatattgaacaatttatgccagtcaaactggctcaggcattatccaacacactttttcctgaattagacagccaacttcgttcagggcgtcatattgggatggatgatcttgataatcatgctttcctgatggattttcaggaggaactggaaacgttttatgctcgctataatgtcgagttaatccgtgcaccagaaggttttttctacctgcgtccgcgttcaacgacgctgatccctcgatctgttctgtctgaaatggacatgatggtaggtaaaatcctgtgctacctctatctcagcccagaacgcctgtccaatcagggaatatttacctttcaggaactgtatgacgagctgttgtcgctcgctgacgaaagtaaactgatgaaattggtgaaccaacgttccacaggctccgatctggataaacaaaaactacaggaaaaagcacggacttccctaaaccgtctgcgccgtttgggaatggcctatttcctgcaaaatgacagcaataaatttacgattactgaaacggtattccgctttggtgcagatgtacgcagtggtgacgacccacgcgaagcacaattacgaatgatccgtgatggtgaagcgatgccggtggaaggcaatttattgcaggaagataatgaacacgaagaagtatcagagcattcagcagaaggtgcggaggataaacagtcatga

SEQ ID NO: 3946 - DNA, 1323 bp, Xenorhabdus bovienii
  Coding DNA location: Contig name=SeqID_16894; Position on contig =50639..51961bp; Strand=-
atgagtgaatattcccagactgttcctgaacttgtgtcctgggccagaaagaatgatttttcgatttcgttgccaccggaacgcttggcttttttgatggcaatctcagtgctgaacagcgaacgttttgatggcgaaatgagcgagggagagttggttgatgcgttccgtgaagtttgcaaaggttttgaacaaacgtcagaggcggttgctgtccgggcgaataatgccattaacgatatggtacgccaaaagctgattaaccgctttaccagtgaattagcggatggcaatgctatctatcggttgacgccattgggtattggtatcagtgactattatattcgccagcgcgaattttccacgttgcgcctttccatgcagttatccattgttgccaacgaactgcatcgggcggctgaatctgctgaagaaggcggcgatgagttccattggcaccgtaatgtttttgcgccgctcaaatattctgtcgctgaaatttttgacagcatcgatatgtcacagcgtactatggatgaacagcaaaacagcgtaaaaacagacattgctgcactcctcaaccaagattggcaggctgctatcgctaattgcgagcatttactgtctgaaacgtcgggcacattgagagagctccaggatacgctagaagctgctggtgataaattacaggccaatctactgcgtattcaggatgctaatatgggcagcggtggcttagaattggtggataaactggtttttgatctgcaaagtaaactcgaccgcattattagttgggggcaacaggctatcgatctctggattggctatgatcgccatgttcacaaatttatccgtaccgctatcgatatggataagaaccgcatatttgctcaacgtctccgccaatctatccaacactattttgatcatccgtgggcgctgaccatcgccaatgcagagcgtttgctggatatgcgcgacgaagaactgacattgcgcaatgaagaggtaatgggagaattaccgccagacatggaatatgaagaatttagtgaaatcaacgaacagttggccgagatggtggcacgagcactggcagtctaccaacaggccaggctcccattagatttgggggcagtactgcgcgattatcttgctcaatatccacgtaaccgccatttcgatgtggcgcgtattctggtggatcaggcagtacggctgggcgttgcagaagcggatttctctgggttgccagcggaatggttagcgattaatgattacggagccaaggtgcaggcacatgtcatcgacacatattga

SEQ ID NO: 3947 - DNA, 786 bp, Xenorhabdus bovienii
  Coding DNA location: Contig name=SeqID_16894; Position on contig =51958..52743bp; Strand=-
atgcgggatcgcaatttcgatgatattgcagacaaattttcacgtaatatttacggcacaaccaagggtaaaatcaggcaggccgttgtctggcaggatatcaacgaattgctgaatcatttacctcagcgccctctgcgcattttggatgcgggaggcggtgaaggaaacatggcttgccaattggctgaattaggccatcaggtcatattatgtgacctctctgaagaaatgatcctgcgggcgaaatgtaatgcacaggagcggggtgttctccatcagatgcaatttatccaaagcccggtacaggatattggtcaacacattaaacaacccgtcgatttaattctatttcatgccgtattggaatggatcactgaccaaaaagatgcgatagaaacattgggggagataataacacccggtggagcactttcattaatgttttataatgctaatggactggtcatgcgtaatgccatattgggtaactttcatttggcaacgccaaatattcagcgtcgccgaaagcgttctttatcgccacagaatccattagtacccgaacaggtatatcagtggcttattgaactcaatatggaaataacaggcaaaacaggcgttagggtttttcacgactacctgcaaagccgccaattacaaaatacagattttccggcgttgcttgaacttgaacaacgttattgcagacaggagccctatatcagcctggggcgttacattcatgtgatggcacgcaagacgactttaaagagtgaattatga

SEQ ID NO: 3948 - DNA, 132 bp, Xenorhabdus bovienii
  Coding DNA location: Contig name=SeqID_16894; Position on contig =52742..52873bp; Strand=+
atgaaaaactgcctcactgataagctaagtttaatttatttattgagtaataatgctggctactgttattttggcacagtactcattgaattcactacttttagccctaaattcgaccctgggcggctataa

SEQ ID NO: 3949 - DNA, 807 bp, Xenorhabdus bovienii
  Coding DNA location: Contig name=SeqID_16894; Position on contig =52897..53703bp; Strand=+
atgttatttctgcttaaaaaatatgttggcgcgctattaatgcctttgcctttgattattcttgtttctttgacagccctgctatttctgtggttcacccgctggcaaaaaacgggtaaagccatactgtcactgagttggcttgcgctacttttatttagtttacagccgattgctgacaaacttttacttcctatcgaagggaagtatgttcaacgctatgagcctgacaaagcatatactgcccccgtaaaatacattgttgttctcggtggcggtttcacttacaactcacaatgggcgcccagtgccaaccttatcagtaatagtctgcccagagtcaccgaaggtattcggttatatcaccttaatcctggtactaaaatgattttcacgggtggtagaggcgttaattcaatcagtagtgccgaaatcgctgctatagtagcacaatctttgggaattcctgtagaagacacgattgcattaagagaacctttagatacggaagaagaagctgctgaagttgaaaaagtgcttgggcaacaaccttttattctggtcacttccgccaatcatatggaacggtcgctcaagttcttcgaacggcgtggtatgcaccctatcgcaggccctgccaatcaactggctgtgacaactccactatatgcatgggaaaaatacattccatccgcctattatttttcacatacggaacgagcttggtatgaaacgctgggtaaaatttggcaggcaataaagccagtaaataaagaggcagcaaccgagaaatcagagaactcttaa

SEQ ID NO: 3950 - DNA, 750 bp, Xenorhabdus bovienii
  Coding DNA location: Contig name=SeqID_16894; Position on contig =53793..54542bp; Strand=-
atgtttaccgttatcattccagcgcgttttgcttcaactcgcctgcctggaaaaccgctggctgatattcatggcaagccaatgattgtgcgcgttatggaacgggctatccgctccggtgccaatcgggtgattgtggcgacagataaccaagccgtttttgatgcagtcactgctgcaggcggtgaagcttgcatgacaagtgcgcatcaccattcaggtacagagcgtttagctgaagtcattgatcaataccaatttgctgatgacgagatcatcgtgaatgttcaaggtgatgagccacttatcccagaacaaattattaagcaggtcgccgataatctggcagaaagtgatgctggaatggcaacacttgcagtgcagatccaagatgcagaagaagcattcaaccctaacgctgtaaaagttgtgatggatgcgcagggctatgcgctctatttctcacgcgccacgattccgtgggaacgtgatcgctttatgcagtcaaaagaaacagtcggggataacttcttgcgccatatcgggctttatgcatatcgggcaggatttatccgtcgctacgtgcaatgggcgccaagcccattggaaagcattgagatgctcgaacaactgcgggtgctttggtacggtgagaaaattcatgtcgcgaaagcgctacaagcgccaggtgcaggggtagatacacctgaagatttggaagccgtcagaaaagcttttgctgagtgttga

SEQ ID NO: 3951 - DNA, 144 bp, Xenorhabdus bovienii
  Coding DNA location: Contig name=SeqID_16894; Position on contig =54526..54669bp; Strand=+
atgataacggtaaacatgaattatttttcttcctctgctggcagggcgcgggcttcattttctaacagcacaggaatgccatcacggacgggaaaagcgaggtggtcaagtttgcaaatcagttcaaagttttctttatcgtaa

SEQ ID NO: 3952 - DNA, 996 bp, Xenorhabdus bovienii
  Coding DNA location: Contig name=SeqID_16894; Position on contig =54834..55829bp; Strand=-
atgattgaacgcatatggttcggccgttcatggctttacatcttgctattgccactgtcagccctttatgggctgataagcggtctgcgtcgtttaggctataaactggggttgatccgttcttggaaagcgcctgtacctgttgttgtcgtgggtaacttgacggcaggagggaatggcaaaacaccagtcgtcatttggctggttgaacaattgcagcgaacaggctatcaggttggtgttgtttctcgcggttatggcgggaaagcggaacattacccactgttggtaacaggcgaagtgacaacggcacaagcgggagatgagccagttttgattcatcgccgtactggtgcacctgttgcggtcgcaccgaaacgcaccgatgctatcaaggcgttattaacgcattttcccgttgatatcatcatcaccgatgatggcctccaacattatgccttacagcgtgattatgaaattgtggtcattgatggtatccgtcgcttcggtaatggttgctggttaccggcagggccgatgcgggaactcgctggtcgtctaaatacggtcaataccattattgttaatggaggaacaccggaagcaggcgaattgcccatgacgctaaaaggtgaactggcgattaacctgctgacaggagaatcgcgtcaggtcagtgatattcccaatggggtggcaatggcaggtattggtcatccaccgcgtttttttgcaactttgcagcagttgggagctgttttgcaggaaacatacgcttttgctgatcatcaatcttatgataaaactcaattgtcggctttgaccgatgatgggcagaatttgctgatgacagaaaaagatgcagttaaatgtttcgaattcgcgcagcctaattggtggtatttaccggtttctgcacattttccagaagaaaaagagcaaaaaatgctggatgaaatttgtgctttactccctaaagtgaacatgcgtagataa

SEQ ID NO: 3953 - DNA, 1746 bp, Xenorhabdus bovienii
  Coding DNA location: Contig name=SeqID_16894; Position on contig =55826..57571bp; Strand=-
atgaatgataaagacctttctacctggcagaccttccgccgattgtggccgctcatcacaccatttaagctagggttggcagtggcggcgattgcactggttataaatgctgccggtgatacattgatgctttctttgctgaaacctttacttgatgagggttttggcaaggcagacatgagtgtattggagtggatgccactggttgttatcgggttgatgcttttgcgtggcatatcgggttttatatcaagttattgtatatcttgggtatctggcaaagttgtcatgcagatgcgccgtcgtctgttcacccatatgatgggaatgccagtttccttttttgaccagcaatctacggggacattgctttcccgcattacatacgattcagaacaggttgcttcttcttcttccggcgcgctggtgacagttgtcagggaaggagcatcaattattggcctgttcattctgatgttttattacagttgggagctttccctgatcttgattgtcattgctccgattgtcgctcttgttattcgtcttgtttcggtacgttttcgtaatatcagcaaaaatatgcagaacagcatgggaatggtgacaaccagcgcagaacagatgctgaaagggcacaaagaagttttgatctttggtggtcagaagattgagactaaacgttttaacaaagtcagtaaccatatgcgtcagcaaggcatgaaaatggtgtcggcgtcgtctatttctgaccctattattcagttaattgcttcttttgctttagcgtttgtcctgtatgctgccagtttcccggaaattatgggcgcactgactgcgggtaaaatcaccgtggtattttcatccatgatcgccctgatgcgcccactgaaatcgctgactaatgttaacgcacaattccagcgtggtatggccgcttgccaaacattatttgcgattctggatatggagcaggaaaaagatgaaggtaagctggagctgaaaaaagcaaaaggtgatcttgaattccgtaatgtcacattctgctatccaaccaaagatcatcctgcgctgaaaagcatctcaatgaccattcctaaaggtaaaactgtcgcattggtggggcgttctggttcaggaaaatcgacgattgccaatcttctcactcgtttttacgatatcaatgaaggcggcatcatattggatgggcatgatctgcgtgaatactcattgtcttcactgcgcagccagatagcgctggtatcgcagaatgtccatttgttcaatgatacggtcgctaataatatcgcttatgccagcgaaggaaaatttagccgtgaagaaattgaacgagccgcggaaatggcctatgcgatggactttatcaagaaactggatcagggtcttgataccatgattggtgaaaatggtgtcctgctttcaggcgggcaacgtcagcgtattgccattgcccgtgcgttgctgcgtgattccccgattcttattctggatgaggcaacctcagcactggatactgaatctgagcgcgccatacaagcggcgctggacgaattgcagaaaaacaggacttctttggtcattgcccatcgcctttctaccattgaaaatgcggatgaaattatcgtcgttgaagacggttttatcgtcgaaaaaggtaatcattcggttctgttggaaaaagatggcgcatatgcccaattacatcggatgcaatttggtcaatga

SEQ ID NO: 3954 - DNA, 2370 bp, Xenorhabdus bovienii
  Coding DNA location: Contig name=SeqID_16894; Position on contig =57610..59979bp; Strand=-
atgtcagcgcagaggcataaccggatgtggcctatcatttttttcccctttacttgtattctctccatttggcgaaagccgctgtttattatcagtctgaatcaggctgctatagcaattattctgggaatgatccccttattattgcttgctgaattacctcagcagaaggaaatttgtttcctgattgggttggcattttgtttatggtttgttccctgtaaatccactcggataacttcgctgatgctatggacatttatttttggatgttggcatggtcacctgatattgaatcaaatcacttatttcagcgaaacctcccgttctgcaacggtcatgattgagagcgtatctttaggtgctgagaaaaataatgagggagaaaaagaacgttatcggatccgattaattgaaagtgatggaaaatatattttccctgctttatttgcatcggtactatggaattctcctgaatcgctgtgtgctggccagatatggcaggtcacaatgaaactcaggccggttcatgctcaattgaaccatggaagctatgatagccagagatatgcactttctattcgtcagccacttaatggcaaaataactaaggcgaggttactgaatggtcagtgcagttttaggcaagatctgataaataaactggcgccagaaatccaaccattgaaatatgcaggtatcgctctggctcttacctttggtgaaagaaagtggctggatcaacaaaccagactgctgttgcagcaaacgggcatcgctcatcttatggcgatttcagggttgcatattgcaatggccagtttattcggctggagccttgccaggggcattcagtttctctttccggcaaggtgggtgagttttcgtttcccgctcctcatggggtggctgactgcggcgttatatgcttggctgtcaggctggggaattccggctgttcgggcaatattaggattaacactttggatttatctgcgatgcagaaaccggttttgtttttcatggcagtgggctttatggagtgcagccctgattttactgtttgatccactggcaatcctttctgacagcttttggctctcatttactgcggtgatggcgttgttattctggtttcactggatgcccttacccgagggtattcgttatggctggcagtggagttggctacgtgggctgcatatgcaattgggaatgatgctaatgttgttgccgttgcagcttttgctgtttcaggggctgaatattgcatcattggttgctaacttatgggctgtaccgatagtctctttcttgtctgtgccactggtgatgttagcgttatcctgtttctttcttcctgttattcagccaattttgtggcagttggttgattacagtattgtactcgctttggcacctttgcagattttaacacattcatggtttgaaacagggtatttccctatctttataacgcttgtggggtggttttttgtcattttttggcgtttgggctggtggaagtcttataaatggctgttaggtgtctcgattggaattattgtctgttatttaaaacgcgatgatgaataccaatggcgtttttcgatgctggatgttggacatggtttggcagtggtcattgacaagggaggaaaggcaatcatttttgatacaggaaaccgttgggaaacgggaagtatggcagaaaaagtcattgcaccttatttgcgttggcatcgtttgacaccagaacagattattctcagccacgatcatttggaccatacaggtggcgtagaatatttgcgcgaaaaatatcctgatattcaaatcaggagttctttgatcgagcaatcacatttgccttgtattcgtggtgagcaatggacctggcaggaattaacgtttcgggtcatctggccgcaagaaaaaacagcggttgtcggtaacaatcaatcttgcgtgatccgcattgatgatggtaaacacagtctattattaacaggtgatttggaaaaacagagtgaataccgcttagtcagtcttgagcgagaacatctgaatgcaacaatattgcaagttcctcatcatgggagcaatacttcgtccacagcggtatttatacggacagttatgcctaaatatgcattaacttcggttgcccgttatagcccgtggaagttgccttcagtgaaagtgcagaaacgttataaaaatgctgaaattcaatggcatagtacttcggtttccggccagattaccggttgtttttatcgtgatcacattaaattagcaggttatagacaacacataatgtcacggtggtatcatcagtggtttggtattcatagcgatcatgagtag

SEQ ID NO: 3955 - DNA, 111 bp, Xenorhabdus bovienii
  Coding DNA location: Contig name=SeqID_16894; Position on contig =60011..60121bp; Strand=-
gtgccgtttttttgtgattattttcgcattattttgtcgtcttttcttgaccgacgaactaatttgcgaagtgattctatattagtacttatctgtctggtcgcagcataa

SEQ ID NO: 3956 - DNA, 291 bp, Xenorhabdus bovienii
  Coding DNA location: Contig name=SeqID_16894; Position on contig =60160..60450bp; Strand=-
atgaccaagtctgaattaatcgaaagacttactgagcaacaatctcacatgcccgctaaagccgttgaagatgcagtgaaagaaatgcttgatcatatggcagaaacattggccgcaggtgaacgaattgaagttcgtggattcggcagcttttctcttcactaccgggctccgcgtgtgggtcgtaaccccaaaactggcgataaagttgaattggaaggtaagtacgttcctcactttaaaccaggtaaagagttacgcgatcgcgtgaatatctatagcgacagctaa

SEQ ID NO: 3957 - DNA, 1674 bp, Xenorhabdus bovienii
  Coding DNA location: Contig name=SeqID_16894; Position on contig =60523..62196bp; Strand=-
atgacagaatcttttgctcaactctttgaagaatccctacaggttatcgaaactcgtccaggtgccattgttcgtggtgtcgtcgtttctatcgataaagacgttgtattggttgatgcaggtctgaaatcagaatctgcaattcctgtagaacaattcaaaaatgctcagggcgagctggaaatccaagttggcgatgaaatcgacgttgctctggatgcggtagaagatggtttcggtgaaactatcctgtcccgtgaaaaagcaaaacgtcacgaagcatggctgatgctggaaaaagcatacgaagaagccgaaactgttaccggtgttatcaacggtaaagtcaaaggtggcttcactgtagaactgaacggtatccgtgcattcctgccaggttcactggttgacgttcgcccagttcgtgatactgctcaccttgaaggcaaagagcttgagttcaaagtcatcaagctggatcagaaacgcaacaacgtagttgtttcccgtcgtgccgttatcgaatctgaaaacagtgcagagcgtgatcaactgctggaaaatctgcaagaaggcatggaagttaaaggtatcgttaagaacctgactgactacggtgcattcgttgatctgggcggcgttgatggcctgctgcacattactgatatggcttggaaacgtgttaaacacccaagcgaaatcgtcaatgtgggcgatgaaatcacagttaaagtactgaaattcgaccgtgagcgtactcgcgtgtctctgggtctgaaacaactgggtgaagatccatgggtagcaatcgctaaacgttacccagaaagtactagactgactggtcgcgtaactaacctgactgattacggctgcttcgttgaaatcgaagagggcgttgaaggtctggtacacgtttcagaaatggattggaccaacaaaaacatccacccatccaaagttgttaacgttggtgacgttgtggaagttatggttctggatatcgatgaagaacgtcgtcgtatctccctgggtctgaaacagtgtaaatctaacccttggcagcaatttgctgagactcacaacaaaaacgaccgcgttgaaggtaaaatcaagtcaatcactgacttcggtatcttcatcggtctggacggcggcatcgacggcctggttcacctgtctgacatctcctggaacgttgcaggcgaagaagcagttcgtgaatacaagaaaggcgacgaaattgctgctgtagttctgcaggttgatgcagagcgtgagcgtatctctctgggcatcaagcaactggcagaagatccattcaacaattacctgtctgtaaataagaaaggtacgattgttaatggtaaagtgactgcagttgacgcaaaaggtgctacagttgaattagctgacggcgttgaaggttacctgcgtgcatcagaagcttctcgtgaccgcattgaagatgcaactcaagttctgaacgttggcgatgaagttgaagctaaatatgttggtgttgatcgcaaaaatcgcatagtcaacctgtctgttcgtgcgaaagacgaagctgatgaaaaagacgctatcgcttctgtgaacaaacaagaagatacgagctttgctaacaacgcaatggctgaagctttcaaagcagctaaaggcgaataa

SEQ ID NO: 3958 - DNA, 177 bp, Xenorhabdus bovienii
  Coding DNA location: Contig name=SeqID_16894; Position on contig =62247..62423bp; Strand=+
atggggttgttttacatacctcgcaactattccctgttacaaggtgctttggtatgccagcatattttactgcccacataccaggattctatatacatcttcttggtgcgctgttgcaagagtacaacatgcgaaaacaacaattacgcaggcagtgccagcgcgtttttcgcataa

SEQ ID NO: 3959 - DNA, 735 bp, Xenorhabdus bovienii
  Coding DNA location: Contig name=SeqID_16894; Position on contig =62390..63124bp; Strand=-
atgacccgtttgttgtgcggaaagcgctatgcgaaaaggaggaaaataatggtggcgatagcctcagtaataaccgttgatgggccaagtggtgctggcaaaggaacactctgtcaggcactggctgaagcattgggttggcaattacttgattcaggtgccatttatcgtgtattagcactggcagccattcatcatcaggtggatatccaatccgaagactcactggttcctctggctgcaaatctagatgttcgttttatgcctgcaaatggcaaactcagggtcatcctggaaggcgaagatgtcagcaatgaaatccgtactgaagctgttggcaatacggcttcacaggcggcaacatttcctcgtgtccgtgaagcactgcttcgtcggcagcgggcttttcgtatcgcaccggggttgatcgctgatgggcgcgatatggggacggtggtatttcctgatgcgccagtgaaaatttttctcgatgccagcgcggaagaacgcgcccgcagacgcatgttacagttgcaggagaagggttttagtgttaactttgaccgccttttgtccgagatacaggagcgggatttccgtgaccgtaatcgggccgttgcgccgttagtgcctgcacatgatgcattgctcttggattcgaccagcatgtctatcgaagaagtgattgataaggccctgacttatgcgaaaaacgcgctggcactgcctgcgtaa

SEQ ID NO: 3960 - DNA, 1287 bp, Xenorhabdus bovienii
  Coding DNA location: Contig name=SeqID_16894; Position on contig =63269..64555bp; Strand=-
atgcaatccctgacgttaaaacctatttcctgtatcaatggaactattaacctgcccggctccaaaagtgtttccaaccgcgcgctgctgcttgcagccttcgccaagggaacaactcgcctgaccaatttgttggacagtgatgatatccgccacatgcttaatgctctgacagcactcgaaattccctaccgtctatcagacgatcgtacttgctgtgaagttgatggtattgggggaactatcaccggaaaaggtgcgctggagctgtttttgggcaatgcaggaacggccatgcgtccgttggctgcggcactgtgtctgggagacaacaatgtcgtgctgacaggggaacctcggatgaaagagcgcccaattggtcacttggtggatgcgttgcgtcaaggcggagcaaaaattgattatcttgaacaggaaaattatccgccactgcatatcaaaggtggattttcgggggggaaagttgtcgttgatggcagtgtttccagccaatttctgacagctttgctgatggccgcaccattggcggcgaatgatacagaaattcatattcagggcgatctggtttctaaaccttatattgatattactctggcgctgatggaaagtttcggtgtgacggtagaaaatcaccaatatcaaatttttcatgttaaagggcagcagcaataccaatcgctgggacattatctggtggaaggggatgcttcatctgcctcttattttctggcagccgctgcgataaaaggtggcacggttcgcgtgacaggcatcggtaagaatagcctgcaaggcgatacaaaatttgctgatgtgctggaaaagatgggggcgacgattcgttggggtaatgattttgtggaatgtgaacgtggtacattgattggtgtcgatatggacatgaatgctattcctgatgccgctatgactattgcgacaacagcgctgtttgctcaaggtgaaaccgtcatccgcaatatttataactggcgggtaaaggaaacggatcgtctcaatgcaatggcgactgaactacgcaagattggggctgaggtggaagaagggaatgattacattcgtgtcgttccgccacaaaagctcaatcatgctgaaattgaaacctataatgatcatcgaatggcgatgtgtttctcgctggttgcactttcggatacaccagtgacgatccttgatccaggctgtacggccaaaacattcccagattatttcaatcagcttgaaaaactgagtcaatacataatgtaa

SEQ ID NO: 3961 - DNA, 126 bp, Xenorhabdus bovienii
  Coding DNA location: Contig name=SeqID_16894; Position on contig =64605..64730bp; Strand=-
atgaaggtgttcaggtattggctgaatttatggctgattttgaacgccgtaacgcataatgcgcttatcatcgggaggaatgaaacctcccgatgtgaatattcctcatttatttcaaaaaattaa

SEQ ID NO: 3962 - DNA, 1089 bp, Xenorhabdus bovienii
  Coding DNA location: Contig name=SeqID_16894; Position on contig =64672..65760bp; Strand=-
atgagtcaggtatataatttcagcgctggtccagccatgttgccagcagaagtattacgccgtgcagaacaagagctttgcaactggcatggcctgggaacatctgttatggaaatcagccaccgtagcaaagagttcatggatgttgcggctgaagcagaaaaagatcttcgggatttattagcgatacctgagaattataaagttttgttttgtcatggtggtgcccgtggtcagttttcggctttgccacagaatctacttggtaacaaaacgacagctgattatatcgtcagtggctattggtctgagtgtgcagcgaaagaagcagaaaaatattgcacaccaaacgtcataaatattacgacagaagttgatggcatcagaagcgtgaagccaatgagtgaatgggcgctgagcagtgatgccgcctatgtgcattattgtcctaatgaaactattgaaggtattgcaatttttgaagagcctgattttggcgatgataagatcgtgattgctgactactcttcaactattctttcagccccgattgatgtgaatcgttacggcgtgatttatgcgggagcccaaaagaacatcgggccagcaggaattacagtggtgattgtccgtgaggacttattgggtaaagcacatcaacataccccatcaattctggattacactgtgcaggctaaatcaggctctatgtacaacactccgccaacatttgcctggtatctctctggcatggtgttcaaatggctgaaagagcagggaggcttacaggaaatcagcaaacgcaatcttgcgaaagcagaactcctctatcgcgctattgataacagtaatctgtatatcaaccgtgttgcaccacagaaccgttccatcatgaacataccattccaactggccaatccaacactggatggcaaatttctggaagaagcctatgcacatgggttgcacgctttgaaaggacataaagttgccggtggtgcgcgggcttccatttataacgctatgccttatgaaggtgttcaggtattggctgaatttatggctgattttgaacgccgtaacgcataa

SEQ ID NO: 3963 - DNA, 222 bp, Xenorhabdus bovienii
  Coding DNA location: Contig name=SeqID_16894; Position on contig =66268..66489bp; Strand=-
gtgacttcgagagagaatcgcatttacctttatgatgtcaatgttattttttatgggtatttgaacaaaaaattaacaacccgagaaagcatgcaggagacgaagccgattgttcatccactttacaaatcagttcaatgttttgtttatctccatagtgtggtcataaataacggaaagtctggattgggctatttaatatatctctcggaacgtcattaa

SEQ ID NO: 3964 - DNA, 162 bp, Xenorhabdus bovienii
  Coding DNA location: Contig name=SeqID_16894; Position on contig =66467..66628bp; Strand=+
atgcgattctctctcgaagtcactaggattaatcctaattatccaaaaaaattacaaattaggatttttcctataggtgatattatagacagagacaatctgccactaatttatcgaggacatcattatgattcaagaaattatgaatattgctcccagtag

SEQ ID NO: 3965 - DNA, 3060 bp, Xenorhabdus bovienii
  Coding DNA location: Contig name=SeqID_16894; Position on contig =66594..69653bp; Strand=+
atgattcaagaaattatgaatattgctcccagtagtttcgcggaaagattaacacacgtcattgataacagtgtgattgatatctttatacaaaaaaccgtggaatatcctgaaaataaagcaatcattaccgcagagcgaactgtgagctatcgtgaactggctcagcaggcacaatctctggcagtttatttacgccaacagggagtaaagtatgaatcccctgttgccattttgttggagccagggattgagcaaatcatttgtcaagtagccatcttactggctggcgggagctgcgttccactcgaccccgccatgcctgatgagaggctaggttttatgctgcaggatttgcaagtcaacctgacattgacagatatcaaatcgcaagagcgccctctgcccacaaatttcatcactatgaatgaaagtttactgaaaccgacggatgcggttcacttactcgatatccatagtggaaaaacgcatcggactcatattttattcacatcaggaacaacaggaaaacccaaagcagttgaaattgaagctcagggtatcctccatttcgttgttaatacaaattatattaatttcgtagccaccgacaaaatagcttgcattgccaaccccacatttgatgcctctttatttgaaatctggggcgcgttattaaatggggcgacaatagtcattattcccagaaaaacagttatcgatccttatctgtttgaggccacattaaaacgattttctgttaacaccatgtttattaccactaccttatttaacttagttgccagtacgtgtccttgggcattccgtggtctgcgttatcttctggtcggtggaaaagcactcaacccttattcgctgcggcaggttttacaatcctctcctccgcaacatctgataaacggttatggaccgactgaaagcaccatttttgctacaacccatgaaattaccctggatcaactaaccggagaaagtatacctattggaaaacccattaataatacggaggtttacattttggatgaccagcaacaatttgttgcaccaagccaattaggtggaatatacattggaggaactggtttagcgcggggttactggaaccgtccggaaattaacgcgcaacgttttattgtggcggatgttaataagaataatacattaaggagagcctataacacgggagatttaggctggcaacgttctgatggcgtttttatgtatgcgggacgggcagacaaccagataaaactacgcggacatcgcattgaaattgaaaagattgaagctcagttgctggaaagtcaatttttgaaatcagcggcggtatgtgtgatcaaaaaagaaaacatagaaccttatctgaccggttttattgtccctaaagatccagactcattttcaaaacaagaattaattcaatggattaatacccgcttacccaactatatgctgcctcagctggtcgttatcgggcatataccagtcacccacaatggtaaaattgatagagcgcgcttactggaggaatgtttagaaaatcaagaacaacaattattaccccaatcaagtacacaaatgagtgaagaagagtctgccatcttaaatatttggcaacaggttctggattcctatgatctgacactagatagtgatttcttccagtccgggggcagctcgttgcaggccgccagactcgtcgttgaaatcagacgcaaaatgcagcgcagtttatcagtccagaatttatacgatgcccctacaccgagaaaactcgtggaaagtctccaacaaaatcatcaggaagacattgatatatgcactgttatgctcaaggacggtgtgctgccattagatattcagcccttgtctcaacccctccagccctggcttaccccaaacacggggcgagtattattaaccggagccaccgggtttctgggcgcttttttcctgcgtgatctgttgttacaacccgaaattaatcaggtgacttgtctggtacgtgcacatgataatgatgcagcgttgcttcgggtcaagaaaaaccttaatcaatacggggtgtggcaggacgaatttctcccccggttgcaggttattgccggcgatattacggagcctctgctcgcaatgaacccacagacttataagcgcttatctgtagaatgtgatgtcattttccatttggcggcacatgtcaattatattcagccttattcagcccatcgcgccggaaacgttgtagggacgctgaatctattacgcttcgcggtcagtgaaaaagtcaaatcttttcattatatctccaccattactgtgtttggccctgccggactgctgtcgcctatatccacaatctatgaagatgacgacatcatgccttacttagacgccatgagatatgattcaggatattcacaaagcgaatgggttgttgaacggataatatggcaggccagagacagagggataccgctttctgtatatcgtcctggttttatcatgggtgacagccagacaggggcaggcaaccccaacgattctatcgcccggttactcaagggatgtatagaaataggcgcctatcccctgttagttaaccagcggagagaattcgttccggtaaattatgtcagttcagccttactgaatatctctcgtgacaacaatcgattaggcagggcttatcatctagttactcctgacaataagcactctgtcgattttaatcaattttttgagttactcaaacagtgtggttatcagctcaacgggttagattattctgagtggctagagaagttggaagcagatcccgcactggtggataatccattaatgccattgatacccatactatctgaaaagatttatgggcagcttacccgatgggaggtgtatgaaaatatgccggcgtatgatgcaaaaaatacaaatatagcattaaagaaaatacataaattatatgcaccaatggacagtcatctgctggaacgctacctttcttattggagacgtataggctttctgtcataa

SEQ ID NO: 3966 - DNA, 177 bp, Xenorhabdus bovienii
  Coding DNA location: Contig name=SeqID_16894; Position on contig =69842..70018bp; Strand=-
atgattgataaaaggttatttattttccaagaattatttaaaattccttatgttttttggaggcgtccatatcattcattgcttgtatatattctgatgttttatattccattaacctggatttttatagggaacattagaaagaacaatgtaaaacattttaattcatccatgtaa

SEQ ID NO: 3967 - DNA, 135 bp, Xenorhabdus bovienii
  Coding DNA location: Contig name=SeqID_16894; Position on contig =70047..70181bp; Strand=+
atgttgaacttaaatacagaaagacgcattaaaggcgtctttctgcttttttatatccttcatctttcaaattacagcttcgttggctacaaattgaaatctattaggtataaatcaggaattaatattgagtaa

SEQ ID NO: 3968 - DNA, 1050 bp, Xenorhabdus bovienii
  Coding DNA location: Contig name=SeqID_16894; Position on contig =70168..71217bp; Strand=-
atgaaaaagactaaaaaaacagcaatagccggctttctgacgttagttagtggttctgcgcttgctctgccaaacattaccgttttggcaactggcggcacaattgctggtggtggcgagtcagcaactcaatctagctatactgcaggtaaagttggtattgattcactgttgaatgctgtacccgcgattaaaaacatcgctgatctgaaaggtgaacaggttgtcagcatcggttctcaagacatgaatgatcaggtttggctgactctggcaaaaaaaatcaacgcagattgtgataagaccgatggtttcgtagttacccacggtactgacactatggaagaaaccgcttacttccttgatttgaccactcagtgccagaagccaatcgtgatggttggtgcaatgcgcccatcaacagctctgggtgctgatggcccattaaacctgtataatgccgtagttgtcgcggcagataaaagctctgcaaaccgcggtgttttgctggctatgaatgattctgtgattcacggtcgtcatattggcaaactgagcacaactgaagttcaggcgtttcaggctatcaatagcggagcagaaggttttgttcacagtggcaaagtgagttactactctgctactgctgcaccagaaaaagcgcataaagccgcttttgatgtcagcaaactggataaactgccaaaagtcggtattgtttataactactctaatgcttccgaattgccagcaaaagcattcgtggaaaatggctatcagggtattgtcagcgcaggtgtaggtaacggtaatatctataaatccatttttgacaccttggctcaagccgctaaagatggtgtggttgttgtcagatccagccgtattccttttggttatacaaccaagaatgctgaagttaacgacagcaaatatggttttgtcgcatcagagcgtttgaacccacagaaagctcgtgttcttctgcaactggctctgactcaaacttctgatccagcaaaaattcaggaaatgtttactcaatattaa

SEQ ID NO: 3969 - DNA, 150 bp, Xenorhabdus bovienii
  Coding DNA location: Contig name=SeqID_16894; Position on contig =71279..71428bp; Strand=-
ttggaagtggttaatggaatcttccaacgcggcgtctttgccggggatataggtttgcgtcatcgttattcacttcaatttttgttaaaggccgcatatcatacggcgttttttttgtctgctctatcaattcccaaaaattattgttaa

SEQ ID NO: 3970 - DNA, 1764 bp, Xenorhabdus bovienii
  Coding DNA location: Contig name=SeqID_16894; Position on contig =71366..73129bp; Strand=+
atgacgcaaacctatatccccggcaaagacgccgcgttggaagattccattaaccacttccaatccaagctgacatctcttggttttaatatcgaagaagcctcatggctgaatcccgtacccaatgtctggtcggtacatatccgcgatcgcgactgcccactgtgctttaccaatggcaaaggagccagcaaaaaagcagcattggcctctgcattaggggaatattttgagcgtctgtcgacaaactattttttcgctgatttttaccttgggaatgccgttgctaacggggaatttgtccattatccaaacgaaaaatggtttccattgccggaagatgattccctgccagagggcattttagacgagcgccttcaccatttctacaaccctgacaacgaactctgcgccagtcaattgattgattttcaatccggcaatgaagagcgcgggatctgtgccctgcctttcactcgccaatccgataatcaaaccgtttatattccgatgaatattatcggcaacctgtatgtctcaaacggcatgtccgcaggcaataccatgaacgaagcgcgcgttcaggggttatcagaagtgtttgagcgctatgtaaaaaaccgcattattgcagaatgcatcagcctgcctgaaatcccagaaagcgtaatgaatcgctatcctagtgtagttgaatccgtcaataaattgcaggcagaaggcttcccactctattgctacgatgcctcactaggggggcaattcccggtaatttgcgttgtgctgtttaatccgaataatggcacttgctttgcctcttttggcgctcatcctgattttggtgttgcgctggaacgtaccgtaaccgagcttctgcaaggccgcagcttaaaggatctggatgtctttacgccaccaagtttcgatgatgaagaagtatctgaacataccaatctggaaactcacttcatcgattcaagcggtgcgattagctgggatctattcaaacaggatgccgactatacatttgccgattggagtttcaaaggcacgacagaagaagaatttgccacactgatggggatcttcaatacgctggatgctgaagcttatattgctgattacgaacatctggacgtttatgcctgccgtattctggtgcctggcatgtcagatatttatccggttgaagatttgcacatcgccaataataccatgggaactcatctgcgtgagactattctggcgttgccaaatagccagtggcagccagcagaatatcttactttccttgaacaattggatgatgaagggctggatgatttcacccgtgtccgtgaattactggggatcgccgcaggtaaagacaacggctggagtaacctgcgcattggtgaattgaaatccatgctggcattggctggcaacgatctggaacaggcgttgatctgggttgagtggacacaggacttcaatgcttcggttttcaccgccgaacgagccaattattatcgctgtttgcaaacactgctgctattgacccaagaagaagatcgtgacccaagccaataccatcaggcttttgtcaaaatgtacggtcaggaaaccgtcgatgctgcctccgccgccattgacggcaaaaacggcttctacggcctatggtctgtagattcagagctaaaaacattgccagcacatcaggcattactcaatgcttatgaaaaactgcaaaaagccaaacgcgagttttggtcaaataaataa

SEQ ID NO: 3971 - DNA, 942 bp, Xenorhabdus bovienii
  Coding DNA location: Contig name=SeqID_16894; Position on contig =73367..74308bp; Strand=+
atgatccatgtcaaattcaggtcaatgctcgtttgttactatcattacgtgctaaaattaattaaggataaagagagtgttagtatgaaaactgacaacccttttaatttatttccacctgctgtaatggcacaaatcgctgatgatagtggtgtatataaagttaataaacatcccgcagtgacttatttatcggcaatcatggcaggtgtgtttatttccattgcttttgtcttttatattacggctaccacaggaacatcttccattccttatggattagcaaaattaactggcgggatttgcttttctcttggtttaatgctggtggttatatttggtgcagatcttttcacctccacagtattgactatagtttcaaaagccacaggccgtatcacctggtcacaaatgctcaaaaattggattaacgtttatatcggtaatctgattggtgcactattttttgtcattttaatgtggcaatcaggccaatatgcggtcgctaatggttcctgggggctgaacgtattacagactgccgatcataaaatgcaccacacctttattgaagcagtatgtttaggcattttggccaatctgatggtatgccttgcggtctggatgagctatgccgggcgcagcctgatcgataaattgtttgccttgatcctgccagttgccatgtttgtcgccagtggctttgaacacagtatcgccaatatgtttttaattccgttcgggatcattatcaaaaattttgccccaactgaattctgggcaaaagtgggagccactcccgaacaatttcctcaactcaccgtttcacactttattactgataacctgatccctgtaacgataggtaatattattggtggtgcgatattggttgggttgatttattggttcatgtatttacgtggcggccaaaaatattaa

SEQ ID NO: 3972 - DNA, 2283 bp, Xenorhabdus bovienii
  Coding DNA location: Contig name=SeqID_16894; Position on contig =74363..76645bp; Strand=+
atgtccgagttaaatgaaaaattctctgtagcatggcaaggctttaacgagggtagctggcaaaatgaagtcaatgttcgtgacttcatccagcagaactatgctccgtatgaaggtgatgaaacattccttgcaggcgccacaaaagcgactgatattttgtggaaaaaagtcatggaaggtatcaaaatcgaaaaccgtactcatgcgccggttgattttgatactgatgttgcgtctacaattatttctcatgatgcgggttatattgccaaagacctagaacaaatcgtaggcctgcaaaccgaagcaccactgaaacgtgccattattccattcggtggaatcaaaatggttgagagttcctgtaaagcttacaaccgtgaactagacccaaaactgaaacaaatttttactgactatcgcaaaacccacaatcagggagtattcgatgtttatacacctgatatcctgaaatgccgtaaatccggtgtactgacaggtttgcctgatgcctatggccgtggccgcatcatcggtgactaccgccgcgttgctctgtacggtatcgacctcctgcgtgatgaaaaatatgctcaattcacatcattacaggaaaaactggaaaacggtgaagatctggaagccactatccgtctgcgtgaagaaatcgctgaacagcaccgcgctcttagtcagattaaagaaatggcggctaaatatggctgtgatatttcctacccggcgatcacagcgaaagaagccgtgcagtggacttacttcgcttatttggcagcggttaaatcgcaaaatggtgcagcgatgtctttcggtcgtgtgtccagcttcctggatatctacatcgaacgcgatctgcaagcaggcagactgacagaacaagaagctcaagaactgattgaccatctggtcatgaaattgcgcatggttcgttttctgcgtactccagaatacgatgagttattctctggcgaccccatctgggcaacggaatcactagcaggtatgggcttggacggccgtactctcgttaccaaaaacagtttccgtttcctgaacacgctttatactatggggccatcaccagagcctaacatgaccatcctgtggtctgaaaaactaccaatcaacttcaaaaaattcgcagcgaaagtgtctatagatacctcatccctgcaatatgaaaacgatgatctgatgcgccctgatttcaacagcgatgactatgctatcgcatgttgtgtcagcccaatgattgttggtaagcaaatgcaattcttcggcgcacgtgccaatctggcaaaaaccatgctgtatgcaatcaacggcggtgtggatgaaaaaatgaaaatacaggttggcccaaaagaagaaccaatgagagacgaagtgctggattatgacaaagtcatggctcgcatggatcatttcatggattggctggcaaaacagtatgtcactgctttaaatatcatccactatatgcatgacagatacagctatgaagcggcactgatggcactgcatgaccgtgatgtttaccgtaccatggcatgtggtatcgcgggtctttccgtagcggccgactcactgtctgcaatcaagtatgcgaaagtttctccaatccgtgatgaagatggcttggcaactgatttcaatattgagggcgaatatccacaattcggtaataacgatccgcgtgtcgatgatatcgcctgtgatctggttgaacgctttatgaagaaaattcaaaagctacaaacctatcgcaacgcagtgccaactcagtctgtactgaccattacttctaacgtggtttatggtaagaaaaccggtaacactcctgatggacgtcgtgctggtgcaccattcggccctggtgctaatccaatgcacggacgtgatcaaaaaggtgcggttgcctcactgacttctgtcgccaaactgccatttgcctatgcgaaagatggggtttcgtatactttctctatcgtgcctaatgcactgggtaaagacgatgaggtacgcaaggcaaatctggctggtctgatggatggttacttccatcacgaagcgaatatcgaaggaggccaacatctgaacgtcaacgtgatgaaccgtgaaatgctactggatgcgatggaaaacccggagaaatatcctcaattgactattcgtgtatctggttacgccgtgcggttcaactcgctgactaaagagcaacagcgagatgtcatcactcgtacatttacccagacgatatga

SEQ ID NO: 3973 - DNA, 741 bp, Xenorhabdus bovienii
  Coding DNA location: Contig name=SeqID_16894; Position on contig =76768..77508bp; Strand=+
atgtctgtacttggtcacatccactcttttgaatcttgcggaaccgttgatggcccaggtatccgttttatcgtgtttttccagggttgcctgatgcgttgcctttattgccataaccgcgatacatggaatacccacggtggtataaccgtcactgttgaagagcttataaaagaagcgacaacttaccgtcattttatgaatgcctccggtggtggtgttaccgcttctggtggagaagccattcttcaggctgaatttgtccgtgactggttcagagcttgtcatgcagaaaatattcacacctgtttagataccaatggctttgttcgtcgttatgatctcatcattgacgaactgctggacgataccgatctggttatgttggatttaaaacagcttgatgatgaaattcaccaaaaactaatcggggtttccaatcatcgcactctcgaatttgcccactatctggcaaaacgcaaccaaaagacctggattcgctatgtcgtggttccggggtggtcagacgatgataaatctgtccatatgcttggtgaatttactcaggatatgaagaatattgaaaaaattgaattattaccttatcacgaacttggcaaacataaatggattgctatgggtgaagaatataaattagaaggagtaaagcctccttcaaaagaaataatggaacgagtaaaagaaatcttagtgagttatggacaccatgtaatctattaa

SEQ ID NO: 3974 - DNA, 822 bp, Xenorhabdus bovienii
  Coding DNA location: Contig name=SeqID_16894; Position on contig =78222..79043bp; Strand=+
atggacaatcaagatatcaatttcaattctggggaaaaaaacgtttccctaaccaaagaaaagagcacattcattcctggtggtcgagcagtaggggctggagcagcaatagaatggattggcaatgcatggcaaatggttaaagcaaacccaatgatgtggatactgctgaccttcatctatatggttatcattgtaggcttgcaatttattccattcctcagtttttttactgccttacttggttctgtgtttattgctggtttcatcgctgccgctgaaaaacagagaacaacaggtaactttgagatagagttactcttccacggtttcaaaaacaaatttggttcactagttgctgttggtgggctagtctttggtatatacctgcttggtgttatcgccgctgtcattattggtggtacaagcatatatcaactgattttagccagccagtatgccgatccagatccagcactgttactaggtagcctttcttctataatgctggcagtccttgttttaactatctttagtatgattgctcttgcatttagctggttcgcacctgccctgattatcattaatgatctgaaattcggtgaagcggtgtcaatgagcctgagtgcagtgaagaaaaacctgttcggtggcttcctgtttttcttactggtgggcattctggttggtatttccatgatcccattctttttaggtatgattattactattcccatctatatggcaactttttatacgacctatcgcagcattttttatacggaagaagtgaaagaacagaagtctagtttaatcagctaa

SEQ ID NO: 3975 - DNA, 807 bp, Xenorhabdus bovienii
  Coding DNA location: Contig name=SeqID_16894; Position on contig =79227..80033bp; Strand=+
atgaacaataaaaatattgatttcagttcaaggtcgagaaatgtttccttaaccaaagataaggagacatttattcctaatgggcgtgcagcaggagccaatgccgcaatagaatggattagaaattcatgggaaatagttaaacccaattttggtaattggatactattgcttttcctttatcttatctgctttaccattatcttattggtcccatttatcaacctcattgctttatttattgcccctgtattcatgggtggttttatggctatctgtgaggaatatagaaaaaagggtagttttaatataggattatttttccacgggttcaaaaaaaattttggttcactactagctgtcggcatattcactattcttattttaactgttggagtactcgcagccatagttatcggtagcgtaggaatatatcaattttaccttatcggacaaggtagtgagattgatatagccatggttcttctcattttctttatatttattttgatctatattgctataatatttttttctatccttgggctagcttatacttggtttgctcctgcactgattgtcattaatggcttaaaattcagtgatgctatatcaatgagtttcaatgcagtgaaaaagaatcttcttggtggttttatctttttcttattaatgaatatgatcataactctttccataatcccattaggcttagggctatttattaccatacctatttatttggcagcttactatacgtcttatcgtagtatcttttatgtagaatcaaaagaatctgaaaattga

SEQ ID NO: 3976 - DNA, 1290 bp, Xenorhabdus bovienii
  Coding DNA location: Contig name=SeqID_16894; Position on contig =80151..81440bp; Strand=-
atgctcgatccaaatatgctgcgtaatgagctagacgcagtcgccgaaaaactggctcgcaggggttatacccttgatgtggagacgctgtgtaaacaagaagagcgtcgtaaagttttgcaagttgaaactgaaaccctgcaagcagaacgtaattcccgatcgaaggctattggtgcagcgaaagcccgtggtgaagatattgaaccactgcgtcaggaagtgaatcagttgggagaaaaacttgatttagcgaaagctgaattggaagcattgcaggcagagatccgtgagctcgcattaagaatgcctaatattcccgatgattcctctccttatggaaaagatgacagtgataatcaggaaattagccgctggggcgagccacgccaatatgattttgaagttaaagatcatgtatcactgggtgaattaaccaacggtcttgattttgccgctgcggtaaaattaacgggttcgcgtttcgtggtaatgaaaggtcagattgctcgtctgcaccgtgcactggcacagttcatgctggatctgcataccgaacagcatggttatctggaaacttatgtaccttatctggttaatcatgaaacgctgtatggcactggtcagctgcctaaatttggtgaagatctgttccacaccaatccattggaagaagaaaccggcagcaactatgccttgattccaactgcggaagtgccggttaccaaccttgtccgtggtgatattctggatgaaagtgcattgccactgaaaatgacggcgcatacaccttgtttccgctctgaagcgggttcttatggccgtgatactcgtggcctgatccgtatgcaccagtttgataaaattgaattggttcagattgcccatcctgaaaaatcaatggatgctctggaagaactgactggacatgcagaaaaagtattgcagttattgaaactaccttaccgcaagatgttgctatgtacgggtgatatgggcgcaagcgcaagaaaaacttacgatctggaagtttggctgccagcgcagaatacttaccgtgaaatctcatcatgctctaatatgtgggattttcaggctcgtcgtatgcaagcacgtttccgcagcaaagatgacaagaaaacccagttagtgcatacactgaatggttctggtctggctgtgggtcgtactctggttgcagtgatggaaaactatcagcaggcagatggccgtatcgaaattccagaagtattgcgtccttatatgaaagggctggaatatattggttaa

SEQ ID NO: 3977 - DNA, 1287 bp, Xenorhabdus bovienii
  Coding DNA location: Contig name=SeqID_16894; Position on contig =81560..82846bp; Strand=-
atgcggccagtcacattagatcattatatcggtcagcaacatttgctagcggaaggcaaacctttgccacgagcaatccgcgcgggtcatcttcactccatgattctgtggggaccaccaggaacggggaaaacaacgctggctgaaattattggccattacgcgcaagccgatatcgagcgtatttctgcggtcacatctggtatcaaagaaattcgtgaatccatagagaaagcgagtcaaaatcgtaatgcaggtcgcaggactatcttatttgttgatgaagtccatcgatttaataaaagccagcaagatgcctttttaccgcatattgaggatggcacgatcacgtttattggtgcgacaaccgaaaatccttcctttgaattaaattcagccttgttgtcacgagctcgtgtctacttactgaaatcactgtcagcagccgaaattgagcaagtgctttttcaggctatgaatgataaagaacgtggcttcggtgggcaaaatattgtgttgcaggacgacacccgtcagatggccgcagaattggttgcaggtgatgctcgtcgttcattgaacttgctggaaatgatgtcagatatggcgaaagccaatgcacaggggcaacgagttctgacaccggagttactgaaagaggtcagcggggaacggagtgcgcggtttgataataaaggtgatcggtattacgatttaatctcagccctgcataaatcaatacgtggttcagcgccggatgctgcgctttattggtacgccagaatcattacagcaggcggtgatccgctttatgttgcccgtcgtttattagccattgcatctgaagatgtgggtaatgctgacccgcgaggtatgcaggtagccattgccgcgtgggattgttttacacgagtaggcgcggcagaaggggaacgggcgattgcacaggccattgtttatctcgcatgcgctccgaaaagcaacgcggtttatatggcattcaaggccgcgatggtggatgcgcaagataagccggattatgacgttcctgcacatttgcgcaatgcgcctaccaaactcatgaaggaaatgggatttggtgaagcataccgctatgcccatgatgaaccgaatgcttatgctgctggtgaagtttatttcccaccagaaatgcgagagactcgctattatcatccgacagccagagggctggaaggtaaaatcggtgataaattaaactggctaattgaacaggataaaaatagccagataaaacgctaccgctaa

SEQ ID NO: 3978 - DNA, 609 bp, Xenorhabdus bovienii
  Coding DNA location: Contig name=SeqID_16894; Position on contig =82914..83522bp; Strand=-
atgaaaaaactgatgttgattggttgtctgatgatgggtgtgagtgtgggtactgcatgggctgatgcctcgcaggatctacaaggtcgcttgggtaaggtgaatagctttcacgccagttttacccaaaccgtcactagcagtgacggttcagcgatccaaaacggtgaagggcaactttgggtcaaacgtcctaatttgttcaactggcacatgacatcgcctgatgagagtgtcttggtttctgatggaaaaacactgtggttctataacccctttgttgaacaagtgaccgctaattggttaaaagatgctgcaggcaatacaccatttatgttgattgcccgtaatgattctgctgactggaagcaatataacgttgtacaaagtggcaataatttcgagttgacgcctagtaacgccaatggaaatttgaaacatttttcaatcactgtaacgccggaggggactatccagaaatttacagcggttgaacaagatggacaaaaaagtgcttatcaattaaaagggcagcaaaatacccgcgttgatgaatcaaaattcaaattcaccatgccagagggcgtcacgttggatgatcagcgttag

SEQ ID NO: 3979 - DNA, 117 bp, Xenorhabdus bovienii
  Coding DNA location: Contig name=SeqID_16894; Position on contig =83465..83581bp; Strand=+
atgcagtacccacactcacacccatcatcagacaaccaatcaacatcagttttttcatgtgcgagataccttcaattcatatttattatcagcattaatagccgataccgcatttaa

SEQ ID NO: 3980 - DNA, 3303 bp, Xenorhabdus bovienii
  Coding DNA location: Contig name=SeqID_16894; Position on contig =83592..86894bp; Strand=-
atggtggcgcttgtcagtttcaatccctccgatcccagctggtcacaaacgtcatggaatgggcccgtccataatttcggtggcagtgttggtgcctggttgtcagatatactattttcggcatttggtattcttgcctatgcagtcccgctatttatgtttttaggttgttggaatgctttccgtcagaaagataggcaagagtatgttgatttctttacgctcgcattacgcgtcattggcgctttggcactggtattaacttcatgtggcctggttgctctcaatattgatgatttaaacgattttgctgctggtggtgtcatcggtaacttattcagtaaagcgattctgccgtggtttaatattcttggggcgacattagcgctgctcggtatttgggctattgggttcacattatttacaggctggtcatggctcactattgcggaaaaaattggtgcagttattcttgaatcactcagttttatggtaaattgcacccgcaatgagcctgagtatggcgaactggaagacgaagttattcctgaacatctggccagcgggcaaaatcgtgctgataatgtaaacacagatgatataggcatgacagcatctgccgctaaagctgtagaagttgacgaggatgacgtgctgttgagtgcgccaacggtggtggaactggttaagactgattcagcgcctccagctatttcagcgtctcaagctatggatacagcgcaggagagcggttcacctgaaaaggttcagcctgtgcagcaaaacgaaaacaggcagcaatctattgctcaggaagccattaccttaccggaatcagtacaaactgaatcggatcatactgaagaagatcaagaacctgttcattatacatttgaactgccagctgattatcaattagacacagaatcagaattcagtaaaactgcacagattactgcacaatcagagttatctacagatagcactgtggcaacaaacatacagccacaaaatgatgtgatagagtcgtttactttttctccgaatgataatctgaaaaatgtggccgctggtgtttccagtgctgctgttgtgatgaaaactcctcagatgaaacagggtattggccctgaaatgccgcggccgaatcccgttagaatacctacccgccgtgaattatatggtgtcaaagtaccgtctcagcgtttgtctgaacatctgcaacgggaagaaaaagagagacaaagcgatcttattgcggaaactgatgaacagcaaatggatgaacagcagcaagacatgttgcggcagcaattccttgaacagcagcgtgaacgttatggttctaattttgaagaagaaacaaaagggcatcgtgaagaaatcgctcagatacataagcaatcagcgacagccgaatttgtagagcatagtgttgatgaaccgtcggaacaggaagaggcattgcgagtagcgttcgaacagcagcagcgtgaacgttatcaaaagatccagcctgctattccaagccaggccgaaaagcctgcgtttgattattcttcactggctgatggttttgaaaaatctgaacctgtagagctattgcccctgcagtcagagtcatcgattcgttcagaacaggaaaaaagaacagtttctgtttcagggccttcccatgaatcgaaaattcagcatacttttgcgcagcaaccgcagcaaccgcagcaaccgcagcaaccgcagcaaccgcagcaaccgcagcagtcgagcctgttccatccattcttgatgcgtaatgatcaaccattgccaaagccaacaacaccgatgccttctttagatcttctggcgaaaccgcccgcggaagaagaacccgtcgatatgtttgcccttgaacagacttcacgtctgattgaagtgcgtctgaatgattatcgcatcaaagcggatgttgttgggttttcaccaggcccggttattacacgatttgaattggatttggcgccgggggttaaggcttcccgtatctccaacttgtcgcgtgaccttgcccgctcactctctgcggtggcggttcgtatcgtggaagtcattccggggaaaccttacgtaggcttggaattaccgaataaaaaacgtcatacagtttatctgcgtgaagtcctggactgtgaaaaattccgtgacaacccatcgccactaactattgttctggggaaagatatcgcaggtcagccagtggttgctgatttgggtaaaatgcctcacttgctggtcgcagggacaacgggatcggggaaatcagtgggggtcaatgcaatgatcctcagtattctgtataaagcaaaaccggaagatgtccgctttattatgatcgatccgaaaatgcttgagttgtcggtttatgaaggaattccgcacttattgacggaagtcgtcactgatatgaaagatgcggcgaatgcgctgcgttggtgtgtgaacgaaatggaacgtcgttataagttgatgtcagctttgggcgtgcgtaatctcgccggctataacgataagatcaaacaagcggaaaatatggggcgcccgatccccgatcctttctggaaaccgggtgacagtatggatgtaactcatcctatgctgaaaaaagagccttatatcgttgtcatggttgatgaatttgctgacttgataatgacggtagggaaaaaagtggaagaattgattgcgcgtttggctcagaaagcacgcgccgcaggtattcacttggtgctggcaacacagcgtccttccgttgatatcattacagggctgattaaagcaaatatcccgacgcgcatcgcatttaccgtttccagtaaaattgattctcgtaccattcttgaccaaggtggtgcagaatcattacttggcatgggggatatgctttatctggcaccaaactcttctattcctgtacgtgttcatggcgcatttgttcgcgatcaggaagttcatgaagttgtcaacgactggaaagcccgtggtcgtcctcaatatattgatagtattatcaagggtggagaagacggtgaaggtggtctgggattggatagcgatgaagaattggatcctctgtttgatcaggcggttcaatttgtgaccgaaaaacgtcgggtttctatttccggtgtacaacgacagttccgcatcgggtataaccgagcagccagaattgtcgaacagatggaagcacagcagattgtcagtacccctggtcacaatggcaatcgtgaagtcttagcgcctccgccgcatgaacattga

SEQ ID NO: 3981 - DNA, 165 bp, Xenorhabdus bovienii
  Coding DNA location: Contig name=SeqID_16894; Position on contig =86872..87036bp; Strand=+
ttgaaactgacaagcgccaccataaagtacacgacgcaaatagcaataaccaacagaatggcttccagaagccgacggctactgcttattttctttaacttaacacgtttatcttctgtatattcctggttcaagaaaggctctccaggttttcctgttgattaa

SEQ ID NO: 3982 - DNA, 495 bp, Xenorhabdus bovienii
  Coding DNA location: Contig name=SeqID_16894; Position on contig =87138..87632bp; Strand=-
atgatagataataagaagcgtccaggaaaagatcttgatcgcatagaccgtaatatccttaacgaattgcagaaagacggccgtatttctaatgtggaattatccaagcgggttggtttatcacctacgccttgtctggagcgtgtacgccgattggaacgtcagggctttatttctggttacaccgccttgttgaatcctcattatctggatgcatcgctattggtatttgtggagattactctgaaccgtggtgcagcagatgtctttgagcagtttaatactgctgtacagaaacttgaagaaatccaagaatgtcacttagtttctggtgattttgactatttgctgaaaacacgagtgccagatatgtctgcatatcgtaaattactgggcgaaaccctgctgcgccttccgggcgtcaatgacacccgcacttatgttgtcatggaagaagtgaagcagagtaaccgtttagtcattaaaactcgctaa

SEQ ID NO: 3983 - DNA, 108 bp, Xenorhabdus bovienii
  Coding DNA location: Contig name=SeqID_16894; Position on contig =87589..87696bp; Strand=+
atgcgatcaagatcttttcctggacgcttcttattatctatcatcttattgctctctctttatattcctacacccataacattttccctatctctctcaagcagttga

SEQ ID NO: 3984 - DNA, 96 bp, Xenorhabdus bovienii
  Coding DNA location: Contig name=SeqID_16894; Position on contig =88205..88300bp; Strand=-
atgataagtttactgtgtttggctgtgctcatgaatacctcatttccattatcgcatattgcggatttggggattgtaggagaaataataagttaa

SEQ ID NO: 3985 - DNA, 960 bp, Xenorhabdus bovienii
  Coding DNA location: Contig name=SeqID_16894; Position on contig =88269..89228bp; Strand=+
atgagcacagccaaacacagtaaacttatcattcttggctcaggtcctgctggttataccgccgctgtttatgcagcccgcgctaatttaaaccccgtccttattaccggggttgaaaaaggcggccaattgaccaccacgactgaagttgaaaactggcccggtgatcctgaagggctgacaggtccagatttgatggaacgtatgttccaacacgctgaaaaatttcaaacagaaattatttctgaccatattcagaaagtcgatttcgaaaaaagaccattccgtctttatggagatgatcaggaatatacctgcgatgctttgatcatcgcgacaggtgcttccgcccgttatttgggtctcccttccgaagacgctttcaaaggtcgtggcgtatctgcctgtgcaacatgtgatggtttcttctatcgtaagcaaaaggttgctgtagttggtggtggcaataccgccgttgaagaagcactgtatcttgcgaacattgcagccgaagtccatctcattcaccgccgtgatactttccgttcagaaaagatcctcattgatcgactgatggagaaagtcaagaatggtaatatcattctgcataccgatagaactttagatgaggtgctgggcgatgatatgggtgtgactggcattcgtattcacgatacgaaaagtgataatgcagaagagctggatgttactggtgtcttcattgctatcggccacagtccaaacacaggtatctttgaaggacagcttgaactgcaaaacggatatattaaagtccagtccggcctgcatggaaatgccacccagacttctattccgggagtatttgccgccggggatgtcatggatcatgtttatcgccaagccatcacctcagcaggtactggctgtatggctgcactggatgctgaacgttttcttgatggattggcaactaaataa

SEQ ID NO: 3986 - DNA, 174 bp, Xenorhabdus bovienii
  Coding DNA location: Contig name=SeqID_16894; Position on contig =89160..89333bp; Strand=-
atgatacaatgtatcaaaaaggctggtgatactgtttgccagcggccaaaccttatgttccctgttaaaaagcgctaccgaaatagcgccttaaagaaagagggtttatttagttgccaatccatcaagaaaacgttcagcatccagtgcagccatacagccagtacctgctga

SEQ ID NO: 3987 - DNA, 1770 bp, Xenorhabdus bovienii
  Coding DNA location: Contig name=SeqID_16894; Position on contig =89359..91128bp; Strand=+
atggacaaaacaagacaatctgaacttgttcgatggctaagacagcaaagtgcgcctgcccgtcggtggcttcggctatccatgctacttggcctcattagcggattactaatcatctctcaagcttggcttctggcgtcaatccttcaagcactaatcatggataaaatcccccgcgaaaatctcatcgttcagtttctgatgctgatagccgcctttacattgcgggcaattgtcagtgctactcgagagcgtatcggttttatctgtggcaaggttgtgcgccaacaaatccgcagtatagttttggataaactggcacaattggggccggtttgggtcaagggaaaacccgccggaagctgggctaccattatcttggaacaaatcgaagatatgcaggatttttattcccgctatctgccccaaatggcgcttgcaaccattatccctctcttaatcctgatgactgtctttcctgtcaactgggcagcaggattaattttactcgttaccgctccgttaattcccctttttatgtcattggttggattaggtgccgctgacgccaatcgacgcaattttgtcgcgctcagtcgtttaagcggcaatttccttgatcgtttacggggtctggaaactctacgcgtgttccatcgcggggaagccgaagttaagcaaattaccgaatcgacagacagtttccgtcacagaacgatggaagtactgcgcatggcatttttatcgtctgctgtgctggagttttttgctgcagtttccattgcggttgttgccgtttattttggtttttcttatttgggagaattacattttggtagttatggtctgggtgtcacgttgtttgcaggcttcctcgctctgatcctcgctcctgaattctttcagccactgcgcgatttgggtacgttttatcatgcaaaagcccaagctgtcggtgccgcagagtcgctttttactctgctcaacagtgatggagaacacactgtatccaacggcgaaaaaatgctgccagatacaaaatcagtgactattgaagcgaacgaactggaaatccggtcacacgatggtcatcatcttgcgggtcccttgagcttcacgattgacaaacatcagcggattgcgttggttgggaaaagtggtgctgggaaaagctcgctgatcaatctattactggggttcctgccctatcgcggctctttgaaaatcaatggaatcgagctacgtgagctgaatctaaccaaatggcgtgagcagttaagctgggttggacaaaacccacacctgccagagcagacgctgctcgataatatccgtcttggtcaatttgacgcaacacaagaccagattaatgatgttatggaacgggcttatgtcagcgagtttattcatgctcttcctgaaggcgtgaatacagtcattggtgacaatgcagcccgcttatctgttgggcaagctcaacgcatcgctgtagcacgggcattattgaacccctgtcagttattgttattggatgagccggcagccagtcttgacgcccatagcgaacaacgtgtgatgatggcattaaatcaggcatccagtcagcaaaccacactgctggtcactcacctgctggaagaaacactggaatatgaccagatctgggtaatggaaaacgggttaatcattgagaaaggccattatcagagtttaagccaatctcaaggggcattttcccgtctgttgtctcatcgcagcgtggagctttaa

SEQ ID NO: 3988 - DNA, 1743 bp, Xenorhabdus bovienii
  Coding DNA location: Contig name=SeqID_16894; Position on contig =91131..92873bp; Strand=+
atgcgtatattactcccatttctcgcactctatcgccgccactggtttctcatcagcttgggcatggtattagcggttgtaaccctgttagccagtattggcctgctgacgctttccggctggtttcttgccggtacagccttggcaggattcgcggggttatatacgttcaactatatgctgccagccgctggcgtccgtggtgcagctattttccgtactgctggccgttatggtgaacgactggtcagtcatgatgctacttttcgcgtattggcacatctacgcgtttttgcctttcagaaaattttaccgctttctccgggaggcatcgcccgttttcgtcaaggcgaactactgaatagaatcgttgcggatgtcgaaacgcttgatcacctctatctgcgagtcatctcccctgtcctttcggcgttggttgtgattgttgttctgacttttggcttgggttttcttgatgtcaccctcgcatataccctaggcggtattatgctggggctactgatgatattgccttttgtgttttatcatgcaggaaagccttatggcagagacatcaccctactgcgcggtcaatatcgtacattactcactagcgcgttgcaggggcaggctgagttgacagtgtttggcgcacttgggcgttttcgacaatcaatgacagacgttgaatccgattggctgaaatgccaacaacagcaagccaacctgacggggctttctcaagccgttatgattttcgctacaggcatgacagtgactctgctactttggctagcagcagcaggtgtaggggaacatagccaacctggagcactgatagctctatttgcgttctgtgctctcgctgctttcgaagctcttggacccgtcacagtggcatttcagcatatgggacaggttatctcatctgcaacccgtgtttctcagttaatgcatcaggagccagaagtcactttccctgctcatgggccacaaacaactgacagcctcaatcttgagataaaaaatattgatttcacctatcctgaacaacctctaccagtattgaagaatatttcactgtccctgacatcaggcgaacatatcgcactattggggaaaacagggtgcggtaaatcgacacttttacagttactgagccgtgcatggggtgttgatcacggcgaaattcggctcaatcaacaacctatttcccagtatgatgaagctacattgcgatcaatgatgtctatcgttcctcagcggatacatgtcttcagccataccctgcgtgaaaacctcttgttagccaaaccggatgccagcgatgatgagttagaaatcgtactcaaacaagtgggtttagggaacttgctagacaataatgaaaagctaaattgttggatgggtgaaggtgggcgccagctttccggtggggaacaacgccgtttggggattgccagagcgttgttacacaatgcaccattaatgctgctggatgagccgacagaagggctggacgccgatactgaacaacagattctgtctctgttacgccacagttgccagcacaagacactgattgtggttacccatcgattaacaggtttacagcatatggatcgtatctgtgttatggatgagggacgcatcattgagcaaggcaaacatgatgtgttgctggctcagcaggggcgttattatcaattttatcagcgacagagctatcttgagcaggagtaa

SEQ ID NO: 3989 - DNA, 690 bp, Xenorhabdus bovienii
  Coding DNA location: Contig name=SeqID_16894; Position on contig =92882..93571bp; Strand=+
atgtcgatagctcaactgggtaactcatatgcatttcctcatccaacccatgcgctggttgaaccaaatggtttactggcatttggtggtgatctatgcgcagagcgtttaagggtagcttatcacgaaggtattttcccttggttttcccctgatgagcttcccctatggtggtcgcccgacccccgagcggtcctaattccgggtgaattacatactgggcgcacgctacgtcgttttattcgcaaacttccttaccaaattacggtaaactatgctttcgatcaggtgatatatggttgtgcccaacggcaagaaggcacttggatcgggtctgatgttcagcaaggttatcaggccctgcatcaagaaggtctggctcattcaattgaagtctggtatgactgccaacttgtaggtggtttatatggggttaatgtaggtacgctattttgcggagaatcgatgtttagcaaaatggagaatgcatctaagtgtgcttttgtggcattctaccaccactttttacatcatggtggccaattattggattgtcaggtactaaatcaccatacgaaatcattaggcgcaaaaaatattccaaggaaagaatttctccagcatctttacttatgcagagagcagtcattgcaggcaggatgctgggctgctcaaatgctggatttatag

SEQ ID NO: 3990 - DNA, 129 bp, Xenorhabdus bovienii
  Coding DNA location: Contig name=SeqID_16894; Position on contig =93553..93681bp; Strand=-
atgccgaaaaaccctcattatgtaaaggaatgtcgtattttaaaccatcattttcctcataatggatatcgacattcccgccgtgaacagcataaatcactagattttgactataaatccagcatttga

SEQ ID NO: 3991 - DNA, 219 bp, Xenorhabdus bovienii
  Coding DNA location: Contig name=SeqID_16894; Position on contig =93727..93945bp; Strand=+
atggccaaagaagacaatattgaaatgcaaggtactgtgttagacacactgccaaacaccatgttccgtgtcgaattggaaaatggacacgtcgttactgctcacatttcaggcaaaatgcgtaaaaactatattcgcatcctgactggagacaaggttacagttgagctaaccccatatgacctgagcaaaggccgtatcgtcttccgtagccgctga

SEQ ID NO: 3992 - DNA, 2286 bp, Xenorhabdus bovienii
  Coding DNA location: Contig name=SeqID_16894; Position on contig =94058..96343bp; Strand=-
atgctcaatcaagaactggagcttagtctcaacattgcttttgccaaagcaagggataacagacatgaatttatgactgtagagcacctattgctggcgttgttaagcaatacatcagcgcgagaagcactggaggcttgcaaagtcgatctggtgatgttacgccaggaattggaaaattttatcgcacaaacaacccctttgttatcagagaatgatgacagggatacacaacctacgttgagttttcaacgtgtattacagcgtgcagtgtttcatgttcagtcttcagggcgttcagaagtttctgggtcgaatgtcttggttgctattttcagtgaacaggaatcccaggctgcttatttactgcgaaagcatgatgtgagccgtctggatatcgtgaatttcatttcacatggaacgcgcaaagatgagtctgataatgagtctcatcacagtgtcaatccgattcaggaggaacaggtgataagtgaagatcgactggaaaatttcactaccaatctgaatcaattggcacaaaaagggcagattgatccgcttgtcggacgtcagcatgaattggaaagaacggttcaggtattatgccgccgccgtaaaaacaaccctttatttgtgggtgagtcaggtgtcggtaagaccgctattgcagaggggcttgcatggcgtattgtgcaaaaagatgttcctgaggttatgaaggattgcacaatctattcgttggatattggttcattgctggcaggtacaaagtatcgaggtgattttgagaagcgcttcaaatctttgttaaaaacgttagagcaagacagcaaaagtattctctttatcgacgaaatccataccattattggtgcaggtgctgcttcggggggacaggtggatgcggctaacctgattaagccgctgttgtccagtggccgcattcgggtgattggctcaacgacgtatcacgaattcagtaatatttttgagaaagatcgcgcactggctcgccggttccagaagatagacattcttgaaccttcttctgaggaaacggtgcagattatcaatgggttgcgtacgaaatatgaggcgcaccatgatgttcgttatactgcgaaagccattcgcgccgcagttgagctatctgtgaaatatattacagatcgccacctgccggataaggcgattgacgttattgatgaagcgggtgcgaggacaagattgatgccggccagtcgtcgtaaaaagacgattaacgttgccgatattgaatctgtagtggctcgtattgcccgtattccagaaaaaacggtttcagccagtgacaaagatgtattgagaacactggatgatcgtttgaagatgctggttttcggtcaggataaagcaataggggtactgacggaagccattaagatgagccgtgccgggttggggcaggatcataaaccagtgggttctttcctgtttgcagggcctacgggggtgggtaagacggaagttactctccagcttgctaaaatgctcaatataaaattactgcggtttgatatgtctgaatatatggaacgccataccgtcagtcgtttgattggtgcaccaccaggttatgtgggatacgatcagggcggtctattgacagatgctattatcaaacatccacattcagtattgttgctggatgagattgagaaagcccatcctgatgtgttcaacttactgctacaggtcatggataatggaacactgacagataacaatggccgaaaagctgacttccgcaatgttattctggtgatgacaactaatgcaggggtacgtgagacacagcgtaaatccatcggttttactgagcaggataacagcatagatggaatggaagagatcaaacggatcttcacacctgaattccgtaaccgtctcgatggcatcatctggtttgatgcactttccgctgaagttattcaactggttgttgataaattcattgttgaactgcaagcacaactggatgaaaaaggtgtttctctggaagtgagtgcagatgcccgtcagtggttatgtgataaaggctacgatagagcgatgggcgcacgtccaatgactcgggtgattcaggacaacctcaagaaaccattggcgaatgaactgttgtttggttcgttgatacatggaggttcggttaggattaatcttgataaagacaaacgggcactgatatacgatttcagaagtgcacaaaagtcgagtaaaaagaaatcggaagatgcggtgctataa

SEQ ID NO: 3993 - DNA, 321 bp, Xenorhabdus bovienii
  Coding DNA location: Contig name=SeqID_16894; Position on contig =96375..96695bp; Strand=-
atgagtgagttttataacagtttgaaaattgaagaattaattgaagataaaacagagcaaacgttacagccaccatcaatgtataaggtgattcttaacaatgacgactatacccctatggagtttgtggttgacgtattgcgaaagttcttttcttatgatgttgaacgagcaacgcaactcatgctggatatccattaccaaggtaaggcaatttgtgggatttatacggcagaggtggcagaaactaaagctgcgcaagtgaatatgtatgctaaagagcacgagcatccgttactttgctcgctggagaaggtctga

SEQ ID NO: 3994 - DNA, 192 bp, Xenorhabdus bovienii
  Coding DNA location: Contig name=SeqID_16894; Position on contig =96776..96967bp; Strand=+
atgaagcactctgcttatcccctctttgatctctggataaagatcccgcctaaaaatcggatatcgttatctatatcaaactttcgctatttgagacagcttgaggttatttctgtgcttgacggcgtaatgaatttcactacagtatattttgtgagcaccgccttggctgggcgtctgctcatatcctaa

SEQ ID NO: 3995 - DNA, 231 bp, Xenorhabdus bovienii
  Coding DNA location: Contig name=SeqID_16894; Position on contig =97019..97249bp; Strand=+
atggaaacaggtactgtgaaatggttcaataatgcaaagggctttggatttatttgtccagccagcggaggcgatgacatattcgctcactattcaaccattcagatggatggttataggacgctgaaagctgggcaaaaagtgaacttcagtattcatcaaggccccaaaggcaaccatgccagccttattgttcctctggaagatgactcgaaatcaaaaaaagagtga

SEQ ID NO: 3996 - DNA, 153 bp, Xenorhabdus bovienii
  Coding DNA location: Contig name=SeqID_16894; Position on contig =97351..97503bp; Strand=-
atgttcctggaacgtgtagaaatttccggttttagcggtgttaatcgattatcacgggttggtcgccatcgtacgacacgttttcgtcatttatgtccattatgggtggggtcggagcaagcccttaaacgtatttatttacgtgtcagttga

SEQ ID NO: 3997 - DNA, 909 bp, Xenorhabdus bovienii
  Coding DNA location: Contig name=SeqID_16894; Position on contig =97719..98627bp; Strand=+
atgtattcagggttgctaattgttctcatgccattaattctaggctaccttattcgtctgaataataaaacggcgctggccacagttcattacctacttaatatcatgatttatgtcattctcttcctgatgggcgtcagcctcgccatgctggagaatctgggcaataatctactctctatcctgctgtatgcgatgacatttttcttgtgcatatttgcgactaacttgctggcacttctcctattggataaacgggatccttggattattcaagtcaataaacaggaaaaatcaccttctcaattacatatggcttttgattccatcaagttatgtagtgcattgatattaggattcttactcgggctgacagactggtcattgtttcattttgccagtcgtgccagtgaaattgccttgattcttttactgcttctggttggtattcaactgcgcaataacggaatgagtttaaaacaaacgctgttgaatcgccgtggcaccattatcgctctgatcgtcgctataagttccctgttgggcggcatgatagccgcatttttactggggttaccgaccaaaaccggtcttgccatcgcatctgggtatggctggtactctctttctggtattttactctctgacgcttatgggccggtgattggcagcactgcatttttcaatgatctagcccgtgagttggcatcaattctactcatcccgatgctcatcaatcgttatcgttcaacagctttggggttaactggagctgcatcaatagacttcacattgccaatattacaacgctgtggtggcataagtatcgtaccagcagccattgttcacggttttatattaagcttgatgacacccgtatttattgcattttttactcaacaggcttag

SEQ ID NO: 3998 - DNA, 162 bp, Xenorhabdus bovienii
  Coding DNA location: Contig name=SeqID_16894; Position on contig =98758..98919bp; Strand=+
atgataataacaattttatgcagatattattgcatagttattcttatgagattaatatccctccaatctattaactattcatatttatcgcatgagcattcaattaaaaaacataaattgtttctatggaacgcatcaggccctgttcgatatcaattttga

SEQ ID NO: 3999 - DNA, 729 bp, Xenorhabdus bovienii
  Coding DNA location: Contig name=SeqID_16894; Position on contig =98849..99577bp; Strand=+
atgagcattcaattaaaaaacataaattgtttctatggaacgcatcaggccctgttcgatatcaattttgaatgtacatcaggagaaactgtggtgctgttgggcccgagtggtgctggcaaaagctctttactgcgagtgcttaatctattggagatgcctcgttctgggcaactaagcgtggcaacacatcagtttgatttcaaacagcagcccggcgccaaggaaatccgaacactgcggcaaaaagttggcatggtttttcaacaatacaacctatggccacacctaactgtgatggataacttgattgaagcgccctgccgcgtattaggtctatccagacagcaggctcgggaaaaagcagcaaaactgctggcccgtcttcgtctggatgaattttccaaccgtttcccacagcacctgtctggcggacagcaacagcgtgtcgctattgcacgggcattaatgatggaaccccagattctgctgtttgatgaaccaaccgctgcacttgatcctgaaattacatctcaagtcatcaatatcatcaaagaactggcaggaactggtattacccaaattatcgtgacacacgaagtggaacttgcgcgtaaggcagcaactcacattgtgtatatggagaaaggccgcatcattgaaaaaggtgacgcaagtcattttttaaaacccaaaacagaagcctttgctcattatttgtcacactag

SEQ ID NO: 4000 - DNA, 750 bp, Xenorhabdus bovienii
  Coding DNA location: Contig name=SeqID_16894; Position on contig =99674..100423bp; Strand=+
atgactatgaagaaattattgtttgctgccttattaaccgcaatgactttatccgcatctgcaaccgcagcagaaaaagaaacgctgcgctttgctactgaagcaacctatcctccatttgaatttattgatgcaaacaataaaattcaaggattcgatgtagatttggcgaatgctatttgcgcgaaaatcaacgcagagtgcacattcaccaatcaagctttcgatagcctcattcccagcctgaaattccgccgttttgatgcattgatggcaggcattgatattacgcccgaccgccgtaaacaagttgatttcactcatacctattatgataactctgccgttttcattgccatcaaagggaagttcactcattctgccgatctgaaaagcaagcaagtgggaatacagaatggtacgacacatcagaaatatttgatggaacagcataaagagatcaaaaccgtaccttatgacagttatcagaatgcaatccttgatctgaaaaatggccgtattgatgctgtattcggtgatactgccgtcgccaatgaatggctgaagaagaataaagaattaggctctgtcggcgacaaagttactgacaaaaattactttggcattggtttaggaattgcagttcgtaaaggtaatacagctttgctggataaactgaacaaagcactggctgaagtcaaacaagatggtacttataactccatctataaaaaatggtttgaacaataa

SEQ ID NO: 4001 - DNA, 777 bp, Xenorhabdus bovienii
  Coding DNA location: Contig name=SeqID_16894; Position on contig =100380..101156bp; Strand=+
atggtacttataactccatctataaaaaatggtttgaacaataacagaatcctaatgaatgaacttcaatctttaattaacgccgccggtattaccgtcggccttgctgtttcttctcttgtcattggcttaattctggcaatgctttttgccgcttgggagtcagcccgctggaaaccctttgcttttttaggctcttgttgggtcacattgatcaggggattgcctgaaattctggttgtcctcttcatctatttcggaagttcacagcttctcataacgctgtcagaaggctttgatgtcaatctcattgtttggcaattcagaatccagatggaaattgacaactttgatgtcagccctttcctttgtggtgttatcgccctttctctactttactccgcatatgcatcacaaacactgcgaggcgcattgaaagccgtcccaatggggcaacgggaagccggacaagcacttgggttaagtcaaagccgtatattttttcgtctgaccgtgccgcagatgtggcgccatgcattgccagggcttggcaatcagtggttggttctactgaaagatactgctttagtttcactgatcagtgttaatgatctgatgttgcaaacgaaaagtatcgcgactcgcacacaggaaccatttacatggtatgtgattgccgccatgatctatctggtgattaccctggtgagccaatttattctcaaacggcttgaaatgcgcgccactcattttgaacggagtgcttccgatgtttga

SEQ ID NO: 4002 - DNA, 669 bp, Xenorhabdus bovienii
  Coding DNA location: Contig name=SeqID_16894; Position on contig =101149..101817bp; Strand=+
atgtttgagtatataaaggatatcttacctgggctgcaaactagcctaagcttgactgtcaccgcattactggctgcatttatactgtctgtggttctgaccttcattttaacgatgaagttgccgatactatcccaattggtaaaaggctatatcacattatttaccggaacgccgttactggttcagttcttcttgatttactacgggcccggacaatttccctcaataaaagagtacccttggttatggcagctcatgtcagagccgtggctatgtgccatggtgacactggccttgaacagtgcagcctattcaacccaacttttttatggcgccgttagggcaatccctgctgggcaatggcaatcctgtcaggctcttggtatgtcaaaaacccattccatgcgcattctactgccttatgccttcaaacgagcgctttcttcctattccaatgaagtcgtcttgattttcaagagtacctctctggccagtacgatcacacttctggatatcatgggatatagccaacttcaattcgggcgtagttatgatgtgactgtatttgttgctgctgggatcatttatctttgcgtaaatgctcttctgacactactgatgcgcatgattgagcgtcgagccttatcatttgagcaacgttattaa

SEQ ID NO: 4003 - DNA, 1134 bp, Xenorhabdus bovienii
  Coding DNA location: Contig name=SeqID_16894; Position on contig =101907..103040bp; Strand=-
atgcaatgtgcgcagtataccgcggggcattgtcactcctgccagtggctcaataagtcctattcacaacaattatctgataaacaacaacatttacagcagcttttacgggagacgtcagcaacgtactggctgcctccagtcagcagcctgatcagtgggtttcgtaataaggccaagatggtggtaagtggcagtgttgaacgcccacagcttggaatgcttcaccgtgatggcagaacggtggatctttgtgattgccctttgtatccgcaatattttcagccagtatttgaagcaataaaaatatttatcgctaaatccgggttggttccgtacaacgttgcacgtaaaaaaggggaattgaaatatattctgctgacagaaagccgtgccagcggtgaaatgatgctacgttttgtcctgcgctcagaaataaaactggctcagttggaacatgctttgccgtggttacaggaacaactaccacaattggcggttatttctgccaatattcaaccaactcatatggcgattttggaaggtgaaaaagagatcatttttactgaacataaaatgctgaaggaaaccttcaacggaattccgctgtatattcgtccccgtagttttttccagacaaacccagaaattgcttcggcgctttatgcgacggctggtcgttgggtcagagagctgaatagcagcagcatgtgggatctcttttgtggagcaggaggttttgggctgcactgtgcagacaaagaaaccagactgacagggattgagattagtgcagaggccattgcctgtgccaaaaactcggccaaaagtcttggtcttgagcaggttgaatttcaggcattggattctacacattttgcccttgataaagcgcaactccctgaactggtgctggtgaatcctcctcgcaggggaattggtaaggcgttatgcgaatacctcagccggatggcacctaaatttattctctattcaagttgtaatgccgaaacaatggcaaaagatattgctgcgcttgagcaatatcgaatagaaaaagtgcaattattcgatatgttccctcatacagaacattatgaaacgctggtgttattgatttttgatggaaagtaa

SEQ ID NO: 4004 - DNA, 591 bp, Xenorhabdus bovienii
  Coding DNA location: Contig name=SeqID_16894; Position on contig =103065..103655bp; Strand=-
ttgatcgtgctgctattggcaaggtgtttccttcaggtagcatgtacaactttttggtcatatgaggttgattcgatggattctatggttgttccaaatttggcaacattgcgtaactggcttgaacgcctcaaaatttcttattttgagaatgattcaaattcggtcttgcatttgcctcatatgcagaacattgatggcctgtttgatgccaagattgatctgttgggtgacgtagtgctgttttctgctctggcagaagtcaggccaacggcgataattccattagttgcaaacttgagccagattaatgcgagttccctcactgccaaagcgttccttgatattcaggacgaaaacttaccgaagttgatagtttgtcaggcatttcctatcgccgctggtatgactttcccgcagttttcccatttcttgcagcaaagtgaggagcagattgccaatgtgatttttgaaattcacagcaataacttcctttatattaataatgatatggaaagcgagatggaagtagaagtagaagatgaggaatcattggcttcgacggaaacatcgacatttaccttgcactaa

SEQ ID NO: 4005 - DNA, 312 bp, Xenorhabdus bovienii
  Coding DNA location: Contig name=SeqID_16894; Position on contig =103664..103975bp; Strand=-
atgaagaaaatctcaacaaaagagatgcgctcgttgtcagatatgccaaagctggttattttattagaaatattgggaatcggcttgttggttttggcgtatttgtcgataactgatagcataattctatcacctttattaatgacgacagaagcgcacattgctatgatcttattgggtataggttgcttgatacctgcagctatccatattatctggcatgcagtctataatctttcttttttgggaattgatcataagaaagtagataaaaatcatcagactggttctgatgatgaaaaaacaaaatag

SEQ ID NO: 4006 - DNA, 264 bp, Xenorhabdus bovienii
  Coding DNA location: Contig name=SeqID_16894; Position on contig =104171..104434bp; Strand=+
atgtatactgtcatttttggtcgcccaagttgcccatattgcgttcgcgccaaagaattggctgaaaaattgaaagcagagcgcgacgactttgattaccgctatattgatatctgggctgaaggcatcaccaaagacgacttgtcaaaaactgtggggaaacccgttgaaaccgttcctcagattttccttgatgagaaacatatcggcggctttactgattttgaagcttacgctaaagaacatctgaacctgtacaaataa

SEQ ID NO: 4007 - DNA, 117 bp, Xenorhabdus bovienii
  Coding DNA location: Contig name=SeqID_16894; Position on contig =104401..104517bp; Strand=-
atgtggatcttagtcaacattatgaacctgccactatccagaagaaagcatcgacatttctggctggatagtgagttttatggttatttgtacaggttcagatgttctttagcgtaa

SEQ ID NO: 4008 - DNA, 159 bp, Xenorhabdus bovienii
  Coding DNA location: Contig name=SeqID_16894; Position on contig =104498..104656bp; Strand=+
atgttgactaagatccacatatccactgaattgaaaaaaatctgtaatttttttctcaacaatgagaactttcatcacatcacgcagtctgaattaatgccactgcttttctttgatgtccccatattgaggagcccgatagtcacccattttggttaa

SEQ ID NO: 4009 - DNA, 198 bp, Xenorhabdus bovienii
  Coding DNA location: Contig name=SeqID_16894; Position on contig =104861..105058bp; Strand=-
atggcttttccttctccccaaagccagcaagcagctaatgttatggggaaaataaacacaagatattttgctataaagatcgccagtaaaatcattgctggtgatgaatccggtgttgcattgataaaagtaaacacattgtggttaagttgttctagcaaagtaagcctcacaagcgtgatattgacgcaaatatga

SEQ ID NO: 4010 - DNA, 543 bp, Xenorhabdus bovienii
  Coding DNA location: Contig name=SeqID_16894; Position on contig =104964..105506bp; Strand=+
atgattttactggcgatctttatagcaaaatatcttgtgtttattttccccataacattagctgcttgctggctttggggagaaggaaaagccatctcacatcaacgtattgttgtcagtaaatcctgtattgcctttgcctttgcaatagccggttcggatatcatcggaacatttgttccacacgcccggccgtttgtagaaggttttggttacaattttctctatcattcccctacagcctcttttcccagtaaccacggtacagcagtctttaccttcgcgttagcatttatcttctggcatcgtatccggtcaggtttatgcctgatgatcatcgcctgcatgattgcatgggccagaatctacgtaggagttcattggccaatcgatatgatcggcgcatttctagtcagcttgatgggttgtgctttttcacaaatattctggcgcttatatggtgagtattggcacagtaaactcattcgcctttaccaattctgctgtgcatttttcatccggaaaggatggataaaaaattaa

SEQ ID NO: 4011 - DNA, 1308 bp, Xenorhabdus bovienii
  Coding DNA location: Contig name=SeqID_16894; Position on contig =106476..107783bp; Strand=+
atggacacgtctcaatcaggttctatcgcagcctctgctgcttccggcaaaagcgattatactacctggcgtaaatcagacactgtatggatgttggggttatatggcactgccattggcgctggagttctgtttcttcccataaacgccggtattggtggtttaattccacttatcatcatgacactactcgcacttccgatgacattttttgctcaccgtggaatgtgccgttttgtcttgtctggcaaaaagcatggcgaagatatcaccggcgtggtagaagagcattttggtaaagttgcaggtttcctgatcacaattctctacttctttgcaatttatcctattttactggtttatagtgttgcactgactaacaccgtagacagctttattactcaccagttacatatgaccgcaccaccgcgtgcattgctggcactggtactgatccttggtgtgatgagcattattcgcttcggtgagcaatttatcgtcaaagcaatgagcgtactggtattcccattcgtcgccgttctgatgctgctggcactgtatttgatcccacactggaataccacaatcttcgataccctgtcactggaaaatgtcctgacttccacgaacggtcatggcttgctgtttactctgtggctggctattcctgtcatggttttctccttcaaccattctccaatcatctctgcatttgccgtagcaaaacgcgaagagtacggtgaaaatgcggagaaaaaatgctcgcgcattctgggttatgctcacatcatgatggtgattaccgtcatgttttttgtcttcagttgcgtactgagcctgtcaccggcaaacctggcagaagcaaaagcacagaacattactatcctgtcctatctggctaaccattttagtgcaccaactattgagtacattgctcccttaattgccttcattgcaattactaaatcgttcctcggtcactatctgggtgctcgcgaaggcttcaacggtatcgtaaacaaagctctaagcacacaaggcaaaacgattcagcgtaagtcgctgaatcgtatcactagcctctttatgttagtcagcgcctggatcgtggctactcttaacccgagcattctagacatcatccaatccctgggtgggccaatcattgccatgattttgttcatcatgccaatgtacgctattcacaaagtgccagctatgcgcaaatatgctggtaagccaagcaatgtctttgtggttgtgacaggattaattgctatttctgcggcagtttactcagtcatgtaa

SEQ ID NO: 4012 - DNA, 93 bp, Xenorhabdus bovienii
  Coding DNA location: Contig name=SeqID_16894; Position on contig =107791..107883bp; Strand=-
atgtatgagcttcggataaataggaaaatgccagtcaatcgtgaagtcggccggcatttttatggagctgctgtcgtagaaatcagcgcttga

SEQ ID NO: 4013 - DNA, 1209 bp, Xenorhabdus bovienii
  Coding DNA location: Contig name=SeqID_16894; Position on contig =107916..109124bp; Strand=-
atgatgaaaaaaagacggcaggtacagataatcaaatcttttactgttggcttgggtgttttttggttgatgggtgtcaacgcatacgcaatggatgaaccctcagcacctgaaattgatgcgaaatcctatatattgatggattacgccagtggaaaaattctggcatcccataatcccgatgagcggctagatccagcgagtctgacaaaggtgatgaccagctatgttgttggtcagtcgattaagtcgggaaagatttccacagaagatcaggtaaccgtaggtaaagatgcttgggcaaccggcaatccggcgcttaaagggtcatccctgatgtttttgaaaccgggtgatcgggtcaaagtcattgatttgaaccgtggcattgtgatccaatctggcaacgatgccagtattgcccttgcggattatgtagcgggcagtcaggatgctttcgttgatttgatgaataaatactcgaaaactctgggactggaaaatacccatttcaagactgttcacggtctggatgctgcggggcaatacagtaccgctcgtgatatggcgctcttgagtcaggctatgatccgtgatgtgccagaagaatatgcgctgaataaagagaaagaatttactttcaataatatccgtcaacctaaccgcaatcgcttattgtggaatcagaatatgaatgtggatggtgtaaaaaccggacacaccaacggggcaggatataaccttgttgcttctgcagcggaagggccaatgcgtttgatttcagttgtactgggagcgcctagtgatcgaatgcgtttctctgacagtgaaaagatcctgtcatggggattccgtttctatgaagccagtactccgcttaaagccagtgacacactggtgacagaaagagtatggttcggtacgcgttcagaggtggctttaggtgtagaaaaagatacggccgtgacggtgccgcgaggtcaagcgaataatctgaaagccagttttacgctgaaccaaacttcacttgaagcgccattggcgaagaatcaagttgtgggaactgtgaatttttcgctgaatgataaggtgattgatcaacgtccgttggttgttaaagaagctgtagaagagagtggcttttttgggcgtatttgggatttaattgtgaagactgtcagcggctggtttaactcaattttcgggtag

SEQ ID NO: 4014 - DNA, 189 bp, Xenorhabdus bovienii
  Coding DNA location: Contig name=SeqID_16894; Position on contig =109045..109233bp; Strand=+
ttgacacccatcaaccaaaaaacacccaagccaacagtaaaagatttgattatctgtacctgccgtctttttttcatcatagcccgccctttttgtctacaaccagaatataaaagctctattaatataggatgttatgagacaagactccaacccaataacgtaaagattttcttgttacccgaatga

SEQ ID NO: 4015 - DNA, 624 bp, Xenorhabdus bovienii
  Coding DNA location: Contig name=SeqID_16894; Position on contig =109285..109908bp; Strand=+
atgatgttgacaatctggggccgtaaaagctcatcaaacgtaaaaaaagtcatttggtgtctggaagagttaaacgtaccatatcagcaaattgatgttggtggtcagtttggcaaacttaatactccagaatacctgctcatgaatcccaatgctgtcattccttgtttgcaggaagatgattttatcttatgggaatcaaacgcgattgtgcgctatatttcggcaaaattcggcgagaatagtctttatcctgccgatcttcaagaaagagccagaattgatcaatggatggattgggtaggctacaatctcttcccgccgatcaaacaacttatgatcaacattgtcagaacaccggaagatcagcgtgacccgaaagtggttgcccagatattaaaagagatagaaaaactgctgaaaattgtcgataacgtactaggtaagcaaaaatacctttccggtgataagtttggcatggcggatatcgccctcgctccattggtctatccatggctaaaggtcgggatagagcgtccatctctgccaaacttggaacgctggtatcaattactgaccgaaagaccagcgtttcaaaaaatcgttatgattgaaataagctga

SEQ ID NO: 4016 - DNA, 834 bp, Xenorhabdus bovienii
  Coding DNA location: Contig name=SeqID_16894; Position on contig =109912..110745bp; Strand=-
atggtgaaaaaagtttccatcatcggattgggttggctgggaatgccgttagcgcaaattttgcaaggctatggtatgcaagtggtcggtagtaaaacaacagcggatggtgtcgaagcggcacgcatgtgtggtgtagattgccacttattgaatctgacccctcagataatctgtgaaacggatgatcttgaacggctcatgtcagtggatgtactagtgctaacattacctgttagcggtattgcggggggtggggaagggtatgtcaaagcggtgcagttagttgtcgatactgcgctttcgcattcggttccccatattattttcaccagctcaacttcagtttatggctcgtctgtcggtcatctgaatgaagatgctccattatttcctgagacgcgatctgccaaggcgttggttgaattggaaaactggctgcatcgactgccaaatacttctgttgatatagtgcgtttggctggtttggtcggcagtggtcgccatgcagggcgtttcctcgcagggcggaaagcgattgagggtggagaaaaggtggtcaatctagttcatcaggatgatgttatttctgctattaaacgccttatagagcagcagaaaggagggcatatctataatctgtgtgcgccagaacatccgaaaagaaaggagttttattcgcaggctagtagtcagctcgatttggctccgccagagttttcacagtcaaaggctcagggagccgcgagcaaagttgttgacggtagccgtatctgtcgggaactggggtttgagtatcaattcccagatcccggcagaatgccaatgagctga

SEQ ID NO: 4017 - DNA, 99 bp, Xenorhabdus bovienii
  Coding DNA location: Contig name=SeqID_16894; Position on contig =110784..110882bp; Strand=-
atgaaaagcaacttttttttcaaaggagctgtttgtattgttctaattgtttgttttataaataaaactggtgttgtcgttaaggcaatatgcagatag

SEQ ID NO: 4018 - DNA, 147 bp, Xenorhabdus bovienii
  Coding DNA location: Contig name=SeqID_16894; Position on contig =110818..110964bp; Strand=-
gtgagctctctatctactttttttaatatatgtttgcgaacaaggattggttgcttaccgtttaacctatatgattttgtgtatgaaaagcaacttttttttcaaaggagctgtttgtattgttctaattgtttgttttataaataa

SEQ ID NO: 4019 - DNA, 288 bp, Xenorhabdus bovienii
  Coding DNA location: Contig name=SeqID_16894; Position on contig =111019..111306bp; Strand=-
atgggcatattttctgcaaatgcaattagacgttgttgctgcaagttgattttgatgccacagcgagccagtaatgcccgggaatcatcactgaggcggccggatttctgcatggctattcgtaagcgtgttttatctagcatgttatgttttaccctatctcaatattcaatatataaatcgcgtaaattggcaataaaaaacccccggaaaatcttccgagggttttttatcgtactcatgccaccggaagacttactaaatgtcttccagcacacaacagcctga

SEQ ID NO: 4020 - DNA, 900 bp, Xenorhabdus bovienii
  Coding DNA location: Contig name=SeqID_16894; Position on contig =111164..112063bp; Strand=+
atgctagataaaacacgcttacgaatagccatgcagaaatccggccgcctcagtgatgattcccgggcattactggctcgctgtggcatcaaaatcaacttgcagcaacaacgtctaattgcatttgcagaaaatatgcccatcgacatcctgcgtgtccgtgatgatgatattccgggtcttgttatggatggtgttgtcgatttaggcattatcggtgaaaacgtacttgaagaagaactgttaaaccgtcgggcacaaggagaagatccccgttataacacattgcgccgccttgattttggtgattgccgtctttcccttgccgctccctttgactacgactataccggagtggaatgcctgcaaaattcccgtatcgccacgtcttacccctacttactgaaacgttatttggataaaaaaggtatccgtttcaaatcctgccttctcaacggttcagttgaagttgctccccgtgcaggattagctgatgctatctgtgatttggtttcaacaggtgcaacactagaagccaacggcctgcgggaagttgaagtcatctatcgctcaaaagcctgcctgatccaacgcgatggtgagatgccagaagccaaacaacaactcatcgacaagctgatgatccgaatccaaggcgttattcaggcgcgtgaatccaaatatatcatgctacatgccccaaacgacaaactggaagagattatctcgttacttccgggtgctgaacgtcccaccattttgccactagcgggggcacaaaaccgtgtagccatgcatatggtcagcagtgaaaccctattctgggaaacgatggaaaaacttaaatcactgggctccagttccattttggttctaccgattgaaaaaatgatggagtaa

SEQ ID NO: 4021 - DNA, 1317 bp, Xenorhabdus bovienii
  Coding DNA location: Contig name=SeqID_16894; Position on contig =112069..113385bp; Strand=+
atgagcacccattttaaaaccattatccgctggcaggaatgcccaccagaacagcaaaaagtattgctgacacgtcccgctgtcgccgcttcagaagatatttctcgcacggtaaaacagattctggaaacggttaaagccaacggcgatgaagcattgcgggaattcagccagcgcttcgacaaaacaacaatcgatactatcccgatttctataagtgaagttaacgcagccgccagtcgtctggcaccagaaatcaaacaggctatgcagcaggccatgaataatattcgcctgttccatgaagcccaaaaacctgctgtgattgaggttgaaaccctgccgggtgttcactgccagcaagtcacacgcccaatcgattcagtggggttatatattcccggtggttctgcgcctctgctttccactgtattaatgctgggaacacccgctagcatcgcaaagtgccgtaaggttattctctgctctccacccccgattgctgatgaaattctctacgcggcacagctctgtgggattaacgaaatatttcaggttggcggcgcacaagccattgctgcaatggcctttggcacagaatccgtccctaaagtggacaagatttttggcccgggtaatgcttgggtaacagaggctaaacggcaagtgagtcagcgcttcgacggtgcagccatagatatgccagcaggtccatcagaagtgctggtaatagcagacagtggagccaatcccgcatttacggcagcagatctgctttcacaagcggaacatggccctgattctcaagtcgtgctggtcacacctgacgaaacttttgccgagcaggtgatccgggaaatcgaaacccaacttgctgccctgccacgccaacaaatcgcggttcaggctctgcaatccagccgaatcattgtcactgacgatctgactcaatgcgtagcgataagcaatcaatacggccctgaacacttgatcattcaaacccgccagcctgagcaacttgtggagcaaatcaccaacgcgggttcgatttttctcggggattggtcgccagaatccgcaggagactacgcttcgggtaccaatcacgtcttaccgacttatggttatacttcaacctattccagcctcagcctggcagatttcctgaaacgaatgacggttcagcaaattacacctcaaggattgagaaacctcgccccaaccatagaaacactggcgcaggcagaacaactcaccgcgcacaaaaatgccgtcacattacgcatagctgccctgaataactcagatgttgaataa

SEQ ID NO: 4022 - DNA, 1107 bp, Xenorhabdus bovienii
  Coding DNA location: Contig name=SeqID_16894; Position on contig =113404..114510bp; Strand=+
atgagtactgtttttgatgtcaattcactggcaagagaaaatgtccgccagttagtcccttatatgtctgcccgccgtctgggtggcaatggtaatatctggttaaatgccaatgaatatcccatcgcccctgattttcagttcagcgaaaaaacgctcaaccgctaccctgaatgtcaacccgtctctgttatccagcgctatgcggattatgccggcctgcaaccggatcaagtccttgtcagccgtggcgccgacgaatctattgaactattgatccgagttttctgtgaaccgggaaaagacgccgtgctgttctgccctcccacttacggcatgtacagcgtcagtgcagaagcctttggcgtagaacagaaaaagatctccacccgtgctgactggcagccggacattgccgctatcgaaaataatctggatcgcgtgaaactgatttatatctgtagccccaacaaccccacgggtaatctgattgctcctgcggcactgcgacagatccttgaactcgctcgtaaccgtgccattgttgccattgatgaagcctatatcgaattctgtccgcaacatactaccaccggctggctgcaagactatccgcacttggtgattttgcgaaccctctcgaaagcttttgcactggcaggactacgctgtggatttacactggcttctcccgatattatcgcgctaatgttgaaagtgattgctccatatccacttgccacgcctgtagcggatatagctgcgcaggcgctgacagaagcaggcattaatataatgaaagatcgtgtagaggaagtggctgagaaccggacttatctccggcaggcattgaatgaactggcaatggtcgaaaaagtgtttccgagcgaaaccaactatattttagtgaaatttaccgatgcggaaatcgtattcaggacattatgggagcaagggatcatcttgcgtgatcagcggaaacaagcgggattggataattgcctgcgcatcaccattggtagccgaaatgagtgtgaacagttggtcaatgccatcgctgctcttcgtagccagactcaaccactaaaggaaactgaaaatccatga

SEQ ID NO: 4023 - DNA, 1068 bp, Xenorhabdus bovienii
  Coding DNA location: Contig name=SeqID_16894; Position on contig =114507..115574bp; Strand=+
atgagccagaaactgctttttattgaccgcgatggaacgttgatcaccgaacctccgaccgattatcaagtcgatcgccttgataaattggcctttgaagctggcgtgatccctgccctgttatccctgcaaaaagcgggttacaaactggtcatgatcaccaatcaggatggattgggtactgatagctttccccaagccgattttgagccaccacacgcactgatgatgcaagttttcacttcacaaggcattcagtttgaagaagttctgatctgcccccacaaacccgaagacaattgcaactgccgcaaacccaagctcggattggtggaaaaatatctaacagaaggcatggtagatacgaaaaacagttgcgttatcggggatcgggaaaccgacttacaattggctgaaaacatgggaattaaaggaattcgctatcaagcccaatcacttggttggtcagcgatttgtgagcaactgacccgcaaagatcgtcatgccagcgttgaacgtaaaaccagagaaactggcatcaatatcgatatctggctggatcgcgaaggtagaagcgaaatcaatactggcgtgggtttctttgatcatatgctggatcagattgccactcacggcggtttccgcatgaatgtacaagttaagggcgatctctgtattgatgatcaccacaccgttgaagatactggattggctttaggtgaagctctgaagcaggcattgggcgataaacgcggcattgcccgttttggcttcacattaccgatggatgaatgtctcgcccgctgtgctctggatatttccggtcggccacatctcgaatacaaagcagagtttaaacatcagcgtgttggcgatttaagtactgagatgatcgaacactttttccgttcactctcttatacgatgggatgcaccttacacctgaaaaccaaaggtaagaatgatcaccatcgggcagaaagtctgttcaaagtctttggccggacattgcggcaggccattcgcgtagaaggcgatgttctgcccagttctaaaggcgtgttataa

SEQ ID NO: 4024 - DNA, 609 bp, Xenorhabdus bovienii
  Coding DNA location: Contig name=SeqID_16894; Position on contig =115583..116191bp; Strand=+
atgatgaaagttgttattttggatacaggctgtgccaatcttgcctccgttacttatgccatccgtcgattaggttatgatcccgtcgtcagtctggatgcagatattgtgcgatcagccgataaactgtttctgccgggagtaggtacagcaatggccgcaatggatcaactccagcaacgacagctgatcccactgattagctcactcacccaacccgtactgggtatttgcctcggtatgcagcttctggcggcaaccagtgaagaaagcaatagtgaaaaagacgataacgtctccttactggcattaattgatgcccccgtcaaaaaaatggcgactgctggcctgccattaccccacatgggttggaatcaagtaaaagcacagactgggcatcccctgttttgccatattgaagacaatgcccgtttttattttgtccatagttacgcgctgcctgttggtgaatacaccattgcccagacggaatatggcaattccttcagcagtgccattgcaaaagacaatttctttggtgtgcagtttcaccctgaacgctctggcacagcaggcgcacaactgctgaaaaactttttggagatgtaa

SEQ ID NO: 4025 - DNA, 738 bp, Xenorhabdus bovienii
  Coding DNA location: Contig name=SeqID_16894; Position on contig =116196..116933bp; Strand=+
atgattatcgccgcattagatttaattgatggcaacgtggtgcgtttgcatcagggggattacgaccagcagcggacttatggcaattcacctttgtcccacctacaacaatatgaaaaagaaggcgccaagttgctgcatctcgtggatctcacaggcgcaaaagatcccaccaggcgccagatgatcttgctgcgtgaattgctggatgacgtttctgttccagtgcaagtgggtggtggcatccgttcggaaaacgatatcaaatcactccttgaggccggagctagtcgggtagtcattggctcaacagcgatcacacagccggaattagtcaaacaatggtttcagcgatatggtgcagagtcaattgtactggcactcgatatccgcatcagtacagacggtgctaaacaaattgccatcagtggctggcaggaaaacagtaataccactcttgaacaggttattgagcaatatctccctgttggtttgaaacatgttttatgtaccgatatttcccgtgacggcacactaaacggctctaatatcgcactctatcaggaaatcagtcagcactacccacagattcaatttcaggcatcgggcgggatcggcaaccttgctgatatttctctcctaccgacgactggcgttgcgggcgttatcgtcggacgggcattacttgaaggaaaattcacactgacggaggctatccaatgttggcaaaacgcataa

SEQ ID NO: 4026 - DNA, 777 bp, Xenorhabdus bovienii
  Coding DNA location: Contig name=SeqID_16894; Position on contig =116915..117691bp; Strand=+
atgttggcaaaacgcataattccttgccttgatgttcgtgatgggcaagtggtcaagggagtacaattccgaaaccacgaaatcatcggtgatatcgttccacttgcacagcgctatgcccaagagggagctgatgagctcgttttttacgacatcaccgcttcttcagatggtcgtgtggtagataaaagctgggtggcgaaagtcgctgaagtgattgatattccattctgcgtcgcaggcggcatcaaaactaccaaagaagctggccagattttatcattcggtgccgataaaatttctattaactcccctgctctggctgatccttcgttaatcagtcgtctggccgatcgctatggcgttcaatgtgtagtaatcggtatcgatacgtggtttgatgaaaatagcaacagctatagtgtctatcaatttaccggtgatgaaaaacgcacaactgcaacgcaatggcaaacactggattgggtcaaggaagtacaacaacgtggcgcgggtgaaatcgtcctgaacatgatgaatcaggatggtgtccgcaatggctatgatcttacccaactgaaattggttcgggatatctgctccgtacctttggtggcttccggcggtgctggtacgccagaacattttttggatgcatttaaactggctaatgttgacggtgccttggctgcctccgtctttcacaaacagatcatcaatattggtgagctcaagcaatatcttgctacacagggtgtcgaggttagaacatgttaa

SEQ ID NO: 4027 - DNA, 621 bp, Xenorhabdus bovienii
  Coding DNA location: Contig name=SeqID_16894; Position on contig =117685..118305bp; Strand=+
atgttaacagcacagcaaatcgaaaaactggattggaaaaaagtggatgatctcatgcccgtcatcgtccagcacgctgtatccggtacggtgttaatgatgggttacatgaatcaagaggcacttaatgccacacaggaatccggtaaaatcacctttttttcccgcaccaaacagcggttatggacaaaaggcgaaagttccggccacttcctgaatctggttgatatctaccccgattgtgacaacgataccctgctcgctctcgtcaatccgattggcccaacctgccatacaggaaccgagagctgttttgcaccagcgcaaactgaatggggcttcctctaccaactcgaacaactactggcaagccggaaaaatgccccaccggctagctcttatactgcccgtctgtatgccagcggcacaaagcggattgcccaaaaggtcggtgaggaaggcatagaaaccgcactggcagccacagttaatgatcgggaagaactgaccagcgaagctgctgatttgatttaccacctgctggttttattacaagatcaagatttggatctcagttgtatcatccgccaattgcaggaaaggcatgtagctaaagaataa

SEQ ID NO: 4028 - DNA, 315 bp, Xenorhabdus bovienii
  Coding DNA location: Contig name=SeqID_16894; Position on contig =118234..118548bp; Strand=-
atgcttgtggttttaccaacccgattcaggcatcacacgaagagattgtggctatttttaaagcggcaatgtaactcgataaatcttgccatttctatggcaagattcaaaaagaagcgaggtggcaccagatatgccgaacttacaattaccgcgccacatttcgactctacctattttatgaatcgcctccgtaggcgaaatgactgcaatttattgaaacctcaattcctgctaagcaaattattctttagctacatgcctttcctgcaattggcggatgatacaactgagatccaaatcttgatcttgtaa

SEQ ID NO: 4029 - DNA, 1152 bp, Xenorhabdus bovienii
  Coding DNA location: Contig name=SeqID_16894; Position on contig =118475..119626bp; Strand=-
atggcagtatcaactttctttatcccgccagtgaataaaatcggtatgggatgcatgactgaagccgttgaattaatgaaaaattatggctacaggcaggctttgattgtcactgaccgcgtgttaaacgagattggtgttgttggagaagttcagagtttactggctgaagcagggataaagagtgcgatttatgctgggacgaatccaaatccgaccactattaatgttgaagaggggctaatcatcctgcgtcagcatgattgtgattgcgttatttctctgggaggtggttcaccgcatgactgtgcaaaagggatcgcgctggtggcggctaacggtggggatatccgtgactacgaaggcgttgatcgttctgctaaacctcaattgccattgattgccattaacactacggcgggtaccgcctctgaaatgacgcgtttctgtatcattacagatgttgatcgtcatatcaaaatggctattgtggataaaaatgtgacgcctatattgtcaatcaatgattccgcattgatggccggtatgccgaaaggactcactgccgcaaccggcatggatgcgctgactcatgctattgaagcttatgtttctacggcagccaatcctatcactgatgcctgtgcgttgaaggcagtgacgatgattagcgactatttgcgccgtgccgttgcgaatggcaatgatatggaagcgcgtgagaatatggcttatgcacagtttttggcaggtatggcattcaataatgcctctttgggttacgttcatgccatggcgcatcagttaggtggtttttatgatttgccacatggtgtttgcaatgcagtattgctgccacatgtacaaaaattcaatgcaaaagtatctgcatctcgcctgaaagagattgctgcggcaatgggggctgatattgccaacttgaacgatcggcagggtgcagaagtctgtatccaagaaatcagcaaattggcaaaagatgtcaatattccggcggggttgtccgagttaagtgtcaaagttgaagacttgccaacgttggcaactaatgcgttaaaagatgcttgtggttttaccaacccgattcaggcatcacacgaagagattgtggctatttttaaagcggcaatgtaa

SEQ ID NO: 4030 - DNA, 123 bp, Xenorhabdus bovienii
  Coding DNA location: Contig name=SeqID_16894; Position on contig =119571..119693bp; Strand=+
atgcatcccataccgattttattcactggcgggataaagaaagttgatactgccattcggaactccttaggttttactgaagtatttcaaatctcgatgcaaaagaagtgggttacaatgtga

SEQ ID NO: 4031 - DNA, 159 bp, Xenorhabdus bovienii
  Coding DNA location: Contig name=SeqID_16894; Position on contig =119841..119999bp; Strand=+
atgtcaataagttcatatggcgattattatatgaataatattcctacattgataatagttgtatttttgattatcagctttgtgctaattgttggcctcgattcagaggtagcacactttattgaaaaatttgctgaaaggctgatacaaaaaaattga

SEQ ID NO: 4032 - DNA, 1428 bp, Xenorhabdus bovienii
  Coding DNA location: Contig name=SeqID_16894; Position on contig =120122..121549bp; Strand=-
atgatcagacgggagtttttcatgtccaaacaacagatcggtgttgtcggtatggcggttatggggcgcaatctggcgttgaatattgaaagccgtggttactctgtatccattttcaaccgctccagcgataaaactgatgaagttattgctgaaaatccagggaaaaaattagttccaagttattccattgaagagtttgttaactcactggaaaagccacgtcgtattctgttgatggtcaaggcaggtgaagctacggataaaaccattgcatcactgacgccgcatttggataaaggtgacattctgatcgatggtggcaatacctattttcaggatactattcgccgcaaccgtgagctgtctgctcagggttttaattttattggtacaggtgtttccggtggggaagaaggcgcattgaaaggtccttcaatcatgcctggcggtcagaaagaagcttatgagctggttgcgcctattctgaaagagatcgctgccaaagttgatggtgagccttgtgtcacttatatcggtgcagacggagcaggtcattatgtgaagatggttcacaatggtattgaatatggcgacatgcaactgattgcagaagcatattctctgctgaagcactccttgaatctgagtaatcaggaactggcggatgtgttcagtgactggaaccaaggtgaactgagcagctatttgatcgaaattaccgctgatatcttccgtaagaaagatgaagaaggtaaatatctggttgatgtcattctggatgaagctgccaataaaggtacgggtaaatggaccagccagagttctctggatctgggtgttccagtaacgctgattaccgaatccgtatttgctcgttatatttcctctctgaaagatcagcgtgttgctgcctctaaagttctgtcagggccagaagcccagccattcaatggtgacaaggcagaatttattgagaaagttcgccgtgctctgtacttgggtaaaatcgtttcttacgctcaaggcttccagcaattgaaagcgtcttcagatgaatacaactgggatctgaattatggcgaaattgccaagatcttccgtgcaggttgtatcattcgtgcgcagttcctgcaaaaaattacggatgcgtacaatgagaactccgctatcgccaacctgttgttagcgccttacttcaagcaagtcgcggatgagtaccagcaagctctgcgcgatgtcgtttcttatggtgtccagaatggcattccaacgccaacattctctgcggccatttcatattacgacagctatcgttcagcggttttgcctgccaacctgattcaggctcaacgcgattatttcggtgcgcatacctataagcggactgataaagaaggtattttccatactgaatggttagattaa

SEQ ID NO: 4033 - DNA, 180 bp, Xenorhabdus bovienii
  Coding DNA location: Contig name=SeqID_16894; Position on contig =121517..121696bp; Strand=+
ttgtttggacatgaaaaactcccgtctgatcatgactgctgcccaccaagatgcctaactcaacattatgtcaatcaaacaatgtcgatcacaaatgtcatatacaacaaaattacagtgggcaatttgttaatgagattacatgttaactcaggaataggcttcaggggtagttattga

SEQ ID NO: 4034 - DNA, 129 bp, Xenorhabdus bovienii
  Coding DNA location: Contig name=SeqID_16894; Position on contig =121696..121824bp; Strand=+
atgcaaccgatatcgtcatactgtttttttgctgaaaaaatttccaactgggataaatcgcctattgatatttctgataccaatccgcattattcagtaatcggcagaagccgtcacattaaaaggtaa

SEQ ID NO: 4035 - DNA, 1581 bp, Xenorhabdus bovienii
  Coding DNA location: Contig name=SeqID_16894; Position on contig =121835..123415bp; Strand=+
atggaatggatcgctgatcctacgatatgggccggtttggccacacttatcgttttagaaattgttctcggaattgacaacttaatatttattgccattctggcagacaaacttcctgaaaaacagagagacaaagctcgcctaacaggtctgacctgtgctctggtcatgagattgctcctgttattcagtctttcttggcttatttccctgacaactccattactaactttatgggatcatcctttcagcgcccgtgatttaattatgctgatagggggaatattcttgctgttcaaggccacaatggagttaaatgagcggttggaaggtaaaatgctacataacaaccaacagcgcaaaggtgcaaacttttgggcagttgttgtgcagattatcgtcttagatgccgtcttctcgctggattctgtcattactgccgtgggtatggtcagtcacattggcaccatgatggctgctgtcatcattgccatgatcctgatgatatgggccagcaagccgctgacgaaatttgttaatgctcatccgaccattgttatcctgtgtctcagctttctgctgatgatcggtttcagtctggtggctgaaggctttggctatgtcattccaaaaggctatctctatgccgccatcggcttctcaatcatgatcgaagcgctgaaccagttttcccagttcaatcgccgtcggttcctgagtgcttcccgttccttgcgcgaaagaaccgcagaggctgtacttcacattttaaatggcaaacgtgaaaacgccgatctggacaatcacgcttccaatctgatcgcagaccatgaagatcataaagccgtctttgaaccgcaggaacgtcatatgatcgcccgtgttctcagcatggcgcaacgcacagtcagcagtatcatgacctcacgccacgatgtggtttacctcgatatccatgcaccaactggaaaattgacaacactactggaaaagcaaccgcatacacgaattgtagtaacggatgagcaagctagtgacgaaccactcggcgtagtgcatgttattgatatcctcaatcaacagctgactcataagtcatttgacttaaggaagctcgtgcaacagcctctgatcttccctgaatcactctccctgcttcaggcgctggagcagttccgtcaggcacagacgcacttcgcctttgttgttgatgaatttggttccgttgaaggtgtggtcacagtgactgacgtgatggaaaccattacaggcaacctgcctgcggggggtggagagatcgacgcccgccatgatattcaggtaacggaagagggatactggatcgccaatggatttatgccactggatgaccttgtgctctatgttccattgccattggatgaaaagcgcgagtaccagacactggccggcttgttgatggaagacctgcagcgtgttccacaacaaggtgagcagttacagatcggcgaatatctgtttgaaccgctcgaagtaatcagccaccgcatcaataaagtgaaaatcacgtccctgaaaacggaagaaaagatagaagcataa

SEQ ID NO: 4036 - DNA, 210 bp, Xenorhabdus bovienii
  Coding DNA location: Contig name=SeqID_16894; Position on contig =123513..123722bp; Strand=-
gtgcgtgaatttcctgtcgtggagaatggtcagtgtcaaaactacctaccacgacacacatccccttgtgatacccgtttgagttatggcgctggtttaatcagcctgcgtcataaactgggtgaatgtgtgttcgtagagacatcttgcaggcaatgtcaaatgagacattcaattgcacctgcgaagctgtccagacaaattatctaa

SEQ ID NO: 4037 - DNA, 141 bp, Xenorhabdus bovienii
  Coding DNA location: Contig name=SeqID_16894; Position on contig =123762..123902bp; Strand=-
atgcaaaatatttcgtactcatatgaaaccctcattttatcaacaataaatagacgtattgctaacccagccacaggaaattttgctgaaaagatcctggggcaatatgaaggcggtggtgacttctccgcccatgagtaa

SEQ ID NO: 4038 - DNA, 5412 bp, Xenorhabdus bovienii
  Coding DNA location: Contig name=SeqID_16894; Position on contig =123881..129292bp; Strand=+
atgagtacgaaatattttgcattactaacacatgcaggcactagtaaactggaaaatgctacgacatcggggacgaaacttgagattacccatatggccgttggtgacggcggtggcagcttacccatcccaaacgtcaatcaatccaaactgattaatgaaaaacatcgcgctgaaattgatgtactgaccattgatcccaaaaaacccaaccatattatcgccgagcaggtacttcctgagggtcaaggtggctggtggatccgtgaaatcggcctgtttgacaaggatggaacgctggttgctgtcgggaactgcgcagatctctacaagcctcaattgcaagaacagaccgttagcatggcgctacccgtcagcaactcagattggccgggctgggtaaacgagctattttctggtctggcaacacgcaattatgtgagagagaaaattaaagatcatgccgaaagccgcaatcacccagatgcaacattgaaagagaagggtcttgtcactttgagtaacgcagtagatagtgacaatgaaactcatgctgcaacatcaaaagcggtgagaacaacctatgctctggcgactaaagcctatgacttggctaatgtaaccaagcctaccgacaagtgggtacctttgacccgcaaagttaatggcaaagagctgtcatcggatatcaatattaatgcagttgatgtcggtacctataacaaggctgagattgatattcaagtcaataaagcagtagaaaccgctggcagcaaagtccccttgacccgcaaagttaatggcaaagagttgtcatccgatatcaatattaatgcagttgatgtcggtacctataacaaggctgagattgatactcaagtcaataaagcagtagaaaccgctgacagcaaggttcccttgacccgcaaagtcaatggcaaagaactgaaagaagatatcgtactcagtgcggctgatctcgatacctataagaaagatgaaattgatcataaagtcggcaaagttgaagctctggctgaaactgccaataagaatgcaacctccgcaattcaaagcgctgacagtaaagtgccattaatccgcaaggtgaatggtaaagaactgttaacagacattgaactgaccgcacttgatgtaaatgcctacaacagaccggaaaccgacgagcttatcggcatagttaaaaaacaggctgatactgctaaccaaaatgcgacggctgccctccaaagtgctgacagcaaagtccccttgacccgcaaggtaaataacaaagaactgctaactgacattgatctgaacgcggcggatgtcggtacttataacaagtcggaaattgatgctcatatcaacaaagttgagcaattggctgataccgtcaataagaatgcgacttccgctattcaaaacgctgacaacaaagtgccattaacccgcaaggtaaatggcaaagaactgttaacagatattgaactaaacgcgactgatatcggtacctataacaaggtggaaatcaatgagcatatcagcaaagttgagaagctagctgaaaccgccaaccagaatgccacgaccgcgatccaaagtgccgacagcaaagtccccttgacccgtaaagtcaatgacaaagaactgtcagtcgatattcaactggacgcggcggatgtcggtgcctacaacaaagtagaaactgacacgcatatcaatatcgtcaaaactcaggtcgataatgtcaataaattggctgaaaccgccaaccagaatgccactaccgcgattcagaatgccgacagcaaagtgccgttaacccgtaaagtcaatggcaaagaactgtcagccgatattcaattgagcgcggcggatgtcggtgcctataccaaagtagaaacggacgaccgtattagtgatgtcaaaactcaggttgataatgtcaataagctggctgaaaccgccaaccagaacgccaccaccgcgatccaaagtgctgacaacaaagtcccgttgacccgtaaagtcaatgataaagagctgtcagccgatattcaactggacgcggcggatgtcggtgcctacaacaaagtagaaactgacacgcatatcaatatcgtcaaaactcaggttgataatgtcaataagctggctgaaaccgccaaccagaacgccaccaccgcgatccaaagtgctgacaacaaagtcccgttgacccgtaaagtcaatgataaagagctgtcagccgatattcaactggacgcggcggatgtcggtgcctacaacaaagtagaaactgacacgcatatcaatatcgtcaaaactcaggttgataatgtcaataaattggctgaaaccgccaaccagaatgccaccaccgcgattcagaatgccgacagcaaagtgccgtcaacccgtaaagtcaatggcaaagaactgtcagccgatattcaactgagcgcagcggatgtcggggcctatagccagaaagaaactgacgatcatatcaatatcgtcaaaactcaggttgataatgtcaataaactggctgaaaccgccaaccagaatgccacgaccgcgatccaaagtgccgacagcaaagtgccgttaacccgtaaagtcaatgacaaagaactgtcagccgatattcaactgaatgcagcggatgtcggtgcttataccaaagaggacacagacgcccatatcaaagacgtcaaggttctggcggaaactgccaaccagaatgccaccaccgcgatccaaaatgccgacagcaaagtgccgtcaacccgtaaagtcaatggcaaagaactgtcagccgatattcaactgagcgcagcggatgtcggggcctatagccagaaagaaactgacgatcatatcaatatcgtcaaaactcaggttggtaatgtcaataaactggcggaaactgccaacctgaacgccaccaccgcgatccaaagtgccgacagtaaagtgccgtcaacccgtaaagtcaatggcaaagaactgtcagccgatattcaactgagcgcagcggatgtcggggcctatagccagaaagaaactgacgaccgtattagtgatgtcaaaactcaggttgataatgtcaataaactggctgaaaccgctaacctgaacgccacgaccgcaattcagaatgccgacagcaaagtgccattaacccgtaaagtcaatgacaaagaactgtcagccgatattaaactgaatgcggcggatatcggtgcctataccaaagtagaaactgacgatcatatcaataacgtcaaggttctggcggaaactgccaaccagaacgccaccaccgcgatccaaagtgccgacagcaaagtgccgttaacccgtaaagttaatgacaaagaactgtcagccgatattaaactgagcgcggctgatgtcaatgcctatagtcaaaaagaaactgacgaccgtattagtgacgtcaaaactcaggttggtaatgtcaataagctggcggaaaccgccaaccagaacgctaccaccgcgattcagaatgccgacaacaaagtgccattaacccgtaaagtcaatgacaaagaactgtcagccgatattaaactggacgcagcggatgtcggtgcctataacaaagtagaaactgacacgcatatcaatatcgtcaaaactcaggtcgataatgtcaataaattggctgaaaccgccaaccagaatgccacgaccgcgattcaaagtgccgacagcaaagtgccgtcaacccgtaaagtcaatggcaaagaactgtcagccgatattcaactgagcgcggcggatgtcggtgcctatagccagaaagaaactgacgatcatatcaatatcgtcaaaactcaggtcgataatgttaataaactggcggaaaccgccaaccagaacgccaccaccgcgattcaaagtgctgacagcaaagtgccattaacccgtaaagtcaatgacaaagaactgtcagtagacattaaactggtcgcagcggatgtcggggcctataccaaagaagaaactgacacgcatatcaataacgtcaaagttctggctgaaaccgccaaccagaatgccacgaccgcgatccaaagtgccgacaacaaagtaccgttaactcgcaaagtcaatggcaaagagctgttaactgacattgagctgagcgcggctgatatcggtacctataacaaaaccgaaatcgatgaacgtatcaacaaagttgacaaactggctgataccgccaatcaaaatgccatttctgccatccagaatgccgacagcaaagtgccagtaactcgcaaagtgaacggcaaggaactgttaacagatattcaactgactgcggatgatgttggtgcctataacaagaaggaaaccgatgatcgtatcaacatagttgataaactcgctgatactgccaataagaatgctatttctgccattcaaaatgttgacagcaaagtgccattaactcgcaaagtgaacggcaaagaactgtcaacagatattgaactgaccgcgattgatatcgatgtctataacaaagcagatgtcaacattcttttcgaggacgttaaagaactggcaaataatgcaaataacaatgcggataacaaagtaccattaactcgtacagtaaatggtaagtcgttgttaacagacattaaactgcaagcatctgacctcaatgtctatagcaaaggagaggttgatagccgcatcgaagatgttaaggaactggcaaatagcgcaaataataatgcggatagccgagtgccgttaactcgtacagtgaatggcaaggcgctgttatcggacattaaacttatagcatctgatgtgggcgcttatactaaagcggaaaccgatctccgtatcagtaaagttgaagacttggctaagagcgctaataataacgccagcggccgactggagaaaggccaaaacggggcggatatcccagacaagaaagcgtttgtaaaaaatcttggcctgtccgatctcattgggttaggtatagaatcccgtcgagtcggaacagatgtcaccataatcaagcttggtgatatcatcaagatcaacgggcttgcaatagctagtgaaccgattggtgaagttaattcattcgttatcggtgggattacatactatacccactactacaaaatacagctaccaaccagcttgccaaacggcataatttcatgccatgcaagtattgtcgggaataattttgataatcaacaaccgggttaccttgctgatgtaaaaacacagcgaaataatccaaatggcgtgggagtgtcgaaagatacattgacaatatctgtcacaacgccacaggttggctgggtgcctcacttcgattatcaggttatagggtattaa

SEQ ID NO: 4039 - DNA, 114 bp, Xenorhabdus bovienii
  Coding DNA location: Contig name=SeqID_16894; Position on contig =129363..129476bp; Strand=-
atgagattatggtgctggtttatttgtagggagatgcaaaggaaaatgtgcttggctggtagactgggtctaaactaccgcatattaaaggtgatcgccgaggcgatcacctga

SEQ ID NO: 4040 - DNA, 1860 bp, Xenorhabdus bovienii
  Coding DNA location: Contig name=SeqID_16894; Position on contig =129493..131352bp; Strand=-
atgaaaagattgttgacgacactcgttattttgttagtagtcattgttgctggtttagctgcgttagttgtgctgattaatccgaatgattttcgtggctacatagtcgaacaggtacaaaagaagagtggttatcatctcgtgttacaggatgatttgcgctggcatatctggccaaaactgagcattttgactgggcagatatcactgacggcacctgatgccgaaatacctgcggtggtggcagagaacatgcgtctggatgtcgaattactgccgctgttatcccaccagtttgtagtcaaaaaagtgatgctgaaaggtgcagttttgcgatttatgccggacagccagccgcagaaacaggctgaagccccgattgcgccgaaaagtgatatccaatatccggtggcagggggtcaaggttggaaactggatattgccagaatcaaggtagcggatagcttactggtctggcaaaccgatactgattcccaattaaatatccgtgatatcaatttcctgatggagcgtagggatcaggatcacgtcaatcttgaattcagcagcaagatcaataaaaaccagcaggagttggcattcgaattcaatacttctgttgatatctctgattatccgcagcgcttggcggctgatgtcagttcgctcaaatatcaactgaagggagtcgggttaccatctgagggtatcaaaggaacaggcagcgttagcttggcgtaccaatcatctccttcattcatttcgctgcaaaaactagcgttgacggtaaatgaaagcgaacttaacggcaatattgctgttaatttgcaaaataagccacaatacaccatcaacctgagttcgccaaaactgaatttagataatctgctgggatgggatgcattaccgcaaaatgatttgcaggcaaggcatgattatcgaattgaaaacagtttattgaaaccggtgattgcgacgtctgtttcaccgttatcaaattatgatctgagtttactgaaggcatttgaggccaatctttcgtttgtggcagataagtttatttatcagggcatggatattgataattttgccttgaaagccgtcaataatgatggaatggcagaaatcttgaaattaagcggcgatgtatttggtgggcattttgcgctccccacgacgattgatgccacggttaacccagctaaattacatactaaaccgctattgcaaaatatagagctgaaaccactgttgacggctctggctctgccaccggtattcagtgggcaacttgagctggatggtgatcttctgggggaaggctatgacgaatatgctattacccattactggcagggtgatctgaatattggcctggaaaatgcgcgtttggagggattgaacattcctcagcttattcagcagtctttttcgagggcgactgatcaagttaatcagccagagaatactgatgattttaccgaagcaaaaaatatgtctgtcagagcgcaactgaatcaaggtgagcttaaggttgataacctctctgcgatatcgggcatgttaaatatcacagggcagggcaaggcgaatttgctgaaacaaaacaccgatatgtcgttgtgggtgcaattgacaggcggctggggaaaacaaaacgaatttgtgcgtaagctacagaaattaaaagtgcccctgcgggtttatggtaattgggataacctgcaatataagctcaatgttgaagcattgctgagtgatgaattacaggaaaaagccaaacaatccatcagaaattggattgaacagaatagtcgtgctgaagatcgtaaggaatttgagaatttgttgaataaatga

SEQ ID NO: 4041 - DNA, 582 bp, Xenorhabdus bovienii
  Coding DNA location: Contig name=SeqID_16894; Position on contig =131402..131983bp; Strand=-
atgcgactctgtgaccgtgacattattaaatggcttgatgaaggtaaactggtaattaccccgcgtccccctatcgaacgtataaatggggcaactgctgatgtgcgccttgggaatcagtttcgcgtttttcgtggtcatactgctgcctacattgatttgagtggccccaaagctgaggtcaatgcagcacttgatcgtgtcatgagcgatgaaatcgttttgccggagggagaagttttcttcctccatcccggcgaactggcactggcggtaacgctggaatcggtcacactgcccgataatttggttggctggctggatgggcgttcatctcttgcccgcctcggcctgatggtacatgtcactgcccaccggattgatccaggctggcatggtcaaattgttttggaattttataactcaggcaaattacctttggcgttgcgcccaggcatggtgattggggcgctgagctttgaacccctttcgggttcagctgaccgcccttacaaccgacgtcaggatgccaagtacaaaaatcagcagggagctgtaggcagccgaattagtgaggactaa

SEQ ID NO: 4042 - DNA, 642 bp, Xenorhabdus bovienii
  Coding DNA location: Contig name=SeqID_16894; Position on contig =132031..132672bp; Strand=-
atggctgatgaagcacataagtgtacaatcgtaggtattgcaggtgcctctgcctcaggcaaaagtcttattgccagtacactttatagagaattacgggctcaggttggtgatcacaatatcggtgttattccagaagattgctattataaagaccaaaaaaacactcctctggaagaacgttataaagttaattacgatcatccaagttcaatggatcacagtttactgttcgaacatatccaagcattgaaagccggaaaatccattgaattgcctcaatatgactatgttgctcatacccgcaaaaccgaatccatccattttgaaccaaaacgcgtcatcatccttgaaggtatcctactattaacggataagcgtttgcgtcaggaaatggatttctctatttttgtagatacaccattggatatctgcctgatgcgccgcattaagcgtgatgtgaatgagcgtggacgtacattggattctgtcatcgaacagtataagaaaaccgttcgtccaatgttcctgcaatttatcgagccatcaaaacaatatgccgatattattgttccccgtggtgggaagaaccgcgtggctatcgacatattgaaagccaagattggccaattttacgaataa

SEQ ID NO: 4043 - DNA, 225 bp, Xenorhabdus bovienii
  Coding DNA location: Contig name=SeqID_16894; Position on contig =132911..133135bp; Strand=-
gtgacattgccgccaatatctctgctcagatgtactggcagggagagaaaattcctacggaaatttctttccgcgcagtttgagttaggcaatttcgtgtcgatatgcgacggaacgttgttgattagtaacagttattgtaatccctcgctacgaatacggtataagtatttacatccgtattttagtgtgattttgttggtattgtcgctatctggcctgtga

SEQ ID NO: 4044 - DNA, 1113 bp, Xenorhabdus bovienii
  Coding DNA location: Contig name=SeqID_16894; Position on contig =133053..134165bp; Strand=-
atgaactcacaatcccccgagcagaccagtcctgacctgctgaaagaacacgttgtgaaaatactggcaacgttcaagcatccgactttagagcgagacttgatagctctgaaagcattgcatcattgcgccatgcttgatggggtactgcatattgaattaatgatgccgttcgtctggaagcgtgcttttgcaaaactgaaggaagaaacgactcaatctttgcaaacggctacgggagcaaaatctgttgactggcggcttacccatgatatctgtactctgcgccgtgccaataatctgcagggcgtcaacggtgtccgcaatattctggcggtcagctcagggaaaggcggtgtggggaaatccagcacggcggtgaatctggcgctggcgctggcgcaggaaggggcaaaggtgggtattctggatgcggatatttatggtccgtccgtgcccaatatgcttggcacagctcaagaacgcccaacctcacctgacggtcagcacatggcgccgattatggtgcacggcatggcgacgaattccatcggctatcttgtcacagatgacaacgcgatgatctggcgcgggccaatggcgagcaaggctctgatgcagatgttacaggatacactgtggccggatctggattatctggtcatcgatatgccgccgggaacaggggatattcagttaacgttgtcccagaatattccggtgactggcgcgttggttattacaacgccgcaggatattgctctgctcgatgcgataaaaggcatcgccatgttccagaaagtcaatgtgccagtattgggcattattgaaaacatgagcatccacatatgcagcaactgtggccatcaggagccgatttttggtacgggtggtgcagagaaactggcggaaaaataccattgtcaactgttggggcagattccgttgcatatctcactgcgtgaagatcttgatcgcggcgaaccgaccgttatcagccagcctggcagtgaattggcagatatttaccgtgacattgccgccaatatctctgctcagatgtactggcagggagagaaaattcctacggaaatttctttccgcgcagtttga

SEQ ID NO: 4045 - DNA, 222 bp, Xenorhabdus bovienii
  Coding DNA location: Contig name=SeqID_16894; Position on contig =134089..134310bp; Strand=+
ttgaacgttgccagtattttcacaacgtgttctttcagcaggtcaggactggtctgctcgggggattgtgagttcatcccggctccttttgatttgtctttttttaaccgaaaaccgtttgtccatcatagcagaagcgggcggtttgggataagaccaaaattgaaatcgacgccgaatagcgccttaaataaaagtaacgaagatcttgcgttaccctag

SEQ ID NO: 4046 - DNA, 132 bp, Xenorhabdus bovienii
  Coding DNA location: Contig name=SeqID_16894; Position on contig =134297..134428bp; Strand=+
ttgcgttaccctagcgacaatgttcttgatcaggtaacatcaaaagcccttttcaatatacggaagtcagatcctaactatgtctcaagtcgcgaacaaattattggtgacctgtgcgttgccttatgctaa

SEQ ID NO: 4047 - DNA, 2028 bp, Xenorhabdus bovienii
  Coding DNA location: Contig name=SeqID_16894; Position on contig =134376..136403bp; Strand=+
atgtctcaagtcgcgaacaaattattggtgacctgtgcgttgccttatgctaacggtcccattcatctcggtcatatcctagaacacattcaggctgatatttgggttcgttatcatcgaatgcgcggcaaagaggttcactttatctgcgctgatgatgcccacggcacgccaattatgctgaaagcccagcagagtgggatctcgccagaagaaatgattaccaaagtgagcctagagcatcagcaggattttgccggctttgccatcagctacgataactaccactctacgcacagcgaagagaataaagagcttgccaccaaaatttatctggaactgaaaaagaacggtcacatcaagaaccggaagatttctcaactgtacgatccagaaaaaggcatgttcctgccagaccgtttcgtcaaaggtgcctgcccgaaatgtaaggccgaagatcagtatggcgataactgtgaagtctgcggaaccacttacagcccaacggaattgattaatcctcgttcggcagtatccggtgcgacgccagaaatgcgcgatacggagcacttcttctttgatctacctgctttcagcgacatgctgcaaaaatggacgcgttccggcagcttgcaagagcaagtcgcaaacaaaatgcaggaatggtttgactcaggtctgcaacagtgggatatcacccgtgatgcaccttacttcggtttcgaaattcctgacgaaccaggcaaatttttctatgtctggctggatgcgccaattggttacatggggtcgttccaaaacctgtgcagcaaacgtgatgacctgaatttcgacgaattttggtcgaaagattccgaagccgatctctaccacttcatcggtaaagatatcgtttatttccatagcctgttctggccagccatgttggaaggcagcaactatcgcaagccgaccaatctgttcgttcacggctatatcacggttaacggcacgaagatgtccaagtcgcgcgggacgtttatcaaggctgaaacgtacctgaagcaccttgatgcagattgcctgcgttattactatgctgcgaagctctcctcccgtattgatgacatcgatctcaatctggaagatttcattcagcgcgttaacagcgatatcgtgaacaaagtagttaaccttgcttcacgtaacgcaggttttatcaataaacgttttgcgggcaaattggctgaccaacttgctgatcctgctctgtaccagcaatttgttgatgcggctgaaggtattgcagaagatttcaccaaccgtgaattcagcaaagctatccgtgaaatcatggcactagccgatttggcaaaccgctacgttgacgaacaggcaccgtgggttgttgccaagcaagaaggtcgggatgccgatctgcaagccatctgctcaatgggtatcaacctgttccgcgttctgatgacttacctgaaaccggttcttccaagcctgactgaccgtacagaagcgttcttgaataccgaactgacttgggatggcatccgacaaccattgcttaaccatgaagtttcaccatttaaggcactatttaaccgtatcgagatggcaaaagttgacgctatggtggctgactccaaagaaagcatcgagccacaaaaaaccctgacaggcccactggccgatgatcccattcaggacaccatcgcatttgatgattttgccaaggttgacctgcgtatcgcactgatcaagcaagctgattttgtcgaaggttcagataagctgctgaaactgacccttgatcttggtagtgaaacgcgtcaagtcttctccggtatccgttcagcctatccagatccaaaagcgctggagaaccgtctgacagtgatggtagccaacctcgcaccacgtaagatgcgttttggcatttctgaaggcatggtaatggcggctggccctggcggaaaagagattttcctgttaagcccagacagcggtgcacagccgggaatgcaggttaaataa

SEQ ID NO: 4048 - DNA, 450 bp, Xenorhabdus bovienii
  Coding DNA location: Contig name=SeqID_16894; Position on contig =136541..136990bp; Strand=+
atgtttatgtctttccgaaacatgctggtgataggctggcaatacctgcgtgcattcgtgctgctctatttgtgcctcatcgcaggaaatatcatttcagcactacttcccttctctctccccggcagcattattggcttacttcttctgttttgtttacttgcattccagcttattcctgcatattgggtgaaaccgggctgtagcctgttgatgaaaaacatgacattgctgtttttacctatcggggtgggtgttatggattattacccgcaacttagccagcaaatgttcccgattgttctctcctgtatcgtcagtacagtaattgtcatgattgtcgttgcttacagttcccattatgtccatcgcgaacgcatcattattggcgctcaacgaaaagaacccgatctcagctccccgccatcacaacaatcggacaaaagataa

SEQ ID NO: 4049 - DNA, 696 bp, Xenorhabdus bovienii
  Coding DNA location: Contig name=SeqID_16894; Position on contig =136993..137688bp; Strand=+
atgttaagccatatctggtggtcactgccattaacactgctcgtattttattgcgccaaaaaattgtcacggcaactcaaacttcccatctttaacccattgttgctatcgatggccgttatcattcctttgctactgatgactcacaccccctatgagcactattttaccggtagcaggatcttaaacgacttactgcaacccgccgttgtcgcattggccttccctctttatgagcagctccatcaaatccgcgctcaatggaaatccattattagcatctgttttatcggtagtattgtcgcgatggtgacaggtacagctatcgcgttatgggcgggagccagccctgagatcgctgcctctgtgctgcccaaatccgtcacaacaccaattgccatggccgttgcggattccgttggcggaattccggctatcagtgcagcctgcgtaattactgtcggtattttgggcgcgatctttggtcataatttgttcaatcttctagaaataaaaacgtcggcttcaagaggattagccatgggaacggcatcccacgccgtgggtactgcacgctgtgccgaactcgatcatattgaaggtgcatacagttctttggcgctgatgacctgcggcattatcacctcattaatggcaccttttttatttcctgtactgcttcatctatttggctaa

SEQ ID NO: 4050 - DNA, 885 bp, Xenorhabdus bovienii
  Coding DNA location: Contig name=SeqID_16894; Position on contig =137872..138756bp; Strand=+
atgcaagctcgttttcacgctatttggtcagaaattacccctaaactgcaagaagccctgttaccctatatcggcaatgacgattttccagcgatgctgaccgcagagcaggttgaatcaatcaggcaaatctgcggttttgatgatcatgcgctggcacttgctctattaccacttgcagcggcctgtgccattacacctatctcgcatttttacgtcggggcaatcgcacggggagaaagtggcaacctttattttggtgccaacatggaatttgctggagtccccttgcagcaaaccgttcatgccgagcaatcagccatcacccatgcttggctgcgcggtgaaaaaaagctggtttccatcaccgtcaattattcgccttgtgggcactgccgccagttcatgaatgaattgaacagtggaacacaattggaagtctgtttacccaaccgcccacgattgacgctggctgactacctgccggaagccttcggcccacgcgatttgctggacgcaccattactgctggataccgtcaatcacggctaccaattggatacctgtgacgcattagtgctggcagcactggatgcagcaaaccaaagtcatgctccttacagccaatcccatgccggtatcgcgctgctggatgaacaagatcaggtttataccggccgctatgcggaaaatgccgcatttaacccaagcctaccacctttacaggcagccctgatcttaatgaatatgtctggtggcaattgtcagtccatcaaacgggcaatactagtggaaggaaaaaatagccatctatcccaatcaaacgcgaccgaatccacattaactgccctcggttgcaccaaaatagaatgccatagattttga

SEQ ID NO: 4051 - DNA, 246 bp, Xenorhabdus bovienii
  Coding DNA location: Contig name=SeqID_16894; Position on contig =138636..138881bp; Strand=-
atgagttttttcgattttaccccctccgagcgatccagaggggaattttgccattttgttaagttatctttatttcatgtttgcccgaattttttgctgaattgttgtttttttgagatgggtagtcaaaatctatggcattctattttggtgcaaccgagggcagttaatgtggattcggtcgcgtttgattgggatagatggctattttttccttccactagtattgcccgtttgatggactga

SEQ ID NO: 4052 - DNA, 1698 bp, Xenorhabdus bovienii
  Coding DNA location: Contig name=SeqID_16894; Position on contig =139027..140724bp; Strand=+
atggaactggaacacgaaagtaaacgtcctctctatattccctacgccggccctatcttgttggaatttcctcttctgaataaaggcagtgcctttactgaagaagaacgcagcaatttcaacttacatggtttattacctcagatagttgaaacgatagaagaacaagccgagcgtgcctaccgtcaattttgcgattttaaaagtgacggtgacaaacacatttatttaagaaatattcaggacaccaacgaaaccctgttctatcggcttcttgatgcccatctcagcgaaatgatgcctatcatctacacccctacggtgggtgaagcatgtgaacacttctctgatatttatcgccgcgcccgtgggctgtttatttcctatccaaacaaagcgtctatcgatgacatgctgcaaaatgccaccaagcagaatgtcaaagtcatcgttgttaccgatggtgaacgtatccttggtctgggagatcagggcattggcggcatgggtattcctatcggtaaactctcgctgtatacctcttgtggtgggatcagcccagcttacaccctgccagttgtactggatgttggtacaaacaacccgcagcgtctgaatgacccactgtatatgggctggcgtcacccacgcattaccggcaaagaatatgatgaatttgtcggtgaatttatccaggctgtgaaacgccgctggccaaacgtgctgctgcaatttgaagattttgcccaaaccaacgccatgccgctgttgacacgctatcgtcatgatctttgctgtttcaatgatgatattcaaggcacggcagccgttgccctcggcagcctggttgccgccagccgcgccgctggccgccagttgagagatcaaaccgtgaccttcctcggagcaggttctgccggttgtggtattgccgaacagatcgtcgctcagatgaaatctgaaggattgagcgatgaacaggcccgcgcccgcgtgttcatggttgatcgctttgggctgctgactgataaacagccaaacctactggacttccagagtgtactggtacagaaaagcagcgtcctgcaatcatgggatgtcagcaatgacagcctttcactgatggatgtggttcgcaatgccaaacctaccgttttgattggtgtttccggccaatcgggtctgttcacggaagagattatccgtgaaatgcacaaacattgtgagcgtccaatcgtcatgccactgtccaacccgacatcacgtgtggaagcgcgtcctgaagacatcattaactggacagatggcaaagcgctggtcgcgactggcagcccatttgcccctgtgaagtatgatgggcaagaatacccaatcgcacagtgcaacaactcctatatcttcccgggcatcggtttgggcgtcattgcttccggcgccagacgtgttacggatgatatgttgatggtagccagccgcgcattggcggattgttcaccgttggcacagacgggttcaggtccattactgccaccgattgatgatattcaaaacgtttcccgcaaaatagctaaagaagtggcgaaaaaagcccagattcaaggcatggctaccgtcacgtcagaagatgcgctagaacaagccattgagcgcaatttctggaaaccagaatatcgcgtctataaacgcacttcattctga

SEQ ID NO: 4053 - DNA, 147 bp, Xenorhabdus bovienii
  Coding DNA location: Contig name=SeqID_16894; Position on contig =140669..140815bp; Strand=+
ttgagcgcaatttctggaaaccagaatatcgcgtctataaacgcacttcattctgatctaagacctgctaagatcagctacaagcctgtcagcaccgttggcaggcttttattacagtccgaaaacttgcttcaatatttcaagtaa

SEQ ID NO: 4054 - DNA, 720 bp, Xenorhabdus bovienii
  Coding DNA location: Contig name=SeqID_16894; Position on contig =140867..141586bp; Strand=+
atgtggaaacgcctgattaccgggttggttttcatcatggctgttctaatgctaacagtcattatgcttgaccgctggattagctggaaaaccgccccctatatttatgatgacctcagccagcttcctgaacgagaagtcggtatggtactcggcacgtccaaatattacacatccggcgcctataaccagtactatttctaccgtattcaaggggctgctaacgcctacaacagcgggaaggtgaattacctgttactgagcggagataacgcccaactcagctataacgaacccattacaatgcagaaagattttatcaaggcgggaattccggcttccaaagtgataatggattttgctggctttaggacgttggattccattgtcagaacgcgtaaggtctttaatgccaacaattttactattattactcagcgtttccactgtgaacgcgccctgtttattgccatgcatatgggcatagacgcacaatgttatgccgtctcttctcccaaaaatatgatgatcatacgtttcagggaagtatttgcacgcctcggagccttggctgacctctatattttgaaacgcgaacctcgctttttaggcccattaacaccgattcccagcgaaactgtcatcccaacaggtattgaaggctatcctgccgtatcgccaggagagttacaggaattggggaaaaagcctcgcagttaa

SEQ ID NO: 4055 - DNA, 1152 bp, Xenorhabdus bovienii
  Coding DNA location: Contig name=SeqID_16894; Position on contig =141638..142789bp; Strand=-
atggaaaatagtgaggtaatgggtcagcggattgaggcaattgatagtgtgcgtggtttcgctattctgggaatattaattttgaatattttcagttttgccttgccatatgccgcttctatgaatcttttttataaagattcgatctcattttctgatgtgatgacatggtctgtcctgagtttttttactcagggaaaatttttattcattttaaccttgttatttggtgcttcacttgaattactgtggcagcgggggagtgaatggaatattcccagactgattattctggctgttattggcttgttgcacggtatcttgctgtgggatggtgatattttactgttatatggcattgccggtcttttggcatggcactttatccatactcgccatagattgtttggtaaaggaattattttttatctgtttggtttgatgatgttttatcttctggggttgtttccagtgggagaaaatagtgccttctggcagccaacaccgcaggatatatttcatgaaagtcattggaaaacccagggtgggttattggctatcgagcatcgttttcgtcaggtaagtggcatgatgatagtggttatcgtgcaatatggctggcaaatggttgggacgatgctctgtggggcgatgttgctgcgcaatggctggctgaaaggggagtttagcctcagtcattaccgcagggtggcattatggctacttccgttgggtatggtcattcaggttattgctctgtcaatacagtgtttatatcccttcagctattttgcctcatggacgattcgtcatactatctccgaactggcgacgcccttgctggcattggcttatatcgcgttgatttatggtttttggccaatcatttcccattggcgagtgaatttctggttacgacaagttggcagaatggcgctgaccagttacttgctgcaaactttgatttgtaccacgattttttatcgttggggattgtttgatcagtttactcgtttggaattgctggtgtttatcccgttgatctgggccttcaatatctggtttgcctgctggtggttaaaacgttatcagcaagggccgattgaaaagctctggcgtgatttaaccagaaaactggctggcagggtttaa

SEQ ID NO: 4056 - DNA, 669 bp, Xenorhabdus bovienii
  Coding DNA location: Contig name=SeqID_16894; Position on contig =142805..143473bp; Strand=-
atgtcatccctaagtacagaagctgcgctggtgcactcggcactggtctcccgtggccttgaaaccccattgcgtgaacaaactctggaaccagaagtgcgtaaggtacggattcaggaacacatgacagaaattatgaaactgttaaatctcgatttgagtgatgacagtctggcggatacgccgagtcgtattgcgaaaatgtatgtagatgaaatattttcaggattggattacaacaactttccgaaaatcaccttgatagaaaataaaatgaaagtagatgagatggtaacggtgcgggatatcacgctgaccagcacctgtgaacaccatttcgtcactatcgatggcaaagccacggttgcttatatccctaaggataaggtgattggcctgtcgaaaattaatcggatcgtgcaattttttgcgcagcgcccacaggtgcaggagcggttgacacagcagatcctgattgcactgcaaacgctgctcggtacaaataacgttgccatttccattgatgctgttcattactgcgtgaaagcccgtggcatccgcgatgcgaccagcacgacgacgacaacttctctcggcggtttgtttaaatctagtcagaatacacgacaggaatttctgcgtgccgtgcgtcacctgcacttatcatga

SEQ ID NO: 4057 - DNA, 111 bp, Xenorhabdus bovienii
  Coding DNA location: Contig name=SeqID_16894; Position on contig =143594..143704bp; Strand=+
atgatatccactcgcgtggtatgtacttacattgtatctgtgtacaactatctctgcacgctatcaatacgcccgatctggattactccttatgattctgattgcgcttga

SEQ ID NO: 4058 - DNA, 1179 bp, Xenorhabdus bovienii
  Coding DNA location: Contig name=SeqID_16894; Position on contig =143676..144854bp; Strand=-
atgagaaatcaaatcatcacttctggccgtcgtcattatcaagccttccaaattgcattgagcggttttctcgctttagttgttgcaatgggaataggacgcttcacttttactccacaagttccgctgatgatcgctgaatcccaatttacactgacgggagcgggaattgttgctgcatttaattaccttggttatctggctggctcttatgatgcgatgcgagcacagcgattcgtggaataccgcctgtggagtgggctgtggggggcggtgatgatcacgttgctttcggcactgctggatgggccaatattgcatagtattgctcgtttctttattggctgggcgagtggttggacgttggtattggtcgctgcatgggcgaacgatgaactggcaaaactgcatcggccgggattgagtgccgctgtctttgccggaaccggaatagggattttaatcagtggtgtgctggctgttgctattcaatcttgggagatgagtgcagccaacgcttgggtgatttatggcatgttggcgttgttatgcagtatctatgtcagccgctatctgcctcgtcgtggtgaactgcaccgcccacagactaacatccaaaaacttactctgacaccggaaatcaaacggttgatatggagctacagtctggcagggtttggctatatcctacccgccacattcctttctcagatggcaacagagcgttttcctgacagcctgtttgcacaatttgtctggccgatatttggtggtgcttctgcacttggcatcgtactgggaattttgttgagctgggtatcgactgctcgcatccgtctggcgataactttatggcttcaggcgattggcatattgattgcagaagtgctgcagggtattggaggcctcttgattggggcattgctggttggtggtgggtttatgtgtgttgtacaactggccttgttgtatgggcgtgaattagcgccgaatcaggctcgttatatggcggggttgctgaccacgggttatgcgttgggacaattagtcgggccagtgctgtcggctatttcgacgtggctgacgggcaagttggagcctgctttgtatatcggatttatttgtttggtcgttgctggattactgctattcaagcgcaatcagaatcataaggagtaa

SEQ ID NO: 4059 - DNA, 1338 bp, Xenorhabdus bovienii
  Coding DNA location: Contig name=SeqID_16894; Position on contig =144962..146299bp; Strand=+
atgacaacaattctccatcaaagcgatctttgccataatgcggccagcacaggaataaacgtttatccgctatcggcggcatattgggagttctttatggatcattgtcatacctcaggcttaatctcgctcgaacaagcgctggaaaaactattggcacaagctgttgccctgactcacacagagaccatcagcctgatgcaagccgctggccggatcaccgctacagatattatttcgccaatcaacgttccctctttcgataactcagcaatggatggttatgctgttcgtcttgccgatctaaacggaaatcaggctttgccaatagcaggcaaggcattcgctggtgcgccgtttcaaggagaatggcttgccggcagttgcatccgtatcatgactggcgctcccattcccgcgggtgccgatgcggtgataatgcaggaacaggctgaagttacagaagcaggtattcgattcccctatcccgctcaaccagggcagaatattcgtaccattggagaagatatcgctcagaatgcggtcgtattgccaaaaggaaccaaactatccacagcacagttgccggtgatcgcctctctgggcattgcaaaggttaaggttattcgcaggttgaaggttgccattttttctacaggtgacgaattacaggcgattggtgagccattacaggcaggtcaaatttacgacactaaccgttttgctgtgcgcctgatgctggaaaaactagactgtgaggtaatcgatctcggtgtgatttccgatgatcctgacgcattgcgcgatgcctttgccaaagccgataaacaagcagatttagtgattagcagtggcggggtttctgtcggtgaagccgattacaccaaagcgattctggaagaagttggcaaaatcaatttctggaaactggcgattaagcccggcaagccttttgcgtttggcaaattggaaaacgcgtggttctgtggtttaccgggaaatcctgtctcagccgtgctgactttttatcaactggtacaaccgctgattgcccgtctgtcaggttttacagcatggcaagcgccaatgcgcctcaatgctaaggccatcacaccactgaaaaagtccccaggcaggctggatttccaacgcggcaacgcttccattaatgaacatggcgaattagaagtacaaaccaccgggcatcagggttcccacattttcagctcatatagcctcggtaattgctttattgtgctggaacgagagcgtgggcacattacggcgggtgaaacagtgcaaatcgaatttttcaaccacttactgaaaaaccaataa

SEQ ID NO: 4060 - DNA, 753 bp, Xenorhabdus bovienii
  Coding DNA location: Contig name=SeqID_16894; Position on contig =146314..147066bp; Strand=+
atggctatcgagctcaccgatgaagaaaccctgcgctacaatcggcagattgttctgcgtaatttcgattttgacgggcaggaaaagttaaaatcagccaaggtgttgattgttggtatgggcggtctcggctgtgcctcctcccagtatcttacttcggctggcgttgggacaatcaccctgctggattttgatgccgtttccctctccaacctgcaacgacaaatccttcatcgcgatgagcgcatcggtatgcccaaagtgcattcggccgcccagacactgcgggaaataaacccgcacgtcaccttacatcccattgagggattattggatgatccatcactggatgaattgattggccgacatgatcttattctggattgtacggataacgttgccattcgcgaacagctcaaccgcctgtgttacgggcgtaaagttcccttggtttccggtgctgctattcgcatggaagggcaactggccgtgtttacttatcaaccggatgaaccctgttatcgctgcttgagccgattatttggtgaaaacagcctgacctgtgttgaagcgggcgtgatggcgccactggtgggaattatcggctccctgcaagcgatggaagcgattaaattactgactcaatacgggaaagtcagccgtggcaaagtgttattgttcgatgccatgaccctgcaatttcgtgagatcaggctgcctaaagatcctcagtgtgaggtttgccagagctaa

SEQ ID NO: 4061 - DNA, 198 bp, Xenorhabdus bovienii
  Coding DNA location: Contig name=SeqID_16894; Position on contig =147054..147251bp; Strand=+
ttgccagagctaattttaacaacaaaccctattctatactcactgcctttcctacctgaaaaaacgcgggttaaggggaataaaaatattgatgatgatttgataacgttatctgatgaagatcaaatttctttacccgaatactcatgtgatgaccacatacagacattactcccttcttttatattccttccttag

SEQ ID NO: 4062 - DNA, 105 bp, Xenorhabdus bovienii
  Coding DNA location: Contig name=SeqID_16894; Position on contig =147169..147273bp; Strand=+
atgaagatcaaatttctttacccgaatactcatgtgatgaccacatacagacattactcccttcttttatattccttccttagaatcgtattcgagctatggtga

SEQ ID NO: 4063 - DNA, 654 bp, Xenorhabdus bovienii
  Coding DNA location: Contig name=SeqID_16894; Position on contig =147366..148019bp; Strand=+
atgcaagaactgaatggtaaaaaatcaactgaagctgatgccttgttatccaacattgctaaaaatattgattttttgatgaaaaataacaacatagactcacagactctgagcagattaacaggtctcggaattgcgactatcaacagcctcagacgtggagttggaaaccccactattgctactgtttcatcaattgcagatgtatttggtgtcaatgtgggtgaaattaccgacgggaaattatctgaatcaaatggaaatgaagaaattatctcctcagtacctctggttaggtatgatgaattggatggttacgtatctggcaaaataatcaccaaaaatttatataagctcagtattcaggataatcatgaagattctctttttgccgtagaatttggaaataaccttttatttccctattttgacagcaacaccatcgcaatagtttctaaaaccgaggcagtttgtgacagtgatgtcgttctcgtaaaaattaaagatgctcccatttgttttagacaagtttttgtcggcgaaagtggaatttacttttcaatattaggcattgagaacgaacggaaaacggttttaacgcaaaattacacaataattggagttgtgattaggtcgattagaaacttaaaatag

SEQ ID NO: 4064 - DNA, 483 bp, Xenorhabdus bovienii
  Coding DNA location: Contig name=SeqID_16894; Position on contig =148029..148511bp; Strand=+
gtgggtaaaataataagttttctcaaaaaaatattcgaaactcgttatatatacagtttacaaaaattcgaacccataaaggaaaacggattttatatcttgaaagagctaggcacccatacatgcataaaagcaaaagcagaagatatttttgacggcgatttattatacaatatcaatcctcaagatattatattcatagcaaggttcgaagaatatgatatgagagaaaaacaaaaattcaaaataatagaggaaaggagagatctttcatttatcatacagaatgcgtattctcgcagacaaattcatgggaaagaactgcttatagaacagaatatagtagaaaaaatagatccgacgagccttgtgagaatagcctatatgtcaggattaaaagatggaaggaaaatttctgacgatatctcaaaagctgaaaaaataaaaccctctaaatccccaaatttaaaggtaataaaatga

SEQ ID NO: 4065 - DNA, 699 bp, Xenorhabdus bovienii
  Coding DNA location: Contig name=SeqID_16894; Position on contig =148508..149206bp; Strand=+
atgactcagaattatcccactcattcaaggtttaagtatgattcgttgtttatttctctatctgtaacaataatgataacttgtgatgttcttgtatataaaacactagacttttatgattttaaaattacatttagtggaattttgttctcgttctactttcttatatccacgattcagacggaggtttatggatacagacaaggcgtaaaaacggtctggatcatggtgttatgccaatcaatctttgtcatggttatctttgtagcgtcgcatatgcaacccgaaaacaatcaaatatcaatgaactttaagtcattattcggagaattttggcgtgttatggtagggacatggacttctgtacccatttcttactttattaacggatttgttatatccagcctgaaaaaagtctttcttggcaggttctttttcatcaggtatctcattgcctcgatgacgactcaggcggctcttctgttatcagcttatcctataagcctctcttcaaaatataatttcaatgaattaataacaataatcacaacaacatggtcttacaaagtcgtaatgtccattattcttctgcctatagggatcatcttagcggataagataaaaaaattagagtcggctgatgtatatgattggggcatatcatacaatccatttttcctcagaggtaataaaaaatga

SEQ ID NO: 4066 - DNA, 744 bp, Xenorhabdus bovienii
  Coding DNA location: Contig name=SeqID_16894; Position on contig =149203..149946bp; Strand=+
atgaaagttgttaatttgacagacatacacctgaccagaaacagagataaaaaactatttgatgtaaatccttatgataactttgattttgtttgtgaggaaatacgtagaatacagaatcttactgggatagagttaattatcgtatccggtgatattgcaaatgacggtgatattgacgcctacagatattttttaaatagaatggagtcactaaaaataccttatatttccatactcggcaatcatgatctcaataaaaactttgaaatagcactggcggaagaaaaaccaaaatacattattacctcccgtgaatataataacaataattggtatatgacttccgtcgacactgtcgttgaaggagaagattatggttttataactcaagataaccttgctgaattagaaagaaaaattatcacaaacagcaattttaatatcgccatatttatgcatcatcatgccatgccggttggtacgccaattgtagatagctgcatgctgaacaatgccaaagcagtattggaactttgtgagaaacataaggttaaatttattggtagcggtcatgcgcacacaccacgcatttggcatcataataatatgacagcatgtgtttctcctgctgtttcatttcaatggttatcaggcaccgatacagtgaaaatatcaaaaggctttggctttaatgttatagattttgtgccagatttatctataacgtcatgtatttattaa

SEQ ID NO: 4067 - DNA, 1653 bp, Xenorhabdus bovienii
  Coding DNA location: Contig name=SeqID_16894; Position on contig =150126..151778bp; Strand=-
atgcgcgactatcgattttttccaaattcccttttatccactttaagagcaaaagttgtgttaagtacaaacaacatcaccatgcagtttggcagtaagccactatttgaaaacatttctgccaaattcggcaacggcaatcgttatggtctgattggcgcgaatggggcgggtaagtctacttttatgaaaatcctgggtggagatttaacgccaaccgccggtaatgtcagtcttgatcccaatgagcggttgggtaagctgcgtcaggatcagttcgctttcgaaacctacacggtgctggatacggtcatcatggggcacgcggaactgtgggaagtgaaacaggaacgtgaccgcatttatgccttggcagaaatgagcgaagaagatggctatcgtgtggctgatctggaggttgcctacggtgaaatggatggctatagtgcagaggcacgtgcgggagaattgctgctcggtgtcggtatccctgtggatcagcattatggtttgatgaacgcggtggcaccgggttggaaattgcgtgtcttgctggcacaggcactgttttctaatcctgatgttctgttgctcgatgagccaaccaacaacttggatatcaatactatccgctggctggaacaagtgctcaacgaacgcaacagcaccatgattattatttcccatgaccgccatttcctgaatatggtctgtacccacatggcagatctggattatggcgcattgcgtctgttcccggggaactatgatgaatacatgactgcggcgacgcaggctcgtgaacgtcagttggcagacaacgccaagaaaaaggcacagattgccgatttacagtcatttgttagtcgtttcagtgccaatgcgtctaagtctaagcaggcaacgtcccgtgctcgtcagattgacaaaatccagttagaagaagtgaaagcttccagccgtcaaaacccatatatccgctttgagcaggagaaaaaactgttccgtaatgcgctagagttggaaagtgtaaccaagggctatgataacgaaccactgtttaagaacctgaacctgctgatggaagttggcgaaaaaatggcggttattggtgaaaacggcatcggtaaaactacgctgctgaaaacgctggtaggtgaagcagagccgagcagcggtacgatcaaatggtctgaaaataatacgattggctattatgcgcaggatcacgctagcgattttgactgcgatctgacggtatttgaatggatgagtcagtggaagcgcgaaggagacgatgagcaggccgtgcgtggtgcgctgggacgcttgttgtttggccaggatgacatcaagaagaaggtcaaggtactgtccggtggtgaacaaggacggatgctgttcggtaagctgatgatgcacaaaccgaatattctgattatggatgagccaaccaaccatctggatatggaatccatcgaatcccttaaccttgcgctggaactctaccaaggtacgttgattttcgtttcccatgaccgttcatttgttagctcattagcaagccgtattttagaaattaaatccgacaaagtggttgatttcagaggtacttatgatgagtatctgagaagccagggaattgctgagtaa

SEQ ID NO: 4068 - DNA, 282 bp, Xenorhabdus bovienii
  Coding DNA location: Contig name=SeqID_16894; Position on contig =151727..152008bp; Strand=+
ttgctcttaaagtggataaaagggaatttggaaaaaatcgatagtcgcgcattatgccacaacaagaaaaaagtatcgccagaatacctcgacctctatctcaaaaaccaaaacacagaccccgttcacataaaaaagataaataaaattttcttatggaatagactatatagtatcgtcatgaaatttgcagccaaagcgcgagacaacggatctgaactgcggcgaggaaagactgactgtttttcgcatatcgcgttgctataccacgccagcgtttaa

SEQ ID NO: 4069 - DNA, 315 bp, Xenorhabdus bovienii
  Coding DNA location: Contig name=SeqID_16894; Position on contig =152018..152332bp; Strand=+
atgcattttcaaccaaatgccaatatcggtagagttccctgtcatattcccgttttatccggcgattttttcggctgggtatttgaacctgcattccttgatgttcagcttgctccacaatggtgttactgtcatagcctctatccgctaacaaatgttcggcttccattcccgcaattaaggcctccgcttgtgagcaatccgctaatccgctgcggtaccgcttgtaataagtactctgagcggcataccatgcgcatccacggccaaatgtatcttgatgttgagcccccttttgtacgtcccatatcctga

SEQ ID NO: 4070 - DNA, 180 bp, Xenorhabdus bovienii
  Coding DNA location: Contig name=SeqID_16894; Position on contig =152298..152477bp; Strand=+
atgttgagcccccttttgtacgtcccatatcctgattaccccctttacgccccggcaaatgtggctcaagtaagtcccctatatgatttgaaatatcatgacggcagtgcaagggggtgttcattgctaatgcaactctatttatgggatatattgattattgcacaaaacatttcatga

SEQ ID NO: 4071 - DNA, 249 bp, Xenorhabdus bovienii
  Coding DNA location: Contig name=SeqID_16894; Position on contig =152524..152772bp; Strand=-
atgaactctggtaaaaaattgaacccctgctacctccatacaaaatacaaaatccgtcatcctttgggctgctatcgtctccgggtcgataatcgagccgccatgaatactatcttttttgtgttacgaaccggatgccagtggaatgcccttaatgccacagggatttgttcttcaagtagtgtctggtacgttgggaaaagcgtgttgaaaattatgaagccatgcttcatttggcttgtagtttaa

SEQ ID NO: 4072 - DNA, 1227 bp, Xenorhabdus bovienii
  Coding DNA location: Contig name=SeqID_16894; Position on contig =153029..154255bp; Strand=+
atgaaagatgttccaataatcaactcccgtatttttagtgtaaaaagtagaaaagaactattaactgaatggtctgaaatctctgaaataatcaataatgaaaatgaatatgatggctcaggggtagtttctttcctaccattaaatagactcaatagtaattcagaaagagaagaatgcctgaatgttatttctaaggtcatggaaactggtaattttaccagcggttcttatatttcagaagtggaaaaatatctgtgtgaattttatcaggctgatatttgtgtagctaccagtagtggtacagatgcgctgaaaatagcgcttaaagcggcaggggttggacacagtgatgaggttattctgcctcttaattcttttgccgctacagagaatgctgtcatggctataggagcaatcccgattttcgccaatatggatgcatcttataacattgcgccagaagaaattgaaagattaacaactcctcgaacaaaagcagtattaccggtatgcctttatggctcaaccaaaaatatttctgaagtgtataaaaaagcgaaacagcataatcttctggttatagtggacgcagcacagtgctttggaattaaaaatgtcattggatactgtgatctaatggctctcagttttaacccctttaaaaatattggaacggttggtaaatcaggtgctgttctgacttgctctcctgaactggcttgccgagcaaggcagtattcatatcatggttttgcagagggaaaaaagaatattaaggcacaaaattgggggtttaatagtcgtatggataacatgcaggcggcaactttgatggtgaaactgaatcattttgaaaaaaatgctacaaaacgtgcttttcttgctgcgaggtatattcattctcttaatcaccttgagacggatttatcactcccatctgaaagaattgaaaatacatggcatctttttccattagttataaaaaaacgaacccgagatgaattactccaatttgctaaaaaacatcatgtagagttagatgtttattaccccgttttgtcccactgcggagtacatgaactggcaacgcattatccagacaggaaacaatttctatcttcagaacgaattcataccaatttggtacaactgccgcttcataaccatatgtccttacaggaacaagatattgtcattgaggtattaaatgaattttttaactga

SEQ ID NO: 4073 - DNA, 828 bp, Xenorhabdus bovienii
  Coding DNA location: Contig name=SeqID_16894; Position on contig =154239..155066bp; Strand=+
atgaattttttaactgaaatattaccaccggaatttccttgtccagtaagcgtaaaaaccttggtgtgctgtgatcttgacgaaacttatatcccattttcactggaaaacaaaccttttggtggggtaagagaacttgaacaatttctatgtgaagaaggtaaaaaaaaaggaatcctattgggttggataactggaacaaatttaagttcagcgatacgtaaggcaaaaggatatatatccagaagcccgcattttttatgttgcagtttgggtacggagttttattgggtcagaaatggaaaattagtcccttctgtttcttgggctgaaagaataaagaaatcaggttacaacagggaaaatgtagaaaaaattctatatttgattggtgaaaaaggtatttttcttgaaaagcaacctgatgattatcaaggaaaatataaagccagtttctactatcatatccgtgaagatatggagagtgattttgaatggattgaaagtatcgcgaagacatttcaaatccgcacatttttcactaaatctaacccagcggctggtgatccggaagattgttatgatgtagaatttattccttattgctgtggtaagggagagacggtttcgtttctgatggaaaaaatgcatattccccgaaattcagttcttgcttttggtgatagttgtaacgacttacctatgttcgaatgtgtgggtcattcttatttggttgcgaacgctgaaaaaacagcaatacaaaaacatggaagcaacttaaataaaccttattgtcacggcattctcagcgtattgacaggattgtaa

SEQ ID NO: 4074 - DNA, 594 bp, Xenorhabdus bovienii
  Coding DNA location: Contig name=SeqID_16894; Position on contig =155069..155662bp; Strand=+
atggtaatcggtattattggttgtggcggtattgcgcgtgcacacgtctattccctatcgctcataagtatggtgaaggggctggcgttttacgatgtcagcgacgataacatgcgtcatctcagtaaattatcagcattaccagtcatattttgttctagtcttaaagaacttgcgattcatagtgatggatttattatttgtgcaccaaataattttcacgtcagtctcgcagaagaagttttgaaatataaaacgatcccatttgtttgcgaaaagccattgtccacagatctcaaatcagcaaaaagattagttgaaatagctccgctcgctagtattgtttcttttaactatcgttacaataaaatagttattaagatacaagaaattatagagaaacgggcactgggtaagttaaatttcttttctgccgaatttaataagaattcggcattaatacgcaacaatctgacttggcgtgattcatcacaacaaagtaaaagcagtggagcattaggtgatttgtcctgccatttgcttgatctgttctgctttcttgccgaagacactattagaactatacgcaattaa

SEQ ID NO: 4075 - DNA, 1038 bp, Xenorhabdus bovienii; identical to SEQ ID NO: 1289
  Coding DNA location: Contig name=SeqID_16894; Position on contig =155659..156696bp; Strand=-

SEQ ID NO: 4076 - DNA, 426 bp, Xenorhabdus bovienii
  Coding DNA location: Contig name=SeqID_16894; Position on contig =156768..157193bp; Strand=+
gtggttaaaggcactagggttaacaataagtcagatggccctgtcgaggttgatgataacggctatgtatttggtagggctgatggaggggcttttttccgcattcgagccagcaaatctgatgatgatgggagccagttgggactgcatataaatttagtatttgatgagggtgaaattcattactctacaacagatgaaaacaaactttttctgacgtttttcagtaaacttggcgtagaggaagttatgcttgaaacccgaaagattatacccgatcccaatcgtgaactgcctttctggtctgactcattttactatcttttactggattggtgccgtttactgcaaaatcatggcaagtcaaaagctctaccttttctgcctgccggacttcacatacaggaaatcatagaagagttctga

SEQ ID NO: 4077 - DNA, 267 bp, Xenorhabdus bovienii
  Coding DNA location: Contig name=SeqID_16894; Position on contig =157211..157477bp; Strand=+
atggatatgacactttttattggcctatttgcagctttcttcactacgtttgcatttgtacctcagagtattaagacgctgaaaaccagaaatacggagggtatttctctcattatgtatataatgtttttgattggcgtaatttcgtgggtcgtttacggttttaagaagtcagatttggcggtgttggttgcgaacgtaactactttcgttcttgccgcacctgttttgatcatgacggtaatatcccgcattaggaaacgttga

SEQ ID NO: 4078 - DNA, 150 bp, Xenorhabdus bovienii
  Coding DNA location: Contig name=SeqID_16894; Position on contig =157528..157677bp; Strand=-
gtgattctaccaattccaattcttcctaataccgccctatcagggcggtattcgtcgaaaaagcataacttattttatatccacagaatatcctcccaataccacgctatcattcagaaaaactcccatttagggagcttatttagctga

SEQ ID NO: 4079 - DNA, 291 bp, Xenorhabdus bovienii
  Coding DNA location: Contig name=SeqID_16894; Position on contig =157704..157994bp; Strand=-
atggaaatgataatatccagttacgctcatatcacgacaactacggaaaaattcattttagacaggttagaacaagctaaaaaagaactgaaggaggatgaattgcaagaaatttcccacactgagttattggcttttcactcagaagcaaaaggagcgtacgacttgtggtgtaaaatagtgttctctcctgaagtcttgtctcgagaaaaactgcttaatgattccttatatttgaagacacttatggacgaattttttgactttatttggtcgattacttctaagtaa

SEQ ID NO: 4080 - DNA, 237 bp, Xenorhabdus bovienii
  Coding DNA location: Contig name=SeqID_16894; Position on contig =158033..158269bp; Strand=+
gtgttttcgcctctagctcagttactgaagttgtccaaccgactgattagcaatgtattattcaaatcattaactaaccgtgaaagttccacttttgaaaaattgttttttacttcaccctatgatatgaacaatattcgccaacttgttcaatttgcatcactattttcaatcagtacgaatgaattttcagttcaagctctggagaaaattattatctctttaccaaaaaaatag

SEQ ID NO: 4081 - DNA, 276 bp, Xenorhabdus bovienii
  Coding DNA location: Contig name=SeqID_16894; Position on contig =158875..159150bp; Strand=+
atggctaaagtggatgtgaaatgcccgttttgtcagcaaacgcccccggtgaagaaacagggtttagggagtaccggccatcagcgttatcgatgtcaggaatgctgccgtagttttcaacttgattatgaatatcgggcttgtcaccctggtacgaaagacaaaatcctcgacctgaccatgaataatgcgggcattcgtgataccgctagagctttgcatatcagcattaatgccgtcgtccgcactttaaaaaactctcgcctcgacacgtaa

SEQ ID NO: 4082 - DNA, 402 bp, Xenorhabdus bovienii
  Coding DNA location: Contig name=SeqID_16894; Position on contig =159171..159572bp; Strand=+
ttgcaagttgagctcctctgtgaagtggatgagcaagggtcttttgtcgcaaataagaaacagcagcgctggctatggtatgcctgggagcctcgcctaaaacgtatcatcgcccatacttttggtcgccgaaataagcgaacacttcgcaagctgcttgccttattgtctggatttaatgtggcttttgggtgcacagacaaatttagagtctacgagatattacccggcgaaaagcacatcgcgagtaagctttatactcagcggattgaacgagaaaacttaaatctaagaaatcgattgaagcgactcaatcgcaagacgttaggttactcgaaatgccctgaaatgcatgacaagatcatgggtacattcattgagcgtgagcattatctattttaa

SEQ ID NO: 4083 - DNA, 204 bp, Xenorhabdus bovienii
  Coding DNA location: Contig name=SeqID_16894; Position on contig =159544..159747bp; Strand=-
atgcctatattgagcgttataatcgaacggttcgttatgactggctgggacactattttgagtgaattacaagactatgcaacaaaatggcagtggttttatcatcatgaaagacccaatatggcattaggtggctatacaccaaagggtagtgtattcaatatagagattattgttaaaatagataatgctcacgctcaatga

SEQ ID NO: 4084 - DNA, 342 bp, Xenorhabdus bovienii
  Coding DNA location: Contig name=SeqID_16894; Position on contig =159683..160024bp; Strand=-
atggattttatgcatgatcagttgtcagatggccgttcagtgcgtttgctcaatattattgatggttttaatcgcgaagcgctcactattgaggttgatttttcattgcccagtcgccgtgtaatacgaacattggagcacctgatggggtggaggagaaaacctgcttcaatacgttgtgacaatgggccagagtatacccgccatgaatttcaggcatgggcgaagacgcatgagatagtgttgagttttatccaacccggaaagcctcaacagaatgcctatattgagcgttataatcgaacggttcgttatgactggctgggacactattttgagtga

SEQ ID NO: 4085 - DNA, 156 bp, Xenorhabdus bovienii
  Coding DNA location: Contig name=SeqID_16894; Position on contig =160081..160236bp; Strand=-
atgaatgcagatagcttatcccattgtgtatctgttaacatagttcgcggcatgatggtgaagtctggttattttttggcgaaaacgattatacccaatcatcatgctgttcaaattcccttcacaaaacgtcaacagcccctaggaaacggttga

SEQ ID NO: 4086 - DNA, 237 bp, Xenorhabdus bovienii
  Coding DNA location: Contig name=SeqID_16894; Position on contig =160184..160420bp; Strand=+
atgccgcgaactatgttaacagatacacaatgggataagctatctgcattcatgcaacacactggacttatttaccacaaaacaaaacatcgccaaacatttgaaggcattctttatcgtatgagaacaggcattccgtggcgcgacctgccttccgaattcgggaaagggaatagtgtttttcagcgttttaatgcctggtcaaaaaagggtgttttgcatttaattttcaactag

SEQ ID NO: 4087 - DNA, 138 bp, Xenorhabdus bovienii
  Coding DNA location: Contig name=SeqID_16894; Position on contig =160421..160558bp; Strand=-
atggattttggttcaacgtcctccacgactttgacccattgcctcatcctcttcagacgccgctcctgcactatgctgatgggctcgaacaatacttccgtcaatgaacaaccattctgtatcagagagtccagataa

SEQ ID NO: 4088 - DNA, 387 bp, Xenorhabdus bovienii
  Coding DNA location: Contig name=SeqID_16894; Position on contig =160559..160945bp; Strand=+
ttggctgtagacagttacggtttacctgttcatttcgaactgtctgggggtcaggtcaatgatattgttcatgcggaaagttttgtatctcagtcacctttatcagattttgtgattgctgataagggatatgatagtcagcgtttgagaagtgttatcgaagaacaaaagtcggttccggtgatcccttatcgcaaaaatagccgaaaattggatcaaaaaattgacaaatgtttatatcgttaccgacatttggtggagaatgcctttgccagaatcaaacattttcgtgcgatagcaacaaaatacgacaaacttgaacggaattacgccagcatgctggcactggcgtttattattgtctggttgtcaatgtgggctgaataa

SEQ ID NO: 4089 - DNA, 339 bp, Xenorhabdus bovienii
  Coding DNA location: Contig name=SeqID_16894; Position on contig =161069..161407bp; Strand=-
atgggtttttcaacatacactatttttccggattgtgcggccaatagagtatattctttgtgtgtcgagggcggtgtcgcaatgtatatcgcatcaatttcaggatcattaaccagtgattcggcatcagaataccactttgggacattatgccgtttgtctgccgaaaatgagcagatttcggcgtggttactgaatatcacgggacaacagtgtaattgggaatttgggttttgctacttgtatttacataatgtgaaagggtttcagtggaaccataaacgggtttaccggatttattgtgaactggccctgaataaacgcattaaacctaaatag

SEQ ID NO: 4090 - DNA, 114 bp, Xenorhabdus bovienii
  Coding DNA location: Contig name=SeqID_16894; Position on contig =161406..161519bp; Strand=+
atggcgctgacctttgaagaatgtaatgaaatgatcgctgcctgccaatctcagaatgtgccactgtttgtcgcttattatcgaagggcactaccaagattaagaattaattga

SEQ ID NO: 4091 - DNA, 540 bp, Xenorhabdus bovienii
  Coding DNA location: Contig name=SeqID_16894; Position on contig =161572..162111bp; Strand=+
atggaatctcgctaccaagatcctgataatttaccctggttcgtaaaaccagaaatatccggtggtgggttatttgttgatttagcctgccatacacttgatatattagattttctgttgggaaaaatcatttcggtcaaagggcatgccaattcacaggcaaaagcctatccggcggaagattgtgtctcaatgtcatttatgtttgaaaaccatatccaaggcgttggtatatggaattttgccgctggcacccgtgaagataaggttgaaattatcggcacgaaaggcaaaatagcgtttgcgacattcggtgatgcagctatttcatattatgacgaaaataatcagctgcaccaattccattttgaaaatcccaaacatattcagatgccatttattcaaacggttatacatcaattacagcgcaataatatcagttcatccaatggggaagccgccgcaagaaccagttgggttattgatgaagtcctaaaagagtatcgaactgccctatacatagaaaacaaagaacaataa

SEQ ID NO: 4092 - DNA, 156 bp, Xenorhabdus bovienii
  Coding DNA location: Contig name=SeqID_16894; Position on contig =162222..162377bp; Strand=-
atgctcttgtgccacggggaatgggtagttcgcagtcggacaatagagggcatgaaccatcggataaaagtcattaagcggatggcttacggataccgcgacacggattacttctttctgaggattcgtgccgcgtctcccggcaaagtgcgatga

SEQ ID NO: 4093 - DNA, 1287 bp, Xenorhabdus bovienii
  Coding DNA location: Contig name=SeqID_16894; Position on contig =162301..163587bp; Strand=-
gtgcactcaaaagatttttcttggcgatattctcttaccgccacaatattactgttatcaccattcgatttactggcatcactgggcatggatatgtatctgccggtagtgcctttcatagccggtgtacttggtgccggagcagggacgatccagctaacgttgacggcatacctggttctgttaggagccggtcagcttctattcggcccgctgtcagattggcttggtcgccgtcctgttttacttagtggtgggattgcttacattgtggcttcattcggcctcaccgtcgcttcatcaccagaagtttttctgagcttccgggttattcaagcctgcggtgcttcggcatgtctcgtagccactttcgcgactatacgcgacatctattcgggccgtgaggaaagcaacatcatctatggcttgctcagctctatgcttgctatggttccggcagtaggcccactgctaggagtgttggttgacacctggctggggtggcgcgcaatctttggtttgctaggaggcgcaatgacagtagctgttattgccgcctggcaactctggccagagacccgatggcaacggaagtcagacttgcagtggtcgcagttacttcttcctgtaaaacgcctgaatttctggctgtacacgctttgctacagcgcaggaatgggtagcttcttcgtctttctttcgactgccccctggttaatgatgggccgacaagggttatcgcagcttaccttcagcttgttatttgcaacagtggctatcgctatgatggtgacttcgcggatcgtgggaggtctggttgtccggtggggaagcctgaacatgttacgggcgggaatgtgctgcctgatggcaggagcactgctgctggctgttggagagacacttatacctaaatcggtatttggctttatcgtcccaatgtggcttgtcggtgtgggtatcgctactgcggtttctgtggcgcctaatggtgcgcttcgaggtttcgatcatatggctgggacggctacagcagtttacttctgcttgggggggctactgttaggggggagcggaacgcttgccattacacttttatccagcgctactgcctggccgattatcgcttattgcctaatcttagcaacagcagcgctttgtctgtcctgctttaattccaacagacgcgatattagcagtgaagagcatgatgctcttgtgccacggggaatgggtagttcgcagtcggacaatagagggcatgaaccatcggataaaagtcattaa

SEQ ID NO: 4094 - DNA, 99 bp, Xenorhabdus bovienii
  Coding DNA location: Contig name=SeqID_16894; Position on contig =163635..163733bp; Strand=+
atgtggttcttgagaacaccgcaacaaccgaaaaactatggctgccgcggcttatttctctgctttctcggtagtgctcatatgcgagttatctcatga

SEQ ID NO: 4095 - DNA, 135 bp, Xenorhabdus bovienii
  Coding DNA location: Contig name=SeqID_16894; Position on contig =163992..164126bp; Strand=-
atgaaaaaatgggcgcaggaaaataattattcgcatctggaattgacagtcttgtcgcacaatgttgaagccattcgtttttatgaaagagaaggatataacgaaatcaataaattgatggcaattactctgtaa

SEQ ID NO: 4096 - DNA, 240 bp, Xenorhabdus bovienii
  Coding DNA location: Contig name=SeqID_16894; Position on contig =164091..164330bp; Strand=+
atgcgaataattattttcctgcgcccattttttcattccaaccaacagtcgctggccaattccttggcttctggcatcctgactgacgatcaaatcaaaaatataaccataatttcgtggtatcaaacaattaaacggcggtgtattttgctcttgcgcaatggaaaaaaccgccgggtagtgccacaaaatcctctgccagttcaatcattactttttgattatacgttacacaactga

SEQ ID NO: 4097 - DNA, 891 bp, Xenorhabdus bovienii
  Coding DNA location: Contig name=SeqID_16894; Position on contig =164409..165299bp; Strand=+
atgtctctttccaaacaccgggcggcttcttttccactgcttcctgtcgttttattattactttcaatgacatcaattcaagcgggtgcttcactggccaaaacagtatttcatgtcattggcgcacctggtgtcaccgccctgagactggcgttggggacgattattttatttctgatttttaaaccttggcgtctgaaattccagcgagagtctcttattcctctttttgcctatggcatttcattgggcgcaatgaattatctgttttacatggcattgtcccgtattcctcttggtgttgctgttgcgcttgaatttacggggcctttagctgttgctatgttctcttcccgacgcccgctggatttcctttggatcgccttggtcattgcaggattaggttttctgttaccggtcggagatggcgtcagcacacttgatcctatcggagtcttatatgcattgggagccggtgttttctgggcactctacattattttcgggcaacgtgctggtgctggctacggtgctgcaacggtttccattggatcatcgattgccgccatgatttttttccctgtgggattgatacaaactggcccagagttactgtttgatccctcattgctgcctattgcactagggatcgccattttatctaccgcatttccctatacactggaaatgattgccctcacccgattacctgccaaaacgtttgggacattgatgagccttgagcctgccttgggagcattatcgggaattatcttcctgaatgagcatttgacgatgactcagtggattgccctgttctgtattattttcgcttcaataggctctacctcaaccattaagcggaaggctaaaatagaaaaagtagaataa

SEQ ID NO: 4098 - DNA, 186 bp, Xenorhabdus bovienii
  Coding DNA location: Contig name=SeqID_16894; Position on contig =165380..165565bp; Strand=+
atgaagggtatatcaactatcaatgtaatagaaacaagcaatatgactcccggagagttatcaactaatcttatttcatccaatgagataactcattattcggcattaagggaacatcattatgagtacagcaaaattaatcagccccaacacttcccacctgatttatacccgcaacaacattaa

SEQ ID NO: 4099 - DNA, 507 bp, Xenorhabdus bovienii
  Coding DNA location: Contig name=SeqID_16894; Position on contig =165501..166007bp; Strand=+
atgagtacagcaaaattaatcagccccaacacttcccacctgatttatacccgcaacaacattaatgaagatgtaaagcagagatcgattactgccctgaatcatatggtgatccactttatcgacctctccatgatgactaaacaagcccattggaacatgcgtggcagaaactttattgccatccatgagatgcttgatggtttccgcactgctctcactgatcaccttgatacattcgcagaacgtgcggttcaattgggtggcaccgcgctaggaacggttcaggaggttcacagccgaacccggctggaaaattacccaacgggcatccatgatgtgcaggatcacttaaaagcactggcagaccgctacgccgttgttgcaaatgatatccgtcaggcgattgttgatgcagaggatgaagatacggcggatatgtttaccgcagcttcccgtgatctcgacaaatttttatggtttatcgaagcaaatattgagcaatga

SEQ ID NO: 4100 - DNA, 111 bp, Xenorhabdus bovienii
  Coding DNA location: Contig name=SeqID_16894; Position on contig =166033..166143bp; Strand=-
atgatttttttaaaggttagtctaatctttgacattgtagcggctatttttcgatgttttttcttattggagattatccgtgatgtagaaaggccgcagatgcggccataa

SEQ ID NO: 4101 - DNA, 222 bp, Xenorhabdus bovienii
  Coding DNA location: Contig name=SeqID_16894; Position on contig =166198..166419bp; Strand=+
atggataccgaagtcaaagattctaacggcgcattattaaatgatggtgacaccgttcaagttatcaaagatctgaaagtcaaaggtacttctaagacgctgaaacgcggcacattgatcaaaaacattcgtctgactcaccgtgaagatgaagttgaatgtaattcggataaaatcaaagggttagtgcttaaaacctgtttcttgaagaaaattgggtaa

SEQ ID NO: 4102 - DNA, 111 bp, Xenorhabdus bovienii
  Coding DNA location: Contig name=SeqID_16894; Position on contig =166882..166992bp; Strand=+
ttgataattacatcacgtataaccagactgtgtttctttgtttacttcgaatcaattacacacttaataacgaaaaaaattcaagttattataaactttaattttagttaa

SEQ ID NO: 4103 - DNA, 339 bp, Xenorhabdus bovienii
  Coding DNA location: Contig name=SeqID_16894; Position on contig =167375..167713bp; Strand=+
atgaatataaaagaaataaacatttatttatctaaattgatatcaaatcctaaatattccataaaaatgtatgaaaaccctaataagttcatggagatatatcacatatctcagtctagccgaggtattttaatagatttttttaggcgaaatggtagtaagtttgttaactcttcaatcttacaaaaaacaaaaagaatggatggattaataatgtcactaccaaatttatacaactatttgaataaagataattttgaattagaatttgaaaaataccttataaatattgacttcaataatgaagtaaaaaagaaccctattattgaatctaagtaa

SEQ ID NO: 4104 - DNA, 537 bp, Xenorhabdus bovienii; identical to SEQ ID NO: 2180
  Coding DNA location: Contig name=SeqID_16894; Position on contig =167714..168250bp; Strand=-

SEQ ID NO: 4105 - DNA, 441 bp, Xenorhabdus bovienii; identical to SEQ ID NO: 2208
  Coding DNA location: Contig name=SeqID_16894; Position on contig =168276..168716bp; Strand=-

SEQ ID NO: 4106 - DNA, 276 bp, Xenorhabdus bovienii
  Coding DNA location: Contig name=SeqID_16894; Position on contig =168813..169088bp; Strand=-
atgtttgttttcactttttccatttttttatttaattcttctctgaagttttctttttctattaatgataatagtgatttgatatttgtatcaaactctttaattcttatagttggattagaaacaataaatattttttctatagcatcatatttaatatcctttgataattccacttctatattgaatgttttttcttgtaaatctattaatagattatttttttctttttcatataaggcaatagttctcaaaaggtcatctccagtcttttga

SEQ ID NO: 4107 - DNA, 156 bp, Xenorhabdus bovienii
  Coding DNA location: Contig name=SeqID_16894; Position on contig =169152..169307bp; Strand=-
atgttatcacctttattactaagtgagattaaatttttcgaactaagaatttttagagttttactaaatgattatctatccaaaatatattgtttatttattttttcaaataatttacatgctgaaataggtgttttgcatgttaatataatgtaa

SEQ ID NO: 4108 - DNA, 384 bp, Xenorhabdus bovienii
  Coding DNA location: Contig name=SeqID_16894; Position on contig =169308..169691bp; Strand=+
atgagtaaatatggaaaattcggtattggcgttaattataaatcatcattttctaaagaaatttataataatcttcaatatattgatattcttgaagttcattctgagaaattttttttagatgaagaggataattatctagaaaaatgttgtgaagagattccaattatatttcatggtcttgatatgtcattaggaactgatgataacttagatactgaatacttagaaaatctaaaaaatgtcataatcaacaaaaaaccaatgtggtatagtgatcatttatccgctacacgacatggaaatattgaggtaggacatcttatgccaattcaattttctattgaaaattcgtataacatcataaataaaataaaaaaataa

SEQ ID NO: 4109 - DNA, 390 bp, Xenorhabdus bovienii
  Coding DNA location: Contig name=SeqID_16894; Position on contig =169745..170134bp; Strand=+
atgccaggttctgatatggctgagatagattttatcaatagtatagttaaaaatagtgactgtggaatattgctagacattaataacttatatattaatgcaatgaatcataattacgaccctgaagaatttcttcttaaattaccattaaatcatattgttgaaatacatttagcaggcggttcgtataagtttgatatgattgtggatactcatgcaaataaaatatgggatgatgtatggaagttatatgaatattctctttctaaaaccgatgtttgtggcgtgattattgaaagagattctaatatagagaattatactaccgttatcgatgaagttactattgctcgtgagatttataaaaaaacatataggaaacactcatga

SEQ ID NO: 4110 - DNA, 714 bp, Xenorhabdus bovienii
  Coding DNA location: Contig name=SeqID_16894; Position on contig =170131..170844bp; Strand=+
atgaatacattaactaataatgaaaatttaaaaatagcatcattagcaagcatcccaaaaagaaaaaacaatctatactacactgttaaatcaattttttcacaaattgacgaattaaatgtatacttaaacggatacaaatccattcctgatttcttaataaaagataaaataaatatatatatgagttccaagtcaggcgatttcggagatgcatctaaattttaccctttgaaagacaaaataggatatttattcacattagatgatgatttaatttatcctaaagattatataaagaaacttgtatctaaaatagatatgtataacagaaaaaatttcatttgcgtacatggaaatatcatagatagaacctcattatcatcgtattatgataataaaaaaggaatacattttctaaaatcacttgataacgatatttttgtaaacattccaggaactggtactttagcttatcattcatctcttcattctttttctatgaaatcatttccaataaaaaacatgtctgatatatgggttgcagttattgccaaaagaaataatataaaaatagttgctattaataggaaaaaatattggattcgcacatcaataaaaaataaagatccttactccatatatagcaataagaataaactagatcaaataatatgccaaataataaaaagagaggaattatataacatatga

SEQ ID NO: 4111 - DNA, 267 bp, Xenorhabdus bovienii
  Coding DNA location: Contig name=SeqID_16894; Position on contig =170841..171107bp; Strand=+
atgaacaatgaatataaaatcaccctgaacaaaaatgggtatattctgataaaaaattttctatgtgatgaagaaaaaaaatctctaaatattgatattgaatttctttataataaaaaagatatcccaggaaagatcatgaaatattacgaagaaagtgttattgatagtaaaaaaatactcaacagaatagaaaatttcattgattataaagaaatagatcatataaataaaatagaaaaaaagtatctaaattactatcaataa

SEQ ID NO: 4112 - DNA, 93 bp, Xenorhabdus bovienii
  Coding DNA location: Contig name=SeqID_16894; Position on contig =171101..171193bp; Strand=-
atgatcttgatgtggaagaaatccaccaccaccactcaatttaaaattaattttatccttaaagagaatatgttttttttctgttattattga

SEQ ID NO: 4113 - DNA, 118 bp, Xenorhabdus bovienii
  Coding DNA location: Contig name=SeqID_16894; Position on contig =171236..171353bp; Strand=+
atgatctcagttgatgatatgaatatagcaaatggttgcctatatatttcaaaaattccatttaaaaagaaatcgatccctcataatagtggacaagcattaaaaagctcatataaaa

SEQ ID NO: 4114 - DNA, 756 bp, Xenorhabdus bovienii
  Coding DNA location: Contig name=SeqID_16895; Position on contig =56..811bp; Strand=+
atgcccgggcaattagtcagattgctgaatatcccgatggaaagggcgaaaaccttgcacggttcagaaaatggtaaggcgcatgcggatgctttaaagcggggctgtcgtgaacattatggtgcggcagggcgggaatggatcggttatctatcgtcacaccatgaggaagccagacaggcttatattgaggcgcaatcacggtggggcaagctaataccggaaagttatggtgagcaggtacaaagggtcagcgaccgctttgccgtactggaggcggctttaatgttggggcgggtcattacgggctggaaagcgcaggattgccgcgatgtgttgcaatatatctttaatgtctgggtggcggagtttgggactggcaataaagaatttgaacagattgtcgagcaggccgtttcctttcttaacgcccatggcatgagccgctatgcccctctgccctatgatgagcgggacttaccgattcgggatttagccggataccgggaaaagaaaggccttcatgataatgatccgatgattttctataccttacccgccacttttaagcaggagatcgcccggggttttaacgtggatatgttcgcagacacgttagtgaaaagcgacatcctcaaaaagccggccagtggaaggagctatcagggcaagacaccccgccttaagcatttggggggtattcagcaacgggcttacatcatggtgttggtgcctgaatcagacgaagaagcctga

SEQ ID NO: 4115 - DNA, 153 bp, Xenorhabdus bovienii
  Coding DNA location: Contig name=SeqID_16895; Position on contig =993..1145bp; Strand=+
atgagaaaattacgtaaattataccgtcagaaaatcaatggctttacgggcatgctgttggaacttcgcaccttgtccgaagagcggttccatgatcgtgagctgaccgacaaaattattcttaatctggtgggggagtgtgctgatgcgtga

SEQ ID NO: 4116 - DNA, 399 bp, Xenorhabdus bovienii
  Coding DNA location: Contig name=SeqID_16895; Position on contig =1138..1536bp; Strand=+
atgcgtgatattcagatggtacttaaccaatggggtgcatgggccagtgaagggaatagtgacgttgactgggcacctattgcagcagggtttaaagggctggttcccagtacccgaaagactcgcgctcaatgttgtgatgatgacggttttgcgattgatgctgccgttctgcgattgaagaaatataacccttattatttccagctaatcgtcatgcactatattaaggcgtctgcacttcgggcaatggggacaaagctaggcatctcccataacgaagtatcaaaacgattacaggcagcagagggatttattgaaggcgttctggcggtatcaggggtcactttggagctggataaatgcgtacaaaaagaaatcatcaatagggttgcgtaa

SEQ ID NO: 4117 - DNA, 315 bp, Xenorhabdus bovienii
  Coding DNA location: Contig name=SeqID_16895; Position on contig =1643..1957bp; Strand=+
gtggatgttatagatttagccgaagcgttcgagcaccaaatcgaaaagagagtgaaaaagattaaccttgatagagagtttaaagatgagctcttttttacttcaggttatgacaaatcggttgtttacaaagaccctggcactcagcttctctgggaaatatttgttgcaggtttagaaaaagggcaaaaatcagcaagaattaggttgcctcaatcaaaagaaaacccagataacttttatgatgctggttataacgaaggcataaaagattgtagaaagcatctgcaagcacaaaaaataaaagttatataa

SEQ ID NO: 4118 - DNA, 360 bp, Xenorhabdus bovienii
  Coding DNA location: Contig name=SeqID_16895; Position on contig =2174..2533bp; Strand=+
atgataaacaaaaaagtgagtattcttgcaggactgcttttacccttgattgctgggacggggatggctgctgagaaagcaacaaccgggcaaggggttattgctccgagtaattttcagtgtgataaattcatgtcatccggttattacatgggaaaattggattatgtgatatcgatagataatttgaacagcacctattattggtttgtaagttcggagcaagataatcaaacaggatgtgttaacgttgacgaatcaaaggtgaagcatgctaaaattattcatgatgcttttcttcaaggaaaaatcgtaaaaattagactgaatggatccgttatagaaaggatatcattttga

SEQ ID NO: 4119 - DNA, 255 bp, Xenorhabdus bovienii
  Coding DNA location: Contig name=SeqID_16895; Position on contig =3046..3300bp; Strand=+
atgtacgcattaaagctaatcacagaaagaaacggtcgttcagtagaagagtcatggatcttgggggacatgtaccgtctggagttttgcccgaaagatgtcgctgataatgttattgcccgtgtcgagcatagccagaacggtaatctgattaatcacgacatcaaaaaaacagaccaagcctacattaccactctgacgggtgacactgttcgcacggtctgtcgaggtcgatcagtaagtcaggccgcatga

SEQ ID NO: 4120 - DNA, 105 bp, Xenorhabdus bovienii
  Coding DNA location: Contig name=SeqID_16895; Position on contig =3350..3454bp; Strand=-
atgggcgtccgtggggtgagctatggtcgcccctgtgagttggttaatagaatgctgaccgcaataggagatacggaggtactgagagtgattgcagcggcataa

SEQ ID NO: 4121 - DNA, 315 bp, Xenorhabdus bovienii
  Coding DNA location: Contig name=SeqID_16895; Position on contig =3480..3794bp; Strand=+
atgaaagagaatcctgatgtatgggctgaactgctcaatggtctgcaaaattcgtggccgcagatatccggctctgctttggcaatagctatttgttacggtcgcctgatttatgacggcgtagaacgcaagaaccgatgggtcgaagcgctgctttgtggtgccttgtcatggagcgtgtccagtggcttagagatgtttggcgttcccagcagttttgcgcccgcaatcggtggtgtcattggttttattggcgttgaaaaaatacgtgagtttgctatccgcgccatcaataaacggttgggagataaataa

SEQ ID NO: 4122 - DNA, 411 bp, Xenorhabdus bovienii
  Coding DNA location: Contig name=SeqID_16895; Position on contig =3794..4204bp; Strand=+
atgaccagaggcattcgtaataacaatcccggcaacattgaccacaactcagcgaataagtggcagggtcaattgctccatgacccgagtatagaaaagcggttctgtcggtttgagtctgctgagtatgggattcgggcattattcaaattgctgagaaattaccagaacaagcaccaattgcattcgattagaaaaatcatcaatcgttatgcgccacctgttgagaacaatacggaaagctacatccagttcgcggctgaaaaggtcggtgtttctgctgatgagaagatatcaactcaggataaaaaagtcctgtttgcgttggcagaaggcattatcaagatggagaacagcaatcagcaaccctattcagaagagacgttagaacgggcatttaatttactctga

SEQ ID NO: 4123 - DNA, 126 bp, Xenorhabdus bovienii
  Coding DNA location: Contig name=SeqID_16895; Position on contig =4196..4321bp; Strand=-
atgaaaggtcgccacccagcgatatctctcaggctctatttctataagctcatgattggatttcgcgcacgtcagtacgcagataaaaagaagccccgcgattgcgaggctcaggattcagagtaa

SEQ ID NO: 4124 - DNA, 576 bp, Xenorhabdus bovienii
  Coding DNA location: Contig name=SeqID_16895; Position on contig =4372..4947bp; Strand=+
atgcacacaatcacagtccccttttatgatgatgaactttatgtcgtggaatacaacaatgaaccgtatgtgccgatgaggcctattgttgaaggaatggggatgaactgggcttcacaatacaccaagataaaacaaagatttaacacctgtgttgtgaatatcacaatgcagcttcccggagataaacagcatagggatgtagtttgccttgctctgcgtaaacttgttggctggttagcaaccatcagtccaaataaagttaaatccggcattaaagacaatgtgatccgctatcaaaatgagtgtgatgacgttctttatgactactggacaaagggtatagcggttaatccccgcaagcgtagcgtgatggaagaactgaatcaggcctgcgctgacttaaaaagagataagcagctagccagtgtatttggtacgggtcttaacgaatggaagaaggttaggcctgagcatgaaagcaagataaataagctggtagggcaggctacggatttactgctggattttgttttagctgagacaggcaaaggcaaaacaacacgcactcaataa

SEQ ID NO: 4125 - DNA, 429 bp, Xenorhabdus bovienii
  Coding DNA location: Contig name=SeqID_16895; Position on contig =4990..5418bp; Strand=+
atgtacattaatcggctggggctggtttttcttagcggtgatgttgctatgaagttcaacagccagcacttcactctcggcgctctggtgattatctcgggtctgctctggttctattacagtgagtatcgggagaaagataaagcctacacggaactggatacgaagtataagaatcagcaggccatcaccgacaacgcctttcagtccatcaggatcatcaatgatatctcacgaattaatcgcgaaagccgggatcggtcagccgtggattctgagcaagctaaaacggccatcaaaacggttgttgccaataatgattgcgccaatcgccttgtgcctgatggggctgttatccggttgcagcagcacacgaaccgaatacgttccggtgccaccgatacctattccggcacatctgctcgctga

SEQ ID NO: 4126 - DNA, 249 bp, Xenorhabdus bovienii
  Coding DNA location: Contig name=SeqID_16895; Position on contig =5306..5554bp; Strand=+
atgattgcgccaatcgccttgtgcctgatggggctgttatccggttgcagcagcacacgaaccgaatacgttccggtgccaccgatacctattccggcacatctgctcgctgattgtctgcctccggtcattcccgacacaatgacatggagtgacagtctcatactgaatgaacagttactgacggtgattgagcagtgcaatctggataagcaggcaatacgggaaatagaagaaaagggtaaataa

SEQ ID NO: 4127 - DNA, 291 bp, Xenorhabdus bovienii
  Coding DNA location: Contig name=SeqID_16895; Position on contig =5557..5847bp; Strand=+
atgaatggattatccaaaggtgagtacaaaaccaatcggaaaatgcataaccggatattcaaatatcgccaattgaaattttatcaatactcaaaggtagctgtcggagacaccactaccttgaatatttacgtgtacaaatggttcattgtattaattgccattccaatgctgctctacggttcatttgtgattggttttataccgacattcaaggagctgattgatctatgggaagagcctgtatcattcgatagtttgcgtcaaatccctgatggactattgaattag

SEQ ID NO: 4128 - DNA, 402 bp, Xenorhabdus bovienii
  Coding DNA location: Contig name=SeqID_16895; Position on contig =5938..6339bp; Strand=+
atgaatagcccagaaattagattgagttatcgttccagtataaaagatctgagtataactattttacatgctatattttttcctttgtatgccgcgtggcgctggtggaaattacatatggctagtaagaaagaaatactggatgatttatctagatatagagagaaaagcgataaattagcggaaaatgtatactctatttcaatgaaatcattggaaattcttagtgaggttgagcgtcttttaaaacagggcggcgaacatcaagaactcatcactcagatacatgaatttagcgaaattgttcttttaagcagcaatgatacttatgaatattcaagctcattgatgaaagactacatcccagcgataaaaaaaataagcaatagctctgaagattaa

SEQ ID NO: 4129 - DNA, 378 bp, Xenorhabdus bovienii
  Coding DNA location: Contig name=SeqID_16895; Position on contig =6349..6726bp; Strand=+
atgccgagtttactttctgaaattcaacaaaaaataaataaatcaaatgagctttatagtgtaaataaaaaagcggtagcttcagaggaattggagttaaaagaaaaaagggaacaagacgacaaagcccgtcatagcctcactttccattttgtttggggattttttggcctgattgttggctgctttctgtttgtgctttggtataacagtcatgctattgattggataaaaacactaaatactcaaggactatctgatgccgccgcctcagtcaaattgttagagctggataaagtattatctgtaattatcggcgccctcggcacatcacttggttttataattggttattactttaaagagaagaaaggctga

SEQ ID NO: 4130 - DNA, 1023 bp, Xenorhabdus bovienii
  Coding DNA location: Contig name=SeqID_16895; Position on contig =6848..7870bp; Strand=+
atgccatcagttaacgcgggtggcatttttgtatctgagttccgcgcactcaccgcgcatatcaataaaacgcagccttacagaaagtcgaacctgagaaatccgttaatgggtatttctgcgggcggctttctacgtgagcaggttcgattttctataaggaaatacccgatgagtaacatcattccatttgagtatgacggtcaccctattcgctttaatgaagaggggtggatcaatgccactgatatagcaatgaagtttgataaggagccgacagcatggcttcgtcaaattgatgttctggaatatatatccgctcttagttttcgtgtatttggtatttctggcactgtgccagagattaacgaaatcaagaggttagcaataagttcaggtgcagctagagccaagatactgagatttgctaaaaagagcggacttgtgaaagtgaaaagtggtccaactggaggcacatggttacatccaaaactcgccatccgttttgctcgctggttgtctgttgacttcgaaatttggtgtgatgaacaaatagatgtattgatccgtggtatccaacccacattcactgaccaacgcatcaatgccatttttcttcttgataagcccgccacatgggaaaagcgttttcagcagcccttttatcaggcactcagccgtatgtcaggtttgccttataagggtcatgttggcggcaccccgtcactgtttgggatgatcacatccaagtgggtgtatcaggttgtgttgcctgactcggtatatgcggaggcaaaagaagcagccaaaagtagcggggacaagatccatcaataccttaaaccggaagcccggaaactggtacaggagcaactgaaagcggtcacgatactggctaacggctgcgtggattacaaagactttgaggctcgttgtgttcagtcatttggaaaatcaggtgagcaaggtttgctgattttaccaatagaaagggaattcagttactcagcggtcagacattag

SEQ ID NO: 4131 - DNA, 456 bp, Xenorhabdus bovienii
  Coding DNA location: Contig name=SeqID_16895; Position on contig =8184..8639bp; Strand=+
atggaaattcgtattaatgaagatggtagtgccagggtaacgacggcgggatacatagcattttacgataaggaaggaagacttaagatggtaattggtcgtcttgtacacacaacgggagaacttgatcctgtacctcaaagactcaccgatatcttacccgtaaagctcatcactgagttagttttcaagcagaaagcagaaaaggaacaggcgagtaaaacctatgacgcaggtatgacactggcagtagatacaggtaataaggctggaattaccagtgatagcttcaaggccttcgatgtagccggaaatgtttacgtgaaagaggcgggcattgatgccaaggcaatcagagcaagccatgacgatcacatccgccagatagtccgtgaagagatacgccagttcgtcaatcgtgagagcagaggcaatggtttattctcaaggcggtga

SEQ ID NO: 4132 - DNA, 363 bp, Xenorhabdus bovienii
  Coding DNA location: Contig name=SeqID_16895; Position on contig =8617..8979bp; Strand=+
atggtttattctcaaggcggtgacgctatgtctcaaccccgtatctatggtagcaaatggaacaaggcacggctggccttcctacaacaacatcccttatgtgtcatgtgtcaccagcaagggagagtgaccggcgcgaccgttgttgaccacatcatcccgcataagctgaaaggggcactggattccggtaacaagccggagatagccaaagcacagaagctattctgggataccaagaactggcagcccttatgtgacagtcaccataactccactaagcaacggatggagaagcgcggtaaggtggtcggttgcgatattaacggcctgccattagatccccattcccactggaattaa

SEQ ID NO: 4133 - DNA, 213 bp, Xenorhabdus bovienii
  Coding DNA location: Contig name=SeqID_16895; Position on contig =8984..9196bp; Strand=+
atgaccgaagacgaacaaaccttactgatgttcaaaggcttgatggcctctctgaacgagcagcaacagaggcacgtcgataactgcctgaacacgatacgccaactgatggatgactacccagaaggtgaggcactgattgcattgggttatatcggggcagaacagcaaatgaaaggcaactggggacaaggtgaaacggttgaccgataa

SEQ ID NO: 4134 - DNA, 111 bp, Xenorhabdus bovienii
  Coding DNA location: Contig name=SeqID_16895; Position on contig =9245..9355bp; Strand=+
atgatgaccccggcagaccggcgccagccctcaaaaataacgctaacccgatttttttcgtttaaccggagtccattatggccgaaaaacgggatcgctcagacagtgtga

SEQ ID NO: 4135 - DNA, 477 bp, Xenorhabdus bovienii
  Coding DNA location: Contig name=SeqID_16895; Position on contig =9322..9798bp; Strand=+
atggccgaaaaacgggatcgctcagacagtgtgagcgccgaaattcaagccatgaaaaacgcggccgctgacaccatcgaaccgcctatccacgcgggtctagagaaaaaagcggagcctttctggcatgacaatatccgctctaaagccctcgatagctggacgccttccgatctgctggcggcggtcgaattagccaataatcagctcgaaatcacgctgttacgcaaagaattacgcaaaaaagagcgggttcagggggaagggcgggacgaagatgtcattaaaactttacgtaagcagattgtggaattgcagcgcaccatcctggcgcaacgccgtgatctgcaaatccattcccacgccaccaatggcgaaagccgtgaccagcgtaaacgtaatcagaacgatgccgaggcacggcgcgtacgcgatgaaatgcagggggatgatttgctggcctccccggtacattaa

SEQ ID NO: 4136 - DNA, 1518 bp, Xenorhabdus bovienii
  Coding DNA location: Contig name=SeqID_16895; Position on contig =9811..11328bp; Strand=+
atgacacgcggtgaacgtgttattgcgtttattgaacgctattgcattgtgccggaaggcgagcttatcggtcagcccatgcggttagatgcgtttcagcagaaattcttactggagacctacgataatccggtcgggacagataaagcctatctcagcattgcccgtaagaacggcaagaccggactgattgccgggattctactggcgcatctggtgggtcccgaagctctccagaatacccagattgtcagcggggcgatgagccgtgagcaggcggggattgtgttcaatctggcggtgaagatggtgaacctcaaccctaagctgcaagagatagtccatattatccccagcggcaagaagctgatcggcaaaccccggaacgtggaatacaaagcgctggcggcggaaggcaaaaccacgcacggtttgtcaccggtactggcgatcctggatgaagtcggccagattgttggtccccgcagtgattttgttgatgccatcattacttctcagggggcgcacaagtcacctttgctgattgccatcagtacacaagcggcgaatgatgccgatttactcagtctctggctggacgatgcgaagcattcccatgacccgcacattgtctcccatgtgtatgaggccgacaaagaggcggacatccttgatcctgccgcgtggcaagcggccaaccccgcactgggtaactttcgctcgttaaaggacatgcagcggctggcagaaatggcttcccgcatgccgagtcaggaaaacatgttccgcaacctgaacctgaatcaacgggtgtccatgagttccccgtttatctcacgtaacgtctgggaagccggggcgaaaccgttaaaacctctggtgggacgctgttatgccgggctggacttatccgaatccaaagacctgacggcgctggtgatcatcgggcaatcggaagatggcatgtggaatgtgcatccttatttctggacaccgaaaaagaccctgcttgaccgggcgaaaacggaccgggtgccgtatgacgtgtgggaaaaacagggcttcctgcgtaccacaccggggtcgatggtggactatgacttcgtggtgcaagacatcgcggagattatcggtgactttgctattgaggtgatcacctttgaccgctggcgtattgatatctttaagaaagccgccgaacacatcggcctgacactccccctggtggagttcgggcagggctataaagacatggcgccggcactggataaaatggagcagcttttgctgaacggacaggttaaccacggcaatcatccggtgatgaacatgtgtgccgccaatgccattacggtcaaggacgcggcatccaaccgcaagctcgcgaaggacaagtcgaccgggcggatggatggcatggtggcctttgcgatggcggttggtgcctcgcatgagatggaaaccgaacagggggatattgacggcttttttgatgacccgattattgtggggatttag

SEQ ID NO: 4137 - DNA, 1332 bp, Xenorhabdus bovienii
  Coding DNA location: Contig name=SeqID_16895; Position on contig =11329..12660bp; Strand=+
atgaaaacagaaaaacaacccggacgtgtcaagtcggccctgctgaactggctgggggtacccctcagtctgacgaacggcaccttctggcaggaatggatcggcaccagcagcagcggcaaggtggtgacggcggacaaggcgatgcagctttcggcggtctgggcttgcgtccggttattgagtgaatccatttctacgctgcccttaaagatttatcgcaccaaaacgaatggttcccgtgaattagccaaagatcatccggtttatcgcgtcctttgccgacaacccaatgccgaaatgaccccatcgcgctttatgctgatgatagtggccagcctgtgcctgcggggcaatgcgtttgtcgagaagcgctatattggttcaaaattggtcgccctgctgcccttattgccgcaaaacatggtggtcaaacggctggagaatgggcaactggaatacacttacacggaattgaaagggagaaagcgggtcattccccttaagcacatgatgcacattcgcggcttcggtctggatggggtcagcggcttaatcccggttcaggtcggcagggatgtgtttgggacagccatgtccattgatgaggcgaccggcaagatctttgaaaacgggttgcaaagtaccggattcctgtctgccaagaccgccctcgataaggatcagcgggagcggctgaggaagaatttacagcagttcgcggggtcaaaaaatgccggaaaactgatggtgctggagacggacttatcttatcagagtgtgaccatgaatcccgaagccgcccagatgctggagagccgcacttttagcacggaggagatttgtcgctggttccgggtgccgccgtttatggtgggtcacattaccaaacaaagtagctggggcgccagtgtggaagggatgaacatgcagttcctgaccaacaccctgcgcccgttactgatcaatatcgagcaggaaatcagccgctgtctgctcaatgacgatgaagatttctatgccgagttctcggtggaaggtctgctccgtgcagacagcgccggacgctcggcttactacaccacggctttgcaaaatggctggatgagccgcaatgatgtgcgccggctggaaaacctgcccccgattgacggcggggatatccacaccgtgcagctcaacctgacgccgattgagcaacttggtaaagccggtaacggctcagaatcagaaaaagtccgggcgcagatagttgactggctttttcctgagcgtagcgagccaccgcctacatcctcaaataccaacgtcaagcctcactctgaggagtaa

SEQ ID NO: 4138 - DNA, 825 bp, Xenorhabdus bovienii
  Coding DNA location: Contig name=SeqID_16895; Position on contig =12667..13491bp; Strand=+
atgagtaaaaaacaactgccggtcgcgccggaggggcgcccctgtgcgtcgatttcctgtgagctgaaaccgaaagccctggatagctggcacagtggcatcaaagccgccagtacggataacaccatcgccattttggatgtgatcggtgaagacttctggggcgaaggagtcacggtcaaacgcatttctgccgcgcttcgggcggtcggcggcggggatgtggtggtcaatatcaacagtcccggcggggatatgttcgaaggtctcgccatctacaatgtgttacgcgcctacgaaggtaaggtcactgtcaaagtgttgggcatcgccgcctcagccgcctccattattgcgatggcgggcgatgaaatccagatggggcgcggggccttcctgatgatccataactgctgggcgctgggtatcggtaaccgccatgattttgccaaactcgcccgtgaccttgagccgtttgataacgcgatgggcgatatctaccgcgcccgcagtggtctggacgaaaatactattgttcagatgatggacaacgaaacctatatcggggccagtgaggccatcgacaggggactggctgacagtctgatgtcggcggaggtcattgagtccggcgatgaaagccatcaggccgccttgcgcaaaatcgatgctttattagccaagacgaacacgccccgcgccgagcggcgcaaactgattcaatctttaaccgggagtccgccgggcgcgacccctgaaattaatcctgaaaccttagccgcactgcaacaggccgtgaatgcctttgccccggcacacctataa

SEQ ID NO: 4139 - DNA, 1215 bp, Xenorhabdus bovienii
  Coding DNA location: Contig name=SeqID_16895; Position on contig =13504..14718bp; Strand=+
atgtccgataccaacgaattactgaaaggcctgtccgccaaaatcgaagaggcgaacggcaaatttaatgccaaagcggaagaagcgctgaatgaagccaaaaaagtgggcggattaagtgcggaaaccaaagcggcggtcgataaaatggcgaccgaactgaacgccctgcgcgaatctgaaaagaccctgaaagcgtctctcggtgaactggagcaacatgtggcgcaaatgccgctgcaaaatgccgttcaggcggcgaagaccatcggtcagcaactcatttctgccgaggtgctgaaagatatcaacgccagtattccggccagcaaacgcatttccgttccggtacaggccgcactgacgtcttccggtgtcgctgagggcgtcgttgaaccgcaacgtttgccgggtgtggatgtcgcgcccaagcagcgcctgtttatccgtgatctgatcgcaccgggcaagaccacgtcatccgctatcttctgggtgcagcaaaccggatttaccaacaaggcggcagtggtgccggaaaataccgccaagccgtacagtgatatccagttcgagaccaaaatcacagccgtgaccaccgtggcgcatatgttcaaggcgtcaaagcaaattctggacgacttcgcccagttgcagtccctggtggatgcggaaatgcgctacggcctgaaatttgtcgaagagcaggaaattttgttcggtgacggctccggtgcacacctgcacggcatcattccgcaggcgtcgaagtttaaggcggaattcaaggtcgataagcaaaacggcattgatgatctgcgtctggcgatgttgcaggctcaactggctcgtttcccggcgtcggcgcatgttctgcactttattgactgggcgagtattgaactcgctaaggattcattaggccgttacattctggggaaccctgccggattgatcggccctacactgtggggcttgcccgttgtggcgacagaagcggcggcgttcaggggcaagttcctgaccggggcattcaatgccggggcgcaaatctttgaccgcgaagaaaccaatgtggtgatttcgaccgagaacaccgacgacttcgagaaaaacatgatttcccttcgttgtgaggagcgtctcgccctggcggtcaaacgtcccgaagccttcgtgtacggtgattttaccgtgcccaaatccggcgaataa

SEQ ID NO: 4140 - DNA, 204 bp, Xenorhabdus bovienii
  Coding DNA location: Contig name=SeqID_16895; Position on contig =14772..14975bp; Strand=+
atgaaactgaccgtactgagagcgatttattttgaggggcaggtgatcacagaaggtcatgtcattgatactgttgaacaacacgggcgcgaattaatccaaaaaggctatgccgccgagacagccgagacgcacactctgacggagccaacggagccaacggagccaacggagccaacggagccggaagataagggggaataa

SEQ ID NO: 4141 - DNA, 321 bp, Xenorhabdus bovienii
  Coding DNA location: Contig name=SeqID_16895; Position on contig =14975..15295bp; Strand=+
atgctttctcttgaactcgtcaaagcacaatgcaaggtcgaataccctgacgatgatgacctgctcaatacctatattggtgcgtcggtgaaatatgtcgagaactacacccgacgctcactgtatcccgataaagaagcgaaagggtatgccgatgaccccgatcacttattgttaaccgccgatgtgcaggccgccatgttattgctgattgcccaatggtatgaaaaccggagtgccgcgtcggtggggcaatccgtgtcttccctgccattttcagtcgcggcgttactgcaaccttaccgcatttacggtttgtaa

SEQ ID NO: 4142 - DNA, 321 bp, Xenorhabdus bovienii
  Coding DNA location: Contig name=SeqID_16895; Position on contig =15305..15625bp; Strand=+
atgcacattggaaaaatgaggcaccgcattacattgcagaactttaccccggtcagattaccttccggccagaaagtgcaggaatggcaggacatcgccacggtctgggcggaagtgaaacacatcagcgggcgggaattactggcctccggggcggcattgtccgaagcgaccgtacgtatctggctgcgctaccgggcggatgtcaccagtgcgtcacgtctggtattcaaggggcaggtgtacgatattcaggccgtcattcctgatgggaaatgtacccaacttgaactgctgtgcaagcagggggtgagatcatga

SEQ ID NO: 4143 - DNA, 447 bp, Xenorhabdus bovienii
  Coding DNA location: Contig name=SeqID_16895; Position on contig =15622..16068bp; Strand=+
atgattgttaccgatctggacttctccgggttacaggagattgcgcgggatttggaaatactgagcaaggccgaaaatagcaaggtattgcggcaggccacttatgccgccgcctcggtattgcgggatgaggccagagtgaaagcgccgaaacgcacgggcaaactgagccggaacattgtggcgtccaaccgcaagagccgcaacggtgacgtgttggcgggggtgtatgtccggggatcgaatgccaaaggcacgaacagcgaccccaaaatgaagaagagcgacccgcgtaacgcgtactactggcgttttctggagtacggcacgtcaaagctggctccgaggccgtttgcccgcccggcctttgatgccaaatccgacgaagcggcaaagtttgccctgaaacggctgaatcaggccattgatgaggtgctgtcgaaatga

SEQ ID NO: 4144 - DNA, 336 bp, Xenorhabdus bovienii
  Coding DNA location: Contig name=SeqID_16895; Position on contig =16065..16400bp; Strand=+
atgaccgaggcggatattttccccttactggccccggtgctgcccgatcaggtctttccctatgtcgcgccgcaatcagccccgtccgtctccccgccgtggtgtgtcttctcactctacagcatcgatcaggatgtgctgaacgggcaggctggacaactgaacaacctgcaaattgatgtctatgcactgaccattgatgcagcgcgggagatacgggataaggccagaatagcccttatgccgcttaaaccgacccaactgagtgaaactaacagctacgagtctgacacggggctgtaccgcgccacactggaatgccaaatctggcagtaa

SEQ ID NO: 4145 - DNA, 474 bp, Xenorhabdus bovienii
  Coding DNA location: Contig name=SeqID_16895; Position on contig =16458..16931bp; Strand=+
atgagcagcaagtacgaaaaagcccagggcacgaaagtcagcatttcggccacggcggcaaaagaagcgaacccggtcacggccgtctggcaggatattgactgcaccacgaaagaggtcagctacaccggtgggcaaaaaagtgacattgaggtcacgacactgtgttccaccgagcaggaaatgaccaacggtttggccgcaccgggcgaaattaccctgtccggtaactggtcagccgacgaagccgggcagaacaccctgcgcaacgcttacgacaccgatgaattgcatgcgtttaaggtgcagttcccgacaggcaacggctatgcctttttagccgaagtgcggcagaactcatggagcgtgtcggccagtggcctagtgaccgcttcatttaccctgcgactgaaaggcaaacccgtccccctcaagcaagcggctacgttaactaaagacacttcacaaggataa

SEQ ID NO: 4146 - DNA, 387 bp, Xenorhabdus bovienii
  Coding DNA location: Contig name=SeqID_16895; Position on contig =16937..17323bp; Strand=+
atggcaaaggcaaagaaagatttacggtctctggcactggcacccggcgccggatttcgcagtaaaaccgtcaccgtaccggaatggggtgatgttgccgtgatcctgcgcgaaccctctgcgggggcgtgggcactctggcaggcggttatttcccctaccgaggacgaggaagcgcagccgctgtcggtcgcggaaaagacccgccgcaatgtccggggggatgtggtgctgtttatcgatgtattgtgggatgaagacggtgaacaggtattttctcctgacgatgacgacaccgtggcggggatttacggtcccgtgcatgcccggttgctgcatcaggcgctggatttaatgacctcacaggccgacgcggaaaaaaagtaa

SEQ ID NO: 4147 - DNA, 276 bp, Xenorhabdus bovienii
  Coding DNA location: Contig name=SeqID_16895; Position on contig =17344..17619bp; Strand=+
atgatgacactggcgttgcggctcggcaaaaccctgcatgagctgcaacgggacatgagtgccagtgaattgttgtgctggatggcctacgaccggcgcagtcccctcagtgaccgccgtggtgacattcaggccgcccagatagcctcagcggtttatcagtcgcagggcggcaaggtcaaactggaagacaccctgctgcaatggggtgccgatccccagcaggatgagcaggagctgtctgggctggaaggtttcctatccaacttatcgtga

SEQ ID NO: 4148 - DNA, 3378 bp, Xenorhabdus bovienii
  Coding DNA location: Contig name=SeqID_16895; Position on contig =17629..21006bp; Strand=+
atggcaaaactgcgtgaattaatcattaaaatctcggcaaattcggcctcgtttcagtcggaaattgcccgcgcctcccggatgggggcgggttattaccggacgatggaaaagggcggacgtcaggcggcgtctgccagccgtaacagccagcaggcgatgcgggaactgaacggacaactggcctccgtgcgggacacggcaaaaggcatggcgggggcgtttgccgggatgtttgcgaccggacgtctcatcagtatggcggacagttacaactccctgaatgcccgtatcaagctggcgacgacatcaacagaggatttcaaaaacgcccagcaagggttgctgcggattagtcagtataccggctcgacctttgaatccaatgccagcctgtttacccgcgtctccagctctttgcgggaatacggctattcgacaaaagatatcctgtccctgaccgattctttggctactggcctgcaagtgtccggggcgtccgccgaagaaaccgcctcccttatcacccagttatcacaggcgttagggcgcggcgtacttcgggggcaggactttaactcggtcgcccaatcggggcagaggatcatgaaagccctgtctgatgggctgggagtcgcccagaaagacctgaaacaactggcggatgccggggaactgaccacgccgaagattgttccggcattagtcagtcagttggaaaccctgcataaagaatttgattcgatgccgaacagtgtcagcgccgcctcaacccgggtgatgaatgcctttcagcagtgggtcggggaagccaaccagacaacatcggcgacggcaaccttgtccggcgtactggatggggtagcgaaaaacatagataccgttgcggcggcgggcgcgatactggtggctgtcggtgccgcccgtttctttggcgggatgatgtccggggcaaagacagccacggggcggatcctggaaactcgcctcgctgaggtggcactcgcggagacgcaggtcagggggacacagatttccaccgcacgggcacgggcagcggtctaccgggcacaacaggcactggtagccgcaaaaggcaccgacaaacaaacgcaggcagaagaacgcctgtcccgagcacaggcaaccctgaaacgcaatacggatgcccggacagcggcacagaatcggctgaacggcgtgacctcagtcggctcccgattgatgggcggcgcgttggggctgattggcggcatgcccggcttggcaatactggcgggttcggcgctctattttatgcatcaaaagcaggagcaggccaaacaatcagcattggaactcaggaacagcacggaactgctgaccgaatccttaaaggaaatgagttcgctggaagtcaataaacgggtctttgatacgcaggaccaaatcacggctcagaacgaagccatagagaaacaagaaaagttagtggaagcgcgaaaagcggatatggtgcgcatccggatagtggctgaaaaaggcgtcaaaaccctgtattcggcagatccggtgacgcaactgaccgaggcgacccgagtgtataacaatgaagtgaacaatctggcgctcatgcaggaggggttaagcaataagcaaaaagaattaaacctgttgcagttcaggcaaacgggtctgttgcgtgataattatgtggaaatgctcaataccagtgatattctgccgatactcacactggccggctcggacttcaaccggatattgtccgtcggcaatcgtctgttgcaagagcgaacgacgttaacaccggttccgtttgcacttccccagactcccctgagcgacgagcaacaggactttctgaagaagtcggcgcgtgatcttgaactttctgcgttgcagggggccgcgaaggttaaaagacaggcggagtttgccgcagaggatcaaaagctaaataccccgcaatatcagaaccattatcaaaaatacatcaatgattcggtcgccatatatcaaaacggggaaaaagccagagaggcgcaggcggcggccgcaaaagcgaccagtgaagcggcaaaggtcgcgcgtgaagccgccagcgcacaggaaaattaccgcaataaagtggctgacctgaaccgggaaattcaggtcgagcaggtgcgtatgaaagacggtgaaacggcggcggcgctcttcgcctcttcactggatgtcagcgccaaatacaccgggaaacagcgcgaggaactaatccggctcagtcaagccagtattcttgccaaacaacgtacccaagatttacaggatgccattgaatccgacccctatcgtaaagccgccgctgcccgcaaggaagcggaagaacaagtccagcgacagattgccgccaaggatatccagagcgtcgaggagtcagcgcggcgtaaacaggaaattaaccttaattacctgaatgccgtcgccgaagctaaccagcgatatgccgtatctcccagtgccgaattagtcggcaatgttgatccgctacaggatatccaaaatcaactggaaaggcggaaagcgttgattcaaacctacgccacagaaggccttatcaccgaacagcgaaaaaatgagttaattattgctgcggataatgaaactaatgagcgtcgttatgaagccgcgatgcaactgtatgccagtcaaggacggatacagaaaatgacggtagatttgttttctaccacaaaagaacgcatgaccaacatgttaacaggcatgttgaccggcacccagtcattcaaggagggcatgatcggcctgttttcctccctcacacaaagcattatccagaacctgatggatatgacagcggaagctattctgaccagcaataccttgaaatccatcatgggcgtggcgggcgggtttttcggtggcgcgggtggcggagggacaacgctcgctaatggtcaggctgtgcccatgttgccccagaacatttcagtcaatgccaaaggtggtgtctatgattcaccgagtctcagtgcctacagtgggcaggtagttagcacacccaccttctttgcctttgctaagggcgcagggctgatgggggaagcggggccggaggcgattatgccgctcgccagaaccggtaatggcaatttgggcgttaggctggttgggggtaatctgccatcgtcgaatagtgcacccaatattcaggtctatatcacggactcaggcggcagaagtcagacagcaaacggcgcagacgcaggattcggtgaaaatttagcgcgggcatttgcacaggtctattacgctgaacgggataaagatctgcgtccgggcgggacgattaaccgggcaatcagggggcgataa

SEQ ID NO: 4149 - DNA, 333 bp, Xenorhabdus bovienii
  Coding DNA location: Contig name=SeqID_16895; Position on contig =21006..21338bp; Strand=+
atggaaacctttaactggagtccccgaacgagcacctctgcgacggtggactttaaaatcagaaaagccgcgtttggcgatggttacacgcaagtgtcgggggatggcattcatccccgtagtcaaaaatgggcgctggattttgtcggcaatgaaaaatacatccgggcgattctggaatttttagaccgccatcaagggcataagtcttttatctggaagccaccgctttctgacaccgggttgtatcgctgcgaaggttataagaccagcgcactgggtggcaaaaactactcgctgtctgctgaatttgttcaggcttatcactcttag

SEQ ID NO: 4150 - DNA, 750 bp, Xenorhabdus bovienii
  Coding DNA location: Contig name=SeqID_16895; Position on contig =21348..22097bp; Strand=+
atgatcagtgctgatgtacagaaactggagccgggtaacgttatccggctctatgaggtcgacggaacggcattcggtgcggatactctgcggttccatgcctacggcataccgcatacccctgccgagattgaggcagcaaaacgtgatcccgacaagttcaagccgaagtctgtctggtggcaaggtgaagaatatggggcgtggcctgtcaagattgaagggctggatatgtccagcgacggacagtctgcacggcctaaattgaaggtcgctaatctggatggcctgattaccgctttgtgtttgcgttttgaggacatggtgcaggccaaagtgaccgttcatgatacctttgttcattatctggatgcggtgaatttccccgaaggcaatccgactgccgatcccgaacaggagcgtaagcaggttttctatgttgaccgcaaggagtctgaaaccgatgaaatggtcacctttgagcttgccagcccggcagatttggaagggcttaaaatcccgacccggcagatacacagcgtatgtacgtggtgctcgcggggctggtatcgcacgggcaagggttgtgattatgccgggagtcgttatttcgatgaaaacgataatccggtcgatgaccccagtaaagataaatgccccgggcgactcaaatcgtgcaagttgcgattcggtgaagatgaacctttgccgttcggggggtttcccggtgctgcattgattaggcggtga

SEQ ID NO: 4151 - DNA, 705 bp, Xenorhabdus bovienii
  Coding DNA location: Contig name=SeqID_16895; Position on contig =22100..22804bp; Strand=+
atgcgtgacagtacgctacaagcgatattcgaacacacaaaggctgaataccccaaagaggcctgcggggtgattgcccaaaaaagtcgggtagaaaaatattttccctgccgaaacttagcgcctgacccttccgagcagtttcatcttgatccgcttggttatgctgccgctgacgaatggggcgcgataactgccattgtccatagccaccctgacgcaacaacgcagcccagtgaactggatgctgctcaatgtgatgccaccgaattaccgtggcatatcgtgagctggccggaaggggatttgaggacaatttatccgcgtggtgagctgcccttaacaggcaggccttttgttctcggtatttatgattgctgggggctaatcatgagttactaccgtcaggaacatgctattgaattgcccgattaccgtgttgactatccttggtgggaacagggcgaaaaccggtatatggacaactggcaggcctgtggctttggtgagttcagtgacaccccccagattggcgacgtggtgattatgcaggttcaggcggatgtacctaatcatgccggagtcttgctggcgggtaatttcttgctgcatcatctttatgggcagttaagccagaaagtgccgtatggtgggtactggaaagatagagcaataaaaattctgcggcacaaaaacctgttttga

SEQ ID NO: 4152 - DNA, 366 bp, Xenorhabdus bovienii
  Coding DNA location: Contig name=SeqID_16895; Position on contig =22863..23228bp; Strand=+
atgcggaaaatcttattattattaacgctattaattttagttggctgcggggttactcccaaagagctgagaagcatgaaaccatatgcggaattcagttccactaagtcacctgattttctttccaaatgtatagcgtctggtttagaaactagaagttatgatggaatcggtgcgcaagtttattttagacccatgaacaatgggatgagcatatctacttttggaaatattgtattgatagatatattttctgagggttcaaaaacattagtaaaatattattctgcatacacccatacatggacatgggggaaagaagatagaattaatgcagcggtacaagatatcaaatcctgtatttaa

SEQ ID NO: 4153 - DNA, 615 bp, Xenorhabdus bovienii
  Coding DNA location: Contig name=SeqID_16895; Position on contig =23276..23890bp; Strand=+
atggcttacatcgatataccgatgcgaacggtgcgtcttcatggtccactaatttctcgttttggtaaagaatttaaatacaaagcacgggatgccagacatgcaattagtgccatgcattgcctgttgcccggttttgaaaagtatatggcggaagcgcataaaaaagggctgacatttgccatttttgttggcggcagaaatatcggtcaggacgaaattgatatgacaaaaggcacggaaactattcatctcttgcctgttattatcgggagtaagcgtgccggattgttccaaactattttgggtgtagcgctggttgctattgctacaattgcaaccaatggttttgcaggtggattagcggcttctggatggtggggaaccgcagctatggcaggcgcatcaatggcgctcggtggtgttgtccagatgctttctccccaaatgtctggactgcgaatgcgtgaatcaccggacaataaaccctcttacgcctttggtggtccggtaaatacgaccgcacaagggaacccagttcctgttctgtacgggacgcgtgaaatcggcggggcgattatctcggcgggtgtctataccgaagaccagcaataa

SEQ ID NO: 4154 - DNA, 3183 bp, Xenorhabdus bovienii
  Coding DNA location: Contig name=SeqID_16895; Position on contig =23945..27127bp; Strand=+
atgggacatcatcttattcaaggcagaaagggtggcggcgggggtggatatacccccgtagagtcaccagacagcattcaatccattgcaaaggctaaagtgttattggcattgggtgaaggtgaatgggggagtaatttagacgctacgcatatttatctgaatggcactccgctggctaatcccgatggagaaatgaatttcacgggggctaaatgggaatatcgggccggcactcaatctcaggaatacatcaagggattgcctgtggcggaaaacgaaatccggctaggggttgaattaaagagtggtacgccgtggatacgttccgtttccaatactaaattgtctgcggtacgtttgcgtttgggttggcctgtattacaacagcaacatgataacggggatattaccggttaccgggtggattacgcgattgatctggcgacggatggcggcgcttataaggaagtactgaaagccgtagtggatgataaaaccacaactttatatgaacgtagtcaccgcattgatttaccaacagcctcgacaggatggcagattcgggtcagaaaattaacgccggatactaaaaatagtcgcatcgcagacaagatgaatatcatggcttttaccgaggtcattgatgcgaaattacgttaccccaatactgcgctgctctatgtcgagttcgatgctcagcaatttcccaatattccccagatatcctgcaagccacagggcagaattatccgcgtaccggataactatgatcctgtttcccgcacttattcggggatttggtcgggtcaatttaaatgggcgcattctgacaaccccgcttgggtattttacgacattattgtgtcagagatgtttgggctgggaaaccgcatcaattcaacacaaattaatgaagcggagctgtaccgcatcgctcagtattgcgatcagcccgtccctgatggtaaaggcgggagcggtacggagcctcgcttcacctgtaatgtgtatatccagtctcgtgaggaagcgtggacggtattagccgatttagccgctatcttccgtggcacgacctactggggtgcgaatgagtttgtcacgctggcggatatgccggcggatgtctcttacatcttcaaccagtccaatgtgattgggggggatttttcatacagcgctgccagtgtgcgtacccgttatagcgtcgctatggtgagctggtcagatcctgataatcattatgctgatacccttgaagcgatctctgatgacgagctggtacgccgttatgatattaatcagacggaactcacggccattggctgtacccgccaaagtgaagcgcagcggcgcggacgttgggcattgctcaccaacgcgcgtgacagtgtggtgtcattcaaggtcgggctggagggacagatcccactgcccggtcacattattggcgtggcacacaagaatcgcgcaggccgggtgattggcgggcgtatcagcgctgtatcagaacgtaacatcacactggatcgcaaaccagaagccaaggcaggcgacaggctgctggtcaatcttccctcgggtgtgtcacaggggcgaaccatacaggcgattaatggcagtatcgtgactgtcacaacggcttacagtgaaataccgagagcggaagcaggctgggcaattgatgccaatgatttgtttattcagcaataccgtgtgaccagtatccgggacagcggagacggtacttttgaaatcagtgcggtttaccatgatcctgataaatatgagcgtatcgacaccggcacccgaatagacgcgcgtccgatttccgttattcctcccggcgttcagccgcccccgaaaaatgtcggtatcagcagttattcggtggtcaatcaggggatagcggtcacgacattgagggttacttggaatgcagccgagagtgcgattgcgtatgaagctgaatggcgacgggataatggcaactggatatctgcgccccgaacctctacacagggctttgaagtccccaatatttacgcgggacgctatcaggcgcgggtacgagccattaatgccgctgagatatccagtctttgggcgaacgcaccggaaactcacctgaaagggaaagagggcaaccctccggcaccgttgggcttcaaggccactccgattatcttcggtatccagctagactggggctttgctccccagacggacgacacgttaaaaactgaaatccagtacagcaagacgaatgacggcgaaggcttaatgttactggccgatatcccctatccccagcgaacgcacacgatgcagggattggcggcaggtgtcgccttctatttccgtgcgcggctggtggataaatccggtaatcaatccccgtggacggcattcattcgtggggagtcttcttcggatacgaactggatcattgatgcggcaagtaaggaatttctttccaacaaagccggccagcgtttgcagtctcaaatagactttaactccgaagccattatggagaacgccgctctcaccggtgctgttgttcagcgtcagttgaaggaaaacggcaatatcaaggccgaaatattggaggttaagaccacgcaagttacagacaggcaagcctttgccgaggatatgaagaaggtacaggccgaagtcggggagaatgcggcggcggtgcagacgaaggccacggccgtttttgatatcgacgggaatggttatgccattaactatgtcggagcgggagtgaagtacaacaaccagttctataaagccgggatggttatcggggctgaggtgaagaacggacaggtcactacctccattggatttaatgccgagaatttcggttggtttaatccggccagtggcaagatggagccgttcatgatggcgaaaaatggacagctatttgtgagggaggcgttttttgataaaaccaccatccaaaaactgttaattggtgccgaaatcaaatccgttaattatatcccgggtaaatcgggcttttattggaatatgcaaacgggacaaatggaaaatatcggctcagacagtcagggaaaaatgaagcagaccaatacgacgattagtattgctgacgaaaagggaaggctaagagggcaattcggaaaaatcacgggggtattttaa

SEQ ID NO: 4155 - DNA, 309 bp, Xenorhabdus bovienii
  Coding DNA location: Contig name=SeqID_16895; Position on contig =27127..27435bp; Strand=+
atgtggggatttcagacatgggatgagaaggggaaaccgaataattcaggggttattccattcttgattgcaggaacaatcaccgtaccaaaggggcaaacctcattcagttatagctatgttttgcctgatggatacaagctggattacaccattatggataatggcggcgatattatggcgaatctggatgacaggcagaagtatgaaatccgggttcatggaaataccatcagtgcccacccgtcaagtctgggtattccttcggcttcgggaaaaaaagtcttggtattctacaggagggtataa

SEQ ID NO: 4156 - DNA, 612 bp, Xenorhabdus bovienii
  Coding DNA location: Contig name=SeqID_16895; Position on contig =27436..28047bp; Strand=+
atgtttggagcattattaaccgcgccggacgggacaccgtggctgctgccgcaaagcacgccgatgtgcctgaaagaaatagtgaccgattaccggcagataactaaagtcccggactcggttaatcgtatgatatttacccagagaaaccttgataacgatgagtataaatattatgtctttactgacgaaccccaaacaccgccgatagggaaatgggcggtttgcttttgggatgaaaatgggaaatgtattgtccatagtttgagtaaaacgctttccgtcatgggttcaatggaggatatttcaagcacgagctggtactggcaaacgcgggattataaggaaacagtaaaaggcagtgcggcggtattatcaacggtggcgggttatgggttttttttagtgcattctcatggctcagatggttccagtatgccattacccattcatgtccgttgggagccgtatgcccataaaaaaggcaataccacaacgataggttatgcctcgggcgatgaatttttattaaataaatccacgataaactcagaacgattcaccggaattcacagtcggatagtttatatagacaccgccatttacgactaa

SEQ ID NO: 4157 - DNA, 1449 bp, Xenorhabdus bovienii
  Coding DNA location: Contig name=SeqID_16895; Position on contig =28060..29508bp; Strand=+
atgatctactcagacggcacaacgaatctcgtgtcaggctcggctattgtccggggaacgggcaccaaatggaaaagtaatattaacggcattgccgccggccaggttatcttaatccagtccggcaatggcaatttactgcatatgattcaggcggtgaactccgataccgaactggtgttggcagataacgccagagccaccctgaataacgcgaaataccagattcaaaccaccgttcccgataccgtttccgatggtgtccggcatatgtgtgccattaacgccgctatcatcttgttcctgcaaaatatggaccggtggatgagtgaaaacggcaaggttgaagtggaaatgccgaacggccagaaagtcacactggactccatccgggcattgcaggcagctatggatgggaagctggttaaggagcagaacggggcagacattccgaacaagccgaagtttgttaacaatctcggcttagcgagaacggtggagttggcgaaaaatgcgctgccgaaagcagggggatggattgatggcgatgtcgccgtacgtagtcgcgatgctgcgttgcgattatgggctgacggtgactccggtttatatatgacctatcaccaaaatagtaagcgttctgcgtggatgggttatggcagtgatggttcaaaaacatttaccattagcaacgaaaaagccggttcaacgatttctctggataaaaatcatgccgctatttatggtgcacaaagcttcattatcagttcaggatatgaatatagtggcataaatataacgaaaccatcagggacgttttttagattggagacagataccgatcagtctgtctccatcgttaattttgtagacagaaaccccgacaactcaaatcgcagtgtacaatccctacctaaaggaaacggcacgttattatctttaggagctaactgctggcgtgatgacaacgggtttatccgactgagctcccccatcatcataatccaccccgatggcaccttcgtcaccaacgacgaatccgaaggtgcgactgtgaccaaactcggccttggtcactacagaatatccggcatccttggctataacgctgacggggcatggggagttcatggcggtatcagtgttccccgtgacgtcaatggcaatgagttagtgtatgtcgaggataaagtgctgccggatggggctattgaaatcagggtgacgcaccgacagaacgcccatatgcccgctcggttgcagaaccgacgcatcaagtcacaggatgagcagacccattacacggatgatgaaccctgtgatttacctgccggcactcgattagacgtccgtgtccagatgccggaagattctatctggaaccagaaacaggtattggtgtctgatcctcagcaggagcatggcgccacgtcagccatcaataaatag

SEQ ID NO: 4158 - DNA, 684 bp, Xenorhabdus bovienii
  Coding DNA location: Contig name=SeqID_16895; Position on contig =29647..30330bp; Strand=-
atgtcttcaagctcagagaaaatagaaatcaaagctggggtaaaagtgcctttcgttcaagcttctactggtcatgctgatgggttgacgaaatctcaagaacaactttttgattcaagttacggcttgcctttcgagctattaagtactttgcaagaaaaaggactattaaaacaagagctgaagggtaaagcgttaggcgaacttgttctcatcagcggcgggatcagcatatttgatgtgaacatagtagtagaatcgtttcctactatgaaaaaaatcatgcaaatgacaggatatggaccaaagggaaagcaagaaaagaaggattttgatactggctcagaattcctgaaattagcacccaaatccacacaaattgactttactgataccgagggaaattccgtttggatgtcagttaattctagcaatctaactatcagcactggtgatatagcccttaagtatggatcaattataccgggaacatggcatgttgttggtgttattgatgctcatcctgatgctttaacagataattctgatactccataccagccgatagtaagcgaatttaagactagtttttcagctgtttttagcatgattagagaaaaaatgggaaggccacctgaagcatacggtattacaccaataatgattttcagggctgtatcatag

SEQ ID NO: 4159 - DNA, 177 bp, Xenorhabdus bovienii
  Coding DNA location: Contig name=SeqID_16895; Position on contig =30413..30589bp; Strand=-
atgttgaagttcaccctaaaagacaagagatctctagaacaaaatcatgaaagtgacgttcagaatgcttttgactacgtgaatagtaaacagaaggaattcatggaaaaaaaagaaaaatttgatgaggatataaaacgtggttcaagactcacaaaacataagttcactttatga

SEQ ID NO: 4160 - DNA, 519 bp, Xenorhabdus bovienii
  Coding DNA location: Contig name=SeqID_16895; Position on contig =30967..31485bp; Strand=-
atgcaagataaaaagcctgatatatcagaattaaaagatactacattagcgcagcaatcttatgaagactttggttatacagtgatacctattggtgttcctgttccttggccatcagaaatcccaccagacggctggcttaaatgcaatggtgaagtatttgatacagaacaatacccaaaactggctcttgcctatccatccggcagattacctgatttaagaggtgaatttattcgtggttgggatgatgagcgtggcgtggattctgatcgcaatgttttatcttggcaggaaggttcttatttggtgcaagatgttaatgataagactgacactgtagttaatttctcactcgatgagcgttctgcgctaaaatgggatccccccagtagtaacgtacaagtgcgcgcaaaggcagtaacaggggcaagttgggaatggaacacagatagtacccacattggcgttagtcgcccccgcaacgtagcattcaattatatagtgagagcagcttaa

SEQ ID NO: 4161 - DNA, 237 bp, Xenorhabdus bovienii
  Coding DNA location: Contig name=SeqID_16895; Position on contig =31732..31968bp; Strand=+
ttggctcagttccaatcggacaaatttttggctgatcgcgccaattgggatttgaaagcccatttgagtgggaatgcctactttggcgataacccattgatatttaatcaagctgcatatttgcagtttgcttataatttgagcgtcagtgatactgactcacaaactttgtgcgggtcatttagcgacgcgcaaaaagaaaaggtattgcggatcatcttaagggcaagtttctga

SEQ ID NO: 4162 - DNA, 174 bp, Xenorhabdus bovienii
  Coding DNA location: Contig name=SeqID_16895; Position on contig =31863..32036bp; Strand=-
atggtttcagtactggcaggcaaaagccatcgtagaacggtgagaagagaagctactgtcgctataggtcagaaacttgcccttaagatgatccgcaataccttttctttttgcgcgtcgctaaatgacccgcacaaagtttgtgagtcagtatcactgacgctcaaattataa

SEQ ID NO: 4163 - DNA, 138 bp, Xenorhabdus bovienii
  Coding DNA location: Contig name=SeqID_16895; Position on contig =32315..32452bp; Strand=-
atgataaaaatcagtatgttaagattaaagatgctttttcgctcttatagattcacttccgacgaaattcgtcgtcagtcattcactcacttctgcaccaagaactccaaaaggtatcgccctctcaaaacctggtag

SEQ ID NO: 4164 - DNA, 105 bp, Xenorhabdus bovienii
  Coding DNA location: Contig name=SeqID_16895; Position on contig =32522..32626bp; Strand=-
atgaaagcaaaaggtatggtggaaatcaccataccctcacctgcatatataaaccaagatgtgatatcccaccttgagatgatccggttttttgttcatgaataa

SEQ ID NO: 4165 - DNA, 291 bp, Xenorhabdus bovienii
  Coding DNA location: Contig name=SeqID_16895; Position on contig =34379..34669bp; Strand=+
atggggcggagcggcttcaatcagggtcggtttagtcacgtaccggacaaaggtttcatggctgacgaacgtcgcgccacaattgatattctggcactggttgtaacgttctttggtttggggggtatgttcaaaactgctgcgggtgtgggcaacatgatagcacagggggcatttcatcataatatgagtgccttattgaaaaggactgccagctctgttaggcaatggcgcgattatagcaaatcaggcgctcatgtcagcatcagaaattttcacttccagctctaa

SEQ ID NO: 4166 - DNA, 750 bp, Xenorhabdus bovienii
  Coding DNA location: Contig name=SeqID_16895; Position on contig =34625..35374bp; Strand=-
atggctgacatcaatgtcaatgcgatctgccttggcgcgtccccggttaatcagtttgcccgaccagtacggatagacaaaacgctggctgagattaacctcagccatattgaccagaccaacgaatctgatggcagtttcctgacccggctggcaaaacaggaaggcgccattgccacggtcaagaacggctgtctgttgtttatccggcaagggcaaaacaaagtggccagcggtcaacccctgcctgcggtcatcctgacccgccagtcgggtgacggctatcgcttttcactggctgatcgtggggcttataccggggtttcggccagttggctgaacacccgtgaaccgaagaaaaaagaaaacatcaccgtcaagcgcaggcggcgcaaacccagcaaggccaatccgcagaaaaaagacgaaaaaaaaggggattatctgattggcagtgaggggaatgtcctggtactgaaacatacctacgccaacaaaaccaacgccgagcgggcggctaaggccgaatgggagaaaatccagcgcggggtcgcttcgttttctattcaattggcaaagggacggccggaactgtttcccgaaatgaaagtgcaggtcagcggcttcaagccccagattgacgcggcagactggacgctggtcaccgtcacccataccttgaatgacagcggcctgatctcggccttagagctggaagtgaaaatttctgatgctgacatgagcgcctga

SEQ ID NO: 4167 - DNA, 930 bp, Xenorhabdus bovienii
  Coding DNA location: Contig name=SeqID_16895; Position on contig =35267..36196bp; Strand=+
atggctgaggttaatctcagccagcgttttgtctatccgtactggtcgggcaaactgattaaccggggacgcgccaaggcagatcgcattgacattgatgtcagccatgacgttttgggcggcggcctgcggtgtgccgacggccagtggcggcagattgtcacgattgaagatgcggtgaaaggcggctgtaccctgtttgaccttgaccagttacggctggaatacagccccgacgagtaccagaacctgctgatgtgtgagtttatggacgatatcgaatccattttctcactgcccctgatgcagggctgcatggtcgatagctgggaaatctggaatgacgtccagcccctgatgctgcgcccgtatggttacaaccccgtctggatcggttatgacccggccaagggcggcgaaaagggggacagcgccggttgtgtggtgatcgccccgcccctggtgccgggcggcaagttccggattctggagcgtcaccagtggcgcgggatggactttcgcgcccagtcggacgctatccagcggctgaccgaacagtataacgtggaatatatcggcattgactcaaccggcgtcgggcatggggtttaccagaacgtcaaagagtttttcccggcggcacgggagtttgtctataacccgtcggtcaagaacgccctggtgctgaaagcgtgggacatcatcaaccaccgccggctggagtttgacgccggacatacggacatcgcccagagttttatggctatccgccggtcgaccaccgccagcggcaaccgcccgacctatgaagccagccgcagtgaagaagcaagccatgctgatttagcctgggccaccatgcacgccctgtttaacgaaccgatcaccggtgacaccccccaacacagaaacatcgtcgaggtctactaa

SEQ ID NO: 4168 - DNA, 1029 bp, Xenorhabdus bovienii
  Coding DNA location: Contig name=SeqID_16895; Position on contig =36196..37224bp; Strand=+
atgagccgtaaaagtaaaaaacgccagccggtgaaaaccccagcccctacccagtcaatggaagccttcacctttggcgacccgatcccggtactggacaagcgtgaggtgtttgattatctggaatgtgccctgattgataactggtacgagccgccgatcagttttaacggactggcgcggtcgttccgggcagccccgcaccacagcagcgcggtgtatgtgaaacgcaatattctgaccagcacctttgtttcccaccggttactgagccggcaggcgttcgattcgtgggcgctggattttatgctgttcggcaatgcttatctggagttacgcaaaaaccgccttggccaacctttaagcctgcatcattgcccggccaaattcacccggcgcggggaagatctggacacctactggtttgtgcgttatggctatcagagccagccgtatgcgttcgagacggggcaggtgtttcacctgattgaacccgacattaatcaggagttgtacggtttgcccgaatatctggcggcgttgccctcagccctgctgaatgaatcggcgacactgttccggcgcaagtattacctgaacggcagccatgcggggtatatcctgtatatcagtgatgcctcgcaaaatatttccgatgtgaacaatatccgggacgcgctgaagaacagcaaaggccccggcaacttccgcaacctgtttctgtatgcgcccggcggtaaaaaagacggtatccagaccattccgctttctgaggcggcggccaaggatgagtttttaaatatcaagaatgtcagccgtgacgatatgctggccgcgcaccgcgttccgccacagatgatggggattatcccgcagaataccggtggctttggcgatgtggagaaagcggccaaggtctttgtgcgcaatgagctgatgccgctgcaaagcaagatgaagcaactcaatgactggctaggggaagaggtgatccggtttgagcgctattcactggaggatgaagagtaa

SEQ ID NO: 4169 - DNA, 420 bp, Xenorhabdus bovienii
  Coding DNA location: Contig name=SeqID_16895; Position on contig =37579..37998bp; Strand=+
atgactcatcaacgcacatacatctcccatattaacgattttcttgagcaggaaagacgtcagggacgacattggcgaccacaccgagccataaatgagttttattacgctggccctgcaattatcacagggcatccaggcaaccactatccattgttacatttagttttttcttttaatggttttacagaatctctaatctatttcactggccctagccctcgtcctatctctagctttgtccctagcattgtccctaactttgatcttcactttggctttgacattgatgttaaccatagcatgtgtgtggtgttatatcgcaactctttttggtttgaatcccgtgtagaccaacttcccagagatatgcaaaacgctactcgtgctcttatggcacattggtttcgatacggttaa

SEQ ID NO: 4170 - DNA, 303 bp, Xenorhabdus bovienii
  Coding DNA location: Contig name=SeqID_16895; Position on contig =38077..38379bp; Strand=-
atggctaaatcccccgcagaacgtaaagccgcccagcgtcaacgccagcaggaagctggcgtcaccaaaatagaattgctcctcgataatcaagagctggacatgttgaagcgtaattgtgtactgaaacggccgaggcgcaatccctatgaggtggttgaatatctcgcctcgctgatctgcaaagatgaggctgacttacgccagaaaaagtgtggtgacaatcttcctgtggctgaatgctgcttctctggtgaagctacgtgctggaataccttaggctggcatgagttaaaattgtga

SEQ ID NO: 4171 - DNA, 690 bp, Xenorhabdus bovienii
  Coding DNA location: Contig name=SeqID_16895; Position on contig =38398..39087bp; Strand=-
atgatcactttacagttaaataccgaaattatttacaacattaaccgtaaatttgttttagatttattcgtctggcagaagcgctggaaagccaatcaacatcaccgtaatcgctttttgcataaatgcaggcaggtgggtgctgatcattatttcgtactggaagcattaagcgatgcctgtcgaacaggccggaataagatttttatgtctgataaagattggctacggaattttgtttataacgttgctcagtattttcctgaacagcaaacgcacttaaccgaaaatgccgaagatatccggttactgacgctcagtaatggcgctgaaatttattttttacatggggatagttctgttgctggtatatgcggtgatgtgtatgtctctgaatgggcttattccgatgatcctattaagttgatacgtctggctttgatgatatcaatgcatacaaagtggcgaagaacgttttattcttccagagactcaggggacaacggcgaggcagcctacaaagaattctttacccggaattgcgtcaaaggtgaatcggcttttttcgatacagtcacattgtttgatgatgttgaaaatcgcttagatgaggaacggatccgtaacatgtggtcaccgcaggcttttgaagagctgtttttgtgccgcttgccgcatccgcgttggtga

SEQ ID NO: 4172 - DNA, 159 bp, Xenorhabdus bovienii
  Coding DNA location: Contig name=SeqID_16895; Position on contig =39284..39442bp; Strand=-
atgggggcattgcagccccttgttagtcagatagtccgactgcccgaccgtggtatcaggggagcccctgatttgggagcctcctttctggctggcttgggttctggcaaaggtaacgccagtgcatcagcaacgactttagccgagcatacacgctga

SEQ ID NO: 4173 - DNA, 492 bp, Xenorhabdus bovienii
  Coding DNA location: Contig name=SeqID_16895; Position on contig =39479..39970bp; Strand=+
atgcaagcgttggacggaaccgtagcaggcgcccagacgatcaagccgaacggtgaaaagcgccttgtctcaggctcacagaaaaagggcagttttatctccttatccgaaattaccggaatgcctgacacgttcatcattacagaaggctacgcgacggccttaaccgtcagccagttgcatgatggcgtgatactggctgcaattgatgaagggaatttaccgactgtagccgaacaggtcagggaacggtggccaactgcgaaaatcattcttgccgctgacaacgatatgaagtccggtcataagaatgtggggaaaatttcagcagaaaaagcggctaaatctgtcaggggctgggtcacattgccgcccacggaagagaaagcggactgggacgattaccgccagcgtcacgacatcgaagcggcaaagcaggcattcagtaatgggttgtatcaggtggggaaaaagaaccaatgtcagtggtga

SEQ ID NO: 4174 - DNA, 1749 bp, Xenorhabdus bovienii
  Coding DNA location: Contig name=SeqID_16895; Position on contig =39958..41706bp; Strand=+
atgtcagtggtgattaatttagcggaacaccgtgagaaagaacgtgatcccctgataccgtttattgatgtgcgcaacaccggagttttttacgcgaccccgaaattagacaaagaaaccggggaaatcatcaaacctgaacagtggttatgttcaccgattgacgtgatcggcacgggcattgatgaaaatgatgagcaatacctgatagtccgctggaaaacgaagggtaataaagacccggtcattaaaggggtagcgtcggccgacattggagaacgcgaaggctggcgaatactcaaggcgggcggtgtgcaggtgaccacaaaaagtaatctcagggcgatcctggctgactggctgatacgaagccacacaaaggaaatctggagtatgacggcaaaatcaggctggcataaaggggcgtatatcatgccggacggttcagtgattggtgtacctcagcagcctgttttgtttaacgggggaagcgctgccgcccatgcttacacggtttcaggcacaacggcaagctggcgtgaacaggtggcgcggctggcaaataataacccgttcatgatgctgggcattgcgacggcgttagcggccccgatgatagggattgtgggggcggacgggtttggtgtccatctgtatgcgcaatcgaccgccgggaaaaccacgacagcagatattgccaccagcctatacggtaagccggatgagcaacggctgacgtggtatggcactgcgctgggtattgctaacgaagccttggcacacaatgacgggttgttatcactggatgaagtcggacagggcgcaaaccctaaacatgtccacacctcagcttataccctgtttaacggtaaggggaaaatacagggggcaaaagaaggcggtaaccgtcctttggcaagctggcgaaccgtggtgatcagtaccggtgagaaagatatccccacgttcttgatggaagccgggattaaaattaatgccgggcaattagtcagattgctgaatatcccgatggaaagggcgaaaaccttgcacggttcagaaaatggtaaggcgcatgcggatgctttaaagcgcggctgtcgtgaacattatggtgcggcagggcgggaatggatcggttatctatcgtcacaccatgaggaagccagacaggcttatattgaggcgcaatcacggtggggcaagttgataccggaaagttatggtgagcaggtacaaagggtcagcgaccgctttgccgtactggaggcggctttaatgttggggcgggtcattacgggctggaaagcgcaggattgccgcgatgtgttgcaatatatctttaatgtctgggtggcggagtttgggacaggcaataaagaatttgaacagattgtcgagcaggccgtttccttttttaacgcccatggcatgagccgctatgcccctctgccctatgatgagcgggacttaccgattcgggatctagccggataccgggaaaagaaaggccttcatgataatgatccgatgattttctataccttacccgccactttcaagcaggagatcgcccggggttttaacgtgggtatgttcgcagacacgttagtgaaaagcgacatactcaaaaagccggccagtggaaggagctatcagggcaagacaccccgccttaagcatctggggggcattcagcaacgggcttacatcatggtgttagtgcctgaatcagacgaagaagcctga

SEQ ID NO: 4175 - DNA, 159 bp, Xenorhabdus bovienii
  Coding DNA location: Contig name=SeqID_16895; Position on contig =41888..42046bp; Strand=+
atgagaaaattacgtaaattataccgtcagaaaatcaatggctttacgggcatgcggttggaacttcacaccttgtccgaagagcgattccatgatcatgagctgaccgacaaaattattcttaatctggtgggggggtgtgccaggggttacgcatga

SEQ ID NO: 4176 - DNA, 1122 bp, Xenorhabdus bovienii
  Coding DNA location: Contig name=SeqID_16895; Position on contig =42089..43210bp; Strand=+
atgaaagaattagtggatgtcttttctgattttccagacccacgttgtcagggaaaggtcaaacaccgtgttattgatatcttagtgatcgcggtatgcgctgtcattgctggggctaacgcctggactgatattgaacagtacggtcaactcaaaaaggattggctgagttcatttcttccgctcaaagggggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatggccacggacgtaccgtcagacggcgcggatgggttctgccactgacatcagaaacaaaacacttaaggtcttggccagatattcaagctcttctggtaacagaaacgatacgacaagaacactattctgacacggtgacttctgactttcgttattatttaagcagttgtcatgattctcccgcctttcagttaggtgcaatacgaaaacattgggctatcgaaaatagtttacactgggtactggatgtcactttccgagaagatgattcacggatgagagagcgggtcgccacaagaatatttgcccaattacgtaaaatggcactcaatattgttaaacgagatatcaatagtaaattgagtttgagtgcgcgaagaaaatcagcgggatgggataacggttatatggaagcactgttatttaatcaattttag

SEQ ID NO: 4177 - DNA, 780 bp, Xenorhabdus bovienii
  Coding DNA location: Contig name=SeqID_16895; Position on contig =43252..44031bp; Strand=+
atgaaactcgaatcagccctgaaacacttttacccgaaaacaccgacgttcagtgatgcgtcaaccagtaccgcaccggacagaatgaaaggcatggataccgcagcggctttggggatggcgggatcacaagccaagttcgggatggcggcatttttcgccaagaatgaggtcagtgaagaagacaagttcagtaccgtagaagaactgacccgatatgcaaggcgaaccatccctaagctgatatcaaaggcagcggggaataaactggggccatgtctggttatcttatcgaagatggcgtttgaagattatgcccgttcagccgcgtcgacttgtcagtgttcggaatgtcgcgggaaaggacttatctacggcatgaaagaagtggaaagacaccccggcattattcgtgcggacggtgaagtgattattgcaccgtggattgaaaaagagcaggtgggtgaactttgccagaagtgccacgggaaaggcgtactgtcaagtcgttgtcgctgcaaggggcggggtgtcgtagtcgatgaggaaaagaccgcattacagggcgtaccggttgataaaatctgccctcgatgctcagggcggggttacagcagagtgccatcatcagtggcttatgcggcaatcaaggcgcttattcctgcattgactcaatcatcatggtctcgcaactggaagcccttttatgaaaagctggtaggtaagtgttacgccgaagaaagcagtgcggaagctatgtttagcaaggtgacaaaataa

SEQ ID NO: 4178 - DNA, 453 bp, Xenorhabdus bovienii; identical to SEQ ID NO: 2538
  Coding DNA location: Contig name=SeqID_16895; Position on contig =44169..44621bp; Strand=-

SEQ ID NO: 4179 - DNA, 216 bp, Xenorhabdus bovienii; identical to SEQ ID NO: 2539
  Coding DNA location: Contig name=SeqID_16895; Position on contig =44784..44999bp; Strand=-

SEQ ID NO: 4180 - DNA, 144 bp, Xenorhabdus bovienii
  Coding DNA location: Contig name=SeqID_16895; Position on contig =44942..45085bp; Strand=+
atgcattttggatggttacattttgttgttcacatgagggaactatttgacttaacaaaggaattgagcgtccatcacaaattcaactcgcacggagtacatgatgttcttgtgagggatatccactccaatcaacagctatga

SEQ ID NO: 4181 - DNA, 339 bp, Xenorhabdus bovienii; identical to SEQ ID NO: 2540
  Coding DNA location: Contig name=SeqID_16895; Position on contig =45024..45362bp; Strand=-

SEQ ID NO: 4182 - DNA, 411 bp, Xenorhabdus bovienii
  Coding DNA location: Contig name=SeqID_16895; Position on contig =45339..45749bp; Strand=+
atgacatatttcacgtacaggcatagcagtgaccttattgacttggtggaacaatcagtagatcacacaacgctatgcctgtctattttctggggattcctcagccctaacgggggttttttattgccagaaaaacagataagagttgctattccctttggttggaattgcatgtgtagtatcctagtgttattgatatgtagccatttggagtgtggtatgttaattacgctagttgatataaataaggacaattatgaggctgtctgcgatctatctgtaactgatgaacagctagacgctgtcgtcatgatattttcagccaaagaacaaggcaacggatttgcactgcggcaagaaaagacgcgctattttttgcatagcgagtggctataccacgccagcgcttaa

SEQ ID NO: 4183 - DNA, 354 bp, Xenorhabdus bovienii; identical to SEQ ID NO: 1124
  Coding DNA location: Contig name=SeqID_16895; Position on contig =45646..45999bp; Strand=-

SEQ ID NO: 4184 - DNA, 477 bp, Xenorhabdus bovienii; identical to SEQ ID NO: 1065
  Coding DNA location: Contig name=SeqID_16895; Position on contig =45936..46412bp; Strand=-

SEQ ID NO: 4185 - DNA, 261 bp, Xenorhabdus bovienii
  Coding DNA location: Contig name=SeqID_16895; Position on contig =46587..46847bp; Strand=+
atgtgggtgccttctgataccggacaaaaaacaactatttggcgctttatggtggataagagccatcaaaataaaggtattggacgcaaagcgttatcactggctattgaggaaatcagacgcacagagcaattggaagaaatagaaatcagttatgtcccaagtaatcttgttgcgaaaaatttttatgccagtttcggctttattgaagttggtatagatgaagaagttaaagaaatgctggcggttataagggtatag

SEQ ID NO: 4186 - DNA, 195 bp, Xenorhabdus bovienii
  Coding DNA location: Contig name=SeqID_16895; Position on contig =47115..47309bp; Strand=-
atgcaaccgaacgataaaaacccactcaaacaaaagtcatttaaattcattcttgccggcatgatattactttttacggcgggtattagattgattcaatatgatgatcttttactgggtactgtcgaaagcttattggctattgggcttgttctctttgggcttaaattgaaaaaaggcgaaaataaaaagtag

SEQ ID NO: 4187 - DNA, 129 bp, Xenorhabdus bovienii
  Coding DNA location: Contig name=SeqID_16895; Position on contig =47329..47457bp; Strand=+
atgttaaaatctagcatgagtatcacatgctcggtcattctgaacaactcaacctatcggtctgaccgactagttcaaattcaaggctgcgctccggcgtggcctttttcatatctggaactttggcgt

SEQ ID NO: 4188 - DNA, 204 bp, Xenorhabdus bovienii
  Coding DNA location: Contig name=SeqID_16895; Position on contig =47656..47859bp; Strand=+
atgaaatattacgttcatactaaaactgataagcagggtgatcatgaagtgcacagcgaagggtgtaatcatacgccactagatgaaaaccgagtacacctcggtgactttactagctgtcagtctgccgtgaaagaggcaaaacggcggggctacagtgctgatggttgttactggtgttcatcggaatgtcacacatcctga

SEQ ID NO: 4189 - DNA, 144 bp, Xenorhabdus bovienii
  Coding DNA location: Contig name=SeqID_16895; Position on contig =47819..47962bp; Strand=+
atggttgttactggtgttcatcggaatgtcacacatcctgatatcagccatatgaacataattaaaggtcacttaggtggccttttttattacctacgcaatgaggaaattatctctgggcgctcgatattgattattacctaa

SEQ ID NO: 4190 - DNA, 333 bp, Xenorhabdus bovienii
  Coding DNA location: Contig name=SeqID_16895; Position on contig =48093..48425bp; Strand=+
atgaaagagaatcctgatttctggatgcatctgggtgactggctcatatcggtaagagagcaaggcatctgggcaacccttgcggggacgatggcattttttcgcggtcgctataacggtggcggctgggtaaaggtttcaatcgacgcctttatgtgtgccatgttcgcctggttcatacgtgatgttttaaatttcatgggtctgaatccagacttggcttacatcggcagtgtggtgattggctacttgggtacagactttatcggtcaattgctgcgtaaggcggcagagaaaagagcgggaggcagcaatgacacatcagatcagtaa

SEQ ID NO: 4191 - DNA, 225 bp, Xenorhabdus bovienii
  Coding DNA location: Contig name=SeqID_16895; Position on contig =48406..48630bp; Strand=+
atgacacatcagatcagtaaatctgcatgtggtgtggatacgttgcttcggattcgccgttggtgggcgctacgtagactgagaaaccattggcgtgatgatatgcgttttttgagatttgcccgtcaatacaaagggatgagcgaccatttcaatttttacaaacgctatcgatttctcaggttactgacagagtatgaacaacaacggggaacaattttatga

SEQ ID NO: 4192 - DNA, 402 bp, Xenorhabdus bovienii
  Coding DNA location: Contig name=SeqID_16895; Position on contig =48627..49028bp; Strand=+
atgaccagaggcattcgcaacaacaatcccggcaatattgaccacaactcagcgaataagtggcagggtcaattgccccacgacccgagtatagaaaagcggttctgtcggtttgaatcaccagagtatggcattcgggcgctgatgaagttgctgtgcaattaccataaaaaaggctatcagacagttgcgaagatgatagaccgctgggcacccactaacgaaaacaacacctccgcttatatcaagggtgtggccaaggcgttaggtgtcgatcctcatcaggtgattagtgtcgataaagtgacgttgattgtgttggccaagtcgatcattcagcacgagaacggcaagcaaccgtattccgatgacattttcacacgggcatttgaattgctatga

SEQ ID NO: 4193 - DNA, 471 bp, Xenorhabdus bovienii
  Coding DNA location: Contig name=SeqID_16895; Position on contig =49025..49495bp; Strand=+
atgaagtggcaattaaaaatcggtgcagtgattgtggctctcgcgctgattggggcagcagtccattccatctactcagtgtatgcagaaaacggacggttaactcaggatattgagacgctgaataagtctctctcagaacaggtcgccatcaacgccacccggcaagagcacatccggcatctcgcagaactggatgccaagcatatggagaaactcgccaatgctgaatctaagatcactcagcttagtgataatttgcgcactaacgttaagcgcgtgtacgtcaaagcccaatgtcccgtgtctgaaaccgctgccggctccggcatggatggttcaagacccgcccgactggagaaagacgctgaacaagattatgtacgtctcctcggagaacttgaaaccctcgaaagccagttcctcggactgagggattacgtgaatactgaatgtgggagaaaagagtga

SEQ ID NO: 4194 - DNA, 213 bp, Xenorhabdus bovienii
  Coding DNA location: Contig name=SeqID_16895; Position on contig =49477..49689bp; Strand=+
atgtgggagaaaagagtgacagacaaacttaaaccttgtccgttttgtggaagtgaagcacaccattacccagatggtgacatggaagggtattcaatccactgctcaaactattcgtgcgtcataaatacatttggttatctggcagctaaagaggccgaggatgcttggaataaaagggcaaataacacattgccaccgcagagcaaatga

SEQ ID NO: 4195 - DNA, 249 bp, Xenorhabdus bovienii
  Coding DNA location: Contig name=SeqID_16895; Position on contig =49782..50030bp; Strand=-
atgctcaataaaaaatatagtccaattttaattcaaggcatagaatatgctatacatatttatgaaaacactgatggcgaagtaaatatagaagcagtagatctagataataataataacaaaataaatgtcacaacatcatatgatactatatctgattacaaccgtgggaacgatgaaggccttatcgaatttgtaaaaaaattcgtgatagaagaattacaaataaaagccactaaacataattaa

SEQ ID NO: 4196 - DNA, 1023 bp, Xenorhabdus bovienii
  Coding DNA location: Contig name=SeqID_16895; Position on contig =50237..51259bp; Strand=+
atgccatcagttaacgctggtggcttttttgtatctgagttccgcgcactcaccgcgcatatcaataaaacgcagccttacagaaagtcgaacctgagaaatccgttaatgggtatttctgcgggcggctttctacgtgagcaggttcgattttctataaggaaatacccgatgagtaacatcattccatttgagtatgacggtcaccctattcgctttaatgaagaggggtggatcaatgccactgatatagcaatgaagtttgataaggagccgacagcatggcttcgtcaaattgatgttctggaatatatatccgctcttagttttcgtgtatttggtatttctggcactgtgccagagattaacgaaatcaagaggttagcaataagttcaggtgcagctagagccaagatactgagatttgctaaaaagagcggatttgtgaaagtgaaaagtggtccaactggaggcacatggttacatccaaaactcgccatccgttttgctcgctggttgtctgttgacttcgaaatttggtgtgatgaacaaatagatgtattgatccgtggtatccaacccacattcactgaccaacgcatcaatgccatttttcttcttgataagcccgccacatgggaaaagcgttttcagcagccctcttatcaggcactcagccgtatgtcaggtttgccttataagggtcatgttggcggcaccccgtcactgtttgggatgatcacatccaagtgggtgtatcaggttgtgttgcctgactcggtatatgcggaggcaaaagaagcagccaaaagtagcggggacaagatccatcaataccttaaaccggaagcccggaaactggtacaggagcaactgaaagcggtcacgatactggctaacggctgcgtggattacaaagactttgaggctcgttgcgttcagtcatttggaaaatcaggtgagcaaggtttgctgattttaccaatagaaagggaattcagttactcagcggtcagacattag

SEQ ID NO: 4197 - DNA, 366 bp, Xenorhabdus bovienii
  Coding DNA location: Contig name=SeqID_16895; Position on contig =51524..51889bp; Strand=+
atgacagaactgaactatgaagcgattgggcgttgtaaggtgttaagggaaaagatagaggctttacgcacgcgaagacaccaacacgtttataagctgagagatgaaacttcaaggctgacatttagtgatggccatttgatacctgaaattgctgagtttgatatgggtctcatgcaaagtcagctgaaagatattgcccttgtggacagtgacctgatgcacgcagtacgcgagtttaatatctggtgtcaggatgcaggagaaccatcaataaaattaaatccttcaactaagaaagatttggagaaattaaaaccattgtcatttgatgggtttcccggctctgcgttattagggcagtga

SEQ ID NO: 4198 - DNA, 744 bp, Xenorhabdus bovienii
  Coding DNA location: Contig name=SeqID_16895; Position on contig =51977..52720bp; Strand=+
atgacacagagtatctacttatcactaaaaggcaagaaacagggattaatttcagcgggatgttcaacgcccgaatccatcggaaatcgctatcagacaggccgggaagacgaaatacaggtactgagtgtcagccattcagtgagccgcgaccagaatgcgcatcatcacccggtcagctttaccaaacccattgataaatcctcgccgctgttagcaatggcaattgacggaaacgaattgctggaagcacgttttatgcactaccggacaagtccaatggggcaactggaattcttttatgaaatcaaactgaccggcgcgacgattgtcgatcttgcctataattatccccattccatcaatgataacggcgcaataccccatgaagtggtcatgctcgattataaatctatctcatgtcagcatattgcggcaggaacttcgggctacagcattacacaattatccgggcgcgaagaaggcaggccgctattgtccgggttctcgaatgttataccaatgaagaaaccgctggtcgaagaaacgccggcaaaacctgctaaacatcatgctcgctatcgttgtgtggatgacgatggcaatcttttaaccgcacacaagtatcgggtttgcctgccggatggtcaaataaaagaagggaagactgacaaacaaggttacagccaatggcatctcactgatgacaaaaataaacttgaatttcaccttttaaaggattaa

SEQ ID NO: 4199 - DNA, 1170 bp, Xenorhabdus bovienii
  Coding DNA location: Contig name=SeqID_16895; Position on contig =52725..53894bp; Strand=+
atgccaacttataccgtttatacccaagttaaatcgaatgttccagccgaaaaactgctttacgatttaattatttctcgtcaggatgaaggaggaaatcatcatatattactggatgttgaaaaagcgcaattacaaagtaattatgaaacgcaaaaacatgtcactcaggaaaccgatgacgatctttccgtgatgtatattatgcaaatcatgctttaccgcaagcatggttcgaatacgattcaggcattgcaagcgccttttaaaaaaatgtatacgctgggcgaattcgtggctggcaaagcctgttcggataataagcgagaaaatgcctgctattttgaaagtacggctgaaacaaaacctgtcagcgatggcgataatacgatagaattaaaaattactattcctgaaagaccgtttattgcgaaagaatatccaattggtcatcctgacgacccatttgaaaaaaataaaattgaatcggaaattcaaaataggatatctaaaaaaaactttccagatcaaaatggggcaagtttatgtggtccagcggcacttttttattgtttgcaaatggatagacctgatatttatgagcaagctgctcgtgaattatggcaatatggcagaactaaaattggtcaattagaaattaaaccgggtgatggttgtcgtcatcctaaaggaactttttatgacaagtacggcgcaagaatctcaggattagattggttgacattagccagtttaagagactcagaaaatatgatttttagttatgatgaggttgatgataaggctgctggtgtgactatgtggggaaaattgactgaatggtttgaaaaagctggttatgaaaaagtatttagtaatattggattgacacatagtaataaagaagatatcgaaactctgaataattatatagaacaaggtttccatgtggtctctttaatttctgctggtatgttgcaaaatatggaggaaacatcaggaaaaaatcattggattgtttgggtggataaagtagaagaaagtgaaaatggtactaacgttaaagcattttcatgggggagagtaaaaacttgggtaaaagaggatgctacgtatgagtattttatcaaacacacatttggaggattggttttcaagccacttaaataa

SEQ ID NO: 4200 - DNA, 468 bp, Xenorhabdus bovienii
  Coding DNA location: Contig name=SeqID_16895; Position on contig =53839..54306bp; Strand=+
atgagtattttatcaaacacacatttggaggattggttttcaagccacttaaataaaatgaaaaaaataatatttttattttttattatattaacctcatcatgtagcacaatttcggtatctgttcaacctaaaggaaattatctacctgacgctatggtaggtaaaaattatcacacttctatttctatagtaggagggccagtaattgtgagtgatgaaaaaaaaccgactaaatttgtcatcatagaacccaacgattctgggatagaatggaagcctagtaaaaagagtttgatatattctggaaaagaagaaatttgggatgattataatcatttagtaataagtggaaaaccatcaaaatcaggggaaatatatataacagtaattggtcgtgtgtatggaactatgttaaatggctccggagagtttcaaaaaaaatatactataaaagtaaatgaataa

SEQ ID NO: 4201 - DNA, 189 bp, Xenorhabdus bovienii
  Coding DNA location: Contig name=SeqID_16895; Position on contig =54287..54475bp; Strand=-
atggtgtttttcggaatagctattttctttaaaacactatttaacaccataaaaaataataaaaaagcctctggaattcagaggctaaacaagggaaaacatgaagacgaaacatttacaaaagatttcattttaaatggcgaattaaatcgccattccgttatatttattattcatttacttttatag

SEQ ID NO: 4202 - DNA, 291 bp, Xenorhabdus bovienii
  Coding DNA location: Contig name=SeqID_16895; Position on contig =54426..54716bp; Strand=+
atggtgttaaatagtgttttaaagaaaatagctattccgaaaaacaccatgaaaaaactgctcgaattacgccagcaaaaagcaacctttaccgaccaaatgcgttcactgctcaccaaagccgaagatgaaaagcgctcactcaacaccgatgaagctaaacaatttgacgaactgcgcaaccagtctgatgccctgaatgcagaaattgcccgttatgaggctctgtctgatgaagaacgcaatcaggccaagaatcagcctgccagcaagaacctgacggcttggtga

SEQ ID NO: 4203 - DNA, 627 bp, Xenorhabdus bovienii
  Coding DNA location: Contig name=SeqID_16895; Position on contig =54732..55358bp; Strand=-
atgaagaaagcacgattttcatattcagatgaaatgaaacaatggatgaaagaacattataaattgacgcgccatgaactcacggacgcgtttaatggccgctttaatacgaaccgaagcagggagaatattagcgacctgcgtaaaagtttaggtttgcgcaccagacagtcagctaaatggcaaaagggagataaacccgttcatgcaggaacccagggagtattgaaagcctctcttggctcgtttaaaaaaggacatctgacctggaataaacaacccgttggcactgagcgcatcaatggtcatggctatgtggatgtcaagctttccgatcctggcatatggaaacccaagcactatctgatttgggaaaaacatcacggtaaacgccctgaaaacagtgtcattacgtttaaagactgcaaccggttgaactgtgatattgataatctgatattgattacccgtgcagagcatacgatagtcaataataccaacaggaaactgaaaggaacagcaacagaatttaaacccgtgctcatcaatttggcaaaaataaaacacgctatcgcaactaaaaccacaaatgaccaacgaccaaaaagaggcaagacccatgcttaa

SEQ ID NO: 4204 - DNA, 600 bp, Xenorhabdus bovienii
  Coding DNA location: Contig name=SeqID_16895; Position on contig =55355..55954bp; Strand=-
atgatccagcgatttgagtataccgctgaaatggaaagctggatgaaagccaactacctgcggccattaggcaaactcacggcgcgttttaatcagcattttgctgtcaaccgttcaaatgaagccattaatggcctcagaaaaagactgggactacgtactggccgtagtggccagttttgcaaaggacaccgcccttttaatgccgggactaaagggttatccaaacccaatgcaggttcatttaaaaaagatcaggccgcatggaataaacgcgatgtgggagcagaacgggtcaatgtttacggttataccgaactcaaagtggccgaacccaatatttggcggccgaagcaccacgtcatttgggaaaaacatcatggcaaacgacccaagggcactatcctgacctttaaagatggtaacacccaaaattgccagattgataacttactgatgctcactcacaaggagcatggcgttataaacaattactatcacgccgtatccgtagaacataaaccgaccgccattaatctggcacggataaaaatagcggtggcaagcaggataaaattggcgtcagaggggcaaaaatga

SEQ ID NO: 4205 - DNA, 228 bp, Xenorhabdus bovienii
  Coding DNA location: Contig name=SeqID_16895; Position on contig =55954..56181bp; Strand=-
atgaaaaatacccttgaagatttgaataaccatctttttgctcagttagagcggttgtctgacgaagatctttccggtgaacagttagagaccgaaattcgtcgtgcaaaagccacttcgggtgtggccacccaaatcatcggcaacgggaaactggcttttgatgttcagaaggcactgggtaatcaggaaatcaagtccgcgcctaaatatctggagggaagataa

SEQ ID NO: 4206 - DNA, 180 bp, Xenorhabdus bovienii
  Coding DNA location: Contig name=SeqID_16895; Position on contig =56195..56374bp; Strand=-
atggctgcaaagttagaaaccattctcttttataacgaagaaatcaaccggtttgaagtgacatggtcatccgatttatctgcggatccagccccaaaggaaaaaattgagctggagaaattaaaaaatacgttgaagggcgtactggaatcaggcatccctcacggccaagtgcattaa

SEQ ID NO: 4207 - DNA, 315 bp, Xenorhabdus bovienii
  Coding DNA location: Contig name=SeqID_16895; Position on contig =56462..56776bp; Strand=+
atgcgcacccggaacggtttcaccgcgttcgatagcgtcctttatcgctttcttgtccggggcgataagggtttgaacgtccaccagctcatcgggcagcaacatttcgttatcgataatgatcttggctacacacgggcgcacactaaaggtatttttagtggtcttaaggctattcagatcagccttcagcaaacaatccagcgcatatttcttgaggtgtttggcggttctgtcgcattaacggaacttcaggtaaacttcccggtttttgcgcgggttccaaacgatgcccctgagccgaaacgcctttaa

SEQ ID NO: 4208 - DNA, 234 bp, Xenorhabdus bovienii
  Coding DNA location: Contig name=SeqID_16895; Position on contig =56751..56984bp; Strand=+
atgcccctgagccgaaacgcctttaaacgtctccattatcccgtcgatatcattgctcaatgtgtccgttggtatttggcctacgccctgagtttgcgtaacttagaggaaatgatggttgaacgggggattgccgttgatcattctaccctttcccgttgggttcatcgtctggttccgttgcttgtgaaacgttatcggcggtgcaagcctgatgttgggcatcgctggtga

SEQ ID NO: 4209 - DNA, 462 bp, Xenorhabdus bovienii
  Coding DNA location: Contig name=SeqID_16895; Position on contig =56985..57446bp; Strand=+
atggatgaaaccgatatcaaaatcaaaggtcaatggaaatatttgtatcgagctgtggactcagacggcaagacagtggattttttgttgacggctcgtcgggataagtcgtcggccttgcgtttcttcaaaaaggcgatgcgtcagcatggccaaccggacgtggtgacaatggataaaagtggcgccaataaagccgcagtggatgaattaaatcaaggaaagccaaaagaggaagccattgttatccggcaaaacaaatacctcaataatctgattgaacaggatcaccgcaacatcaaacggcgaatacatcccatgctgggatttaaacatttccggcgagctcaaacgttattgagcggtattgaattggtcagtatgttacgtaaaggacaatatccgcaagaaccagagtgttttctttcacccgccgactttttctatcaattggctgcataa

SEQ ID NO: 4210 - DNA, 141 bp, Xenorhabdus bovienii
  Coding DNA location: Contig name=SeqID_16895; Position on contig =57472..57612bp; Strand=-
atgaggtggtttttaaattcctatagtaacgatatcgaaaaagaaataatgagccattttgatgcatgtatcccgctggctaaacaaccgcgatatattgtgcatacgaaatgtggttctgtcgcattaacagagcgctag

SEQ ID NO: 4211 - DNA, 585 bp, Xenorhabdus bovienii
  Coding DNA location: Contig name=SeqID_16895; Position on contig =57775..58359bp; Strand=-
atgagccaccttgttgaagacatctatgtcaatattaaaagcttacttaataaaccttatctattttttggtcacagtttaggtagccgagtcgcttttgaactaataagaaaaattaacgcagcatcattacctctccccatcgaatttattgcctcaggcagtaaagggccccaggttcctgctatcagagaaccattaagtgggttaccggataaagattttatcaatggattacagacgtttggccgggttgataaacaagtcatcgacaatgccgaattattgtccctgattttacccgcaataaaggcggattttaaaatttcggaagaatatcattatgttggaacagaatctttctcctgtactttaaccgtgtttggtggaaaaaatgatgccatagtcacagagcaagaactctattcttggttagatttatttgaacaagagaaaaaggtcatcatttttgaaggtactcacttttttattgacgataataatgaacctgttattgatacagttcaaaacattatcaaatcaaaaagttcccaacaatataaccgatatccaccaacaatataa

SEQ ID NO: 4212 - DNA, 348 bp, Xenorhabdus bovienii
  Coding DNA location: Contig name=SeqID_16895; Position on contig =59268..59615bp; Strand=-
atgaaatatacaccattaggagacttaactaaatgggaattaaaaaaaatagactatagcggggcattacttattaatttcccggcagaaaataaaagatcagtcgtttatattgaaaatagtaaaataattgccctcgatgataaatgccctcatagaggcgggcctatacatctttgccggaaacattctgacggaaaactagaatgtctctggcatgggaataccataaagaaaccttcaatatcaaaagatgtatcagcaatttatcatcggactaccggaaaagtgactcttgtgtctgtgactaaaacgaatagagagtggccagttaaaacgttctcttag

SEQ ID NO: 4213 - DNA, 144 bp, Xenorhabdus bovienii
  Coding DNA location: Contig name=SeqID_16895; Position on contig =59584..59727bp; Strand=-
atggagtttttaaatggttttgaaaaatctacaattttaaatgctggagaaggaattattatcgaacataatcggttacatggtgctttaattaaatcagaatcttgtgattatgaaatatacaccattaggagacttaactaa

SEQ ID NO: 4214 - DNA, 543 bp, Xenorhabdus bovienii
  Coding DNA location: Contig name=SeqID_16895; Position on contig =59871..60413bp; Strand=-
atggctagatatgccagtggaagctatggggaaattgccagttctttattcaagataattattgatgaactcggttatggtgatttttctaaacatcacgcaacattataccgagacacgcttaattctgttaatttaaattctacacctcattactactggcaatattatcttaatggcagcttactattagcaaattattataatatggtaacaaaagacaaaagacaatcttttcgttatattggcgcaacttatcaagcagaaacgtctttcattacgagttgtaaaatttggaaaaacgcattaaaagaagcattgccaaatattaatgtcaaatattttaatgagcattgtcacatagacattgaccattcaagaatggtatttgaaggattagtctcaccggctatagataaatatggccaaattgcagcaacagagatcattagaggattcgaagaagcatgtttaatcagtgatatcagcgaacaagattttatacgtcagatagaatggaaggataatgctgaaacaatataa

SEQ ID NO: 4215 - DNA, 519 bp, Xenorhabdus bovienii
  Coding DNA location: Contig name=SeqID_16895; Position on contig =60527..61045bp; Strand=-
atggatcgctggaacgtgacggaaaattcatacttgaggagttttaaaatgaataaaaaacttatacgtgattataaaaaaattgaaaatttcaacgacattaatataggtagagatgctattcttgcatttgctgattcagaacaatgtattgataacggaaatcgctacgaagaacaattttatggtcgaagaataagaccacacgtccttaaatatattgatctttcgagtcctttaaccagagataatatcttaacatatagtgcattcgctgcaaatagaactctttttaccatgaatgaaatggattttttaatgcttcctgaaatggataaattcatctgggaagactatcaaaaattttattctgatgagcgctttattacttctaatgcaggcattaggcttttggaaaaatatctgttttcattccttaatgatgaaatcattattactgaaaactggaataaagaaagagttaaagaatatttttctcattcgcagatgaatcattaa

SEQ ID NO: 4216 - DNA, 867 bp, Xenorhabdus bovienii
  Coding DNA location: Contig name=SeqID_16895; Position on contig =60999..61865bp; Strand=-
atgcttaatagtagcgtgaggtcatttgatacttggcattactccatgttaaatgataatgcgaggacaatagctttagaaagtgccattaaggaattgaatctaaatggtaaaaatgtttttgaaattggtactggcgcagggttaatatcaatgatgtttgcaaaatatggcgctaaaaaagtattaacttgcgaaataaatgagcaactatcgaaagaggcaatcgcaatatttaaattaaataacctcgataagtgtattactttaataaacaagtcaagttccaaagttatagatgatggagatcttgattttacgccagatattatattcactgaaactattgattgtggcgtcataggtgaaggtttctatagtatttcagaagatattaaaaaaatcgcacaaccacaaacaataatcatgccttataagatagagcaatatggctatcttgtagagagtaaagaaatatacagcctcaataatgttgctattattaaaggcctggatctatcgccacttaatcgttatagcacaaaaaatttctttcctgtcagatcccatctttacgaaaataaattgctaacccctctcacaaatataaaaaactatgactatttaaccgagatttcaacaacagaaacttcgacattctcaataaatgaagaaggtatttgttatggcatgttgtctttctttgttgccaaatttggatcattctatgtttcaaataaagccggcttacaaagccattggcatcaggcatttcatcccttaaatacgccaaagaaagttttaaaatataagcaatattatggatcgctggaacgtgacggaaaattcatacttgaggagttttaa

SEQ ID NO: 4217 - DNA, 972 bp, Xenorhabdus bovienii
  Coding DNA location: Contig name=SeqID_16895; Position on contig =61911..62882bp; Strand=-
atgagagccaaactgacacaatctatgaaagactacgagtacacatgctcaaacgtaatggataccgatttttactttaaaagtattgattatgttagatcttcttataaagcactattttcgcggttccccccaaagccacgagatggaactgtttctgaagatctgcaattcaaaagttcagtaacagacaaaatacttgatatgcgaattcattcgcctaatgaacagcttgaatcaaagcaaattttaccctgtattatctatgctcacggtagtggttttgtaagtggtgatctgagtgttgttgatgctatgggtagagatttagcacttgatcttaatgtcagagtcgtggcttttaattaccgtctcgcccctgagcatccatatcctgctgcccttgaagattgttgtgatgtttatcttttcatacgtcagattgcaaaacaaaaaggcatcaatattgaccaaatttattttgctggtgagagctgcggtggaaactgggcgatagcattacccctttggctacgagataataatctaccacaactggccggctccattgcaatcaaccctgtattggatgttcaccgatgggctcaaaagaaagtcagcgatgtatctaaagcattctgtgatgaaatgcatttttttaccacatcatatcttggccaaaatgaaaagaaactcatccaatacgcatctccgttactcgctgataatctttccggattacctcctgctgtattttggtctgctgccattgacccgttgtctgatgacgtcagaacactatcagatcgcatgaaacaaaacgggattaatgtttatgtcaatattgaagatgaagcgatacatggttgtttacgcgcaagatatcattatttatttgcaaaaaaagggtatgaaaatttattactactcataacaaatttaattagtcttaaaatgaaaaataaaaattag

SEQ ID NO: 4218 - DNA, 1074 bp, Xenorhabdus bovienii
  Coding DNA location: Contig name=SeqID_16895; Position on contig =63174..64247bp; Strand=+
atgtcttggagcaaagataatactctattaactgaattagatccccgttggttggatataaaggcgaaaaacatcaaagctgacggccacttcgtctacgccgttaaaacaacaggaatttattgccgtccatcctgtccgacgagaattcctaagcttcatcacatcgagatttttgataattgtgaatttgctgaaaataaaaactatcgcgcctgtaaacgatgtaatcccaatggtgaatcaatttcaacaaaaaatgaacgcttagtgacaaaggcgtgtaggattatagaaaacagaaggggagatataaaacttgaggaactctcaatgcaggtagaaataagtgcctattttttccaccgtctgtttaagaagatcattggtgtgacgccaaaacaatatagtaccgctattcgtattaagaatatgcataacgaattgattaacaaaaatgaaagtataacaaatgctatatacaattccggttttaattcttgtagccgattttatgcggcaacggataattcattaggtatgacgcccagtgtctatcggaaaggtggcaaggatactttaattcaattttctattaccgagtgctcactaggaactattttagtcgcccgttcattgaaagggatttgcgctatttcatttggtgataatccaacagaacttcttaatagtctccaagataaattttctaaagctgaatttattggcggcgacttagattttgagaatgtagttgcaaaggttattgagcttgttgaaaaaccaggcattctatttaaccttccactggatattcaaggcacagtttttcaacaacgtgtatggaaaatgcttctcactattccgactggaacgacgattagctatacccaattagccgaaatgatcggtaatccgggggctgtgcgtgctgttgcgaatgcgtgtggccagaattcaattgctgttgctattccttgtcaccgggtcgttaaattggatggcgatatttcaggatatcgctgggggattgaacgtaaacgcttattacttgatcgggaagctgcggagtga

SEQ ID NO: 4219 - DNA, 2274 bp, Xenorhabdus bovienii
  Coding DNA location: Contig name=SeqID_16895; Position on contig =64558..66831bp; Strand=+
atgaaggtattgatagcaaagaacgaagtgggtacacgatatcacagtcattatattgaaaatgccgtacaccggttggcggataaattaaccgaccgagatgttgaggtggttattgcagactcatttgatgatagttacacgataattgcatccaatgagccgttcgattgcttaatggtcagttgcgcattgatggatgatgatttatatcgagaaatacagcgattattaaataaattgtttgaacgccaggaaaatgtgccggtatttttattaagtgatcgggaaaaaaccgtatttctgctaaatcatgaattgctggaacagttgactgaatttgcatggatacttgaagactctgctgatttcattgcaggcagggcaattgcggcaatgcagcgttatcgtcaacaattattaccgcctttgatggccgctttaatgaaatacagccaaatctatgagtattcttgggcagcgccggggcatcagggtggagtcgggtttaataaaaccccagttggtcgtctttatcatgactattatggcgaaaatctctttcgtaccgatatgggaattgagcgcgcttcgttgggatcgctattagatcactccggcgcatttggcgaaagtgaaaaaaatgcggccagagtctttggcgctgatcactcttattccgttgtggtaggaacatcaggctctaaccgcacgattatgcaagcctgcatgaccgaagatgatgttgttatcattgaccgcaactgccataaatccatcgaacaggggcttattctgacaggcgcaaagcccgtctatctgctaccgagccgcaatcgttatggcatcattggtcccatctatccgcaggaaatgcagacaaaaacactccagaaaaaactgaaacagaacccactgactcaagacatggctagccgtaaacctgcctatagtgtcgtgacaaactgtacctatgatggtgtctgttataacgccaagcatgtacaggaattgctggctaaaagtgttgataggatacattttgatgaagcatggtacggttatgcgcgttttaacccgatttaccatgatcattatgcgatgcgtggtaatccgaaggatcatgcagggccgactgtttttgccacccattcatcccataagttgctgaatgccttatcacaagcctctttcattcatgtgcgggatggtcggaatcccgttgatttttcaagatttaatcaagcctatatgatgcatgcgacgacttctccgctctatgcgatttgcgcctcaaacgatatcgcggtttccatgatggacggcaatagcggttattctttgacgcaagaagtgattgaggaagcggtagactttcgtcaggcattggctcgcttgcatcgcgatttcaacgaaaagggcgattggttttttaaaccgtggaatcaggaaaaagtcaccgatcccgcgacaggcaaaaaaattgcgtttgaagatgccccaagagatttactgaccaaagaacaaagttgctggactatgcgcccaggagacagttggcacggttttgaagacttgcccgatgactggagtatgcttgatccaatcaaagtcagtatcttggtgccgggcatgggagataatggtcaattgctgaagcggggtgtgccagcggcgctggtgacagcctggttaagccagcatggtatagtaccaacccgaactaccgattttcaaattatgtttctgttttcaatggggattaccaaaggaaaatggggaacattgctcaataccttactttctttcaaacatcattacgacgccaatacgcctctcagtaaggttttacctgagctggtaaatcaacatcaggaagtctatggcaatttaggtttgcaagagttgggcgataaaatgtttgcttatttgcatcagaataatccgggcgataagttgaatcacgcgtattccggtctgccggaaatggcgatgacccctcgaacagcttatcaggccattgtgaccaacaacgtcgaaatggtagcgatcgacgatcttcctcaccgtatcgcggccaactccatcattccatatcctcccggcattccgatgttgctttcaggggaaaacttcggagataaaaccagcccgcaaataggttacttacatgccctgcaaaaatgggatcacgaatttcccggatttgagcatgaaacggaaggaacagaggttatcaacggtatttatcacgttatgtgcataaaaaaatga

SEQ ID NO: 4220 - DNA, 1329 bp, Xenorhabdus bovienii
  Coding DNA location: Contig name=SeqID_16895; Position on contig =66849..68177bp; Strand=+
atgactacggtttcagagatgaaaaaagtcggattgatccccgttacgttgatggttgcgggcaatatcatgggatcaggcgtttttctcctgcccgccagcctggcttccaccggaggcattgccattctcggatggctggtcacgatcatcggtgcggtggggctatctatggtgtatgccaagatctcttcactggatgatagcccgggggggtcttatgcctatgctcgacgtgcctttgggccatttttgggctaccagaccaacgtcctgtactggctggcctgttggatcggcaatatcgcgatggtggtgattggcgtcggttatctcagttacttttttgctatcctgaaagacccgatcattctgaccatgacttgcatcgcgatactgtgggtatttgtcttcttgaatattatcgggccgcatgtcattaccagagtacaggctgttgctacaacattggcacttatcccgatcgtggcgacggcggtattcggctggttctggttcagcggtaaaacgtatatggatgcgtggaacgtgagcgggctaaatacctttggggctatccaaagtattttaaacgtgacgttatggtctttcattggggttgaaagtgcctcggttgccgcgggtgtggtcaaaaaccccaaacgcaacgtgcctatcgcgaccatcgggggtgtacttatcgctgccgtatgctacatcttgtccagcagcgtgattatgggcatgatcccgaatgccgcgctgaaactctcatcttcgccttttggtgatgcggcgagactggcactgggtgataccgcaggagcgatagtcgtattttgtgcggcggtagggtgtttaggatcactgggcggttggacgttgctcgctggacagaccgctaaggctgccgccgatgatggtctgtttcctgctatttttggcaaagtgaacaaggagggaaccccggttgctggcctgctgatcctcggtgtattgatgactctcttccaattcagtagcatttccccgaatgcggcgaaagagtttgggctggtctcttctgtttcagtcatttttaccctgataccctatctgtatacctgcgcagccctgctgttactggggcatggacatttcagacaggaaaaaccgcgctacatagtgatcacttttattgcctttgcctactgtatttgggccgtgatgggaacaggcgctgaacaagttgtatggacgctggttgtgatgatgatcgtcacggctatgtatacttttaactacaacacaaagcatcctgctcctttcccattggagaaaaatgattaa

SEQ ID NO: 4221 - DNA, 120 bp, Xenorhabdus bovienii
  Coding DNA location: Contig name=SeqID_16895; Position on contig =68517..68636bp; Strand=-
atggcatcactggcaggcagtaaagtgcatttacattatttgttgtcattatgggaaagagatcgtaagtctcatgaaaggcttttcacattggataaatttgacataaatcacgtttaa

SEQ ID NO: 4222 - DNA, 1092 bp, Xenorhabdus bovienii
  Coding DNA location: Contig name=SeqID_16895; Position on contig =68676..69767bp; Strand=+
atggcgaatcgggaaaaacagatattgcacctcctcaggcgagatccttttattcagcagcaagaaattgccgatattcttggaattagccgttcatgtgttgcggggcatattatgaacctgagcaagaaggggcatataaaaggtaaaggctatattctgtctgacaataggtattctgttacggttggtgcagccaatatggatgttaccagctatgcattcgcagaattaatctatgaagattctaatccggggaaaattcaatccacggcgggtggcgttggccgcaatattgcccataacatcgctttattaggcagtgaaagctatttaatttctgttattggtaatgatttttatggcaaaacattattcgaacagacgaagttagcgggtgtttatgttgattatttccataaattatatggtgaaacgacatcaacctacaattcagtgattgatgacagcggagaaatgcgattagccattaatgacatgaatattctggaaaaacttacgcctgccttattatctcaatccaaagccttaatccagaatgcaggtgtattgattattgactgtaatttgacggaagaatcattagagtggctattcagtcatgccggaaatatcccaatctttgttgatacggtatcaacattcaaagccacgaaaattcgccattggttatcgcatatccataccctgaaacccaatcgatttgaagcagaaatactcagcggaatcaaaattgtcacattggcagatgcggctgacaccgcaacctggttccatcagcaaggtgttcagaggctggctctgagcatgggaacagcaggcgtatattacagtgaaatagcgggaatcgcggattgctcacctgccatttccatcaacattgtcaatgccaatggtgcgggagatgcaatgatggcggggcttgcccattgctggctggaaggcatgacattggaagacagcattcgtttcgcacaagggtgctctgcgctcaccttgtcctcagaactgaccaatcaccccaatttatcccttggtagagtgaaaaaactgttggaattaaaatcatga

SEQ ID NO: 4223 - DNA, 945 bp, Xenorhabdus bovienii
  Coding DNA location: Contig name=SeqID_16895; Position on contig =69764..70708bp; Strand=+
atgaaaaataatcttgtcttaaatgaatacttggatatttctccggaagtagcacatgctttggctgataatcggcctgtcgtggcgctggaatccactattattgctcatggtatgccttatccgcaaaacgtggaaacggcgctggaagttgaaaactgtatccgggaacatggggcagttccggcgaccattgcgattattaatggacgcatgaaagcaggattatttcaggaagacattgagttgttggggaaagagcggcatttagttgcaaaagtcagccgccgtgatctgccgtttgtcgtggcagaggggaaacacggggcgacaaccgtggcttcaacgatgattattgccgaaatggccggcattgccgtatttgcgacgggagggattggtggcgttcatcgtggtgctgaacacacttttgatatttcagccgatttgcaggaattagcgattaccaacgtggcagtagtgtgtgcgggtgccaaatccattcttgatttgggattaacgaccgaatatctggaaacacatggcgtgccactcgtaggatatcaaaccgaaaaattgccggcatttttctgccgtaccagcccatttccggtgagtgtgacgcttgaaaatccccaacagatagcccatgcgatgaaagcaaaatggaattcggggctgagaggaggactggtgatcgccaaccccacccctgagccattcgctatgccggaagctcaaatcaatgcagctattgaacaggctgtccgagaagcgcaggagcaggggattcatggcaaagagagtactccattcctgctgaccagagtatcggaattgacgggcggtgaaagtttacaggcaaatatcgaactggttttcaataatgcgaaactggcagcgcaaattgccattgcttatcaagcaataaataagcaccagtaa

SEQ ID NO: 4224 - DNA, 1257 bp, Xenorhabdus bovienii
  Coding DNA location: Contig name=SeqID_16895; Position on contig =70827..72083bp; Strand=+
atggatattttacgcagtttaatgggaatagtaatacttcttctggttggatatttgttctctgtcaataaaaaaagaattagcttgcgtacggtgggcgctgcattattgtttcaagtcagccttggcgcaataatgctgtatattcccgccggtaaatggttaattaataacattgccaatggcgttaatgccgttatttcttatagttccgctggcagttcatttatcttcgggagtttagttgggccgaaaatgaatgaattatttgatggagcagggtttgttttcgcatttcaggtactgcccgctattatctttattacttctttgatatctattctttattatattgggatcatgaaatgggtcattaatattttgggatatgcttttcagaaagcgatgcgaattagtaaagtggaagcctttgctgcagtaaccacaatctttctggggcaaaatgaattacctgcggtgttaaaaccttttgtcaataaaatgaaccgcaatgagcttttcactgtgatatgcagtggtatggcctcaattgccggatcgatgctggtgggttatgcaggattgggcgtaccgatagaatatctgttggcggcatctttgatggctattccgggagggattctgtttgctcgtttgctcagtcctgccacggagccttcacaagtacagtttgaacagatctcattcagtgagacgcgtccggccagcattatcgaagcggctgccggaggtgccatgttaggattgaaaattgctgttggcgtcgcgacggtggtgatgacatttgttgccctgatagcgctgatcaatggcatgatcggtagcattggcgagttattcggcctgacggggctgagtatgcagagcctgctgggttatcttttttcgcctttggcttatatcatgggggttaactgggagcatactgatctggcagggagtttgattggacaaaaattagcaatcaacgaatttgtggcttatgtgaacttttctccttatttaaaagatcctacggttcttctggataccaaaactatcgcggttatttcgttcgcgctttgtggctttgccaattttggttcgatagcggttgttgtcggtgcatttacagcggtagtacccgaaagagcttcagacattgcaaggctgggtctgagggcactactggcagcaacactgtccaatctgatgagtgcaacaattgccggcttgttcattaatttggcaggttaa

SEQ ID NO: 4225 - DNA, 429 bp, Xenorhabdus bovienii
  Coding DNA location: Contig name=SeqID_16895; Position on contig =72213..72641bp; Strand=+
atgtacagaactattttagtaccggtagatatttcagaagaagaactaacgagtaaggctgttcgctgtgcgcttgatatcgccagagaaacaggtgctaagttacatattctacatgtactccctatttcatccgcaattattaatgcttatgcattaggctatatggaaattaaagacaaagcgaccgtcaaggccgaagaggaattggctatgctggtagattccattgatttaccgaacgatcgcatttcctattcaatttcttttggctcaccacgagacgaaattacctccacggctgatgagattgaagccgatttgatcgtcattggttcaaggcggccgaatattacgacccatctgttaggttctaactcggcggggattgtcagatatgcgaaaacctctgtattagttgtgagataa

SEQ ID NO: 4226 - DNA, 438 bp, Xenorhabdus bovienii
  Coding DNA location: Contig name=SeqID_16895; Position on contig =72753..73190bp; Strand=+
atgtataaaacgattttagttccaatagatattccagaagatcaactcactgataatgcgattaaacatgcagaatttttggcaaaaatctccggtgcaaaaattcacctgtttcacgcagttccggatatctcaaggttttctgtaaattacagctatcactatgatttgctgagtgcttttgctaaaaaagccgttacaaattctgaagaggaactcaaaaaagtcgtagaaaaaatcaatttaccgaaagatagagtatcgttctccgttgcttttggttctccacgagataaagtactctccactgcccgtgaaattggcgcagatttgatcatcgtaggttcaaggtggcctgatatttcaacccatttactgggctcaaatgcgtcgggcattgtttcctacgctaatatctcggtattggttgttcgataa

SEQ ID NO: 4227 - DNA, 189 bp, Xenorhabdus bovienii
  Coding DNA location: Contig name=SeqID_16895; Position on contig =73241..73429bp; Strand=-
atgactattagcactaaaattgagcagcttgagcaagagttgctggcagtggtaagaaaatattcagggaatgaagaagtgactgtaattacgactaacagctcagaaaataacttacaaattcaagttatcattgctggtaaaaatcagttagatatcactctgaattcatttactgaccaggcataa

SEQ ID NO: 4228 - DNA, 1005 bp, Xenorhabdus bovienii
  Coding DNA location: Contig name=SeqID_16895; Position on contig =73707..74711bp; Strand=+
ttgaatagtaaaattagcctgtgggcaagttatcttttgttttttggattaaccgtatcttttcatgcattgagtgcgccggccagctttgagcaggcgaaaatagaatcaagaaaaaatgtctatagtggacaaaccaaatcagcaattggcacattgtattgcggttgtgactggcaatgggtaggtaagagtggcgggcgtgttgatctggcatcttgcggctatcaggtcaggtcacagcagtcacgtgcggaacgtattgaatgggaacatatggtgccggcatgggtctttgggcatcagcggcagtgctggcagaatggcgggagaaaaaattgcgttgagaatgatccgttttttcgcgtaatagaatcggatatgcacaatctggcgccttcgattggtgaagtgaatggtgatcgcagtaatttcagttacggaatggttcctggaaatatggcaaatatgtatggggcatgcagtagtaaagtcgatttcaaatcacgcctgtttgaaccgcgcgatagagtgaaaggcgtggttgccagagtttacttttatatgcacgatcgttataaccttgcgatgtctcgtcaacagcagcaactgatgatggcatgggatcgccaatatccagtagatgggtgggaacgggaaagagataataaaatcgcccggatcatggggcaccataacccatttgttactggtagccagaaatgggaactggggcataaaaattcaggtcagggactgagcactcaaaatggtgtccaaaagcaaaatagctttcaagcggctggcaatcaggctctagccagaaacccgaccgtaaaaaccgcgcagagtgaaaaaattaaaggcaacaagaatagccagatttatcatcttgcccactgttctggttacaaaaccatagccgataaaaacgcggtctattttggaacagaagccgaagctaaaaaagcgggatatcgtctggcgagtcattgtaaaaagtaa

SEQ ID NO: 4229 - DNA, 789 bp, Xenorhabdus bovienii
  Coding DNA location: Contig name=SeqID_16895; Position on contig =75104..75892bp; Strand=+
atgggtagacagaaaacagtgattaaatctcgtcgtgaagtcaggagaatgttaaaaaaagacctgcgccagtcacgttatcgcaatgatgataatgtgacttcattggtgccgattggcggagtggaggctattggaatggcgcgtgagaacagggatacttctgaaattcgtccacataatgaaatgcagcatcgctatatgtgggcaattaataataagcagttagttattgccaatggtgcagcgggttgcggtaaaacgtttatcagtaccgttatggcggctgatgcgttaatcaataaagagattgataaaatcattgtaacgcgtccggtattgcaggcagaagaagatctcggctttctgccgggcgacatggctgaaaagtttgcaccttattttcgtccggtttatgacgttttattaaaacggatgggcgcttcgtttttacaatattgtctgcgccctgaaatagggaaagtagagatagccccttttgcttacatgcgcggcagaacatttgaaaatgcgtttgtgatccttgatgaagcgcagaatgtgacagtcaatcaaatgaaaatgtttttaacccggctgggagaaaatgttaccgtaattgttaatggtgatgtgagccagtgtgacttgccggagtgtattacatccgggctgatggatgcactggagcggttttctgatgatgaagcgattagtgtgattcatttttctcaggaagactgtgttcgttccagattgtgtcagaaagcattgctggcttatcgttga

SEQ ID NO: 4230 - DNA, 1251 bp, Xenorhabdus bovienii
  Coding DNA location: Contig name=SeqID_16895; Position on contig =75966..77216bp; Strand=-
atgaaaactttctctgacagtccaatagcagcaacaggctggttatgtggcgcagccatcaccatcaatttgtctgtgctgctatttcttggtttgaataccccgctcaccttgcccggaaagctgtgggtcatctttgatatcctgagtatcctgtgccttttaagcttgctgtataaagccgatatgatttcgctccaggtggcatcattttgtaagataaaacagagaaagataactgtcttgaaacgggatagacaatacctgcgttttcttatctccgtccattctcaactcaatcttaatacttcactctctgataatttttatagggtatttttcagacttaaccaattcatcccctttggcgaagtcaggatcacgctttatcatccaccgcgtaagtatcattttgaatatccccgtagcccctttgacgtcaatcttcctcggatacaaaaatgggatttatatgacaggcatacttttcacggcataattcaaatcaagattaatcaaactcagattctgtcttcttatgaacgggatctgatccagtctgttacggatgcgctggcaaaacacctgtctctgaaaaataccgtgcatcagcaaattcagcaggggcttatcaatgaacgggaaaatatttccagagaattacatgacacagtggcacaatcatttctatttctgaaaattcagattaacagcctgcatgtgcgccacgataaattctcccgacaggccttaatcgccttgcggatcataaaagaggagataactttagccagtcagcaattaagggaaatgctggccacattgcgggcagaaaaaaaccattatgacctgtatgaatccctgcaatccctgataaaaggattcaatcatcggctgggattccagattgaattttattatcggcttactcaccagattattcctatcggccaccgccgtcatttggcgcagattattcgtgaggccttaaataactgttataaacatgctgacgcgagttggatcagtattcgcatctatccgataggcaaaaatattatcacggttatcagtgataatggccgcggcatccatcaggagcaaattaaggctcaatttggtctcgctatcatgcgggaacgggtcactctcatttcagggcaaataaaaatcaaaaaacgcaaaaaaggcggcacagaaattgaaattcaatttccgctgcaagatgagctgagtaatataaaaaaataa

SEQ ID NO: 4231 - DNA, 159 bp, Xenorhabdus bovienii
  Coding DNA location: Contig name=SeqID_16895; Position on contig =77283..77441bp; Strand=-
atgaacaaggttatcactgagtccgatcctccccgcccttccctctggaaacggctgggttggctggtcaccatctggcttggcagtgtgctggcactttacgccgcctcttcgctatttcgtgtcttaatgacaacagcgggaatgaaagttaagtga

SEQ ID NO: 4232 - DNA, 1008 bp, Xenorhabdus bovienii
  Coding DNA location: Contig name=SeqID_16895; Position on contig =77422..78429bp; Strand=-
atgggcattgatcttcccctgatttggtttctgatcattatattcagtaccatgatgtacatcgtgatggacggttttgacctcggcatcggcattttgtatcctatgatgaaggggcagtcagaccgcgatttaatgatgaattccgtagcaccggtctgggatggcaatgaaacttggctggtgctgggcggggcggcgctgttcggcgcttttcctttggcgtatgcggtgatcttggatgcactggcaatcccgctgactatcatgctcttagggctgatattccgtggtgtcgcttttgagtttcgttttaaagccacgccagaacatcagcacatctgggacaaagcatttatttctggttcaatcatcgccacttttacgcaaggaatggtggttggcgcggtgattgaaggctttccggtcgagaaccgcacctatattggaggggctttcgattggtttgccccattcccgctattctgcggctttggtctggttgtcgcttatgcgttgctgggatgtggctggctggtgatgaaaaccgaaggccacctgcaacagcagatgtatcgcattctgcgcccgctgacgcggctgatgctggccgtcatcagcattatcagcctctggacccccatcgcacatcaagccattgccgaacgctggttcagcctgcctaatttgctgttctttatacccgtaccgctactcgttatagggtcaagctggaagctcctgcaagctaacgagaacaccagccattacaccccatttctggctgcattactgctgatattcatggggttcagtggattagggatcagtatctggccaaatatcatcccgccgatgattggttatcaagaagcggccgccccaccgcaatcactgggctttatgctggtcggcgccctgttcatcatcccaatcatactggtctacaccttttggagttattatgtcttccgaggaaaaatcacccatgaacaaggttatcactga

SEQ ID NO: 4233 - DNA, 1338 bp, Xenorhabdus bovienii
  Coding DNA location: Contig name=SeqID_16895; Position on contig =78419..79756bp; Strand=-
atgtttgggttaagtgcccttgaactcgcaaggatacagtttgccttcacgatttcttttcacattatttttcctgccattacgataggcctggccagttttctagccttattggaagggctatggctaaagacacgcaatacagactacaaaacgttataccacttctggtcgaaaatttttgcagttaatttcggtatgggagtagtttctggtttagtgatggcctatcaattcggcaccaactggagttttttctccgaatttgccggcagtattacgggcccgttgctagtctatgaagtgttgaccgcgtttttccttgaagcaggatttcttggcgtcatgctgtttggctggagtcgggttggcgaaaggctgcattttttcgctacttgcatggttgccctcggtacaattatctccacattctggatcttggcctccaacagttggatgcagacaccgcagggccatgaaatcatcaataatcaaatcgttcctgttgactggtttgccgtgattttcaacccctcctttccttatcgtctactgcatatgggaaccgctgcgtttctcgcatcagcgttcttcattgccgcctccgctgcgtggcacctgctgaaaggcaatgattcctccgccatgaagaaaatgctgtcaatggcaatgtggctgattctgatcatcgccccgttgcaagccatcattggtgattttcatggcttgaataccctgaaatatcagccagccaaagttgccgcaatggaggggcattgggaaaaccgtcccggcgaagctactccgctgatcctcttcggcattccaaatcaggaagcagaagaaactcgctatgccgtcaaaattccttatcttgccagcctgatcctgacacacagtacggataaacaggttccggcattgaaagaatttgcacccgaagatcgccccaatgtctttatgatgttctggtcatttcgtgtcatggttgggctgggaatattgatgattgtggcgggcgtttggggattgttactacgttacaaaaagcgattatatgaaaacaggacgtttctccggtttatattcttaatggcaccttcgggtcttatcgccattctggccggttggtttaccacggagattggccgccagccgtgggttgtatatggcttaatgcgtaccaaagatgcggtatcggcacatggcgagatccacatgagcatcagcctgcttattttcttcgtcgtttatgctgccgtctttggtgttggttacgcctatatgatgaaactgatccgcaaaggccccaacaaggagttaacaaatgggcattga

SEQ ID NO: 4234 - DNA, 1422 bp, Xenorhabdus bovienii
  Coding DNA location: Contig name=SeqID_16895; Position on contig =79895..81316bp; Strand=+
atgacacgttacgaacaattggctggggcgatccgccagcaaatagaggatgatatttggcaggtgggcgacaaattgccatcactgcgggaatcggtgaaatcatcaggattaagcttgatgacggtgctgcaagcctatcaattgctggaaagtcagggttggatcgtggctcgtccgcaatctggctattatgtagccactcggttaacgcaatttgcggcagcgaaaggcggaaaaggcctgcatttaagcgaaagtgtagagatcagcgcctctatttttgatgtgttgcaggcgtgcaaagaccccaaaatcgtgccttttggctcggcatttcccgatccttccctactgaacgagccaaaattatccaaaatactggcctcagttgcccgtcgctttgttcctcatagttcgttggagaatttgccgcctggcaatgagaagttgcggcgtaatatttcccgtcgttatgccgcccacggcattcatgtgtctcctgatgagatcgtgatcactgcgggggcaatggaatcattaagttttagcctacaatccgtgacctcaccgggagattgggtggtgattgaatcgcccgctttttatggtgcgttgcaggccatagagcgcctgcgcctgaaagctatcgcgattaaaaccgatccgcggacaggcattgatttggatgcactggaagagatcgtgcagaaatacccgataaaagcttgctggttgatgtctcgtttccaaaatccattgtgcaacacgatgccatctgaaaataaacagcggctggtggagattttgaatagtagtcatattgccctgattgaagatgatgtttatggtgaactgtatttcgatcaagaaccgccgatgccaatcaaagcatgggataaagaaaataatttcatgcactgttcatcattttcaaaatgccttgctcccggatatcgcgtgggctgggttgcagcaggcaagcacgcagggaaaattcagcaattgcagatgatgagcacggtttcagccagcgcaccaacacaattggcggttgcggaatatctggctcacgggggatatgataaccacctgcggcggctgcggcgtcagttggaacagcggcaaagtcaggttttacgggcgatcagtgaatattttcctgactcggtgaaagtgaacagtgcacgtggcggttatttcctgtggctggagtttgaaccgcctttcaatgctaaccggttgtatcgactggcgctggccaaagggatcagtattgctccgggcagcatgttttctaccagttctcagtttgatcacgcctttcgcttgaacacgtcatttgcatggaatgacgtgcaggcttcagcaatgaaaactttggcagacttgtgtcatacgctattaagggaatgcgggtaa

SEQ ID NO: 4235 - DNA, 192 bp, Xenorhabdus bovienii
  Coding DNA location: Contig name=SeqID_16895; Position on contig =81321..81512bp; Strand=-
ttgtttcgcctgtcccgcctgaccattgcgttcttggtaacgttgcataatcgaaatatttcattttcatgccacctcctcaccactcttaagccctgtgtatattcccagaagacggttaacgtcgaattgttaactccaacattcgcaaataattctgcctacgacaacatagagataattgaaatgtga

SEQ ID NO: 4236 - DNA, 570 bp, Xenorhabdus bovienii
  Coding DNA location: Contig name=SeqID_16895; Position on contig =81443..82012bp; Strand=+
atgaaaatgaaatatttcgattatgcaacgttaccaagaacgcaatggtcaggcgggacaggcgaaacaagggacattgtctgttggccagtttctgatgatttcgcctggcgggcctgtttcacgtcaatttatgaaagtgaagtattggggcagtttcctgatattgaccgctccattgtcttattgaagggaaaggggatcagattgaccagtccgggttttcttgagcacgaactggtgaaaaaaatgacacccttccatttttctggcgatattcgcgggcatgctgaattgttggatggctctgtccagtgtttcaatatcatgacgcgtcgctcttgctgggcttccgaaatttcggtgatatcccatgagcatcttttaccgacttctcacagtggtgtgctttatgttttaaaaggccgttgggaaatgacgggctcagattgtgttcagcttgctttcgggcaaggagcctggtggctgccagatatacgggaaggttcaattaagccgctggtggcggatagccagttattgtgggttgatttacgcccgattgggtga

SEQ ID NO: 4237 - DNA, 240 bp, Xenorhabdus bovienii
  Coding DNA location: Contig name=SeqID_16895; Position on contig =81898..82137bp; Strand=-
atgacagaatggaattttattttgcatgaaaaatatccgggaatggatttagcctatatacccatttatctttcaagtagcggcctgacattacaccaagccgcatccggtaagtatttcaataatcacccaatcgggcgtaaatcaacccacaataactggctatccgccaccagcggcttaattgaaccttcccgtatatctggcagccaccaggctccttgcccgaaagcaagctga

SEQ ID NO: 4238 - DNA, 1050 bp, Xenorhabdus bovienii; identical to SEQ ID NO: 2546
  Coding DNA location: Contig name=SeqID_16895; Position on contig =82417..83466bp; Strand=-

SEQ ID NO: 4239 - DNA, 264 bp, Xenorhabdus bovienii
  Coding DNA location: Contig name=SeqID_16895; Position on contig =83487..83750bp; Strand=-
atgaacatgataaaatatcttataaaacagaaggcgaaagtgctaatctttgttctaataatatttagcccttacgtttattcaaaaaataaaacagaaataattgatttaacaggcctagaattaactgaaagcaatgataaagacattattaatgaatgtaaaaaatggaacttaagtaaagaaaatgtagataaaatatttaagatcagcaaggaatataaagattatccatatatatccgtcgtcattgaagatgcttga

SEQ ID NO: 4240 - DNA, 156 bp, Xenorhabdus bovienii
  Coding DNA location: Contig name=SeqID_16895; Position on contig =83683..83838bp; Strand=-
atgataatattaattttaacaaaagaatcaattaaaaaattagttaacttactaaaatgtaattacaatttaggtaatagtgatatatatgaacatgataaaatatcttataaaacagaaggcgaaagtgctaatctttgttctaataatatttag

SEQ ID NO: 4241 - DNA, 270 bp, Xenorhabdus bovienii
  Coding DNA location: Contig name=SeqID_16895; Position on contig =84021..84290bp; Strand=-
atggaaaatgcagtcaaaatcggtgatatcggcacagagcacggtgattgcccggcgacgccagtcattaccggcgccagcagtgtcaaggttgatggtgcctatcttgcccggcagggagatgctctgcaatcacactcgtctcattcacgggcgatagcaggcggctcaggttcagtttttatcgaagaaaagcctgccgccagaactggcgacgcagttaactgtggtagtgttgttattggcggcggtagcgtcaatattggttga

SEQ ID NO: 4242 - DNA, 957 bp, Xenorhabdus bovienii
  Coding DNA location: Contig name=SeqID_16895; Position on contig =84340..85296bp; Strand=-
atgactgagacggtatctgaactccggcggcagtcccggcgatttactggcccccgccaaccccgccattctgctggccgccgccggcgaaggttcaatgtttgtcgcccattgcccgatgaaggagaagcaggaatgagtcaggagatactttacgccattgttgatgggacggcagaaccgaatttgtctttgatgctggaacgctacgatccgccttccacctgtctttacagtgaaccgttacagccagagctggctgaaattgcgccttatttagtgcaggtcaatgaagaggtgaaaatctggctggaatgccgcaaaacgccgtggggaatttatctgcacagcacagcagatttgaaaactctgcgccaccatttacggaaatacctgcaagtgctacttcccgggcaagaaaaaccggtctttttccgtttttacgacccgcgcaatatctgggatttcctcgaagtcttaagtgattgggaaatgcattgcttattggggcctattcataaaatcaccacagattataaaggtgaatacaaacaggataattttctaaaagtccgagaaaaatatcctgataacgccaaaggaagatataagattttcaaaatcagtgaagagcagtatgaattgatagaaataaagcaaaaagagaagtacttacaaaaacttgatttatttctgctatctgagttggcagaactgagaaaaagcatcagtatcgtcaattcaatatcatttttagcttttttctatgattatctgcttgccgaaaaaatcacagatacccgttctatggaaggaattcttaagaaagtgatcagagaagatgattttgatattgatattgatattgatcattttgacaaatcactcttatccaatcttgttgatgatggaactcccggctggtatagagccaataactttattgaagatatttaa

SEQ ID NO: 4243 - DNA, 963 bp, Xenorhabdus bovienii
  Coding DNA location: Contig name=SeqID_16895; Position on contig =85296..86258bp; Strand=-
atgtctgataacatcgtagtcggtattgatatcgccaaacacaaatttgatgtcgccgtttgggcaggcgaaaatcattacaaaatgaagcattttccaaatgaccttaagggattcgacgccttcattaattggcttaaacccgcctcaaattaccatttttgcatggaagcaacaggaatttatggggatccgctcgcactttatctttcggataaggggcttcttatcagtgttgtcaatccggtacaaatccatgcctttggtaaagcggaattactccgcaataaaaccgataaaattgacgccaaactgatagcacgttattgcgccagtcagcatcctccggcatggcagcccgctccgctttgtgaacgccaattactggctttagtccgccatcgcaataagctgaatgaaatgcttttgacggaagagaatcgcctctccgtggcggatgaagttgtttgtgattctcatgcaaagataatcaccctgctaaagcaagaactcaaagacaccgaattgaaactaaaaaagcacattgatgactcgccttcgctgaagaaaaataaagggttactggaaagtattcccggtattggcgaacggttgagcgcaacactgctggcttatattggtgatggttcacggtttcatcatagtgggcaagtggtggcttacgctgggcttaatcctaaattacatgaatcaggacaactaaaagggcgggctcatctctcgaagcagggaagtgccgagctgcgaaaagcactttatatgcctgggctggcagcgatcagttgcaataaagtagtgaaaaagcagtgggaacagctgacagcacgccataaaggggggaaagtcggtgtttgtgcagtgatgcgtaaactcttacgattagcctatggcgtgatgaaatcaggcacattatttaacgcagaaataccgcttgcagtttaa

SEQ ID NO: 4244 - DNA, 1896 bp, Xenorhabdus bovienii
  Coding DNA location: Contig name=SeqID_16895; Position on contig =86497..88392bp; Strand=-
atggataaaatcaatcaactacttgatcgttcaggcctgatatttacactgatcacggaaaatttaccggaacaaacttttgccgttgtcgatttttctctgaatgaagcgctatcaaccccttttcggttggaagccacattgacctgtaaaacctcggagattaactttgccgatgtcctcgacagaaatgccgcttttgccgtttaccgtaatgggcaggctgaacgacagattaccggcatagtgacacatttttcactgctgtccaccggacgtcatcgcagccattaccatatcaccattcaaccaccgctatggcgggcatcattgcgggtcaatagccggattttccagaaccaatccgtgatggatatcgttgaaattctactgcgggaaaacggtgtaagcagtttcttctttgccctcggttacaaacatccaccacgggaattctgtgttcagtacgatgaaagcgacctcacctttatccaacgcttactggccgatgaaggtattttttactacttcactttcgatcaagaacagcacgaacaacgtattgtgtttcacgactcctgcctttccctcaatcaggtcattactgtcccttaccgtccggaaactgatgcaacaggtgaaacaacctgtatccgtcaatttagctggtcagaacaagtcggtgttgccaatatcactaccaaagaccggacattcaaaaacccgcgctggaaccgggagttttggtatgaaggccgtaatcttgagcatcagcggctactgaacagttatcactattacgattttcccagccgttataaggacgatgcgctgggacaacgggcaagccagtaccgtctggaatacctgcgcagggatactcagcttggcaacggtcagggtgactgttttgctctgtggccggggcagttgtttagcttgaccgatcatcccagagacgcgttcaatgaccaatggcagcttatccaaatcactcattccggacaacagctacaggcagacgaaacccattccggagggagtggtacatggctgtccaatcaatttaccttcacccgccggaaaaattcttatcgcccttcctcctatccgaaacccaaaatggaaggcccgcatatcgccactgtcgttgggccagagggagaagcagagggagaagaaatcttttgtgatgaacatgggcgcgtccgtattcagtttgactgggacaggtacggtgaattcaatgatcgcagttcctgctgggtgcgtgtcagccaagcgtgggcagggcaattgatggggatgatcgccattccccgcattggtcacgaagtgctggtcgattttgtccacggtgatcccgaccaaccgattattgtcgggcgggcctatcacgccaacaatattccgccaaaccgcctgccgatggcaaaaacccagatgtcgatccgctcgaaaacgcataaaggcgaagggtttaacgaactgcgttttgaagatgagaaagatcgcgaagagatatttattcatgcccagaaaaacctggccattaaggtgctcaattcacgcggagaacgaattaactatgaccgcacaaccagcattgggcatgacgatgaactggtcattgccaataaccgcaaagtcacggtagaaggccagcaagaccataaaaccacaggaaactatattgagcaaactgacggtgatcgctcattacaagtcaaaggcgacttaattgaaaaaattcagggtgtgttaagtgtagatatacaaggggatatcaccctgcaaagcggcagtaaagtcaccctgagtgtcggcggcagttttattgtgctccatgcgggcggaattgatatcaaaggtaccgctatcaaccttatatcttga

SEQ ID NO: 4245 - DNA, 201 bp, Xenorhabdus bovienii
  Coding DNA location: Contig name=SeqID_16895; Position on contig =88448..88648bp; Strand=-
atgatttttaaatcaggaatgaggtgcggaatgacggatataaaagtggataataacattcctcatataaaaacaattccagccccattccccaaaagtgatttaaataaagatcattacaatgaacgtcctgaaaaaactccagaacaaaagcttcttactcaaacagacaataatgaaacagatattaaaatcagctaa

SEQ ID NO: 4246 - DNA, 1617 bp, Xenorhabdus bovienii
  Coding DNA location: Contig name=SeqID_16895; Position on contig =88744..90360bp; Strand=+
atgtctctctctgaacctgccatcaaacgtctcgatcacctcggccttgtcgccgctttttgccatgagatcggtttaccccgcatgattgatgctattttgcctaaatatgcagagcatacggtttctcatggcgaggctcttttagcgatgatcctcaatgggttgggtttccacagtcgaacgctccatatgtgccctgatttttttaagcacaaacccgttgaacgcctgattggggtgggaattatggctgaacacctcaatgatgatgtgctcggccgcacgctggacgccttgtttgactgcggtgtctctgaaatttatcaggttatcgctgagcgggttattgataaattggcattaaaatccgattccgttcaccttgatatcacgagttttcacgtggatggtgagtacaaactccccgatgatgacgagacaaaacgcctcgttttggtgcgtggttacagtcgtgatcaccgtcctgacctgaatcaggttgtgctgcaacttatctgtgaaaatcaggcggggatccccgtatacatgcaggcgatgagcggaaacaccaacgacaccaaagcgtttgcagagacgacgaaacatcacattggctgcctgaaagcggcccaaaacagccgttatctgattgccgatgccgcgctttatacccaagagacactggcctcacttcatcaacaaaatcaaaaatttattacccgggttccgttaaccattaaagaggcgaaacagcacctgctgacggttaataccgaccagttacaaccggttacagaaggttatgccggtcattggattgaatcttgctacgggggcgttccacagcgctggttactggtcaacagtgaagcggcgatgcagtgtgaacatcagactttcaggaaaaatacgcggatttcgacggaaaaagaactgaaacagttcgaaaaactcagcaaaaagtcgtttccctgtggtgaagatgctttgcaggcattgtgtgacttcgaagcagaatgccagtttatcggcattgaggcccccaaagttcaaaaaatcgaggtgcataaggggcgaggccgcccggctaaaggtcaacatcccgatagtgttcattatcagctttctgcctcggtctacagccaactggggaaagtggcttatgcccgcctcaaagtcggcatgttcattctggcgacgaatgaaatggacgataaggcgctgaatatggaaactctgctggctaattacaaagcgcaacaaaaagtcgagcggggtttccgtttcctgaaaagtccggagtttctgacttcagcgatttatttgaaaaagccagaacgcatcgaagcgttattaatgataatgacatgcagtttaatggtttatgctgcactggagcataaaatccgcaccggactgaagcaaaatgccccgttctatcccgatatgaaaggtaaacccacccaatctcccacggcgcgttgggtgtttttgaccttcgaagggattagtactttcgagtttcaggaacaccgtatggtgacgggaatacaggtgtatcaaaatgaactgctgaaaatattggggcaaccctatgaatcattttattcctga

SEQ ID NO: 4247 - DNA, 708 bp, Xenorhabdus bovienii
  Coding DNA location: Contig name=SeqID_16895; Position on contig =90351..91058bp; Strand=-
atgacaccaataaactcaacggaagaattattgctaaatattactaatgactctaatttttcaaaagaaaacaaaacaaatcttatcaactcaactgcttacccaaaccaagaagtgaattatgcggcaggaaagccatgtacgacatgcccgcctccacaggcaagacctgaatttgtggaaaacctaataagatctttaggtataagatataccatcaccatctatgctgctcatcccggaactcctcttaatgaggataatggagaacccaaatttaagaatggagaacgtgtgacatcatttgcgggacatatgtggtatgaaatctcagatggaaaatctgataacgcctatggttttgctcccattgaatcgggaatgcatggagatggaatagtaacagaaaaagataccatccattatgaaaagccacgatataaacgaacattagaaatcacagaggaacaatataaccaattgagaaattatggaacttctgcagttaaaaattcaaatcctgattttaacctttattacaacggagcctggaatagctgcattgattttacctggaaagcactgcgaagtgctggattaaaacccggaatgacgtggaatgattttagtaacattaatagaattaataaagctctgggaacattcgacggagatataaccgacattccgcaccactttcaggaataa

SEQ ID NO: 4248 - DNA, 381 bp, Xenorhabdus bovienii
  Coding DNA location: Contig name=SeqID_16895; Position on contig =91061..91441bp; Strand=-
atggtgaaaattttacgtagagatacgttttttggctataaaagaatcgatcttaaagtggaatcccgccctgattatactcctgacttattcaagaatgatggtccattagctaaaccaaaagatgctcctatattatctataaaattacataaaattaatgaggacctcactgaaacattagtgtttaaaaaaacatactcggagcctgactcaattgcaggtactgctgatgggattttatttagattcgttagccttggggaaagatataaatatggtcaatatcgtttaaatctagaaatattaggtaattggcctgaattaaaaaatgataacgtcagttattatctatttattccttctttctcaggaaaataa

SEQ ID NO: 4249 - DNA, 333 bp, Xenorhabdus bovienii
  Coding DNA location: Contig name=SeqID_16895; Position on contig =91495..91827bp; Strand=-
atggtgaaaaaaattatgctattggtttttgctgcttttctcggggcgggtatcgtattactggttcaatggatgcgtcctccaacagaggacccttacttttttttaactccaaaaccaactacaggacatcccattgaagtccccattaaactgtataaaaaaggggaaaaaatagaattagtattttggaatgttcctcaacccccacctaaaattttatatctttttcctggtcatactcctgaacctcgagttatgttaaaaacaaaagggtataaagaagatgagctaacctattatactcccagggcgggattttactttgcttaa

SEQ ID NO: 4250 - DNA, 1047 bp, Xenorhabdus bovienii
  Coding DNA location: Contig name=SeqID_16895; Position on contig =92240..93286bp; Strand=+
atgttgaacgtaagaatagctggcaactggctgaatggatgggggaaagtacccccgatgggattcaatatttgctggaacgcgctgattgggatgtcgatatggcccgcgatatcctgcgggattatgtcactgaacatttgggcgatgaacagggtgttctcatcattgataaaaccggttttatcaaaaaagggacacattctgccggggtacagcgtcagtaatagtgggaccgctggacgggtagaaaacagccagataggcgtatttctttgttacgccggcaacggagggcatgcctttgttgaccgggcattatacctgcctcgccagtggacagatgcccgttcccgctgtgaagccgcgggtatccccgccagcgtcacttttgcaacgaaacccccgttagcccggcagatgctggaacgaacatgggatgccggcgttccctgtcgctgggtgactgcggatgaagtttatggccgtgaccgtcgtctaagagtctggctggagtcccgatacccgccctttgtgttagccattccctgcaatacccccttagggtggcgagggccagagtatatccgtgctgaccggattgccgataccctgaccgccgctgactggaaaacacggtcagcgggaacggggacaaaaggtgagcgtgagtatgactgggctgtcgtgccgttatggcgtttacagctcagtgaagaggatcgacattatggtcattatttgttagttcgacgcagccgggatagcagacaggaacgggcttactatgtggtgtatgccctgagagaacaggtggatcttaatacgctggttcaggttgcgggttgtcgctgggaaatcgaaagtggctttgaggaaaccaaaggggaatgtgggctggatcactacgaagtgcggcgatggcagagctggcaccggcatattaccttgtcgttactggcccatgcagtcctggcggttttgcgggtacaggagaaaaaaaacaccggtaggccgggttccgctcagtgtagcggaactccgtaa

SEQ ID NO: 4251 - DNA, 234 bp, Xenorhabdus bovienii; identical to SEQ ID NO: 3573
  Coding DNA location: Contig name=SeqID_16895; Position on contig =93204..93437bp; Strand=+

SEQ ID NO: 4252 - DNA, 261 bp, Xenorhabdus bovienii
  Coding DNA location: Contig name=SeqID_16895; Position on contig =93731..93991bp; Strand=+
gtgcgtcgcgctgttcagaagcctggccacacagcaaagtccgcggacgttggttatctcctgctcagacagtcgtatgatcccggaactgctgacataactcgctcaaaagtccgttgcatacgagcagttcaacccagtgaagttgtgcaatcgttttctgaaaatgacaagggtagaacaggtattatctgcattacgtggttgcctgatattatgggtgatttattgcctgttattagtgtaaataacaggcaataa

SEQ ID NO: 4253 - DNA, 141 bp, Xenorhabdus bovienii
  Coding DNA location: Contig name=SeqID_16895; Position on contig =94000..94140bp; Strand=+
atgggggtttactttcccccctttagaaagaaacgtcgagcttttgtgacaggctcggtagggcgaggtgatttgttttattgcatgccgtttgcagatttattttgcgatttagtcagcatatataagcggaataggtaa

SEQ ID NO: 4254 - DNA, 759 bp, Xenorhabdus bovienii
  Coding DNA location: Contig name=SeqID_16895; Position on contig =94077..94835bp; Strand=-
atgcccatcacggcaaatatcctgtatcgtgacagcttcaatttttttaagaaccagctgttaaatattttcatactctctgtcttggccgcgttggtggcagcactgcttgaacatcttctgatgcctgatggtgaacaactcaaactgctggttgagatacaaaacgcctttaaagagtcaggcaatacaggagtcaaaaattttgtggcgcaattaacgccagaagaacagttaatgttcttacgcacagcattcggtattctattttccaacatattcggcagtacattgctgaccgccaatgtgttgttacttatcaatgccatttctaacgggcaccaaaccaatgcgctccatgccagcaaatcatcaataggatcgctgcctaaaatgtttttgctgatgtttatctgtaccctgttgattcaattaggttacgcgttgatgttcattcccggcatactactttctattgcatttgcatttgcccctgtttttctgcttgaaaaaggaagaggtgttttctcatccatgcaggaaagctggaaattggcgtttgccaatctgcgtctgttagccccggccatactgttatggtttgcaataaagctaattatcgctcttggtttcgctagaatgcccgatatcgtactgtcaatactaaataacctgctatcttccatactgctgatttacctattccgcttatatatgctgactaaatcgcaaaataaatctgcaaacggcatgcaataa

SEQ ID NO: 4255 - DNA, 657 bp, Xenorhabdus bovienii
  Coding DNA location: Contig name=SeqID_16895; Position on contig =95288..95944bp; Strand=+
atgggatggataatgaaaaaaattttttcgcttgtattggctacggctgcgttagctccgtcattgacctttgctcatgaagcaggtgacttcctgttccgcgcaggtacagcaacagtaagaccgaatgctggatctgataatgtgttaggtcagggatctttcggtgtaaataataatacgcagctgggtttgacttttggttatatgatcaccgataacattggtgttgaattattagccgctacacctttccagcatcgtgtcaatttaccgaaagctggtgatgtggctaaagttaggcatttacccccaaccctaatggcgcaatattattttggctccaaagaaaataacttacgtccttatgtggggattggtgtaaattacaccacattctttagcgaaaaatttaatgacaataatgcaactgttgaagccgcgaaattaaatagtctggatctgaaagattcctggggtgttgctggtcaggttggtttagattatcagttggataaaaactgggtactgaatacctcattgtggtggatgaatatcgaaactgatgtgagatttaaagcgggtgatgcagaacaaaaatataaaactcgccttgatccatgggtgtttatgtttggtgtcggttataaattctaa

SEQ ID NO: 4256 - DNA, 1176 bp, Xenorhabdus bovienii
  Coding DNA location: Contig name=SeqID_16895; Position on contig =96210..97385bp; Strand=-
atgacacgacgtgcaaaaatcattctgacgggagcgggagtagggggagttatttgtgcttgtgccatgattttctttttcgtcctgccaaggctcattgagacacggatgaatcgtgtgatcggggttactgatgtagcgacacaaaccgcagttgacttgcacaagcgtctgcagatcgccgacttgcatgccgatacgctgctctggggcagggatcttttggatcgatcgacgcgtgggcaagtcgacataccgcgtttaatagacggcaatgtggctgtgcagatctttgctgttgtttctaagtcaccacgtgggctgaatatcgagaagaatagcgccgaaactgacaatgtgactttgcttgccctggcacaacgttggccttggcgaactctgttcagtttaaaagaacgggcactctatcaagctgcgcgcctacatgaggctgccgctcgttcaaatgggaaactggtggtgatcaaaagccgcgctgacttgaaggccttccttgaaagacgcaggagtgatccaaagatcgtgggtgcgctgctcgcttcagaaggcgcacaggttctcgagggcgacccagccaacgtggatgtacttttcgaggccggctaccggatgatggcacctactcatttcttcgatacagagttgggcggatctgcccatggtattgaaaaaggtggactaactgctgccggtgccgatatggtgcggcgaatggaggcaaggagtatgatcattgatctggcccacgcctcgaccaaaaccattgatgacatactggcaatcgcgacgcgacccgtggtcgtttcccatactggcgtcaaaggtacttgtgacaacattcgtaatctgtccgatgaccaactcaggcggatcgctgcaaagggtggattgatcggtatcggtttttgggacaaagcagtgtgcgatcctacccccaccggtatcgctaaggcacaaatctatgcggctaatatcgccggcgatgatcatgtagcccttggatctgactttgatggtgcggttgagatgcccttcgacgctactggcctcgttagtgtcactgacgctttactgaaaaatggcgcgcagccagagaggattgctaaactgatgggtgagaatcagatccgttttctattggaaaaccttccatag

SEQ ID NO: 4257 - DNA, 315 bp, Xenorhabdus bovienii
  Coding DNA location: Contig name=SeqID_16895; Position on contig =97597..97911bp; Strand=-
atgaaactattaaaagtagtctctacgttttttgttgctactgttatggcgatgacgatctctgcatgtgccccaacagcaacaacagaaagtacagggaattacattgacgataccgtcattacagccaaagtaaaatcagcattacttgaggccaaaaatctaaaatccagagaaatcagtgtagaaactttcaaaggccgtgtgcagttaagtggattcgttagctctcctgaagacgtcacacgtgcaatacaaatcactaaaggaattaagggtgtcaataccgtgattaattcaatcaagcttcgataa

SEQ ID NO: 4258 - DNA, 150 bp, Xenorhabdus bovienii
  Coding DNA location: Contig name=SeqID_16895; Position on contig =97939..98088bp; Strand=+
atgcttatttatcgaaacattattcttgtttctactttaggtatcatgccattgtgtaatggccgtaatcagaaagtattattgaaaacgggaaaacctacaaatgataggggaaatatttattcccggatggtgataggttggcggtaa

SEQ ID NO: 4259 - DNA, 807 bp, Xenorhabdus bovienii
  Coding DNA location: Contig name=SeqID_16895; Position on contig =98129..98935bp; Strand=-
atggaacgttatgagcagctatttaaaaaactagaaagccaaaatcagggcgtttttgttccttttgtcaccttgggcgatcctaatcctgagttatctctggagattattgacgcacttatcgctggcggagcggatgcgctggaattaggcattccattttccgatcctctcgctgatggccctaccatccaaaacgcgaatttacgggcattatcttccaatgttacacctgcattgtgttttgagctgctgtctcaaatccgagctaaataccctgatatcccgattggattgctgatgtatgcaaatctggtttttcacaatgggatcgacgaattttatcgccgctgtaaaaatgccggtgttgattctgttttgatcgctgacgtaccgttatcagaatcgcatgatttccgctcaactgcattgaaatatgacattgctccgatattaatttgcccaccaaatgcagatgatgatctactgcgtgaaatagcagtatgtgggcgaggttacacttatctgctgtcaagagccggggtcactggaactcagaatcgagctgaacatccactaacgcacctagttaataagctcaaagagtatcatgccgctcctgcactacaaggttttggcatatcggagcccgcacaagtcacatcagtactcgatagcggcgcggctggcgctatttccggctccgccgtggtaaaaatcattgaagataatttaaaccagccccaaattatactggaaaaactagtgacgtttgtccgaaccatgaaaaccgcgacacaacgttaa

SEQ ID NO: 4260 - DNA, 1191 bp, Xenorhabdus bovienii
  unsure (1)..(1191): unsure at all n locations
  Coding DNA location: Contig name=SeqID_16895; Position on contig =98935..100125bp; Strand=-
atgagtaaactgaatccttattttggtgactttggtgggcagtttgttccccaaatcttgatccccgcccttgatcagttagaagaagtatttattgaggcacagaacgatcctgaatttcaacaagcctttcaggatctactaanaaactacgcaggccgccctaccgccttaacgttatgccagaacctgaccaaaggcacaaaaagtcgtctgtatttgaaacgggaagatttgctccacggtggcgcgcacaagaccaatcaggtattagggcaggcattgctggcaaagcgaatgggtaaaaacgaaatcattgccgagactggagccggtcagcatggtgtggcaaccgcactagcctgtgcacttctggggctaaaatgccgtatttacatgggagccaaagacattgaacgccaatcccccaatgtctttcgtatgcgtctaatgggcgctgaagtcattcctgttcacagtggcgccgcaaccctgaaagacgcctgcaacgaggcgatgcgtgactggtctggttgctatgacaaagcccattatttgctgggaaccgccgccggcccccatccttatccaacgatagtgcgtgaatttcaacgaatgatcggcgaggaagccaaggcacagattatggaaaaagaggggcgtttacccgatgcggttatcgcctgtattggcggcggctcgaatgccattggcctgttcgctgaattcattccagaaaccaatgttcgcctgattggtgtcgaaccggcaggacatggtatcgaaaccggagaacatggtgcgccattgaaacatggcaagctagggatctacttcggtatgaaatctccgatcatgcagacagaagacgggcaaattgaagaatcttactctatttccgccggactggattttccttctgtcggcccccaacacgcttacctaaacaatattggacgcgctgattatgtttcagtcactgacgatgaggcaattgacgcattcaaggctctgtcgcgcaacgaaggcatcattcccgcgttagaatcctcacatgcacttgcccacgccttgaaaatgatccatcaggctcctgataaagaacaattattgattgttaatttatctggccgtggcgacaaagacatctttaccgtacacgatattttacaatccaagggggaaatctga

SEQ ID NO: 4261 - DNA, 1365 bp, Xenorhabdus bovienii
  Coding DNA location: Contig name=SeqID_16895; Position on contig =100157..101521bp; Strand=-
atgaaaaacaacatattacagaagattgttgatgataaggtggcatatctggtcgaacgcaaagcagagcagccattggaaagtgttattgattccattgtaccgagccatcgtcagttttatcaggcactgagccataagcaaacagtttttattctggaatgtaaaaaagcgtccccttcaaaagggttaattcgtacagatttcgatccggttcgcattgctaaaacttaccaaccttacgctgccgcaatctctgtgctgacagatgaaaaatatttccagggcaactatgattttctccgcatggttagctctgcggtacaccagccagttttgtgtaaagatttcatcattgatgcctatcaggtttatctggctcgttattatcaggccgatgccattttgttaatgctttcggtgattaatgatgagacttatcgtgagctgtccgcactggcacacagccttgatatgggcgtattgacggaagtcagcaccgaagatgaacgtcgccgggcaattgtgctaggagcaaaagtcatcggcattaacaatcgagatctgcgtgatctgtccatagatttagatcgcactcgcaggctggcaactgatttaccagaaggcaccattatcatcagcgaatctggcatcaaccagcatcaacaggtacgtgaattaagccaatttgcccacggtttcctgataggcagtgctttaatggcacagccggatttagatctcgccttacgtcggttgattctgggtgacaataaaatctgtggtcttacccgcccacaagatgccaaaactgcgttacaagccggggctgtttatggtggcttaattttcgcggaaaaatcaccgcgtaaaattaatctgcaacacgcccagcagatcatcaatgaagctcctctgcaatatgttggcgtatttcaaaaccaatcattagattttgtcagtgatatcgcccggcaactttccttgaatgccgttcagttgcatggcaatgaggacaaaaactacatcaatgcacttcgtcctttactacctgaatcttgtgagatttggaaagccattgatatgtcaaaggctacagaattttccgaaatatccaatatcgaccacttattgctggataatggagcggggggaacaggagaaacctttgactggcaattaatcgatcagcgttttcagcgtaacagtatgctggccggtgggttaaatgctgaaaactgccaacaggcagccgcgctgggatgttatggactagattttaattctggtgtcgaaacaagcgttggcatcaaaagcagtcaaaaaatcaaactaatattccaacaattacgctgttatcactaa

SEQ ID NO: 4262 - DNA, 999 bp, Xenorhabdus bovienii
  Coding DNA location: Contig name=SeqID_16895; Position on contig =101524..102522bp; Strand=-
atgcagttaattttcgaaaaattgttcagtgcccaaacactgacacaacaagaaagtcagcaattatttaccgcgattgtttgtggtgaactgagtgacgctcaattggcggctgtactggtcagcatgaaactgcacggcgagcagccacaggaaattgcgggtgcggcgcaggcattattggcgaatgcctcaccctttccacgtcctgattacaccttctgcgatatcgtaggtacaggcggagatgggacaaacagcatcaatatttccacaaccagcgcctttgtcgcggcagcctgtggccttaaagtggcaaaacatggaaatcgcagcacctccagccgttcgggatcatccgatttactgaccgcgtttggcatcgcattagatgccagtgccgaggattcacgcagtgcgctggatgagatcggtgtttgttttctgttcgctccacaatatcatagtggattccgccacgtcgtacaggttcgccaacagttgaaagttcgcacattatttaatgtactcggcccattgatcaacccggcacgccccccgcggacactgattggcgtttacagccccgaactggtggttcccatcgcccatacattaaaggttttgggctatcagcgtgccgcagttgtacatagtggaggaatggatgaagttgccttacatgcccccactctcgttgcagaattaaatcacggggaaataattcagtatcaattaacagcaaaagattttggattgcctaaccatccaatatcttcactgaaagggggaacaccggaagaaaattgcgatatgttgagcctgttattacaaggtcgtggacaaaaagcgcatgttgatgccgtggccgccaatgtggctcttttgatgaaaatccacggacaagaaaatctacgggaaaatactcaactggcattgaacacgatttatagcggtcaagcctacgaaaaagtgaccgcattagcggcaaggatttaa

SEQ ID NO: 4263 - DNA, 579 bp, Xenorhabdus bovienii
  Coding DNA location: Contig name=SeqID_16895; Position on contig =102537..103115bp; Strand=-
atggcaaatattcttctgctcgataacgttgattcgtttacctacaacctcgtggatcaactgcgtgccagtgatcatcaggtcgttatctaccgtaatacggtatcaacagaaacaatcatgacacaacttagtcagatggaatcaccgcttctgatgttatcacccggcccgggaaagccggcagatgctggctgtatgccccagttgctcaaacgtatcattagccaaattcctgtgattgggatatgtcttggacaccaagcgattattgaagcttatggtggaacaatctctgccgccagagaaattctgcacggaaaggccactctggccactcatgatgggcaggccatgttttccggcttaatcaaccctctgcccgttgcccgttatcattcccttacggggatgaatattcccgacacgctggtggtttcggcttcttgtggtgatacagtgatggcggtacgtcatgacagacacaaagtctgtgggttccagttccatcctgaatccatcctgaccacacagggagctaaattactcgaacaaactctggcatgggtacaggaataa

SEQ ID NO: 4264 - DNA, 1128 bp, Xenorhabdus bovienii
  Coding DNA location: Contig name=SeqID_16895; Position on contig =103115..104242bp; Strand=-
gtgggcggactgtttgcttacgatttagttgcaggatttgaaccgcttcccaaggtcaaaactcatcaacgttgccccgatttctgtttttatctcgcagaaacgctattagtgatcgaccatcgaaataaacacgcattcttgcaaacatcactgtttggtgaatcagattcagaaaaacagcgtcttcatgaccgcctgaccgcattaactgctgccatttcgaaacccggccaaccacttgaatctgtgaaattaccagacatgaccattgcctgtaatcaaagtgatgaccaatatgcagacatcgtgcagcaattacagcaatccatccgtcaaggcgacatttttcaggcagttccgtcacggcgtttcaccttaccctgtccttctccactcaatgcttaccaaacgctgaaacatcaaaaccccagtccttatatgttcttcatgcaggatcaggacttttgtctgtttggtgcttctccagaaagtgcccttaaatatgatgccagcagtcgtcagatcgaaatctacccaatagccggaacacgtcctcgtggacgcaatgccaacggcacactgaatgccgatctagatggccggattgaactggaaatgcgtacagatgccaaagagctttctgaacacctgatgctggttgatttggcgcgcaacgatttagcacgcatttgtgaaccgggtagccgctatgtggcagatttaaccaaagttgatcgctattcgtttgtcatgcatctcgtttctcgtgtcgtaggcacactccgccacgatctggatgtctttcatgcttatcaagcgtgcatgaatatgggtacattgacaggagccccaaaagttcgggcgatgcaactcattgcacaacatgaaggtgaacgacgtggcagttatgggggtgccatcggttatttcactgccaagggggattttgatatgtgcattgtgattcgctctgcctatgtggaagacggcacggccgccgttcaagtaggtgctggcattgttttagattccattcccgagtcagaagtcgatgaaacgcacagtaaagccagagccgttattcgggcgattgctcaggcacacaaggcggaggtgacattctga

SEQ ID NO: 4265 - DNA, 471 bp, Xenorhabdus bovienii
  Coding DNA location: Contig name=SeqID_16895; Position on contig =104202..104672bp; Strand=-
atgaataaaaattttaagatttcaatcaatcaagtagacactgtttaccaaacagatccaactctacttttcaatcagctttgtggtaatcgcccagccacgttattactggaatcggctgaaataaacagcaaaaggaatttgaaaagcctgttaatcatcgacagtgccatgagaattacagccaacgaacgacaagtcacttttgaggccctcaccgaaaatggccggcagctactgcctatactcaccgatttactctcagcaaaagcccgattgcatgttggattacatattctccaggcacagtttcccgcaactgggcacaatctggatgaagacagccgtttaaaggccgattctattttcgatgcattgcggacactaatgacattatcccccttttctggaactccagacgcaatttttcgtgggcggactgtttgcttacgatttagttgcaggatttga

SEQ ID NO: 4266 - DNA, 207 bp, Xenorhabdus bovienii
  Coding DNA location: Contig name=SeqID_16895; Position on contig =104644..104850bp; Strand=+
ttgattgaaatcttaaaatttttattcatcatatttgccccgttgctacctttagccacaaattttggttataaaaaaacccgcttttggggcgggttgcggcactttcgtatctgtacttatgtgcgtgattcaaccgccctgaacgggaagttgcgccaccagcgaattgcctgcataaatacgatcattttctctgtgccttag

SEQ ID NO: 4267 - DNA, 354 bp, Xenorhabdus bovienii
  Coding DNA location: Contig name=SeqID_16895; Position on contig =105268..105621bp; Strand=+
atgtctatgtttatgaaatcaagtaaaattattttatattttatattttatattttatattttatattttatattttatattttatattttatattttatattttatattgtttttcattgccttgattgtttttaataatgctggtgcaattgaattaatgagtgattatattgttttaagaggaaattatgatgaattaggaaaaaataaaaacagaagtaatctattagcagattataatatgatttttaaaaatgacagtaagcatgataattttgaaattaaaatgttaggttatcaatgtgtgtataaagttggagatgaatatataaatttgaaacctgggggataa

SEQ ID NO: 4268 - DNA, 222 bp, Xenorhabdus bovienii
  Coding DNA location: Contig name=SeqID_16895; Position on contig =105928..106149bp; Strand=+
atgcaaaatattgaggatgctgatccttatttcttgacgaatttaattattttggctcgggctattttagctctgaatttattgataggcatagaattagcaatccaaaagagattatacccactgaacttaaaggtcaaaaattatctggtattggaggtgatgatagccgttctactttgtagaatggtgatatatttttatcttcataatattctataa

SEQ ID NO: 4269 - DNA, 861 bp, Xenorhabdus bovienii
  Coding DNA location: Contig name=SeqID_16895; Position on contig =106290..107150bp; Strand=+
ttgaaatacagcctctatcgcattgaagtagtagacaaatatcattcattgggattggctgatatcaaaaaaaattggcagggatcgtctcctgataaaagctactttagtataaaaacttctaatgtcgagattaaaaatctttctgaaggagggacagaaattgtcggtaccccaagttttttgtcagggcgatctaatgtgccgggagatgaggtcaatattaaaagacgcaggatcgagcgctcatcagaattgaaggaaaatattcaaaaccttgcacaagaaacagttatttgctcgggagctgtggtcagtgacaatggtaactggcagtgtgacagaccaataatttttcctgtgggtacttatgaactgaccgctgaattgataaaagaaggaaagtggacgtgccccgataaccctgccttgaccgtagctaataaagggacgtttttcctttatgcggctcaatatcaaaaaacaggctcggctcaattgggtgaattgggcgatacgtatgaaagaacctcacaggtcacgcgtaagtatgaagttaccgaaacaaaaataaacatcattgcccccaatcatggagcaaaaataataaaactaccttttactatttcaggtacgggagaaaagggatctcaggtatatatcgaaggttttggtggcgccgatgattgtaatactactgttgatacctcattaggccaatggtcatgtgggccttatcggccggaagatggcaaatataccctctccgcagatcaatttatcgataatcagttagattcaactgcgcaagcgtcttttgaagtccagacgaaaaccgtcaggccagtagttatcacgtaa

SEQ ID NO: 4270 - DNA, 861 bp, Xenorhabdus bovienii
  Coding DNA location: Contig name=SeqID_16895; Position on contig =107318..108178bp; Strand=+
atgactgaagccgccagtgaactgataagacgctatgacctgcatagccatacgaccgcttcagatggagttttatcaccggaacagcttgtggatagggcggtttctatgggtatcaacgtactggcaatcaccgatcatgatactacagatggtattcctcctgccttaaaccatattcagcaaaataatttgcctttgacgttggtatccggcgttgaaatttcgacattatgggagaattttgaaatccatattgtcgccctgaatatcgatactgattgcgtttttttgacaaactttctctccaatcaggtaacgttgaggaaacagcgtggtattgaaattggacagcgccttgctaaggcgggtatccctaatgcctgggaaggcgcctctcgcttggcaaatggcgggcaggtcactcgcgggcattttgcccgttatttgattgaagcgggagttgaaccgacaatcccaaaagtattcaaaaaatatctggcgaagggaaaaatcggttatgtccctgctcaatggtgtacaattgagcaggctattgaaactattcatcaagctggggggcaggctgtgattgcccatccaggcaggtatgatttatcgatgaaatggctgaagcgtttgatagcctggtttcaacagcatggcggtgatgcaatggaagttgcgcagtgccagcaggcacctaatgaaaggcaacaacttggtcaattggcaaaggaatatggacttaaagtatcattaggctcggattttcaccaaccctgttcatggatagagctagggcgcaatttgtggttacccagtgatgtaataccgatatggcatgattggtcacgctag

SEQ ID NO: 4271 - DNA, 621 bp, Xenorhabdus bovienii
  Coding DNA location: Contig name=SeqID_16895; Position on contig =108207..108827bp; Strand=+
gtgagccagtttttttatatccatcctgacaatccacaatcccgcttaattgggcagagtgtagatgtgttaaaaaagggtggagttgtcatttatcctactgattcaggctacgctattgggtgctgccttgaaaacaaggatgccatgacacacatatgccgtattcgccaattggatggacgccacaattttaccctgatgtgccgtgatctttctgaaattgcggcttatgcgcatgtggataatcaggcattcagattgataaaaaataatacgcccggtaattacacctttattttacaggcgacgaaagacgttccccgtcgtttgatgaacgaaaagcgtaaaaccatcggcctgcgtgtcccttccaatcctattgctttggcattactggaaggaatgagagagccactgatgtcatgtagcttgattttacccggaaatgattttgcggaatctgatccagaagagattaaggatgtgctgggtaaacaggttgatttaattattcacggtggttatcttgggcagcaaccgacgacggtaattgatttgaccggagattttccggaggttctgcgcgaaggtgaaggggatgtaacaccttttctatag

SEQ ID NO: 4272 - DNA, 945 bp, Xenorhabdus bovienii
  Coding DNA location: Contig name=SeqID_16895; Position on contig =108893..109837bp; Strand=+
atgagcgataaaacgcaaaaaacagaaagaacggaaaagttacaaaaaattctcgcacgtgctggtcatggttctcgccgcgaaattgagggctatatccaagaggggcggattagcatcgatggcaagaccgcaacgttgggtgatcgaatcgaagtcaaaccttccataaaaattcgccttgatgggcgtatcttaaatataaaagagccacaaaaaacgatttgtcgcgttctggcctattataagcctgaaggtgagctgtgtactcgacatgatcctgaagggcgtccaacagtgtttgatcgcctgcccaaaatgcaggatgctcgctggattgccgtagggcgtttggacatcaatacttgcggactgctgctgtttacgacggatggagaactggcaaaccgcctgatgcatccaagctgtgaagttgagcgtgaatatgctgttcgtgttttcggtgaagtagacaatgcgaaacttcgtcaattgacacaaggcgttcagttggaagacgggcctgcctccttcaaaactatctcattcaagggtggtgaaggtatcaaccagtggtataacgtgacactgacggaaggtcgtaaccgtgaagtcaggcgtttgtgggaagctgttggcgtacaagttagccgcttgatccgtgtccgttatggtgatatcgatctaccgaaaggtttaccacgtggtggatggacagaactggggctggagcagactaactatttacgtcagttggttgatttaaatgaagaaaccatgtccaaagttgcggttgaacgtgaccaacgccgtattaaggccaatcagatccgccgggcagtaaaacggcattctcaggtcggctcctcccgtccagcggggaaacgccctgcaagtagctctcgtcagaatacgggaagaaaagcggtacctaaaggccgttaa

SEQ ID NO: 4273 - DNA, 597 bp, Xenorhabdus bovienii
  Coding DNA location: Contig name=SeqID_16895; Position on contig =109911..110507bp; Strand=-
atgccaacggataacggacagtacaagaaaaggcaacagcgcctgaaagagaaagtcgatgcccgcattgaagctgctcaacaggaacggggtatcgtcatagtattcaccggaaatggtaaagggaaaacaaccgctgcgtttggcacagtcactcgtgcaatcggccatggtcagcgtgccggcgttattcaatttatcaagggaacatgggaaaacggtgaaaggaatctgctagcacaacagggtgttgagtttcatatcatggcgacagggttcacatgggagacgcaaaaccgtgaaactgacatcgcagcctgccaagctgtatggcaacatgccctgacgatgttatccgacccctcattgcagcttgtcgttctggatgagttgacctatatggtcagttacaaatatcttgacctaaccgatgtacttaccgcactcaaacaacgtcctatccatcagtctgtcattattaccggacggggctgccatcgtgaattacttgaacttgcagataccattacggaaatgcgtccagtaaaacatgcgtttgatgcgggaatcaaagctcagaaaggggttgattggtaa

SEQ ID NO: 4274 - DNA, 765 bp, Xenorhabdus bovienii
  Coding DNA location: Contig name=SeqID_16895; Position on contig =110507..111271bp; Strand=-
atgttagattaccaacccaatcatgatctgctgcaacagaaaatcattttagtcaccggtgccggagacggcattggtcgtgaagcggcgctaacttatgctcgccacggcgcacaggttattctgctggggcgcacaacagcaaaactggaagcggtcaaacaacaaatcgaaaacagtggcggcttaccggttaccatttacacaatggatcttttgaccgtgacagccgaagaatgtcaggcctttgcagatgaactcacccagcattatccccgtctggatggggtattgcacaacgcaggtctgctgggtgttgtcgcacctgtcatagaacagcctgttcagctttggcatgaagtcatgcaagtgaatgtcaacgcaactttcatgctgactcaggtgttaatccccctgttattgaaatcccccaatggctctctggtatttaccagttccagtgtggggcgtgaaggaagaagtggttggggtgcatatgctgtttccaaatttgcaacagaaggtctaatgcaggttctagcgcaggagtatcaggaaactgccttgcgtattaactgcattaatcctggaggtacacgcaccggtatgcgtgcgagtgcatttcctgatgaaaatgcgaccaaattaaaaatccctgccgagatcatgccggtctatctctatctgatgggtgatgacagcctgagtgattcaggtatcagctttgatgctcagccgggtcgtaaagcggggcctgccaaataa

SEQ ID NO: 4275 - DNA, 105 bp, Xenorhabdus bovienii
  Coding DNA location: Contig name=SeqID_16895; Position on contig =111330..111434bp; Strand=+
atggcatctgctattttaggcggacacatgaagtctgtcatcagaacaaaacttaatgcccccgtcaaatttgctcaatatagacagaaaagaacagagctctga

SEQ ID NO: 4276 - DNA, 135 bp, Xenorhabdus bovienii
  Coding DNA location: Contig name=SeqID_16895; Position on contig =111505..111639bp; Strand=-
atggttttacgtacacccaatccgatacaaaatactgccagaacgacgactgctaataccacagtaaccactttggccaagaacagcccgtatagagacaaatactccacagatccaccttatcttcaattatga

SEQ ID NO: 4277 - DNA, 939 bp, Xenorhabdus bovienii
  Coding DNA location: Contig name=SeqID_16895; Position on contig =111638..112576bp; Strand=+
atgcataaaggggagttgcgtctgaccaatctgggtgaatcatacagggaaaaacagcgccagatgcagcaggctcggatgagtgacgcagagcagaaaatttggcagaaggcgttaaaaaaacagcagaaaaatgatgccaagcagaaaaaggcagaggctaaagcgagtcagaaaggtttacagaaatcgaacctttatgttctggattttaaaggcagtatggatgcccatgaagttgattctctccgtgaagagattagcgccatactcgctgtggcagatagcaaagatgaagtgttactgcgtttagaaagccccggcggtatggtacatggttatgggcttgctgcatctcagttggctcgtttacggcagaaaggaatacgtctgacgattgccgtggataaagttgccgcaagtggtggttacatgatggcttgtgtggcagatcgcattattgctgccccttttgcgattattggttctatcggtgttgtggcccaactcccgaatatccaccgattactcaagaaaaatgatattgatgtagaattacatactgccggggaatacaagcgtactctgactgttctgggagaaaatactgagcagggacggcagaaatttcaggaagatttgaatgaaactcataaattatttaaatcatttatttatcagcatcgtccatctctggatgtggaaaaagtagccactggtgaatactggtatggtatgcaggcaaaagaaaatgggttaattgatgatgtaggtgtcagtgatgattttctgattggacagattgaacactgtgaagtcatcggagtcagttattctcgtcgtaaacgtgtgatagagcgtttcatgggtagcgcaatggagaatgttgataaattgttcatgcgctggtggcaaaggggcgaaaagccactgttctga

SEQ ID NO: 4278 - DNA, 252 bp, Xenorhabdus bovienii
  Coding DNA location: Contig name=SeqID_16895; Position on contig =112704..112955bp; Strand=-
atgcaaactgaaacattacccattaagcgtaaacagttactggaaaaagcaaataaaatcattaggaaacacgacgattttattcagggaatgtatgcagataatgtagaacagaaaggcgaagtgctcgtttttaagggagaatattttttggatagctataatctgcctaccacgaaaagtaccgctgtgtttaatatgtttaaacatttagcacatatattatccgaaaagtatcatttagcagactag

SEQ ID NO: 4279 - DNA, 165 bp, Xenorhabdus bovienii
  Coding DNA location: Contig name=SeqID_16895; Position on contig =112894..113058bp; Strand=+
atgattttatttgctttttccagtaactgtttacgcttaatgggtaatgtttcagtttgcatcgattatgctcctccaaaaaataagttgttgcgcatcgttttttatcaggtagagtgtgggcttttcgtcatgcagatggaagattttgtttacaactgttaa

SEQ ID NO: 4280 - DNA, 2592 bp, Xenorhabdus bovienii
  Coding DNA location: Contig name=SeqID_16895; Position on contig =113262..115853bp; Strand=+
atgggtaaagctcttgttatagtggagtccccggcaaaagccaaaacaatcaataaatatctggggaatgactacgttgtaaaatccagtgtaggtcatatccgtgatttgccgaccagtggagcagcgagtcaaaagagttcgaactcatcaaccgataagaataaaaagaaaaaggatgagaagacagcgctggttaaccgaatgggagttgatccctatcacggttgggaagcggattaccaaattttgcctggtaaggaaaaagttgtcgcagaactgaaaacgcttgctgagaaagccgatcatatctatctcgcaacggatcttgatcgcgaaggggaagccattgcatggcacctacgagaggttattggtggaggagaggctcgtttcagtcgggttgtattcaatgagatcaccaaaaatgccatcactcaggcttttgacaatcctggtgaactgaatatcgaccgtgtaaatgcacagcaggcgcgccgttttatggatcgcgtcgtgggttatatggtttcaccgctgttgtggaagaaagtcgccagagggctgtctgccgggcgcgttcaatccgtagcggttcgccttatcgttgagcgggagcgtgaaatcaaggtctttgtgccagaagaatactggcaattgcacgcggacttaatggcaaaaggagacattgcgctccaaatggaagtcacccatgaagggggaaaaccattcaagcccgttaacgcacagcaaacacaggctgcggtatccttgcttgaaaaagccagatacaaagttcttgatcgtgaagaccgcccgacgtccagtaaaccgggcgcgccattcattacttcaacactgcaacaggctgccagtacgcggcttgggttcggtgtcaagaaaacgatgatgatggcacagcggttatatgaagcaggacatatcacgtacatgcgtaccgactctatcaatttgagtcaggatgcactggacatggttcgcggttatatcaatgatcactttggtgacaaatatttgccaaaaacagccaatatctacagcagtaaggagaattcgcaggaggctcatgaagctatccggccttctaatgtagatgtcatggcggaagaactgaaagatatggaagccgatgcacaaaaactgtatcagcttatctggcgccagttcgttgcctgtcagatgatgccagcgaaatacgattccactacgctgacagttcaggcggggaattttgaactccgtgccaaaggtcgtacattgcgtttcgatggttggacgaaagtgatgccagcattgcgcaagggggatgaagaccatactttaccagtggttgaagttggcactgaacttgacttgcaacagttgagcccaagccagcatttcacgaaaccaccggcacgtttcagtgaagcatctctggtcagggagttggaaaagcgtggcattggtcgcccatcaacctatgcgtcaattatttcaactattcaggatcgtggttatgtgcggggtgaaaaccgtcgattctatgcggaaaaaatgggtgaaatcgttaatgatcgtttagaagagaacttcaacgaattaatgagctatgactttaccgcaagaatggaagaccagctcgatcacgtcgctaataacgaagctaactggaaaggggtactggacgagttttttaccaatttcagtgaacagcttgatgttgctagcaaagatcctgatgaaggcggtatgcgtccgaatccaatggtgatcacttctattgattgtccgacgtgtagtcgcccaatgggtattcgcacggcgacaacgggggtatttcttggctgctctggctatgtgctatcaccgaaagagcgttgcaagcaaaccatcaatttgatcccggaaaacgaaatcctgaacattctggaaggggatgatgcggaaactaatgcactgcgtgcccgccatcgctgtaaagaatgcggtacagcaatggatagctacctgattgataaccaacgtaaattacatgtttgtggtaataatcctgcatgtgatggttatgaagtggaagagggcgaattccgaatcaaaggttatgatggcccaatcgttgagtgtgataaatgtggttcagaaatgcacttaaaaatgggtcgtttcggtaaatacatgggatgcacaagcgaagagtgcaaaaacacccgtaagatcctccggagcggggaagttgccccaccgaaagaagatccagttccattgcctgaattgccatgtgaaaaatcggatgcctattttgttctgcgcgatggtgctgctggtgtatttcttgcagccaacacgttccctaaatcgcgtgaaacacgagcaccgctggttgaggaacttgtcaagttcaaggatcgcttgccagagaagttatgctatttggctaaggctcctgttgctgaccctgaaggtcataaaacagtagtgcgttttagccgcaagacgaagcagcaatatgtctcttcggagaaaaatggtaaggcgaccgggtgggccgcattttttgttgatggtgcttgggtaacaaaagaaaagtaa

SEQ ID NO: 4281 - DNA, 975 bp, Xenorhabdus bovienii
  Coding DNA location: Contig name=SeqID_16895; Position on contig =116194..117168bp; Strand=+
atgaaactacagcaattacgttatattgtagaggtggttaaccataacctgaatgtatcttctacggcagaaggattgtacacctctcaacccgggatcagcaaacaagtcagaatgcttgaagatgaattgggtatccaaatatttgctcgcagtggcaaacatctgacacatgtcacaccggccggtgaagaagttatccgtatttcacgtgaagtactgtcaaaaattgattcaatccgttccgtagccagtgaacatacttatccggatcgtgggtctctgtatattgcaactacacacacccaagcaagatatgccttgcctcctgttatcaaaggttttattgagcgctatcccaatgtttcccttcatatgcatcaaggttcacccactcaaattgcggaagaagtatgtaagggaaacagcgattttgcgatagcaaccgaagcacttcatctctatagcgatcttattatgttgccttgttatcattggaaccgctctgtagtggttacgaaagatcatcctctggcagccaggcaaaacgtaacgattgaggaattggcggaatacccgattgtgacatatacctttggctttacggggcgttctgagttggatgttgcttttgaccaggctggtcttaaacctaagatagtattcacagcgacagatgctgatgtaattaagacttatgttcggttagggttaggagtcggcgtgattgccagcatggcgatagaacctgttcaggacagtgatttagtgcgcattgatatgcgtgataaattcagttatagcacgacaaagattggtttccgtcgcagtagtttcctgcgtagttatatgtatgattttatctggcgttttgctccgcatttaacacgagatgtggttgataaagctatcgcgttgcgatctaatgaagaaattgaagagatgttcaaggacatcgaattaccgatagcataa

SEQ ID NO: 4282 - DNA, 822 bp, Xenorhabdus bovienii
  Coding DNA location: Contig name=SeqID_16895; Position on contig =117518..118339bp; Strand=-
atggatataaaagtcgacaaaaaccgccaacactatttaaaccatatagcgcaggctgaacaatttttttccagtggaattgaggataatttttccctgtcaaaccaccaattcagtgatatgggtggacttgttcaatttgtcattacttcacaaatcaatgacaaatccagcgtgatacaacggttaaatgaaataaagaaaacacagatttctctttcctcaattgcgactgattatatcataaaatatgcaaatacccatggccaacaatatagaactgacgtgcaattctggggcgatatcatagagaaactgccgttaatgagcgtcaggaatatagaaagccaaacctacagccatgtaatgaaaggattttcaatcgcaacgaacttgctgcaacttatcatggatattgttttgaatacaaactcttccagcatgaaaagcttttctcagttcctgcaaaaacaaggagatgctattaggattgggttgaagaagaataacgagcattactctactctgactttggccagtatcattgaagctgttggagctgaagatcaagtgatttatattcccaaaatgaaactgtacaaagtgaattttgacagaagcaattcagaaattgcttcaaattgtgcttccaatgaaaatatcaatgtcgaattcacttactcttcctgtatttcattatttgattatcaggcattggaagatcccgaaattaaggcatcctttgatctatttattcgtaataacaaaaaatcatcaatagagaattctaataattttttcaacggtgaatttaaagtgtaa

SEQ ID NO: 4283 - DNA, 2676 bp, Xenorhabdus bovienii
  Coding DNA location: Contig name=SeqID_16895; Position on contig =118555..121230bp; Strand=+
atgtcgtttaaattgaaaacggactgtgcatcaacactctccattggcagtaaaacatatcattattacagtttatctctgttatctgaacaattgggtgagatagcccgtttgcctaagtccatgaaagtcctgcttgaaaatctcctgcgcaatattgatggcgattctgttgtggaagaggatttgaaggcattggtggaatggcagaaaaacggtcatgcagacagggaaatcgcttatcgtcccgcccgtgtgttaatgcaggattttaccggcgttccggctgtcgtggatcttgcagccatgcgggaagcggttctgcggcttggcggtaatgttgaacaagttaatcctttgtctcccgttgatcttgtgattgaccactcagtcatggtagacaaattcggtacagagcaggcgtttgaagaaaacgttcagattgagatggaacgtaactatgaacgttatctatttttacgttgggggcaaaaagcctttaatcgcttccgcgttgtgcctcccggaacaggaatttgccatcaggttaaccttgaatatcttggtaaatcggtttggtatgaaaaccagaatggcaaggattttgcctatcctgatacgttggtggggacggattctcatacaaccatgattaacggactcggtgtattaggttggggcgttgggggaattgaagccgaagctgctatgttggggcagcctgtctccatgctgatcccggatgtcgttggttttaaactggccgggaaattgcgggaagggatcacggcaaccgaccttgtcctgacggtgacgcagatgctgcgcaagcatggcgtggttggcaagtttgtcgaattctatggtgatgggctgtctgatttgccattggcagatagagcaactattgccaatatgtcgcctgaatatggcgcaacctgcggtttcttccctgttgatgatattacactgggctatttgcgcttaactggacgcaatgaagatgaaattgccttagttgaagcctactgtaagaagcagggattatggcgtaacgcaggggatgaacccattttcaccaacaaccttgagctggatatgtccacggttgaagtgagcttggcaggaccgaaacgccctcaggatagagtagcacttggcgatgtaccacatgcattccaagctgccatggaactggacatccataaaatacaggagcatcgggcggacacgatagtcactcttgataatcagacttttgcactgcaagatggcgctgtagttattgctgccatcacttcctgtacaaatacatctaatcctagtgtcttgatgacagcaggtttacttgccaaaaaagcgattgaaaaaggtttgcaacgtcaaccgtgggttaaaacctcgctggcacccggctccaaggtagtaacggattaccttgaactggcagggctcatgccatatctggaaaaactgggtttcaatctagtgggatatggttgtaccacttgtatcggtaactcaggcccattgccagagccgattgaagtagcgattaagcaatctgatctgatggttggcgcggtgctttccggtaaccggaattttgaagggcgcattcatcctctggtgaaaactaactggctggcatctccgccactggtggttgcctatgcactttctggtaatatgaaaaaagatctcactagggagccattagggcaagatcaacaaggtcatgatatctatctgcaagatatctggccggatagtcaagaagtcgctgaagctgttggtaaagtcaggacagagatgttccacaaagaatacaatgccgtttttgatggtgatgaaaattggcaatcgttggaagtggaaaggtcagaaacttattcttggcagcaggattcaacctatattcgccttcccccttttttcagcgatatgacgattgagcccaagccgataactgatatccatcaagccaatatacttgcgatcttgggggattcagtcacaacggatcatatttctccggcgggaaacataaaagctgacagcccagcaggacgatacttgcaggaacatggcgtttcgccgaaagattttaactcttacggttcaaggcgtggcaatcatgaagttatgatgcgtgggacgtttgccaatatccgtatccgcaacgaaatgatgcctggtgtggaaggaggatacactcgccatattccatctcaagctcagttggcgatttatgacgcggccatgctttatcaggaagacaagacaccgctggccattattgcaggtaaagaatatggttccggttcaagccgtgattgggcagcgaaaggaactaggctgctgggagcgagggtcgtgattgcggaatctttcgaacgtatccaccgttctaatctgattgggatgggcgtattaccactggaattcccacaaggtgtcagccgtaagacgctaaacctgactggtgatgaacgaatcgatattgtaggattggggcatatcgagccagggcagaccattgcggtaaaaatcaattatatcaatggaaaagaaactgtcattgatgtccgttgtcgcatcgataccaatacggaactggcgtatttttataatgacggcattttgcactatgtgatccgtaatatgctgaaataa

SEQ ID NO: 4284 - DNA, 609 bp, Xenorhabdus bovienii
  Coding DNA location: Contig name=SeqID_16895; Position on contig =121333..121941bp; Strand=-
atgaatactaaaatacagctaaaacgagtagctgaagcgaaactgcccacgccatggggcgagtttctgatgattgggtttgaagaaattaaaacaggtcgtgaccatgttgcgcttgttttcggtgatatttccggtgatgagcctgttttatcacggatccattcagaatgtctcacgggggatgctttattcagcctgagatgtgactgcggttttcagttggaagctgctttttcacaaatcagcaaggaaggtaaaggtgttctactgtatcatcggcaggaaggccgaaatattggtctgctgaataaaattcgcgcctacgcattacaggataaaggcgttgataccgtagaagccaaccatcaactaggctttgctgctgatgaacgagatttcactctatgctcagatatgtataaattgctgggtattaatgcaatccgtcttctaacaaataatcctaaaaaagttgaaatcatggtagaagcaggcattaatatcgtcgagcgtgtaccactggtcgtggggcgtaatcctaaaaacgcttattatctagataccaaagccagccggatgggacatctactatccaaatcaaactga

SEQ ID NO: 4285 - DNA, 315 bp, Xenorhabdus bovienii
  Coding DNA location: Contig name=SeqID_16895; Position on contig =122359..122673bp; Strand=+
gtgaaatattttctaattttattactggcactggttgtttttgtcatctcagtgactctgggagcaaataatgatcaggtagtgacatttaattatctgattgccaaaggtgattactcgatatccacactgctgtctgtattgtttgctatcggttttatgcttggctggggtatctgtgggggtttttacctgcgcgtctgtgtatcattgcgacgtgcgaaacgtaaaattaagcgtctggaagcccaattggaacagcctgctgagtcatccgtaaaaactgcatcgcctgtagtattaaccaaggaataa

SEQ ID NO: 4286 - DNA, 1170 bp, Xenorhabdus bovienii
  Coding DNA location: Contig name=SeqID_16895; Position on contig =122680..123849bp; Strand=+
atgttagagctgttgtttctgttgcttcctattgccgctgcttatggctggtatatggggcgcagaagtgctcaacaagataaacagcaatctgctgaccgactctcacgtggatatgttgatggtgttaattttttactttccaatcagcaagataaagccgtcgatttattccttgatatgctaaaagaagatagttcagcgtttgaggcacatttaacgctgggaaatctattccgttcccgtggtgaagttgaaagagctatccgcattcaccagtcacttatggaaagtgcatctctgacatttgaacagcgtttgcttgccatccaacagcttgggcgtgactatatggctgctggtgtgtatgaccgggcagaaaacatgttcattcaattggttgatgaagctgatttccgtgagaatgcttttaactccttattaaccatctatcagtcaaccagtgactggaacaaagctatcgatgtttctgagaagctggtcaaactaggtaaacaccattttcgggaagaaatcgcccatttttactgtgagttggcactacaatgcatgggcagtgatgattctactgaagcagtagggcatctcaacaaggcggctcaggcggacaaaaactgtgcccgtgtgtcaattatgttcggccgtatttatatagcgcaaaaggaatataccaaagcggcggagctgctgaaacgtattctcgaacaagacaaacaactggtcagtgaatctttgcccatgctggaagaatgttaccagaacttgtctcaaccggaagaatgggaggcttttgttcagtgttgcgtggaagaaaaatgtggtgccattgcagaactttacctggctgatattatcgagaaaaaagaaggccgtgatatcgcccaaaattatattaaccgccagttagaacgccatccaactatgcggctgttttatcgcttgatggactaccatttggcagacgcagaagaagggcgtgccaaagagagcttgctccttctgcgcaatatggtgggtgagcagatccgcactaaacccgactatcgatgccataaatgtggtttcacttccctctcactttattggcattgcccatcatgccgttcatgggacactatcaaaccaatccggggtctggatggacagtga

SEQ ID NO: 4287 - DNA, 741 bp, Xenorhabdus bovienii
  Coding DNA location: Contig name=SeqID_16895; Position on contig =123949..124689bp; Strand=+
atgacatcccacacagctcaaactttaggtaagcagattgattcacctgttattgtcgcattggattatgacaatcaagacgcggcgttagcatttgttgacaagattgatccgcagtcctgccgtcttaaagtgggtaaagagatgtttacgctgaatggcccgcaatttattcaggtattgcatcagcgtggcttcgaggtgtttttggatctcaaatttcacgatattcctaatacaacggcaagagcggtagcagcagcggctgaattgggtgtttggatggtgaatgttcatgccagtggtggtgcgagaatgatgaccgccgccaaagaggctttgttgccatatggtaaagatgcacctttgttgatcgcagtgacagttttaaccagtatggaacaatccgatctgctgggcgttggtattgatgtgacacccgcacagcacgcagagcgtttggcgacattggcaaaacaatgtggtttggatggtgtggtatgttctgctcatgaagcacagcaattgaaagcagtctgcggacaggaattccaactggttacgccaggcattcgccctgaaaggcgtagaggctggagatcagcgccgcatcatgacacctcctcaggcagttcaggttggtgtggattatatggtgatcgggcgtccgattacccgggcagaaatccagcattggcattacagcagattaatcactctattgggatcgttcatggataa

SEQ ID NO: 4288 - DNA, 444 bp, Xenorhabdus bovienii
  Coding DNA location: Contig name=SeqID_16895; Position on contig =124562..125005bp; Strand=+
atgacacctcctcaggcagttcaggttggtgtggattatatggtgatcgggcgtccgattacccgggcagaaatccagcattggcattacagcagattaatcactctattgggatcgttcatggataataattctcgcttggtttattcgacggatatcggtcgggtccaagaggaaaaagttgagctttctcgccataaaggcgatggtatcgtgcgtatccaacgccagaccagtgggcgtaaaggcaagggcgtttgtataatcactggcattgatgctgatgaccaaacgcttgccaagctggctgcagaattgaagaaaaaatgtggctgtggtggctcagttaaagaaggtgaaatcgaaattcagggcgataagcgtgatttgctgaagcagttgctggaagctaagggcatgacagttaaactggctggtggttga

SEQ ID NO: 4289 - DNA, 114 bp, Xenorhabdus bovienii
  Coding DNA location: Contig name=SeqID_16895; Position on contig =125006..125119bp; Strand=-
atgaccaaaagttggcggttatcacagctgcccgatcactatcccatttactacatattacttaacaggctatacaatccagttatacatagcctgttaaaagacagaaactaa

SEQ ID NO: 4290 - DNA, 420 bp, Xenorhabdus bovienii
  Coding DNA location: Contig name=SeqID_16895; Position on contig =125926..126345bp; Strand=+
atgttaaataataaagctgtcatacttagcatattattaagcatagccaatattactggctcatcaggattgactatttggatagataatgtgctgaaagaagggggggggatattaaatacgtatattccgctcttttcttatttgatagggttgtctataggttgtatgacaatatctttttttattcgtaatataaaaaatatttttttaaaagaaaatatttttatatgttctttactattggcaacaacaaactgtcttctattttcaaaagagtggataactatatcagttttggctgattctatccatagagttatatggggaattatgagtggatttaccgttatattaggaaggaatattcttataacagaaggaaatgaaaaaaaacaaataaaaatttttctattttaa

SEQ ID NO: 4291 - DNA, 135 bp, Xenorhabdus bovienii
  Coding DNA location: Contig name=SeqID_16895; Position on contig =126610..126744bp; Strand=+
atgccagcaatgcgagtaatttattttaattacattgatatgactcaaatgtatataatattattaactctttggtttccttgtgctatttttagcataaagataattaagtcagccaaccttgaaaaaaaataa

SEQ ID NO: 4292 - DNA, 336 bp, Xenorhabdus bovienii
  Coding DNA location: Contig name=SeqID_16895; Position on contig =126759..127094bp; Strand=+
atgcaattaatttcttttggtttatgtttgatttccataagtataggttctagaatattgtatatcttttttatgctgctaatgtttttagcaaatatgattatgcaacctgtttttttttcctacttaggattatattctaaaaattctctttatactctcggtatgcaatcagggatttatgtttttataacaacaatcattcttgcatacactgtttttataaatattgaaatggagaagataatgattggattcgcttcgttattaattctatccgtaataaattctattacgtttgtcttaatcgtcaatagaggaaaaaataacaaataa

SEQ ID NO: 4293 - DNA, 354 bp, Xenorhabdus bovienii
  Coding DNA location: Contig name=SeqID_16895; Position on contig =127196..127549bp; Strand=-
atgccgatcagagcacttattacaagcggtcccacagcggattgctcacaagctgaggccttgattgacggaatagatgcagaacatttattagcggatcggggctatgacagtaataccgttgttgaacaagcagaaaaacaaggcatggcagcgcaaattcccggccgaaaaaatcgcaaagtgaaacgagaatatgatcgggaactctatcgactcaggcatttagttgaaaatgcttttcttcatcttaaacgctggcggggtatagcgacccgttatgccaaaaatagtgcctcatttcttgctactgttcagatccgctgtcttgctctttggttaaatgtcttatga

SEQ ID NO: 4294 - DNA, 492 bp, Xenorhabdus bovienii
  Coding DNA location: Contig name=SeqID_16895; Position on contig =127486..127977bp; Strand=-
atggatgacttaaccatgagcacacccgtacaccgccgtcacgatatttccgatcatatttggagtttgcttgaacctcacctgccgggacgtaagggagcctgggggcgtgttgcttatgataatcgattatttattaatgccgtgttctggattttacggacaggcgcaccctggcgagatttaccgcccgattatggcgactggaaaaatacgcatcgccgtttttgttggtggcgggacaaaggcgtatgggaagaactgcttgaagaactcatctttgaacccgatttcgaatggctgatgattgacgccagtcatattaaggttcatccccacgccgcaggggcggcaggaggcaatcaggatatggggcgcacaaaagggggctcaatacaaagatacatctggccgtggatgcgcatggtatgccgatcagagcacttattacaagcggtcccacagcggattgctcacaagctgaggccttga

SEQ ID NO: 4295 - DNA, 576 bp, Xenorhabdus bovienii
  Coding DNA location: Contig name=SeqID_16895; Position on contig =128041..128616bp; Strand=+
atgactacacaaaatatatttttcccgaaacaacagatcttgtccattctctccagccgtaaaatgacgctggaacaactggtggggattgcggatattcatcatgataatgtcgtttttccctcgcctcaggtattgcgtgatttttccgatcatattgctgtgccactaagtgtgttttatcaggaagatccgtgcagcgatctggatgatggggtaaaaattgcccgtcgtaatggaacattcagccgtgatgaaatccgtgatggagtgcattactacacctatcaccacctagtaaccaccaaagcggatcctggattaatggcattacgcctagatttacatagtaatgagacccagccactgcggcttaattccggtcatagcacacgcgaagtagtatatgtgacacgcggtacagtacgggtacaatggctggatgacgcgcagcaattacatgaggaaatcctcaacgaaggggactctatttttgtcactccgttagtaccgcatagtttcaccaaccattcgacacaggaaaaatccgagatcattgccattaattatgaataa

SEQ ID NO: 4296 - DNA, 168 bp, Xenorhabdus bovienii
  Coding DNA location: Contig name=SeqID_16895; Position on contig =128609..128776bp; Strand=+
atgaataatatcgtagctatagctacttcttcctgtgctccaaacagacttgaggcgctgtatatcatcaaattgggtgacagcatatccatcaataaagatgatcgttatgaattgcactgggagaatttacagttaattgcggatattactgcgcaacggaaataa

SEQ ID NO: 4297 - DNA, 96 bp, Xenorhabdus bovienii
  Coding DNA location: Contig name=SeqID_16895; Position on contig =128877..128972bp; Strand=+
atgccactccgtaaagtgaacattggtattcgctatactgtgcgatcatttgatctggaaatggcaacatgtataacatcggatttattggcttag

SEQ ID NO: 4298 - DNA, 885 bp, Xenorhabdus bovienii
  Coding DNA location: Contig name=SeqID_16895; Position on contig =128945..129829bp; Strand=+
atgtataacatcggatttattggcttaggccgtatggggcaggcaatctgtttacgactgttgtcccacgacattattctacgcgtttataaccgtacaccagaaaaggcgacgaaactgttggataaaggtgcagtgtggtgtaactccccggcggagcttggcgccgcgtgcgacattattatgttatgcctttcgggagagcaagtgaccgaggcactactgactgatagcgaaaacggcctgctgcgtcactgtcaccccggttgcatgattattgatactggcaccatctccccagaaagtgcgacatataatgcccatcttactgagacacagggacaggaatatatctcttgcccggtttctggcggcgtggaaggagcgaacaatggtacgctggcagcgatcgttgccgcgcagcctgcggtacgtacgataattgaatccgttatcagtcggtttgccgatcgaattacttggctgacaagtcacgctgatgcccagaaactgaaaataatcaacaatctagccgaaagcatcaatttattgggagcatttgaggtgctgaatatcggcctgacacacggcatcaccttagatgagttacacagcgttctgactacctgccgtgggcgttcagcctatatggatgtggcactacgtttcctcaacagtaacctgaaaccgagtgatgtgtcgttagctgttcgctgtaaagatttatgtctggcgggtagcttagctgatatttccagacattacccaatatctgacgcagcaattgagttattcagtcgggtgcgggaaaagtatggcgatgagcaggatcagtgtgagtattttaattttattaatgaggaaaagaaattaaatgacaattaa

SEQ ID NO: 4299 - DNA, 1143 bp, Xenorhabdus bovienii
  Coding DNA location: Contig name=SeqID_16895; Position on contig =129819..130961bp; Strand=+
atgacaattaatcataatattattctcgaagataccacgcttcgcgatggcgaacaggctcccggcgttgctttcacaggtgaagaaaaactggcgattattgattcactgatcagcagtggcgtgaaatggattgaagctggtataaacgccatgggtggtagcgaaagtcgcacactacatatgatgttggagcgtgttgagggcagtgatattcaccttataggctggaatcgtggggtgaaggaggatattgccgcttcgctagatctaggatttaaccatattcatattggactgccaacctcatcaattcatctcgacaatagcttggctaaaagccgttcttggttggttaaccaagcttgccagttagtggattacgccaaacaacgaggcgcatttgtctccatcagcgctgaggatgtcggccgttccgatcttgattttgttatagagtatgccactgcaattaaagaagcgggagccgatcgcctccggctgtctgatacagttggtattcttactccacaacagtatggtcacatcatcgagcaactaacccagaaagtggctattgatacccaatgccacactcataatgactttggctatggggttgccaataccatcgctgggctacatgccggtgcccgctatttccatactactgttaatggtatcggtgaacgtgcggggatgcctgatatggcacaaaccgtaatgactctgcgagtccattacggagtggatttggggattgataccactcacctgaaagcactatcgcaccaagttgccaacgcagcaggtattacgatgtacccttggcagccgattactggtagcaacgtattctctcatgaatcaggcattcatgccaacggtacgttaaaaaatagttccgcatttgaaccgatagctccggaaatggtcaatggagaacgcaggatcgtcattggcaaacattctggcaaagcgtcactgaagtatgctctgggctgtcaggggcattcctgggatgaagagcggctgggagatctactggcgttggtacgcgaagtggcgacactgaaaaaaggtgatttatcatatcaggctgtttgcctcctgtatgacagcctagtgcagagaggtgtataa

SEQ ID NO: 4300 - DNA, 567 bp, Xenorhabdus bovienii
  Coding DNA location: Contig name=SeqID_16895; Position on contig =130965..131531bp; Strand=+
atggtatcgttaaccttttaccggaaaactattgagcagttgttggcccgccgcaaaatggtactcaccgacatccgccatttggtttgcgtcagcgatgacagcgtggaggtcgaggatttcgatcagcttttcgccttaagccaacatacttctttatctgctagtgaatatattgcagcgcatcatagagaaaacgcggcacagaacgagctggtaaccatcactcgtaaggatagactgtacacgcgtattaaaggtgatgcacttcgtggaggctaccattaccgtcatgtccttaccacaacactggatcccgacctgttggtattacgaaccacaccgttgagcacccggcatcaagctcggccaaataccggacatcaggtgaaagaaatagtgtatgtgctgtcaggcagagtggggatagtctggcagaacaccggaggcaatgaacggcacagcaatttggggtctggagattcggtctacatagactcatgggtaccgcatgctttttatgccatcgagccggagtcacagattctggctgtagactacctctga

SEQ ID NO: 4301 - DNA, 180 bp, Xenorhabdus bovienii
  Coding DNA location: Contig name=SeqID_16895; Position on contig =131465..131644bp; Strand=+
atgggtaccgcatgctttttatgccatcgagccggagtcacagattctggctgtagactacctctgactcaggggctcacttcggctgaaaccgaaatggcacaacctgctagtccagcagtgttgtgtccagtccggcttttaacggaacgcttttttagggaatcgcttggaagatga

SEQ ID NO: 4302 - DNA, 891 bp, Xenorhabdus bovienii
  Coding DNA location: Contig name=SeqID_16895; Position on contig =131783..132673bp; Strand=-
atgccattttcctcattaagactcacacgaatatcagcaacgattttccctctacttggtgccctgataccgtttccaacccatgctactactcaacaaaatcaaattaccaatcaactttcggccctggaaaaaaatgccaatggccgtcttggcgttgtattaatcgacaccgcagaccattcaataatcacttatcgtggacacgaacgctttccattatgtagcaccagcaaaatgatgacggtatccgctcttctgaaaaaaagcgaaaccgataaagatttgttaaatcagcgcattcactaccagcaatctgacatcgttgaatacagccctattacagaaaaacacctcaaagatggcatgacactggcagagctaagtgccgcaaccattcaatacagtgacaatacagcgatgaatctgctactggatcaattaggcggggcgcatagtgtgacacgattcgctcgatctatcggtgacaacgcattccgccttgatcgtaaagaacctgaattaaacatggttacgccaggtgatgagcgcgacacgacaaccccacaggctatggctgacagcctgtataaattggcattgggtaacacacttgctgcaacacaacgcacacaattggttgagtggttgaaagggaacacaacaggcggtaccagcattagtgccggggtgccagataattggattgtgggagataaaacgggtcgctgcgactatggttctacaaatgatattgcggtgatttggcctgataaagacaaagctcccttgattctggtgacctattttacccaaccaagtgataaagacgccaaagcgcataatgatgttcttgctgcggctgcacgtattatgacgcaagaaagataa

SEQ ID NO: 4303 - DNA, 153 bp, Xenorhabdus bovienii
  Coding DNA location: Contig name=SeqID_16895; Position on contig =132732..132884bp; Strand=-
atgacattattaatgtacgcattgaagaagtcagaatggaaacccgtaatattgtggcacgccctgttgcctgatattacaaatagtttaaaaaaaacagtaaataaactgccgccaataacaagcggcagttttataatcagcacgagataa

SEQ ID NO: 4304 - DNA, 1941 bp, Xenorhabdus bovienii
  Coding DNA location: Contig name=SeqID_16895; Position on contig =132811..134751bp; Strand=-
atgtttcaagacaatccgctgcttgcacagctaaaacagcaactccacgctcagaccctacgcgtagaaggtttagttaaaggaactgaaaaaggctttggatttttggaagtcgatggccagaaaagttatttcattccaccaccacagatgaagaaagtgatgcatggcgatcgtattaccgccgccattcacaccgataaagagaaagaaatcgctgaaccagaagccttgattgagccatttctgacccgttttgtaggaagagtccaaaagaaagagaacgacaaccgactgtggattattccggatcatccattattaaaagatacaatcctttgccgtcctgctaatcaagtcacccataattttgaaaatggcgattgggcagtagctgaaatgcgccgtcatccactgaaaggtgatcggggatttcaggctgaaattaccggttacattaccaaaggtgatgatcactacgcaccttggtgggtaactctgacacgccataatctgcaacgtgaagctccaacaatgcccgattgtcagttggatgatggttcgctggagcgtatcgatctgaccgctctcgattttgtcaccatcgacagtgcgacaaccgaggacatggacgatgcgctgcatatcgtcaaaaatggtgatggcagcctgaaattgtccatcgccattgccgatccaactgcctatatcaaggctgacagtgaattagacaaaattgcctaccagcgcagcttcactaactatctgccaggcttcaatattcctatgctgcctcgcgaactctctgatgatttatgttcgctgcggccaaacgttcgccgtcctgcactggtttgccaggtttccattctggaagatgggcaattgggcgatgacatgcaatttttcgctgcatgggtggaatcgaaatttaaactggcttacgacgatgtttctgactggctggaacaccaagccggctggaaaccagaatcagaagcagtcactacccaaatcactctcttacaagagatgtgcgaacgccgcaatcaatggcgtcatcaatatgcccttgttttcaaagagcgcccagattatcgctttgtccttgataaaggtggcaatgttgttgatatcgttattgatcaacgtcgttctgccaaccgcattgttgaagaagcgatgattactgcgaacctatgcgcagccaagatcctgcgtgacaaattaggttttggcatttataacgttcatactggtttcgaaccaacacaaattgatcaagttgtggacgttttaaaagaaaatggtattgaaactgaagcaaatgcactgctagaactggatggtttctgccagttacgccgtgaattggatcaacaaccgactcaattcctcgatagccgtatccgtcgcttccaaacgtttgcagaaatcaaacccgaaccaggcccacactttggactgggctttgatgcctatgcgacttggacatctcctatccgtaaatacagcgatattattaaccaccgtttgttgaaagctatcattcagcaaaccgaagaagaaaagccatccgaagaggtctgcctgcaactgacagatcgtcgtcgcgcaaaccgcatggcagaacgcgatgtaggcgactggctctatgcccgtttcctacatcctcatgctggcacagataaaactttctcttctgagattgtggatattacccgtggtggcctgcgcattcgtctggttgacaatggtgctatcgctttcgttccagggccattcctacatgccgtgcgtgatgagcttcagtgcagtcaagagaccggttccgttcttattaagggtgaagccgttcatcgtttgaatgacattattaatgtacgcattgaagaagtcagaatggaaacccgtaatattgtggcacgccctgttgcctga

SEQ ID NO: 4305 - DNA, 219 bp, Xenorhabdus bovienii
  Coding DNA location: Contig name=SeqID_16895; Position on contig =134922..135140bp; Strand=+
atgtcatcaaattttgttgtgggccgatccttcctacaattcatggtcaagtgtgcgatagacggttggctgggggatggagaatggttcggccagattgctgatcgagggttttcctacacaatatatgaacttatggataatttatttatatcgctgttctacttaggtatttttatcactcggttttatcagcatactcacacagatcctcaataa

SEQ ID NO: 4306 - DNA, 633 bp, Xenorhabdus bovienii
  Coding DNA location: Contig name=SeqID_16895; Position on contig =135100..135732bp; Strand=-
atgaatcaacaaaaacggatcgcaattttaacccgcttacagaataacaacccacagccaaccaccgagttggctttcaattctccttttgagttgctgatatctgtattactgtcagcacaggcgactgacgtcagcgtcaataaagcaaccacaaagttgtatccggttgccaatactccacagacgatcctcaatctgggtgttgacagtctgaaagagtatataaaaaccatcgggttatataacaccaaagccgagaacgtgattaaaacctgccgtattttgttagaaaagcaccagggcgaagtaccggaagatcgcgcggctctggaagcactgccgggagttggccgcaagaccgctaatgtcgttttaaatactgcttttggctggccgactatcgccgtcgatacgcatatctttcgtgtctgcaatcgtacccaatttgccccaggaaaaaacgttgatgaagtcgagagaaagttactgaaagttgtaccggatgaattcaagcttgattgccatcattggttgattctacacggccgctatacctgtattgcccgtaaacctcgctgtggatcttgtattattgaggatctgtgtgagtatgctgataaaaccgagtga

SEQ ID NO: 4307 - DNA, 708 bp, Xenorhabdus bovienii
  Coding DNA location: Contig name=SeqID_16895; Position on contig =135747..136454bp; Strand=-
atgagtgaaaccaagaaactattttctcaggggttatggaaaaacaactccgcattagtccagctattggggctttgtcctttgctggctgtctcttctactgccaccaatgctctggggctagggttagcgacaacgttggttttattaagtaccaacattgctgtgtctgccttacgacgctgggttccccatgaaatccgcattcctatttatgtgatgatcattgcctctgtcgttagtgccgtccagatgttaatcaatgcattcgccttcggattatatgagtcattggggatatttatccctttgatcgtgactaactgcatcgtcattggccgtgctgaagcttacgcatcaaaaaactcgatctacaattccacaattgatggccttgcaatggggctcggcgcaaccttttccctattcgtactgggaaccatacgagaaatcttaggaaatggcaccattttcgatggcgcagatctgttattgggaagttgggcaaaatcattacgcattgaaattatgcatatggattctccattcctgttagccatcctgccaccgggtgcatttatcggattaggcttgatgctggcaggaaaatacatcattgatgaacgcatcaaaaatcgggctgataatcaagcacgtcgctatgacaacgtagaaaaaggctgtggcagccatatcacgaaaagctaa

SEQ ID NO: 4308 - DNA, 627 bp, Xenorhabdus bovienii
  Coding DNA location: Contig name=SeqID_16895; Position on contig =136454..137080bp; Strand=-
atgttagaaaccatgcgacgccacgggattaccctcgcaatttttgcggcctgcactacagggctgactgccatcgtctattctttgacaaaagatcggattgccgagcaagctgcactacaacacaagatactgctggatcaagttgtccctcccacactgtataacaataatatgcaagatgaatgctatgtggtgacggctgatgcattgggcaacaaacaaccccatcgactttatctcgcccgtaaaaatggctctcccgttgcggcggcgatagaaagtaccgcaccagatggctattcaggtgcaatccaattattggtaggtgctgatttttcaggcaatgtattcggtgttcgtgtaactgaacatcatgaaacaccgggtttaggcgataaaattgacacacgtatttccaattggatctattctctttctgacaaaaaagtcgtttcaaacaacgatcctcattgggctgttaaaaaagacggcggggaatttgaccaatttacaggagcaaccatcacacctcgtgccgtcgtaaatgcagctaaatggacaaccctctatctgaaaaccattcccgcacaactttcttcactaccaacttgtggagttgaataa

SEQ ID NO: 4309 - DNA, 1080 bp, Xenorhabdus bovienii
  Coding DNA location: Contig name=SeqID_16895; Position on contig =137090..138169bp; Strand=-
atgaaatttaggccagtaaaaactgacaataaccagctaaaagtcgctagttcgccttttacacacaatcaaaaaagtaccagccagctcatgctgtgggtagttttagccgccgtacccggtattgcggtacaaacctatctatttggctatggaaccctattccagatcttgctggcagttattaccgccttactcgctgagtctgtagccattgccatgaaaaaacaggtgatagctccattcctcaaagacaactcagcgctagtgacaggattgctattaggaatcagcctgccccctttagcaccgtggtggctgatcgtacttggcacattctttgcgattatcatcgccaaacacctgtatggtgggcttggacaaaacccatttaaccctgccatggtgggttatgtcgttttgcttatctcatttcctgtacagatgacaagctggctgccaccagtgtccttccaggcactcacgttgaccccttgggattgcctgatggtgatctttacagggcatacgcttgatggttctactttgcttcacctacaacaaggtattgatgggctcagtcaagccacgcctctggacagctttaaaaccggcagattgacccataatattgatgaggtattacagcaaccaatattacaaggtactttggtcggtattggctggcagtgggtcaatgtcgcttacctgattggggggctgattatgctgaatagaaaagttattagctggcagatcccaaccgcatttattttagcgctgtgcacctgtgctttgctcagttggctcatcgacccaaccagctattcaccacctttactccagattttttccggtgcaactatgctgggcgcattttttatcgcaaccgatccggttagtgcatcaaccacagcaaaaggacggctaatttacggtgcgattattggcgtgttgatttggattatccgtgtatatggtggttatccagatgccatagcatttgccgtcttattggcaaatatctgcgtgccactgatcgaccattacactcaacctcgtgcttatggccataaataa

SEQ ID NO: 4310 - DNA, 2244 bp, Xenorhabdus bovienii
  Coding DNA location: Contig name=SeqID_16895; Position on contig =138207..140450bp; Strand=-
atgtttaatctgttcaacttgcttaacaaaaataaaatctgggactttgagggtggtatccatccaccagaaatgaaactgcaatccagccgtaccccattacgccacgcgccactaccggatgaattaattattcctctgcaacaacatttaggcccagaaggtgaattactggttaaagttggtgacaaggtactgaaaggccagcctttgacggttggtacaggccgtaccgtaccagtccatgcatctacgtcagggactatcacggcaattgaaccctgtgtcactactcacccttccggactgaaagaattatgtgtccgcctgtatccagatggtgaagataaatggtgtgaacgtattcaaaccacggattacacttccctcaataccagcactttattgcaacgcattcaacaagcaggtattgccggtctgggtggcgcgggcttccctaccgcgtcaaaactacaaggtagtcggcacgatctaaaaacgttgatcatcaatgcagcagagtgtgaaccgtacatcacagcagatgatcgtctgatgcaagaacatgccaacgaagttattgaaggtatacgcatcttgatgcacttactcaatccagagcgagtgttgattggtattgaagataataagactgaagcgattgatgcgctgaataccgctcttaatggtgacgactccatcgttgtacgtgttattcccacaaaatacccgtctggtggtgcaaagcaacttaccaagatcctgacaggcaaagaagtaccatctggtgggcgttcctccgatattggtgttctcatgcagaatgtcggcacagtcatggccatcaaacgagctattatcgatggagagccgttaatcgaacgtatcgtgactctgactggagaagccgttactgcacccggaaatttctgggcgcgtctgggtactcccgttcaattcctgctgcaacaagcaggattcaaagccaagccagaacagatggttattatgggagggccattaatgggttttaccctgccagatttaaacgtacctgtcgtcaaaatcagtaactgcattcttgccccttccattcaagaaatggaaccgaaaacggttgaagaggcctgtatccgctgtggcttatgtgttgaagcttgcccggcgggtctattacctcagcagctttactggttcagtcgcggccaggaacataaaaaagccaaaaatcatcatctgttcgactgtattgaatgtggtgcctgcgcttacgtgtgtccaagcaatattcctttggttcaatactaccgtcaggaaaaagcagaaatacgcgccatagatgcagaaacacgccgttcggccgaagccaaaatccgctttgaagccaaacaaacgcgtatggaacaagaaaaactggctcgcgaggaacgccataaaaaatcggctgttcaagtggatagcaaagatcaaagcgctatacaggcggcccttagccgagtgaaagaaaaacagaagaatgctggtgaagctatcaatgttcaagctgggcaattacctgataatgaagcagccattgcagcacgtaaagccagaaaagagcaattgcgtattcgtcaggaagagaaaccagcagcaataaccgtcaatacagaacccgccacaccaactgaaagcgatgatcctcgcaaagctgcacttgcagccgcaatagccagagcaaaagcgaaaaaggcgactcaaagtgaaaaggtgacaacgtcacaaaaagattcaccaaataacgcggatgataaacaagatccacgtaaggcagccgtctctgcggccatcgctagggctaaagctaaaaaagccacgcaaaatcagtctgaacctacgccacaacaagaagatattaccgctgtaccggaagaagctgatccacgcaaagctgctgtcgctgcggctatcgcacgtgctaaagctaaaaaagccacgcaaagtcagtccaaacctacgccacagcaagaagatgttactgctgtatcggaagagactgatccactcaaagctgccgttgctgcggccatcgcccgtgctaaagctaaaaaagccgcgcaaaatcagtccaaacctacgctacagcaagaagatgttaccgctgtaccggaagaggctgatccacgcaaagctgctgtcgctgcggctatcgcacgcgtgaaagccaaaaaagcagcgcttgaaaaacaaaaaagcagcgcttga

SEQ ID NO: 4311 - DNA, 618 bp, Xenorhabdus bovienii
  Coding DNA location: Contig name=SeqID_16895; Position on contig =140443..141060bp; Strand=-
atgatgtcattatggattgctatcggtgtgttgagcctgctggggttagcctttggcttaattctaggttttgctgcccgtcgttttaaagtagaagaagatcctattgttgagaaaatcgataacctgttgcctcagagtcaatgtgggcaatgtagctacccgggctgtcgcccatatgcagaagcaattgccaataatggagagatgataaacaaatgtgctccaggcggagagcaggtaatgctcaagatgtcagaactgctgggtgttgaccctcagccgctggatggcgatgacagtgtacagaatccggcaagaaaggtggctttcattgatgaggagaactgcataggctgcaccaaatgcattcaagcatgtccggtcgatgccattattggcgcaaaccgtgcaatacacactgtagttgaagatctctgtactggctgtgatctgtgtgtcgcaccttgtccaacagattgcatcacaatgatccctgtcgctactactacatcaaactggaaatgggatttgaattccattccggtcagaaatattccgattaatccaatctttgtttctcctactaagcctgttgaggttaaagctaatgtttaa

SEQ ID NO: 4312 - DNA, 657 bp, Xenorhabdus bovienii
  Coding DNA location: Contig name=SeqID_16895; Position on contig =141060..141716bp; Strand=-
atggggcaatctctgtcattttcattgactataaacagtactttactttcaaatatattattttcaggtatagcaatgactgaataccttcttttgtttattggcacagtgttagttaataattttgttttagtaaaatttttgggcttatgtccttttatgggcgtttccaaaaaactcgaaacagccattggcatggggctggcaacaacatttgttctgaccctcgcctccatcagttcatggctgataaacacctttattcttgtaccattggatttagtttatttacgcacactgagttttatcctcgttatcgccgttgtcgtccaattcaccgagttggtcgtccgaaaaaccagcccgacgctctatcggttactggggatttttctgccattgatcacaactaactgcgcagttctcggtgtcgcgttgctgaacgtcaatcaatcacataactttctgcaatcagccatatatggtttcagcgccgcagtcggtttttcccttgtgatggtactgttcgccgccattcgtgaacgtctggcagttgccaacattcctgccccttttcgtggttcatcgatagggcttattactgcagggctgatgtcccttgcatttatgggctttagtggtttggtgaaattctaa

SEQ ID NO: 4313 - DNA, 441 bp, Xenorhabdus bovienii
  Coding DNA location: Contig name=SeqID_16895; Position on contig =141766..142206bp; Strand=-
atgtatcaatccaatgattattaccgtattaacggctggttattggctcccgccgcctatctgattatgacacttattgcggccagtttaatgctgttgctatatttaataacgctcatctacagaaacgaagctgtccaccaagtagacggaaactttaccactatgtggtatatatcattattaaccacggcaatgatgtggtgttttactctctgggtattaaagttgctttttattcgttcaaaacgattcccgcgtatctttattatctggctcatggtctctgttctaattgccataaaaaccttcgccttttcccccatttctgacgagatggctattcgttcgctgttatggccgctattagctgccgctgttttcgttccttatatcaagcgttcccatcgggtgaaaatgactttcacacaagatcgataa

SEQ ID NO: 4314 - DNA, 1047 bp, Xenorhabdus bovienii
  Coding DNA location: Contig name=SeqID_16895; Position on contig =142357..143403bp; Strand=+
atgagtgattttttaaaggttggcctagtagggtatggttatgcaagtaaaacgttccatgcgccattaattgcaggtacatctaatgttgaattagttgcgatttctagcagtgatacagaaaaagtcagaaaagattggccgactgttactgtagtttcctcgccggaagcattattcagtgatccagatattgacctgattgtgatcccaacgcccaatgatactcattatccattggcacagaaagctctggcggccggtaaacatgtcgtagttgataaacctttcaccattacagtggaagaagctgaagcacttaaaaagcaggcggaagaggctaacttgttgctgtctgtcttccataatcgccgttgggatgccgggtttttaacagttaagtcattgattcaagaaaatcgattgggaaaattgaaatattatgaatcccactttgaccgttaccgtccggtggttcgtcagcgctggcgggaagctgcgggagctggtggaggaatttggtacgatttggggcctcatttattggatcaggcggttcaactctttggtaagccacatgctatcaccgtggatttaggtatgattcgcccaaatgccgaggcggtggactattttcatactcagttgaattatccagatttgaaagttgtattgcatgcaacaacggtcgcagcggcagagtctccgatttatatactgcatggtatggaaggtagttatgtgaagtatggcttggatacacaagaagagcgtttgaaagcaggggaaagaccaccacggactgattggggatacgatgtacgtgatggaagcgtgacgttgtcacaaggagacgatttgataacgcaaattattccgaccttaccgggcaattatgggacatattatgcggctatccgtgatgctattgtggctggaaaacccaaccctgtgactgcaaacgaggctattttgatcatgaaactgattgaatccggtgaaaaatcagcaaaagagcaacgcacgatccttatcgactgggaatga

SEQ ID NO: 4315 - DNA, 984 bp, Xenorhabdus bovienii
  Coding DNA location: Contig name=SeqID_16895; Position on contig =143426..144409bp; Strand=+
atgagctggtggcagaaattaagaatcgacccttttctggtaacactaattacagtagtgatcatagcaacgcttttcccctgtgaaggagaatcgaaaaagtggtttcaatatttgacgacagcggctattgcacttctgtttttcatgcatggagccaagctgtcccgtagtgcgattttagcgggaattgggcactggcggctgcatctggtgattttcctgagtacctttgttttgttcccgatattgggaatgggactgtattttattgtacctgaatggctgtcgccaacggtctatatgggatttctttatctttgtgctttgcctgctaccgtgcaatctgctatcgcctttacttccgtagcaaagggcaatgtcgcagcagccatatgcagtgcttcggcttccagtttgttgggtgtgtttatttctccattattggtcggcttgttgattcagactaatgatggtggtggtcatactgatacgtggaaagcgataaaagatattatcctgcaactaatggtgccatttattgccgggcacctaccgcggccactgattgccagttgggtggaaaaacataaaaaattggtcaacacgactgaccgatcttctattttgctggtggtgtatgttgcattcagtgaggcggtggtggagggtatctggcataaaattgatgcttactcgcttatgatgattggcgttgtgtgctgtattttattggttatggtattgatgatcaatgtatacagctcgcgtttgtttgggttcagtaaagaagatgaaattactattgtcttctgtggctccaaaaaaagcctcgccaatggtgtaccgatggctaatgtattgtttccggcttcaatggtaggtgtgatgctgctaccgttgatgatttttcatcagattcaactgatggtttgtgcagtacttgcccagcgttatgcaaggcgtccaaaaaaggcagattaa

SEQ ID NO: 4316 - DNA, 1002 bp, Xenorhabdus bovienii
  Coding DNA location: Contig name=SeqID_16895; Position on contig =144449..145450bp; Strand=-
atgattgatatacggcttcccctgaccgatttacaccgtcaccttgacggcaacattcgtcctgaaaccattctggaactcgcccgtcagcataatatcccgttaccagcttatgagctggaagcattgcgtcctcatgtccagatcactgaaaacgaacctaatcttatcagtttcctgcaaaaactggattggggagtagcggtactggcagatttagatgcctgccgccgtgttgccattgaaaacgttgaagatgcggtcaatgctgagcttgattatgcagaactgcgtttctcaccttactacatggcgatgaaacatcagctccctgttgaaggtgtggttgaagcggtaattgatggtattcattctgccagtcagcaacttgatgttcagatacgtttgattggcattctaagcagaacgtttggcgaaaaggcctgttctcaggaactcgcgagccttctcgttcataaacaacacattacagcgctggatttggcaggtgatgagcttggcttccctggtcatctgtttgagcagcattttatccaagcacgtgatgcaggttggaacattagtgtacatgctggagaagccgctggtgcagaaagtatttggcacgctattcgtgatttaggagcaacccggatcggccacggtgtgaaggcaattaccgatcccgcattgatggattacctagcaaaacacggcatcggtattgaatcttgtctgacatcgaacctgcaaaccagtacagtaaattccctgtcagcccatccgctgaaacaattccttgcgcatggcattctggcatcaatcaatacagatgacccagcagttgaagggatagaaattcgccacgaatataacgttgctgcgcctgcggctgggttatcacccgaacaaatccgacaagcacagattaatggattgaaaactgcattcctcagtgaaacagaaaaacaagcgctgaaagccaaggctgcaaatcgctag

SEQ ID NO: 4317 - DNA, 1452 bp, Xenorhabdus bovienii
  Coding DNA location: Contig name=SeqID_16895; Position on contig =145664..147115bp; Strand=-
atgaaaaaatcgttagtagctgtaggtgttattgttgcgttaggtgcagcatggataggcgcatcatggtatacagggaaacaaattgaaggccgcctgaataacatcattaagactgtaaacactcaacttgcaaaatcatttcctgaaagtgctattgaatggcaaacgaaagactttcaacgtggtgttttcagttctgatgtccgcttgatcctcaaaatcaaagatggcgtgaaaaatacggacatcaaaccaaatgaagaaattatcttcaaatccagtatagggcatggcccgttacccatttctgacctgaaaaaacttcatctggttccgaaaatggcatctatccattcagagctagaacagagcgaagcaacaaaagccttatttgaagctaccaaaggtaaatccctgctcaccatggaaaccaaaataggttatagcagtagcctttctactgatattgactttattcctgttgattacacagcgaaaaatggcaataaactagttttttcaggtgcaaaaatcgatgctgaaattgcccgtgatttaagtaatttcaaatttgatgtgaaaagcgataggctgattttcagctctccttccaaacacgaagagctgactcttaaaggcattggctttaagggagacaacaagaaaggtaaattcgacctgtatcttggcgatcaaaattataatattgatgaaatcaccttgagttcaacgagtgatgacagcttctctctcaagggaatgaaaataacttctaaggtaggagaaactgacaagaacctgaatctgaatgtctcttatggcattgatggcctcaaactcaagaacatggatcttggctcaggtcaattggttatcggtatgagtaatctggatggtcaatcagtccgtaaatttagtcaagcttataacgatgccacggcaaaagtactgacttcagaggctctatctaccgattcagtgtctaataaagttatcgaaaacgcacatctgctgtttaataatagtccgcaattcagccttgagccgataaaatggaaaaacagtaaaggcgaaagctcggtaaacttcaaactcgcattgaaaaacataccagaaaataaagactcgctgatcctcatgggaccggaagaaatgatccgtaccctccttcaagaactatctttggatgttaagatccccaaacctatgttgatagaatctatcactcaagccaaaatacttgatggaaaaacaaaagaggccgcagaagccgaggctactcaagaagtacagatgatagccagccaaggtgtttcgtttaagatcctcaccgatgagaataacgtgatcggccttaaactccactatgccaatgataaagttgaattgaataacaaaaaatccgacttgcatcaattcttgcttgataatcacttaatcggctcctaa

SEQ ID NO: 4318 - DNA, 1179 bp, Xenorhabdus bovienii
  Coding DNA location: Contig name=SeqID_16895; Position on contig =147288..148466bp; Strand=-
atgctgaaaatgaccaaccagatccaacattatgactggggaagtaaaaccgccctgacggacatctacggtattaagaatccaaataatcagccaatggcagaactatggatgggtgcacatccgaaatgcagttctcaggtcacggatcccaaaacaggtgagaccatagcgttgaatgcactgatagcccaagagccagaaaaatatctgggggaaaaagtggttgaacaattccagcggttaccgttcttgttcaaggtattatgcgcagcccagccactttccattcaagtacatccggacaaatcatcggcagaaacaggatttgacagagaaaatgcagctggtattcctttaaattcactccagcgcaactacaaagatgataatcataagcctgaattggtgtatgctctgactccgtttaaggcaatgaatgcctttcggcctttatcagacattgctcaattacttggccctgtttctgccgcacatcccgatattcaggcatttatccagaacccgactgaatcgcatctatcgtttctcttttcccagttgctgactatgcaaggcgaacaaaaacgtttggcgatcgccgtcttgaaatcagtgctgaacaatcgagagggagaaccttgggatactatcagaaaagtggctggcttctatcccgatgataatggtttatttacccccctgctgcttaatatagttgaattgaaaccaggccaggctatgtttctctatgcccgtacacctcacgcttatctcgaaggtgtggccttagaagtcatggccaattcagacaatgttctgcgtgccggcttaaccagcaaacatattgatgttgccgagttgatggctaatctggattttgtttccaaacccgccgatactttactgactctcccaaaacaggaaaaagatgctctgaattaccctgttcctgtcaatgatttttacttttctgtttatgatgtttcagaacagccaataacactgaaaaatgattctgcttcggttctattttgctttgaaggtcaaataattatcagttcggatgaacagcaacagcaattgagattattctcaggtgaatcagttttcttatctgctatagaaaaaaacttgactgttcatggtaatgggaaaattgctaaagtatctaattaa

SEQ ID NO: 4319 - DNA, 1464 bp, Xenorhabdus bovienii
  Coding DNA location: Contig name=SeqID_16895; Position on contig =148572..150035bp; Strand=+
atgccgactaatttatctgcaaattttgatccggcgtattcaattattctgtgtgctaaggagatagtaatggcagccactcgcattgaaaaagactcaatgggacctattgaagtacctgctgaccaattatggggagcgcaaactcagcgctcactggagcatttccgcatttctcaggaaaaaatgcctgttgcgctgattcatgctcttgcattgactaaacaggctgcggccagtgtcaatatggatctgggccttttgcctaaagaacgtagtgatgcaattattgctgcggcgaaagaggtattggaaggcaaacacccaacagagttccctcttgctatctggcagactggttcgggaactcaaagcaacatgaatatgaatgaagtgttggcgaaccgtggtagtgagatccttggcggtcagaggggtaatgaacgtctgattcatcccaatgatgatgttaacaaaagccaaagttccaatgacgtttttccaacagccatgcatgttgcagcagttattggattgagtgagcagctattgcctgagttgaaagcattacaaaaaaccctggcagataaagcggtagcatttaaagatatcgtaaaaattggtcgtactcacctgcaagatgcgactcctctgactctgggtcaggagatttctggttgggcggcgatgctgactcataacctgaaacatattgaagatagcattcctcacgtatgtgaattggcattgggcggtacagcggtaggaactggcctgaatacgcaccctgaatatgctgttcgcgttgcgaagaaaatcgctgaattatctggccaacctttcgttacttccccaaataaatttgaagcactggcaacttgtgatgcattagttcattcacatggatcattaaaaggtctggctgcatctctgatgaaaattgctaatgatgttcgctggttagcttctggtcctcgttgtggtattggtgaaatttccattcctgaaaatgagccaggtagctcaattatgccgggtaaagtgaatccgactcagtgcgaagccatgacgatgttgtgtgcacaagtgatgggtaacgatgtggcaattaatattggcggagcatctggtaactttgagctgaacgtattccgtccgatggtgatcgataacttcctgcaatcaattcgcttgttagcggatggtatgcgtagtttcaatgagcattgtgctgttggtattgaacctaaccgtgatcgtattactcaattgctgaacgaatctctgatgctggtaacggctttgaatacccatattggttatgataaggccgcagagattgctaaaaaagcacataaagatggtctgacgctgaagcagtcagcgatgcaactgggctatttgaccgatgctgaatttgacgcatgggttcgtccagaagatatggttggtagcatgaaataa

SEQ ID NO: 4320 - DNA, 963 bp, Xenorhabdus bovienii
  Coding DNA location: Contig name=SeqID_16895; Position on contig =150108..151070bp; Strand=-
atgaaaaagccacatcatttatcgctgagagtccttatgaataaatacttttcaatagaatcacttacgtccagcttcaaaaaacaggaagaaaaattggctgaactagttggattattgatggactacccgctcattgatgcgcgggtgtttgaattgcctcaaattgaaaaaggcgaagaacatgagcagattactgaaattgcagtcaacccattacagggaaatgacgctctcaacttagggctacatttctaccaaaagctattcatacaccataaccaccccaatatcagcagcaaagctgcaagtcggttacctggtgcgttatgttttgctgttagccaccagcaatataaaacagcgatgaacgttatcaatgaagttaaccagcttaaggccgaactggaaaatatcgtaaccaaagagtcaggcgtcagcaaagaacaaagatttgaatttgtccatgatcatctacgcggtttaattaccttgaatgcctaccgcactattactcccctcatgaatccagactctatcaattttggttgggcgaataaaaacatcattaataaagtcaccaaacaacaagttcttgaacagttggaaaaaagttataattctggacgagcggttcctccctactctagcgatcaatgggctgcattggttgcattagaaatcacggatattaagaaattacctgatgatgcgatattgaaaatcaaaaggcctgtcaaagttcagcccattacccgagtttggtattcagaactgcaaaaacaggtgcaatatgcctgtccattgccaattattgttttttatacagacgattgcgaaataaaaccgaagataggtacattatcaaattataatgccaatgccatcaagcaccgatataaacccaaagccaaaccacttgaattagttatcccacgcttacatctttatcgggaaatataa

SEQ ID NO: 4321 - DNA, 633 bp, Xenorhabdus bovienii
  Coding DNA location: Contig name=SeqID_16895; Position on contig =151329..151961bp; Strand=+
atgaaaaaattagtcaagccagtgaattcctttgaaaaggtggttgatacgttattaccgtattctgaattaattgcttctgatttaccgacacaaggtaaattgcttaaagttgaaaatgaatttgctaaattttttttattgcagcaggggtatgtaaatatacgaagagtagatgacagtttaatcattgcaacggttttttcaccttatattatagggttatctttctactctggctctgatgtctattattccattgaacttggccctcattgcagactatatcaactccctcgtattaatgctttgaatgctataaaaaaacatgatctttatagagaatggatgaggataatttcatacaagatggcttttttatatgcaagagatgtcagtatttttcgtcctggagccaaagaagttgtgtgcagtctattatcccgacttataactctacctgctgaatttcatgaaaacacatctgttatcaaatatatagaacaaagatgtacgctttcacgcagttgtatacaacgtgtattatcgtcgttgaaaagagaaaattatattgagatgattgatgggcatttagtaaaaattaattcattgccgattcattcttattattaa

SEQ ID NO: 4322 - DNA, 1281 bp, Xenorhabdus bovienii
  Coding DNA location: Contig name=SeqID_16895; Position on contig =152058..153338bp; Strand=-
gtgaatacagccccaagcgtcggtgaagaatcagcagttcctgacgttgaaagtgatgttgaaagtgatgttgaaatcaatcgacggcatgaaaatgaacagcgctatattcaacgagatgatgccgtatatcttcgtgttaccctatctttctttgccgtaggattagcaacttttgcgttactttactttgttcagcctatattgcccatcttatcagaggaatttaatgtctccccagcaagcagcagcttggcactatctctatccaccggtatgttatctcttggcttattgataacaggtcctttatcagatgctcttggccgtaaaaatgtcatggtagtatcactggctgctgctgccatttttacactcttgagtacagtagtgacgagctggaacgggcttttggttgtccgcgcactgattggggtgtcattaagtggtgttgccgctgttgcaatgacctatttaagcgaagaaatccatcccagttatgttgcgttgtctatcgggctttacgtcagtggaaattcattgggaggaatgagtgggcgtttgattacaggtgtgattgcggatcattttccttggcggtttgctgtcattttactgggttcatttgcactaattgcagctatcgcattttggaaaatgttaccaccctctaaaaattttagagcaagttcattaaaacccaataccttgtttatcaacctgaaactgcattttcgtgaccaaggcctacctttattgtttgctgaagccttcttattaatgggctgctttgtcactatgtttaactatattggttatcggctattgggtgcaccttaccatttcaaccaaactattattggattattgtcgatagtctacttaaccggaacttacagtgcgacaaaagccggtgctttgacaaataaacatgggcgtggaaaggtgctgctggttgcgatcagcatgatgttgattggcggtttcattacaatatgttcttccatctgggcaattatgcttggcatgatggtactaactacgggatttttcgctgctcattcggttgctagtggatgggtcggatggcgagctaaacgagccaaagcgcaagcctcatccctttatttattctgctattacgcaggctctagcgttgctggaacattaggtggcatattttggctgcattttcaatggaatggtgtagtcatatttatgtcattattaacaatcatcgcactgtatttaggtttaaaactcaacaaatctgaagaatga

SEQ ID NO: 4323 - DNA, 918 bp, Xenorhabdus bovienii
  Coding DNA location: Contig name=SeqID_16895; Position on contig =153471..154388bp; Strand=+
atgagtataaacattgaattaaggcacttacgttactttattgcggttgcggaggaattgcatttcgggcgtgcagcggaacgattgaacatctcacaaccgccattaagccaacaaattcaggctcttgaaacaagcatcaaggcacagttactggcgcgtaataaccgcaatgtcagtcttactcccgctggaaatatgtttcttaaggaggcataccagatactcgcccaagtagatgcagcggcaactaaagccgccagaatgcagcagggtgaactgggagagatatccatcggttttacatccaccacacctttcatgcgtaaggtcactctcagtttacgtcaattccgtgaacgttatcctgacgtggccattcatatgcatcaaatgaacaccaagcagcaaatagcacctttgcagacaggtagaattgatatcggggtcatgcgtaatacgttattgcctgataacttagagcatcgattacttttccgcgaacgctttatgctcgcggtatatgatgggcatcccctgctgaattatgctaacgaaggtatcagcttagaaatgttatctggctatccactcgtattttttgagcgtgatgtaggaacagccttgtatgatgaaattatctctctgctggctaatgcaggagtcacccctatgatttcacaggaagcgggggaagcgatgacaatacttggattagtcgctgcggggttagggatcagtataataacggaatcatttacccggatgaaaatcgacggtgttcaatatctccatttagcaaatgctcctgcctgctccgaagtctggttggtcaatcacaagaatcgacagaatagcgcggcagtagaccgattaaccaatctcttaatttcaaatattgttgatgaaagttgttaa

SEQ ID NO: 4324 - DNA, 1221 bp, Xenorhabdus bovienii
  Coding DNA location: Contig name=SeqID_16895; Position on contig =154520..155740bp; Strand=+
gtgagtgtcgatattcagccaagtcacgttgaccagataaaacagaccaatatcggtctggtttatcggttaattgatcaatatggtccaatctcacgtatcgcactttctaaaaaatctcaactggctcccgcaagtattacaaagattacacgggaactgattgatgctcacctggtgaaagaagccgaatttcccgatctgagttttcgagggcgtcccgctgtagggttgaaaatcgatagtaaagggtggcaattcctatgcatacgcattaacaaagaaagtgttgtctttggtcttcgtgatttaagtaataacttgagggttgaagaagagctaccgttctcattttcccttaatcaatcttttctggattgtatcgttgatgaaattgatgatttcttctttcggcatcaatcttgtcttgaacgcctgacggccattagtattaccaccaatgcgattatcgatcccaacaatgggattattcacagttcgccgtattatgatattcaagatatcccacttggcacatttttgcatcagcgtactgggttaccgacgtttctgcaacacagcatcacagcatggacaatcgcggaatctttatatggcgcgggggaaaactgtcagaacattatccagatcgtcattgacgataatgtaggagcaggggttatgacagcgggacagatgcttcatgccggaaaccatagcgttgtggaaataggacatactcaagtcgatcctgatggtgaacattgttattgtggtaatacaggttgtctggaaaccgttgtcggaataaaaaacatcttggtgaaagctcatcgcctggcagaaagccatcctgactcgttactttattcaatatcaccactgacaattgattcactttgtcaggctgcgaatcaaggcgatcttctggcaacaaacatcatccatgatgtcggagaacgaatcgggcgcatcatggcaattatggttaatatatttaacccagagaaaatcttgatcggttccccactgaacggcgcacagaacattctctatcctgccattcaacagcagatagcccaactgtctctccctggctatagccaacaggttaacattgttgccacccgatttgacaataccgggacactgccagcggcatcattgattaaacaatccctatatagtggtgagttgctgatcgaactcatgcaaggatag

SEQ ID NO: 4325 - DNA, 669 bp, Xenorhabdus bovienii
  Coding DNA location: Contig name=SeqID_16895; Position on contig =155860..156528bp; Strand=+
atgttaacgcgcttatttgttacaggcacggataccaacatcggtaaaacagttgttacccgtgcattactgcaagtctttaatcgtgaaggaacaaccgcagtgggatataaacccatcgcgacagagaaacgagaaacaccggagggaatacgtaatcatgatgccttagtcatacataaatcttcaccggttcaagtcacttatgaagaaattaaccctattatttgggaaagcaattatgaagaagggaaccagattaactttgttcaaatgacaaaaagcctgaaaaatttaagccaaaaagccgatcgtgtgattatcgaaggtaatggtggctggcgtatcttgctacaagatgactcattctactcagactgggtggtgcaagaaaagctgcctgttattttagtggtagggattcaggcgggatgcgtcagtcatgccatcctgaccgctcaatccattatcaatgatggtgtaccactgattggctgggtagctaaccgcattaaccctgggctggcgcactatgccaaaacgctggataggttacggtatcatataccggcaccacaacttggcgaaattccttatcttttaaggcccgaagaaagagatttatcttgctatttggatatttcagcaatatccaagtttgataactaa

SEQ ID NO: 4326 - DNA, 300 bp, Xenorhabdus bovienii
  Coding DNA location: Contig name=SeqID_16895; Position on contig =156581..156880bp; Strand=-
atggtgaaaaagatcctactgactggtgccttgttttttgcgcttgctccctttgcagtacaagcctcacaaaagacaacatgtgaaagcctgaaagaaataatttctcaaaagatcattgataatcatgtctctaaagaagatttcaggcttgaagttgtccctaatgatcaagttgtagaaggcactgggaaagttgtcggtagctgtgattatggaaaacagaaaattgtctatatccgtctttcccacactacaggttctcacgctactagcgatgcaaaagaagctcaaaaatga

SEQ ID NO: 4327 - DNA, 420 bp, Xenorhabdus bovienii
  Coding DNA location: Contig name=SeqID_16895; Position on contig =156799..157218bp; Strand=+
atgttgtcttttgtgaggcttgtactgcaaagggagcaagcgcaaaaaacaaggcaccagtcagtaggatctttttcaccatcatctccttatttattgatgtcgatgtttggtctatcagggtttgatcggaagacctgtattgagatccagacaacgttttgtattgggttcccaataagcattcacgttggtgcttttcaaacaggcatctcgattatcaacgtccacctcatacttatcaaactgtttttcttcacgtttgttaatttttttgcgaaggcttccctgttcattccattcttctttttgttgacgagccatttctttgctcatcgaattctcaccacccccattgatggttacgcaagtactactcgatgtacaaggcgcagaaaatgctggagtttgccacaataa

SEQ ID NO: 4328 - DNA, 750 bp, Xenorhabdus bovienii
  Coding DNA location: Contig name=SeqID_16895; Position on contig =157401..158150bp; Strand=-
atgattgtttttgttacaggggtaacttccggttttggtgaagccattgcacggaaattcattaaacacggttccgtagtcattgctacagggcgcaggaaggaacgattggacaggttaaaagccgaattaggcgaaaacttccaccccattcaacttgatgtgagagatcgtaatgcaatagagaaagttgtacaggaactgcctgatgcacttcgaaatgttgatgtgttagttaataatgctgggttagcattagggctagaacctgctcatcaagcaaacccagatgattgggaaacaatgattgataccaatacgaaagggttggtgaacatgacacgcgccctgctgcctaagatggtacaaatcaatcatgggcacgttatcaatattggttccacggcagcaaactggccatatgccggcggtaatgtatacggtgcgactaaagcatttgttaagcagttcagcttaggattacgggctgatttacaaggcaagaatattagagtgacagatattgaacctgggcttgttggcggaacagagttttctcaagtacgctttaaaggtaatgatgaaaaagtcaacaaaacttacgacggtgctgaggctctcactcctgatgatatcgcagaggccgtgttttgggttgcgactctgccttctcgcgtcaatatcaatacattggaaatgatgccagtttgccagtcatttgcaggcttaagtgtgcatagaaatccgtaa

SEQ ID NO: 4329 - DNA, 168 bp, Xenorhabdus bovienii
  Coding DNA location: Contig name=SeqID_16895; Position on contig =158225..158392bp; Strand=+
atgaattctttatccactattaacattgtgttttttaagtgttattttttactcattaatataagtgtcagattaacaatgacaaaaatcctgaaactctgcaactatagaggaatccctatcatgtcattgaaactaccgccagttagttgttacccgttttattga

SEQ ID NO: 4330 - DNA, 732 bp, Xenorhabdus bovienii
  Coding DNA location: Contig name=SeqID_16895; Position on contig =158990..159721bp; Strand=+
atgttccgctggtcagaaggagatgatgtcagtttatggcggcaaaattctaactatgtcaatgggaatgcgctggacaatgaagaaagggtggttagttgcgagcatggtaggcgggggatttctcggacagaaaaagatggcagcgtcatcatgctggttgacaaaatagatggcaaaagattcaattctcccaatgatgtcgttgtgcgttctgacggaacgatttggtttaccgatcctccttatggaattattagtgatgaggaggggtataaatcagaaagccagattattggatgctatgtatattgttacgatccaaatgataacaaaatctccatcgcaaccagtgatgttcagcgcccaaatgggctggcattttctccagatgaaaaatggttatacgttgcagacatgtctattgctgatttccctttgcatggaagacatgagcttcgtatctatccagtacaaggtaaaaccttaggagcaggcaaacattttgttactgtatctcctggatttccagatggcttttgtgttgataaattcggcaatatctattgcagttgtttagatggaattttaatttttaataaatttggcaagaaaatacataaaattgcagtgcctgaacgaacatccaattgtacttttggcggcattaatggtgaccagttgtatattacggcaacaacatcattatatcgagcctcgtttcgttggtaa

SEQ ID NO: 4331 - DNA, 528 bp, Xenorhabdus bovienii
  Coding DNA location: Contig name=SeqID_16895; Position on contig =159981..160508bp; Strand=+
atgtcaagagtaattactattgagccatataattcacattgggtgaatgcatataatgatgaaatggttaagcttaaagatgattttccggaggagatattatttgtgcatcatattggaagtacctcagtacttgggctagcagccaagccaattattgacattttattggaaataaaaaatatgggtaaattcgatgagaatcatagtgtgattgaaagtcttggatacaccgcgcgcggagagtatggcatacccggtaggcgctattttattaaaggcggggataaccgtacacatcatatccatgcttttgaaaccggttgttttcatatcactcgacatttagtgttcagagattaccttcgtagacacaatgatattgctcatcaatatgcagaaattaagtatcaggctgcaagagcatgtgggaatagctcagaaatctattgtcagctaaaaaacgaattcattctcttacatgaaaagctggctttaaaggaactatcccccaatgagaatcaatga

SEQ ID NO: 4332 - DNA, 228 bp, Xenorhabdus bovienii
  Coding DNA location: Contig name=SeqID_16895; Position on contig =160502..160729bp; Strand=-
gtgcgaaccaatgttgtatggatgattacaaccgctgttttgccaaagttcctcgacatggttttgatgttaattgaagatagtgaaatcagtcgtaaagcaatcggaaaatacattgatgtttggcactatcctgatggtcgaaaagaactccgattaaacagtgttattcttccctactctaatatttggctgtggttcttaaggataatgtggcactttcattga

SEQ ID NO: 4333 - DNA, 873 bp, Xenorhabdus bovienii
  Coding DNA location: Contig name=SeqID_16895; Position on contig =160881..161753bp; Strand=-
atgaggaggaaactatctttattcatctgtggtatattccctatcgcagactttaacatttttttaggatttttcgtaatgccatggacattttcacatccagcagccgtttttcctttgaagagtcttccgggggggaggttgttaaatttgcctgcgctaattactggcagtttgtctcctgatttcttttactctgttgggttatatgatgttgcaacggttgcgcatcacttacccggatggttttataccgcatttcctttatgtctattgatatttttgattgtacgtctattgtcatatcctttatccgtccttttcccaatatcctttgcgcgttataaaaaaccagactataaggacagagttctttttgtgttgtcgttatttataggagctgtaacccatattggctgggatgcattcacacacgataaaggtttttttgtcgagctaattcctttactacagttccgcatttttcattccattaccaacgggcaggggataagtatatataaaattctacagcatctcagctcattgtcaggattattgtatctcgccatgaagtactggcggtatcagaaaaaattggatctcagtattcaaaaaacgaacaaaagaaaactttactatttgattgttattgggtttatttcagggtttttgacatgccctgtagcattgtttttatcctgggaggtatcggggataaatatgggcaggtttatttttaaggaactcactctatctgtaccagtattttttattattctggtacttattgcgttatggataaggtattactcttcgaagactaaacttgttcaatcaaaatctattgacattcaaatagacaacacatag

SEQ ID NO: 4334 - DNA, 915 bp, Xenorhabdus bovienii
  Coding DNA location: Contig name=SeqID_16895; Position on contig =161801..162715bp; Strand=+
atgcgtaaaaacgatcattttagcggaattgttgcctttgtggcgacagcacaattaggcagttttactgctgcagctgaacgacttggactgacgaaatctgcggttggaaaaagtctaaatcgccttgaagaacgattggggcttaagctttttcaacgttctacaagaagtttgagtttaacccctgaaggtgatgtttttctgcaaagttgccaaaatgcgatagcgattttagaacaagccgaagcggggatagcttctcatattacttcaccaataggtcgattacgtattgatctccctgctgcttttggacgccaacgcattcttcctatcttgttaaatatcactaaggaataccctgaactcacgttatcagtctcttttagcgagcgatttgttgatgtgattgaggacggtatcgatttagtgatccgtattggtgaattagcagatagtagtggtttggttgctagacgcctcacaactcaaaaattagtaatttgcgctgctccagactatttacaacgtcgaggaatacctacaagttctgatgagctaaaccaacaccattgtgttgtcggatttcggcgtcatcagcccttccattggtgtttaagaacaacgaatggtaacaacaaaaatatcacgcctccacctacatacgaattggcggatggtgatgcaatgcttactgcggtgttagcgggttgcggattggcacagttgccattatggatggtgaatcgatacctaaaaaatggtgaactaaaaactgttttacctgaatattcgggggttgaagtaccaattagcgccctctggccaaaaagccgtcaactgttgccgaagatacgttatgttgtcgatactcttgttgcagcagcagaaaacggtttattggatgaataa

SEQ ID NO: 4335 - DNA, 1179 bp, Xenorhabdus bovienii
  Coding DNA location: Contig name=SeqID_16895; Position on contig =162726..163904bp; Strand=-
atgacaaataaatcatttttcttattaatgactttaacgatttctgtttttggagttattacaacggaagtttctgttatagggttacttccgcaattagagcttcagttaaatacaactccaattcaagttggttatttggtgagtgtatatgcgattgtcgttgctattgccggacctgttattactttactattatttaaatataatagaaagtatgttttattatgcattctatttatattcattgtatcaaatattatttatgctacggaaaatatatttaatataatactgatttttcggatcttacctgcattaactcatgccctattttttgcagtagcgctggttatagcagcaaattcagtacctaaagagaagagtgctgatgcagtagcgactgtgttttccggggttgcacttgggatggtactaggaatgcctttaagttcttttattgctgaatatgtttcactcagtgcggccttttattttggttctgtgacatgtttaattgcatttataggtgttttttattttattccgtcattacctgttagccaaaaaatcaatatacttgaacaagtaactatattgaaaaaaccaaatttatggttaagcattgcaactgttactttgattttttcagctatgttttctagttttagctatatttctgattatcttaccaaaataacgcatctcagtaataatatgattgccatttttcttattttatttggtgctagtggttatatgggtaattttatctttagccgtctattacaaaaaaatacagttagaaccacttatgcttatacatttttatttattctggtctattgcttagtgtggatattgggtttttcaccttttgtaatggtgctattaattatattttggggtatctttcattcatcagggttaatcgtcagtcaaacatggttaatgcatgaagcaagtgaagcgcctgagtttgccaacagcctatatatcgctttttctaatttaggaataaccctaggcgcaatggctggtggatttgttatatcacactatggcgtacattcgattgtactgacgggaattctgtttttaatactttctttctttagtatttacataaaaaatcgcgcaacggtagccaaacagacctcagataaaacgattatttaa

SEQ ID NO: 4336 - DNA, 141 bp, Xenorhabdus bovienii
  Coding DNA location: Contig name=SeqID_16895; Position on contig =163990..164130bp; Strand=+
atgtcttatgcagtaagagagttcgcagatgatgacaaaattgatttcaaaagagaagcctatttttgtctactgtttgtagaaaaaaagttgtcagttagcccagttatcgttccgatattcgggctaactttcatttga

SEQ ID NO: 4337 - DNA, 96 bp, Xenorhabdus bovienii
  Coding DNA location: Contig name=SeqID_16895; Position on contig =164143..164238bp; Strand=-
atgattcgtctggctctcgggtcgatagaactgacacctctgcggacagagttggaaaaagtgagatacattgttgaaatgtactcgtgtttgtag

SEQ ID NO: 4338 - DNA, 255 bp, Xenorhabdus bovienii
  Coding DNA location: Contig name=SeqID_16895; Position on contig =164239..164493bp; Strand=+
atgaggtacgagcacagactgacgaagagtacagcgagtgggtggtttaacggttttattggtgtattaatcttcagcggttcattaccggcaacaaaagtagcagtcatggattttgaacccttttttctgactgtagcccgtgcttctattgctggtttgttagcattcgttatgctattagcctttaaagagaaacgctctggtttacttggtgaacctgtaagcctgatcatggttgcttgtaaccattga

SEQ ID NO: 4339 - DNA, 408 bp, Xenorhabdus bovienii
  Coding DNA location: Contig name=SeqID_16895; Position on contig =164582..164989bp; Strand=+
atgttttcaggcctcagtgcatttcccttgacccccacgaacgaaaatggcatcgacgaagcggctttcgtccggctaatcgaacgtttagttgttgctaatgtcgattccattggagccctcggttcgactggtaactatgcttatttcacacttgctgaacgtttacgagtcacacagctggcggtgcaacatgccgggaacactccggtgattattggaatcggcgctttgcgtacacgggatgtattggacttagccgaaggtgcacagacagcaggagcgagcgcagtgctgttggctccgatatcgtaccaaaggctatctgctgatgaagtatttggtctgtatgaaaccgtaacccgcaacctttccgtaccgctggcgtatatgacaacccaaatatga

SEQ ID NO: 4340 - DNA, 474 bp, Xenorhabdus bovienii
  Coding DNA location: Contig name=SeqID_16895; Position on contig =164986..165459bp; Strand=+
atgacacatttcgaattcagcgacgaattgcatggtaggatcgctcatcttccgaacgtttgctccatcaagattcccagtgttacggtagatcccgtagccgcaaaagcgcgtgtggggcgtcttcgtgctctgattccatcacacgtgacgatcgggatcagcggtgatggttttgccgcgacggggttaaatgccggatgtgaagtctggtactcggtaatcgacggtctctttcctaaggcggcattggcaatcacccgcgctgcacaggccggagacatacaggaagttacacgcctatccgaacggctgcaaccgctgtggacatttttcagacagtatggcggcagcctgcgtgttgtcgcgtcggcagccgtgctactggggctggttgaacaagactgtctacctctgccgctcaaggcactggaggcggctgatttgcaacagctcgctgaactgcttgattag

SEQ ID NO: 4341 - DNA, 459 bp, Xenorhabdus bovienii
  Coding DNA location: Contig name=SeqID_16895; Position on contig =165553..166011bp; Strand=-
atggaaataaccgtgttttgcccggaacatattgaggtactgagaattctttacttggaatcgagaaaggtcacttttacttggctgaatacggataactatcaacttactgattttgataaagatactgaaggtgaggtgatttatattgccgtagaaaacggtaaggttctaggttttatctctgtttgggcacagaatcattttatccatcatctttatgtttctaccgaatctcatcggtctggcataggcactcaactactggatttcgtcaaatccaaatatccacaccaattaagtttaaaatgtctagttaaaaaccataaagcggttaatttctacgaattcaacggttttatcaagaaagctaaaagctcagatgagctagcagggaattactatctcatggttttttctgatcaaattagaaaaaagaatcaaaacatccacagctaa

SEQ ID NO: 4342 - DNA, 420 bp, Xenorhabdus bovienii
  Coding DNA location: Contig name=SeqID_16895; Position on contig =166015..166434bp; Strand=-
atgaaaattcatgaactcatggaagtaattgaaaataaatatcctgctgctgaaagttgggtatttggtgactcaatcgaaatgtatgacaagctttctgcattagttgccgaaggcactaaaacagcaacgagttgttcatatcatgcttataaacaggttgatgaagatatcgaaattggcaatgagtatattgtcttaaatggtaaaaatcttccggtttgtgttgttagagtaactgctgttcatttaacccaattttcagcaatgacaaccgaactggcttggaaggaaggcgagggtgatagaagtctacatcgttggcggatggagcataagtgtttttttgagcgagaaggaacgttttctccagatatggaagttgttgttatcgagtttgaggtaattgaggtgctataa

SEQ ID NO: 4343 - DNA, 1332 bp, Xenorhabdus bovienii
  Coding DNA location: Contig name=SeqID_16895; Position on contig =166607..167938bp; Strand=-
atgtcagatatcaattcttttcaatcactgaacctgaatgcgcattggatgccgcttagtgccaatcgtcattttcaacaagatccacgtttaattgtctccgcagatggaaactggctggtcgataaccagggtcgtcgaatttacgacagtttgtcggggttatggacttgtggggcgggtcattcacgaaccgaaatccgtcaggctgtttctgaacaactgggaacattggattattcccctggtttccaatatggtcacccttggtcattcaaattggcagacaagattgctaatcttatgcctggtgatttaaaccatgtgttttttactggttctggttcggaaactgctgatacagcagtaaaaatggcacgtgcttactggcgcattaaagggaaatctgccaaaactaaatttatcggacgtgcacgtggctatcatggcgtcaatatcgccggtacaagtctcggcggtattggcggtaatcgtaagatgtttggtcagtttatggatgtggatcacttgtcacataccttgcaacccggcatggcctttactaaaggaatgccaactgctggtggccctgaacttgccgatgaactgctgaaactgattgagttacatgatgcaagtaatattgccgctgttattgtggaacccgtttgtggctctgccggcgccattgttccaccacaaggctacttacaacgtttacgggaaatctgtacccagcacgatattttattgatctttgacgaagtgattacaggttttgggcgtttgggtcgttggacaggggctgattatttcggtgtcacacccgatattctcaattttgccaaacaaattaccaacggtgctattcctctgggcggggtggtggcatccagcgagatctataatgcatttatggcacagcggctgcctgagcatatgattgaatttagccacggttacacctattcagcccatcccgttgcctgtgctgcgggcttagcaacactcgaattgttggaaaaagaaaatctaatccaacaatctgctgaattagctcagtatttcgaacaagcattacatgggcttaaccactgtccgaatgtcgttgacattcgtaactgcgggctggtgggcgcaattcaaattgccccacgcgatggggacgaagctgtccgtcctttcgaagcgggtattgcattatggaaagccgggttctatgtgcgatttagtggcgatactctgcaatttggcccgatgttcaatgctaaaacagacgatcttgatcgcgttttcaatgcagtcggcgatattctgcaccagattaagtaa

SEQ ID NO: 4344 - DNA, 153 bp, Xenorhabdus bovienii
  Coding DNA location: Contig name=SeqID_16895; Position on contig =168161..168313bp; Strand=-
atgctgtcacgccgatgctccagagtttttgataccactggtccaatgaacaacatcaaaatcgccagtgaggcgatcaaggcaggtattcggcgttgtgatagacgaaaaagcgataacaagctaatgatccagatcaattcccacgattag

SEQ ID NO: 4345 - DNA, 366 bp, Xenorhabdus bovienii
  Coding DNA location: Contig name=SeqID_16895; Position on contig =168258..168623bp; Strand=+
atgttgttcattggaccagtggtatcaaaaactctggagcatcggcgtgacagcataaaaagcgaagtctaccacaacatgccaatgtctggcatgcaaaatagcaataatcatcattacgcatcaccggcacatggtcatgacatgcatcatggcgcttcccatatccatacggggttgatggatgatattgcctgtggttattgtcagcttctgattaacctgccattgttgacgtgggtgtttgttccttttatctggctggcactgactatctcccgcaccccaccagtccggcttttttggggttctgccattcagctattttatggcgaatcgcaaccgcgcgccccaccccttaattaa

SEQ ID NO: 4346 - DNA, 2043 bp, Xenorhabdus bovienii
  Coding DNA location: Contig name=SeqID_16895; Position on contig =168743..170785bp; Strand=+
atgtctactacacaattatttcgtgtatcacctctgacagccgctttagctgtcattctctttatgcctgccagtagcttggctgcaacaggtgaaaataacaacgacaaagagataaaagacacacagacagttaatgatagagaatcggtgataattgtgaccgctccggcgatttcaccactcactataattacctcacccaaaacacctcgtcagcctgtacccgctagcgatggttcggattacttgaaaactattcctggtttttcccaaattcgtaacggtggtactaatggtgacccagtatttcgtggcatgtttggctcgcgcctgcgtatgttggttgatgatggtgaaatattgggttcttgtccgtcacgtatggatgcaccaagctcctacatttcacctgaaagttatgatgttctgagtttggttaaagggcctcaaactgtactttggggtgcaggaaactcagcaggaacggttcgctttgaacgtacccgccctcagttcgacaaactgggtgctcaaggtaatatcagtacggtagcggcttccaatgggcgttgggatggtaatgctgacctcagttttggtaatgagctcggctatgtgcgtttgagcggcaataaatcacgctctaacgattataaagatggtgatggtaatcgcgtaccttctcgctgggataaatggaataccgacatcgcagtcggctggacgccggatgatgatactttgctagaattaacggctggccagggtgatggtaaagcacgttacgctggacgtagtatggatggctccaagttcaaacgagaaagttttggtgtgcgttttgaaaagtccaacatcagtgacgtgttcgacaagtttgaaaccaatttttattacaattacaccaaccatattatggacaactattccctccgtaccccttccccaatgagtatgggaggacatggtggacatggaatgggtgccatggaactggatcgccgtactatgggcggccgtatgatggggacttggatttgggaagattttaagttacagagcggtgtagatactcagtccaatacccatcgaaacaaatatgacactgtttgggtgaaagatgctcgctaccgtaattatggtattttcagtgagttaacttgggacgccactgaacagagtaaagttatcggtggtgctcgtctggatagagtactcgtggataattacgttaaggcagcagaacggacagctactctaccttctggcttcattcggctcgaacataatctgacggaagtaccgttgatgttttatgctggtgtgggctacaccgaacgttttcctgattactgggaactgtttgattattgggaactgatctcgtccaaaccagagagtaaagccttcagagatttgaaaaccgagaaaaccactcagttggatattggtgcgcaatatcacggccaatattttagtggttgggtatctgcttacgtaggtaaggttaatgactttatcctgttccgctattccccaactgataggacaaaaagtcaggcgaataatgtcgatgccactattatgggtggagaaatgggcgccagctatcagttgagcgaccattggaaaaccgatgcaagtctggcttattcttgggcgaagaatacttccgatcatcgcccattgccacaaactccaccattagaagcgcgatttggactgacttgggaacatggcgactggacaagtagtggtttgcttcgtgttgttagcagtcaaaaccgagtgtcaatcaatgaaggtaacgttgttggtaaggattttgatcgcagcgctggatttgctatcctgtctgcaaacaccgcctataaagtgactaaaaatgttcaggttagcgccggtattgacaatatttttgacagaacctacagcgagcaccttaacttagccggaagtaatagttttggttattcaagcaatacgccagtaaacgagccgggccgtacttattgggctagagtgaacgttaaattctaa

SEQ ID NO: 4347 - DNA, 492 bp, Xenorhabdus bovienii
  Coding DNA location: Contig name=SeqID_16895; Position on contig =170929..171420bp; Strand=-
atgaagtacgatcacgttgaccgtttgctaatacagtgggaacagcagcgtccagacctcgatccttccccgatgggggtaattggaaggttagtccgtgtaaacaaaatcattgagcagcgtctgcaacatgcctttaaagcacatggcctgagtgctattgagtttgatattctcgctacacttcgccgttataacacaccaattacaccaaccgaaatgtatcagtcagttatgctgacttctggtgcaatgagtacccgtattgagcatatggtacagcgagggttaattgagcgtatcgccaatgaagaagaccgacgtagctgcaaagtttttctgactccggaaggaaaaacacttatagacaatgctgtcgagagccatttggagaacgaaagagctattctccagccattgacggaagaacaacaggaacaaattgccatactgttacgccattggctgctcaccaatgaatctgctacttga

SEQ ID NO: 4348 - DNA, 888 bp, Xenorhabdus bovienii
  Coding DNA location: Contig name=SeqID_16895; Position on contig =171548..172435bp; Strand=+
atgcaggaaacgagaatactcagtaatattttgcttaccgcactagcgcctatcgtatggggcagtacctatattgtcgccactgaaatattgccgcccaacatgcctttattggcatctaccgtcagggctttgcctgctggcatattattattgttggtttgccgcacagtaccaaaaggagtgtggtggctacgtctcaccgtgctggggctacttaacattggtgcttttttctatttcctttttgttgcagcggggtatcttcccggaggtacggcgtcgctaatcatgtcttgtcaacccgtgattgttatattcttaagtgcttatttgttaagaacatcgctgacaaaaaaacattttttttcggcgatgctgggtattgccgggattgcattactagtgatgaactcagctaccagcctgaattggcagggagttattgcaggatttgctggttgtagctgtatggcattgggggttgttctgaccaagtattggaatcgccctgccaatttatcattactgagttttacgggctggcaattaacactgggtggattgatgttactaccaatcgcaatttacactgaaggtgtgccacaacagctcacaccaactaatatcatcggctatggttatttgtgtctgattggtgctattttctcatatatcatttggtttcgtggcattgagaaacttcccgttgtaagcatctcattcttgggatttctgagtgcattatcagcctgcgttctgggatttgtttttctgaagcaaacattttccttgctacaatttttcggagcctgcaccatcattgtttctgtctggctttctattcctcggaatcagacacaaaaatccaataactctacaatctaa

SEQ ID NO: 4349 - DNA, 612 bp, Xenorhabdus bovienii
  Coding DNA location: Contig name=SeqID_16895; Position on contig =172452..173063bp; Strand=+
atgaaaaaatcatcaatgaaacttaccattatctctggtagtcaacgtccagattcccgcagtcaacgtgttgcatcatacttgcaagaattaagtcgtgaatatggatttactgatatacatctgcttgaactgtctaatgtagaacttccatttcacgatggttacacaacggatatatcagcagaatcgcacccttggcaggctctagctccgaatctaagagagagtgacgcatttatttttattactccagaatggcacggtatggcaacgccggcactaaaaaatttcctgttgtattgctcagtgacagaattgggtcataaacctgcgctattggccagtgtctccgccagcatgaacggtgtttatcctcttagcgaattacgcatgacaggttttaagaacaatcacgtttgttttctgcctgatcatttaattttccgccacagtgaaggtctgatttcgacagatttggcttgtagtaatgctgaatttgaagcacgtgcgaaatacacgctgaaactattgaaggcttatgctgaagccttgaagcaagtacgcgaagtcgttggagaagaaagcaaaaattacccttatggcatgtaa

SEQ ID NO: 4350 - DNA, 1392 bp, Xenorhabdus bovienii
  Coding DNA location: Contig name=SeqID_16895; Position on contig =173379..174770bp; Strand=-
atgactaaaaaggattatttggctctgtcagtactgttattggctggatttgtgactatttttgatctattcgttgtcaatatcgccattaccaatatccaaacacatttacaggcaagtatatttcaaatcacgctggtcattgttgcctatgaaattggctttggtctattactgattacgggaggtcgcttaggcgatctctttggaagacggcggttatttcaactaggtatattggcttttactttgacatcattattctgtggttttgcaccaaccgcgaattttttaattgctgcacgtttcttacaaggtcttgccgcagctttattatttccacaagtttatgccagcatacgcgtcaattttgaaggagagaatagccgccgagcatttggattattgggtatgacattgggatttgcagcaattgccggacaaactttagggggatggatagtttctgccaatgtatgggatttacaatggcgctctatcttccttatcaatgctccagttggaatcctggctttcgtctgctctggttatatcaatgaaagcatagcgagaaaaaaaacagaattagattgggttggggtggtactttccagtattagtattttcgccttactgctgccattattgatcggccctgtgtttggctggcctatatggtgttggctattactccttttagcaggtgtggtactgctacagttcatacgccatgagattcattatgtatctcaaggaaaaacacctttattcgattttgatttattgaagaacaaacaatttagtttaggatgtttattggtcttgtttgtgtattccactgccagctcatttttcctcgtatttgcgttatttttacaaaacggactcggttttactccgcttgattctggactcatttttgcgccagcaagcgtagggtttgttttatcttcattaaatgcgtcttactgggttaagcgttttggtagtcaagctatcgttatgggcgctttactttattctgtttcttttattgcgctgattgttacggttgctacgctccccgttgcaaccaatttattattgatcgtgccaatcctgatacttctggggtatggtcagggttttgtgatgacacctttactcaatatcgttttggcttttattcatgtgcgatttgctggtatggccgcaggtatcattgctactttgcagcaaatcggtgcagctttgggagtcgcagtcgtcagcgtattagttcaatggcaattgaataatgcggatgcgctctcttttatcacataccgaaatgccttcgtcagcagcatgctctacaatgtagtggccgcttttattacattttatttgttgaaaaaattacatcaaaaataa

SEQ ID NO: 4351 - DNA, 783 bp, Xenorhabdus bovienii
  Coding DNA location: Contig name=SeqID_16895; Position on contig =174876..175658bp; Strand=+
atgacaaagttgaaaagaactcgcacagagttagccagttttttacgtattaaaagagaaagcttaaatcctgaatcggttggattaccacatattgggcggcgacgtacaccgggattaagacgtgaagaagttgcggctttagctggcgttggcctcacttggtacacatggctggaacaagggcgagaaattggagtatcggccatttttttggataatctggccaaggtcttaaagctgaatgcggctgaacgaaggcatttatatctactggctcatatgcgtgaacctgtcgaaaccggtcaaacgtggtgtgttgtttctcctataatcaaacggattatgaatgatttatctcctcatttaacttatgtattgaatctacactgggatgtattggcctttaatcaaccagcagatgaatattttcacttcagtcaggttaaagatgaacaacgcaattttttatggttactgttcactaatgattattatcgtgaattattgtgccattggaatcaggatgcctatcggttgttagccagtttcagacgtgattatgcccttgcagccgaagacggctatattcaaaatctcgttaataaactacttaaaacatcacccgacttttatgatatgtggcataagcatgaaatttatgaaccctgtaatggagtgcggcaactgaatgtaaatggggaagccatttcttttgaatatacgtcaatggttattgatttagaaaagcatctgcgtttaattgtttatgcagaaatctga

SEQ ID NO: 4352 - DNA, 699 bp, Xenorhabdus bovienii
  Coding DNA location: Contig name=SeqID_16895; Position on contig =175808..176506bp; Strand=-
atgagtcagtggaaagaaaaagatatatttaaattattttcacagtacgataatatccttgaggagcaatatggatttactgctatttataattttattaaacaacatagctcaataaaaaaagtattagatctcggctgtggttcaggtgaattaattccttttcttacatctatcgcttcccaggtagttggcgccgatatttcagaacacgctttagaaaatgcaagagaaaagcataagaatagcggggctacgtttatttacgcaagcgaactacctaattatattaataataatagtaagttcgacgctgtcataagttcttttttgctttgtactctaaataccgaaaatttaattaagttactgttatgccaagtcaataatgctcttattgaacatggttactatatccttcttaattttaacttgaatgcgatgggagtagatttcgggacattcaaaacaggagaagagggtaaaatttaccatgatggagaggcactacctgtcagcatgcggacaaagtctggggaacagtttacttttaatgataccttttggtcttttagcaaattaataactctttcggaggaaatgggattttccctttaccaacaatcaactctaaccctcccacaatttactatttctcctttcacgatatttgttttaaaaaagcaaaatgaagtttaa

SEQ ID NO: 4353 - DNA, 3057 bp, Xenorhabdus bovienii
  Coding DNA location: Contig name=SeqID_16895; Position on contig =176858..179914bp; Strand=+
atgaaaaaaaacaatccggcacggccgatttttttagggatgacattgttatttgggctattacctactggttcgttaattgctgccactgaatatcacgaacagggtaaaaaaggtatacctgatagttggttgtcagatgaatttaagaatcaatgggggttggcctctatcggtgcccattatgcctatgccagaggttatacgggtaagggcattaatgtcggtgtattagatgaggcggttaccaaccatcctgaatttgctgacaaactaaagataatcgctccatccgacatttggaactatagttatgattcctacagcgatctgatcagctttggcgcccatggcaatcatgtgtcaggaaccattgcggcgaacagagatggcaaagaaatgcacggagtagcatttgatgcaggtttaatcaccgcaaagtttctgcaaaatgattacaaccgcacagaagctatgattcaaagcgatgctcgcatcattaataacagttggggagttcgtccgcgttattatgtgggtagcgacggtagacctatccgattgcctaatgggactatcgcttattataaagttacattgaaacagctaattaattatgtctcgccaattaaagaaaaactaaacgagttaagccaagccccgctcgcagttacgggagagccgttagccagtgatgccggcatgttacgtgctgctcgccaaggaaaattaatggttttcgctgcgggtaacgcgaataattataacgtgacttggttacatgcagggatgccttatttcttcccggacgtactgaaaaactaccttagcgtcaccaatctaaaagaagatggtttgattgcaccctcgtcaactagctgtggatataccgctagttggtgcctagctgcaccaggcaccaaggtttacagtagcactggcgattttgtctcgaaaaatggtggcgaaattaacgaggacgctttaaagaaaggcgagctggagattgatcccacctatgatacttacacaggtacatcaatggccgcgccgcatgtggcaggagccgctgcagtcctgatgcaacgtttcccttatatgactgcggcgcaaattgccgatgttatcaaaaccaccgcgactgatttggggacgccgggtcttgatgacttatatggttggggaaaactgaacctgaaagatgccattaatggccctaaaatgttcattactaagcaagatatccccgctaaatattacattgaaggttcgtataccgaaacacagtttatcgccaatattgacggcatcggcagtctgattgagccaggcaccaccgtacaacgagtatgtaacagtattgagtgcgtctacgactattggagcaatgatatcagtggtcatggtggcctgactaaaactggcagcggtgcgctcttacttaccggagccagtacttattctggtccaacatgggtgaataaagggctgttattggtgaacggttcgataacctccgatgtgacagtacaaagcgatgcaaccttgagcggaaaaggcactgttggctcactcactgcttacaacggagctaacattgcaccgggtaatactaatactgacgctgctctgaatgttgatcgcgaagtcatttttaaaacaggctctcgctatcaggtgacattaacgccggatggtaagaatgatcgtatcctgagtaatggtatggcagggctggaaggtggtgaagtgcaagtgactttggaaaaccggggtaacttgctgtcgcagcaaaaggtacgcagtctgcttggccagcaatacaatatcttgcaagcgagcaatggcatctatggtcaatttgacacagtatcacaggggcatctgttccttgatatcccgctcaactatcaatttgatcgagcgttgctggatataaaacgcaacacaaccgagtttgccagcctggccacaacggctaatgggcgttcagttgccaaagcagctgatatgctgaattcagaccatccagttcatgaaagtattctaatggtaaattcagctgcacaggccagtcaggcattcagccaactttcaggacaggttcatgctgatattgctgctgcacagatcaatagcagccgctatctgcgcgatacactgaatacccgtttgcgtcaggccaatggcgtagccacttctcaggaaatcaaagcggatacagatggtgcttgggtacagataatgggtaactggcagcgtgccagcggcaacaatgaagtcagcggttatcggatgtccaactacggcgtgttgttgggtgtagataaagacttgtccagcgactggcggcttggcgtggctaccggctacactcgctcttctctgcatgggggcgatagtgcgtcagcacgcagtgataactatcacttggctttatacggcagcaaacagattgatgctctggcattacgtgctggtgtggcctacagttggcatcgttttgacaccgagcgctcagttgcttttggtgatcagtccgacgatctgaaagctaaatacggtgcacgtactggacaattatttaccgaagcgggttacggtattaaaacctcttggctgaatttggagccatttgccaacttagctcacgttaacttccacaacaatagcattaatgaacaaggcggagccgctgcactgcacggtgacaaaaaatcacaaaatgctaccttctctacactgggtttgcgtgccgaccaaaaatggaaaatcgaacgcgaatcccaaagagaattgcatgtgggtgtatatggtgaactgggctggcaacatcggtttggtaacatcaatcgtggcactaagttaggtttcagcaatagtaatacgatgtttactgtcaacagtgtttcagcggggcgtgatgcagcagtggttaaagtaggtactgaattagatatcggcaaaaataccacactggcactgggatataatggcgttttatcaagcagccataaagataatggtgtgttcttgaatgctaattggcgattctga

SEQ ID NO: 4354 - DNA, 1206 bp, Xenorhabdus bovienii
  Coding DNA location: Contig name=SeqID_16895; Position on contig =180212..181417bp; Strand=-
atggagcggatgatgagcaaaactcagagtgcgatcattgtggggggaggtatcggtggtgccgctgctgcattatcactggcaaaagtcggcattaaggctttattattggaacaagccaacgagataggtgaaatcggtgcggggatccaacttggccctaatgccttttctgctttagatagtttggggattggcgaaattgcgcgtgagcgagcggtatttacggattacattgccatgatggatgcgatggatgctaatgaagtggtacgaattgataccgggcaagtgtttcgtgactattttggcggtccatatgcggttattcatcgagctgatatccatgacacggtttggcaagccgctttaaagaattcattagtgagttatcgaaccgcaacaaaagtggtggaagtgaatatcactcaaaatgatgtagaagtcattgatgagaaaggtaatagctataaagcagatgtattgattggttgtgatggagggaaatcgattattcgtgactctacattgaatgataaaccaagggttacaggtcatgttgtgtatcgtgcggttattgaacgagaagatatgccggaagatttacgaattaatgcccccattttatggggaggcccgcattgccatttagtgcattacccactacgtggggggtcacaatataatttggtagtcactttccatagccggcagcaagaggagtggggagtaactgatggtagtaaagaggaagtgatgtcctactttgacactattcatccacggcctcggcaaatgttagataagacaacatcatggcgtcgctgggcgacagccgatcgtgaacctgttgagtcatggggcactggtcgagtcaccttattaggtgatgctgcacatccagtcgcacaatatatggctcagggggcatgtatggcgttagaagatgccgtaacattaggggaagcggtgaaagcgtgtaatggtaatgcgattgaggcgtttaaactgtaccaagccgtccgcattccgcgtactgctcgtattgtgtggtctactcgggaaatgggacgtctttatcatgcaaaaggggttgaacgcgaagttcgcaatttactgtggaaaggtaagacccagcaagattattacaaagctttggaatggttatatggctggaaagaagagaattgtttgcaaccgaggtaa

SEQ ID NO: 4355 - DNA, 645 bp, Xenorhabdus bovienii
  Coding DNA location: Contig name=SeqID_16895; Position on contig =181456..182100bp; Strand=-
atgaaactatttagtttttttaatagttcagcctcttatcgggtacgtatcgctttagcgttgaaaggtattgattaccaaacagagccagttaatattcgccttggtgaacagtatgatacggaatatttgcagcttaatcccgttggcgccgtaccaacgctaattgatgatgaaggcaactcaatgggtcagtcattggctattattgattatttagagcggtgtttccctgtgccacaactcttaccacaaggcgcacaaatacgcactcaagtattagagattgcctctattatcgcttgcgatatccaccctgtgaataatatgcgagttttacgctatttaacggatgagttgcagattagcgatagccagaaaaaaaattggtatgcccactggatcaaagtagggctaggcgcagtggagcgtttgttagagaagaataattctggaaattattgtgttggtgatcaagtgacattggcggattgttttttgatccctcaatgggctaacgcgttacggatggagtgtgaattgtctcactatccacgttgccagaaggtttaccagcactgtagtgccttacctgaatttattgtggcagcaccagagaatcagccagggcttatagcaccttaa

SEQ ID NO: 4356 - DNA, 702 bp, Xenorhabdus bovienii
  Coding DNA location: Contig name=SeqID_16895; Position on contig =182121..182822bp; Strand=-
atgagtaagtttgttttttcaccggcacctcaagttgccgttcctgttgttgggacagatgaattttttcctgttcatcgtgtttattgtgtagggcgtaattacgcggcccacgctcgtgaaatggggtttgatcctgagcgtgaaccgccttttttcttctgtaagccagcagatgcggttgtgcctgtgaaggcgggtgagattttagaattagcgtatcctgagcaaaccgagaattaccactatgaaattgagttggtcgcggcgattgggaaaggcggcaaaaatatctctgtcgaagaagctttgaaccatgtttatggttatgcaacggggctcgatatgacacgcagagatcgccagatcgagatgcgtaaaatggggcgtccgtgggaaatcggtaaagcatttgatctttctgcgcctatttcaccgattcatccatcggtgagctgcccagatatgaataaggcggcgatatggttacatgtcaacggcacagaatatcagagtagcagtattgattttctgatttggtctgttgcagagacaattagttatctatcgaccttctttgaactgcagccgggcgatcttatttatacaggaacacctgaaggcgtcggtgcagtcgtgaaaggggatacaattatctgtggcgtagaaggattaacagatttaactgtggcgatcatttag

SEQ ID NO: 4357 - DNA, 330 bp, Xenorhabdus bovienii
  unsure (1)..(330): unsure at all n locations
  Coding DNA location: Contig name=SeqID_16895; Position on contig =182894..183223bp; Strand=-
atnaatatgaaggggttcaaactacgttatgtcaacccagcaaatggtgggtacacaatgccaaccatggcagcatttttgcagttattaccaaaagggtttaaaggggaaaacagtcgttctacagacagtactatttaccatgtcgctgaggggcaaggtcaggtcactatcgggggagagaactttatgtttggtccaaaagatatttttgtagtgccatcttggcttcccgtcagttttgaaactcagtcggataccgtgttattcagcttttcggatcgcccagtacaagaggtattaggtctatttcgggaagctcgtggttaa

SEQ ID NO: 4358 - DNA, 702 bp, Xenorhabdus bovienii
  Coding DNA location: Contig name=SeqID_16895; Position on contig =183232..183933bp; Strand=-
atgcaaaaaattaacacaagccaattagatcgcagaaagagtttctatcaggacattgcgaaattaaacctttcgcctctttgggaagagttacatagattagtgccagatgtaccccattcctctatttctgccgcgctatggcgttatcaggatattcgcccttttttgatggaaagcggggagttaattggggctcgcgaagcgattcgccgcgtactggtattagaaaaccctgcgttaatcggtaagtcatctattacgtcatcattatatgccggattgcaattaatcatgcctggagaagttgcaccgagccatcgacattctcaatcggctttacgctttatcgttgaagggagtggggcgtttacagccgttaatggtgagcggacgacgatggaggcgggtgactttattctaactccgcagtggcaatggcatgaccatggtaacccaggaacagagcctgttatctggcttgatggcttggatttgcctttagtgaactatctgggatgtggatttgcggaggattacccagaagaacagcaacccgtgttacgtccaaatgacgactacttgccacgctatgccgccaatatgctgcctgtacgttatcaatcaggtaattcttcaccgatttttaattatcgatatgaccgcagccgagaagcgttagaacagctaagcccgcaatag

SEQ ID NO: 4359 - DNA, 1353 bp, Xenorhabdus bovienii
  Coding DNA location: Contig name=SeqID_16895; Position on contig =183954..185306bp; Strand=-
atggcactaaagcgcagtatgactgttcaggaggtgattgatgcagcccctgtatcccgctaccaatggcaagtgttgatttgttgttttctagtcgtaacgtttgacggttttgatactgcgtcaatcgggtttattgctcccgctattcgccaacaatggcagttggatgcagcgcatctagcacctttgtttgcctcaggtctttttgggctgacgttaggtgctttgatatttgggccaatggcggaccgttttggtcgtaaaaatattatgcaattcagtgtggcactttttggcctaatgtgtttgttatcggcatttgctacagatatgacaacactaacgatattacgctttttgacggggctaggtcttggtggtgcaatgccgaatgcaatcacattaacatcggaattcatgcctgcaaggcggcgagctggtttagtcacgcttatgttttgtggttttacgttaggttcagccctaggggggattgtaagtgctcaatgggtaccttccattggctgggaagggatcttgatcctcggtggcgtcatgccactagcattgagtgtcttgctatggaaaatcttgcctgaatcacctcgttatcgagtattaaaacagtatcaacccgaaaaaattcctgatgtcttgaataaaattacgggtaaaaattatgacgatgtcactttttacttggacgaaaaacctgcagaaaaaagcgctgtctccgcattatttagccgtgaaatcttacctacaacactgttgttatggtgtgtgttctttatgagcttgctgattatttactcactttcaagttggttaccgacattactgaacaatagtgggatcgatttacaacatgcatcttgggtgacgacagcctttcaggtgggtggaacggcaggggctattttgataggggttgtgatggatcgcttaaatccttattggacattagcggtaagttacgccctaggggcagtattcattgtattaatcagcttctcagaaggctctttatggatgatggcactggttgtcttgggtacaggtgtggggattagtggctctcaggtaggccttaatgcgttgtccgccgcactctatcctactcaatgtcgtgcaacaggcgtgagctgggcaaacgccgttggccgttgtggtgcgattgttggatccctcagtggtggtttgatgctgtcttggaatatctcttttagcacgatatttattgttatcgctttacctgctgtcgttgctgctttagcaatggttattttacgtacacaacatagaacggcacgtattgtcgtctcgcacatgaccatacaagaaaaatag

SEQ ID NO: 4360 - DNA, 948 bp, Xenorhabdus bovienii
  Coding DNA location: Contig name=SeqID_16895; Position on contig =185440..186387bp; Strand=+
atgagtaactggacacaaaaattaaaaattcagcatctaaggctgctaatctgtattggcgagcaagggaatttaagtaaagttgcagagattatggggattactcagcccgcactatcaaaatggttagggggattagaggaagatattgggatcacactctttgaacggcacagtaaaggattgcgtccatcggaaggtggccgtctgctgctggaacatgcccagcgtatacttaatgatttagaacggtctcaagaagatattgaacaatttaaaatgggtatcaaaggtagtctgattattggcagttcacctgtcgccacggactgtgtttctcttgccctcctttcacttgttaatgattacccaagtattcatgtcaaagtcgttgaaaatgtcatgacttcactattgcaaagcctaatttccggcaaaattgatgttgtggttggccgagtcggtggaaaagcattgcaattacctctcaattatcaaacattatatacagagccggtctgttttgtgggtcgttgtaatcacccattagccaatcgagagagtattaattggcaagatctcttagaatacaactggattgtctggccaacaggtactcccattcgtactagcattgataatgccatcgtcgatcaaggtgtaatgttacccaacaattatctagaatcgtcatcaatgaatgtaaccattaatatgatccaagcaagcgatattgtctcgattttatcgtggcgtttagcacatcgttatgtagaaaaaggtcaactagcaatattgcctttgccccgtatcgagcaaaaaggcagcgttggggtattttggcgtaaagatactaccccatctgatgcattgcagtgcttcttatcgcatttaacgaagacatcggcagaatcagaaaatgatggagtttttgtgatatcaaattag

SEQ ID NO: 4361 - DNA, 315 bp, Xenorhabdus bovienii
  Coding DNA location: Contig name=SeqID_16895; Position on contig =186293..186607bp; Strand=-
atgtttaaagtaagagaaggagaatatgttagtttaatcgaactatctttaagatttgattacgttaatggttgtgaaacatcacccgtcgcctttcttgaaggaatttatacgacctcaagccatcgccagaaaggaatcgcaaatatgctgatatcccatgcgtgtctctgggcaaaagaacacaactgccaagaaatcgcgtctgatacccatatttctaatttgatatcacaaaaactccatcattttctgattctgccgatgtcttcgttaaatgcgataagaagcactgcaatgcatcagatggggtag

SEQ ID NO: 4362 - DNA, 1170 bp, Xenorhabdus bovienii
  Coding DNA location: Contig name=SeqID_16895; Position on contig =186905..188074bp; Strand=+
atgccgccacgttttattctgcctgtattggcactcactgtattttttattggtacgacggaatttatgctgtctcccatgctcaagccattggccagtgcatttagaacgacgcttgataatgttgcttggcttgtatccggttatgctctttcctatgctcttgcagccccctttttcggttggctttctgatcgtgtaaatcgacgcagattgttactgatatccctgctgtttcttatggttgatggattggcgctaacatttgccccaaatttgagtactgctattggattgcgtatttttggtggcatcgcttcagcggcattaatcccaacaacgtttgccttgattgcagagcttttcccacgccaaaagcaagtgtcagccatgggtctggttatgcttggcatgacagcgggtattgctggtggcccaatatttgcgggggttttaacggaattatttgattggcgggcgccatttctggtcaatgctgcggggtgtttgctggtttttgtcttaggcaggaaatgtattccaattcaagcgcctgttgagagaataaaacaccagatggttacatttaaatcaatgtttcagtgggtgcgccagaaaaatttaatgattcctcttattgcaaaaggattttggaatggtacggcggtgtctgctttgatattggccggagaggtgttacgacaacactatgagataggaacaggaacgattggtatctcaatttctacattcggaatcggtcttggtttgggcaatttgtccgtcggcatggtgaaacgtctgggattaagggatgaactcatattgttactggcgatcgtgttactttcctcagcgacgactgcgtttatgctgatgcctttatctctgccctttagcctgagctgtttgattgtatggggaagcgcccttggccttgctgcaccgatcagtactgttattctggcaaatcgagcgaaacagcataaaggtcaggtactggcggtttcagaaagcttgaacaatctggtgattttgcttttgatcccaattgctacaatgctgatgactcatcatggcattgcagtaaccatgctaatgttaggattcagtttaataataagtattgtgctgacaataagagacttttttggtgacactgtcacgtaa

SEQ ID NO: 4363 - DNA, 1965 bp, Xenorhabdus bovienii
  Coding DNA location: Contig name=SeqID_16895; Position on contig =188194..190158bp; Strand=-
atgactaagcctctttataccaacttaaatgtagatgcgttgtttctaggcccaaaatcagaaaatgcagtttttttcagagaaatgatggactatgcagttagtgaacacatgcactggcgttcaggatttcacccagaagatgccgctttggttacatccgttgatcgttatgagcataattacagagaaactctctatcggacagaaggaatattgaatcagctatcagcaaaattgaaaaacacctcgattcctttcttctcccctcgttatctaggtcacattagtggcgacactttgatggtttccaatctcgcctatgtgatggcaatgatgtacaaccccaacaactgtagctacgaatcatcacccacaacaacagaacttgaacttgaatccgggctagatctctgccggatgtttggttatgaccctcagcacgcatggggacatatcacttccggtggaactgttgctaactatgaaggtttgtgggttgccagaaacttaaaaacattgccttttgctgtatcccaacatcctgatacaaaagagttggttagtcataagtcaccaaagcaattgatgaatatgccaacaactgaagttctcgatttaatcagcgagttacaagaacgtgggattttcgatgaaatacgtaacatgacgtgtcgtggtacagggagtaagactgaaattttgggtaagctactcgtaccacaatccaaacattattcctggatgaaagcagcagatatttttgggatcggtcaggaaaatattatcccattgcctgtgaatgaacactatcaaaccgatattggcaaaatgcgggaaatcacttttgacttaatcgagaagggcgagcctattttggcgatgattggtgtagtcggtacgactgaagtcggtgctattgatcggattgatgaagtgattgcattacggcaagaatgtgaagaacgttatggtggatcattctatatccatgttgatgccgcttatgcaggatatgcctgttccatgcttctcaatgaacagggggaatttatggaatatgatgatctggttaactatcaccatacactaggcatcgtacctgaaaatatcagttggccaaaaccagaggtttaccagagcttcaaagcattgcgatatgtcgattcgatcacagttgacccgcataaggttggatttattcaatattcagccggggcaatttgtatgaaagacaaacgtattctcgatttgatttcttcacgcgccctttatgtctttgaagaaaatgacaaccaaagtaactctcctgccagtaaccgaggggtacttggcgcttcgatcatggaaggttcgaaatcaggggcaaccgcagcagcgctgtgggcagctcatcgattactgcctttaaacatcagtggttatggaaaagtaatagccgctggcatagtcaccgcgaatcagctattagataaaatggcaaatatgccaccaatcgaagtcggtgagtatcggtttaaaatgcatattatgccaacacctgattttcacatgatcaacttcaccttcaaagaagtcggaaacgccagccttatcaaccacaatgcacttaacaagcgaatttatgaactgtgttcatattcttcaggacgtgcatatagcaacgattttctcacatcctcaaccatactggattacaaagagtacggtgatacaccttggtactacgctgaaaaatgtggttttagccgtagtgagtgggaaaaaacacgctgtgtttatgtactacgtgcagcagtaatgacacattgcttacgtaatgaagaacacttcgaagagcattggaatcaattacaagctattttcgtcagaaaattaactcaactggttgatgaagaagagaaaaaattacgccagatgttgaatcgtgaggagtcgtttctcattattgacaaaaataactga

SEQ ID NO: 4364 - DNA, 294 bp, Xenorhabdus bovienii
  Coding DNA location: Contig name=SeqID_16895; Position on contig =190617..190910bp; Strand=-
atgcgattgattgagcagcctgcctatatggagtggttaatagaaaccacaacagtcgacgaaaatattatctttccactccatccagaacttaatttcaaaagtgcatttgggctgagaatagtttcatggtgtttatatattattgcaatggcaatatgggcttactccttatggaaagggagaaatcgggcgttaatccgtctgggttttcccattctgtctggcacggttatcatgtttatcgctgagatggtcaatcaatatacttttttcattatatgtaacatgtaa

SEQ ID NO: 4365 - DNA, 756 bp, Xenorhabdus bovienii
  Coding DNA location: Contig name=SeqID_16895; Position on contig =191195..191950bp; Strand=+
atgatcccggaaaaacgtattattcgtcggattcaatctggtggttgtgcaatccactgtcaggattgcagcattagccagctatgcattcctttcaccttaaatgaacatgaactcgatcagcttgataatattattgagcgtaaaaaacctatccagaaaggacaaactttgtttaaggctggtgatgcattgaaatcactctatgctatccgttctgggactatcaaaagttatacgattacagaagaaggcgatgagcagattactggttttcaccttgccggcgatttagtagggtttgatgctatcatcaatactgagcaccccagctttgcccaagcactggaaacttccatggtgtgtgaaatcccatttgaaacactggatgatctttccggtaagatgccaaatctccgccagcagatgatgcgcttgatgagcggtgaaatcaaaggcgatcaggaaatgatcctcctgctatccaagaagaatgcggaagaaaggctggcagcatttatctataacctgtcacgccgttttgcgcagcgcggtttttctcctcgcgagttccgtttgaccatgacgcgtggcgatattggtaattatcttggtttgactgttgagacaattagccgcctgcttggccgtttccagaaaaatggcattttgggtgttaaaggtaagtacatcgcggtcgaaaatatggagaaactgacggaattggcaggaaaagcccctgtttgcgtgtcctaa

SEQ ID NO: 4366 - DNA, 945 bp, Xenorhabdus bovienii
  Coding DNA location: Contig name=SeqID_16895; Position on contig =192077..193021bp; Strand=+
atggcaaactaccaaaacctcttagttgcaattgacccaaatcaggatgatcagccggcattaagacgtgcagtatatatcgtgcaacgtaatggtggccggattaaagcattcttacctatttatgacctctcatatgaaatgaccaccctgctttctccagaagaaagaaatgccatgcgtaaaggtgtcattggtcaaagaattgcttggataaaacagcaggcacactactatcttgaatcaggcatcgacattgaaatcaaggtagtttggcatggtcgtccttatgaagccattattcaggaagtcatcacaggaaagcatgatttattattgaaaatggcacatcagcattctttattggaatccatgatttttacgccgctggattggcatctattacgtaaatgcccttgccctgtctggatggttaaagatcaggtctggccagaaaaagactctgccgttgttgcggttaatttatcaaatgaagaatcttaccatactgcactaaatctaaaattggtgaaagaaacgcaagatctcgctaaccgaattgtaaaagaacctctgattcatcttgtcagcgcttatcctaccgcgcctttaaatattgcaatggaactgcccgattttgatcccaatgtatataaccaggcattacgtggtcagcatttggttgcaatgaaagagttgcggcaaaaattctatattgatgaacaacagactcatgttcacgaggggctacctgaaaaagtcattcctgaaatttgtgatgaattaaatacgggagtggttgttctgggcattcttgggcgaactgggttatccgctgcatttcttggtaatacggctgaacatgtcatcgataagcttaaatgtgacctgctggcaattaaaccggatggttttgtttgcccgattagtgtggatgaagagtaa

SEQ ID NO: 4367 - DNA, 957 bp, Xenorhabdus bovienii
  Coding DNA location: Contig name=SeqID_16895; Position on contig =193313..194269bp; Strand=-
atggtcatttcacgtgatcaacaaaagcagggcatgatcatgtcattgtctgcatctggccagcagatacataacaatcccgctattgcatatcttgtcagtcttggctcaaagcgaagtcgccagactatgaaatcgtttcttaatatcgtggcaaaaatgcttgggtatcaaaatgtacaggactgtacttggaatgcactacgacgccatcatgtgcaagctatcatggaaatgctctccgattccggcaaagccccagcgacgatcaatacctaccttgccgcgttaaaaggcgtggcgctggaagcttggacaatgaagcaaatcgataccgacagttttcaacatatcaaacaagtgcgttctgtcagggggaatcggttgccgaaaggaagagcgcttgaccgttatgaaattaaaacgttattttttacttgtgaaaatgacttcagcacaaaaggcttacgtgatgccgccatcattggtgtacttgtcggttgcggactccgtcggtcagaaattatctcgctggatttgaaaaatgttattcgccgtgagcaagcattgagagtcatgggaaaaggaaacaaagaacgtttatcttatatgccggaaggaacgtgggaacgtttgaaccgctggatagatgaaatccggggtgattatgccgggccattgtttacccgtatccgtcgtgatgatgatgtaacagataaccgcctgtcagaccaggcaatttatcatatattggagacacgtagaattgagagtggactggaaaaatttgcgcctcatgatctgcgtagaacattcgcatcagctatgttggacaatggggaggatattgtaacagtgaaagatgcgatggggcattcaagtatcactacaacccaaaaatatgatcgaagaggcgatgaacgtttaaaaaatgcagccaaaaatctgaatttttaa

SEQ ID NO: 4368 - DNA, 216 bp, Xenorhabdus bovienii
  Coding DNA location: Contig name=SeqID_16895; Position on contig =194262..194477bp; Strand=+
atgaccatcaatgattttgtgtcttcatcacttccatcgttaaattcatctaggttttggtggttcaaaatttcctccttgttgctgatttcaatgtcttccgttcaaacaagctcgaatcgaattgttacaaaacaagtgtgtccactccgttcagataatggaacttaccttattagctcgatttttgatcataatcatgattgcgctgtgtaa

SEQ ID NO: 4369 - DNA, 7542 bp, Xenorhabdus bovienii
  Coding DNA location: Contig name=SeqID_16895; Position on contig =194740..202281bp; Strand=-
atggacaataatttaaggagctatatgaacacgattaatgagttgttaaataaaataaataaagaaaagagtggtgatactttatcattggctgacattatatctatgtccttcagtgagtttcgtcatagatcgagtgaagcgttgacatggagagaaactaatcttttgtataaacaggctcatcatgagtccaaacagagtaaactcgcagagttacgcattctgtctcgtgctaatccacaattggctaataccaccaaccttgatatttcaccgtcatcacagaacagcagttataacaattggttttatggacgtgctcaccgttttgttaaacccgggtcggttgcttccatgttttcacccgcggcttacttaacagagttgtatcgagaatcaaaaaaccttcatcctgaaacatctcaatatcatttgaataaacggcgacccgatatcgctgctctggcactgacacaggataatatggatgaagagctttctacgttgtccttatccaatgaattactgctgcataatattcaaacgttagaaaaaactgactataacggcgtaatggaaatgctgtctgcttatcggcaaacaggcctgacgccctatcatctgccgtatgagtcagcacgtcaggccattttattacaagataaaaatctctctgcatttagccgtaatacagatgtggcgaaattaatggacccaacatcgttattggctatcaaggcgaatatatcccctgaactgtaccaaatccttgtggaagaaattacagaggaaaatgcagcggaactgatgaaggaaaatttcggtacagatgatattctaatttttaagaattatgctgctctggctcgctattatgatctgtcttatgatgaactcagtttgtttgtaaatttgtccttcggtaagaaaaacaccaatcaacagtataagaatgatcaactaataacattggtaaatgatggcaataacacggcaaaagcaaggttgattaagcgaacccgcaaagattactacgattcacgtttaaattacgcagagcttattccggtaaaaggaaatgagtacaaatataatttcagcataaaaaaaacagagcatgactgtatagattttcgtcttcaaaatggagatgacgaatatgtatatcgagatacaaatttcgtgcctattgctaatacccattacagcattcccatcaaactgacgacagaacaagttatcaatggcataacacttcgtttatggcgagttaatccagatccttggaaagctatcaatgccaacacattcttcaaaatggtggaattccccggcgatatatttctattgaaattgaacaaagccattcgtttgtataaagcgatgggaatagctccagaagatatctggcaggtggtagaaagtattaatgatgatttaaccattgatagcaatgtgctgggtaagttgttttatgtccaatattatatgcaacactataatattaacgtaagtgatgcgctggtattgtgtaattctaatattagtcaataccccactaagcagcaagccagccagttcacaacgctgttcaatacaccgttactgaatggacaagagttttctgccgataataccgaactggatttaacccctggtgcatcagaaaaccattttcacttgggagtaatgaaacgtgctttcagagttaatgataccgagctgtatactctatggaaactggtcaacaagggaacaaattcggcatttatttgttcaatgaagaacctgtcagtcctttatcgcgtccacctactggcagaaattcataatctgacggtgaatgaattctccatgctgttgtccgtttccccatatgcagacaagaaaattgccgatttctccgatacagaattaacccaattaatcagttttctgtttcaatgcacacagtggctggcaacacaaaagtggtcagtcagtgatgtatttcttatgaccacagacaattacagcactatcctcactccggacattgaaaacctgatcacgacactaagtcatggactatcgacaccttcactcggtagtgacgaacttatccgtgctgctgcaccgcttattgctgccagcattcaattggattcagccaagacagcggaagctatcctgctatggattaatcagataaaacctcaagggctgacatttgataatttcatgatccttgttaccaaaaatgatcgctcagagaacgaaacccaaaaaatggtagccttttgtcaggtactggggcaactttcactgattgtgcgcaatattgggctaagcgaaagcgaattaacactgttggtcacaaaaccggagcggtttcaattagaaacaacggtactacagcacgatcttctcacacttcaagcgttgactcgtttccacactgtaataatgcgttgtggaagctatgccacagaaattttaactgcattagacatggggagactcacagccgagcagttggctatagctctaaaatttgatgttcaagaaatggctcaggcattgcaacaggctggttcgggagaaagcatttttaccaattggaaaacaatggatgcaactctgcaatggctggatgtagccaccacgctgggcatcactccggatggcgttgcagcactcataaaactaaaatatgccggtgaacctgaaacacctctgccagcttttgatgactggcaagcagccagtattttgttgcaggcaggtctgaacaatcaacaatccaattaccttcaggcgctgttggatgaagcaacggctacagcggtcagtgcttactatatcaataatggcgcacctcaacagattcagagccgggatgagttatacagctatctactgattgacaaccaagtttctgccaaagtgaaaactacccgtgtggcagaggcaattgccagtattcaactgtatgtcaatcgggcgttgaataatgttgaaagtaaaatatcaaaacaagtgaaagcccgtcagttcttctgcgactgggaaacctataatcgacgttacagcacttgggccggagtgtctgaactggtctattacccggaaaactatatcgatcccacgatgcgtattggtcagacgggtatgatgaataacctgttacaacagctttcccaaagccaattaaacaccgataccgtcgaagacggtttcaaaaattatctgactgcatttgaagatgtcgctaatttacaggtcattagtggataccatgacaatatcaatgtgaatgagggattaacctatttaattggtcatagtcagacagaaccaaaattatattattggcgtaatgtcgaacatcaaaagtgcgaacacggtaaattttctgccaacgcctggggagaatggaaaaagattgaaaccccaatcaatgtatggcaggaaaatattagacctgttgtttgcaaatctcgcttgtatttactgtggctagagaaaaaagaattaaaaaatgaagatggttcgctaaatgtcatcgattatatattgaaattgtcacatattcgttatgatggaagttggatttccccttttagtttcaatgtatccgataaaatcaataacaattcaattgttggtatatattgttcttatgattatgaaaaagaagtgataattgtttatttttatgaaaagaaagatgcttattcaagcaataaccttcctgcaaacaaaggaataaccattaatcctgatatgacattttctattctcacggagaatgatttaaatgccattgttaaaagtacattatcagaacttgataccaaaacggactataaagttaataatcaatttaccatagactacttagttgaatacaaggataaaacgacagacaaaaacaaaattattagtttaacaggcaatattgttgatctatcatatgaatcatcaaccagtggtcatattaaattaagcttcaaaccatcaatggaaattagcttttcaaaaggaggtatatataatgatgagattaaatacctactatcgatggtagaagatgaggaagttcttttatttgattatgataggcatgatgagatacttggaaaagatgacgaaatcgtacattatggaacattagattttattattactatagattttattattactatagatttaaaaaatccagaatattttagagtattaatgcatggtagaaccgaagaaaagatctccagagaatctggtggaattttaattcatatgagtaacggtactgaattaagcctcgaagttaatatggtatctaattggaaagatagcgcaggagtctggcatactatatgcgaagcatttattgatgatattttaaacattaatgaaccggaaattatttttgtaggatttgaacgtaacgacccatgtcagtatttctatttaattgctacagatatagagtttgtttcacctatgatccaacaaattccagataaatatattggttttttattaaaaaatggcaatgatattttagtagaattaaatgctaacgaccatgtaatttctaagccttcacctgaatctaaccctatggtatatgattttaatcaagtcacagtggatgttgaaggctatgatattcctcttataggtgagtttactattaataagccagaggtcggttataatggcatggttgctgaatcgccgattcatataaagctaaaatccaaagataaaagtaatattatatcgctgcataaaatgccatcaggcgcacaatatatgcagattggcccttatagaacccgattaaatactttattttccagaaaattagctgaaagagccaatattggcattgataatgttttgagtatggaaacgcaaaacttgccggaactgcaattgggtaaaggtttctacgccagcttcgtgctaccaccatataataaagcggagcatggcgatgagcgctggtttaaactcaatctcaaacacgtcgttgataatactccccgggtctattattctggcatgttacaggataaagagttatccgtaacattattcattcctttggatgaaaagccacttgatgagaggtttattgcagaaattttattaagtaccagcaaaaaccacggcgatgtcccttggtcaggtcctcattttatctatgtgaacaaagaacaaaatgagtttggcattaacagtaattcaaagttaggcatgttcaaattagttacggtactcaataataaaaacaccgagcccatggatttcagcggtgccaatgctctctatttctgggaactgttctactatacccccatgctggtggctcagcgcttactacatgaacaaaatttcactggcgccacacgttggttgcagtatatttggaacccagccggctatctggttcagggcgatatacaggattattactggaatatccgtccattggaggaagatatttcctggaacgccaatccgctggattcggtagatccagacgccgttgcccagaatgatcccatgcattataaagtgactacctttatgaaagcgctcgatttgctaattgctcgcggagatagcgcctatcgccagcttgaacgcgatactttgaacgaagccaaaatgtggtatgtgcaggcactcaccttattgggcgatgaaccttatttttcattggataacgattggtcagaaccccgtttggaagaagccgccagtcaaaccattcgtgatcattatcagcataaaatgcggcaactgcgtcaacgcgcggccttgccggcgaaacgtactgcaaattcgttaaccgctttgttccttcctcagataaacaaaaaactgcaaagttactggcagacgttagcacaacgcctatataacttacgtcataatctgacaattgatggtcagccgttgtcattacccatctatgcgacaccagcagatccgtccgtactgcttagtgctgccgtcaccgcctcacaaggcggaggagatttgcctcgggcagtaatgccgatgtaccgttttccgattattctggaaaatgccaagtggggagtggcccaactgatacagtttggcaataccctgctcaacattactgaacggcaggatgcagaagcactggcagaattgctgcaaactcaaggcagtgaattagctttgcagagtattaaaatgcaggacaagatgattgctgaaattgatgctgatgaagtggcgcttaaggaaagccgtcatagtgcacaatctcgttttgacagcttcagtacattgtatgacgaagatgttaactccggtgaaaaacaagcgatggatctgtatctctcttcatcgatattgagcaccagcagtacggccctgcatatggctgcggcagccgcagatttagtccccaatatttacggttttgccgtggggggctcacgttttggggcacttttcaatgctaccgctatcggtatcgagatttcttcatcagccacacgtattgccgcagataaaatcagccaatccgaaatataccgccgtcgtcgacaagagtgggaaattcagcgcaacaatgccgaaactgagctaaaacaaattgatgcccaattagctgctctggctatacgtcgtgaagcggcagtattgcaaaaaaactatctggaaacccaacaggcacaaactcaggcacagctggcctgcctgcaaaacaaattcagcaatacagcgttgtataactggctacgtgggcgattggcggctatttattatcagttttatgacttggctgtttccctgtgtttgatggctgaacaaacttaccagtatgaattgaacgataaggctgtacgcttcattaagcccggtgcctggcatggaacttatgctggtttgttagcaggtgaaaccctgatgctaaatttggcacagatggaaaaaaactatttggaaaaagatgaacgggcactggaggtcactagaactgtttctttagctgaggtgtatatcggcctgtcagataacagtttcacctttactgataagatcattgagttggtaaatgcaggtaagggaagtgccggtacagatctgaacggtttgaaggtggagggaacacaactacaagcaaacctcaaattgtcggatctggatattgccgcagattaccctgaaggtttagggaaaactcgtcgtataaaacaaatcagtgtcacgctgcctgcatttttaggcccataccaagatgtccgtgccatactgagttatggcggcagcacaataatgccacgtggttgcaaggctatcgcgatttcacatggaatgaacgacagtggtcaattccagatggatttcaatgatgccaagtacctgccatttgaaggacttcctgtggatgacacgggtacattaaccctgagtttccccgatataaacgacaaacagaaaaacttattgctcagtttgaacgatatcattctgcatatccgttacaccattcgttcttaa

SEQ ID NO: 4370 - DNA, 378 bp, Xenorhabdus bovienii
  Coding DNA location: Contig name=SeqID_16895; Position on contig =202370..202747bp; Strand=-
atgggctctcaggtggctgagtctcaggaaactctggagggagtgggtgacgttgctgcaacagcggcgatagaaggcgcattagcagggcgtaaattagctaaaacgcttggtcttcgtagtatagctgcccgtgtggttcaggctgtagcggatatagatatttcgccagctgctgtagtcgaaaattccagtactgctatttatgcccatggaaaaacatttctacatgtgagaacaaaagacactaacgattttgaagcgtttagaaatatagaggaaacattacccgcagacgggaatgcagggtggatgaatgatgccctggaaacagcattgggatggtttaaccgatcgaatcaagaaagttttgcctga

SEQ ID NO: 4371 - DNA, 192 bp, Xenorhabdus bovienii
  Coding DNA location: Contig name=SeqID_16895; Position on contig =202666..202857bp; Strand=+
atgcgccttctatcgccgctgttgcagcaacgtcacccactccctccagagtttcctgagactcagccacctgagagcccattgcagtcgcgcttgaggcaatacctaatcagcggaaactgtaccggaggcaattcctatctcagcgccagctacacttctgtattcatcagaccgcccctgttgttttaa

SEQ ID NO: 4372 - DNA, 507 bp, Xenorhabdus bovienii
  Coding DNA location: Contig name=SeqID_16895; Position on contig =202890..203396bp; Strand=-
atgagcaacgctattacgctgatcggtggattattcaacaatggactttctttgcccagtttctctcgaccgtcgctctctatgccatcactgtttgattttgatttatcgtttgatatcagcccagtaggtattatcaaaaagactgtagggcctgccataaagttcgtctacaagaaaacctataaaaaactgcttaattatgcgctgagtaaagcaaaaacagagcagcagaagagaaacattattcgtggattcaggggggtaagcattggtgtcggcgtcgcggttgccattgcgggggttgtgtcaacagcggggcttgcgatacctgttgccgttggtgctgttgccgcaggcggggctattgccggggctgtgggctttttttctgggcctatttctcgctctttatctaagatttatgctcgcctattttcagggcgcatttgtctacggctacaggtaatgttatggccggtggaagtggtggcagtgcgactgtag

SEQ ID NO: 4373 - DNA, 723 bp, Xenorhabdus bovienii
  Coding DNA location: Contig name=SeqID_16895; Position on contig =203396..204118bp; Strand=-
atgatatggacgctaactggcaggggaaacacgcccaatgattggaatgcgccattgtccggagacagttttaccactcggatgacgacggatgtactgacctataaccggcgcggtgaattatcccgggtcaatccggtcagccgtgataccgagatggatgaagaagggtatcgctataacgaagacagccagcgactggttaaagtcagtaaatacctgaatggtaatacccagcgaaaatcgcgaaccgtttatcttcccgggctggaattaagaacgatgttcaggggaaatacgctgaatgaagagttacatattataacagtgggccatgtcaggctgcttcactgggtatcaggccagccggcagccattcaaggcgacccgttacgttattcctatagtaatttcaccggcagcagtgtgatggaagtggatgaagccgggaaaattattagccaggaggaatactatccctacggtggaacggccatctggacagtacgaaaccagactgaagcagattataagtttcaccgatattcaggcaaagaaagggattcaaccggactttattattatggtctgcgatattatttgccgtgggcaggtcgttggctcagtgcggatcccggaggcattgttgatggattgaatatgttcagtatggtgcacaataatcccgtcaatggtaccgatagtgacggggggcatcattga

SEQ ID NO: 4374 - DNA, 627 bp, Xenorhabdus bovienii
  Coding DNA location: Contig name=SeqID_16895; Position on contig =204078..204704bp; Strand=-
atgtcacagacattatattcaggaaccccgtccgtagttgtcatggataaccgcggcctaaacgtcagaactgttcaatattaccggcatccggatacgctggatctgaccgatgaacgtatttcttttagtcagtatacccaagccggttttccggcgcggatcttttcaccccgtcaacatgatttatggaaaaacgacaaccgcataaaacccgacagagccagtatacaaagcctgagtggtatggctctccggacagaaggagccgatgacggcgttgccgcggcattaaatgatattgccgggcggccggtgatcagtattgatgcgatgggggtaaaacggcgatatttatatgaggcgcatcatctggccgggcgactgctgagtatttctgaacaggcgtcagggcaggaacccagtattgttgaacgctttatctggtcaggaaatagtcagcaagaaaaggcctataacctgattggagcctgtgcatcccgctacgatacggcaggacgtgaagcatgccagggcatatctttactgggaagtccgataagaataacccgacagctattgccaaatgatatggacgctaactggcaggggaaacacgcccaatga

SEQ ID NO: 4375 - DNA, 1812 bp, Xenorhabdus bovienii
  Coding DNA location: Contig name=SeqID_16895; Position on contig =204755..206566bp; Strand=-
atgtactggttgagccgggcgctgaaggggatgccgttacgcagtgaaatatatggggatgacgatacagaactggcggggacaccctattctgtcagcgagtcacgtcctcagatccgcctgcttgcgggaatgatggcagaggcgccttcagcatggccatcaatgctggaatcgcgaagttatcaatatgagcgcattgcagtcgatccacagtgcagtcagcagattgttctgaaaagtgatgcattgggctttcccgcagatattctgagtatcgcttatccccggcgccagaaacccgcagtgtcaccctatccggataccttgccggaaacgctgtttgacagcagttatgatgaccaacaaatgttattgcgcctgactcgtcagcgctacgaatatcatcatgtgattgacgaaacattatggctattgggactgccagcggtgtcgcgcagtgatacccgggtattatctcagaacgtcgtgcctgacggcggattatcactggaagggttcagtacggtttttggcactcccggtgccggacaactgcctaacacagaagatgactatctgggtcatgtgacagtgaactataccggtgctggtggtaaaccggattttcctccccgggttgcttacaccgaaaccgctgaatttaataaggcctcgttaaaaacctttgaggggatcatgagtccggatgagcgcgaaaaagagcttgaaaacgcgggctggcagtctgttccggtgcctttacaggacaacgggggatttaatgtctgggtgggacatcaaggttacaccgactttgcgggagcagaagggttttatcggccactggcgcaacgtcagacgctgatgaccggcaaaaatcttatcggctgggatacgcatttctgcgcggtgatccgggagcagagtgccacgggatcggttgcgtatgcccaatatgattatcgttttaacgtggccaatagggtaacggatgcgaacgataatatttctacttccacgtttgatgcgctgggaagagtgaccagcgtaagattttgtggactggaagaaggggtgatgcagggatacacccaacccgaagatgaagtgacgccgtttattgtgcctgctcttatccatgaagcccttgagctgaaacccaggatccctgtggccgggctggcggtatacgcccccctgagctggatgccgcgggtaacaccagaaacgacagaatttaaaaacgtatcccccgaagataatcgcatgggtcggctcgccctgagacgttatctgcgccgaaattccgccgcgagttttagctcaaattcctgccttccaccccatacgctgaatatttcaacggacagatatgaccgtgatccagaacaacaactccgccagagcctctctttcagtgatggtttcggaagaacgctacaaaccgcagccagacatgaagcagggcaagcatggcggttgagtgatgacggtacgattatcgcagatgaagccggattacccatcaatgaacacactgatttcaggtgggtggtatccgggaggacagaatatgacggcaaaggccaacctgtacggacatacctgccttactttctgaataactggcgatatgtcaaagatgatagtgcacgtcgcgatctcttcgctgatacaagctgttatgacccgctgggccgtgtctggcaagtggtgactgcggcgggttatctgcgccggacgttaatgactccctggtttgttgtcagtgaagatgaaaacgacacggccgcggaagtgagccaatag

SEQ ID NO: 4376 - DNA, 1230 bp, Xenorhabdus bovienii
  Coding DNA location: Contig name=SeqID_16895; Position on contig =206554..207783bp; Strand=-
atggtgaacgttcctcttccctttacactgtgccggccggactgtttttcccgttatcagtttggttttgaggttcgtacccgccgtctgtgtcagcaggttctgatgtttcaccgtctgcaggcgctggcggggggaaatgtcacaaacgaagtcccggcactggtgtcccgcctgattctggattatgacctgaacaaccgtgtttccctgttactcagtgcacgccatctggcgcatgaggccgagggcacaccggtcaccctggctccgctggaggtggattatcagcgttttgacaatgaactgaacctgaactggcagaagatgcccgagttggaaaaatttaatgcattccaaccttatcaactggtcgatttatacggtgaaggaattcctggcatcctttaccaggatgcacccggcgcctggtggtatcgggcacccatgagagacggggcatcagataacgcagatgcggccacctatgatacggcaaaaccgttgccatctattccggctcagcaggacagtgccatgctgatcgatttcaatggcgacggtcggctggactgggtggtgaccgccgccggactccggggttaccacacgatgacgcctgagggggaatggacgccatttatcccgctgtcttccatcccggtggaatactttcatccgcaagcgcaattggcagatatcactggctcggggttacccgatcttgcactgattggtccccatagtgtgcggttctgggcagataccccggggggatgggataaagctcaggatgtgggctgtcaggggagcattccgctgccgatcccgggacgggatgcgcgcaaattggtggcattcagtgatatgacgggttccgggcagccgcatctggtggaagtctctgctgacggtgttcgctgttggccaaatctgggtcggggacgcttcggtgaaccgttgacactgccgggttttcgaattaccggggaagcttttaaccccaatcgattgtatatggcggatatggacggctccggtaccactgacctgatttatgtccgcagtacttatctggagctctatatcaatgaaagtggctgccgcgcgaatactggcaaggggatgaacaggcttttgcaagctttacaccccgttttacccgctacgacacccccacaggcagtgaggtcaccatcacccctaatgaagaggaaatgtactggttga

SEQ ID NO: 4377 - DNA, 882 bp, Xenorhabdus bovienii
  Coding DNA location: Contig name=SeqID_16895; Position on contig =207713..208594bp; Strand=-
atgcagagttcaaaaaacctgaaactggagatgccgtcattgccgaaagggggtggttcactctatgggatgggggaatcactgggggcggtcgacccggatggtctggcatctttatcactgccgttgcccgtttctggcgggcggggagtcgctccatcgctggggttaagttacagcagtgcagccggtaatggggcatttgggatgggatggcagtgtgggctaggatcaatcagcctgcgtacgtctcaaggtgtgcctcaatatatgggagaggatattttcctcggcccttctggggaagccttgtcgattgttcctgacctaaaagggcagccagatcggcgcactgcgacctcattactgggcactgcgctgaaacaaccgcatatcgtcacccgctatcagccacgcattgtcagtgatttcagcaaactggagtactggcagccacaacagagcggtcaggataaacctttctgggtaatgttttccaccgatggacaggtacatttgctgggtaaacaccgccacgcacaaattgctgatccgaaagagacaacgaaaattgcctgctggttactggaagaaacggtaacgcccacgggcgagcatatctattatcactatcgtgccgaagatgatgccggttgcgattccagtgagctcaatcagcaccccggtatgcatgcacagcgctatctggcacaagtctgttatggcaatatttttccggaagccgcgtttattgcggtgaaatccggtattccggctgacgacgcctggttgtttcatctggtgtttggctatggtgaacgttcctcttccctttacactgtgccggccggactgtttttcccgttatcagtttggttttga

SEQ ID NO: 4378 - DNA, 279 bp, Xenorhabdus bovienii
  Coding DNA location: Contig name=SeqID_16895; Position on contig =208656..208934bp; Strand=-
ttgcctgcgggggaagatatccgggcggtactgaactatggcggcagcgtggtgatgccacgcggttgcagcgccattgccctatcccacgggatgaatgacagcgggcaatttgtgctggatttcaacgatacccgttacctgccgtttgaaggcattccggtgaatgacggtggcagtctgacgctgagtttcccggatgcgaccgaccggcagaaggcgatattgcagagcctgaacgacattattctgcatatccgctacaccatccgttcctga

SEQ ID NO: 4379 - DNA, 3009 bp, Xenorhabdus bovienii
  Coding DNA location: Contig name=SeqID_16895; Position on contig =208834..211842bp; Strand=-
gtggaaacttatgaccgttttacgctgaaactggcatttttacgtcatgacggcagttggagtgccccctggtcttacgatatcacggctcaggtgaaggcagtcaccgacgatcagcctgatgttgaacgattggggttggcggcttcaggctttcagggcgaggatacgttgctggtatttgtgtacaagactggggagagttacaacgattttggcgacagcaacaaagaggtagagggactatttgtatatgcggatggcacctgcaacccaatgaatgcgaagcagttgaatcgctattccttgataaagaatactttcgatattatctcttcggatagggggcatattgttaaacgcgccaattataaatttgctcaagattatgatattcctagctctttagcactggactccgctcccagtcaaaattcatttatcgctatagataatgcattgataccgcaaatatctcacgtccattcaagtgaagacttgattattacgctgaataatccgggatttactctaaattatcgagcaaatgatgatctaagacgccatcaattaattgcaatgaaagtttgtggcaagccagatcacacatttattttggcggataaggtaagtaaatatcttccttttccaaagatgtacgggccaattccagtttataacacaacaaataataccattggagtcgcacaaaactctcctttttatcttgggggagaagacaactacatagccttgaattcaggcagttccagagagtttttatttcctattaactcttttgagaatacaacaaactttcacgttggctcaaatcgccaagaaaaatttaaaaagtgcgagaccactttttatgtcttacgtctccggagttacctctactggcctatgtttatgtcgcaatcgaaagggtggtattattttgattcgaacatagatgcaaaaaacatcttcttttctgtaagaaaatccacaaaaaatcaagtctttaatgccaaggatgcagccaataaccttccgaaacccagctttgaaggaatgaattacgtatttaatcctgttattttgaatgcgtcagatctaacctttattaacaatatagagtccatagatgtctattttgaaattaaagataacgatggaaagagtattggaaaggcgagttttacgctgacgataaaaaaagtagattactctcaaaacaatattcttcacctatataacactgatgctggtgttcagtatatgcagcttggagtttatcgcattcgccttaataccctgctggcacctcaactggtgtccagagcgaatatcggcattgataccatcttgaccatggcgacgcagcagctgccggagccgcagttgggtaaaggcttctacgccacgttcaccctggcgccttacaacccggcgacgcatggtaccagtcgggcgttccagcttaaccttaaacatgtggttgatgataatgcgcacataatttattcggggttgctgcaggataccgagcttgcggttcggctctttattcccctggatgataaacccctgaggtcatacgttgccaaggtgtttttaaccactcagaagaatcccaatgacggtacatggaacggaccacactttacggatgatagcggtaaaataggtatccatgacagttcgaatgtcagtatgttcgctggggtacaaccccataacggtatcaccaccgaaccactggattttaacggcgcctgtgcactctattactgggagctgttctactacaccccgatgatgtgcttccagcgtctgttacaggaaaaacaattcgacgacgccaccaaatggatgaactacgtctacaatcccgcgggctatatcgttgacggggaaatcactccctggacctggaattgccgaccgttggaagagaccacctcctggcatgccaatccgctggacgcaattgacccggatgctgtcgcccaaagtgacccgacgcactacaaagtggccacctttatgcgcctgctggatcagcttattctgcgcggcgatatggcctatcgcgaactgacccgtgatgcactgaatgaagcgaaaatgtggtatgtgcgcactctggaattgctcggtgacgaaccggaggattacggcagcagccagtgggcggcaccgtccctttctgttgcagccagccagactgtgcaggcggtttatcaacaggatcttgctgcgctggaccgtggagacgtttccacgcagtcccagccccgtaccgctaattctctggtcgggctgttcctgccggaatataacccggcgctcactgattactggaaaaccctgcgcctgcgtctgtttaacctgcgcaacaacctttccattgacgggcagccgttatcgctggcgatctacgccgaacccaccgatccgaaagcgctgctcaccagcatggtacaggcgtctcagggcggcagtgtattgccgacaggcactttggcgctatatcgcttcccggtcatgctggagcgggcccgcaatctggtggcgcaattgacccagttcggggcttctctgctcagtatggcagagcatgatgatgccgatgaactcaccacactgttactgcagcagggcatggagctggcgacacagagcatccgcattcagcaacggacagtagacgaagtggatgccgatattaccgtattggcagagagccggcgcagtgcgcagaaccgtctggagaaataccagcagctgtatgacgaggacatcaaccacggagaacagcgggccatgtcgctatttgatgcggcggcaggtcaatccctggccgggcaggtgctcacaacggcagaaggggtggctgacctgctgccaaacgtgttcggctttgcctgcgggggaagatatccgggcggtactgaactatggcggcagcgtggtgatgccacgcggttgcagcgccattgccctatcccacgggatgaatga

SEQ ID NO: 4380 - DNA, 3009 bp, Xenorhabdus bovienii
  Coding DNA location: Contig name=SeqID_16895; Position on contig =211815..214823bp; Strand=-
atgtttggctcccgctcttcttcctttgtgaacccaggctccgtagcctccatgttctcgccggccggctacctcacagagttgtatcgtgaggcgaaagagctgcatttcacaagctcggcttatcatcttgataatcgccgcccggatttggctgacctgacgctgagtcagaataacatggactcggaaatctccactctggcactgtctaatgaactgttgctggcgcatattacccgtcagaccgaaagtgacgcggaagcactgatggagagcctgtcgacttaccgccaggccgttgacacgccttaccatcagccttatgaggctgttcgtcaggtcattatggcgcatgaccgtaccctgtcagcattgtcccgtaacccagacgtcatggggcaggcggaaggggcttcattgctggctattctggccaatatctcaccggaactttataacatcctgaccgaggaaattacggaaaaaaatgcggatgcgttatttgcgaaaaacttcggtgaaaatatcacgcccgagaattttgcatcacaagcatggatagcccagcattatggccttgaactttctgacgttcaaaaatatctcgggatgttgcaaaacgacttttctgacaacgtctcggtttatattgataatatttcaacgggcctgttgacggaccaggaagataaacttgaagcttacaagataacccgggttcctggtggagattatactaaacacctgaacttttgggacctgctctatcaaggcgacaaccatttcattatcagagccagttttaaaaaaagtggtggcgctctcacaatccgtaaaagtaacgtgggaacgaccaacggtagcaaggccataggttctatctctgcaccaaccgatgcgaatacagtttatcaaagtggcgtgttgtcaccgcttaccgctgatgagttgaaaaagggggcaacaatatttgattttaatcgcagcggcaatggacagattgggtggactgctgtctttactttcgaaagttatcctctgagcattttcgccctcaaactgaataaagccattcgtttgtgcctggctagcggactttcaccgaatgaactgcaaactatcctactcagtgataattcacagggcatcatcaacgactcggttctgacccgagttttctacacgttgttctacagtcactcttatgctctgagctttgatgaagcgctggtgctgagcggagccatcatcaatcagtgtgtcgacgacgacagcgtcagtcactttaaccgtctctttaacacccctgcgctgagtgggaaaatctttgaagctgacggcagcacggtcagcattgacccgggtgaggagcaagcgacctttgcctgttcggccctgatgcggggcttgggcgtcaatggcggtgagctgtatcaactagctaaactggctggtgtgatggacataaaaaataacatcaccctttctgtccccgtgatcacttcgctttatcgtctgacgttgctggcccgagcccatcagctgacagtcaatgaattatgtatgctttatggtttttcgccgttcaggggcaaaacgacaacttccctgtcttctggagagttatcacgattggttatctggttgtatcaaatgacgcaatggttggttgaggcaggaatatccacggaagcgctctggttgttatgtacacccgagttcagcaggaatatttcaccggaaatcagtaatctgctgaataccctcaggccccgcctcagtgaggagatggcgcagagtgacaatcgggaactacaggctgaaattctcgcgccgtttattgctgctacgttgaatctggcgtcaccggatatggcgcgttatatcctgttatggacagataatttgcgaccgggcggcctgaatatcgccggatttatgatgctggtgctgaaagagacgctgagtgacgatgaaacgacccaactggtgcagttctgccatgtgatggcgcagctgtcgctttccgtgcaggtgctgcgcctcagtgaagcggagctgtccgtactggtcatctctggctttaccgtgctggaaaccaaaaatcagcctgccgggcagcacaatattgataccctgttatccctttaccgattccaccaatggattaacgcactgggtaaccccagctctgacacgctggatatgctgcgccaacagacgttgacggctgacaggctggcttcggtgatgggtctggacatcagtatggtgacacaagcgatggcctgcgccggcgttagtcgccttcaatgctggcaggatattgataccgtgctgcagtggatagatgtggcatcagcactgcacaccatgccgtcggttatccggacgctggtgaatatccgttacgtgaccgtaccgaacaaggccgagccggagctaccttcctgggaggagtggcagaccctggcagaaaatatggaagccgggctcagtgcgcaacaggctcaggcgctggcagatcataccgcagagcgcctgagtagcgtgctgtgccttgacccgacccagcgtatcgggcagacacggatgatggatgaactgctcgaaaacatcagccagagcaagcttagccgggatacggtggaggaggcctttaaaacctacctgacccgctttgaaactgtggcggatctgaaagtcgtcagcgcctatcacgataacgtcaacagtgacaccgggctgacctggtttgtcgggcaaacgcgggaaaatctgccggagtactactggcgtaacgtggatatctcacgcatgcaggcgggtaaactggcggccaatgcctggaaagagtggacgaagattgataccgcactcaatccctacggggatgcggtgcgtccggtgatgttcagggagcgcctgcaccttatctgggtggaaaagaggaagtcgcgaaaaatggcaccgatccggtggaaacttatgaccgttttacgctga

SEQ ID NO: 4381 - DNA, 312 bp, Xenorhabdus bovienii
  Coding DNA location: Contig name=SeqID_16895; Position on contig =214793..215104bp; Strand=-
atgtacagtgcggatgtattactgaacaaaatcagtcctactcgcgacggtaggacgatgactctcgcagaccttcagcacctttccttcagtgaactgagaaaaacatttgatgaccaactcagttggggtgaaagccattatctctatcgtgaaactgttgaacaaaaaaacgtcatcgcctgctggaagcccgtattttcacccgcgccaacccgcaattatccggcgccatccgtcggggtattgaacgagacagtgcttcacgcagttacgatgaaatgtttggctcccgctcttcttcctttgtga

SEQ ID NO: 4382 - DNA, 1749 bp, Xenorhabdus bovienii
  Coding DNA location: Contig name=SeqID_16895; Position on contig =215595..217343bp; Strand=+
atgaataaatcattatgtaattcagcattaaaattaaatggttatttaggcatagagaatgacgaatcatctgataatatttttaatatacttaaaactccctgcaatgattaccagtcgtcagtaaagaaatttataaagctacttaattacattcaggataataatattgatataacatcatttaatgaattggttgcgcttcatgaactcgtagctccgcatgatgccgctgtagtttctatgatgtcaattcattttaatctggccatagggactatcgccaacttaggtgctcaaacaccatatatagaaaatctataccaacagctttgttcaggtagtgctattggcgtatatctggcgactgaactggcttacggtaataatctgatagcaatcgaaacacaggctgattatcttccggaaaaaggtgtgttcatacttaattcacccaatcctggtgcatataaatttatgcctaataccctaccatgtgagttaccaaaagtagctgtaattttagctcaactaaatgtatcagggaaaaaatatggtattttcccgtttgtactccctctgtcagtaagtggtcagttaactgttggagttaaaatcacttcacttggcgataagccaggattttatcttgataacgcaataacttcatttgataacgttgaaattccttttgaagggctccttgctggcaatatgatcacattgaccagaaatggtcaggtatcattacatactaaaagattaaaagagcggttttcgttaattacaaaccgaatacatactgggaaattatgcatggccgtaagctcggttgcaggggctaaatcggctcttcatatcaccagtacatatggtaataaacgacaaactttcggctactcaggggctatgccaataattaattattttcatttcagagagggcgtagcttgggataccctgagtacggtcacacatgcattatatttaagagaattaaccaaaaaagtttcagtaatgctatcaggctctgttaaaaattttaaattctcagatgaagtacttattgaaattattactgcaaagtccttgtgcacatggcgtacacaagaaatattaattaattgctgtgaacgctgtggcgctcatggattattttctatcaacaagataccccattatttaatgggcaattttggtgcaattaccgccgaaggtgataacgttgtactctccctgaaggctggagagatgatttttattggtggaataaaaaataataaagaaaatgttcagcatgatttatttttcattctgaatgattatatggattttttattacaaaaactgaataaattaatagtcagtggcagtaaaaaaacaaatttcgatgctgttaataagtatagcggtgattttctggagttaagccagacatatgctgttttatccgtagtgacgacaatcattgatgcatatcacactgatgacattgacatgattatcgaaggttatcttctcgactgggttcaccgtaccatgagtaacctcttaataggtgaagtcattgattttcaggaagctaaaaaaatagatgaaaggcgcatagagtatatacgtaaatacgcagaaaaaataaatgattatatttccgagtttgcagtggataaatctggaattgaaacaccaatatccagtgatgactatatatcctggtatgcaggaaatcataatcagttaaaaaattaa

SEQ ID NO: 4383 - DNA, 1389 bp, Xenorhabdus bovienii
  Coding DNA location: Contig name=SeqID_16895; Position on contig =217551..218939bp; Strand=-
atgtcgaacggagtagttacagcggcatatattgttgccgccattttatttattttcagccttgccggcctttcccgccatgaaagttctaggcgaggtaatatctttggtatagccggtatggcaattgcgctgattgccactattctgggacccgatgctggcaaagtaggttggattattttggcgatgatcatcggtgctgtcattggcattcgcctggccaaaaaagtggaaatgaccgaaatgcctgaattggtcgccatcttgcacagctttgtcggtctggcagcggttttggtcgggttcaacagctttattgcccatgatatttttgttgctcccattatggaaaacattcacctgacagaagttttcttggggatcttcattggtgcagtcacctttactggctcaattgtggcattcggcaaattgcgcggcaaaatttcatccaaaccgctgatgttaccccaccgccataaactcaatttggccgcgttgattgtttcctttgtactgatggttatctttataaaaacccaaagtgttggtttgcaagttttcactatgctagtgatgactgctatcgcacttgctttcggttggcacttagtgtcgtcgatcggaggggcagatatgcccgtcgttgtttccatgctgaactcatattcaggctgggcagccgcagccgctggtttcatgttaagcaatgacttgctgattgtgaccggtgctttagtaggttcttctggtgcaatcctttcttatattatgtgtaaagcgatgaaccgttcttttattagcgtcatcgccggtggttttggtactgatggtacttcaacgggtgatgaacaagagatgggcgaataccgcgaaacaaacgcggaagacgttgctgaactgctaaaaaattccacttcagttattattacgccaggctatggtatggctgttgctcaagcgcaatatccggtacatgacatcaccgcaaaattgcgtgagaagggcgttaaagttcgctttggtatccatcctgttgcggggcgtttaccgggtcacatgaacgtgttgcttgctgaagccaaagttccttacgatattgttttggaaatggatgaaatcaacaatgattttactgagacagataccgttctggttatcggagccaatgacacagtaaaccccgcagctcaagaagatccacacagtccgattgcgggaatgcctgtactggaagtttggaaagcacaaaacgtaattgtctttaaacgttctatgaatacaggatatgcaggagtacaaaacccgttgttctttaaagaaaatacccagatgttattcggtgatgcaaaagccagtgtcgaagcgatcctccgtgcactgtag

SEQ ID NO: 4384 - DNA, 1533 bp, Xenorhabdus bovienii
  Coding DNA location: Contig name=SeqID_16895; Position on contig =218950..220482bp; Strand=-
atgcatattggtgtaccaaaagagcgactttccaatgaagctcgcgttgctgccacaccatcaacggtggaacaactgcggaaattggggttcagcgttagagtggaaacaagggctgggcatcttgccagttttgatgatattgcttatcaaaaagcaggagctgatattgcagaacatcatgaagtttggcaatcagatattatttttacagtgaatgccccggaagataaagaaattgccctgatgaaagaaggggcgacgctggttagttttatctggccagcacaaaacccagaattaatgacaaaattgtcagaacgtaaagtaacggttctggcaatggatgccgtaccacgaatttcccgtgcgcaatcactagatgtcctcagttcaatggcaaatattgctggttatcgggctattgttgaagcggctcatgaatttgggcgcttcttcactggccaaattacagcagcaggcaaagtaccaccagctaaagttatgattatcggagccggtgttgcggggctggccgctatcggtgcggcaggaagtcttggcgctattgtccgagcttttgatacccgtccagaagttaaagaacaggtacaaagcatgggtgctgaatttttggaattgaatttcaaagaagaagctggcagtggtgacggctatgcaaaaatcatgtcagaagcctttatcaaggcagaaatggaattgttttctgcacaggcaaaagaagttgatattatcgttacaacggcattgattccggggaaacctgcaccgcggctgatcaccaaagaaatggttgagtccatgaagcctggcagtgtcattgtcgatttagctgcgcagaatggaggtaactgtgagctgacggaggctgataaactcgttgtgacaccaaatggtgtaaagatcattggttataccgacttgcctagccgtttacccactcaatcgtcacaactgtacggcacaaatctggttaacctcgcgaagttactgtgcaaagagaaaaatggcgaaatcactatcgattttgaagatgtcgttgtacgtggcgttaccgtaattaaagagggagaagtcacatggccagcccctcctattcaagtttccgctccacccaccaaacttgcgacgctgaagaagaaagaagataaaccagcagcaaagccgagatctccgtggttgaaatatggtttgtttgctcttgccattatcctgttcggctggttggcaaacgttgcaccgaaggagtttttgtctcactttaccgtatttgctttgtcttgcgtggttggttattacgtcgtctggaacgttagccattcattgcacacacccctgatgtcggtcactaatgccatttcagggatcattgtcgttggggcagtcctacaaattggtgaaggtggatgggtgagtttcttctcattcatcgcggttttaattgccagcatcaatatttttggtggtttcaccgtcacccagcgtatgctgaaaatgtttcgtaaagggtaa

SEQ ID NO: 4385 - DNA, 978 bp, Xenorhabdus bovienii
  Coding DNA location: Contig name=SeqID_16895; Position on contig =220826..221803bp; Strand=+
atgcgcaaggctaaaggattttttatgaagctgaagacaacgatcatcgctacagcgatgctctcgctaacaacgattactgctgcacatgcggctaaagaattaacgccagaacaagctgtagagctaaagccatttgaacgaatctcagtcactggccgtttcaatgcaatctatgaagctgctgatgcgatttcccgtcaggcggataaaaaaggcgcctatagtttctatatccaaagtctcgacgattttaatggtggtggtaatttacgtgttgtagccgacttgtatcataaagatgcagaaaaatccgataaaacaactaactatcgcatttatcgtggaattaaagagctgcctaaaactgaagccattacgctggaaccttttgatactgtaaccgtgaatggttactttgctactgcccctgatctgaaagaggccatcgctaaggctgctaaaaagaaagatgctgcctctttctttattgttcgtgatatttctcccaataatggcggaaaccaaatagttactgcatatgtttataaaacagatgcaccgaaacgtcagatacagtctaataatgcggttattccagcagattcggagactggccgtcaggcactggctcaaggcggcgaagaagccgagaaagttgaaattccaggtgttgcttcctcaacttctaccagcaatttggttgggcgattttttgaaacccagtcatcaaaaggtggtcgttacacggtcacgttatctgatggcacaaaaatggaagaactgaataaagcatctgccgctcaaatggttccttttgactcgattaccttctctggttattacaccacggatccagaaatttcttatcaagtggctaaacgtgcagcgaaaaaaggcgcgaaatactatcatgtcaccagagagtggcaatccaatggtggtaacatcactgtcagcgctgatttattcaaataa

SEQ ID NO: 4386 - DNA, 126 bp, Xenorhabdus bovienii
  Coding DNA location: Contig name=SeqID_16895; Position on contig =221920..222045bp; Strand=+
atgcataaaatttatatttttttgcatagtcacccattgcatacaatcctttcactccgtagaatcgccctgtttttggatttaacgactgaatcttctctgcaatccagagcatggatgcaataa

SEQ ID NO: 4387 - DNA, 1470 bp, Xenorhabdus bovienii
  Coding DNA location: Contig name=SeqID_16895; Position on contig =222046..223515bp; Strand=+
atgtccaatatgtgttcgatattcagaacaagtgttctgactaatcgtgtcgattatattactttcaggaacctatctttggaaaaaaaattaggcctcacatctctgacagcactggtacttagctccatggtgggagcgggtgtattcagcttgccacaaaatatggcacaagtaggcagtcctgctgcattaatgattggttgggggattacaggcgtaggtattctctttttggccacttctttgctattgctttcacgtcttcgccctgacctcgacagtggaatttttacttatgcaagagaaggatttggcgaattagttggtttctgttctgcatggggatactggttttgtgccattattgccaatgtttcttatctggttatcgtctttgcggcattaagtttttttactgacaccgaacattcagttattttcggtgatgggaatacctggcaatctctgattggtgaatctattttgctttggtttgttcattggctcgtactccgaggagtacaaactgcggctagtatcaaccagttggctacagtggcaaaactgttaccattgggtatgttcatcattttggccgtaatttcattcaaaatggatgtctttacgtttgacttcactggcattgaaatggggatacccgtttggcaacaagtcaaagatacgatgctgatcaccttgtgggtttttattggtgttgaaggtgcagttgttgtttcagccagggccaaaaagcgcaaagatatcggtatcgcaactgttctcgctgttgtttcagcattaggcgtttatatcctggttaccctgctctctcttggattggtagcaagacctgaattagcggcaatgcgcaatccttcaatggcaaacctgatggtagggttaattggctctgtgggtgaaattgttattattgctggcctgatcatttccgtttgcggtgcttatttgagttggacaattatggccgcggaagttcccttcatcgcttcgttacatggctcatttcctaaggtattcaataaacagaacgctaaaaaagcacctgagtcatcactgtggataactaatggagctgttcagatttccttgatcttaatctggttaagtggcagcaattacaacatgttgctttctattgcatcggaaatgatcctcgtcccctactttctcgttggtgcatttttagtgaaagtagcatttcaacgtagtaaccgggttttgttgttgattgctgtaggggcctgtacttatggtgtgtggttactttacgcatctggtttaatgcatttgcttctttctgttgtattgtatgcacctggattgcttgttttcttgtatgcacgtaaacagaatcagggacaaaagccactgaatatactggaaaaatcaactattgtgcttttgatactaatgactatcccctctacatggttactaatacattaa

SEQ ID NO: 4388 - DNA, 459 bp, Xenorhabdus bovienii; identical to SEQ ID NO: 2154
  Coding DNA location: Contig name=SeqID_16895; Position on contig =223877..224335bp; Strand=+

SEQ ID NO: 4389 - DNA, 306 bp, Xenorhabdus bovienii; identical to SEQ ID NO: 2153
  Coding DNA location: Contig name=SeqID_16895; Position on contig =224413..224718bp; Strand=+

SEQ ID NO: 4390 - DNA, 135 bp, Xenorhabdus bovienii
  Coding DNA location: Contig name=SeqID_16895; Position on contig =224882..225016bp; Strand=+
atggtaaagtattcaattacaaaaataaacacgtttaaaatcgcatttattttcacggaatttcatcaactaataattaatcttataaaacagaataaacgttcatccgcggtggaaaaacattccattttctga

SEQ ID NO: 4391 - DNA, 138 bp, Xenorhabdus bovienii
  Coding DNA location: Contig name=SeqID_16895; Position on contig =225070..225207bp; Strand=+
atggcgagttattatttttatctttgtcaattaatcgctactatattcttcgaaatatctgtcgataaagaaacgttaactaacgtctctttgttgtgtttcggtataaattcggacaaatcacttgctgtatcataa

SEQ ID NO: 4392 - DNA, 534 bp, Xenorhabdus bovienii
  Coding DNA location: Contig name=SeqID_16895; Position on contig =225283..225816bp; Strand=+
atgaaaaccaatctaattatttcctctttatttgtatcatctgtatttgtatccgcagcatatgccgccgatggacaaatcaaatttacaggcgacattaccgcaactgcatgtaaaattgatcctagttctgcaaaccaaactgttaacatgggtactatcagttcaagttcattcaatggagtaaatagcgcatcagccgcaacacgtttcagtatcacactgactgactgccctacagaagttaattatgcccaagttaaatttgatggaaatccggatagccgaaataataaccttttggcattaaacaacgacaatccaaagaaaaaagcggctgatggagttgcactcggtctttatgaagccgatagcgcaactcttatttctctggcgcagccatccaaatctcagaaattgactaataaatccaaacaagaattgaattttattgctaaatatattgctacaaattcaactgttaaccctggttccggtgatgcggtagccaactttactattgtctacaactaa

SEQ ID NO: 4393 - DNA, 705 bp, Xenorhabdus bovienii
  Coding DNA location: Contig name=SeqID_16895; Position on contig =225906..226610bp; Strand=+
ttgtttggagcaaccactttgaaatattttcgtgtttttattttcattattatctacattttcagcaccaatatttcttttgctggtatcgttatcggtggcactcgtgttgtgtatattagtgaccgaaaagaagcatcaatctccgttagcaatcctgaaacagatgtttcttatcttattcaatcatgggttcaagatgaaaataatgaaaccaaagttccttttattatcactcccccactattcaaattaaccgccggaaatgaaaatattctgcgaattgtaaaaactggcgaaaacttgccaaatgataaagagtctcttttctggcttaatgtcaagtctatcccaggaacagtgaaatcagatcagaaccaattgcaaatcaccgtgaaatcccgctttaagctattttatcgccctgtcggtttagcagacaacgccagtattgcctacaaagcactgaggtttaaaaccgtaggacataagctaatcgcagagaacccaacaccatactatatctcgttttcggatctaaccactgaaaataattcaataaatcatgaaataaaaccggcgggtatgatatctccttatggtcaattaagttgggatattcccgttaaaaatatcaactatgtcacttggaaaaccatcaatgattttggcggtgtaacgccagaagaaaaacgcatgttctga

SEQ ID NO: 4394 - DNA, 2550 bp, Xenorhabdus bovienii
  Coding DNA location: Contig name=SeqID_16895; Position on contig =226650..229199bp; Strand=+
atggataactaccgtcattatcttcaacataatatttctgataattgggtattatttatcaagccaagcaaagtgtttttatatgctgtaacaatcacatggcttttcactcattataatgaggcttatggtgaagaatatttcaatatcaatgcgttggaaactcactccggctttccagaagatattgatctatcaatttttactcaagataatcagcaactacctggccgctattgggtggatatttacctcaatcgggaaaaagtagacactgggaatgtcgattttagcattgtaaaccataagctatcgccgaagattaaactacagcggttaaagaagatgggagttagtattgactcattcccctccttacgtgatttaccacaagaaacagaaatagctgatcttgggcaatatattccatctgcatcatcttttttcgacttcaataagcagcggcttgatatcagtattccccaagccgctctgaatagccaagtcagggattatgtttcatctcatttgtgggaacaggggttaacctctctgctggttaattataattacagcggttcaatcaattggctgaataatcaacctggatcgacaagcaacaattttctcaatcttagaacaggcgccaattggggagcatggcggttgcggaattactctacttacagcagccaaaaccacaaatggcaaagtcttaacacttacctacaacgtgatattcatgccctgaaaagccagttggtatttggtgacagttatacaccttcaaccatttttgatggttttcaatttaggggaatgcaattagcttctgatgacaacatgctgcctgatagcctgaaaggatttgcacccacgatacggggaatagcccaaagtaatgctcaagttaccattaaacagaatggttatatcatttatgaaacctatgtttctgctgggccttttgttatcagcgatctctaccccaccacatccagtggtaatctggaaattattatcaaggaagcggatgggagagaacatcgttctgtacagcctttttcagccgtgcctatcatgttacgggaaaatagttggcgacactccctgactctggggaaatatcaatctttcactcatcgtggcaaagaaccttattttatgcagggtatggtgatatatggtatttccaaccgtgtgacggtttatggtggaaccaccctctcaaaagattatcaatccgctgccttcggtacaggatatagcttttctgattggggttctctctcctttgatgtcactcatgcaaaatcagatttagctgagaatttcagtgattcagggcagtcatatcgtttccagtatgcaaaagatctttcccaaacaggcactaacctcactttagcgggttatcgttattcgactcaccgcttttatgattttaaggacgccaatgagatcgatattacagacaacaaagataaccgcagcaacaccaataaacgcagtaaattacaactgcatgtcaaccagtcactggggaatttgggaagcgtttatctatctgcttttcagcaaaattactggtaccaacaaggttacgaacggaacatcagtgctggttacaataccagttatcattcaattaattataatctgaattatacctacagtgaattccccggctcaaaacacaatgagcagattttatcattcagtgtgcaaatcccgcttgatcgctggctgaaaaatagctgggtaaattataacctgaccaacagtaaaaacagggatacgtcccatcagatcagtctcaatggtacagccctggaagataacaatctgatttacagtatccagcaaaattatacccatcacgataaagatattggcgggaatatcagtgcggaatacaaaggtgcatatggccagatcaacgcgggttacaattacgataaacaatccaaccaactgaattacggcttaaatggcggggttgttgcgcatccttacggtgttacgctttcccaatcattgggagatacactggcattagtacgtgcccatggtgccaaaggggttaaagttcaaaatcataccggtatttcaacagactggaacggctatgccatcgtaccttatgtgagtagttatcgtaaaaaccgtattgctctggatacttattcaatgggcaacaatgttgatattgatatcaatacgcaaactatcatcccaacccaaggctcattggctttagccaatttccaaacccgtattggctatcgcgttttaatggtgctttcccatgaaggtaaagtaatcccatttggcgcaacagcaacactggaaaaacaacatgatatcgatgacgccaacaacaccattgtcagtaatgatggacaggcttatttcagtggtgttcctaagacaggtcggttatgggtgaaatgggggtacaaggatattcaggaatgtcatgtggattatcaacttcctgatgaaataccgacatcaggtttgtacatggtgaatgcagcctgtgaataa

SEQ ID NO: 4395 - DNA, 1002 bp, Xenorhabdus bovienii
  Coding DNA location: Contig name=SeqID_16895; Position on contig =229248..230249bp; Strand=+
atggttaacggcttaaaattattattagcaagtacgtttatcgcgggcataatgagtagttttaatgctctggcaaattatgactgccaatattcgccgagtttttcagccggtactacatatgtctcttttggcactatcgttattcctagagattatccgattggaacaaccatcaaggaaattcgtcttgatgaagtgaatgaaaaaggcaatattgccctctgtaatacaaccacacctacgtcatgggaaaggccggactttgatcccgcacactacaactatgatgcgatttatgaatctggagtgcctggggtcggtatccgcatcaatacatggggacccggctatggtattgattggctacccagaacagtgacatacccagtcacttgttccccgccgagtcagtttccaaataaaaagcaatattgtggccgaacatggggttatttgaccgttcaattaatcaaaattacgccaacaaccggttcagggccaactcatcagaggctgctgaccagagctaaattggggctcgatctccctattcatgctttctttttgacaaatacttatatcatgactcaggggtgttccctcaaacaaaaaacgaccttcgtcaatatgggagaagtcagaaccagtgcgtttcgcggcatgaatagcacagccggcatgcgaaatttcgaattaaatctggattgcgatgcgaatgttaaagttggcgtgacgctggatggacgacctgcaaaaagcaatgccaataatatctgggcattggattataatagtgacaacgtcacggcaaccggaattggtttgcagatcttgtaccaaaatcaaccgttatcaatgggttctccgcttataattcactccggccaagtaataggcaattttgctattccactgcacgctcgttatatccaaacagaaggacgggtgacaccaggcaaggcagatgcaacggcaacgattacgttgacctatcaataa

SEQ ID NO: 4396 - DNA, 297 bp, Xenorhabdus bovienii
  Coding DNA location: Contig name=SeqID_16895; Position on contig =230103..230399bp; Strand=-
ttgtacgataattattcgtttaactgttatcgtcctctgggcaacgaggtaaaattgcagcctttcggacaatccagccaccaaaagaatagcccaagaagtgaaaaggcctttgggctgtgtttggcggatcgtcttggagatttgcatttattgataggtcaacgtaatcgttgccgttgcatctgccttgcctggtgtcacccgtccttctgtttggatataacgagcgtgcagtggaatagcaaaattgcctattacttggccggagtgaattataagcggagaacccattga

SEQ ID NO: 4397 - DNA, 96 bp, Xenorhabdus bovienii
  Coding DNA location: Contig name=SeqID_16895; Position on contig =230496..230591bp; Strand=+
atgcaccccaacatcctcgcttacgatgtttctgccagaaacaaagtatcgacatcaaggtataatttagttaatttacctacaatcactcattga

SEQ ID NO: 4398 - DNA, 11538 bp, Xenorhabdus bovienii
  Coding DNA location: Contig name=SeqID_16895; Position on contig =230741..242278bp; Strand=+
atgtcacacagccaaaatcgctcctcagaaatttccttagccgttgataacaacaattctcttcttcctcatgcacacccgttgagttctcctcagcaagtcatctggctcgatcaggttatccatcccggttctcccaattacaatatcggtctttttacctgcatcgacggtgaattggatgaagccttgttcgctcgtgcttttgaagccgttgtttatcgtcatgacacactgcgtttacagctcatcaacacccacaccttaccgctgcaaaaggtgactgatacgctccccgtgttcatggacatacacgatttctctccgcatatcgacgcagaagcccaaaccaaacaacatatcgatgccgagtttatgcgtccgttccacttggatggagtgctatggcgtagcgaattattacgggtgagccatacacgccggtactggcagttttgctgtcatcatttgatcatggatggtattggtttatccatactcagtgaagatgttgtcgatacctacaatcgcctaatgaggggagaaacgctgaacagaactgctccttcttatctgaatttcattacggatgaccgagattatctggcttctcaacgctactcacacgatttgcaattttgggtgaaacgctatgaaagcctgccgccgccattgctcccaactgccaatcccaacaaagccgcaagtcacggtcaagccaaacctattttttggcaaatagacaaggcgctttttcaacgcatcgaagacaccgtagctcggcagggattatccgtcctgcattttatgtataccgttctggctagctatttcagccggacgacgggggcggatgaaattgtcatcggcattcctgtgcacaaccgcaaaaatgcccaacaaaaaaacaccatgggaatgtttgcatccgttattccgattggcgtgacaatttcaccagaagacacgttccttgatgtcatgcacaaagccgctaccgaattgcgtcgttgctataagcaccaacgttttcctattgcagagatcaaccgacaaacacatattcagcagaaaacggggcgtgttcaattatttgacattacattgtcactcgaaccgtttaaagccaacctgcatatggcaggagaagataccaacatccaattttttgatatacaccatggtgtaccctatcctctttcgatcatcatcaagcagtacacaaccggtcttggcgatgaccttcaacccatcacaattgaattcgatttctctaccgattacctgagcacctcagaagtcatggctctccaatctcgttttgccgtattgatcgacgccgccatcaccgctctggatacgccgatagtgaatttgcccatcttgcccgaggctgaacgccaacagatattggtggacttcaatgccactcaagccaatttcccgcaaaatgcattaattcatcaattgttcgaagcacaggtacaacgcaatcctgacgctatcgccgtggtctttgaaggccaatccctaagttatgacgagcttaaccgccgcgccaatcgtctggcccatcatctgattgcgttgaatgtgcgcccagacgatcgggtggcgatgtgtgtcgaacgcagtctggatatggtggtcggtttattgggtatcctcaaggccggcggggcttatgtaccgctcgatccggcctatcctgccgagcggttggcatatatgcttgatgacgcagcaccagtggctctgctcacacagacggtactgctcgacacactggtcagcagaatcatacctacgctagtgctcaacaagcccgaatcgactatagcaacgcaaccaacccacaatccggacgcgcaagcactcggcctgacgtcacaccatttggcctatgtgatctacacttcgggatctaccggactccccaaaggagtgatggtcgagcatcgcggcctgagtaatctgatctcgacacagcaggatgccctggcaatcgagccaagcagtcatatcctgcaatttgcctcaaacagctttgacgcctgtatctgggaatgctgcatggcacttctgggaggtgcctgtctccatcttgcccagcgcacacatctcctgcccggtgcagcactactggatactttggaatcccatgccattacccatgtgttgttgtcgccaacagcgttggctgcactggattccgttcctgtgacactacagaccctgatcgtaggcggagaagcctgcccatcctcactgatcaaacgctgggctaccggtcgacgcatgcttaatgcctatgggccgactgaaagtacgatctgttcaactatttatctgtgcgataaccaaaaagaagggactccgcctatcggcagtccaatctccaatactcgtatctatatccttgatccgcatggacagcccgtcccccttggtgtggcgggggaaatccatatcgccggtgttggcattgcccgcggctacctgaaccgtcctgaattgacggcggaacgcttcctgcccgacccgttttccggcatgccggcagcacgcatgtacaaaaccggtgatcgagggcgctggctggctgacggcaatatcgaatacctcggtcgtaacgattttcaggtcaagttgcgcggcttccgtatcgaactgggagaaattgagtctcaactggtacaatgccacggcgtgcgcgaagcagttgtccttgcccgagaagacatttctgatgaaaatacaccgggtgaaaaacggctcattgcttatctgctcgccgaaccaaatgtgaaactggtgccagcggaactgcgccagcagctcgcacggcaccttaccgaatatatgctgcccagcgcttttgtaacactcgacaccttcccgctaacgtccaatggcaagctcgaccgtcaggctctacctgctccggatcagatggcggtcgtagcgcgcggctacgaagcacctgccgatgaaatggaaacggcattggctgagatttggcaaatgttattggggctggaaaaggtgggacgttatgaccatttctttgagctcggtggtcattcgctaatggcagtgaacctgatcgaacgactgcgtcgtcggggctgggttcttgacatccgtaccgtcttctccacaccagtgctggccgaaatggcgcaagcaatgctgcttactcaagacagtgctgccgctttcaccgtgccacccaatctcatccctgacggctgtaccaccattacgcctgatatgctgtccctgatatccttgtcccagcgcgagattgatactattgccgccaacatccccggtggtgccgctaatattcaggatatctacccactcgcgccattacaggaaggcattctgtttcatcacctgttacaaccgcaaggtgatacttatctattacgcagcctgctcgctttcgacacccatgaacgcctcactgccttcctgacagccttacaacaggtcattaaccgccacgatattctgcgcaccgccgcctgctggcagggattagcacagccagtgcaagtcgtctggcgtcaggcccctctgcgcaccgacacgtttgtgccgaccagtgacaaggacgtccaatctcaatttctggcacacaccgacccacaccagcggcgtctcgatttgcgtcaggctccgcttttctccatcgatatcgcccatgatccgatccagaacgagtggttgctggttctgtgcttccaccatctggtcagtgaccatatcaccctggaacttatcatcgctgaaatcagcgaactgttgcaaaatcgtgccgaaaacttacccgcagcacagccttaccgcaattttgtcgcccagtccctgagcgtaccggcttcagagcacgaaacttacttccgtgaggtgctcgccagtgtggatgcgccaaccactcccttcgggatactggatgtccacagcggggatagacaggtgacggaagccacgcacctacttgatgcggtactggccagggccatccgcacgcaggcgcgccgtcaaggtatcagtcccggtgtgctgttccatgtcgcatgggcgcaggtgttggctaaaaccagcgggcgggatgatgtggttttcggtacagtcttactggggcgtatgcaagggagtgcaggcatcgctcggagccttggcctgtttatcaataccctgcccgtgagggtccggctggcagggaacagcgtacaaacgaccgtgcaaacggtctaccgtaatttgacgaggctgctggaacacgagcaggcaccacttacgctggcgcagcgctgtagtggtgtggcaccgcccctgccgctcttcagcgcactgcttaactatcgtcatagtcaaccagagacaacctttgccgcgtgggaaggtaaaggtatacgtctgttggcagaacaggaaagaaccaactatcctctcaccttgtccgtggatgatttgggtgaaggcttccggctggttgcccagaccgtgccgggtatcgatccggctcgtctggccgcctatatgaccaccgctcttacaggtctggttgaggcgttggaaaccgaacctcaacggccgatcgtgaacctctctattctgcccgccaccgagcaccagcaactgctggtcgatttcaacgccactcaagtcgacttcccgcagtatacgttaattcatcaactgttcgaagcgcaagtacagcgcacaccagatgccaccgccgtggtctttgaagaccaatcgatgagttataacgagctaaaccaccgtgccaatcgtctggcgcatcatctaatgacgttggggatacgccctgatgatcgggtggcactttatgtcgaacgcagtctggctatggtagtcggtttattaggcgttctgaaagctggcggggcttatgtaccgctcgacccggcttatcccgacgagcggctggcgtatatgcttgaagacgcgacaccaaaggtggtactaacccagaagatgctcgccgatcgtctggccagcacagtgcctacggttatgcccataataatactcgacaacccagaaccattgattgaggctatgccaaccgataatccagatgcgcggtcactgggcctgacgtcacgccatctggcatacgtgatctacacctcaggctctaccggtctgcccaagggagtggcgatcgaacaccgcaatacggtgaatttcctcacctgggtacaacaagctttccgccctgaagagctagcccatacccttttcgctacctcgctcaattttgacttagccgtgtacgaatgttttgcgcctttcatctccgggggcacggttcatcttgtttctgatgcgctttcgctggtcaccaaaaaaccatcggtcagcctaatcaatacggtgccatcggccatcacgcatttgatcgacactaacgcgatccctgcggctacccgaacagtcaatttggctggtgaagcactgaaaccgcacgttgtcgaacaattgtttgcttgttcttctgtacaggaggtgtgcaatttatacggcccttcggagacgacaacctattcaacttgggtacgcatgaaccggatgactggctttgtcgctcatattggtcgcccaatcgccaatacccaaatttatatcctcgacgccgacagtcaacctgtcccgctcggtgttacaggggaaatccatatcgcgggtgccggtgttgcccgcggctatctgaaccgccccgaactgacggcggaacgtttcctgcccaatcccttcgcaacaatagccggagcgcgcatgtacaagaccggcgatctgggccgctggctacccgacggcaatattgaatacctcggccgcaacgattttcaggtcaagctgcgcggcttccggattgaactcggagaaatcgaagccagattggtgcaatgccacggtgtgagcgaggcagttgtgattgcccgagaagatatttccgatgaaatttccgatgaaaatagtgcaggtcagaagcgtctggtcgcctatctgctgcctcaggcgggtgttgaattggaaccaatggcactgcgccagcagctcgcgcaacaccttgccgagtatatgctgcccagtgcctttgtgacgctcgatgccttcccgctgacgcctaatggcaaactcgaccggcaggcgctccctgtccctgattcatctgcggtggtgacgcgtggctatgaagcgcctgttagtgaaatggaaatagcactggccgagatttggcaagtgttattagggctggaaagggtgagccgttacgaccatttctttgagctcggcggtcattccctgctcgcgatccagcttgctgcacgagtacgccagcggctggcgttggaactgcccttaccgcaactctttgcctaccctgtcctcgctgatttagctgccgtactcatcggcgcatcagtagccgcgcaaaccgtcattctgaccgccgaccgccgtcagtcactgccgctttctttcgcccagcaacgcctgtggttcctcgcccaactcaatcctaaggccagtctggcctaccatatccctacggttcttcgcctgcacggacagttagaccacaccgcatttacagccgcactcgacaaccttgttgcccgacaagaaagcctgcgcacacgttttgtcctgattgatgaacagccttaccagcaaattgacgacgcggatatcggttttaccctgatttgtcaggacctgcgcggattagacgaggcttcccgcctaacccgtattgacgaattgatggaacttgaaacacaaaccctgtttaattttgccaacgaaccgctggttcgaggtcaattgctgcaattggcggacgaagaacatgtgttgatcctcacccagcatcatctcatcaccgacggctggtcagtgggggtattgatccacgaactgagagcactctactgtgccgcgcttggggagcatggtgatcctttaccgcccctgtctattcagtatgccgactatgccgtctggcaacgcgaatggttgcagggtgatattctcactgcgcaacgggatttctggcgagagcaacttcagggcgcaccgtcgctgctggcgctgcccaccgaccgaccacgctcaccagagcagcgttacgccggcagccatgtgcctatccatctggatgctgacttattgactgccctcaaggcactcggacagcgtcagggcacgacgttatttatgaccctgcttacggcttgggggatcgtgcttacccgtttgagtggtcaggacgatatcgtcatcggcacccccgtagccaatcgcccacggagtgaacttgaggggctgatcggctttttcgtcaataccctacctttgcgtatcgaattggggcagtgcaacgcagtggcggaacttagcgtagcagaactgctcgcccacgtccgcgagcgagcgctggcggcctatactcatcaagacctgccttttgaacaaatagtggaaaccctgcaacctgagcgtagcctgagctacagcccgatctttcaggtcatgctggcgctgaacaatacccccacccaatcctttgaattacccggtttatccgtttcgttggttgaacagacacatcgcagcgcgcactttgacctgacattgtcactcattgaaaccgtagatgacctcaatggttatctagaatatgcctcagatcttttcgaccgtgcgacggttgagcgcatggtgggttatctcactcaagtactgacggccatggcggccgatgaaacgcaagccattgcccgtctgccgatgctgtccgttgccgaacgtcagcagttgctggttgatttcaacgccactcaagtcgacttcccgcaacatgggctgattcatcaactattcgaagctcaggtacaacgcacaccgaacgccgctgccgtaatctttgagaaacactcgctgagttatagtgaactcaaccgccgcgccaatcaattggcacacagcctgatagcctttggcgtgcgccctgatgatcgtgtggcgatttgtgttgaacggggcttggatatgatcatcggcctgttcgggatcttaaaagccggtgctggttatatcccactcgatccagaatatcccactgaacggctggtctatcagttgtcggacagcaaacctgtcatattgctgactcagaagcatttacaaacacgcttctcaatacaagacctatccatctggctgctggatgatgaaattcatcaaaatagcgtggcgaaacagccagcgcataaccctgacagcgaacaaatggggcttcagccgcaccatttggcctatatcatctacacttccggttcaactgggcacccaaaaggcgtcatgctggaacaccacaatgccgtgagccttattcatgctcaatgccagatcagtgagccccgcttgggcgatcgtattctgcaatttgtgaccatagcgtttgatatttcggtgtcggatattttccctacccttgcatcgggtgccacactggttctacgtccgccccatatcaaaataccgaatatcacttttgtcgatttcttacgtgatcaaaaaattactatcatcaatataccgaccgccttctggcaccactgggtacaagagataatggcaggacgcggtggtttcagcccctatctgcacaccgtcattgttggcggtgataaagtagaataccgctatttaatggattggttgtcgtgcccagagacgcaatcctgccgttggttcaacgcctatggccccacagagataaccgtcactgccacggcactgatgatagatgacaaacatactccgtctattaccgacaacgttccaattggtcgcccgctgtccaatacccgcatctatattttggatgcgctcggtcagccagttcctgtcggcgtgagcggcgaaatccatatcggtggtatgggcgtcgcccgtggttattcgaaccaaccggaactaacagcagagaaatttgttgtcgatccattcagcgaccaccccaacgcccgcatgtataaaaccggcgacttgggtcgctggcggactgacggcaatatcgaatatctcggtcgcaatgatttccaggttaaaatacgcggttttcgtatcgagctgggggaaatcgaaaccagattagtacaatgccacggcgtgcgtgaggctattgtgcttcatcgcgaagtttctaccggtaaagaaatgccgggcgacaagcgcctcgttgcctatctgctcgccgaaccaaatacggaactggtaccagcggaactggtaccagcggaactgcgccagcagctcgcgcagcaccttgccgaatatatgctacccagcgcctttgtaacactcgatgccttcccgctggcacctaatggcaagcttgatcgtcaggcactgccgatgccggatcaggcggcggtcgtgacccgcacttatgaagctcccgtcggcgacatggaaatagcactggccgagatctggcaagcgttattagggttggaaaaggtgagccgttatgaccacttctttgaactcggtggtcactcactaatggtagtcagtctgatcgaacggctgcgcagccagggttggatcattgatatccgtaccgtattcgctacacccgtgcttaccgagatagcgaaagtgatgcagatagccggaggtaacacggccacattcactacaccgcccaatctcattcctgatggttataccgccatcaccccggacatgttgcctctggtgtccctgacgcaatccgagattgatgccatcaccgctacccttcccggtggggcggctaatatccaggatatctacccgctcgccccgttacaggaaggcatgctgttccaccacctgctgcaaacacaaggggatatttatctgttacatatcttgcttactttcgacacccgcgagcgccttgatgcctttctgacggctcttcaacaagtcattgatcgccacgatattctacgcaccgccttctgctggcagaaattaccccagccaatgcaagttgtctggcgtcaggcgcccctgcgcatcgacacctttgtgccggacagcgacaaggacattccttctcagttgctggcgcacactgacccataccggcaccgtcttgatatcagtcaggctccgcttttctccactgatatcgttcatgatccgcgccaaggtaagtggttgctggctctatgctgccaccatatcctcaacgaccatatgtcattggatctcatcattgatgaaatcaacgaactgttgcaccatcgtaccgggcacttaccccctgcactgccttaccgccactttatctcccagtccttacgtgtaccgatgtcagatcacgaggcctgtttccgtgagatgctcgccgacatagatgcgccgaccgcacctttcgggatactggatgtctacagtggggatagaccagtgactgaggttacaaaaccacttaatgcagcactgaccagagctatccgaacgcaggcgcgccgccagggagtcagtcccggcgtgctgttccatgtcgcatgggcgcaggtgctggcaaaaatcagtgggcgggatgatgtggtcttcgggacagttttactggggcgcatgcagggaagtgccaacatcgagcggattctaggtctgtttatcaatacgctgcctgtgcggatccaacttgcagggaacagtgtacaggagaccgtgaaagcggcttatcgcagtttgacgcgactgctggaacacgagcaggcaccactggcgctagctcagcactgtagcggtgtagcgccgcccctgccgctcttcagttcactccttaactatcgccatagccaatcggatgtaacccgcaccctatgggagggcatacacctgacagctgcacaggagaggactaattatcccctctacttggctgtggatgatttgggtaaaggctttctgttggcggctcaggccgtaccgggtatcgatccggcgtgtctgatcacctatatgaccaccgccttggcgggtctggttgaggcgttggaaacagaacctcaacggccgatcgtgaacctctccattctgcctgccaccgaacatcggcagttgcaagataccttgattcagcacttcacccaatcccacggagtgcgtgaagaaactgtcgtgactcgcggctatgaatcccccatcggtgacatggaaacggcactggcccaaatctggcagaagctgctgaaactggaaaaagtcggccggcatgacaatttctttgagttgggtggccattcgctgacagcgatacaattgctggctcgtatgtatgagcaaaatatggagattccgttagcggcggtgttcactcaccccaccctgtgtgagctggcttcaaccgtgggtaagccgacttccccacttgtcgctgagctatggacaaaattagcaaagaatttttatcctaaatag

SEQ ID NO: 4399 - DNA, 3906 bp, Xenorhabdus bovienii
  Coding DNA location: Contig name=SeqID_16895; Position on contig =242352..246257bp; Strand=-
gtggaatcacctttgacagcatcatttgctgcattattcgctgaacttgagcacacgccgctgcgcgatcaattccggctaaaaaaacgtctgcatggagcagcaaaaatcaaaaatcaggcctctttgcaggccgtggcaaaatccatatctgaagatatcgccactgcaaaacagaaagttatcaatcgtcaagtttcatgtcctccgctcaaataccctgaaaaactgccggttagccagaaaaaagacgatatttataaagcgattcgggataatcaggtcgtcattattgcgggagaaacgggttcaggtaaaacaacccagatccccaaaatctgccttgagttgggaagaggggttaaagggctaattggccatacgcagccccgtcgcctggcggcgcgctcggttgccagccgtattgcggatgaactggaaactctgcttggctcaaccgtcggttataaagtacgttttaatgatcatgtcagcgagaatacgctggtcaagttaatgacggacggtattcttctggcagaattgcagcaagatcgcctgctgctgcagtatgacacgctgattattgatgaagctcatgaacgcagcctgaacattgattttatccttggctatttgcgccagttgttgcttaaacgccctgatctaaaaattatcattacctccgcgactattgatcctgagcgtttttcccgccatttcaacaatgcaccgattattgaagtctctggccgtacttatccagtggaagttcgatatcgcccggtggcaggcgatgatagtgacagtgatcgggatcaacttgaagctatcattgatgctgtagatgaattggggcatgaaagttcaggcgacattctggttttcatgagcggagagcgggaaatccgtgatacagcggatgcactggataaacataactttccgcatactgaaatcctgcccctgtttgcccgtttatctaacagcgaacagaaccggatattccagccgcatgtcgggcgtagaattatattggccactaacgttgcagaaacatcgctgaccgtgcctggtatcaaatatgtcattgataccggttttgcacgtattagccgatacagttatcgaaccaaagtccagcgtctgccgatagagccgatttcgcaggcatctgccaatcagcgcaaaggccgctgtggccgtgtttcagatgggatctgtatccggctctactcggaagacgattatttatctcgtccggaatttaccgatcctgagattctgcgtactaatttggcttctgtcattttgcagatgacctccattggcttgggagatgtgagcgcattcccgtttgttgaagcgccggataaacgtaatgttcaagatggtgtccgtttgctggaagaacttggagccattgatccggaatccctgtcaggcggaacttaccgactgacgccaatggggcggcaacttgcacaattgcctatcgatccaagattggcacgtatggtgttggaagccagggcgcatggttgtgtccgtgaagtcatggtcattacctctgcgttatccattcaagatccacgggaaaggccgctggaaaaacagcaggcttctgatgaaaaacaccgtcgtttcgcagataaagattctgatttcatcgcattcctgaaattgtgggattttctggttgaacagcagaaagcgctttccagctcgcaattccgcaaactttgccgccaggactatctgaattacctcagagtgagggagtggcaggatgtctatactcagcttcggcaggttgttaaagaaattggcctgctgataaacagtcaagaagcagattaccgcagtatccatattgcgttgctgacgggtctgttatctcatgtcggtcagaaggataccgataaacaagaatatactggtgcccgcaatgcccgtttttctgtatttccgggatctggattatttaaaaagccacctaaatggggaatggtggctgaattggtggaaaccagccgattatgggggcgtattgcagcgcgcatcgagcctgaatggatcgagccattagcggcacatttaatcaagcaccactacagcgaaccgcattggcagaaatcccaaggtgcggtgatggtaacggaaaaagtgactttgtatggcttgccggttgtggcggggcgtttggtgaattacagccagattgatccgatgttatgccgagaattgttcatccgtcatgcgttggtggaaggtgattggcagacccggcattcatttttccgtgcgaatctcaagttacgcgaagaagttgaagaactggaacataaatcccgccgtcgggatattctggtggatgatgaaaccttgttcagtttctacgatcagcgaatcggtcaagaagtcgtgtcttcccgacattttgatcgctggtggcaagttgccagtaaagatcaacctgaactgctcaactttgaaaagagcatgttaattaaaggtgatgcagataaagttagtgctttggattatcctaactattggcatcaagacaatttgaaattccgtttgagttaccagtttgagccaggaacggatgcggatggtgtcaccatacatattccgctgccaatcctaaatcaagttaaagatgaaggttttgactggcaaattccgggaattcgtcatgatctggtcgttgcattgattaaatccctgccaaaacccgtacgccggaattttgtgcctgcaccgaactatgcacaggcatttctggagcgggtaacacagccgcaagctaccttactggatagttttgagaaagaactccgccgtatgacgggtgtgacagtgtcacgtgatgattggcaattggatcaggttcctgatcacctgaaaatcacatttcgtatcattggtgagaaaaacaaaccgctggcggaaggtaaggatctgtctgcactgaaactgcaattgaaagggaaagtacaggaaacactttcggcggtagcggatgatggcattgaacaaagcgggctgcatatctggagctttggtgagttgcctgaacgttacgagcagaaacgcggcggttactctgttaaggcatttccggcattggtggatgaaaaagacagcatcggtattaaactgttcgaaactgaatccgaacagcaaaatgcgatgtgggaaggcactcgtcgattgctgctcatgaatattccgtcaccgattaaatacctgcatgagaaattacctaacaaatccaaacttgggctgtattttaatccctatggaaaagtgctggatctgattgatgactgcatttcctgcggtgtggatagattaatcgcagaaaatggtgggcccgcatggaatgaagaagcatttgcaagtttgcagaataaagttcgggctgatctgaatgatgcagtggtcgatatagccaaacaagtcgagcagatcttgacgacggttttttctattaataaacgtttgaagggaagggtggatatcgcactcgcgcttgccttgtcggatattaaagaacaaatttccagtttagtttttaatggttttgttacctctcacggctggaaacgtcttgcggatgttttgcgttacttgaatggcattgaacgtcggttggaaaaattggcgattgatccaaacagggatagggtacacatgagccggattgaaaatatccaacggcaatggcagcagtggctggcgaaactttctattcagcagaaacaactgcctgaagtgaaagagatccgctggatgatagaagaactgcgaatcagcctgtttgcccagcaattggggacagcgtacccaatttcggataagcgtattttgcaggtaatggaaaatatcgctatgtag

SEQ ID NO: 4400 - DNA, 615 bp, Xenorhabdus bovienii
  Coding DNA location: Contig name=SeqID_16895; Position on contig =246610..247224bp; Strand=+
atgaataaagtactggttctgaaatcgagcattctggctcagcattcccaaagcaataaaatggctgattactttgtcgaaaaatggctggccaaccacgtagatgatagcattactgtacgcgatttagctgaaaatccagtaccggtgcttgatggagaattagtgggagctttgcgccctagtgatgcagagatgacagtgcgccaaaaagccacattagctttgtcggatgaactgattgcagagttgaaagttcacgatgtgatcgtgcttactgccccaatgtataacttcgctattccaatccaattgaaagcttattttgacctgattgcccgtgccggcactaccttccgctataccgaaaccgggtcagaaggtttgctgaaaaacaaacgtgccattgtgctgaccagccgtggcggcattcataaagataacccaacggatttgataacaccgtacctgcgtacttttttgggattcatcggtattaacaatgttgaattcgtctttgcagagggttttggattgggtgcagaatcagcagaactggctcatcaatctgcccagaatgctatcaatgatatgatgacaaaaatttcagcttaa

SEQ ID NO: 4401 - DNA, 321 bp, Xenorhabdus bovienii
  Coding DNA location: Contig name=SeqID_16895; Position on contig =247309..247629bp; Strand=-
atgaaaaaagcaggagtaatatttctggcgagtctgctattcagttcttttgctgtaggcatgacgttgagtgaagcaaaacagcaagggctggtaggagaaacgttcagtggctatttggcacccgtgaagaagaccagggatgctcagtccgtgatccaaaaggtcaacgaggagcgggaaaagaaatatgctgcaattgccgttcaaaataatatgacaacgaatcaggttgctaaaatggcgggtgaaaaattggtgaaccgtgccggggcaggtgaatatgtgcttggtattaatggcaattgggtgaagaagtaa

SEQ ID NO: 4402 - DNA, 210 bp, Xenorhabdus bovienii
  Coding DNA location: Contig name=SeqID_16895; Position on contig =247640..247849bp; Strand=-
atgataacaaaaactggactcaggttgtcggtgggcatggctagcctgatgttggccagcatagttttgacggggtgcatcaggctggaggtagcgacgccagataaaccgatcaagatcgatatgaatgtgaagattgagcatgaaattcatattaaagtcgataggcaaattgaagatatgctcaaaaacaactccaacttattttaa

SEQ ID NO: 4403 - DNA, 2625 bp, Xenorhabdus bovienii
  Coding DNA location: Contig name=SeqID_16895; Position on contig =247846..250470bp; Strand=-
atgaccaagatattcaaagtgtttgcggtgatgataacactgctggtgttattggtgttgacgggttggtacacacttccatgttggctgccattgattgtcagtcattggctgccacagggcgttactctttctctcagtcaaccaaaatgggaaaagaatacattacggctggatgatttggcattgcaggcaaaaggttgtgaatgggtcaatatgtccgggctgtttgtgggatacccacgcagagaaaaaaccaaagagcgctactggaatattcatgctgctagtgttcacagcaatagcccgtgtctggggcagttgccagtgacagaaaacccttcagaaccattatcgattgaggatacattatcctccatttctgcggttaaacttgtcgttgatcactttgagctcacgccgtggcaggaatttgccggaaaactccaatttgattcatcacgtcaagggcagacattttcctatcaaggcaagcaattaaagctgaatgttcatacggcagataaaaagacattagttattcaccaattcttcgtgaaattacctgagcaggaaatcagcctgaatggggatatctcattgccattgggtattgacgcactacccgtacaaggtcagataacagggcggctatccatcagtcaatatcctgatcctttgcaggtaatattaaaatggcaggggcagggaggaacgctcactattagggaagagaagcaaaagcggatattggcagagttgccatggtcattcaatcaatctcaatttctgataactgatggtaaatggcaatggatggatacggggcagccactgtcaggaggcgtgaatttgacctttgatcactggagaaaaggtgtagatggcatgctaatcagtgggcgagtgaatttgatcacccaaaatgaacgaggcaggggcaatatcgttctttctataaaaccgacactcatcaatatggcgaatgcccatatcccatttcagttaaccggacaaatgaaccgcgggcagatggtcatgacgatgtcattgcccgctattgtgacgggtccgctggtggcacctaaaatcacatttcagccgggcgcgctgtttcgcgcgtggggaaaagtaagcgagacctttacggttaaggaagcgcgtttaccattggcggggacttatctgacccgtgatggttttacgggtcgtctgcaagccatcgtgactgcacaggataactattggggaaaattcaaactgcatcttgatggggatgccgaggattttatacccgatcagggaaattggcggtggcgttattggggcaatggacatttagctccgctgcaagctaaatgggatattgcaggcacaggaagctgggagcgttcacagataacggtgaatgcgttaaacacgggttttgatgttatccaatacggccttgtgcagatggaggcaccgcgtttgcagcttatcaagccgctggtgtgggaacgttccgcaactcaaccgacattcatgggggacttgcagttatccgccttaagaacagatttccgttctggcggtttcttacctcctttcgacttcaaggcgacagtgacaggtcagtcaccggataattttatcctgaatgggaaattatctcccaaaggtattgagccaatcccattttatggccgctgggacggtacgcgattgcgaggagatgctcgctggccgagtcaatctctgttggcacttcagcccttgatccccggagatttggggatgacggtacgtggtggaaacctctatgcccaagcggcattttcggctgcgaaggggcagggattacgtgccggtggtcattgggtagtgaaaaatgcgagtgtttggctaaaggatggtgaaattgacggcttgaattttgttttgccgtggcgtttgcaggaacatacttggcagttgggggtcatatcacctgtccaactcagggtcaatgaaattaaaggcttgtttggtatgcagaatgtgacagccgatttgctgggtttctacccacccactgaaacccagccattgacgttatccaatgtgaatgtggacatgctggatggtaagcttgggctggataaacttcaattaccccaaaaacaggctgcggtactgcgatttgataaattaaatctgagtaaattgttcggtgttctgaaagttaagcaaatagccatgtcgggcagaatcagcggggaattgccgctattattgaatgataaaaattggattattcagcagggctgggtatccaatgatggatctctgacattgaggttagataaagatacggttggctcaatagggaaaaatgacctgacggcaggtatgacaatggattggctgagttatttggagatcagccatttaaaggcacatgttacgctggataatttgggcattttgatactgaattcagaaatcagcggtgtcaatcctatggtggataaaaaacgagaagtcaggcttaactatcgccatgaggagaacatttttcagttatggcgtagtctgcgctttggcagtaatctggaagagtggttacagaaaaatatatctgtaatgaacgggagtgacaaatga

SEQ ID NO: 4404 - DNA, 111 bp, Xenorhabdus bovienii
  Coding DNA location: Contig name=SeqID_16895; Position on contig =250529..250639bp; Strand=-
atgacgtttactgagataggttctaagcgttatctctcgctatattcgaacaaaccgactaataagctattcatgataatagcccgtataataaaccagcttagagcctga

SEQ ID NO: 4405 - DNA, 996 bp, Xenorhabdus bovienii
  Coding DNA location: Contig name=SeqID_16895; Position on contig =250741..251736bp; Strand=+
atgaaattggttgtttatagtacaaaacaatatgaccgtaaacatttagaaatgctcaaccaaagacttgggcttgattaccatatcgaattctttgatttttccttaagcccacacacggccaaaaatgccattggtgcagatgccatctgtattttcgtcaatgatgacggtggacgtgaagtgctggaagaattggcagcaatgaacatcaaaattttggcgttgcgttgtgcgggattcaataatgtcgatctggatgcggccaaagagctaggcattcaagtcgtccgcgtcccggcttattcacctgaatctgttgctgaacacgcggttggattgatgctgtgtttgaatcggcgtattcaccgagcctaccagcgtacccgcgatgccaatttctctctggaagggctgactggcttcaacatgtataaacgcacagccggtattatcggtacggggaaaatcggtctggctatactgagaattttgaaaggttttggtatgcgtttgctggcacatgatccctacccaaatcaggaagtgttagagcttggcgtgaaatatgtagatttagataccttgtacgccgaatctgacgtgatttctcttcactgtcctatgacgccagaaaaccatcacttactggatgaaacagcatttaataagatgaaagatggcgtgatgatcatcaataccagccgaggggcgctaatcgattcaattgctgctattaacgctttgaaacagcagaaaattggcgcattgggtatggatgtatatgaaaacgagcgtgacttgttttttgaagataaatcgaatgatgttatccaagatgatatttttcgccgcctgtcttcctgccataatgtgttgttcacaggccatcaagcatttttgacagaagaagcgttaaccagtatcagtgaaacgactttacaaaatatccagcaattaacctccggcaaaccttgcccgaatcttgttgggtga

SEQ ID NO: 4406 - DNA, 435 bp, Xenorhabdus bovienii
  Coding DNA location: Contig name=SeqID_16895; Position on contig =251761..252195bp; Strand=+
atgaagaaagcgatttcgtttgcgatcgcgaccctgctactcacagcatgtcaatcttcgggagttagcgccacggggaatgttacggtcagggatctgcaacatcgtaattttgctttaatcagtgtcaatggtgcaactgtttcgaataaagaagacagtaaactttctattgcatttggtgaaaaaatgtttgtttcagcaactatgtgcaatcattttatgggagtgggtaaattaaagcagcgtgttctgactgtcagtattttagaaaaatcccagatgttttgtgtcaatgaacagctccatcaatgggatcaagtgatttatgatgtactgactgagggagccacggtcagattaaaaagcaaacagcttacattaactaatgacaaaaacacgctggtttatgttttgagggatattacccaataa

SEQ ID NO: 4407 - DNA, 204 bp, Xenorhabdus bovienii
  Coding DNA location: Contig name=SeqID_16895; Position on contig =252385..252588bp; Strand=-
atggcattcacacgacttaccaaatatatatggggtactgttggtgaggatttgaagtcagaccatcagagattatctcatgcagctatgcaagtctgtttgataatgagaggtgaaaaaatgaatagtgaatggctggtttatataaaatttgtgggattatggattgctttaatgctgatgattggtgtgatgttgtcataa

SEQ ID NO: 4408 - DNA, 294 bp, Xenorhabdus bovienii
  Coding DNA location: Contig name=SeqID_16895; Position on contig =252700..252993bp; Strand=-
atggcaagttatttggttcgtgtggaactttatggcacgggttctgatggctatgagaagttgcataacagaatgacagcaaataagttcaataaatcgatacaatttcctaatggaaaatggcatcgtcttcccagtggaacttatattggtaactcatcgctagaatcccttcaattagcggaaaaaatcaaatcaatcgcgacccctttttcaagcaaagaaccgtcgatattcgtctgtatttacagcaattggagtgcagcattgtatcccgatacaggagccggctga

SEQ ID NO: 4409 - DNA, 180 bp, Xenorhabdus bovienii
  Coding DNA location: Contig name=SeqID_16895; Position on contig =252928..253107bp; Strand=+
atgcaacttctcatagccatcagaacccgtgccataaagttccacacgaaccaaataacttgccatttatcattccttgtattgactgtggagcagacaagttatcagtttttcttggctgataaaagcaagaaaaacgagaggaaaatccgatattcatggcaatccggtgtgtggtga

SEQ ID NO: 4410 - DNA, 153 bp, Xenorhabdus bovienii
  Coding DNA location: Contig name=SeqID_16895; Position on contig =253136..253288bp; Strand=-
atgataactctctattttctcaaaatggttatccattcgataggaatatttttacgaaaggtgtctgtggattcagggtggttaaacttcgcaatgacttgtaattcacgggatgagtcagacataaaaaattggtctcaaattattgtttga

SEQ ID NO: 4411 - DNA, 645 bp, Xenorhabdus bovienii
  Coding DNA location: Contig name=SeqID_16895; Position on contig =253355..253999bp; Strand=-
atgtctattgaaaatatcaatatcaatatcaatgagcaaaaaattggtaaagattcagttgtacttggacatgcggaagcatcggcagtacatgctgtcgcaattggtgcttcaccacgaaattctaaagccatcagtgaagcggctattgctattgggcaaaatcaacttgccggtaaacagggagatgcgaacgttgtttttccaattgcaattggtgctgattctgtatccaatggcctggcttccatcgctttggggcaaaaggtaactgccagtgcatctcaggccatagcgattggtcaaaattcctctgcaacagaaaaagggagcgttgcattaggcgcagattccattgcgaacaaaccgaatgttatttctgtaggaaaatctggtcatgaacgtaagatcgtgcatgttgctgctggtgatatttcaaatcatagtactgaggcggttaatggtcatcaattatattctgaattggctaaaactaatgtattgttggatgaaaaaaataagcaattagaaaataaaattgaaactctggagagtaatatagctaatcttaatctattaaataagaacaatgcggatgatattgcattattgaagcaacggctttttgatgcattaaattattaa

SEQ ID NO: 4412 - DNA, 447 bp, Xenorhabdus bovienii
  Coding DNA location: Contig name=SeqID_16895; Position on contig =254426..254872bp; Strand=-
atgactgaacttatgtctcaacctttctggcaggggaaaactctggaacagatgacagaccaagagtgggaagcattatgtgatggctgcggtcagtgctgtctgcataagctaatggatgaagatactgatgcaatctacttcaccaatgttgcctgtaatcaattgaatatcaaaacctgccagtgcaagaattatgaagatcgttttagatatgagcctgattgtatcaaattgacgcgtgagaatatggttacgtttgaatggctaccaatgacttgtgcttatcgtttgattggtgaaggaaaaaaactccttccttggcacccattagtcagtggttcaaaatcagctatgcatgcagagcgtatttctgtcagacacattgctgtgcgtgaggctgatgtggtggactgggaagatcatattatgaacaaaccagagtag

SEQ ID NO: 4413 - DNA, 657 bp, Xenorhabdus bovienii
  Coding DNA location: Contig name=SeqID_16895; Position on contig =254882..255538bp; Strand=-
atgtaccagcatcgagactggcagggcgtactgctggattttcctgccagtaaagtggtttgtgtcggcagtaattacgagaggcatatgaaagagatgggctctaaagtgaccgaagagccggttatatttctcaagcctgaaacggctctttgtgatctctgtcaatcggtttccatcccacagggattgggagctgtgcaccatgaaattgaactggcggtcttgattggttcgacactcaagaatgccagtgaggaacgggtcggcaaggcgatcgcaggttttgcggtagcactggatctgacattgcgtgatttgcagcataaattcaagcagtctgggcaaccgtgggaaaagagtaaggcgtttgatggttcatgccccatatcgggctttattcctgtcaaagccttgagtgaaccacaaaatgctcagctttccctgacagtaaatggcgaatcacgccaaaacggcaatacgagtgacatgcgaatgcccatcatcccattgattagctatatgtcgcgtttttttaccctgcgccccggtgatattatcttaacgggaacgcctgaaggtgtagggccactacaacctggtgatgtactgaacgtctctcttaatgagcacgttttaacaaccagagtgatttaa

SEQ ID NO: 4414 - DNA, 1086 bp, Xenorhabdus bovienii
  Coding DNA location: Contig name=SeqID_16895; Position on contig =255574..256659bp; Strand=-
atgaaattaatctctggtgtgaccttattgacagcgacactgttggcagggtgtacttcatcgaatggaaaagtgttgcaggatcaatccagacaggctgttgtgatacagaaagaaatcagggcattggatgaacaatttccaattgcctctcgtgaaccatcgcaatttcccgcctatgtggttttactgaaacaacaggctagagagaagggtttcagtgaaaaaacacgggatcgtgcatttgccgatattcattttatctcgcgggttattcaatctgatcgtaatcagccggaaaagaaaatcacgttggatgattaccttaaccgtgtcctgtcagcccggaagattgagcagggcgtcatccagtatcagaataacctgccccagttagagagaatcagccgcaaatatggtgtatcgaaagactatattgttgctttgtggggtttggaaagcggttttggcaaagttcagggaaaagaagatgtcatttcggcattatctacacttgcttttgaaggtcgtcgggaagatctttttataaaacaattaatggcagcacttgaaatcatagaaaagaaatatattgatgaaaatcaaactttgaaaggttcctgggcgggagcgatggggcaaagccagtttatgccgacctcgtacttgacttatgctgctgacggtaatggcgatggcaaaatcgatatctggaacagtaaggaagatgtatttgcctcaattgccaattatctggcgaaggaaggttggcaacaagggttaccgtggggttatggggtttcactgcctgctggttttaatcaaaacttggaaggtattaagttagagcaggggaaaactattgcccaatggcaggcgttgggtgtttcatctcccgattttgccagtctgccagtgaataccaaaggctggattgtgataccgaatgatactgaacagcgagcattttgggtaacgcagaattttcgtactatcatgcactggaatcgttcttacaattttgctcttagtgtgggtatgatggcagagagtattggtcagaaaacccatttcctcactcactga

SEQ ID NO: 4415 - DNA, 270 bp, Xenorhabdus bovienii
  Coding DNA location: Contig name=SeqID_16895; Position on contig =256709..256978bp; Strand=-
atgatttgtgtaatctacagaagcccaaaacgtgaccagacatttctctatgtcgaaaaaaaaggtgatttctcacgcatccctgaagcgttgctgaaaacattcggtgaaccccaatactccatgatgatttcattatcaggaagaaaaaaacttgctaatgcagatattgtaaaagtaagaactatgctaagtgagcagggtttttacctgcaagtgccaccaccagtggaaagtctgatgagtgaacatctggctgtaaataagtaa

SEQ ID NO: 4416 - DNA, 684 bp, Xenorhabdus bovienii
  Coding DNA location: Contig name=SeqID_16895; Position on contig =257108..257791bp; Strand=+
atgtcacagtcgccaattgagctaaaaggcagtaattttacgctttcggtcgttcatttgcatgatggccagccggaagtcattcaaagggctatgcaggaaaaaatggagcaagcaccagaattcctcaaaaatgcccccgtcgtaatcaatatatctgatcttccagccggtgccgatctcctcgcactctatcgtgctgttgaatctgtcgggttgcgcattgttggcatcagcggctgtcaggatgaagaacaacgaaaaattgttctaaaatctgggctacctttactgaaagaaggtaaaagtcagaaaattcctactcaagaaaataaaccgactgaacctattttcaaaaaaactcgtataattaatacgccggttcgatcaggacaaagaatttatgcgccaaatagcgatcttattgtcaccagtaatgtcagcgctggcgcagaattaatcgctgatggaaatattcttatatatggtgtgctacgtggacgagtattggcaggcgcatctggtgataaagaaagccagattttctgcacccatttaaacgctgaactctgctctattgcaggtcaatattggctcagcgaaaacattccagaaaattttgttggcaaggctgcaaaattacgtttggtaaataatgaattaactattgaaaccttagtctag

SEQ ID NO: 4417 - DNA, 813 bp, Xenorhabdus bovienii
  Coding DNA location: Contig name=SeqID_16895; Position on contig =257815..258627bp; Strand=+
atggcacgcattattgttgttacatctggtaaaggtggcgttggcaaaaccacttcaagcgcggccattgctaccggtctcgcccaaagtgggaagaaaaccgtagttatcgattttgatatcggtctacgaaatctcgatctgattatgggctgtgaacgccgcgtggtttttgacttcgtgaatgttattcaaggtgatgccgcattaaatcaagcgcttattaaagataaacgtaccgagaatctgtatattctgcccgcttctcaaacccgtgacaaagaagccctcacccgtgaaggcgtcgaaaaaattctgaatgagttggatcaacaagggttcgagtttattatctgtgattcaccagcaggtattgaaagcggtgcattaatggcgctctattttgccgatgaagcaattatcacgacaaacccggaagtttcatctgttcgtgattctgatcgtatcttaggtattctggcctccaaatcacgccgcgcagaaaaagctaatgagccgattaaagagcatctcctactgactcgttataatccggggcgtgtgaaccggggcgatatgctcagtatggaagacgtgctggaaattctgtgtatccctttgcttggtgttatcccggaagatcaatctgttctgcgttcatcgaaccaaggggaaccggtcattctggataaagaatctgatgcgggtaaagcatacgaagataccgttttacgtttactcggtgaagaacggcctttccgttttatcgaagaagaaaaaaagggctttttaaaacgcctgtttggggggtaa

SEQ ID NO: 4418 - DNA, 270 bp, Xenorhabdus bovienii
  Coding DNA location: Contig name=SeqID_16895; Position on contig =258631..258900bp; Strand=+
atggctttgttagatttcttcctgtcgagaaaaaaaccgacagccaatattgccaaggagcggctgcaaatcatcgtggcagagcgtcggcgcggtgattccgagcctgcttatttgcccgaaatgaaacgggatattctggccgttatatgtaaatatgtacaaatcgacccagaaatgctctctgtgcagtttgaacaaaaagatgatgatatatccgtactggaactcaatgtaacattaccggagactgaggaattgccaaaataa

SEQ ID NO: 4419 - DNA, 129 bp, Xenorhabdus bovienii
  Coding DNA location: Contig name=SeqID_16895; Position on contig =258947..259075bp; Strand=+
atgaatcggggtgtcctaacatcccgatttcaaatattcaacaaatctatcaatgcctttttctcatttttctccaattctcgtcatcccccgattttggcaatcaccctctccatatttattatatga

SEQ ID NO: 4420 - DNA, 543 bp, Xenorhabdus bovienii
  Coding DNA location: Contig name=SeqID_16895; Position on contig =259127..259669bp; Strand=-
atgcttttgacggaagagaatcgcctctccgtggcggatgaagttgtttgtgattctcatgcaaagataatcaccctgctaaagcaagaactcaaagacaccgaattgaaactaaaaaagcacattgatgactcgccttcgctgaagaaaaataaggggttactggaaagtattcccggtattggcgaacggttgagcgcaacactgctggcttatattggtgatggttcacggtttcatcatagtgggcaagtggtggcttacgctgggcttaatcctaaattacatgaatcaggacaactaaaagggcgggctcatctctcgaagcagggaagtgccgagctgcgaaaagcactttatatgcctgggctggcagcgatcagttgcaataaagtagtgaaaaagcagtgggaacagctgacagcacgccataaaggggggaaagtcggtgtttgtgcagtgatgcgtaaactcttacgattagcctatggcgtgatgaaatcaggcacattatttaacgcagaaataccgcttgcagtttaa

SEQ ID NO: 4421 - DNA, 114 bp, Xenorhabdus bovienii
  Coding DNA location: Contig name=SeqID_16895; Position on contig =259738..259851bp; Strand=+
atgccggaggatgctgactggcgcaataacgtgctatcagtttggcgtcaattttatcggttttattgcggagtaattccgctttaccaaaggcatggatttgtaccggattga

SEQ ID NO: 4422 - DNA, 1122 bp, Xenorhabdus bovienii
  Coding DNA location: Contig name=SeqID_16895; Position on contig =259898..261019bp; Strand=-
atgaaagaattagtggatgtcttttctgattttccagacccacgttgtcagggaaaggtcaaacaccgtgttattgatatcttagtgatcgcggtatgcgctgtcattgctggggctaacgcctggactgatattgaacagtacggtcaactcaaaaaggattggctgagttcatttcttccgctcaaagggggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatagccacggacgtaccgtcagacggcgcggatgggttctgccactgacatcagaaacaaaacacttaaggtcttggccagatattcaagctcttctggtaacagaaacgatacgacaagaacactattctgacacggtgacttctgactttcgttattatttaagcagttgtcatgattctcccgcctttcagttaggtgcaatacgaaaacattgggctatcgaaaatagtttacactgggtactggatgtcactttccgagaagatgattcacggatgagagagcgggtcgccacaagaatatttgcccaattacgtaaaatggcactcaatattgttaaacgagatatcaatagtaaattgagtttgagtgcgcgaagaaaatcagcgggatgggataacggttatatggaagcactgttatttaatcaattttag

SEQ ID NO: 4423 - DNA, 369 bp, Xenorhabdus bovienii
  Coding DNA location: Contig name=SeqID_16895; Position on contig =261097..261465bp; Strand=+
gtgccaactcgtgaatatgttaaaggcgcgatagcagaacacgcccagagccgtaaccacccatacgcaactcaggtagagccgggatttgtgacactaagtaatgatgttgatagcgacagtgaaaagactgtggcaacatccaaagcggtgaaagcagcgtatgatttagccaatacagccaaccaaaacgccctcaataataactcaaatctctatttagagaagaagctgaatggggcagatatcccggataaagcggagtttgtgaagaatcttggtttatctgaattagtttatagagccatagggaatgggccaaaccaagtgccggacataaacagttttgattcttgttataactggtag

SEQ ID NO: 4424 - DNA, 126 bp, Xenorhabdus bovienii
  Coding DNA location: Contig name=SeqID_16895; Position on contig =261685..261810bp; Strand=-
gtgcagaatatatcgcctattagtgcggaattggccgccgcgctacaggagcctatgaaattccgaaggatattggttagacatccatgtctagattggtatgtgatcgatagtagtgatatttga

SEQ ID NO: 4425 - DNA, 690 bp, Xenorhabdus bovienii
  Coding DNA location: Contig name=SeqID_16895; Position on contig =262023..262712bp; Strand=+
atgtgcgctgctgcaactgcaagacggcaagcgcgtcagcagaaaagaatgggcagtcagaaggaatgcctgttgcgtcatcccggactagcagaccaagtggtcaacatcggggattatccggcacaggctggggtgaaagtgggtacccgcttaaattacttgccttaccttgaacgccatacggcatcgaggaatgtgatgccctggctggcctcatcggctgacctagaagcgctggactgggaagtgattgtcaagacaccagaaatccataagcaagttgaatatagactggttttggacaagtacacgtgttcatcgagccgcaatgcagaccctgaatatgaaaaatggacagtctctgaacctcatcagtccatgttgattgacagtaacctcgattttaacgttccacgttttgactgggtggataaccatgccgccaaacccaatgaatttagtgttcattttagcaatcaatcgcctgaggcccgcgaaaaattgagcgctatcaccgataaaaaactgactattaccgtaaaggggatcgaatatccgctggggcaccacacacccgactcagattatcaccatcctcgctatcaaggcagtgaggctgaaaaaatcggcgggctggtgaaggcacagtttggcactcttcgtttccactttaaatggcatgactga

SEQ ID NO: 4426 - DNA, 423 bp, Xenorhabdus bovienii
  Coding DNA location: Contig name=SeqID_16895; Position on contig =262761..263183bp; Strand=-
atgtatgtatattgtgcaaaaaataatatgttttacccggaagtcctaaagcaggactacctcaatgtgggaaaatggcctgcggacggtatcgaggttggcgagagtgtttatctggagtttgtggcaagcaggccaccagaaggcaagcgtcgcgtagtgggtgagaatggtctgcctgcgtggggcgatattccgccgccaacaccagaggaacaacagcaacgggcagagcggaaaaaacaatacctgatgtcacaggcatcaaacgctatcgcaccgttacaggatgcggttgagttggagatggcaacgggtgccgagaaatccgcattaaccgaatggcgtaaataccgggtgctgctcaatcgggtagattgcactaccgcacccgatgtcaaatggccggaacaaccaacataa

SEQ ID NO: 4427 - DNA, 1182 bp, Xenorhabdus bovienii
  Coding DNA location: Contig name=SeqID_16895; Position on contig =263186..264367bp; Strand=-
atggcaaaaaatgaatttctcccgttcggcatcgcagacggggcgagtatattaacaaacgaggagtacggcaatctggccgcacggactaacgggtttagttctggtgtggctaagtcgcaggagctaaacaaagtttggcggcaggcttcggtaatcgcgagcgtggtggctcagtttatcgctgagaccaacaagcaggacgtattggatgatggtaacacggaagcgttacgagcagggctgctaaacgcattgagggcaacggtaggcgctaatatccccgtggcatctcagactctggcaggcattactaaactgtctaacgccactaacagtaacagtgaggtggatgctgcaacaccgagagcggttaaagcaacgtatgatctggctaataccgcaaatcagaatgccggaaacgctatcaacaacgcgaacaccgccatccaaaatgcggccaatgcgaataacaatgctaattctcgtctggagaaatcaaagaacggcgcggacattccgaacgaaaatgagtttgtgaaaaacctcggtttggcagataccgtggagcgggcgaaaaatgccgcctctctgacggaatggacaccacagatttttaacagtgatgtctatgctaaaactattatttcaggattacccggtgccgaccgaacctatctggaaatagtcaagggtgcagtaatgtggcaagcatatgagggagaacgaaattacacactgcggcatccggcaaaaagtggaacagtggccattattgaggagctatacaaaaaatcagaactgtatacaaaagatgacctatacaagaaaagcgaactctataccgtaaccgaatcgaataaccggtttgggtataaaaatgacgcgaaattggatcaaaacgggtggtggaaatgcggggataccggggtaattttccaatggggttatacagagaaaacgctggctgaatcctctgagacgattacattttcgacagagtttccccgtcggtgttttggcggactggcatcgccatcgtatccccacgcgagcagcagtaattccagcgcctattttttcaatctcaatgatggtaaacgcgcaatcattacctgtgaccagtcggcgggtgcgcccgatgataggtcgtatattttctggtgggcagtggggatttaa

SEQ ID NO: 4428 - DNA, 654 bp, Xenorhabdus bovienii
  Coding DNA location: Contig name=SeqID_16895; Position on contig =264375..265028bp; Strand=-
atgaggcgagactatctaaaactcattaccgcccagcatcggacagcgcctaaatttgttgaccaccttgacctcatcacccgcacgctctcagacattgccacagttgcccagaccctgaataccgaattctccatcgaccacggggtcggtgtgcaattggatgcagtcggggaatggattgggctgtcgcgctacgtgcgggtacctattgttggcgtgtatttctcgctggacatggaggaaatcggtttcgatcggggtagctggaagaggaaatttgacagtgacaccggatttacggaactggacgatgagacgtatcgcacactgttacgggtaaaaattcaggctaaccactgggacggcaccagcgaaatgctggaggccatttatcagcaaatcttgccggacagtaataccaaaatattgtttatcgataatcaggacatgacgatggatgtgtttttaaccggtggcgtcgttcttgaggtgattaaggcagtgatcaggcaaggctatctgaacgtcaaacctgaggcggttcgggttaacaactatatcaattctgcccgcaaggggctgtttggctttgatatcaataatgaatttgtcgccggttttggtacgggcggctgggctgtaaaactgtga

SEQ ID NO: 4429 - DNA, 1188 bp, Xenorhabdus bovienii
  Coding DNA location: Contig name=SeqID_16895; Position on contig =265025..266212bp; Strand=-
atgcttaatctagacaccttagggcttgcggccaaaatcaccgcgagcggcatcactgcgcctgattacccgacgatactggaacggctcaacgggtattttcgtcagatttacggcgaggatgcctatttagagccggacagtaaagacgggcagatgatcgccatttacgctctggcaatccatgatgccaataacatggtcgttgcgtcctataacacctacagtccccgtacgtccagcggtgccgcactctctaacaacgtcgccattaatggcttgtcacgccatgcagctactcgctcgacggccgatattactctggtgggtcaggtcggcacggtggttaaaaacggtctcgtgcgtgaccggaacaaccatccgtggacgttgccagatattgtcacgataggtacgcagggtacagtaaccgtcacggcgacctgtcaaaaactgggggcgatcaccgccgcaccgggcgacatttatataatcggcacaccgacacggggctggcagagtgtcactaattcgtatagcgccacggcgggcgcgcccattgaaccggacggcgcgttacgcatccgccaacataaatcggtcgcactgccatcgcgaacggtacttgatggcatgcacggcgcaatcagtttgataccgggtgttgttcgtctgcgtggatttgagaatgatacccataaaactgacgtcaacggtatcccgccgcactcggttgccatgatcgtcgatggcggggacgcgactgaaatcgctaaaaccattgccctgaaaaaaacgcccggctcagggacgttcggcgacacaacgattaatgttcgcaaccattatggattgtcaactccagtccggttctcgcgtcccgttgacgtgcctgtttatgtcgagctgagtattacggcttttgagggctacaccacgctggtaggggacaggatcaaaacggccatcgcgaaatacattaatacgattgttattggcgataatgtttatctggcgcggctctattcccctgccaacctgcccggcgatgaagaagggaagacctacgacattaacacattgaaaatcggccgatcagcccatgcgctggcggaatccaatttaaaaatcgcctttaacgaggcacccgtttgtaacattgacaacattaatgtggtggtgacatga

SEQ ID NO: 4430 - DNA, 348 bp, Xenorhabdus bovienii
  Coding DNA location: Contig name=SeqID_16895; Position on contig =266216..266563bp; Strand=-
atgcgataccgacgagaagacagcaacggcgattacagtttcgggcagggtgatagtacctttctgaccaactcacccgaagcagtcgcacaggccgtaaaaacacggctcaacttatggcgtggggactggtttctggatacggcagcgggaacaccctaccgagaggcagtattagataaaagctatgccagtgcgatggcaattcgcgagcacattctcggtactgagggggtaactgaaattatctcactcgatgctaaacgtgatcccgacacccgaaaaatgaccctcaccgccactatcaacacccgctacggcaaaaccacagtaaccagcgaacggtaa

SEQ ID NO: 4431 - DNA, 756 bp, Xenorhabdus bovienii
  Coding DNA location: Contig name=SeqID_16895; Position on contig =266563..267318bp; Strand=-
atgatcactcaccatgaacgagttaaccagcccgaaacgccgtttctagtcatgcagacggcgatcagttccgggctatacgtggccttaccctgcattattcagtcatttaatgccgatgcggtgacagtgactgcacagcctgcgatacgctggaaagtcacgaacagcgaaggcaagacagaatcagtagcattacctttgctggtggacgtgccggttattttcccgcgtggaggcggtgtcacactgacatttcctgttaaagccggtgatgaatgtctggtcgttttcgctgaccgttgtattgattactggtggcagagcggcggtgttcaggaacctgtagaccctcgtcagcataatttatcagatgggtttgcgattgtggggcctcagtctcaggcaaagaaaatcagtggtatcagtaccagcgccgcccaactgcgaactgacgacggcgcggcctacatcgaactgtctcccggcagtcataacattacggtcaaaacgcccggcaaactgaccgcaacggcggatggcggaactgaaatcacttcacccgagattgtgctcaatggcaatgtgatcatcaacggcaatctgtcacagggtatgggtgccagtggtggtatggcgatgatgaatggccctattaatgtgaaaaatgatgtgatagcgggtggcgttagtcagatgaaacacaaacatagtggagttgaaacaggcggcggaactacaggaggacctcaataa

SEQ ID NO: 4432 - DNA, 303 bp, Xenorhabdus bovienii
  Coding DNA location: Contig name=SeqID_16895; Position on contig =267386..267688bp; Strand=-
atggatgaaaccgacataaaaatcaaaggacagtggaaatatctgtaccgggcggttgacagcaacggtcagaccatcgacttcctattgaccaccaaacgagatgccgcggcagcccttcgatttttccgtaaggccatccggtaccatgatgaacccgaggtggtaaatctacgggggttatcgcctctggcaacagtgataaagagatgcctacgcccattgacgccgatggtgactacgtggttatcaacgtcaactatttcggtgatacccgtgaaaacacgtggtacatggaattga

SEQ ID NO: 4433 - DNA, 258 bp, Xenorhabdus bovienii
  Coding DNA location: Contig name=SeqID_16895; Position on contig =267695..267952bp; Strand=-
atgctgttttttttgagatgttacctgactatgcctctgatccgaaaagccttcaaacgtctacattatcctgtcgatatcatcgctcagtgcgttcgttggtatctcgcttatgccctcagcctgcgtaacttggaagaaataatggcagagagcggcgttgtcgttgaccattccacgcttcaccgctgggtcattcgcctgataccgttgctggataaggcctttcgccgacataagcgcaccgtgggtcgttga

SEQ ID NO: 4434 - DNA, 981 bp, Xenorhabdus bovienii
  Coding DNA location: Contig name=SeqID_16895; Position on contig =268461..269441bp; Strand=-
atgaaaacacctacactacagaatagtgaaaataagattgtgatgggcttctggcacaattgggcaccggagccgggccagggttataagcaagggcgttttactgaaatggacctgtcagaaatccccgtggcgtataacgttattgccgttgcctttatgaaggtactggagaacagcgaccgtattcctgatttcaaaccttataaaggtactgaaactgagttccgccgtcagatcgatctggttcacgctcagggtcgtaaagtgcttatttccctcggtggtgcggatgcacatattgagctgatcagcggggacgaagtggcgctggcaaatcgtatcatcgcgctgactgaacagtacgattttgacggcctggatattgacctagagcaggctgccattactgctgctaacaatcagaccgttattcctgctgcactgaaagtagttaagaaccattttcgtccgttgggtaaaaacttcaccatcagtatggccccggaattcccgtatctggcgcaggggcgtgagtacaacgcctatattaacggactggaaggctactacgattacatcgccccgcaattttataatcagggcggcgacggcgtttacgtagatggcgtcggctggattgcccagaataatgatgcacagaaagaagacttcctttattacctgaccgagagcttggtcaccggtatccgtggttttataaaaattcctcacggtaaatttattataggcctgccagccaataatgatgcagcagccactggctacgttatcgatccgcaggatgtgtataacgcgctggcacgactgaaagcggcgggtctggacattctcggcctgatgacctggtcagtgaactgggatgccggcttcagccgcagcggtgaagcctatgcctgggaatttattaaccgctatggctatctcgccaatgatggcacggtaccagaaccagagtag

SEQ ID NO: 4435 - DNA, 123 bp, Xenorhabdus bovienii
  Coding DNA location: Contig name=SeqID_16895; Position on contig =269560..269682bp; Strand=+
atgaatacgatagtcagtgttgcgattgtcgggatggcgaataaactggcccgcacggtctggacactggttgcccatcaacgggaataccaaaaaaattacgtcagtgtcaggccttattga

SEQ ID NO: 4436 - DNA, 120 bp, Xenorhabdus bovienii
  Coding DNA location: Contig name=SeqID_16895; Position on contig =269755..269874bp; Strand=-
atgatacaagtgcaatttttcagaagggcggtcagttgctatagtaggcatctttctcgccaaaggaatctatggtccctatatgaacgcatcccgtttgcaagacaaaagttattgtga

SEQ ID NO: 4437 - DNA, 102 bp, Xenorhabdus bovienii
  Coding DNA location: Contig name=SeqID_16895; Position on contig =269831..269932bp; Strand=-
atgtgcaatatgaggctcaccttgtttcttatgatggtagctaaccaccataattactatgatacaagtgcaatttttcagaagggcggtcagttgctatag

SEQ ID NO: 4438 - DNA, 165 bp, Xenorhabdus bovienii
  Coding DNA location: Contig name=SeqID_16895; Position on contig =269889..270053bp; Strand=-
atgccatcacgccaatttcacttgtatatacagagtcgttgctcttggttaccgttcaatattggtgctggcgtggaaggtgaaacaaggggccttcgcttattaacaaagtctcgcttaaatgtgcaatatgaggctcaccttgtttcttatgatggtagctaa

SEQ ID NO: 4439 - DNA, 987 bp, Xenorhabdus bovienii
  Coding DNA location: Contig name=SeqID_16895; Position on contig =270074..271060bp; Strand=+
atgtattatgtcggaatagatgtcagtaagaataaactggatatttgtttgttatatgatggagttaaaggtaaacgcaaaacaaaatcccttctgaataatgaacatttagcctgtatgttaatagcgtggctagctaaatatattcctgccctgcaacaagtcaatatcgttatggaagccaccggagtctatcatgaacggttggcttattcccttcatcaggctgggggaaggattgcaatagccaaccctttacgcgtgcgtgattttgctaaaggtatggggatactgactaaaacagacaaagtagatgcctatattttagcctgttacagtgccttaaaacaacccgatgtctggcaacctcctcctatagaaattcgcgaattgaaggctctcctatgccgtcgggatgcgttattagaagatatccagcgtgaacgtaaccgatatgaaaaaagcggctcaacccataccccaaaaagggttattgagtccatagaggcaatgatgcatcacatgaaaaatgagttagccgagcttgaggctcttattgccgagcatataaaccagcaccctaatttaaaaaaagattttgaacttttaacctcaataaagggggttggaactcagattggtcttaacatgctgattatcttacgtacgaatacctttactcgtgcaacgcaagtcgctgcatatcttggtgttattcctattgcaaagcagtcaggtacatcggtgcatggtcgagtgcgcttatctaaaacggggcctgctaaaatccgtgctaagttgtttatgtctgcactcactgcagttcgttttaacccccacataaatgatttatataatcgattggttaataaagggaaggcaaaaatgttggctttaggcgctgcgatgcgtaagttagttcatttgtgctacggagtattaaatacgcagcaatcatatgatgaaaactatgctattagaacttga

SEQ ID NO: 4440 - DNA, 183 bp, Xenorhabdus bovienii
  Coding DNA location: Contig name=SeqID_16895; Position on contig =271118..271300bp; Strand=-
atgttcctgataatcacgtatatcgtatcagaagatatgaatgaacactgggtttactttctaggggcggtagcgtgcccacaaaaaactatatccttaggggcttacactaataaagtgaaattttcttatctaattaattatcgttccggtattaattgtaatgtcgatgaatatgattaa

SEQ ID NO: 4441 - DNA, 594 bp, Xenorhabdus bovienii
  Coding DNA location: Contig name=SeqID_16895; Position on contig =271529..272122bp; Strand=-
atgaaaaaaaacacttccagaggttctgtcgcattaacggaacatcaggtaagctccctattttttagcgaatccagaacgatgtccctgatccgaaatgtgttcaaacgcctgcattatcctgttgatatcatcgctcagtgcgttcgcgggtatctgacctacgcgctaagtctgcgtaacttggaagaaatgatggctgagcgcgggattgcggttgatcattccacgctttctcgttgggttcatcgctgggtttcgttgatcgttaaacgttatcggcggggcaggcccgaagttgaacgtcggtggcgaatggatgaaacttatatcaaaatcaaaggacaatggcgttacctctaccgtgctatagactcagacggtaatacggttgaatttttgctgacagctcatcgggataaaaaagcggcattgcgtttcttcaaaaaggcgatgcgtcaacatggacaacctgacggggtaactcttgataaaagcggtgccaataaagcggcgttggacgaaatgaacaaggaaaaactgaaaaatatcacaacaactaaccattcaatacatgacctaatttttaaataa

SEQ ID NO: 4442 - DNA, 198 bp, Xenorhabdus bovienii
  Coding DNA location: Contig name=SeqID_16895; Position on contig =272352..272549bp; Strand=-
gtgtacagagaagttagagtcgttttcatctattccggcgcattcagtacttataccccggatgtagcgctctaccgcagttgcgatagaactggagttggtgaaaaaggcagtgttaagcaactggtcgatctaattggccagttgcacaaattgtttttggggtttcaggaacaacggaacagtaaacgccgttaa

SEQ ID NO: 4443 - DNA, 7626 bp, Xenorhabdus bovienii
  Coding DNA location: Contig name=SeqID_16895; Position on contig =272483..280108bp; Strand=-
atggtttatatgtcgaaagacttcaaaaaattgctcaatactctgatcgatcgacagatcgaggtggcgggtcgtcagaccgaatggttcaacatgaatgccaacgcgcgtgccgactatatcaggcaggtaaacgaacgactgcaagaaatgcagcagagtaccctgagtgtgctggctgctcagcattttcagatgcaggacaaccctgtttctgtcggcgaccagttgcagacgctacagcaaagacggcagcagatggacggtaaatctgacacgccggcgattaaggcctacaagcagcaactggatcgcgacatccggttatacagccgccagcaggcggccataacgcactttaacagttctaggaaaaaggccttggatatgctcagtcccagcggttccaagaccttgaatgcgatgactctgagggaggatgcggcggtcaagcaggctaagctggataccgagatcaagaatctggaacagcaactgactatacaggtgactgactccacgttcagcccaaaatacgtgaggctgttttccaagctgcaggcctacaaggatgtcaaagcccgctacattgccttgctcgagacatcctctaaggaagagacaaaagaagctaaggttttcagcaagctgatcgaagtgcctctggcctctgatgatttgccggtaaatgtttcactgttaatgatggaggaacgtcctggctacatccgcatgaacgtcgctctggttaatgccagccccgatggccgcttcaaggacttcttcctgaaggacggcaggctggtcgtgcctaaggacggggtattcaacttttcctttggtactccagcccgctccctggcctggcaacaacaataccggcttaagagtgagccgccatcctttcgctctccgacctatgcaccaattcgctcggtactggtcaaaatcgaattcgtcgagaagtatttcgctaactacctggtttcggaaagcaccgagcgcgaaggcttcaaggagcattttctggataacgatcgcaagatactgttgatcagcgttgaccgcaaggtaccgaaccaaattgggattaaggtgtccggccacacccatgaggttccattggccggcaccttgagtgacctgatcaaccagaatgctgatatcaccagcttccagactatcggcttggaggatttccgccagaacagttatgacccagatcgtgatgggcttttcatcaatatccatgagctggaacgctcggtcggttttggcaatcgccagtacttgctggaaatgccacagggcaaaatcccgagcaaaacctacctgtccgcaacgccctttggggtgatgagcgttgacggcgacaaagtcagcagtggtcacttgagtaaggcacagaccgccgaattgtatcaatacaacgccgcatttttcgagacgctggatcgattgcgagacgatggtgcgaaggccagtcgtttgtttgaaggcagtagcgaacgcaaagtgttcgagcagcaactggtgcgtttgctcgaacgcaaccacatcacccccgcaggggtgttggagtcggagtacaccgataacagaatgcgcgatatcaagggcaataacctgaacaaggtgttgtgggaacaggcgtttgccacttcggtctgggaaaacatcgataatgacccgctactgtctaaactggcgaataaactgaatagtctagtattctcctccacaaccgtggacaaggtcttaaaaaatagctatgtgcaaagtgacatcgcccaagttaagggattgctggcactgcagtacgaacaatggcgcattcgggccaccgaagaagaaacccagcggatcaaccgcgctaatgcagaacagcatccaaacaacccgaaaatacaggtcttcaatcagaccgaggttgagcgctcgctggacagaaagctactcgccttgttgttggtcggccccgagaactttgagagaaccgatgagcaattgtatccggccgttaaggcagctctgttgagcaatgagggcaggagcctgcgcaaacaggtcttgttccatgtcttgcgcccggtagccgatagcttttccaagcttgcagtcccggtaaatccccatgctgagctgatgtcggaaagaggtgacaacaaggtcataatcaataaccggctgaatcagccagacccgtttctgatcctcaataccagccctgaggagcaggtatatcacgatggttcgaacctgatcaaggacgataagtaccgcagctacaaccaattccgtccggatcccgagaataaggctacactctacatgaatgatctggataccccgttcgtaggcggaatttcagggaccacccagacggtcagcaatgtcttaccggaattgttcggtgacacgttgagcgtcaaggagtactggaacttccagatggccaatgcggccttcatgatccgtaacggctatcactcgttctttgaaaccttctatgtcgctgcgcgttacgaaccgaagagtgcagacagtatcggcaagggcatgttacagatgtttgacgagtaccgcgctgaaggcagagagaaggcgttgcagggtgaactgtatgacggagtgatggcacgcgtcttgccgatcatcaatcagggcttgccagaggctaagaagttccattcaccgcgttttatgccgacactgctggatcaggaggaaggtcgctaccgtcatgaaccagagggcattgctccgttcgatgaaaaacctgtcagtaactgggaaaagcctgtagttgaggctcaccatgagggtggaatgtcccgctttgatggtcagctgattattcagcttgaaaacgatcctgtagtcagggaagcggcagcaaaattagcgggaaaacacacagattcggtgctggtgcagctggatgcccagagtcaataccaggtggttcatggtgacctgactatcctgaaggataaaggaaaaatccgttggcaactggttggtcatagccgcgatggtggggataagcttaatcaccagacgctggccaaacgtactccggaagctctggcgtcacaactcagccagttctatacagactccggcgttaaaacgtcccctgaacatatcagtatggtaagctgttcactggctggtgaagaccaacaggaaagctatgcgctaaagtttgctcagtcgcttgaccagcgtattcgtccactttctgttaaggcttataccactcaaattactgtcagccctgaaggccggaaacaactcatagaaaacggtaataaagccgcgcttgtttttaatccggagaatagtgtatgggagataaccgtaacgccaggtaaatcggtccctgcagggggtatggttaacccgccactgggaaacaaaacggctccgattccagacaatgtgcagattgacatccggctgctggagatgcttaaccgtgcagaggattttcagcaggccacggagcagctgtacagtaaaaacgcactgtccgcagaagaatggctgccagtactgggcagcctcagggagggggtgtcccagcccggaagttattctttacagtttattaatacggcacggtctgagcttcctccccagacattcataacggatgaccgacgtattattgattttattcattcttatgataaagatctcgagactgtcagcaaaactcacgcgtataccaaagggaaactaaccctgcgcacaggtatccccgaagcagatgctgttcacggactgaataccgcctttatagttaagactctgatcccttggtttgccgatagaaaccgcaccaccgtagccagtgataaggtgcccaatacgatgcccaatacgttagagaccgcactgcgggtgcacacttatgttaacctggcgcagatggctcatggtacgctggaggacggtgctaaactcgccagtttgtacagggcggtggtcagtgaaggccggggagtgaccagcagcctgttttcatcactgtcccatgtcagcactggtgtcggggcggggttaaatatcctcagtgtggcactggatggcatagaactggcgcatgcgcagaatgaatcgcagaaggctgtttatggtacccagctggcgtttgacagtgctggcctggttacaactggcgtgggtattggtgccgggatcttcggtgcccccattgttgctggttttgcctcctcgctggcggtaccactggctggtttgggtattggttttacggctctggccgaggcgttcggcagggtagccagtgatgcacaagcggtaggcaattattttgccgatctggaagcagcttatcagcagggtggatatcggcagacggaaaaagtggcagcagatggcagccgttatacggtgatggaaccgatccccggcgcagtgatccgtcagctcgatttgcgccacggtcacctgacttttgacagccagtatctctatcgcaatgacccgacttactcatggggctcgggtaggagtaattactttttctggtggcccggcagggcggctgatactgataaaaagcatgcaattaatatccgcgaaggcatcggtcacaaacaggcacagagcaacttccatttccgttctagaagcagcgacatactgatcctgccagttaccatgaagtcctacattaattacgaatatatgatcctgcccttcgtcactgcccgcaacgaccggggatttgacgttctgcgccgactggaagaagacggacgattcgactttgatttttatgcttttcccggagagcgcgtggtacgccgtataaagccggaatttgttgcgacgccgattgacatcattctggacgatgaagaccgggatattgtcattcagcagttgccggagaaggactacgggatcctgtcctatcaattgaccggcgggaagggcaaataccgtatcagcttgcaggagggggtttctctgtccttacaggaaaacaccggtacccactggatactggatgcccgtcatatcggctctaatgttaacaccagtttcagcaaaaaagataacagacaactactgcatatcggcagtataaagataaccctgcctgaaaagtcggataatatttctctgataaataatgcagggatattttctgtcaagcagaacaaagagaatcagtggcagataacagagagcgtaacgaatgctatgcagtttaacagcctgcaggcgttgcatgatcatctcaggcagttaagcaattctgaacatcacaacaggccatatttagtagtggaacactaccagcactcaccgcaaagccgtcctgtcggccgtgcattctatgagaccggtcgtgatcgtatgatttacactaacgtccctgacgcagcagattttctcagctatgcagagctggcgaaagttgaaggtaataaggcgtggttttatcgggatactacgctctggcaagtggatattgtcagtggcgaagttctgcggcaatatctgccgataaaatttccggggagtgatcaggagaaaatcagcagccatgtgatgcagagcaatgaccagctctggtttgtggtggaacggcagctggatgagggctatatctcgtatacttatcaggtggcagaggaagcactgaaactggtggcagttgacgggaatacggtcatgttggcgggcctggataaaatcagtgaaaaaaactttgtcgcgctgcctgtcccccttgattccagtgacggtgagtttaatggccttctggcaccactggcggcgaatcagtggttcaccggcgatctctgtgcgccggaacgtcaggttaaaggcagcccggcggaggtgatcagcctttctgggcgagtagctggtgtggatagacattactggttacagactgatggaaaacagctgcggaatgtggtcagaatgaaccggataaatccggatcaagaggatgccggcatcctggctgagctgaaaaagaaaaattcggatctgctggccctgacggctgattttacccgcgttttcaccacgaccggtgataaaccgggttattatttttacagccatcagcgacatagtctttattttcagcaggataatggcctgtccggcactccggccagcaaagtggctgttgatgatatcagatccgtatccatagcgaacaagcagttggttgcactttccagtagggggatgctgtggctggcggatgatcagggcagtatccgtctgatcggggtgacggcagactggctgcagcaacctcaccagaatggtctgacagccgcattgagtcagctggcgcgggataatccagatcggttcagcaccctgctgctgctggggttacaggatagcaacggaaaaccaatcagtgcctggtatgacagtacggcaggccgggtggtgcagagcggagttggtctcattacagaacacactctgacctatcttggtttagcggaggatggcagtcaggcatggatttttgacaccgataaccatcagttatatcgtcagcccctgtcggcggagcctgaccttaagttgagtgaaaagcgggtgctctctgaggaacctgccgcagcggaatcttggctccgggccagccatcaataccgcagtgcggttcgtcagggcaatacactccggctggaaaccccggacggcgcggtcttactgctgtcagctgatgccaagatgacagaccgcccggtgctgattgcctggcatgtgcagggtcgcccggacagtcaaattgcctcagccattgtggcgctcaggaatgaggctgaattaccgcaagccgttagactgttttctgagcgtggttatcctgcttggtacctgccggaggaagggaaaacgcttcgttccagcatagttgactcgaatcatgttctgcattacttgggtcaggtcgccgggcaggaggccagttatgtccatgaccagactaccggagaattgtggcaagtcagcgaagaaaaatccaccttagaggggaattactgttttgttaaccgaacaccggagagtctggtgttgcaggtgggtcaggttcctttgggggaaaaaatccgtctgccgcaactggcgggcactgatcggctggccatcaccggacgttcaaaagaattgtattactggctttcctcccctgaggcgctgactcactaccggcatatcacgatagatgatcggggtcagggttcagccatccggttttctgatacctgcatagccaacctgtcactctggcgcagtggccaaaatctagtgctgcttcatcaggcatcagaagacaccagtatatgcattgtcagtattgaacaggcggcgcagcgctatatgaggcttgaaagtacaggaactccggcgctgaagaagatgaagataattcacttactgagaaaaatggacaaactgacggtattaaaccccgatgtcagctgtttcgagctggaatcagaggaaggtgaactcaggataaaaccagctgagtgtacagagaagttagagtcgttttcatctattccggcgcattcagtacttataccccggatgtag

SEQ ID NO: 4444 - DNA, 177 bp, Xenorhabdus bovienii
  Coding DNA location: Contig name=SeqID_16895; Position on contig =280278..280454bp; Strand=+
atgatgtttgttatctatttgttttcgtttattttattatctggatatgacgtcaaaggctttataacgatctttgccagttccgatatgacggtatgctatttggaacatttggtatcttcgtcattttcggatagcggaaccgggcatgaaaaaacagatgtagcgctattatga

SEQ ID NO: 4445 - DNA, 537 bp, Xenorhabdus bovienii; identical to SEQ ID NO: 2180
  Coding DNA location: Contig name=SeqID_16895; Position on contig =280489..281025bp; Strand=-

SEQ ID NO: 4446 - DNA, 441 bp, Xenorhabdus bovienii; identical to SEQ ID NO: 2208
  Coding DNA location: Contig name=SeqID_16895; Position on contig =281051..281491bp; Strand=-

SEQ ID NO: 4447 - DNA, 1713 bp, Xenorhabdus bovienii
  Coding DNA location: Contig name=SeqID_16895; Position on contig =282357..284069bp; Strand=-
atgttgtggaaaagattacatcgctggatgccggggttggagaatttttgttattaccgcaaagagtattttagtcatgatatacggtcaggcctctcagttgctgcggttgcgttacccgttgcaattgcttatgcggagttaatgggaataagcgccatcattggtctgtatgcctgtatcttaccgatgtttgcctacgctttatttggcacgtcccgtcagttaattgtcgggcctgatgccgcaacatgcgccgtgattgccgcagcagttgccccactggccttgggaaatgagcatgttcgttggcagcttgccattatcatgacactgatgaccggattctggtgtattttagcgagccattttcgactgggtgcatttgccgattttctgtcacgccctattttaaaaggctttatcaatggcgtggcgattaccatcatggctgatcagcttgctaaagtattcggactttcgggtttacctccggaattaattgagcggttaattgcgcttcctcataaattattggaatctcactggccaacagtaggcatgtcagtgatgactttactgatattgttaggtgtgcgttttctgcatccaggttggccagcaccactgatagcgatgatcgtttcaacctatgtgagctggcaatttgagctgaatcaatatggtatccagatcgttggcaatatggagagcggtttgcccatcgtcccaatgcctgaatttcaacttggtgttatgcgtgacttggttgttccctccattaaccttgcggtcatcagctttgtcagctttatgatgacggctcgtagctttgccagtaaaaatggttaccaggttgatgcggatttggaactgcgggcattgggcattgccaatattgcctcatcattatcactgggatttgctgttagtgctgccagtagccgtactgcggttaatgatgctattggtggtaaaacacagatggtgtcggtcattgctgccattactatattattggtactgctgtttatgacagaatttctggggtatatccctctgtcatcactgggtattgttttgatcttctccacatggtcattgttggggttaaaaaatatctggtcatatcgaaaacgtaaccgccgggcttttacgctatccattttcacattggtagccgttttactggttggtgtgattgatggtattggctttgcggtattgcttggtctattgcaatttctgcgcatcatttttcgtccctccgatcaactgttgggggtgaatgagcaagggatgatccactctatcaatcaaggcaatgatatagcgtcagtggatggcatcatgatgtaccgctttaattcgcctttaacttacttcaatgttgggtatttcaaaaaacgggtattacagcatgtagagagagcatcgaaatatcctacatggctggtggtagatgcagcggttagttttactcatgatgatgtaagcgttttcgctgtgttggatgagctgattacggaattgaaagaaaaggatgtgactttagtactggcggggcgcagaacagaattaaattactggatcaagcagaacaggcttagtcgtagtgatgaagatttgattgtcgtaccggatctctattttgccattcgtttgattcaaagtaagcagcaagtagaagaaaaaaaagaagaatgtgcgtag

SEQ ID NO: 4448 - DNA, 141 bp, Xenorhabdus bovienii
  Coding DNA location: Contig name=SeqID_16895; Position on contig =284068..284208bp; Strand=+
atggtatttagtcctttcgtgaatggagcgcattataatgcggtgttaaataaaaactctcaaccctacccgtggcctctcagtttctctgttcgttatggtaaaattagggataaacatgttttttcacctgataaataa

SEQ ID NO: 4449 - DNA, 537 bp, Xenorhabdus bovienii
  Coding DNA location: Contig name=SeqID_16895; Position on contig =284287..284823bp; Strand=+
atgaaacaacttttagactttttgccattagtcgtttttttcatcgtctacaaaatgtatgacattttttatgcatcaggagcattgatcgcagcaacaggattggccgttgtcatcacctacctgatttaccgcaaagttgagaaatcatctttgatcacttttattgtggttgctatcttcggcacactgacactggcttttcacagtgatttattcattaaatggaaagtgacggtaatttatactatttttgccttagcactgcttatcagccaatggtttatgaaaaaaacgttgattcagaggatgctgggtaaggaactggaattgccggactttatctggaaaaaattgaacatatcttgggcgattttctttattgcctgtgcactggcaaatatttatgtcgctttctggctacctcaggatgtttgggtaaactttaaagtgttcgggttaacggcattgacgctggtttttactgtgttgagtgtggtatatatctaccgtcatctacctcgcgaacaaaaataa

SEQ ID NO: 4450 - DNA, 438 bp, Xenorhabdus bovienii
  Coding DNA location: Contig name=SeqID_16895; Position on contig =284896..285333bp; Strand=+
atgacacaacaacaatgcttaccaaacggagaattggtcctccgtacactggccatgcccgctgataccaatgccaatggggatattttcggtggctggctgatgtctcaaatggatattggcggcgcaattctggcaaaagagattgcagaggggcgcgtagtgactgttagcgtagatggcatcagttttctaaaaccagttgcggtaggtgatgtcgtctgctgttatgcccgttgtctaaaaacaggaaattcatctatcacaattcatattgaagtttgggtgaaaaaagtggcatccgaaccggttgggcagcgttatcgtgcaacagatgcagttttcacgtatgtagctgttaataaagataatacttcacgacgtttacccgaaggaaaaactcagttcaaacttgaaagcagtgattcaaaacaatga

SEQ ID NO: 4451 - DNA, 687 bp, Xenorhabdus bovienii
  Coding DNA location: Contig name=SeqID_16895; Position on contig =285552..286238bp; Strand=-
atgcgttggatacactggccggtattactttctgtttgtttacatgtttctattgctgcggcgctctttcatgctattgaacccgaaaaacagctagaagcgactcccatatctgttgctatgatccaactggcagcggaagaagcccctgtctcggagcctgccatgcctgaatcaattcctgaaccacctgaaccagagcctgaacccgaacctatcgctaaggttgctctgcctaaacctgagaaaaaaccggaagagaaaaaggttgttaaaaaggagcctaagccgatggaaagaaaagtagagaaaacatcggaacaacctgtcaaaccagtttctgacgcttctcaaatggtgaataaccggaataatcagttaaaaccaacccatcctgcccttaatgacaaacctaaagtgcagaatgggccaaaagcattaagcagatcggtgcctgtttatccatcccgagcgtggcaattgggtacagagggaatggttaaggtaaaatatgatattgacgaagatggtagggttaaaaatattgaaattattgctgccgatcctaaaaacgtctttgagcgggaagtgaagcaagcgatgagaaaatggcgttatgaaaaagcgcctgcaacggggtatgtgacaaccattgaatttaagcttactggtatttcacagtcttaa

SEQ ID NO: 4452 - DNA, 180 bp, Xenorhabdus bovienii
  Coding DNA location: Contig name=SeqID_16895; Position on contig =286358..286537bp; Strand=-
atgaaacatagcaggaatgaagtagggcgatggcgaatgattcgccaaaacatccgtcgccgtcgtcgctggttagaggggcaatcacgtcgcaatttacacatctattcgttgcgcaagaccaatggtgacaggcgtcgcaggtcgattctgtttgtgcagagcggggagtgtctctaa

SEQ ID NO: 4453 - DNA, 195 bp, Xenorhabdus bovienii
  Coding DNA location: Contig name=SeqID_16895; Position on contig =286605..286799bp; Strand=-
atggaaaccctaacaaaccatcagctaaatgtagtcaacttagcagagaataatcaaaacattaccaatatcatacctgatgtagtctcacaggtattatgtaatttgattcagttaaatcatgaatcaattatatatctattaactaatgacttagattcaatacagcgttgtgttaaaccttccattggttga

SEQ ID NO: 4454 - DNA, 1461 bp, Xenorhabdus bovienii
  Coding DNA location: Contig name=SeqID_16895; Position on contig =286857..288317bp; Strand=+
atgacaaccttttattcagtactgaactggctggctattttcttatactggttgattattgccggtatcacaattcgtgttttaatgaaacgtcggcctgtaacatcagcaatgacttgggtacttatcatttatatccttcctttggttggaattgtcgcttatctgtcatttggcgaattgtatctaggcaaacgcagagtcgaacaagccaaacaaatgcgttcatctgtcgctaaatggctctctgaattaagaaaatccccccatatttttgcccatgaaaatagcaaagtagctgaaccgctattccaattatgcgagcggcgccagaggatcaaaggagtcaggggcaataaaatgcaactgatgacttcttatgatcattctctgaaatccatcgttaatgatattgaaaaagccaaccataatatcgaaatggtattttatatatggcaggcaggcgggttagttgatcaggttactggtgccttgatgcgtgccgctaaacgcggtgtcaaatgtcgtatcatggtagattccgccggaagctggcaatttttccgcagcccatatcctgacatcatgcgcaaggcgggtattgaatttgtcgaatcactaaaggttaatatcttccgtctgttcttacgccgcatggatttacgtcaacatagaaaaattattcttatcgataatcatatttcatacactggcagcatgaatatggttgacccgcgctttttcaaacaagatgcaggattcggccaatgggtcgatatcatggtaagaatggaaggcccggtcacaacgaccctggggattatctatgctttcgactgggaaatggaaacaggtcagcgccatcttccgtcaccgcctgacagcactattatgcctttcgagcaagccagtggacatacagctcaggttattgcttctggaccagggtttcctgatgaattgatccagcagtccttaatgacagctatcttttcagccagagaacaacttattcttaccacgccttactttgtacccagtgatgatttaatgcacgcaatttgtaccgctgccatgcgcggcgttgatgtcagcattattcttccaagccagaacaattcatttctcgttcgctgggcaagccgggcattttttatggaattgctagaagctggcgtaaaaatttatcagtttgaagatggtttgttacatactaaaagcgttttggtggatggacaactcagcatggtaggctctgttaatctggatatgcgtagcctgtggctaaattttgaaatcacggttgtgattgatgataagcacttcggcaatgatttaacattcgtccagcagggctatattgctcgctcgactctgcttgataatgaggaatgggcgaaacgcccgctctggcaccgtattcttgaacgtatctgttattttttcagcccacttttgtaa

SEQ ID NO: 4455 - DNA, 354 bp, Xenorhabdus bovienii
  Coding DNA location: Contig name=SeqID_16895; Position on contig =288470..288823bp; Strand=+
atggaaaataaaccaacacattctctccaattagatttcaataatcgaatgactgaggatgaaacgcttgaaaaagcctacgatatctttctggaacaagcgatcaccaatctcgatccggcagatagtctattgtttaatttacaatttgaagaacgaggcggcgctgaattattagaaccctcagcgatatggcttgaacatgttgattttgatttacatcctgatttttttgcagaagttattattggcttggcagaatctgacgatgctgaaattgatgatatctttgcacgagtattaatctgtcgggaaaaatctcacccaatctgccagatcttatggaaaaaataa

SEQ ID NO: 4456 - DNA, 1002 bp, Xenorhabdus bovienii
  Coding DNA location: Contig name=SeqID_16895; Position on contig =288918..289919bp; Strand=-
atgaacgcagcagctgaaaaacgagtcctgttggaagtcgatgacctaaaagtttattttgacattaaagacgggaaacaatggttctggcaaccagcaaaaactctgaaggcagtcgatggcgttacactgagattgtacgaaggagaaacgctgggcgtagtgggtgaatcaggctgcggtaaatcgacgcttgcgagagcggttatcggtctggttaaagcctctggcggtacagtaacgtggcttggacaaaacctgctggatatgagtggcaatcagtggcggaatattcgtaacgatattcagatgattttccaagatcctctggcatcccttaatccgcggatgacgattggtgacattattgctgaaccgctcagaacctatcaccccaaaatgaaatctggggaaataaaagaaaaagtcaaaaatatgatgatgcgggtagggttgttacctaacctaattaaccgctacccccatgagttttcaggggggcaatgccagcgtattgggattgcccgtgcgctgattctagagcctaaactggttatctgtgatgagccggtttctgcgttggatgtttccattcaggcacaggttgtgaatctattgcaggaattacagcgggaaatggggctttccctgatatttattgctcacgatctgtcgatagtgaaacatatttcagaccgcgtattagtgatgtatttggggaatgcagtggagttgggtacttatgatgaggtttatcataatccgttacatccttatacccgcgctttaatgtcagccgttcccattcctgatccagacaaagagcgaaataaacgcatcgaattgctggagggagagctgccttcgcctattgatccaccatctggttgtgtatttcgaacccgttgcccaatggctgatgcagaatgtgccaaaacacgtccattgcttgaaggcagcttcaaacatgccgtgtcttgtcttaaggttgatccgctatag

SEQ ID NO: 4457 - DNA, 1008 bp, Xenorhabdus bovienii
  Coding DNA location: Contig name=SeqID_16895; Position on contig =289916..290923bp; Strand=-
atgaatagcgtagaagcttcaaaaaatgctaaaagtgctgagccactattaacggtgaaagatctgaatgtcgcgttcagcacacccgatggcagtgtgatagccgtaaataaactgaactttgatttaaaagcaggagaaacgttgggcatagtgggagaatccggctccggtaaatcacagactgcttttgccctgatgggattattagccagtaatggtgttgtgagtggttctgctgcttttaatggaagagaaatactcaacctgaaagaaaaagatctaaaccgaatgcgggcggaagagatctcaatgatatttcaagatccaatgacttcccttaatccttatatgcgagtgggtgaacagctaactgaagtcttgatgttgcataagcgcatcagtaaaagtgaagctgtcgaagaatccattcgtatgttggatgctgtcaaaatgccagaagcgcgtaagcggatgaaaatgtacccgcatgaattctccggtggtatgcgtcaacgtgtcatgattgcaatggcattattatgccagcccaaactgttgattgcggatgaaccgacaacagcactggatgtcactgttcaggcacagatcatgacactactcaacgagctgaaaagagagtttaatactgccatcatcctgattacccatgacctgggtgtcgttgcaggtatttgtgacaaagtactggttatgtatgcgggcagaaccatggaatatggttctgcgcgtgatatattttatcacccgacccatccgtattcgattgggttgcttgatgcggttcctcgactggatgacgatgaggaatcattgacgactattcagggcaacccacctaacttactgagactgccaaaaggatgcccattccagccgcgttgtcaatttgccactgagcgttgtgccaacgaagagccacagttggaacattttgatcttgggcgcttgcgtgcctgctttaaacctcaggaggaattggtatga

SEQ ID NO: 4458 - DNA, 909 bp, Xenorhabdus bovienii
  Coding DNA location: Contig name=SeqID_16895; Position on contig =290933..291841bp; Strand=-
atgttactaaataaacgaaatagcgaagctctggaaaatttttctgagcaactggaagttgaaggccgcagtttgtggcaggacgcacgacgccgttttatccacaacaaggcagcgattacgagtttgtgtgtgctgcttctcatcacattatttgtgatttttgcgccagtgttgtctcaatttgcctacgacgatacggattggaatatgatgacgatgccacctgattccgaatctagccactattttggcaccgactcatcagggcgtgatctgctggttcgtgtcgctatcggtgggcgtatttcattgatggtcggtattgcagccgctttgattgctgtgatattcggcacgctgtatggggcgacatcaggctatcttggcggtaaagtcgatatgatcatgatgcgcctgctggaaatattaaactccttcccattcatgttcttcgtgatcctgctggtgactttcttcgggcaaaacatcctgttgattttcgtggcaataggcatggtgtcatggttggacatggcgcgtatcgtccgtggtcaaacattaagcctcaagcgtaaggaatttattgaagccgcattagtgggcggtgtatccacccgtcatatcgttttgcgtcatatcgtaccgaatgtattgggagttgtggtggtttatgcctcattgctggtgccaagcatgatcctgtttgaatccttcctgagcttccttggattgggaacgcaggagccgctcagtagctggggagccttattaagcgatggtgccaattcaatggaagtcgccccgtggttgttgttgtttccggctggttttctggtactgaccctgttttgttttaactttattggtgacggcctgcgagatgccctcgacccgaaagaccgttaa

SEQ ID NO: 4459 - DNA, 921 bp, Xenorhabdus bovienii
  Coding DNA location: Contig name=SeqID_16895; Position on contig =291856..292776bp; Strand=-
atgtttaaatttattttacgccgctgtttagaggcgatcccgacacttttaattctaattactatttcatttttcatgatgcggttggcaccaggcagtccatttacgggtgaacgaaaattaccgccagaagtgatggcaaatatcgaagcgaaatatcatctgaatgatcctatctataaacaatacttcaattacttagtccagctttcaaaaggggattttggcccatcattcaaatacaaagattacagtgttaacgatttggtggcagaagcattgccggtttctgccaaactgggatttgctgcttttattatggctgttgtattgggcgtcagtgcaggcactatcgcagcactgaatcagaatactaaatgggattacacggtgatggggtttgccatgacaggggtggtgatccccagcttcgtggttgcccccttattagtactgatttttgccattatattgaagtggctaccggggggtggctggaatggtggtgcgccgaagtacatgatcctgccgatggtggctttgtctcttgcctatattgccagcatctcccgtattacccggggttccatgatagaaatactacattcaaactttattcgtacggcacgagccaaggggctgccattgcgagcgattatcttccgtcatgctttgaaacctgccttattgccggtcatttcttatatggggcctgcatttgtgggcatcattacgggttcaatggtcatcgaaaccatctttggcttaccgggactgggtcagttgttcgttaatggcgccttaaaccgtgattactcactggtattgagcctgacgattctggtagggggattgactattctgttcaatgccattgttgacgtgctgtatgccgtcattgatccgaaaattcgttactga

SEQ ID NO: 4460 - DNA, 1638 bp, Xenorhabdus bovienii
  Coding DNA location: Contig name=SeqID_16895; Position on contig =292859..294496bp; Strand=-
atggtaaacacaacaaagaaaaggttagctgctggcattacggtagcgttaggtatgatgacgggttggcaggcatttgctgcacaggttcctgcgggagtgcagttggctgaaaaacaagttttggtgcgtaataatagctctgaaccgcaatctttagatcctcataaaattgaaggggtgccagaatccaatatagctcgtgatttatttgaagggattgtgattaatggttctaatggcgaaattttacccggcgtagcgactcattgggaaaatcaggaattcaaggtttggacatttcatctgcgtaaagatgccaagtggtcgaatggtgatccggttactgcgcaggattttgtttacagctggcgccgtctggctgatccaaatacagcatcgccttacgcaagttatctccaatatgctcatattattaatgttgatgatgtcatcaagggaaaacaaaagccggagtcactgggtgttaaggcgctggatgaccatacccttcaggtgacactcagcgaacccgttccctatctggtcagactactgattcattcgacaatgtcaccagtgcaccgtgcaacagttgaaaaatatggggatagatggactcagccgcaaaatttcgtaggtaatggcgcttataaactgaaaagctggagcatcaatgaacgccttgttttcgagcgtagcccgacatattgggataacaaaaatactatcattaaccaagttaccttcctgcctatttcgtctgaagtgactgatgtcaaccgctatcgcagcggtgaaattgacatgacttatagcaatctaccgatcgaactattccaaaaactaaaaaaagaaattcccgatcagttacgtgttaatccttatttgtgcacttacttttatgaaattaacaaccagaagccacccttcaatgatcctcgcgtccgtactgcattgaaattgggtatggatcgcgatctgattactaacaaagttaaaaatcaaggtgatacgcccgcttacggttgggtcccgccttacattgccgattttaaagatgaaaaaccagattggtacaccaaattaaaccagcagcaacgtaatgaagaagccaaaaaactcttggcagaggcgggatttagtaaagacaaccctctgaaaatcagtttgttgtataacacttctgatttgcataaaaaaatggcgattgcggccgctgccatctggaagaaaaatatcggtgctgaggtttctttagagaatcaggaatggaaaactttccttgatacccgccaccaaggcaattatgacatcgctcgtgcaggctggtgcgctgattataacgaacccacgactttcctgaatgttaaattatcttatagcagcaacaatacagctcactacaagagtgaagcatttgatgctttgatgaaagaagcattaaaagtgaagaccgatgcagagcgagtagaaatctacaaacaagcgaatgctctgatagataaagattctgccgttgttccgctttattactatgtaagtacccgtttagtgaaaccttatgtggggggttataccggtaaagacccattggataacatccataccaaggatttttacattataaaacactag

SEQ ID NO: 4461 - DNA, 1644 bp, Xenorhabdus bovienii
  Coding DNA location: Contig name=SeqID_16895; Position on contig =294621..296264bp; Strand=-
atgaggaaaacaccatcaaagttgggtcagttaatatcgactattgctttattatcgtttcctgtagcacaggggatggctgcaactgttcctgcaggagtggcattggctgaaaagcaggaagtgactgttaataatggcgttgaagtcgcttcacttgatcctcataaggttgagggtgcacctgaaactacgattattcgcaacctactggaaggattggttacgacagggcctgatggtgagactgtgccaggggtggcagaaaagtgggaaaatcaagattataaggtctggacgttttatttacgtgacaatgccaaatggagtgatggcaagccagtcacagcccatgattttgtctatagctggcgtcgccttgctgatcctaaagtggggtcaccttataccagttatctgcaatatacttatgttcagaatgctgaggatatcttaaaagggaaaaaagcgcctgagcaattgggcgtcaaagcgctggatgatcaccgttttcaagtaactctcagccattcggttccctatctggtagacatgttgagccacacagcaatgaaacccgtcaggcaagatgtggttgaggcattcgataaaaaatggacgttaccagaaaattatattggcaatggggcttatgtactgaaagattgggttgtcaacgaacgtatcgtcttaacacgtaacccgcaatattggaataataaagaaaccatcattgaaaaaggcaccttcctgcccgtcgtctcagaagtcagtgatattaaccgttaccgcagtggtgaaatagacattaccaatggtgctattacgccttatttgtaccagaaaatgaagcgggatattccagaccaactacacgtttcacctttcttgtgcacgttttactatgaaattaataacaaaaatccactgtttaaagataaacgggtgcgtgaatcgattaaattgagccttgacagaaatattatcgctgaaaggattatggggcaggggcagattccggcttatggtttcacccctacttacattggtgatggcggctttactatcaacccagaatgggcaaactggacgcaggaacaacgtaaccaacgggcaaaggatctattgaaagaagccggttttgatgcccgtaatcctctcaaattcactttattgtacaacacgtcagatcaaaacaaacaacaagccattgccgcagcatcaatgtggcagaagaacattggtgcacaagtgacgttgcagaatcaagaatggaaaacctcactggagagccgccatcaaggaaattatgatgtggcaagggcaacatggtgcggtgattataacgaaccttcttccttcctgaatactctgttgtccgatagcagtaacaatacaggtttctatcaaagcgctgcctttgataactatcttagtcaggctctggccgcgaaagatgaagcagcacgtaaagcattttatcagcaggccgaagctcagcttgataaagactcagggctgataccggtttattaccgtgtcagtgtgcgtctgattcgcccgacggtggtggggctgacagggaaagatccccttgattatatcgattttaagaatctctatattaaaaaagcgaatgactga

SEQ ID NO: 4462 - DNA, 99 bp, Xenorhabdus bovienii
  Coding DNA location: Contig name=SeqID_16895; Position on contig =296249..296347bp; Strand=+
atggtgttttcctcatttttcgctccaagttatcaacagcaaattaattgttttttaattgagcaaccctatcatcttactcattttgttaataaatag

SEQ ID NO: 4463 - DNA, 174 bp, Xenorhabdus bovienii
  Coding DNA location: Contig name=SeqID_16895; Position on contig =296710..296883bp; Strand=+
ttgtttttaaaaaatgatacaggaacgacgttattgattaatcatatttctcattggttgtttattagctcatttttagttaattcattccctatttcagtaaaaatttctcttttttatattaactttctaaatcaatacaaacgttaccattacctgtgcatatcacagtaa

SEQ ID NO: 4464 - DNA, 612 bp, Xenorhabdus bovienii
  Coding DNA location: Contig name=SeqID_16895; Position on contig =296862..297473bp; Strand=-
atggggttgtttgccttggtgaaccccatcggaattttacctgtcttcattagtatgacgaattatcagacaccagcggggcgcaataaaacaaaccttatcgcaaatttgtctgttgccattattttgtgtatctcattactgataggtgactctatcctgcacatgtttggcatttttatcgattcatttcgtatcgcaggtggggtgttgatagtgacaattgcgatgtcaatgattaacggcaaactgggagaggataaacaaaataagcaggaaaaatcagaaacagcggttagggtcagtattgcggttgttccattggcattgcctcttatggcagggccgggagctatcagctcttgtattgtatggagtgcatgttatcaaggatggcaaaattatttggggcttgcattaacctgcctgctattcactttttgttgctggttattatttcgttcagcgactttattggtcaaatttttggggcaaacaggtattaatgttattacccgaattatgggactattgttaatgtcgctgggaattgagtttattgtgcaggaacaaaagccgtgtttcctggattactgtgatatgcacaggtaa

SEQ ID NO: 4465 - DNA, 2664 bp, Xenorhabdus bovienii
  Coding DNA location: Contig name=SeqID_16895; Position on contig =298015..300678bp; Strand=+
atggctgtaactcagattgccgaactcaatgaattagttgctcgtgtaaaaaaagcccagagagaatttgcccatttttcccaagaacaaattgaccgaattttccgtgcagctgctctcgcggcagcagatgcccgtattccattggcaaaattagccgtagctgaatctggtatgggtattgtggaagataaagtgatcaaaaatcacttcgcttctgaatatatttataacgcctataaagatgataaaacctgtgggattttatctgaagataatactttcggtacgataaccatcgctgaacctattggcttgatttgcggtattgttccaaccacaaatccaacatcaaccgcgattttcaaggcactcatcagcctgaagacccgtaatggtattattttttcaccccatccacgcgcaaaaaaagcaaccaatagggcggcagaaatcgttcttcaagcggctgttgcagccggtgcgccaaaagatatcatcggttggatagatgaaccttctgttgagctatccaatgctttaatgcatcaccctgatattaatcttattttggcaacgggtgggcccggcatggtaaaagcagcctatagctcaggcaagcccgcaattggtgttggtgcgggtaatacgccagtcgtgatcgatgaatctgcggatatcaaacgtgccgtagcatcgatcctgatgtccaaaactttcgataacggcgtcatttgtgcttctgagcaatctgtaattgtcgtcgatagcgtttatgatcaagtccgtaaacgtttctcgacccacggtggttatctcctgcaaggagaggagcttaaagccgttcaagatatcattttgaaaaatggcagtctgaatgccgccattgtcggccaacctgcaaccaagattgctgaaatggcaggtatctgcgttccggaagaaactaaaattcttatcggggaagtcactctggtggacgaaacagaaccttttgcccatgaaaaactttcgccactgcttgctatgtaccgtggtaaaaactttgaagatgccgttgaaaaagcagaaaaactggttgaaatgggtggcattggtcacacctcctctctctatactgatcaggataatcaatccgaacgtatcaaatatttcggcgacaagatgaagactgcccgcattctgataaatacaccggcatctcagggtggaatcggcgatctttacaatttcaaactctccccttctctaacactgggttgtggctcttggggaggaaactccatttccgaaaacgtggggccaaaacacctgatcaatacgaaaactgtcgccaaaagagccgagaatatgttgtggcataaacttcccaaatcaatctattttcgccgtggctccctgcccgtagcactggaagaagttgctacagatggcgcaaaacgtgccttcatcgtgacggaccgtttcttgtttaataacggctacgccgatcaggttatcaatgtatttaaatctcacggaatagaaaccgaagttttcttcgaggttgaagccgatcctactttaagcatcgtccgcaagggcgctgaacaaatgcatctgtttaaacctgatgtcatcattgcccttggtgggggctcacctatggatgcagccaaaattatgtgggttatgtatgagcatccagaaactcactttgaagaattggcactgcgttttatggatatccgcaaacgcatctataaattccccaaaatgggcgtgaaagcaaaaatggtagctattacaaccacctctggaacaggttcagaagtaacaccttttgcggttgttaccgatgatatcactggacagaaatatccattggcagactatgcattaacacctgatatggcgattgtcgatgcaaaccttgtcatgaatatgccaaagtcactgtgtgcctttggtggattggatgccgttacccatgcactcgaagcttatgtttctgtcttggctaatgaatattctgatggtcaagcattgcaagcgctgaagctactgaaggattttctgcctgccagttaccatgaaggcgctaaaaatccagttgcccgcgaacgcgtccataatgcggcaaccattgccggaattgcctttgccaatgcttttctgggggtctgccattccatggctcataaactgggttctgagttccatatcccacatggattggcgaatgcgttgttgatctgtaacgttattcgctacaacgctaacgacaacccaacaaaacaaactgcattcagccaatatgaccgtccacaggcacgacgccgctatgctgaaattgcagagcatctgggattgacggcatcagaggatcgcactgccgccaagattgaaaaattactggcttggctggaagagctaaaatctcagttaggtattccagtgtcaattcatgaaacaggtattcaggaagccgatttcctggcgaaaatcgataaacttgcggaagacgcttttgatgatcaatgcacaggcgccaatccgcgttatccattaatttctgagttgaagcaattgatgctggactctttctatggtcgtaaattcacagaatatgccatatctcagcaggcagaaaaatcaaacagaaaaaataataagaaacagtaa

SEQ ID NO: 4466 - DNA, 612 bp, Xenorhabdus bovienii
  Coding DNA location: Contig name=SeqID_16895; Position on contig =300785..301396bp; Strand=-
atggacgggccaatggctcaactttatttttatcattctgccatgaatgcaggaaaatcaacttctttattgcaatcttcctataactataacgaaagaggaatgagaacgctgatttttacagcagaaatcgatacacgatttggtaaaggacgggtcagctcccgtattggtctatctgctgatgccttattattttcatcggagacaaatatcgctgaacttatcagacgtgaaaacgaggtggaaaaagtccattgtgtcttgattgatgaatgtcagtttttaacgaaaaaacacgtcgaacaactgtgtgaaatcgttgattatgacgatatccctgtcctttgttacggattacgaacagatttccaaggtgaattattcagtggaagccaatatcttctcgcttggtcagataaattggttgaattgaaaaccatctgccattgtggaagaaaagccagtcgtgtactgcgttttggcagcgacggaaacgttgtttatgatggtgcacaggttgatattggaggcaatgaaaaatacgtctccgtgtgtcgtaggcactatacggacgttattcgtgaagctcagacaaaaaaagttccatga

SEQ ID NO: 4467 - DNA, 402 bp, Xenorhabdus bovienii
  Coding DNA location: Contig name=SeqID_16895; Position on contig =302032..302433bp; Strand=+
atgagcgaaaatttaaaatccttaaataacatccgtaccttgcgcgcacaagcaagagaatgtgaacttactaccttagaagaaatgttggaaaaactaacgattgttgttgaagaacgtcgtgacgaagacagccaagctcgcgcacaaatagaagagcgcagccgtaagcttcaagaataccgtgaaatgctggagaaagacggcattgaattaagcgatttagtagatgctttaagcggtaaagccactagcaaatctaagcgtgctacacgtccagccaaatattcataccttgacgaaggtgaaactaaaacttggactggccaaggccgtacaccagctgtaatcaaaaaagcaattgatgaagaaggcaaaaagctggacgatttcttgatctaa

SEQ ID NO: 4468 - DNA, 1017 bp, Xenorhabdus bovienii
  Coding DNA location: Contig name=SeqID_16895; Position on contig =302667..303683bp; Strand=-
atgaaatttttagtgacaggttctgctggttttattggttttcatgttagccagcgattattgggtatggggcatgaagttgtcggtatcgataacatcaatgattattatgatgttaatttgaagcaggcgagattaaatttattactccctcatccgagttttcaatttgaaaaattggatctggccgacagaattgcaatcccggaattgtttgctaaacaccaatttcagcgagtcatccatttgggcgctcagccgggtgttcgttattcaatacaaaacccaatggcatatattgacgccaatatcgttggtcatatcaatattcttgaaggatgtcgtcataatcgtgttgaacacttattatatgcatcttcaagttcagtgtatggattaaataaaaagcaaccgttttccaccaatgattcggttgatcatcctgtttctttatatgcggcgacgaaaaaaactgatgagttaatgtctcacagctattcgcatctctatcaactaccaacaacgggattgcggttttttaccgtatacgggccgtggggacgccctgatatggctttatttaagttcactaaagccatgttagagggccggtcaattgatgtttataatcatggtaatatggtgagggatttcacatatattgatgatattgtcgaatctataatcagattgcaagatatcattcctactcctaataaagactggtcagttgaagatggggcgatatcttccagttctgctccgtatcgtatttacaatattggtaacggtcagccgacaaaattgggtgattttattgaagctattgaagcgtcattagggattaacgccaagaagaactttatggaaattcaggatggcgatgtgttatcaacttgtgcggactccagcacactttatgataagattggcttttcacctgataccccagtgaaggaaggggtgaaacggtttgtcgattggtatttggatttttaccagaaatcggaacaatga

SEQ ID NO: 4469 - DNA, 1344 bp, Xenorhabdus bovienii
  Coding DNA location: Contig name=SeqID_16895; Position on contig =303692..305035bp; Strand=-
atgaaagttactgtatttggtattggctacgtgggcttggttcaagcaactgtatttgccgaagtcgggcatgatgtgctttgtgtcgatgttgatgcaaaaaaagtcgaaaacctgaaaaatggccagatccctatttttgagccaggtttagtgccgcttgtgaagaaaaattatacggaagggcgcctgaattttacaacggatgctaaagccggtgttgcacatggcaaattacagtttattgcagtaggaacgcctcctgatgaagatggatcagcagatcttcaatatgtcactgccgtagcccgtactattgcggaaaacatggatggctacaaagtcgttgttgataaatcaacggtacctgtaggtacggctgataaagtcagagcagttatgcaaacggtattaactcaacgcagcgcagattttccatttgatgttgtttccaaccctgaatttttgaaggaaggggcagcgatttctgactgtatgcggcctgagcgtattataattggctgtgataatgacaatgtgattgatgtgatgcgcgaactgtatgagccatttaatcgtaatcatgatcgtatgattgtcatggacatccgcagtgcagagttgactaaatatgcagctaactgcatgttggcaactaagatcagttttatgaatgaaattgcaaacttggcagaaatgttaggggctgatattgagcatgtacgtcagggaataggttctgatccgcgtattggctatcatttcatttatccaggatgcggatatggtggttcatgtttcccgaaagatgttcaggcattaatccggacttccgagcaaattggatatacacctaaaatacttcaggcggtggaactggttaacgaaaaacaaaagagtaagctgcctacttttgttaaacgccattttggtgatgatttatcaggtaaaacattcgcaatttggggattatcatttaaacctaatacggatgatatgcgtgaggcatcaagtcgcgtattaatggaagcattgtgggaaagcggcgctaaagtgcaggcatatgatccagaagctatgcaggaagctcagcgtatttatggccagcgtgatgatctttctctgatgggaacaaaagaagcggcattaaaaggtgcggatgctttgattatttgtacggaatggcagaacttcagagcgcctgatttcgatataatgaaggactcaatgaagtcgccaataatttttgatgggcgcaatctttatgatccagaacgcctgcaatcgcgtggattcacttactatggcattggtcgtggcgcctctatcaatccagttgtttga

SEQ ID NO: 4470 - DNA, 918 bp, Xenorhabdus bovienii
  Coding DNA location: Contig name=SeqID_16895; Position on contig =305060..305977bp; Strand=-
atgtcagttataaacaaaaaggtaaaaaaagctgttattcctgttgctggtttgggaacaaggatgttaccggctaccaaagccattcctaaagaaatgctcccgctggttgataaaccacttattcagtatgtcgttaatgaatgtattaaggcgggtattaatgaaattattctggttacacattcatccaaaaactctatagaaaaccattttgataccagttttgagctggaagcgatccttgaaaggagggtcaagcgccagttgctagatgaagtacagtcaatttgcccaaatcatgtgacaattatgcaaacccgtcaggggatcgcaaaaggattgggccatgcggtgttatgtgctaagccactgattggtgatgaaccatttgctgtcattctgccagatgtcattttggatgaatacagtacagatttgtcgaaatataatttgagtgaaatgttgtcacgctttaatagcagtggagcgagccagattttggttgaacccgttcctttggaaagcgtcgccgattatggggttgttgattgccttggtgaaaacctgcaacctggtgacagcaaacctattgttcgtgttgttgaaaaacccaaaccggaagaagccccatcgaatctttccatcgttggtcgctatgtgttgtctgaaaaaatctggccattattggcgaaaactgcacctggtgcaggagatgaaattcagctgacagatgccattgctatgctaatggaaaaagaacccgttgaagcttatcacttgcaaggccgcagtcatgattgtggtaataaattgggttatatgcaggcattcgtcgaatatggtatgaagcataaggacttaggtgcagcattcaaggattggatcatgacattgcagaatcagatcgaaaaataa

SEQ ID NO: 4471 - DNA, 924 bp, Xenorhabdus bovienii
  Coding DNA location: Contig name=SeqID_16895; Position on contig =306218..307141bp; Strand=-
atgtgtgcatcaaatggagaaatggcattacagacggttgatagagagataaaacctgaactcattttctgcaatttaagcatgcctattatgggtggcattgaatttatgggccatatggcgattaaggggttgactattcctatcattattgtttccgcaacaaataagatgacggagatagatgatgtgttgcgccttggagctaaagacattctgttaaagccgatagccaatctcaatgaggtaaagaaaatggctttggattatttacatccgaaggtatttatgtctgatgcgatagagcaaaaccgcttgattcaggaactgtcgaaactaaaacaaaatacggaatcagtctggtgtttattacaacaactacagccacctgtctcccaaattattgctaactgtagggtaaattaccgcttattaaatacagtaggtaaaatgggtttggtttttgacatcacagcactttctgataatgaaatgattttctattgtctggatattagccgttcgaaagataatggtgctgtatctgcactgctattgagagtggttttcaataacttattgaaaaagcgaaagtttcataaaaaaagtggtctaccagatatgcaagagatcatgaactgggtgaaccggatattaaatgatacggagatttcggaaccacttccattattattgggttattacaatacgcataataaaaccatcttaatgtcatcagcaggattaagtgcgcgtattcagtctggtaatcatcaacagcagctgggtagagggattcctcttggtacgttgaagatcattcattcacatcaggtatgtgaacatagttctctttggcaatgccgcatatggaataacaaaaatcaaataaaattgatgttttccccaccattttatcagtga

SEQ ID NO: 4472 - DNA, 363 bp, Xenorhabdus bovienii
  Coding DNA location: Contig name=SeqID_16895; Position on contig =307495..307857bp; Strand=+
atgcgttccagatatagtgcttatgcaacaaaaaatgcagattatctcatcgcgacctggcacccagaatgtcaagcagaaagctggcgttctgaaatagaacagagttttgcgggtgtacagtggctagggctaaatgttattgagacagttgaagggcaacataataacgaatcctatgtcgaattttcagcctgctttattgagcaaggaaagcaagacagacaattgattcatgagcgctcccgttttttgcgcattgaccaacattggttttatttagatggcatacgtccccaaacaggccgtaatagtccttgtccatgtggttcaggcaaaaaatacaaaaagtgctgtggctag

SEQ ID NO: 4473 - DNA, 849 bp, Xenorhabdus bovienii
  Coding DNA location: Contig name=SeqID_16895; Position on contig =307931..308779bp; Strand=+
atgcaaaacgcaaacatacaaaaaaaaatcttgcgtacaatctgtcctgatgccaaagggttaatcgcaaagatcacgaacatttgctacaagcatcaattgaatattgttcaaaataatgaatttgtagatcaccgtactggccgtttttttatgcgcacagagctggaaggtattttcaatgatgaaacatttctagccgatctggatgatgccttgcctgcgggttcaaaccgtgaattaaatacagcgggtcgtcgccgtattgttattatggtgacaaaagaagctcattgtattggtgacatcttggtgaaaagcgcttacggtggattggatgtcgaaattgctgccgttatcggcaaccatacgatcctgcaacacttggtggaacaatttgatattccgttccactacattagtcatgatggtttaacccgagaacaacatgacgaagcattgatggttcaaatcgatcaatataaacccgattatgttgtactcgctaagtatatgcgtgtcttgacgccagcatttgttcagcattatccgaaccaaatcatcaacattcaccattcattcttgcctgcttttattggtgctcgtccctatcatcaggcttatgagcgtggcgtcaaaataataggtgctactgcacattatgtgaatgataacttggatgaaggcccaatcatcacacaggatgtgataaatgtggatcatacctatactgccgaggagatgaagcgcgcaggattggatgttgaaaaaaatgtgctgagtcaggcattgcactgggtcttttctcagcgggtttttgtgtatggtaatcgtactgtcattctttga

SEQ ID NO: 4474 - DNA, 132 bp, Xenorhabdus bovienii
  Coding DNA location: Contig name=SeqID_16895; Position on contig =308838..308969bp; Strand=+
atggaacgggatttgagcatcaagtttaaaaaaacagcatttgatactttattttcaattatctactttacagcggcggcttatctgatattatgccgaccgctgtcaacgataaattcaaaaatttggtgg

SEQ ID NO: 4475 - DNA, 864 bp, Xenorhabdus bovienii
  Coding DNA location: Contig name=SeqID_16895; Position on contig =309415..310278bp; Strand=-
atgtttttttctcgtaaattagaagcattcatggcggtggtggaaatgggttctttaagcaaagcggcaagagtgatgaaccgtacgactcccccagtcgctaaatcaattaaagacttcgaagcgacgttaggaaagcgcttatttaaaagggagaagtttgggatgattctgaccaaagacggagtggagctatataatgacctaaaagaactctatttgaaagagaaagaaattacaaagaaacacatcagcgggagtatttgtaatgttgtaaatatataccatgattggggtaagaaaaagcatctaatttcgctttataaagcagcagacagaaataatgctcaggttaatatattacgcttcagttatgataacatcgatgaaatagttgattatgagggcaatacgataattttaagttcagaaaaagtactcagtgatcgattcagccttgtccgaaaaattgaagggccaaatttagggatctgctgccgtaaagaattattggatgaggttcatggcgactttactcaattgctgaaaaagagaacatggttatgtgatccagtgctctataaaggtaatttgataaagaatttagaagaagagatgataagaaatggagaaaaagtcaatatacggcaaatggatagtatcgagtgctgtcttaattttattcagtcaacagattatatctttattacagattcccactctggtgcattggaagagggagaaagcttaggcttcattccaatatcacgaactgatgcagttaatcagtgttatgtctacaaatcaaaatctcattcaagcgtgttaaatcgctttatagactctgtcagcgatatggagtaa

SEQ ID NO: 4476 - DNA, 807 bp, Xenorhabdus bovienii
  Coding DNA location: Contig name=SeqID_16895; Position on contig =310929..311735bp; Strand=+
atgaaatttgtctcattcaatattaatggcctgcgggcgcgtcctcaccaacttgctgccatcgttgaacagcaccaaccagatgttatcggattgcaggaaacaaaagttcatgatgaaatgtttcctttagaagaagttagcaagcttggttaccacatcttctatcacggccaaaaatcccactacggtgttgccctgctcacccgtcagcaacccgttgctgttcgtaaaggctttcctactgatgatgatgaagcacagaggcgcatcattatggctgatatcgaaacgccgcaaggcttattgaccataatcaacgggtattttcctcaaggcgaaagccgtgaacatccggttaaatttccggcaaaagagagattttatcaggatctgaatcgctatctggaaaaaaaccaatctccagattcacatattctcattatgggtgatatgaatatcagcccaactgatctcgatattgggatcggagaaaataatcagaaacgctggttaaaaacagggaagtgttcttttttaccggaagaaagagaatggatgggccgtcttaaagactggggcttaatcgacacattccgggcacagcatccagaagccagcgaccagttctcttggtttgactatcgctcaaaagggtttgatgataatcgagggctgcgcattgatttactgcttgccagccgcccattggcagaacggtgcctctcttctggcatagattacgctatccgcagcatggaaaaatcttctgaccatgcaccgatctgggcagagtttagaatataa

SEQ ID NO: 4477 - DNA, 1935 bp, Xenorhabdus bovienii
  Coding DNA location: Contig name=SeqID_16895; Position on contig =311796..313730bp; Strand=-
atgcgtctttttattgcagaaaaacctagcctcgcgcgagctattgcagatgttttgcctaaaccccatcgtcggggggatgggtttatcgaatgcggtaacaaccaattcgtgacttggtgcgtaggccatctattggagcaggccgagccagatgcctacgatagccgttatgcgcgttgggtcttgtctgatttaccaatcattcctgaaaaatggcagttgaagccacgggttgctgtggctaaacaacttaacacgattaaatcccttctggaaaaagcggacgaagttatccacgcaggtgaccctgatcgcgaagggcagttactggtggacgaagtgctggattttctgagccttagggatgataaaaaacagaacgtccagcgctgtctgattaatgacctgaacccccaggcggtaatcaaggcgattgaacgtctgaggagtaaccgggaattcatccctctgtgtgtttctgcactcgccagagccagagccgactggctctatggcattaacatgactcgtgcttatacattattgggacagaatgctggctatcagggagtgttatctgtcggacgtgtccagacaccggttttggggttggttgttcgtcgtgacgaggaaatagagcactttgtgccgaaagatttctttgaagttaaggcgcacattgttacgccaaacgaggaacgatttacgaccttatggcagcctagtgaatcctgcattgattttcaagatgaagaagggcggctcatacaccagccattggcagagcatgtagtggctcgtattacgggacagcctgcttatgttactgcctatcaggataagcgggaatcagaaacggcaccgttgccattttctctttcttccttgcagattgaagcggccaagcgttttggtttaagtgctcagaatgtactggatatctgccagcgactctatgaaacccataaactgatcacctatccgcgttctgattgccgttatttgcctgaagaacatttcgtcgggcgtcatgctgtcttgaatgccatttcgattcattcttctgatttacttccgcaggatgcactggagagtgataagaagaaccgttgctgggatgataagaaagttgatgcgcaccacgcgattgttcctactgctcgaagcagccaagtcaatttgacagagaatgaaaggcaaatttatggtttgattgccagacagtatctgatgcagtttttaccagatgcggtattccgtaaatgcacgattgaacttgatattgcgggtggcaaattcattgctaaagcgcgtttcctggccgaagcaggttggagaactcttcttggcaacaaggagcgggatgaggagaatgaaggcactccattgcctgttgttgccaagggggatgagcttttgtgtgaaaaaggggaagtggtggaaaggcagactcaaccgccgcgcccttttagcgatgcgactttactatccgctatgacaggtattgcacgatttgtacaggataaatcactgaagaaggtgctacgtgcgacggatggattaggtacagaggcaacaagggccggtattattgaactgctgttcaagcgagaattcttgtacaaaaaagggcgtaatattcatgctacgcctgctggacgagcacttattcatgtattgccggatatggctgtattaccggatatgactgcacattgggaatccagattaacgcaaatcagtgaaaaacagtttcgttatcaggattttatgctgccccttcaggaaacgttacagcagttaatcgggcaggcgaaacagtatcgaaacttgaaagcttttagggacttgcctcctgttcccgcaaaaggcaaaaaaggaaaaacaaaacaggtaaaaaagggcaaagaaaaagtgaataaaacggaataa

SEQ ID NO: 4478 - DNA, 1044 bp, Xenorhabdus bovienii
  Coding DNA location: Contig name=SeqID_16895; Position on contig =313736..314779bp; Strand=-
atgtcaactgaaatccgtctgactcagtatagccatggtgctggatgtggctgtaaaatttcgccaaaagtgttggaaactattctgcacagtgagcaggcaaaattttttgacccaaatctattggttggaaacgaaacacgtgacgatgctgccgtatacgatatcggcaatggtaccggcatcatcagtactacggattttttcatgccgattgttgatgatccatttgattttggtcgcattgcggccactaatgccatcagtgatatctatgcgatggggggaaagcccatcatggcgattgcaattttgggctggccaattgctaaattatccccagaaatcgcgcaaaaagttattgaaggaggccgggccgtatgtaaagaggctggcatttctcttgctggtgggcactcgattgatgcgcctgaacctatttttggcttggccgtgacgggtatcattaatatcgatcgtgtgaaacgcaatagtcaggcaaaagcgggaagcattttgttcctgactaaacctttaggtattggggtattgactactgctgagaagaaaggactacttcaacccgggcatcaaggtattgcaaaagaaacgatgtgccagctaaataaggcaggtgcagatttcgctggtatcgatggcgttacagcaatgacagatgtcacgggttttggcttacttgggcatctgggggaaatctgtgagggttccggcgttcaggcaacggtcaacttttcacaagtcccaagattgccagatgttgatgactatattgaaaaaggctgcgtacccggaggaacagggcgcaactttgacagttatggacacttgattggggaactgacagcacgtcagcgccatctcttgtgtgatccacaaacttcgggtggtttattgctggcagtactgccagatgccgtggaagaggcgaaggccattgcacgaagccacaacattgatttgattgccattggtgaactgactgaaccacgctcagacagggcattgattgaagttattgaataa

SEQ ID NO: 4479 - DNA, 552 bp, Xenorhabdus bovienii
  Coding DNA location: Contig name=SeqID_16895; Position on contig =314792..315343bp; Strand=-
atgaatgctttggaacttttgttgaatcgtcgttcagcttcacgtttaaccacgcccgcccccgaaggaaatgagctggagtatattctggcggcagggatgagagcgccagatcatggggcattgcgtccttggcattttgtcgtcatgcagggcgagggtattgataaattcagtaaattgttggaaaaatcggcgattgagaatgctttgggccaagaaattgaggaaaaagcgagaaatgcaccttatcgtgcacccatgattatcactgttattgccaaagttgttgagaatacgaaaatacctgcatgggaacaaatcgtagcggctggctgtgcggttcatgccatgcaaatggcggctgtggctcaggggtttggtggaatatggcgttcaggatcatggacagaagatccagttgtcaaagcaggtctgggatgtggagagaatgataaaatcgtcgggttcctctacttgggaacaccggtactcaaagcaccagaaaaagtagcattaccagatttaactaactttgttagttatttctaa

SEQ ID NO: 4480 - DNA, 1911 bp, Xenorhabdus bovienii
  Coding DNA location: Contig name=SeqID_16895; Position on contig =315511..317421bp; Strand=+
atgcgtactttatggaagtttatagcagcattatttaaatggagttggaaactgctaaatttcgctcgccaacttatttcaaatctgatttttatcctactagtgattgtagtagctactggcattctggtttatcagcaacaatccaaatctggcgatgattatcgtggagccttatatgtcgatctgtctggcattgttgtggatcaagtctccgcccgtagtccattagatcaatttgggcgggatcttatcggtgcatccagtagtagctcgcaggaaacgtctctgttcgacattgttgacagtattcgacgggcaaaacatgacgctaaaattactggtatggtattaaaactagataattttctcggcgccgatcagccttccatgcaatatattggcaaggccatcaacgagtttaaggcagcgggtaaaaccgttatcgccatcagtgataattatagccaaccacaatattatttagccagctatgccaataaagtatacctttctccacagggagccgtgtcccttcatggtttctcaactaatcatctgtattacaagtcattattggacagtctgaaagtttccacccatattttccgtgtcggcacatataaatcagcggtagagccaatgacacgggacaatatgtccgaagaagcacgtcaagcagatagcctctggcttaatgaactttggaacaattaccgcaatacgattgcagttaacagaaaaatccctgccgataaagtgctgccggaacctatccagtttattgaaaaactccgtcaaactggtggagatagtgcactgtatgctgcaaaaaataagttagttgacgaaattaaacctcggaatgtcattgaaacagaattaagcaacaaatttggttgggatgaaaaaaacaaacatttcaattatatcagcctctatgattatatcgcacagcagccaatcaaaaattctgatcaaagcaatagcaacattgccgtaattattgccgaaggtgcaatcatggatggcagacaatcagaaggcatagcgggcggtgataccatagcggaacaacttcgtgaagcacgcctgaatccaaatataaaagccattgtgttacgcgtgaacagccccgggggtagtatcagtgcatctgaacttatccgcagtgaactcgtcgctatccgtgaaggcacaacagtaaaagataaagaaggtcgtactgttaaagaaaatcaaaaaccgattgttgtgtccatgggaggacttgctgcctcagggggctattggatttcaaccccagctaactacatcatcgctgacaaaaatacgctgacaggctctatcggtgtttttggtgttctcaatacttatgaaaaaggcttaaattatcttggtgtgaatacagacggtatttcaacgcatccgttggcagatatttcagtaaccaaaggaataaaccctatgttttctgatgtcatgcaactgtctattgaaagtggctatcataaatttatcgaactggtcgcacaatctcgccagaagacaccgaatgaaattaaagaaatcgctcagggtcgggtctggagtggcagtgatgccaagaagaatggtctggtcgatcagttaggtgactttgatgatgcagtcaataaagctgctcaattagctggtatcaaaacagtatcattgaattggatgcaaccagaactctcattctctgaaaaactcatgctggagttttcctcatcagcacaaacactgctgccaaatgccctgcaatcaatgttgccggctccgattgcccaaattgcgcaagatatgaaacaacaagctgtattttataaccgcatgaatgatcctcagaatatctatacgttctgcctgaactgtgcggatatccgctaa

SEQ ID NO: 4481 - DNA, 636 bp, Xenorhabdus bovienii
  unsure (1)..(636): unsure at all n locations
  Coding DNA location: Contig name=SeqID_16895; Position on contig =317532..318167bp; Strand=+
atgcagaagaaatctatttacgttgtttacactggtggcacaattgggatgcagcgctcccctaatggctacatccctgtctctggtcatttacaacgacaactcgcgcagatgccggagtttcatcgtccagaaatgccaacctttaccatccgtgaacaccagcctctgattgattcttctgatatgagtccaaacgactgggggattatcgccaacgatatctaccagaattaccacgattacgatggctttgtgatcctgcatggtacggacactatggcttttaccgcgtcagcactctctttcatgtttgaaaatcttaaaaaacctgtgatcgtgacagggtcacaaatacccctggaggctctgcgttctgatggtcagacaaatttgcttaatgcactgtatctagctgctaactatcccatcaacgaagtcggcttatttttcagcaataaactgtttcgcgggaatcgaacaattaaagcccatgccgatggctttgaggccttcacatcccccaactgtcggccactgatcgaagcagggatcaacatccgtacgttcaatacaagcccgatacccgccagtcatgatgagtttaccgtacaccagatcacatcacnnnnnnnn

SEQ ID NO: 4482 - DNA, 484 bp, Xenorhabdus bovienii
  unsure (1)..(484): unsure at all n locations
  Coding DNA location: Contig name=SeqID_16896; Position on contig =376..859bp; Strand=+
atgtattatgtcggaatagatgtcagtaagaataaactggatatttgtttgttatatgatggagttaaaggtaaacgcaaaacaaaatcccttctgaataatgaacattcagcctgtatgttaatagcgtggctagctaaatatattcctgccctgcaacaagtcaatatcgttatggaagccaccggagtctatcatgaacggttggcttattcccttcatcaggctgggggaaggattgcaatagccaaccctttacgcgtgcgtgattttgctaaaggtatggggatactgactaaaacagacaaagtagatgcctatattttagcctgttacagtgccttaaaacaacccgatgtctggcaacctcctcctatagaaattcgcgaattgaaggctctcctatgccgtcgggatgcgttattagaagatatccagcgtgaacgtaaccgatataaaaagagncctgatttatgccaagatg

SEQ ID NO: 4483 - DNA, 567 bp, Xenorhabdus bovienii
  Coding DNA location: Contig name=SeqID_16897; Position on contig =209..775bp; Strand=-
gtgactcaaggtattcccgccgtatttttggatcgtgacggcacggttaacatcgatcatggctatgttcatgaaatagacaattttcaatttattgatggcgcgattgaagccatgctcgaattgaaaaaaatgggctacgcactggtattgataactaatcagtccggtattgctcgggagatgtttacagaagatcaatttttgcagttaacagaatggatggattggtcgctggcagaccgaggtgtcgatcttgatggcatctattattgcccgcatcaccccgaggggagtgctgacgcatataagaagaactgtcattgtcgcaaaccgcagccaggcatgttgttggatgcacaggaagaattaagcatcgatatgtcagcttcttatatggtgggagataaaatagaagacatgctggcagcaaatgcagccaatgttggaaccaaagtactcgttcgtactggaaaagcggtaacagaagcagtagaacagactgctgatctggttattaatagccttgcagatctcccagatgcgataaaaaataggcaaaaatag

SEQ ID NO: 4484 - DNA, 1032 bp, Xenorhabdus bovienii
  Coding DNA location: Contig name=SeqID_16897; Position on contig =955..1986bp; Strand=+
atgataagactgactcagataaataaggtatttcaacaaggagcgcgctcaataaaagcgctttcagatatcgacttgcatgtcccgctggggcaaatatatggtgttattggctcttctggcgctggaaaaagtaccttaattcgttgcgtaaatatgcttgaacgcccaacctcaggtcaggtattggttgatgggcaggatctgacatcgctttcagagcgcgaactgacgcgtgcccgtcgtcacatcggtatgattttccagcactttaatctgctatcttccagaactgtgtttgacaatgtggcattgcctttagaattggacaacacaccaaaagccgagataaacgctagagtcaatgaattactggaattggtcggtctctctgataagcatgatgcttatcctgctaatttatctggtggtcagaaacagcgtgtagctattgccagagcactggcaaattcaccgaaagtacttttgtgtgacgaagccaccagcgctctggatccagcaacaacgcgttctattctggaattattaaaagacattaaccgccggttagggttaacgatccttctgatcactcatgaaatggatgttgttaaacgcatctgtgatcaagttgcagtaattagtggtggacaattaatcgagcaggatgtagtgagcgcaatattttcacatcctaaaacacctgttgctcaacaatttattaaatctacgctgcatttggatatccctgaagattatctacaaaaattgcagcctgaatcagcgcctgatcgctgtccactagtgaaactggaattcacgggtaaatcagttgatgctcccctaatttccatggcagtacgccgctttaatatcgatatcagcattttaagttcccaaatggattacgctggtggcgtgaaatttggcgttatgctggctgaattagacggtgaaagcagcagtattgaatcaacaattacgttcttagaagaacaccatgtgaaaatagaggttctcggttatgtctga

SEQ ID NO: 4485 - DNA, 654 bp, Xenorhabdus bovienii
  Coding DNA location: Contig name=SeqID_16897; Position on contig =1979..2632bp; Strand=+
atgtctgaaggaatgattttattactggctaaaggcgtctgggaaactctggtgatgacttttgtttctggcttctttggttttgttattggcttaccggcaggtgtgcttttatatgttacccgtccaggtcagattatagaaaatggggcactttatcgcatactatctgctctggtgaatattacccgctcaatcccgttcattattttgctggtatggatgatcccattcactcgactcattgtgggaacatccatcgggttgcaagcggcgattgttcctttaacggtcggcgcagcaccttttattgcacgtatggtggaaaatgccttattggaaattccgtcaggtttaattgaagcagctcgcgcaatgggagcgacaccgcttcagattgtcaaaaaaattctgttgccggaagcattaccgggtttgattaatgccgctacgattaccttaattactctggttggttattccgcaatgggaggcgctgttggtgcaggcggtctaggccagattgggtatcagtatggctatattggctacaatgcaactgtgatgaataccgtattagcgttgctggttattctcgttttcttgattcaattaagcggtgatcatttggccaaagcggctaaccgtaaataa

SEQ ID NO: 4486 - DNA, 111 bp, Xenorhabdus bovienii
  Coding DNA location: Contig name=SeqID_16897; Position on contig =2668..2778bp; Strand=-
atggatttcaattttactgacatattttcacccctattgaatactgatttagaacctgtcttaccaggctactgcgtactactcatgaggcttttaggtataagcccttaa

SEQ ID NO: 4487 - DNA, 816 bp, Xenorhabdus bovienii
  Coding DNA location: Contig name=SeqID_16897; Position on contig =2756..3571bp; Strand=+
atgtcagtaaaattgaaatccatcgttgcaatcagtgcattattaggaacattaattcttgcaggctgcggtcaggaaccaagagatccaaaccacattaaggttggagtcattgttgggcctgaacttgaagttgcagaagttgccaaaaaagtggccaaagagaaatatggccttgatgttgagttgactacgttcaatgactatgttctgccgaatgagtcactgagcaagggagatattgatgcgaatgtcttccagcataaaccttatttagatcaacaaataaaagaacgcaactacaaattggctattgttggtaactctttcatctacccaatagcagcttattccaagaaaataaaatctctggatgaattgcaggatggtgctcaaatcgctctaccaaacgatccgaccaacttgggccgttcactgttgttattgcagaagcaaggtttgattaaactgaaagatggcgttggtctgttgccaactattttggatgttactgagaatccaaagcatctggacatcgttcaattagaagcaccacaattaccacgttcactggacgatcagaaaattgccttggctatcatcaataacacctatgctggccagattggtctaacaccggaaaaagatggtttatttgtggaagacaaagattcaccttacgttaatatcatcgttagccgtgaagacaataaagatgcggaaaatgttcaaaagtttgttaaagcttatcaatctgaggaagtagaacaagccgcccagacaattttcaaaggtggtgcgctaaaaggctggtaa

SEQ ID NO: 4488 - DNA, 99 bp, Xenorhabdus bovienii
  Coding DNA location: Contig name=SeqID_16897; Position on contig =3582..3680bp; Strand=-
atgtcgatgcatgaaactgcgatcaaaagcgtttggctcccccagtcaaaatgggcggataataatacccgcccgatgattttaatcttgattgactga

SEQ ID NO: 4489 - DNA, 393 bp, Xenorhabdus bovienii
  Coding DNA location: Contig name=SeqID_16897; Position on contig =3728..4120bp; Strand=+
atgcgtatgctacctatctgtttcatggcgctatttatggttgggtgtacttctctgtcaactcaggtcgaaaaacctactcaggtaggctcaaagttgaaacatcagccagccaagaaaagtaaagtgtcgtcttacattgagctatacactaagacagaagaactgttaggcactccatttaaagatttaggtatcgttttcggggaatcctgtcgcactacgcaacaagatcctcctgccagcattgcagttgcacggaaaaacatgctggcaaaagccgcatctctgaaagctaatgcagtattacttcatcaatgcgcaatactgtctaatcacaactgctaccagactgcgatttgtgaaggctctgccctgcttaccactaaataa

SEQ ID NO: 4490 - DNA, 729 bp, Xenorhabdus bovienii
  Coding DNA location: Contig name=SeqID_16897; Position on contig =4120..4848bp; Strand=+
atgatgactaaaaaaacgctcatggcagattttcattttactcaaataggaaccatccattctccttataaagagaagtttgctattccccgccaaccgggtttggtagaagatgggacggggcagctagagttgctggctccttataaccagattgatgcggtacgtgggcttgaacaattcagtcatttatggattatttttgtttttcaccaaacgatgaatggtggctggaatccattagttcgcccaccccgtttggggggaaatgccaaaatgggcgtgttcgctacccgctcgacattccgccccaatccgattggtatgtcgctggtagaattgaaaggtattcaatgccagaacaatcgggtcattttggaactcggcagtctggatttagtagatggcacacccgttatcgatatcaagccctatctgcctttcgccgaatctcgcccagaagccagagcgggttttgcacaggaggcaccagacaccggaatggaagtctcgttcttaccaatagctgaacatcaactatcgtcccatcaggcaaattaccctcatttacgacgtttcatcagtcagatattggcgcaggatcctcgtccggcctatcgtaagaaagaacaggaaaaccggatatatgcagttcatatcttggatttcaatgttcgctggcagatacgtgacgctatgacggaagtggtttctattgaacaccgttaa

SEQ ID NO: 4491 - DNA, 1722 bp, Xenorhabdus bovienii
  Coding DNA location: Contig name=SeqID_16897; Position on contig =4964..6685bp; Strand=+
atgcgtactagccaatatctgctctctactttaaaagagacgcctgctgatgcggaggttgtcagtcataaactgatgcttcgtgccggcatgacacgtaaactcgcctcaggtctgtacaactggatgcctacaggtgtccgtgtattaaaaaaagtcgaaaacattgttcgtgaagagatgaataatgctggggcgattgaagtttccatgccggtagttcaaccggcagatttgtggcaggaaagtggccgttgggaacaatatggcccagaattactgcgttttgaagatcggggcgcccgtcctttcgttctcgggccgactcatgaagaagtcatcaccgatctggttcgtaatgaagtgacttcatataaacaacttccactgaacctgttccagatccaaaccaaattccgtgacgaagtccgtccgcgtttcggtgttatgcgttcacgcgaattcattatgaaagatgcttattctttccataccaaccaagagtctctgcaagagacttacgataaaatgtatgctgcctacagcaaaatttttactcgtattgggctggatttccgtgctgttctggcagataccggttctatcggcgggagtgcttcccatgaatttcaggttctggctgacagcggtgaagatgatattgccttctccacagaatctaactatgcggctaatattgaattggctgaagccgttatgccatcccacgagcgagctgtcccatcagaagatatgcatttggtagagacacccaatgctaaaaccattgctgaactggtcgaacaattcaacttgccgattgagaaaaccgtcaaaactctgatcgtccatgcggcaaaagaaagcggtcatcaactggtcgcattgctggtacgtggtgatcatgaactgaatgaaatcaaggcgggaaaactaccattagtagcaagtccgctgaatttcgctaccgaagaagaaattcgtgccgttgtacaggcaggcccaggttccttaggaccagtaaacctgcctatgcctgttatcattgaccgtagcgtatctgtcatgagcgattttggcgcaggcgcaaatgttgatgataaacattatttcggcattaactgggaacgtgacttaccactgccagaaatcgccgatatccgtaatgtcgttgaaggtgatgccagcccagacggtcaaggtacactgctaatcaaacggggtattgaagtcggtcatatcttccagttaggcaccaaatactccgatgccctgaaagccacggtgcaaaatgaagatggtcacaatcaagttgtctcaatggggtgttacggcattggcgtaacccgtattgttgctgcagctattgaacagaaccacgatgatcgtggcattatctggccagatgccattgctccattccaagtcgctcttttacctatgaatatgcacaaatcttatcgggtgaaggaagttgctgaaaaattatatgcggacttacatgccaatggtattgatgtgattttcgatgatcgcaaagagcgcccaggtgtcatgtttgctgatatggaactgatcggtgtgccgcatactctggttattggcgatcgcaatctggataacggcgaagttgaatacaaataccgccgtaatggtgataagcaaatgctgaaactggaaggtattgttgaatatctgaaagggcaaattcagcagcattaa

SEQ ID NO: 4492 - DNA, 690 bp, Xenorhabdus bovienii
  Coding DNA location: Contig name=SeqID_16897; Position on contig =6771..7460bp; Strand=-
atgatgaataaaaaaatattgctcgccttggtcgctgtgggagtgttaaccgcggttgggtgtcagaacaaagtggcctctcaggataatgctacgcttcaggagaatgcacttcagacaactgagagcgtgtttactggcgttgtaccttgtgcggactgcaccggtattgagactactttgcagctttcaagcgatggctcatatatattgggacaaatttatctggaagcgaaaaatgaagaaaacacctttttcgaaacgggtcattggataaaaaacggtaaaaagatagatttgacgcatgaggatagtaagaaatcttattatcagatgaaaggtgaaaatctggtcatgctggatatcaacggtgaaccaatccagtcaaatttcaattatgaattgggaaaagttacaccaaaaaagatggcgggggaatacagctatatcgctgacagtgcgacatttacagagtgccgtaccggaaaactctatgatgcgtctgaaaatatcgatttggaacgtggctacagtgcgacaggtgtggaagggggagagcctgtttatgtggaagtcgaaggttactactcgcttcggccttcgatggaagatggtgtgtttgatcatgcactgattcaaacaggcaaaatccattttgacaagtcagcctcttgtcagaccaggaaataa

SEQ ID NO: 4493 - DNA, 258 bp, Xenorhabdus bovienii
  Coding DNA location: Contig name=SeqID_16897; Position on contig =7784..8041bp; Strand=+
atgtctatagatactgaatatcaaccaattaattgtgatgattatgataaccttgagctagcttgccagcaccagcttcatttacacatccaactgcaaggtggtgacgtatttgaaggaaaagctaataagctgattttaagaaaaaaagtcgaatatattctcgtagaatcaaatgaagaaacccgtgaattaaggttggatcacatcatcagtttcagcaacccagaaattggtacgattgttattgagcattga

SEQ ID NO: 4494 - DNA, 117 bp, Xenorhabdus bovienii
  Coding DNA location: Contig name=SeqID_16897; Position on contig =8418..8534bp; Strand=-
atgaggatttggatagtcttgatgctaagacaactcaatgttgggtctacgcattgtcaattactacaacaattatattttatgatgatgataataataatttgggaaattttgtag

SEQ ID NO: 4495 - DNA, 1347 bp, Xenorhabdus bovienii
  Coding DNA location: Contig name=SeqID_16897; Position on contig =9398..10744bp; Strand=-
atgagcaatattcatgagcctctgttaacgatgttaatcgatcagctagggcgatataaaaaaatcttgattggatttagcggtggattggattccaccgtattgctgcatttgctggttcagttacgttaccaatcccacaaagtcattcgtgatcaaatagagctaagggcaattcatatccatcacggtttaaatccaaaggcggataagtgggttgaacattgtcgccagatttgtgccgactggaaggtcgattttcgggtcgaaaaagtcagcctggatatccggcaaaatggcattgaagcggcggctcgtgacgcccgttatcaggcattccagcatgaattgcaacagggtgaaattttggtcacggcgcagcatctcgatgatcaggcagaaacctttctgctggcactgaaacgggggagtggccctgccggactatcatctatgcctttttccatgccatttgctggaacaacactgattcgcccattgctgaatgccagtcgtgcagaactcgaaacgtatgcacacacacagaggttgcaatggatcgaagatgatagtaaccaagatgatcgttatgatcgtaattttttgcgtttgcatatcatgccattgcttaaccagcgctggcctcatttccctcaagccgcttctcgtagtgccagcttgtgtggagagcaagaacaattgttggatgaattgcttaatgaatcgttgagtgagctgataaccccggaaggcgcgatagccatttcaccgttggtggattgctctgaggccaagcgtaatgctttgttacgcagatggttcaatcagcatggtgtgaagatgcctgcgcgtgaacaactccagagaatttggtcggaagtggcgctttccagacaggatgccgagccacgttttagattggggcagcacgatgttcgccgttatcggcaacaactctggctggttcctcaatgccaatcgctggcaggaaccctacttgaatgggatatagcacaagaactgcgattacccgatggtttgggcatgctggtgttgtcagaagaaagtggtattaatgtcagaatgcctggtagaaatgagcgggtaaccattcgttttggtgtacagggaaatattagcatcgtgggtcgtaagcattcccggcacagtaaaaaattatggcaggaattaggtatcgcaccttggcttagggaaagaacaccattgctttattatgatgaaacattgattgcagcattgggggtttttgtcaccagggaggggcagcctttggcgggagaggagatactttcaatcaaatgggacagaatgccgtattctgcttaa

SEQ ID NO: 4496 - DNA, 918 bp, Xenorhabdus bovienii
  Coding DNA location: Contig name=SeqID_16897; Position on contig =10777..11694bp; Strand=-
atggccaaatataaatatatcatttatgcgttttcctgtgtgttgatctggagttttgttccctccatatcccgtttgggtcaaaaagggatggatcacttccaatatttgttctggtcaaatattctgtccgttctggcggttttctttgttgctatcctgatggggagaaatttaaaacaacttttatttatttcctttccagttatgcttaaagttttgatattaggtgctctggactgtttcttctatttattgctctattacggttattccatcgagaatggggttgctgtcttggtcgttcaatatagctggccactgatgatcatcgggttgtcgtttttcctgttcaaagaaaaattatcaatcaggcagatgattggcatcacgcttggtttcattgccgttttgatcacgtttacgcaaggaaatattacccagattgcagtagaacatccgcaggctctgttgctggtatccagtggggcattttgttttgccttgatgtccgtgctatcgaaacatttcgcgattgacccttatatcagtacattttgggtattcacttgctctaccttagtgtcggcggtgtttttattggcatttagcagcttcaattggccagtgggtgattcactgatgccaacgctgctcaacggcatcatattgaatggcgtatcctatattatctggtttaaggctatgaatagccctgattcgcctaaaattgcctcaatcttatttttatcaccggtgctgtcgatgatatggcttattctgttctttggtgatgcgtttgtccctgcttatgctgtgggattagcgcttgttatcatatcggggctgctctgcatcagtgcaaaaaccaagacagcgacacagaataaattgagcgatgatttgattgaggattga

SEQ ID NO: 4497 - DNA, 960 bp, Xenorhabdus bovienii
  Coding DNA location: Contig name=SeqID_16897; Position on contig =11922..12881bp; Strand=-
atgagtctgaattttctggattttgaacagccgattgctgagctggaagcgaaaatcgattcgctcaacgcagttagccgtcaagatgaaaagctagatataaatctggatgaagaagtccagcgtctgcgagaaaaaagccttgaattaacccgcaagattttctctgatctgggggcatggcaaatatctcaactgtcacgtcatccactccgtccctatacgctggattatattcagcgcgtttttactgactttgaagagctggcgggtgatcgtgcctatgcggatgacaaggcgatagtcgctggtttggcgcgccttgatgggcgtccggtcatggtgattggtcatcagaaaggccgtgagacgaaagaaaagatccgccgtaactttggtatgccatcgccagaaggctatcgcaaagcactgaggctgatggagttggcagagcgtttcaaactgccgatcattacctttattgacactcctggcgcgtatccgggtgtgggggctgaagagcgtggtcaatcagaagctattgcccgcaacctgcgtgaaatgtcccgcctgtccgtacctgtcatctgtacggtgatcggtgagggcggttctggtggtgcgttggcactcagtgtgggtgacaaggtgaatatgttgcaatacagcaccttttctaccatatctccggaaggttgtgcctctatcttatggaagagtgccgacaaagccccactggcagccgaagcgatgggcaatacagcaccacgtctgaaagagttgaaattgattgattccgttattccagaaccactgggcggggcacatcgtaactatgacgcgattgctcaagcattaaaagcgcaattactggctgattttgccgatttggatcatctgaacagcgaagaattagttaatcgccgttatgagcgtttaatgcaatacggttactgctaa

SEQ ID NO: 4498 - DNA, 3483 bp, Xenorhabdus bovienii
  Coding DNA location: Contig name=SeqID_16897; Position on contig =12894..16376bp; Strand=-
atgacagaaccacgttttgtacacttacgtgttcacagcgactattcaatgattgacggcttagccaaaacagggtcactggtaaaacaagtggctaaattggatatgcctgcttttgcgatcactgattttactaacctgtgcggcttggtgaaattctatggcagtgcccatagtacaggtatcaagccgattataggcgctgatttttatgtggaaagtgatctgctgggggatgagtatgcccatctgacgatccttgcccgtaataacgaaggttaccaaaacctgacttttctgatttccgaagcttatcagaaaggttatggcgtgattgggccgacgattaaacaagaatggctgataaaatacaaagccggcttgattcttctgtctggtgggagaatgggggatgttggtaaattccttctgcgtggcaatcgggcgatggtggatcagtgcctcgatttctatcaggaacactttccagacagctattaccttgaattgatccgtactgggcgtcaagacgaagaaaattatcttcatgctgtcgttgaagtggcagcagaaaaaaacctacctgttgtggcaaccaatgacgtttgttttctggaaagcgacgactttgaggcccatgaaattcgggttgccattcatgatggctatacgatggctgatcccaaacgccctaaaaactatagccttcagcagtatctgcgcagtgaacaggaaatgtgcgagctattctctgacattcctgaagcgctgcaaaatagcgtagaaattgctaaacgctgcaatgtgactattcgcctcggtgaatatttcctgccacagtttccaacaggggatatgagcactgaagactatctggttgaaaaatcgaagcaaggtctggaagatcgcctgaactttctctatcccgatcctcaattaagagcggaaaaacgttccgaatacgatgagcgtttggatatcgagctggaagttatcaaccagatgggcttccccggctactttctgatcgtgatggaatttatccaatggtcgaaagataatggcgtacctgtagggccggggcgtggttccggtgcgggttcccttgtcgcctatgccttgaaaattaccgatattgatccgttggcatttgatttgctgttcgaacgtttcctcaaccctgaacgtatttcgatgcccgactttgacgtcgatttttgcatggaaaaacgtgatcaggtgattgaccacgttgcggatatgtacgggcgggatgcggtatcgcagatcattaccttcggtacgatggcggcaaaagcagttatccgtgacgttgggcgcgtattggggcatccatatggctttgtcgatcgaatatcaaaactggtgcctcctgatcctggtatgacgttggaaaaggcgtttgcggctgagcctcagttgcctgaaatctacgaagcagatgaagaagtcagggcgctgattgacatggcgcgtaaactggaaggtgtcactcgtaatgccggtaaacatgcgggtggtgtggtcattgccccgaccaagatcactgactttgcaccgatttactgtgatccggaaggcctgaaccccgtcactcagtttgataagaacgatgtggaatatgcgggtctggtaaagtttgacttccttggcctgagaaccttgaccatcatcaactcggcgcttgagatggtgaacgcccgtcgtactcataaaaatctggaaccgattgatattacggcaattccgctggatgaccagataagtttcgatatgctgcaacgctctgaaactacggcggtgttccagcttgaatcccgtgggatgaaagatctgatcaaacgcctgcgtcccgactgtttcgaagacatgatcgcactggtggcgttgttccgtccggggccattacaatccggtatggtggataactttatcgaccgtaaacatgggcgcgaagagctttcatacccagatgttgagtggcagcacgaatccctgaaacccgtattagagccaacatacggtatcattctgtatcaggaacaggtgatgcagattgctcaggtgctggcaggttataccctcggtggtgcagatatgctccgtcgcgcaatgggtaagaaacagccggaagagatggctaaacagcgctcggtatttgaagagggcgcgataagccaaggtattaatggcgaactcgccataaaaatcttcgatctggtggagaaattcgcgggttatggcttcaacaaatctcactccgcagcctatgcgttggtttcttaccaaaccttatggttaaaagcgcattatccggcagaatttatggcggccgtgatgacggcggacatggataatacagaaaaagtggttgggctggtggatgagtgctggcgcatggggcttaaggttttaccaccggatatcaacagcggtctgtatcacttccatgttaatgacgaaggcgaaattgtttacggcattggtgcaattaaaggtgtgggtgaagggccgattgaagcaatcctcgaagcacgtcaaaaagaggggcatttcaaagaactgtttgatctgtgcgcgcgtgttgataccaaaaagctgaaccgtcgtgtgatggaaaagctgattatgtctggtgcgttcgacaggctggggccacatcgcgcggccttgatgtcttcgttggaagacgcgctgaaagcggctgaccaacatgctaaagcagaagccattggccagacagatatgtttggagtactggctgaaaaaccagaacaggttgagctttcatatgccagtacaccgaaatggccagagcaaatcgtgttagatggtgaacgggaaacgctggggttgtatttaacgggtcacccgatcacaagttatttgaaagagattgaacgatatacgaatggattgcgtctaaaagatgtgagcccgacacctcgtggtcaagtaacgactgtggtaggtttggtgctggcctccaaaatcttgacaaccaaacggggcaaccggattggcatctgtactttggatgatcgttcaggacggctggaaatcatgctgttttctgatgcactggaaagatatcagcatttattggaacaggacaaaattttaattgctaccggacaagtcagctttgatgacttcaacggcggccttaaaatgacagtccgtgaattaatggatatcagtgaggcgcgtgaaaaatttgcacgcgggatagctatctcgttgtcagacaggcaaattaatgaacaattatttaatcgtctccgtggcgtattggagccgcatcgttcaggtacgataccagttcatctttattaccagcgagtagatgccagtgcccgtttacgattcggtgcaacatggcgggtaacgccgacggatacccttttgacagatctgcgaactctgctgggtaacgagcaggtagaattagaatttgactaa

SEQ ID NO: 4499 - DNA, 591 bp, Xenorhabdus bovienii
  Coding DNA location: Contig name=SeqID_16897; Position on contig =16393..16983bp; Strand=-
atggattttgtttatcctcaggcgaatttgattgccggtgttgatgaagttgggcgtggcccactggtcggggcagtggttactgcggcagtcattcttgatcctgccaaaccgattacaggcttgatggattcgaaaaaactcacagaaaagcggcgtgaagcactttatctggaaattaaagaaaaggcgctgtgctggagccttggccgtgccgaaccagaagaaattgatcaactcaatattctccacgctaccatgctcgccatgcagcgagcggtggaaggtttagctatcacaccggattatgtcctgattgatgggaaccgttgtcctgcattgccaatgtcggcacaggcggtggttaagggggataatctggtggcagaaataagtgctgcttccattttagcaaaagtgacacgcgacagagaaatggccgaactgggtaagcaatttcctgattatggtttcgcgaaacacaaaggttacccgaccgccctgcatctggaaaaactggctttgctgggcgccacggcacatcatcgtaaaagctttgcgccggtcaaacgagcgctgggtcttggataa

SEQ ID NO: 4500 - DNA, 1185 bp, Xenorhabdus bovienii
  Coding DNA location: Contig name=SeqID_16897; Position on contig =16983..18167bp; Strand=-
atgaaggatactcctttggctaccttttcttctgttagtaatcagcgtccgctgacaattgctttggttgccggagaaacgtccggtgacattcttggtgccgggctgattcgcgcattgaaagctaaaattcctgatgcccattttgtgggtgttgctggccctcttatgcaggcggaaggttgcgaagcctggtatgagatggaagagctggcggtcatggggatcgttgaagtattgggacgcttgccccgtttgttgaaaatccgcaaagatttaacggcacggtttaccgcgttgaagccggatgtctttattggtatcgatgcccctgattttaacatcacgttggaagggcggctgaaacagcgagggattaggacgattcattacgtcagtccatcagtatgggcatggcgtcagaaacgggttttcaaaatcggccgggcaacggatctggtactggcatttttgccatttgaaaaagcgttctatgatcgatttagcgttccatgcaggtttattggccacacgatggctgattcgatgccactgcaaacggataaagtggcagcccgggaggctttgggtgttcccttaaatgcccattgcctagcgatactgcccggtagccgccatgcagaagttgagatgttgagtgccgattttcttagaaccgtgcagttgctgaggaaaacccttcctgatctgcatgtattggttccattggtgaatgccaagcggcatcagcagtttcagcgtattaaagatgagattgcgccggatttatctgtccatttgttggatggtaacgccggtaaagccatgatcgccagtgatgcgactttactggcctcaggtacggcagcgctggagtgtgtgctggccaaatgcccgatggtggtgggctacagaatgaaaccttttacattctggctggcaaagcggctggtaaaaacgccgtatgtttctctgcctaacctgctggcaggcaaagaattagttaaagaactattacaggacgaatgtgagccacaagcattgtctgaggcattgttgcctctcttgcaaggtggtgctgatgtggaagcgttgaaacaaacgtttctgcatttgcatgaaagcattcgctgtgatgccgatgaacaagctgcacaagcggttctggaattagcgagaagataa

SEQ ID NO: 4501 - DNA, 798 bp, Xenorhabdus bovienii
  Coding DNA location: Contig name=SeqID_16897; Position on contig =18172..18969bp; Strand=-
atgattgatcaaactgctgttattcatccctcttccattgttgaagagggtgcagttattggtgccaatgtccgtattggcccattttgctatatcggttctcaggttgagatcggtgaagggaccgaagttaaatcccatgttgtgatcaacgggatcaccaggattggccgtgataaccagatttatcaatttgcctctattggtgaagtaaatcaggatctcaaatatcagggtgaaccgactcgcgttgagattggtgatcgtaaccgtattcgtgaaagcgtatcgattcatcgtggcaccgttcagggtggcggtttgactaaaattggcagtgacaatctgctgatgattaacacccacattgctcatgattgcatgcttggtgatcgctgtatcattgcgaataacggcacactgggtgggcatgtcattctgggcgattacgtcattattggtggaatgacggctgttcatcaattctgtcagattggcgctcatgttatggtcggtggttgttctggcgttgcgcaggatgtcccgccttacgtcattgcacagggaaaccatgccacacctttcggattgaatattgaaggtttgaagcgccgtggctttgataaagaatcactgcatgcaatccgtaatgcctataaagtactttaccgtagcggaaagacgctggaagaagccagaatagaaattgagcttcaggcggcaaataacccacatgtgaaagcattcagtgattttctggaaaattcagcaaaatccaaccgtggcatcattcgttaa

SEQ ID NO: 4502 - DNA, 453 bp, Xenorhabdus bovienii
  Coding DNA location: Contig name=SeqID_16897; Position on contig =18973..19425bp; Strand=-
atgagtgataatcgtactctgcaaattgaagagattttggatttgctacctcaccgctacccgtttctgctggtagaccgtgttttggattttgaggaaggtaaattcctacgcgcagtcaaaaatgtatcatttaatgagccattctttcaggggcattttccgggtaagccaattttcccaggcgtcctgatccttgaagcaatggctcaggcaaccggaattctggcattcaaaagcgttggctcactggcaccgggtgagttgtattactttgccgctatcgatggcgctcgtttcaagcgtccggttctgccaggtgatcaaatgattctggaagttgaatttattaaagaacgtcgcggtgttgcgcgttttaggggcgtagcaaaagtcgatggagaagtggcttgcgaagctgaaatgatgtgtgctcgccgtcgtgaggcttaa

SEQ ID NO: 4503 - DNA, 1029 bp, Xenorhabdus bovienii
  Coding DNA location: Contig name=SeqID_16897; Position on contig =19548..20576bp; Strand=-
atggtttcaattcgattagctgatctcgctcagcagttgaatgcgcaattacatggtgatggcgatatcgtcatcaccagcattgcgccaatgtattcagcaaatagcgaacaaattacatttttatctgacagccgttacactgacaaacttgcagaatgtcaggctgcggctgttgtgctgcgtgaatctgatcttactcattgtaaggtcgccgcactggttgttgataatccctatcttgcctatgcacgtatggcacaaatcatggatacgacgccacaacctgcacaggatattcacccatcagccgtgatattttctgaagtgcaattggggaaaaatgtggcggttggtgcaaatgccgttgtcgaatctggcgttgttctgggtgataatgtcattgtcggtgcgggttgctttattggcaaaaatacgcgtattggtgcaggaacccgcctttgggccaatgtatcagtataccataacgttgaaattggcgaacagtgccttattcagtcaggcaccgtgatcgggtcggatggttttggctatgccaatgaccgtggcaactggattaaaattccacagttaggctcagtgatcatcggtgaccgcgttgaaatcggtgcttctacgactatcgatcgcggagcgctggataacacagttatcggtaatggtgttatcattgacaaccagtgccaaattgctcacaacgtcataattggtgacaacacagcagtggctggtggtgccactatggcgggtagcctgaaaattggtcgttattgtatgattggtggagccagcgtcattaatgggcatatagaaatctgtgataaagtgaccgtaaccggtatgggcatggtgatgcgtccaattacagagcctggtgtatactcgtctggtatcccattacaaccgaacaaagtttggcgtaaaactgctgctttagtcatgaatatcaatgaaatgaataaacggcttaaatctgtagaacgccagcttgaaggtgaaaacgagtaa

SEQ ID NO: 4504 - DNA, 498 bp, Xenorhabdus bovienii
  Coding DNA location: Contig name=SeqID_16897; Position on contig =20581..21078bp; Strand=-
gtgaaaaaagtattgtgtgcggcaagccttggtatcgcattagctttctctgcgggtgttcaggcagcagacaaaatcggagtcgtgaacgttggtgaaatcatccaaaagttaccggctcgtgaagctgctgtaaaacagttggatagtgaatttaaaggccgtatatccgagttgcagagtatggaagctgatatgcaggccaaggtgcagaaactgcagcgtgatggttcaaccatgaaagccagcgaccgcacaaaattagagaaagaagtgatggcacagcgtaacgactatgcccagaaggcgcagtctcttgataacgatagccgtcgccgccagatggaagagcagaacaaactcctgacccgcattcacgatgccgttaaagtggttgcaggtaaagaaggttacgacgttgttcttgatgctaataccgtattatattccgtatcgggtaaagacattaccgcagatgtactgaaacaggttaaataa

SEQ ID NO: 4505 - DNA, 2436 bp, Xenorhabdus bovienii
  Coding DNA location: Contig name=SeqID_16897; Position on contig =21177..23612bp; Strand=-
atgatttctcccgcttctaaggtgggagaccggttaggaaaacgcataacaacgatggcgatgaaaaagttgctcatagcgtcgctgctgttcggcagcgccactgcatacagttcagacggattcgtggttcgggacattcagtttgagggtcttcaacgtgtcacttctggtgcagcattactgaatatgccagttcgcgtaggtgatacaatcagcgatgaggatatcagtcgcacgattcatacactgttcgcgactggaaactttgaagatgtccgtgtcttgcgtgatggcaatacactcgtcgttcaggttaaagaacggccaaccatcgccagcattactttctccggtaacaaatcggtgaaagatgacatgctcaagaaaaaccttgagtcctctcgtgttagtgttggtgaagctcttgaccgtaccatgctgtctaatatggaaaaagggctggaagatttttactacagtgttggtaaatacaatgctacggtgcaagccgttgtcacgccgctgccccgtaaccgtattgatctgaaactcatattttcagaagggatctcagctcagatccagcagattaatattgtcggcaataaagcattttctacaaatgagttgctcaaccgcttccagctcagggatgatattccttggtggaactttatgtctgaccagaaataccagaaacagaaattggcgggtgaccttgaaaccctgcgcagtttctaccttgatcgaggttatgcccgtttcagtattgattcgactcaagtcaatctgacgccagataaaaaaggtatctatatcaccgtgaatatcaatgaaggcgctcagtacaagatcgccagtattgatttgaacggtaacttggcaggttatcagtctgaagccacaaaactgaccaacattcagcctgggtcgctgtataacggtacagaagtgacctcgatggaaaaggcaattaaaaacctgcttggtcgctatggctatgcctacccgcgagttattacacagcctgaaatcaacgatacagacaaaacggttaagttacatgttaatgtggatgcgggtaaccgtttctatgtgcgtaaaatccgcttcgaaggtaatgatgttagcacagactctgtgcttcgccgcgaaatgcgtcaaatggaaggggcatggctaggcagcgatcgtgttgaacagggcaaagagcgtctggacagactgggcttttttgaaacggttaatgtggatacagaacgtgtagccggcagcccagatttggttgatgtggtttataaagtcaaagaacgcaatacgggttccatgaactttggtgttggtttcggtactgaaagtggcatgagcttccagatcggccttcagcaggaaaactggctgggaacgggtaactctgtagggatcagtgccagcaaaaatgactattcgacctctgcggatttgtcctttaccgatccttacttcacagtgaatggcgtaagtctgggcggtcgtgtgtactataacgacttccgtgcagatgatgctgaactttctggttataccaataaagcctacggtactgaaggtattttgggcttcccgctaaatgaaaataacaggctggccatgagattgggctatgcccataactcactgtctgacatgcgtccacaggcagcgatgtggcgttatttgaaaaaaatgggcaaagagccgccttttgagggcaaggcatcgttcgattccaatgatttcccactgacattcagttggatatatggcaactttgaccgtggtttcttcccaacttctggtttcaagtcttcagtggatgccaaagtggctctgccaggctcagacaaccagtactataaactcacttggagcgctacaggttattatccgattgatgataagaattcatgggtaatgatggggcgcacccgcatgggctatggtggcggtttaggtggcaaggaaatgccattctacgaaaacttctatgctggtggttctaatagtgtccgtggtttccgttcgaataatatcggtccaaaagcgatttatttaggtaaggacaaagaaccagaaaaaaatagtccatcccgtgatgctgtgggggggaatgcgttagcgactgccagcttcgagttgattacgccaacccctttcctagatgcgaaatatgccaatactgtacggacttccttctttgttgatgcgggaaccgtgtgggataccaactggaacaagatttaccctggcctgcctgactacagcaagccaaataatatccgtgtttcggccggtattgcattgcaatggttgtcaccgttggggccattgaccttctcttatgggaagccaatcaaggaatacgaaggtgatagagcggagcagttccaatttaacatcggcggcacttggtag

SEQ ID NO: 4506 - DNA, 1353 bp, Xenorhabdus bovienii
  Coding DNA location: Contig name=SeqID_16897; Position on contig =23593..24945bp; Strand=-
atggatattctctggaatctggctgcatttattgttgcattgggtattcttatcacagtgcatgagtttggtcatttttgggttgccagacggtatggcatctacgttgaacgcttttccatcgggtttggtaaagcgctctggcgtcgcacagataagcagggaaccgaatacgttatcgctcttatccctctggggggatatgtcaaaatgcttgatgagcgggttgagtctgtctctcccgaacgtcgtcatatggcattcaacaataaaaccatcggccagcgcgcggcagtcgtcagtgctgggccaatcgctaactttattctggcagtcattgcttattggctggtttttgtgattggcgtgccttctgtgcgcccggtggttttggatgttaagccagattctattgccgcccaggcaaatattttgcccggaatggaactaaaaatggttgatggtatcgaaacctttgattggaattcggtacgtctggccttagtgagtaaagtgggtgaatcttttgtgtcaatggatgtgatgccagtgggtgcttctgccagcacgcaaaaaacattagatttacgtgactgggcattcgatccatccaagcaggatgtcttgctgtctttgggtattatgcctgtcgtaccacgaatcagctctcaggtagagaacgtttacccgggctctcctgctgaaaaagcaggtttacaacgtggagacaggatcgttaaagtcaatggccagaatgtggatgtctggcacacttttgtatcttttatcaggaagaatccgaatgttcctctaaaattggacgttgcgagggcagatagcataatccccctgtctttgacaccagaggccaggcggttgtccaatgggcgtgaagaaggcttcgctggcgccgaacttcaagttattccactggcggatgaatataaggtaattcaacaatatggggctttctctgccatttatcaggcaggagacaaaacttggcaattgatgaagctgactgtcaatatgatcggtaaattaattgtgggggatgtgaaactcaataacctgagtggtcctatttccattgccaaaggcgctggagtatcggctgattctggcttggtgtattatttgatgtttttggcgctgattagcgtcaaccttgggatcattaatttgttcccattacccgtactagatggtggacacttgcttttccttgctattgagaagatcaagggagggccagtctccgagcgtgtacaagacttcagttatcgcattggtactatattactggtgttattaatggggcttgcacttttcaatgatttctcccgcttctaa

SEQ ID NO: 4507 - DNA, 864 bp, Xenorhabdus bovienii
  Coding DNA location: Contig name=SeqID_16897; Position on contig =24955..25818bp; Strand=-
ttgctgaagtaccgtcttttaactacgttgatattaattccaattgttattgcagcactgtttttacttcctccatccgggtttggattggttgttattacagtatcagtacttgccgcatgggaatgggggcaatttgctggcctcttcacacaagctaaacgtattacgttggccgtgttatttgccgtagggctactggccttacagtattctttgtcagattttttccatcttattgaaaaaccacagattatatatctattgtgggctggcatgatttggtgggctgcggctatcctgttggtcatcacttatcctgcttctgcctcaatctggaagtcatcaactgcactgcgcctgttgtttggcgttctgactatcgtgccattttattgcggaatgatgctgcttcgaactcagggatatgaaaacaacccctatcatggtgcatggtggctattgtatgcgatgctgctggtatggggagccgattccggtgcctatatttttggccggacactgggtaagcacaaaatggcaccgagagtgtctccgggcaaaacacttgaaggtttggtcggaggagtattgactgctgcgcttatttcgtggttgttcggtaaatttgcgccagtaccggtaatgcctgaaaacttattattgatttcggctgtggttgtgattgcctctgtcttcggtgacttgaccgagagtatgttcaaaagagaatcaggcatcaaagacagcagcctgctgatccccgggcatggtggggttatggacagggtagatagcctgacagcagcagttcctgtgttcgcgggattggtactgttaatttcttctggatttggtctctga

SEQ ID NO: 4508 - DNA, 696 bp, Xenorhabdus bovienii
  Coding DNA location: Contig name=SeqID_16897; Position on contig =25828..26523bp; Strand=-
atggatggcaatggccgctgggcaaaacaacgtgggaagttaagggtttttggccatcgcgccggtgttaaagctgtgcgggttgccgtgagtttttcggttaaacacaatattgaatcactgacgttatatgctttcagcagtgagaactggaatcgcccacagcaggaagtcagttcattaatggagttgtttgtttttgctcttgataatgaagtgaagagcttgcataagcacaatgtgaaattgtctgttattggtgatatcagtcggtttagctcacggttgcaggaacgtattcgccgttcagttgaattgacggcgggcaataccggattgcagcttaatattgccgccaattatggcgggcgttgggatttggctcagggcgttaagcaaatcgctgaaaaaatcagggcgaatgagctggagcccgaggaaattactgaagccacagtgggcagcttcatcaatttgagtgagcaacctgaagttgatctggtgatcaggacgggcggcgaacaccgtatcagtaattttctgttatggcagatagcttatgcagaattgtattttaccgatatactttggcctgatttcgatgaaactgtttttgaaggtgccattaatgcctttgttaaacgagaacgccgattcggcggaacaataccagacgatgccgaagtgggatcatag

SEQ ID NO: 4509 - DNA, 210 bp, Xenorhabdus bovienii
  Coding DNA location: Contig name=SeqID_16897; Position on contig =26642..26851bp; Strand=+
atgaaaaagccgtgtcaacaattaccacggctatttctggggcatggcccgaatgaaagcctctatctttggcacacactcggaaaacgtgtgacaaatattgaaccggctattataacaactattatttacccgcgaactataccatttgccaaaacgcaaacaaatatatacttattagcaagattcgctatttggaaaaggtcttaa

SEQ ID NO: 4510 - DNA, 1197 bp, Xenorhabdus bovienii
  Coding DNA location: Contig name=SeqID_16897; Position on contig =26832..28028bp; Strand=-
atgaaacgcttaactatccttggctcaacgggttcgattgggaaaagtaccctctctgttgtcagaaataacttggataaattccaagttgtggcactcgtcgctgggaaaaatattgaaatcatggcacagcagtgtctggagtttcgccctcaatatgcggcaatggcggatgcgcactcagcaacggtattacggcagttattgcaagagcagggaagccagacagaagtgttgtccggtagggaagccatttgtgatttagctgcgttggacgatgttgatcaagtcatgtccgcgattgtcggtgttgccgggttattgccgacgctggcggctatccgcaaaggtaagcaagtcttgttggccaacaaagaatcactcattaccagtgggcgtttgttcatggaggcggtgaatcaatatcaagcgcaactgttgcccatcgatagtgaacataatgccatcttccagagcttgcctgaatctgttcagcacaatcttggaaatgcaagtttaaaacaacatggtatctccagtattatcctgacgggatcaggtgggccgttccgcagaacccccctggagaaattgcttgatgtcacacctgatgaagcctgtgctcaccccgtctggtctatgggacgcaaaatttctgttgattccgcaaccatgatgaacaaagggctggaatatatcgaagcccgttacctgttcaatgcttctgctgatgaaattgaagtgctgctccatcctcaatcagtgatccattcgatggttcgttatcaggatggcagcatcattgctcagttaggaacgcaggatatgtgtaccccaatagcctatgcaatggcttatcctaatcgcattgcttctggtgcaaaacctctggattttactgaactgagcacactcacttttgaagcgttggattatcggcgttacccttgtctgaaactggccatcgatgcctgccatgaaggtcaggcggcaacaaccgcgttgaatgccgccaatgaagagacggtcagtgctttcttgaaagatgggatccgtttcaccgatatcgtgatgattaatcggctggtcgtcgaaaaattaaatttgtctgaacctcaaagtatcgaagaggtcttagaaatcgataaagtcgctagaaaattagtaaaagaaacgattaagaccttttccaaatag

SEQ ID NO: 4511 - DNA, 618 bp, Xenorhabdus bovienii
  Coding DNA location: Contig name=SeqID_16897; Position on contig =28169..28786bp; Strand=-
atgatatcttattttgatattcgtgggctacaaaataaccagttcccaagggtttgtaacgtgattaatgaaatcaagaaagacgcacaagaccgcatggaaaaaagcgtcgaagcactgaaaagccaaatcagtaagattcgtacaggccgtgcctctcccagcctgctggatggtatcaacgtcgagtattacggctctgcgaccccattacgtcagattgccagcgtcgttgttgaagacgcacgtactttagcgataacggtttttgatcgttccatgacgcctgctatcgaaaaagcgattatggcttccgatctgggtctgaacccatcttctgctggaaccattatccgtgttccactgccagcactgacagaagagcgtcgtaaagatctgatcaaagttgtgcgtggcgatgcagaacaaggccgtgtgtccgtgcgtaatatccgtcgtgacgccaatgataaggttaaggcactgctgaaagacaaagaaatcagtgaagatgaagaacgccgttcacaagacgaaattcagaaactgactgacaatttcatcaagaaaattgatgaagcattggcaagtaaagaaactgaattgatggatttctaa

SEQ ID NO: 4512 - DNA, 729 bp, Xenorhabdus bovienii
  Coding DNA location: Contig name=SeqID_16897; Position on contig =28859..29587bp; Strand=-
atggcaaccaatgcaaaacccgtatatcagagaatcctgcttaagctcagtggagaagccctgcaaggcgcagaaggttttggtatcgatgccagcgtcttagaccgcatggctcaggaagtcaaagaactggttgagctgggtattcaggtcggtgtcgttattggcggaggtaacctgtttcgtggagccggtctggccgaagcaggaatgaaccgtgtagtcggcgatcacatgggcatgttggcaaccgtaatgaacggtctggcgatgcgcgatgccttacaccgcgcctatgtgaacgctcgtttgatgtctgccattccactgaatggagtgtgtgacaattatagctgggctgaggctatcagcttactgcgtcacggtcgtgttgttattttctctgcaggtactggcaacccattctttacgacagattccgcagcatgcttgcgcggcattgaaattgaagcggatgttgtgttaaaagcaaccaaagttgatggggtctattctagtgaccctgctaaagatactgaagctgttctttacagtaagctcacttatcaggaagtattggagcgtgaactgaaagtcatggatctagccgcctttactctggctcgtgaccatagtatcccaattcgtgtcttcaatatgaacaagccaggcgcacttcgtcgtgttgtgatgggggaaagtgaaggtacgttgatttctcacggataa

SEQ ID NO: 4513 - DNA, 858 bp, Xenorhabdus bovienii
  Coding DNA location: Contig name=SeqID_16897; Position on contig =29718..30575bp; Strand=-
atggctgacattaccgctgctctggtaaaagaactgcgtgagcgtactggcgcaggcatgatggaatgtaaaaaagcactggttgaagcaaatggtgatatcgagctggctatcgataacatgcgtaaatcaggtcaggcaaaagctgctaagaaagcaggccgtgttgcggctgaaggtgttatcctggttgaagttgcagctgacgctaaatatgcgggtattgttgaactgaactgtgaaactgacttcgttgctaaagactctggcttcctggcgttcggtaaagaagtgattgctgccgttatggctgacaaaaatgctgacattgatgcactgaaagctcagttcgaagaacagcgtgctaacctggtagcgaaaatcggtgaaaacatcaacatccgtcgcgtaactatcctggaaggtgacgcagtaggttcttacctgcacggtgctcgcatcggtgttctggttgctgctgaaggcgcaagcgaagaactgatcaagcacgttgcaatgcacgttgctgcaagtaagccagaatacgtgaacccaactgacgttcctgctgatgttgttgcgcgtgaacaccagatccagatggatatcgcaatgcaatcaggcaaaccacgcgaaatcgcagagaaaatggtttctggccgcatgaacaaattcactggcgaaatctctctgacgggtcaaaacttcgtgatggatccaagcaaaacggttggtgacctgatgaaagaaaataatgctaaagttatcaacttcatccgttttgaagtcggtgaaggcattgagaaagttgaagctgatttcgcagcagaagttgctgcaatgagcaagcagtcttaa

SEQ ID NO: 4514 - DNA, 726 bp, Xenorhabdus bovienii
  Coding DNA location: Contig name=SeqID_16897; Position on contig =30723..31448bp; Strand=-
atggcaactgtttccatgcgcgatatgctgcaagcgggcgttcacttcggtcaccagactcgttactggaacccaaaaatgaaacctttcatctttggcgctcgtaacaaagttcatatcatcaacctggaaaaaactgttccaatgttcaatattgcattggcagagctgaacaaaattgcttcccgtaaaggcaaaattctgtttgttggcaccaagcgtgcggccagcgaaggaatcaaagaagaagcactgggctgtgaccaatactttgttaaccaccgttggttaggtggtatgctgactaactggaaaactgtgcgtcagtcaatcaagcgtctgaaagatctggaaattcagtctcaggacggtacttttgacaagctgaccaagaaagaagcgctgatgcgtactcgtgagcttggcaaactggaaaacagcctgggcggtatcaaagacatgggcggcctgcctgatgctctgtttgttatcgatgctgaacacgaacacattgctatcaaagaagcaaataacctgggtatcccagtattcgctatcgttgatactaactctgatccagacggcgttgatttcatcatccctggtaacgacgacgcaatccgtgcagtaaaactgtacttgggcgctgtggctactgctgttcgtgaaggtcgttcacaagatctggctgttcaagctgaagaaggtcttgtagacgctgaataa

SEQ ID NO: 4515 - DNA, 813 bp, Xenorhabdus bovienii
  Coding DNA location: Contig name=SeqID_16897; Position on contig =31789..32601bp; Strand=-
atggggttcttcttctttgcgcaatgtcatgatttcacagccattgtcggtgacgacgatggtgtgctcatactgagcagaccagccgtggtctttggttttgactgtccagccatctttcatggtgcggatacgggaatcgccggtattgaccatcggttcaatcgtgaacgccatccctttctgcaatacaacgccaccatcatcggcatcataatggagtacatggggttcttcgtggaagaccctgccgataccatggccgcagtattcgcggacgacagagtaatcctgcccttccacatactgttggatcgctttgccaaggctgcgcaggcggatgccgggtttcaccattttcagcgcaaggtacaggctttcctgggtaacgcggcacagacgctcgccctgaatagtcggtttgccgacaatgaacattttggaggtatcgccgtgaaattcctctttgatgacagtgacatcaatgttgacgatatcgccttctttcagcgccttgtcatcgctgggaataccgtgacaaatcacatcattgacggagatgcatacggatttcgggaaaccgtggtagccaagacaggcagaaattgcctgctgtttatgggtaatgtgatcgtggcaaatacgatcaagctcacctgtggtcacaccaaccttaacgtaaggttcgatcatttccagaacttcggctgccagacgtccggcaacgcgcattttctggatgtcttcatctgttttgatagaaatagccatgaaatcggtccattcaagtcggaaatttacccgactgtttga

SEQ ID NO: 4516 - DNA, 2655 bp, Xenorhabdus bovienii
  Coding DNA location: Contig name=SeqID_16897; Position on contig =32786..35440bp; Strand=+
atgtcagttgatatcacctttgcacacgcgcccattcctcccctctctcctgcggaattttccctcaatgatcttcaacgcccggcattgaaacagcatgttgatgaatttcaattgtggcttcagcaggcattcaaagcggggatctcgccagaagcactgatttcagcccgcagtgattatattgatcgtctcctgatgcgcctgtggcaggcttacggtttcgatcagctcacttcactttccctgattgcagtaggtggttatggccgacgcgaattgcatcccctctccgatattgatttattggttctcagcgagagccaactgactgaagatcaagcccacaatatcgggcaattcataaccctgctctgggatatccgtctggaagtgggccatagtgtcagaacctttgaagagtgcctgcatgaagggttatcggatttaaccgttgccacaaatctgattgaatcacgtttgatctgcggtgatctgcctctgttcctgcggttacaaaagcacattttcagcgatgacttttggccttccgcaacgtttttcgcagcaaaactccgcgaacagtgggaacgccaccagcgttatcacagcaccagttataatctagagccggatatcaaaagcagccccggcgggctccgggatattcataccctgctttgggttgctcgccgccattttggggcagcttcgctggatgaaatggtggatttcagcttcctgacccgcgaggagcgcaatgaattaaatgaatgccaggattttctctggagtatccgttttgccctccatttggtcgtcacgcgctatgacaatcggctactgtttgaacgtcagttcaatgttgcccaattgctcggttatgaaggagaacgcaatcaacctgtcgaacggatgatgaaaaatttctaccgcgtgacccgccgtgtcagtgaattgaatgacatgctacttcaactctttgatgaagcgatcctgacattacagcccgatgaaaaaccacgtcccttgaatgaagcgtttcagttgcggggagatcttatcgacttaagcgatgaaaccctgtttatccaagatccaacctcaattttaaaaatgttttaccacatggctgaacatcgggaaattaaggggatctattccacgacattacgccagcttcgctacgcccgtagaaacctcaaacatcctttgtgtgagttgcccgaagcacgaaaacttttcatggatatcctgcgccatcctcgtgccgttaaaaacgcactgctcccgatgcaccgtcatagcgttctaggtgcttatatgccgctctggagtaatattgtcggccagatgcaatttgaccttttccacgcttataccgttgatgagcacacccttcgggtactgcaaaaactcgaaagtttcgccgatgaaaacaaccgtgtgatccatcccttatgtgtcgaactgtatccccgcattcctcagccggaactcttacggctggcggcctttttccatgatatcgccaaggggcgtaatggcgatcattctgaactgggcgccaaagatgcgtttacatttgcacgccaacatggtctgactacccgtgaggccgaattagtggaatggctggttcgcgaccatttgctgatgtcagtcaccgcacagcggcgggatattcaagatcctgacgtcatccagcaatttgccggccaagtcaaaaatcaaaaccggctgaattacctgctctgccttaccgtcgcagatatctgcgccaccaactccaaattgtggaacagttggaagcagagcctgatacgcgaactctatttcgccactgaaacccagttacgtcaaggtatacagaatacgcctgacttgcgtgaacgtgtccgccataatcgtttacaggcattagctttactgcgacaggaaggaaccgacgaagaacaattacacaatatctggagccgctgccatgcggattatttcctgcgccatacgccggatcaactggcctggcatgccggccatttgatccaacatcaatctgcgcagcccatggtgttaatcagcaccgcattttcccacggtggaaccgaaatttttatctggtgtcaggacagaccttcgcttttcgcggctgtagtcggagagttggacagacgtaacctcagtgtccacgatgctcagatctttaccaatcgcgatgaaatggcgatggatacctttattgtactggaacccaatggtcatccgctggcgctcgatcgtcatgaacctatccgccgggcattattgaaagtcgtgaacgatccgcatccgaaagcgcccaaagcgcgtaatcttcccgctaaactgcgtcattttgatgtgccgaccaaagtgagttttttaccagcacaaaatgtccgccgctcttatatggagctggttgcactggatcaacccggtctgctggcacgcgtgggcaatattttcgccgaactgggcgtttccctgcatggcgcgcggattaccaccattggtgagcgcgttgaagacttttttgtgctggcagataaagaccatcaggagctggataacaaaatcaagggagaattatcagaaaggttgacagaaaccctcaacaccaaggataaagtataa

SEQ ID NO: 4517 - DNA, 843 bp, Xenorhabdus bovienii
  Coding DNA location: Contig name=SeqID_16897; Position on contig =35482..36324bp; Strand=+
atgcagcaattacaatccattatcgaaatacaagccattatcgacaatgcgtttgaaaaccgcactgacattacccccagcactgttgatgaagcaacccgtgacgccgtcaatcaggtgattcagatgctggacagcggcaaattacgggtcgctgaaaaaatcgcagggcaatgggtaacgcatcaatggctaaaaaaggccgtattactctctttccgcattaatgacaatcaggtcatcgaaggggctgaaagtcgctatttcgacaaagttccgatgaaattcgctgattatgatcaagctcgtttcgaaaaagaaggttttcgcgtcgttcctcctgccgcagttcgccaaggcgcctatattgcccgcaacacagtattgatgccatcttacgtcaacatcggcgcttatgtggatgaaggtacgatggtagacacttgggccaccgtgggttcctgtgcacagatcggcaaaaacgttcacttgtccggcggtgtgggcattggtggcgttctggaacccttgcaagccaatcctactatcattgaagacaactgctttatcggcgcacgctctgaaattgtagaaggcgttatcgtagaagaaggtgccgtgatctcaatgggggtttacattggccaaagcaccaaaatttatgatcgtgaaacaggtgaaatccattacggccgggttcctgcgggttctgttgtagtatcaggtaatcttccttccaaagatggcagttacagcctgtattgcgcagtcatcgtgaaaaaggtcgatgccaaaacacgtggtaaagttggccttaatgagctgctcagaaacatagactaa

SEQ ID NO: 4518 - DNA, 387 bp, Xenorhabdus bovienii
  Coding DNA location: Contig name=SeqID_16897; Position on contig =36403..36789bp; Strand=+
atgtacgataacttgaaaagtttggggatcacgcatcctgaagatattgatcgctatagcctccgtcaggaagcgaataacgatattctgaagatttatttccgtaaggataaaggcgaattttttgccaaaagtgttaaattcaaatatccacgccaactcaaaactatctctgacgacaattcagcgcaaggttacaaagaagtcaaagagattaacactaatttgcgttatgtgattgaagaactggatcaaatttgtaaacgtgatcaagtagaagtggatttgaaacacaagatcctcgacgatctccgccatcttgagcatgttgttgccaataagattgcagaaatcgaagcggatttagaaaaactgactcgcaagtaa

SEQ ID NO: 4519 - DNA, 495 bp, Xenorhabdus bovienii
  Coding DNA location: Contig name=SeqID_16897; Position on contig =36846..37340bp; Strand=-
atgaatgaacgcagtacaaacaggctaaagagatcaatatttatggcaaagattggtgttttcgttggtacagtttatggcaatgcgctggcagttgcggaagaggcgctacagatccttcagcagcaggggcatgaagttgaggtttttgaagatgcgaccttgacgcagtggcagaaatacctgcaacaggttgtcctggtggtcacatcgtcgaccggacagggtgaattacccgataatatccagccactttattcagatttgaatgataagttgggccatcagcccgacttacgttatggcgttatcgctcttggtgacagtagctatgacttcttttgtggcggtggccgcacatttgacaaactgttacaggaacagggagcaaagcgtgtgggcgaagtcctgctgattgatggtattgacgtggttgaaccagaagtctttgcccagaactgggttgaggagtggggcgctttactgacagaatag

SEQ ID NO: 4520 - DNA, 753 bp, Xenorhabdus bovienii
  Coding DNA location: Contig name=SeqID_16897; Position on contig =37333..38085bp; Strand=-
atgctggatatcatttatcaggacgatcatattgttgcggtcaataaacctgcgggttggttagtgcatcgcagctggcttgctcgccatgaaacggtctttgtcatgcagacgctgcgtgatcaaatcgggcaacatgttttccccgtccatcgactggataaaccgacatccggcgttttgctgatggcgctgtcaagtgaggtggcaagaacgctttcccaacaatttgaatgtcaccatatacaaaaaacatatcacgccattgtacgcggttatgttgaaggtgatggtattatcgactacgcactaatggaagagctggataaaattgctgataaattcgctgatactgacagggaagcacaatcagcaatcactcactatcgttcattggcaaaagttgaatgtccggtagaaataggacgttacccaacatcacggttcagcctgctggagctgatgccaaaaaccgggcgtaagcatcaattacgacggcatatgtcgcatctccggcatcccatcattggggataccacacacggcgatctgcgacaaaactgcggagttgttaaatattatcagactggcaggttaatgctgcatgccagtcaactccaattggcgcatcctgtgacaggagagaatcttcttctgacagcccggtgggaagcttcgtggcagcatttgctggagcaatttggctggcagggtattttacctgagttggaatgtccaaccactcatgaatga

SEQ ID NO: 4521 - DNA, 327 bp, Xenorhabdus bovienii
  Coding DNA location: Contig name=SeqID_16897; Position on contig =38087..38413bp; Strand=-
atgaatatcgaacaacaaattctacttaaattacagctaattgaagctgacatgaacgcggctggcctgtggcgaagccatcctcccaagccggaagcttttgaaagcaccgagcccttttcgctagatacgatgtccgcagaagagtggcttcagtgggttttaattccaagaatgcgagctatgatagaacaaaacgccaatctgccgacggcatttgagatcacaccttatttcgaagaagcctataaggaagaagcagaacgttatctaccgctgcttgaacatcttcgggaattggacagcctgtttacacaggatatttga

SEQ ID NO: 4522 - DNA, 552 bp, Xenorhabdus bovienii
  Coding DNA location: Contig name=SeqID_16897; Position on contig =38973..39524bp; Strand=-
atgaccttcaatgtggcagaagcacttactgattttacccgacgttatgttgaattgtggcaggaggagacagggctgccgccagccagcagtgacctttatggtatcccttcttcgtgtattgagcggacaggggatggtgtggtgtactggttgcccaagctgttttctgttcacgaaaaactcagcaaagtggaaaccgcgctggacattcgcttgcaggattcgattcatgattactatgttacgcagctcgccggtgacatgcccgccagttttgaggggcagaatctcagcctgattcaggtatggagtgacgatgattttatccgtttgcaggaaaacctgattgggcatctcgtgacccagaaacggcttaagctttccccgacggcatttattgcgacgattgattcggagatgagcatgatatctgtgtgtaatttgactgggcaggtcattcttgaacagtctggtaaacctaagcgggcgatcttatctgctgatttggcgagttttctgtcggttatcaagccagccacatcgttgtag

SEQ ID NO: 4523 - DNA, 189 bp, Xenorhabdus bovienii
  Coding DNA location: Contig name=SeqID_16897; Position on contig =39616..39804bp; Strand=-
atgaagtcacgggagaagtcggctagtctggcttctccttttttggcgaagcgaatgcactgttcgcgtaccgaatatccatttatgatctcattttccggttgttattttgctgaaaactatatacacccaatggattttaagatgcagcgcgacggcaagggaacgaatccccaagcgcatagataa

SEQ ID NO: 4524 - DNA, 1872 bp, Xenorhabdus bovienii
  Coding DNA location: Contig name=SeqID_16897; Position on contig =39850..41721bp; Strand=-
atgaatagtaactataatgacatgggcttgccatcaagccgaaataaccctgttgaaaaagcaagtccgggtgtgtttgtgttcaggggacctgatgccccccatatcccgtgggtcgtaaaaattattaggcaagaacgtgatgagcacggtgcagtgtgtcctgattacgtgcactctagcactggctttttggtatcggatatgtggcttttgaccgcccgccatgctgtcgagcaaggggggaggcctgtcaggccagaagacgtgtccgttaggggcttttacaggactcaagaacccggcacacccgtctctcaagttatgctgcaaatcgatgcgattgaattttcgccaaacggcggagatatcgccgcgcttcgattgactgcgccctacagactgaacgactatgcgcctgttaatctactgcattctgctcaaggcatgatcggcatacgtgtccgtctgtacgcgtatgctgatgcaaacaattaccgtttgggaaccgcattcggaacggtatctcgcgtatatccagatccacaatatcccccaacgcagcaattattagttcactatgatgtgggacagggcagtggagtttcagaggcaggggattccggcgggccggtgctcttgggttacccgatcgacatcggcccacgttcctatgaaatggttgttggtctgcatgtaggtggggagcctcttcaggctgagggagattttgtgctactatcggatcatcgagattttattgagcctctcttgatgccacagctgatagccagcatctcggagtcaaactatcaactagtaactgcgcttcatctgttaaataattgtagttattttgaacgtctcgcaagagagccgttcagccgcgaggccgtgctgtcagatgatgcgggtacggtccccacttcctgtaatgcatttgattcgtaccgtttcttctataaaaaagcgagtgagggtgacagttgggacaacgcgactgcgtatgaagtcacaccttccggtcagactcacagatacgaacttccgcttgataaaacgcacccgcacagcgatagggagctgtgggatattacggtgctcccggtcggggatgggaaagtatttggggcgggagaaaatggcaagccactgccaggagtccaaagtaacttctttgtcagaacaaccccgactgtttccctgccgacgcatctgacgattagtgaacagccgggtatgcccggaatggttaaagtttcatggaagaattctgaatcacccatttccggaacgatcaaaggctatacgctattctatatgcctgctgaccatgttcctttctattgggcggggtgcgagggcacttctgttgctccgacctcttacgaaacgacctcggtggtcatccccgtatatacatcgggtaactacgctttactggttttacccgctgtgggcgatggggttgtgggtacgcaagaggatggtacgccttaccccggaacgtatagtggtgatcaggttacgcttattggcccacctgtcgtgcgatatcaaattccgaaggggggtgaaaacatgcacatcgatctcaatagtcatggctatgggatcatggccaatgtcagcttcgatgatcagaatgattacgaatgggtttggtgcaaagacaagccggacggtaattactcatcgggaggcgactggagcttcaccagtgggaaaaaatcctcgatcctcatctttggttcgcccgagaaacccgccagatcagcagattccggctggtataaactgaaggtggaaaatgcatttggtgtagtggaaacgaagccggttttcgtcagaatcgaaccgccgcccatgtag

SEQ ID NO: 4525 - DNA, 120 bp, Xenorhabdus bovienii
  Coding DNA location: Contig name=SeqID_16897; Position on contig =41808..41927bp; Strand=+
atgagcggattgggtcagaaatcagctgacgaaaaagcatttctgcgttgtcgcatgtgcattggcaaacaagttagctcggatagcctaggccataacaacccgtcaaaccgtatttga

SEQ ID NO: 4526 - DNA, 231 bp, Xenorhabdus bovienii
  Coding DNA location: Contig name=SeqID_16897; Position on contig =42006..42236bp; Strand=-
atgagattatggcatcattttccgggagagcacaaaatctatggttcccccagtttttgcaatactcattttgatgtatggttggcttgcgtaaatctatccggcatcactctaggcaaggatgcctgcgccttgatgggttccgtgtctgatgtacctaaaaatctgttcggcttcaaagagccattttttatgttaggtttgtcatcaagccgttcatgtcatcaataa

SEQ ID NO: 4527 - DNA, 1692 bp, Xenorhabdus bovienii
  Coding DNA location: Contig name=SeqID_16897; Position on contig =42461..44152bp; Strand=+
atgaactcatcaaatataatgagaaaagagaatattttagctagtgaatgtccccatgttaaaccagaatataacttaatcagctttcccaacgggataaaatgggaaaataggcattttaagaattggtcaggtgaaattgagcaacataacattccctgttgcataccacgctctgttgaagaaattcttgccgtcgttaactgggcctggaaggaaaattataagctgagacccgttgggcaatctcataattggtcgccgctgatacttccgcaaaaacagcggcctgaatcccgggttatgttaatggatctcagccagtattttactcaggtaagcatcgaacaccgctcgcagttctctatcgttacggcacagactggcatattgatggaaacgctaatggctgaaatggagaaacacgggctaggctttaccgcaacccctgcccccggagatttaacgctgggtgccgttctggcaataaatgggcatggaaccgcaatcaaagcactcaatgaaacatgcctgcctgggtacacttacggttccctcagcaacacaatattggccttatctgccgtcatatgggatacagaaagccagcaatatatcattaagcgttttgagcgacatgaacccagctgcgcttctctgttaacccatttggggtgttcaatggttttggaagtccagcttcaggcaggccagaatcaacgcctccggtgtgaaagttttactcacatccctgctgctgagttgttttcccctgtgcaaagcaaaaatactcagaggactcttagccactttcttgataaaagtggtcgggcagaagttatcttatttccatttaccaataagccctggttaaaggtctggagtgttgcaccagagaaaccggcttccagcgttgaagtgacagaaccttataactatccattttccgataatatctcatcttcgttatctcaacttgtcaacgagatgctttctggtattcctcagctaacgccgtctataggcgctctgcaatataccttggtgaataccactctgccaaagaatggaaaagatatctggggctggagtaaaaacctgttgctatatgtgaaacccacgacattacgggtgacagcaaatggttatgcagtattaacgcgccgggcagatattcagcgagtgctgcatgagttttattctgaatggcaatccttgatgaaagagtttcaatataaaaatcaatacccaataaatggccctcttgaagtcagggtaaccggattagacacgcctgaagacgttatgcaggaagccgctgtcgtgccaagtttgtctgccatacgcccacgtttggatcagcctcattgggatgtcgctgtttggctcgatgttttaacctttcccggaaccccgtatgccattgagttttgtcgcaagtttgaacaatggctatttaaagaattcgatggctcgtatgctttagcccgtgttgaatggagtaaaggctgggcctatagcccaaatgccgcgtgggaagataatgatacactgaccaaaacaatcccggcttcatttaatgatggcttgcctgctgataatcattgggcttcatccgttgcagcattgcaacaatatgatcctcatcatctattcagatcacccttattggaaaaattaatttctggttaa

SEQ ID NO: 4528 - DNA, 846 bp, Xenorhabdus bovienii
  Coding DNA location: Contig name=SeqID_16897; Position on contig =45107..45952bp; Strand=+
atgtctttgtatcaagataatcaggcattcgcccaacttactctgggtaaagccacaccctactgtgatcactacgatcctactttactgcaagcggttccgcgcagcatgaaccgtgaaccacttgggctatttcctgataatcttccgtttcacggcgctgatatctggacaatgtacgaactttcctggctcaattcacgcggtgttcctcaagttgccatcggccatgtcagcctaagtgcagccagtgtgaatctcgttgaatcaaaaagttttaagctttacctgaatagtttcaatcaaacccgctttgcagattgggataccgtgcaaaaaacgctgcaacaggatttatccgtctgcgcaaacggtgatgtacatgttgttttacgtcccctgcacgatttcagccagcaaccgatcgccgagtttgaaggaaaatgtatcgataatcaggacattgaaattgatgattatcaattcagtcgcgattatcttaacgatgctgcagcaggttcggtcgttgatgaaatattggtcagccatttgctaaaatcaaattgcctgatcacacatcagcccgattggggttccgtacagatccgctataaaggccccaaaatcgatcaggaaaaattattgcgctatctggtttctttccgccatcacaatgaatttcatgaacagtgtgttgagcgtattttcaatgacttaattgcgttatgcgcacctgaaaaactcacggtttatgctcgctatacccgccggggagggttagatatcaacccgtggcgcagtaacgaagcctttattccagaaacaggaagactggctcgccagtaa

SEQ ID NO: 4529 - DNA, 1338 bp, Xenorhabdus bovienii
  Coding DNA location: Contig name=SeqID_16897; Position on contig =46021..47358bp; Strand=+
atggatttactctctcaacttgaagtcgatgcactcaagcgtaccgcaagcagtgatttataccgcctgttccgcaactgctcactggcggtactcaactccggcagccagacagataacagcaaagagttgctgtcaaaacatgaagattttgatattaacgtcctgcgtagagagcgtggcgtcaaactggaactcgtcaatccaccagaagacgctttcgttgacggcaaaatcattcgctctctgcaagccaacctgttcgcggttctgcgggatattctgtttgttcatgcgcagattgacagtgcacagaaagtgcaccatctgaatatggaaaatggtatgcacattaccaacaccattttttctattctgcgcaatgccaaagcgcttcatctctcagaagatccgaatatgatcgtctgttggggcggtcactcgattaatgaaaaagagtatctgtatgggcgcaaagtgggtaacgagttggggctgcgcgaactgaatatctgcacgggctgtgggccgggcgcaatggaagcgcccatgaaaggtgctgcggttgggcatgcccagcaacgttaccaaaaaagccgctttatcggcattacagagccttccattattgctgcagaaccccccaatccgctggtcaatgaactgatcatcatgccggatatcgaaaaacggctggaggcatttgtccgcatagctcacggcattattatcttcccgggcggggtgggaacagcagaagagctgctctatctactgggtattttgatgaaccctgataataaagatcaagtgctgccattgatcttgaccgggccaaaagagagtgccgattacttccatgtgctcgataagtttatcgtcaataccttgggagaacaggctcgtcagtactatcgcatcattatagatgatccttcagaagtcgcccgagtgatgaaaaaaaccatgccgcaggttaaagaacatcgccgctctaccggagatgcctatagctttaactggtcactgaaaatcagccatgatttgcagcatccgttcgagccattccatagcaatatggctaacctgaatttgcatccgaatcagcctcccgaaaaactggcttctgctctgcgatgtgccttttccggcattgtggcgggcaatgtgaaagaagcgggcattcatgccattgaaaaagacggagcgttcaaaatccacggtgatgtggatatcatgcgccatatggatgaactattgaaagattttgtcaggcaggatcgcatgaaattgccgggaggtacggcttacgagccgtgctataaaatcatcaaataa

SEQ ID NO: 4530 - DNA, 756 bp, Xenorhabdus bovienii
  Coding DNA location: Contig name=SeqID_16897; Position on contig =47428..48183bp; Strand=+
atgatacatcttttgattgtagacgcactgaacttgatccgacgcatccatgctgtgcagggaagcccttgtgttcccgcctgtgagcatgcgttaaagcagctaatcacccattcttctccgactcatgccgttgcggtattcgatgaagatgaccgtggtcatagctggcgccaccagcttcttcccgattacaaagccgggcgttctgccatgcccgacgatttacagcaggaaatgccgctgattaaacaggcattcaatgcactaggggtaacttgctggcatgccgaagggcatgaagccgatgatttggcggcaacactggcaaccaaagttgtttctacggggcatcgagtcaccattgtttcaacggataagggctactgccagctactttcaccgaatatccagatccgcgattacttccaaaaacgctggctggatttaccctttgttgagcgggagtttggtgtttcccctgcccagctccccgattattggggtctggcaggggtcagtagcagtaaaatccccggtgttcagggaatagggccaaaaacagcggccattctgctacaacaaactggctcgctggataaccttttccaacatctggaagcccagccggataaatggcgcaataaattggcagcccataaagaaatggcgtatatcagccgtgaagtggcttcactgcgcacggatttatcgctcaatggcaatttgcagcaattgcggttagatcacaggtaa

SEQ ID NO: 4531 - DNA, 1383 bp, Xenorhabdus bovienii
  Coding DNA location: Contig name=SeqID_16897; Position on contig =48290..49672bp; Strand=-
atgttcagatctagtggttttacggggcgtgtcctgtttttatctctgtttctgctgatgtcgttttcaggtacggttcaggcgctttccttaacggaagcttacgcgctggcgctgcaacatgatccgacgtttcaggcggcgataaaagcgcaggaagcggggcaggaagagaaaaaccttgggcgggcggaattactgcccaagctcgcttttaactaccaatatgttccccagaattggcagaaaatggaatcctcttcttcagattcagggcaaaggggaagtacggtcacggaaagtcgcaaccgccagtatcacagctacagtggttcgcttgtgctgactcagccgctggtggatttcgaggcgtgggcgcgttacaaaacccgtcaggcctacgcgctgatgagtgatgcccgttttcgggtagacacccagcaactggcagtcagggtagtaaacagctatgtggatgtcgcttatgcgcaggacaggctggcgcaggttgctcagcagggcagggcttatgaagaacaactggaacggaatcagaaattgtttgcctccggtgaaggcacgcgcactgatgtggcggaaacccaagcccgttacagtcagattgtggcggatgagttaacggtcaaagatgaactggatgcggtgatccgtgacttgcaattgctggttggtacacctttaccaagcgacttaccggtcaatcgcctgtcgcctgtccagaacttcaagactataaagctggcttttgcacattatgccgattgggagcagatggcgttgagtcaaaacccgcagttggcggaggctcgccagaaagtggccgttgcggctcaggacattgagcgcaatcgggcaggttatctgccaaaactggagctgtatgcttcccatactgaaaataaatccagcagcgataacatcatcgatcaaaaataccgcaccgattcaatcggcttgcgggtatcgatgaatctctataatggtggaggaacgtcggcggcagtgcgtcaatcagcagcgaattatggcagagccaaatatgagatggatgctgaagcgggagaaattctgaatgcgctgcgacgcaattataacgcctgcatgaatggcgagaagcggatacgtgcctatgaatcggcagtggaagcggctgaattacaggttaaagcgactcagaaaagcgtggcacttgggcagcgggttaacgtagatatcctgaatgcagagcaacagctctacatggctcgtcgtgatctttctcaggccaagtaccaatatatgaaatcctggattgggttattgagtgaatctgggcaattgaatggggaggatattcaattagcttcggggtattttgagtga

SEQ ID NO: 4532 - DNA, 1338 bp, Xenorhabdus bovienii
  Coding DNA location: Contig name=SeqID_16897; Position on contig =49678..51015bp; Strand=-
atgtcctatcagaccaacgcaaaaagtgcgaaaaatgatgaatcgggattactgccgctggatgcaaatcactacctgcggctgggctggctggtcatcggtattggcctcctggggtttttcgtctgggcggcttttgccccgctcgataaaggtgtcgcttcccccggtattgtggtggtggatggcaaccgtaaaaccgtgcagtcgccagccaatggcatcatcagacaaattctggcatcggaaggggaacaggttaaggccggacaggtactggtgcagcttagtcaggtgcaggttaatgcccaaattgactccctgaaacagcaattgcataccactctggcgacggaagtccgattgctggccgagcagcaagggctggaggtgatttcctttccggctacgttgtcggatcagcaatcggagccacgtattaaggatattctggtattgcagaaacagcttttcctgtcacgtcgtgagatgctgagaagtgatctggctgggatgcagcaggctgaagaggggctgagttttcagctcaaagggttgcgggaagcgctgacgaataaacagcagcagcaggtttcactcaaagagcaagtgaccaatctgcggccgttgaccgaagagggttactttccccgtaaccgttatctggagttgcagcgcagtcaaagtgagttaagtggcagcatggccgagatggcaggacgcattggtcagcttgaaaaacagtgtcaggaaacccggcagcggattatccagcggcaggctgattatcaacgtgaagtccgcagccagctttcggatgtgcaggtgcaggccaatgagctgaaaaacaagctggaaacagctcagtttgatttatcccatacctcaattaccgccccggtgggtggctcagtggtggggctgacagtatttactcaaggcggtgttgtggcttccggggaaaaactgatggaaatcttgcctgcccagagtgcgttagaagtcgaagcgcgcttgatggtacatctgattgataaagtagaaatggggcaggatgtggatttgatgttcaccgcgttcaatcagaaccagacgccgaaagtgacaggcaaagtgacagtgatctccgccgaccggctggtggatggggtgacaagggaaccttattaccagatgcgggttagagtgacgccagagggaatggcacaactggcagggctacatatcaagccgggcatgccggttgaagtcttcgttaaaacagggtcgcgctcactgttgagttatctattcaagccattgatggacagggcgtcaacgtcactgattgaggagtaa

SEQ ID NO: 4533 - DNA, 1626 bp, Xenorhabdus bovienii
  Coding DNA location: Contig name=SeqID_16897; Position on contig =51089..52714bp; Strand=-
atgttggttccctctatttatatgcttcaggtatatgatcgagttctgccctccagtaatgaaatgaccctgctgatgctgaccctgatcacgctcggcatgttcgctattatgggggggctggaatatatccgtagcatggtggtgatccgcatcggtagccagtttgatatgtgcctgaaccagcgtgtttataccgcgtcgtatgagtccaacctgaaaaatggctccaccgatgccgggcagatgctcaatgacttggctactatccgccagttcctgacgggcaatgcgctgtttgctttttttgatgtgccttggttcccggtctatctctgggtcatttttctgtttagcccgtacttgggattgctggcgctggttggggcgatcattttgatcgcgttggcggtattgaaccaatggctgtctcagtcgcctttatcggaagcaagtcatctctccctgcgctctgctaatcttgccagtactaatctgcgtaatgcggaagtcattgaagccttgggtatgttgccggcactgcgtcagcgttggtttagcctgcatgagcgctttctcaatttccagcgtattgccagcgaacgggcggcatctatcaccgcactgaccaaaacagtgcgcatggccttgcagtcgttgatcctcggtttgggaggctggctggcgattgaaggcaatatcacgccgggcatgatgatcgcgggttctatcttgatgggacgggcattgtcgccgattgagcagttgatccaagcgtggaaaagctggagcgctgcgcgtctgtcatggcagcggctggataaattgctgaaggcgcagccagaacgcaaaagcggtatgtcactgcctgcccctaaaggcattttgttgctggaaaaagttgccgcgataccaccgagtaaaacacaggccagacaaacggcgggaaatcataaacaggtcttgcaggatatcagtttttccctgaatgccggcgatgtgttgggcgtgattggccccagcgcgtcggggaaatctacgctggctcgcctgctggtggggatttggccgtcacaggagggtgttgtccggctcgatgatgccgacatttaccaatggaacaaggatgaactgggagcatcgataggttatttgccgcaggacatcgaactgtttggtggcacgattgcggaaaacattgcacgttttaatgacgttgatcctgaaaaagtcattgaagcggccaaaaaagcgggcgtccatgaactggtactcaatcttgaacagggttatgacacggtgattggcgctggggggatgggactgtccggtgggcaaaagcagcggattgggctggcacgggcattgtacggcaatccgtcactgctggtgctggatgaaccgaattccaatctggatgatattggtgaaaaggcgctgagtcaggcgattacgcaattgcgggaacagggcaaaactgtggtggtgatcacgcatcggccttctttgctctcacaaacaaacaaaattttgctgttggtgcagggaaaaatgaaaatgtttggcccatctcagcaagttatggcggcgctgtcgcagtcaaaagcggttgaacgtgcctcgtag

SEQ ID NO: 4534 - DNA, 228 bp, Xenorhabdus bovienii
  Coding DNA location: Contig name=SeqID_16897; Position on contig =52915..53142bp; Strand=+
atgcgtgccactgaatgtcataatgagttcccgcccatcaacaaggtatgccacccattgctcggactcatgaccaaaaaaggccagactattgccatcatcgtcagtcaaagtgataccatcaggtgtaggacgccagccctctacagggttcctcatcagttcggtcaggcaagaatcacctttcagcgcccaaatggacccctcaggcaaacgggtatccgttaa

SEQ ID NO: 4535 - DNA, 1431 bp, Xenorhabdus bovienii
  Coding DNA location: Contig name=SeqID_16897; Position on contig =53401..54831bp; Strand=-
atgacctcaaagaataaatatacctatgtggggttatctgattccaagtccgttcaggatgttaatgcacttctcacagcctacgttccaaattccgatccgggtattcgtgtcgcacatacaccgctgggagataaagctcccgatgaacttgtgcgaaccaattatcattggtcgaataaagtcggctcttccggtgcagtggaattatcatatcattttctagaatctgctccttccgtgatgccaagatttggcattgccggattcagttcctttaatgatgagcagaaagaggcagcaagattgtctttgcaatcgtggtctgatgttgccaatgtaaaatttaatgaagtcagcagtctttctaaagccaatattacttttggtttctttgattatagtataactgacgactatgcgtttgcgactttaccaaaagggcagaatacgacttattcctggtatagcgcggagagtcatactttcatagacaatgacattggcgtgaatggctatggccgccagacatttacccatgaaatcgggcatacgctgggtctggatcatcctgccgagtacgatgcttctgatgcggtcagaccgacctatatcagtgtaggtgaatacttcgaagatagccgtgcctataccgtcatgagctatttcagtgaaaaatacaccggtcaggattacaaaggggcattctcatctgcgccattgctgaatgatatctccgccattcaagacttatatggggccaatactgaaactcgtacaggtgatacggtatatggtttcaactccaataccgaccgtgatttcatgaccgcaaccgatgccaatagcaaactggtattcagtgtctgggatgcggatggtaatgatacgttcgatttttccgattttactcaggatcagcgtattaacctgaatgcaggatctttctcggatgttggcggtttgaaaggcaacgtatctattgcccgtggtgtaaccattgagaatgcgatcggtggcagcggcgatgacattctggtaggcaacagtgctgataacgtgctgaaaggcggcgacggcgatgacatcatttatggtggcttgggcggcgatcacctgtggggtggcgcaggcaaggatacttttgtttatctgaatggcaaagaatcactgaaagacaatcctgactggatccatgattttgtttccggtgaagacaagattgatctatcggactttaactttggtagtaagggtgatatcaaatttgttgattcattctctggtagggcgggtgaagtcctgctgacttacgacaaagtgaccgatataaccgatatgtcgatcagccttggtggtgatttagtcagtaatgattttctggtgaaaattatcggtcagcctgtagctgaagctgattttatcgtctaa

SEQ ID NO: 4536 - DNA, 1098 bp, Xenorhabdus bovienii
  Coding DNA location: Contig name=SeqID_16897; Position on contig =55149..56246bp; Strand=-
atgaataaagttgctttatattgccgccccgggtttgaaaaagagtgtgcggcagaaattactgataaggcgggtaagaaaggagtttacggttttgcccgcgtaaaagaaaacagcggttatgtgttgtttgagtgttatcagcatgatgatgcggatcgtctgatccgtgaaattccgttcggtgaattgatctttgcccgccaaatggtggttgtgggtgaattgctgaaaaatttacctcaggaagatcgtattaccccgatccttgggatgctgactggggttattgagcgtgcaggcgagctgcgcgtagaagtgccggataatgatgaaagtaaagagttgatgacattctgccgtaagtttacggttccgttgcgtaatgcaatgcgtcaggaaaaactcttgctggcaaaggaaagtgctcaccgaccggtgattcatgttttgtttattgctccgggctgttgttacgtcggctactcttacagcaacaacaattcccgtttttatatggggatccctcgtctgaagtttccgtcagatgctccgagtcgttcaacgctgaaactggaagaagcttttcatgtgtttattccccatgacgagtgggaagaacgtctgggcagtgggctgtatgctgtggatcttggtgcttgtccgggaggctggacttaccagctcgtgagacggggcatgatagttcatgcggtagataatggcttgatggctgatagtttgatggacaccggacaggtgaaacatcatcgtgtggatggctttaagtttgaaccctcagtgaaaaatgtttactggctggtttgtgacatggttgagcagccggccaaggttgcacagcttatgacagactggttagtaaaaagctggtgccgtgaagccattttcaacctcaagctgccgatgaaaaagcgttatgaggaagttgctcagatcttgcagaagatagaacagcaattgaaagaaaatggaattaacgtccaaattcaggccaagcacttgtaccacgatcgtgaagaggtcacggtacatgttcgtcgtatttggtctgcatatgcaatgacccgagatttttaa

SEQ ID NO: 4537 - DNA, 444 bp, Xenorhabdus bovienii
  Coding DNA location: Contig name=SeqID_16897; Position on contig =56239..56682bp; Strand=-
atgtgtgaaggagtgtcatttcatacatccagaaacaggagcggagcgatgagcagtcgtgtcatgcttatttttgtgggtatcagcggttttttctatgtggcattgggtgcgatgggtgcacatatgctggtacctgtcctgacgtcacgccaaatggaatggatccataccggcctgcaatatcaggggctgcatacactggtcatgatggtgctggctgttttgctgatgcggcagccaatgaagccgtttggctgggcgggtatttttttcgctgcgggaatggtgttgtttagtggcagtctttattgtctggcctttttaccgctaaaatttttggtttatctgacaccaatcggtgggttcagttttctcattggttggttatgtatattaattggcgctctgcgtctaaggaaattggcgcctagccatgaataa

SEQ ID NO: 4538 - DNA, 921 bp, Xenorhabdus bovienii
  Coding DNA location: Contig name=SeqID_16897; Position on contig =56690..57610bp; Strand=-
atgtctaaacgtttaccaccacttaatgcgttacgcgtttttgatgctgctgctcgtcatcttagttttactaaagcagcagaagaattatttgtaactcaggcggccgtaagtcaccagatgaaaagtctggaagactttctgggattgaaactttttcgtcgccgtaaccgctcgctactgctgacggaggacgggcagagttactatctggatatcaaagaaattttcactgctatcaatgatgcaacccgcaaacttcaggctcgcagtgccaaaggtgcactgacggtaagtttgtcaccgagctttgccattcagtggctggtgccacggctttctggtttcaaccagagtttcccgggcattgatgtcaggattcaggcggtggatagggaagaagataaattggcagatgatgttgatgttgcgattttttatggcagaggcaattggccaggcatgcgaacagatcgtctctatcctgaatatctgctacccgtctgttctccctctttactgatgggtgaacgtccattaaaaacgccggcagatctggccaagcatactctgttgcacgattcttcccgacgggactggcaggcctatattcgccagcttgatatgcaacagctcatcaatgttcagcaggggccgatattcagccatagctccatggtgattcaggcggcggtacatgggcagggggtcgctcttgccaataatgtgatggcacaaaatgagattgatgcagggcgccttgtctgcccattcaatgatgttttggtcagcaagaatgcattttatttggtttgccatgataatcaggcagaattgggcaagattgcggcttttcggaaatggatcttgatgcaggccgcgagtgaacaggcaaggttagggtttattactaacgaatga

SEQ ID NO: 4539 - DNA, 183 bp, Xenorhabdus bovienii
  Coding DNA location: Contig name=SeqID_16897; Position on contig =57663..57845bp; Strand=-
atgctacaaagtctggtagaccagacaacttgcaaacacaacatcacaaccacaaagccaaaagcttcaatgtatcactacagagttacttttcgttccggcttaggaagttgcgcacactatagggatttgctggtatatcatcaatggacaaattataatgattcggattacaaaaactaa

SEQ ID NO: 4540 - DNA, 1104 bp, Xenorhabdus bovienii
  Coding DNA location: Contig name=SeqID_16897; Position on contig =58119..59222bp; Strand=+
atgattgaggcaacccagcactattatcaaaaccacagtgcaacggttcatcgtagccaacacgcaagcgcacaggccatgacggcccgttatgaacaagctcgttcgctggtggcggaattgctcaacgccccacggcctgaaaatatcatctggacaaaaggcaccagcgaagccattaatctgaccgcccaaggctattttcgccctcgcctgaatgtggatgatgaaattatagtcagtgaacaggaacaccactccaatctgttgccgtggctgattctggcggaacaaacaggcgcaaaaatcgttaagtggccgataggcaatcagaatcgtccggacatcaatattctcgcaaaactgctaaatgaaaaaagccggctggtcgccatcagccaaatgtcgaatgtcactggtaccacagtcgatctggcgcaggtcacggcactcgcccaccagtatgattgcctgattttggtcgatggcgctcaaggcatcgttcacactcccgttgatgtacagcggctggatatcgatttttatgccttctctgcccataaactgtatggccccaatggtctgggagtattgtatggcaaaggggaattgctggatgcaatgtcaccgtggcagggcggtgggaaaatgctgactcaggtatctttcaacggtttcacaccagaagccgttccttatcgctttgaagcgggaaccccgaatgtcgcgggcgtggttagctttgccgctacgttggaatggttaaaaaccgttgatatcccgctcgctgaatcccatgccgttaccctgactgactatgccgagcagcagctcagtatctttgctggatttatcagctaccgcgccgccaatgccagtttgctggccttcaatatccaagggatacatcacaatgatttggcaacgttgattgctgaacagaatatttccctgcgttcaggccaacactgcgcacagcccctgttggatgctctggggatcagcggctgcctacgtgcttcttttatgccttataataatcggcaggatgtggataagctggtcagtgctgtgaaatttgccctatcgctactggaagaataa

SEQ ID NO: 4541 - DNA, 459 bp, Xenorhabdus bovienii
  Coding DNA location: Contig name=SeqID_16897; Position on contig =59272..59730bp; Strand=+
atgacatcaatttcagattcaatccttgccccgcatccgtttggaacggagatatcggagcaacaacttattgaaaattttcagcaatgccagttatgggaagatcgctatcggcagcttatcggactggccaaaaaactgccaccactagcggatgaactgaaacagcagaacattgaaatgtccggctgtgaaaaccgtgtctggctagggcaccagttgcgttctgacggctgtttgcatttttatggagatagcgaaggccgcatcgtcaaaggcttattagccgtactcctgactgctgtggaaggaaaaacagcagagcaggttttacaggcgcctttatctgagttatttcagcacatgggtcttgagcaacaactgagcggttcgcgactcaatgggatcaaatccctgatcaacaccgttcaagagattgcccgctcacatttgtcttaa

SEQ ID NO: 4542 - DNA, 813 bp, Xenorhabdus bovienii
  Coding DNA location: Contig name=SeqID_16897; Position on contig =59752..60564bp; Strand=-
atgcaagtttctctctctgatgcttatcttcagcgttttgctggtaccgcgcggttatatggccagaaagcactttcattatttgcccgttcacatgtctgtgtcgttggtattggcggtgttggctcatgggcggcggaagcattggcgcgcacaggcattggggcaatcacgctgattgatatggatgatgtctgtatcaccaatactaaccgccagttgcatacgctggtacagaatgtagggttgccaaaaaccgaggtgattgctgaacggatacgggcaatcaatccggagtgccaagttacctgcgttgatgattttgtgacgcccgataatgtggctgagctgatgtctgctgaattcagttatgtgattgatgccattgacagtgtgcgtccaaaagcggcattgctggcttattgtcgccgctataaaattccgcttgttacgactggcggggctggggggcagcttgatcctgctcagatccaggtggtggatctggcgaaaacggtgcaagatccgctggcggctaaattgaaggaacgcctgaaatctgactatcgcgtggtgaaaaacagcaagggtaaattggggattgattgtgtattctcaacggaacagttggtttacccgcaatctgacggtacggtctgcgctgccaaaagcacggcggatggttcgaaacggatggattgtgcgtccggttttggtgccgcaacgatggtcacggcaacatttgggtttattgccgtgtctcacgcactgaaaaagatggtggcaaaagccgagcgggaaaacaggctttaa

SEQ ID NO: 4543 - DNA, 1098 bp, Xenorhabdus bovienii
  Coding DNA location: Contig name=SeqID_16897; Position on contig =60676..61773bp; Strand=-
atgaaactttggggcaaatatcttttatgcgggtttgtcatttcgttattatcgggttgccaggtgcgtcctacagatcaagggcagcagtataaagatggccgcatcagcgaagatctccagcttgttaatattccaaatgcacaaggctcccctatcaacgccggagattttcaggcacaagtcaaatttatcagcaaatcttctcctcggctctatggtaataatcgtgcaacgcttgatgccatccagaattggatgctgtctggtggagatccgcgtgaattaaaccagtttgggttgctggcctatcagatggacggtgatgataattacggtaatgttaagtttactggttattacacgccagttttgcaggcacgccatgttaagcagggcgagtttaaatatcccctgtaccgaatgccaggtaagtcgcgttttcgcctgccaaaccgtgcagctatatacaatggggctttgagtgaaaaatttatcatagggtacactaattccctgattgataattttttgatggaagtgcaggggagtggttatatcgattttggtgatggcaatccattgaccttcttcggttatagcgggaagaatggccatgcttatcagagtatcggcaagatacttgttaaccgaggagaagtgcctcttgaaaaaatgtcactgaaagccattcgccagtgggcatctcaacataatgaatcagaggtacgagagctgctggaacagaatccctcttttattttctttaagcccgaaccctttacacctgtgcggggagccagtgctgtgcctcttgtcgcggaagcatccgtagcatcggataaggtattgattccactcggaacggcgttattggcggaagtgccggtgttggataaaacaggaaaatttaccggacagtatcggatgcgtttgatggtggcattggatgttggaggcgcaataaaaggcaatcatttcgatatctatcatggtgtgggtcatgatgctggagaagcagccggtttttataatcactatggccgtgtctgggtattgaagaaatcgtcgcctggctttttgacggcaaaccagtaa

SEQ ID NO: 4544 - DNA, 99 bp, Xenorhabdus bovienii
  Coding DNA location: Contig name=SeqID_16897; Position on contig =61733..61831bp; Strand=+
atgacaaacccgcataaaagatatttgccccaaagtttcatattatgccttatctcctgtcatcacgattcgacgacgaacaatatcaaaccccggtaa

SEQ ID NO: 4545 - DNA, 1248 bp, Xenorhabdus bovienii
  Coding DNA location: Contig name=SeqID_16897; Position on contig =62489..63736bp; Strand=-
atgagtcattcagactataattcttcacgtcgcaatttgttgaaaggcgcagcagccatgtggttgttgagcattagctcaataggacacgcagcaacgtcaaaaattattgctgttcgtatctggcctgcatcaagttataccagagtgacactggaggctaatattccacttaaatatcgtcaattttctctttcaaaccctaaccggattgtcatcgacttgcagggtgttcagcttaatagtgtcctgagcggtatggggtcgcagattcatcagcgagatccctatttaaaattggtacgagccgggcaatttgatcccaaaaccgtgcgcctggtgtttgaaattaagcagccagttgccccgcatatttttacactaccacccattgcgaaattcaaacatcgtctggtgttagatctttatccgagtaaggcggcaaatgtggaggatgatcccttgcaagcgctgttggaagaatacaacagcggggatttgaagaagaatctacctgctgaaaagagaaaaccggggcggccgggcaggaacagaccgattgttattatgcttgatccggggcatggcggtgaagattcaggtgccatcgggaaatacaagacccgtgagaaagatgtggtgttacagattgcccgtcgcctgcaaacacttatcaaacgtgaacccggcatgaaagtatacatgacgcgtaatgaggatgttttcattccattgcaggtcagggtcgcgaaagcacgcaagatgcaggcggatttatttgtctccattcatgcggatgcctttaccaatcgaaccgcccgaggatcttccgtgttcgcgttatcaactaagggagcaaccagcaataccgctcgttttctggcacagacccagaatgaggctgacttgattgggggagttagcaaaagtggtgatgaatatctggatcatactatgttggatctggttcaaaccgcgacgattaatgatagcctcaagtttggcagtgaagtgctcaaacggattggcaaggtcaataaactgcataaaaatagtatcgatcaggcgggatttgcagtattgaaagcaccggatattccgtccattctggttgaaacggcatttatcagtaatctggaagaagaacgcaaattgaaaacggcgaaattccagcagcaagtagcggaatccatttttgcaggtattaaggcttattttaaaagtggtgtagagctggcacggcggtga

SEQ ID NO: 4546 - DNA, 1335 bp, Xenorhabdus bovienii
  Coding DNA location: Contig name=SeqID_16897; Position on contig =63973..65307bp; Strand=+
atgaaagaacgctgtaccgaattggttgaagttttccggcattcagttccgtatataaatgcacatcgaggcaaaacctttgtcattatgttgggtggtgaggctatcgcccacgagaattttccaaatatcgttaatgacatcggcctactgcataatctgggcatccgtttgatcgtcgtgtatggcgctcgtccccaaatcgaccagaagcttgccgaataccatagccagccgatttatcacaagcacaccagagttacggatgccaagacactggaactggtcaaacagtccgcaggcctgctacagcttgatattacggcccgtctttccatgagcctcagcaatacacccttgcaaggtgccaatattaacgttgtcagcggtaactttattatcgcccagccactaggtgtcgatgatggcattgattactgtcatagtggcagggttcgccgtattgacgaggaggccattaaccagcagctggataactattccattgtattaattgggcccgttgccgtttccgtcacaggtgaaagtttcaacctgacttccgaagaaatagcctcacaattagcgattaaattaaaagccgaaaaattgatcgggttctgctcatcacagggcgtacttgatgcagaggggaatatcctgtcggaaattgttcccaatgaggggcaagcacgactgaatgagctggaaagtgagggggattattcttcaggtaccgtccgcttcttgagaggagccatcaaagcctgccgtcgtggggttcgtcgcagccatttgatcagctatcgggaaaatggctcgctggttcaggaattattctcccgtgaaggcagtggaacccagatagtcatggagcgctccgaacagatccgtcgagccaatatcaatgatattggtggcattcttgagcttattcgtccattggaacagacaggcatcttggctcgccgctcacgggaacaactggaaatggaaattgataagttcactctgatagagcacgataatgtaacgatcgcctgcgctgcgctctattcttaccctgacgaaaaaattggtgaaatggcctgtgttgcggttcatccaaactaccgaaactcttcccgtggcgaagtgttgctgaattccatcgccggtcaggccagacaggcagggctggagaaactattcgtactcacgacccgcagtatccactggtttcgggaaaaaggctttgaacctgctgaaatcaatatgcttcctgtggaaaaacaagcgctgtataactaccagcgctgttcgaaaatcttgatgttaaatttagagattcactga

SEQ ID NO: 4547 - DNA, 1908 bp, Xenorhabdus bovienii
  Coding DNA location: Contig name=SeqID_16897; Position on contig =65301..67208bp; Strand=-
atgagtgacatgaaattattgttgcagcaagccgttgcccaaaaattactgcgtccgctggatgtgcagtttgcctatgcgatgattgaaaacggagatcctctgttattgctggttatggcattggtgagtgcggaatcgggagcagggcatgtctgcctgccattagagcggatctcgcctgaatatttatttgaggggcggcagcctgaattggcagcatcgctctggtcttcggcggggaaaccaaatcagcagcaagttatttcagctttacaagcatgttccgcagtgagcactggcgaatctcccacaccgatcattctttcccgccacgcacttgctgattatcgcctttacatgcaacgcatgtggcaaagtgagcgtcggatcgcggagtttttttcgtcggtagaattttctgacgatattgatgaagtgcagttacgtcgcattttggatgaactttttggtgtgaccgccgaaggggaaatagactggcagaaagtggcggcagcagttgctgtaaccagccgtatttccgtgatctctggcgggccagggacaggaaaaacgacgacggtagctaagttgctggccgccttgatcaaactgaatgaaggcaaaacactgagcattcaattggcggcgcccactggcaaagcggccgccagattgactgaatcgctgagtgaggcagtagataaactggctttaacatcacaacaatcgaatagcattcctgagcaggcgcaaacgattcatcgcctgttgggagcgcagccagatagtcaaaaactgcgttatcaccgcgataatccgctatctcttgatattttgatcatcgatgaagcctcgatggtggacttaccgatgatggcacgtttgatagaagccctgccgccacgggcaaaagtgattttcctgggggataaagatcagttggcctcggttgaagcgggagccgtattgggggatatttgccgcttttctgaacaaggttatagcaccaagcgtgctgaacaattgagtcagttgacaggctgtcagttaacatcgtattcaatgcctgattctggagaacatgcactggcagtccgtgattgtttatgtctgttgcgtaaaagctatcgtttcaactcggcttcgggtatcgggcaattggcatcggcggttaatcaggggaatagtgtcggggtatctgccgtattaagtcggtctttgcctgatgttcacttcaatcctctttcaggagatgaagattatcagcgtttactgacgcaaactgcagaaggttactaccgttatttagcgatggtgaacgaacaggcggctgacaaagatattttggcagaatttaaccgtttcaggttgttgtgtgctttgagggaagggccgtttggtgtcagcggcttgaaccagcgggtagagcaattgttacaccgtaaaggcgtcatttctctacccagaaatgcagagagccgtggctatgctggacgacccattatgatcttgcgtaacgacagtacactggggctatttaatggtgacatcggtattatgctcaggaataaggataatgagctgaaagcccatttccagctatctgatgggacgataaagccatttcagccgagccgattgcctcagcatgaaacggcctatgtgatgactgtccataaatcccaaggttctgagtttgaacacaccgcgttagtcttgccgactcagttctcgccagttgtcagccgggaactggtgtacacagccttaacccgtgcccgtgaaaaattgacgctttacgcacataaacccgtcttggataaggcggtgggtacatcaacacagcggcgtagtggcttggcagaatggctcaagccacagggaaagtgccagtcaggtcagtga

SEQ ID NO: 4548 - DNA, 3618 bp, Xenorhabdus bovienii
  Coding DNA location: Contig name=SeqID_16897; Position on contig =67205..70822bp; Strand=-
gtgagcacagaaatactaaaccataaacttaacccattaacactgccgctgcatggtcagcggctgattgaggcttcagcggggacgggaaagacctacacgataggtttgctctatcttcgtctgttactcggattaggcggcgatgccgcctttttccacccgctaaatgtcgaagaaatccttgttgtaacctttactgaagctgcaacggatgaattgcgtggacgtatccgtgaaaatatccatcagcttcgtttggcgtgtattcgcgaaggaacggagggaagtgatcctgtttatcagcaattgctggatcaaattcctgacagagcaagtgctgccagttggcttctggctgctgaacgtcaaatggacgaagcggcaatttatactattcatggtttttgccagcgaatgctggtgcacaatgcctttgaatccggtgttctgtttgaccaaacgttgattcaggatgaatacccgctgcgcaaacaaggctgtgccgatttttggcggcgtcactgctatccgctctcgttgtcaatggcgacggtgatcaatcaagagtggagtgggccagaggcactgcttaaggatgtttcctctcatctacaaggggatatgccttatatcgtcaatgcgcctgccagtgatgaaactctgattggccgtcatgaaaagatcattggtctgattgatacagtcaagcatcagtggaatgatgtagcatcggatttacacgatcttattgccaattctgatgttgataaacgtagttacagtaaaaagcacttacccaactggctgaacagtgtttctgaatgggctaaatcgcagactagtgattatcagcttcccaaagatttagataaattttgtcagtcacgattggcggaaaaaaccaaaaagggcgaagctcctcagcatcctgtgtttactgtcatcgacgatttatatcagcaaccgctaacactgcgggacatcattatctccaaggcaattgttgaaatacgtcagtccgtcaatcaggaaaaattgatgcgcggacacatgggatttgatgacttactgacgcggctggacagcgccttgcaacgggagggaggagaacagcttgcgacgactatccgacagcgttatcccgttgccatgatcgatgaatttcaggacaccgacccgcagcaataccgtatttttcaagccatatatcgcgatcagccgcaaaatgagcagcgggagaatggtttgctgtttatcggtgatcccaagcaagcgatttatgcgttccgtggtgcggatatttttacctatattcgggcgcgttcccaagtcagtgcccattacacgctggaaaccaactggcgctcttctgtgccaatggtgcaagctgtcaataagctgttttcccacacagagcggcccttcctgttcagccaaatcccgtttattaatgtgaaagccgcggaaaaaaaccataatctgagattcttgttccacaatcaggaagaggctgctttgcagttttggttacagcccggagagggaatttccaaagggcaatatgaacaaagcatggcgcggcactgtgctgctcaaatccgggattggttgctggctgggcaactgggacaggcatttttgcagcaggcagaaaaaagccaacccgtcacggcggcagatattaccgtgctggtgcgtaaccgtcgtgaagcggcactgatccgcgatgaattaaatgcgctcaagataccgtcggtatttctttccaaccgtgacagtgtatttgatacgccagaagcgaaggatttgctttggctattacaagcggtgctatcaccggagaaggagcgtgaactccggagcgcattggccagtagcttgtttggcctgagtgcgcagcaaattgatcagctaaatcacgatgaaaccgcatgggatcagctggtggatgaattttccggttatgcccggttatggcgcttccgtggggtgttgccgatgctacgggcggtcatggtgaaataccagattgcagaaaatctactggccggatatgacggtgagcgccggctgactgatgttatgcacattggcgagttgttgcaggaaacatcactgcaattggatagcgaacatgcagtggttcgctggctggcgcaacagatttcccgtcctgatccccaatcagaaacccagcagatgcggctggaaagtgataagcatctggtgcagatatgtaccatccataaatcgaaaggattggaatacccactggtttggctgccgttcatatgtagtttcaggaaacaggaacaggcgatttaccatgatcgtcagagttttgagactcacttcagtatctttcaggatgatgaaaagaaggcactggcagatgaagagcgattggcagaagatttgcgtctgctctatgttgccttaacacggtcgatttatcactgtagtgtcggggttgcgccacttattcaaggtaataagaaaaaagcaggcaatacggatttacacttatctgcccttggttatctgttgcagaaagggcagcaaggtgatgcgcaattgctggcagatagtttagatgaactcagtaatggcgatattcaggtcacgctgatggaggaaactgatgatgcgcagtggtgttcgcaaaatgacaatgactcattgctggcggccagaaaattccggcgctccattcaggatgattggcgggtaaccagttattctggcttgcagtattcctcttcgcactctatttcccatgcgtatgccagcgcgtttggagaatcggtggatgttattgtgcagtcgattgccccgaaactggatattgatgcgcgtggtgaaaagcaggaggaaccgtcatcgcagatgacaccacatacttttcctcgcggggcatctgctggcaccttcttgcatagcatcttggaagatcttgatttcagcgagctacctgagcagatgtggctggcagaaaaattaacggcagccgggtttgatgagaactgggcgccagtattgcagcagtggatagcggatttcgtgaccgcagagttgaatgagcagggaatgcaacttgcccatgttcctcgtcatcagcaacaaagtgaaatgcagttttatttacctgtcgataagctgctgcattcacatgcattgagtgcattgacccgccgttatgatccgctgtctgcacaatgtacacctttatcctttcatcaggtcaggggcatgttgaaagggtttattgatttagttttttgctggcagggtaagttttatgtggtggattacaagtcaaactggctgggggagagcagtcagtcatatactcaggaagccatgaccagagccatgatagaacatcggtacgatttgcagtatcaactttatacgttggcgttacatcgttatttgcgtcaccgattggcgaattatgattatcagcagcattttgggggagctatctacctgtttctgcgtgggattgataaggctaatccaggacatggtgtttatcgttatttgccccccattgaatttgttgacgaactagataggcttttcagcgctgctggcgaggagcaaggtgtatga

SEQ ID NO: 4549 - DNA, 2886 bp, Xenorhabdus bovienii
  Coding DNA location: Contig name=SeqID_16897; Position on contig =70819..73704bp; Strand=-
atgcctaaatatgttattcgcatcatgacgatgctttttctgctcttttggggaaccacagcatatgcaaagttgccttggcagcctttgcctgaaactattaataaaagtgaacgagatcttcgtcaatataaagccatccaattacccaatggcatgacggttttactggtttctgatgagaaggccattaaatcattggctgccatttcagttccggttggtcatatggaaaatcctgataaccagcttggtctggctcactatttggagcatatggtgctcatgggctccaagcgataccctcaatctgggggtttcaccgagtttttgcagaagcacagtggaagtcacaatgccagcacttcaagcaatcgtaccgcattttatctggaagttgagaatggctcactgacagaagcgacagatcgccttagcgatgcccttgctgaaccgcttcttgatccggttaacgccgatcgtgagcgtcatgctattgataacgaaatgaccattgcccgtgctggtgagggtcatcgtatatggcaggtccgctctgaaacgctcaatcccgcgcatcccaatgcccgttttggtggtggaaaccttgaaacgctgaaagataagcccgatagtaaattacagactgcactcactgatttttaccagcgctattactctgccaatctgatgaaaggggtgctgtatggtcatcaaccgatcgacaaactggctcatattgcggtagaaacctttggccgtattccgaaccggcatgcttcagtacccgctattacggttccggcgataacggataaagaaaaaggcatcattatccattatgtgccttcgaagccctacaaatcgttacaactggaattcagcattgctgacaacagtgcggattttcgcagcaaaacagatacatatctggggtatctgattggtaatcgtagtgcgaacacgctgtctgactggttgcagaaacaaggattggttgaaggtatcagtgccagcgccagcccgacaacggatggtaactcaggaacgtttggtattgatgtttcattaacggacaaagggtttgagcagcgtgatcgggttattgcggccatcttctcttacattaatctgttaaagcaaaagggcattgaaaagagctattttgatgaaatggctaaagtactcaatttatcattcgagtatgcgtcaatcgtgcgggatatgggctacattcagtggttgtctgatgttatgcaggatgtccctgtttcccatgtactggacgtcggctatcttgcggacgaatacaacccacaagctatctccagccgtctggctgaactgacacctgaaaatgcgcgtatttggtttaccggcccggaagagccacataacaaggaagcttactttgttcatgcgccataccaggtcaataaaatcaccccgcagcagcggacggaatggcggaaactcgaaaaagaggtttcgctctctttgccagaactgaacccgtatattcctgatgatttatctttgattaaggcatcaggcagtcaaaaacacccgaaaatgatttttgaacagccaaatgttcgtttgctctatatgcagagccaatattttatggatgaacccaagtccatcatcacattgaatatgcgtaatgcggatggaatgagtaatgccaaagatcaggttacttattcgttattgtcctatttgagtgatatgggattggatcagcttggctatcaggcatctgtaggtggcatgggattaacattagggtattcagaaggcctgcaaattggagtgagtggttatactcagcacttgcctgaactattaacttcggccatcagccagtacattacgttcacacccactcaggaagagctgaatcaggcaaaatcgcggtatcgtgaccaagtgaaagccgtcaataatggcaaggcttatgaaatggcgacacaccccgtctcccgtctttctcgtgtgccttattttgagcaggctgaccgtttgaaagttttggataccatcacgattgacgatattgttaaataccgtcagagaatgattcagcattcggctttacaggcgggaattttcggtaatttaacggaaaaacagagtatcgatatcgttaagtcggcacacaagcaactcgcaaatcagggtactacgtggtggagtggcgaccatatcgtggttgatcgtgattatgcggtgaattttaaaggaactgccagcagtaccgataatgcactgtctgaagtctatattccaacgggatatgaccgaatcaatggttatatctattccaatctgttggggcgtattttgtcaccttggttctttgaacaactcagaacatcggaacaactgggctatgttgcttcagctttcaacactagcgtgggtgaacaatcgggattgggcttcctgttgcagagtaacagcaagcaacccgattacctgcatcaacgttaccagagcttttatcaacaggccgcaaaaaaattacaggcaatgtctgatgctgattttaaacagtataaaaaagcgttattgacagaaatgcggcagccaccagaaactttttatgcagaagcatcccgttataattatgattttgggagtaataacttcaaatttgatacacacgaaaaaaccattgccgctacggagaaagtgactaaggcacaactgattgctttttatgataaagcggttatgaagcgtcaaggattggcactgatttcccaaattactgggaaaaaagggacagctcatcaatatgctgagctgacaggctggaaaacttactctaacgtgtcagatttccagaaacagttgccggttaaggtgaatgctcagtga

SEQ ID NO: 4550 - DNA, 3396 bp, Xenorhabdus bovienii
  Coding DNA location: Contig name=SeqID_16897; Position on contig =73724..77119bp; Strand=-
atgtttagagtttatcattcaaatcaactcgatattcttaaggagttgatggcaatatttatcggggaaaatccccttgccgacccatttggcaaagaagtggttctagtgcaaagccccggcatgtcacagtggctgcaaatccaacttgcagaaaaactggggattgccgcgaacatggaatttccactgccggctacttttatctggcagatgtttacgcaggtattgcctgatgttcctaaagatggctcattcagtaaggatgccatgaaatggaagctgatgacgctgttacccggcttgttaacagaacctgagttttcatctctcaggcactatctcgaccaagatatcgataaacgtaagatccaccagttggcaggccgagttgccgatttgtttgaccaatatctggtttatcgccctcaatggctggaaagctgggaaagcgatcagtcaattgatgggttaagtgataaccaagcgtggcaaaaaagattatggcttgaactgacagaatatacccgtcagctagaacaaccgctgtggcaccgcgctaacttatatcatcgattcatttcaactttgcaagaaggccgttttccactggaaaagctgcctgcacgggtatttatctgtggggtatctacgttacctcctgcttatctgcaaatatttaaggcattggggcaacatatcgatattcatctgatgttcactaatccatgtctgtactattggggggatatccagagttatgcctttctggccaagttaaatagccgtaaaccaaaacattatcaaagccagcagtcactggagcgatttagagatccagaaaatgcgtcatctctcttcaatgatgagggagagcagagcctgaacaatcccttgttggcgtcatgggggaaattaggcagggataacctctacctgctatcgcagttggaacccgactctgatgttcatgcttttgttgaactggagccgggttgtatcctgcatcaaatccagcgggatatgctgaatcttgaagatcacgctcaaattggttccacggaacactctttcaaaaatagcctaaaaaaacgtcagattgacggtgaagaccgctcgctatcttttcattcatgtcatagcccacagagagaggtggaagttttgcaggatcagatcctgcgtcttctggatgatgatccctcactgacaccacgagacattatcgtgatgatggcggatatcgacagttatgctccctatattcaggcggttttcggcaatgcaccggaggagcgctatatcccctttgcgatttctgatcgtaaagcccgtcaggctcatcccgttttgcaggctttcattaccttactggagctgccgcagagtcgttttacggcagagcaggtactggcattactggaagtgcccgcattggccagcaaatttgccattcaggaagatggattacgtctgttacggcgctgggtgaaagaatcagggatttgctgggggttggatgacgacaacatagaagcactgtcgttgcctgctactgggcagaacacgtggcgttttggtttgacacgtatgttattggggtatgctatggacagtcatgcaggcccatggaatgacgttttgccttatgatgaatccagtggtcttgccgcagaactggctgggcaactggcggaatttttaatggagctgaaccgctggcgtaaaattctgagtgaagagcaggggttgtcggattggctggcagtatgtccgcaactgttggaaactttttttgatgcggatgaggaaacagagctggtattggcattgatcactcagcagtggcagaaagtcattgataatggtctgaatgctcattacagcgagagtgcccctttggtgctgttgcgtgatgaattggcgctgcgttttgatgatgagaaaatcagtcagcgttttctcgccggttcgttgaatttctgtactcttatgcccatgcgttccattccttttaaagttgtttgcctgctgggaatgaatgatggcgtttatccacgaactattccgccacttgggttcgatctgatggcagaaaaaagccagcggggagataggaagcggcgcgatgatgaccgttatctttttctggaagccctgatttcggcagaaacgtgtctttatattagttacatcggtaaatcgattcgtgatgatacagagtgtaatccttccgtattggtcaacgagttactggattatgtctgccagagctgttgcttgccgggagatgagatgctgaatgttgatgacagtgcaaggaacgttagaaatcacctgctgttacaacatactcgtgttccttttgcgatggaaaacttcgtgcctgatcattatcagcaaagttatgccgcagaatggttgccggcggccagtcagcaaggcgtttcacccgtcgatttttgccagccgattgggtttgagagcagtgagataaaggaagtgacactcgatgagctgagccgtttttaccgttaccccgtcagggcatttttccagcgtcggctgaaggtgcattttgtcattgaagagacggaactgcctgaagaagaaccttttgtactcgatcacctgcaacgttatcaatttaaccaattgttgttgaatatcttgatagaagaaggatcacctgaatctctgttttatcatctccgtgcatcgggggggttaccacatggggcgtttggtgaggtttactggctgaatcaattagaagctatgcagccattggcaaataagattcgggaagagagaacggagtcttctttcatcgatttacaccatgagctagataccgtggtattgactggaaaaattcatcaggtgcagcccgatggaattttacgttggcgtccagcgaacttaatggccaatgatggtatccaactatggattgaacatcttgcttattgtttttcaggaaacaacggtgatagtgagagccgcatgtatggaagggaaaacagcgagtggcgtttttcaccattgacatcggatgaggcgaaaaaatatctgaatcagatggttgccggttattttcagggcatgtctgaacctctccctttgttttgccgaagcggttgggcatggctggatgattgctttgacagagaaagtcaggaaatcaatttcagtgcggaagctcaacaaaaagctgaaaacaaactgatgcagcaatggctgggaacacagggaaaaagtggcgaaagcagtgatgcctacgttcagcgcgcatttaggcaagttgatcaattattttgggtgcgtatgaaacgcgaagtacagagttatttgttgcctatggcttgtcatttaagtcgctcttcatctaaataa

SEQ ID NO: 4551 - DNA, 378 bp, Xenorhabdus bovienii
  Coding DNA location: Contig name=SeqID_16897; Position on contig =77112..77489bp; Strand=-
atgaaacgattccatctccatcgacacgagcggcaaaatggcatgagtttgccggaagttatgttggcatctgtcgtgtttgcgatctctttgttgggcttaatgcgttaccatcaggcactgtcatcaaattttcagcagtactggttgcagcttaaggcggtgagattggcgcatgaccagttggaacaatatgagcggttgaaagggcagatggtgttggaggaaactgaatcacagcaagggtggaaaatcgaacttcaacgggaatttcgttctttgggatgctatcaaataaccgttaatgtgacaaaaagttataatcaatctaataaattagaacgctggttttgtgcaagtgggagtattgatgtttag

SEQ ID NO: 4552 - DNA, 399 bp, Xenorhabdus bovienii
  Coding DNA location: Contig name=SeqID_16897; Position on contig =77486..77884bp; Strand=-
atgttaatggcactgagcttaatgatgttgaaagcactccattatcaacaagagagtgccatgctcatgatgatggatgagaaaaagtacctgaacgcttttcagcgggcagagtcatcgctggaatggggaaaggtgcagtcatggcaattcaatgcacaggaagaggaaaactggttttgccagcaacagccggaatttcatttgcaaagctgccttaaacactatgcggataatctttttctattaaagggggtggctcagttcgcgtcaggggaaactcttgaactttatcaatggatgaaacagatgaaaaacgcaaatagagatacacttattcctattgaaagtggttggctggatttctgccctgttccgcaggctgaattttgtttatga

SEQ ID NO: 4553 - DNA, 612 bp, Xenorhabdus bovienii
  Coding DNA location: Contig name=SeqID_16897; Position on contig =77931..78542bp; Strand=-
atgacattggctatacccctttttaagggaaaacagaccggattctctttacttgaagtcatggttgccatgttgatcagtagtgtgatttttatcgctatgacaaaaacttatccggttttatcaggtcagatcctcgatctataccggaaatatcgcctccattatctggtgaatagaactgtctatatgatggaaaaagatctcaggcgtgcgggttattgtcgggacagaaaacaatgtgaaggtgaaccattgctgattaacaataaaaatacagaagctgctaattcctgttttattgttgcttttgaccttaatttaaataaccaatgggagaagcctgattatattgaatcagagttttttggttatcgattaaataatcatgtcctcgaatggaaaagaggcgtggagaattgtcagggaaatggctgggaaagattgtttgatccaatggaggttagggttgatgtttttcaccttgaaaaatcacaggaaaaaaatgggcttatttttattacgttgtccattaatacccgctggcttaaatctccatccattatatatcgtcaccaaatgacagttcgcctgcgtaatataaggaaataa

SEQ ID NO: 4554 - DNA, 516 bp, Xenorhabdus bovienii
  Coding DNA location: Contig name=SeqID_16897; Position on contig =78539..79054bp; Strand=-
atggcaacaaaaaatggaggaagtattaatggacagtctggatttacattactggaattactgatagctatgtccttaatttcaatgagtctatcctgggggttatatcattgggggcaatatcaaaaccgcctgcgtttacagtcagcggtacagaatgtgttgtcttttatggaaaggcaacaagggttggcaaattatatgaatcaggagcgtacattgtggctggtgataggacaaacgtggtgtctgatttcttcggtatccaggatatctgattgccatgagggggagggagagcgagttaactcaccttatgacgatgtatttttggcatcagcaaccagtgatcgcattgatttttatggtgttagaaacaccgctatgccagccagttttgtgctggcaaattcagcaggagagattagcgtggtgatttcaggacgtggaagaatcagaacatgcagcaatgatattagccaacttcctaattgtgagggaataaaaggttcatga

SEQ ID NO: 4555 - DNA, 198 bp, Xenorhabdus bovienii
  Coding DNA location: Contig name=SeqID_16897; Position on contig =79209..79406bp; Strand=+
atggcaagtcgctattttttaatattgagaacaaccgccgataaatgtaaaaagagcaggctgaacccgctctttaacaatttggtagatactcttcatcttttattgggtataggtttaaatcgcgactggggctttaatacccggatgcggatcataatccacaatctcaaagtcttcgaaccgataatcaaataa

SEQ ID NO: 4556 - DNA, 795 bp, Xenorhabdus bovienii
  Coding DNA location: Contig name=SeqID_16897; Position on contig =79326..80120bp; Strand=-
atgaaacagtatctggatttaatgaaaaaagtgctagcagaaggcacggcaaaagatgaccgtacaggtacgggaacactctcgatatttggtcatcagatgcgtttcaatttgcaagagggtttcccgttggtgacaaccaaacgctgtcatattcgctccatcattcatgaactgctgtggttcctgaatggtgataccaatacccaatatctgcgtgataataatgtgactatctgggatgaatgggccgacgaaaatggcgatctggggccagtttatggcaaacaatggcgtgcctggggctctgcagatggccgtcaaatcgatcaattggcaaaagtccttgaacagttgaaaagtgaccctgattcgcgtcggattattgtttctgcatggaatgtcggggaactggataaaatggcattagcgccctgtcatgcttttttccagttctacgtcgcgaagggtaaactgtcctgccagctttaccagcgttcttgtgacgtctttttagggttgccattcaacattgcaagttatgctttgctggttcatatgttggcgcagcagtgtgacctggaagtgggtgattttgtctggactggcggtgatacccatctttacagcaaccacttagaacagacagaacttcagttaagccgcgaaccgcgagcgttacctaagctggttattaagcgcaagcctgcgtcattatttgattatcggttcgaagactttgagattgtggattatgatccgcatccgggtattaaagccccagtcgcgatttaa

SEQ ID NO: 4557 - DNA, 879 bp, Xenorhabdus bovienii
  Coding DNA location: Contig name=SeqID_16897; Position on contig =80117..80995bp; Strand=-
atgagcactagttatctggcatttcctaatattgaccctgtcatattctcaatcgggcctgtatccctccactggtacggttttatgtatctggttggttttatttttgccatgtggctggcaaatcgacgcgcagcaaaaccaaacagtggctggaataaaaacgaagtagagagcttgctttatacagggtttgtcggggtgttcgtcggtggacgcctcggttatgttctgttctacaatctcccaatgttccttgataatccgttgtatctgttcaaggtctgggatggcggcatgtctttccacggtggtctggtcggggttatatgtgccatgtggtggttcgcccgccgtactaaacgtcactttctacaggtttctgatttcgttgctccattgattcccttcggtttggggatgggacgtatcggtaactttatcaatggtgaattgtgggggcgtgttacgcttgatacaccgtgggcgatcttgttcccgagttctcgcagcgaagatatcgcactggcgacaaccgatccctctttatggccgattctggaaaagtatggtgtcctgcctcgccatccatcacaactgtatgaaatggtgctggaagggatagtgctgtttatcattctcaatttatttatccgtaaaccacgtccgatgggaagtatttcaggcctgtttctgattggttacggagcattccgcatcatcgtcgaatttttccgtcaacctgatgcacagctcgggttgtttgaggggatcagtatggggcagatcctttccattccaatgattttagtaggaattttaatgatgatctgggcttgtaaatgcccgcgtaacaacaagatacaagaggcaaaatga

SEQ ID NO: 4558 - DNA, 2247 bp, Xenorhabdus bovienii
  Coding DNA location: Contig name=SeqID_16897; Position on contig =81137..83383bp; Strand=-
atgctcatgcgcttacgggaaattgtcgaaaaggttgccatggcagctaatttgtctgaagcgcttgaactattggtcaatgaaacctgtctggcaatgagtacggatgtctgttccatctatctggcagatcatcagcggtattgctattacttgatggctaccagaggcttaaagaagccaaaggaacgagcgatcagcctggcctttgatgaaggtgtcgttggtgaagtcgggcgtttatctgaattaatcaacctcgccgatgtgcgcgatcatcccagttttaaatatatcccccaagtaaaagaagaaggtctgcgggcttttttaggcgtaccgattgtttaccgtcgtcagttgcaaggtgtactggttgttcaacaaaatgaacgacggctattcaatgaaagtgaagagtcttttatggtcacgctggccatgcaattggcggttattctcgctcaggcacagacaaaaggactatttggccagtatcgtcagacacgcattaaggcgcttgccatttccagtggcatcgtcatggctcagggttggcaagatggctcgcagccatcacttgaacaagtttttgaagcgtcaacgctggaatatcaggcagaacgttctcggctgaccgaagcccttgagcaggcaaccgccgaatgtcgccgtatcagcaagcgttttacctccagttcacagaaagaaagtgccgctatttttgacctctattctcatttgctgaatgatcccaaacttaagcaggatctgttttcttccgtcgataacgggtttgtggcggagtgggcagttaaaagtgttgtcgaaaaatatgccgaacagtttgccagcctgcaagatccctatatgcgggagagagcttctgatttacgggcgcttgggcagcgggtattgttccatctggatggttctttcacaggtgatagcgaatggccagagcgctttattctggttgccgatgaactcagtgccaatttactggctgagatgccacaggaacaactggctggtgtgattgtacgggatggcgcaacccattcccattccgcaatactggttcgggcgatggggataccagctatcatgggagccgatatccagcctgaattactgcataatcggatgctaatccttgacggttatcgcggcgaggtttttgttgaaccagaaccactgattattcaggaataccgacagattattgaagaagaacaggttctcagcgaattagccgagggggagctgaaacaaaaagcacaactcaaaaatggcgaaagagtgctggtgcagctcaatgcagggttaagtttaaaatacgagcagcagataggtggtagtattgatggtgtaggcctgtatcgtactgaaatcccttttatgctgcaccgtggttttccatcagaagatgagcagaaaaaccgttatcaagagatgttggcgcttctcccagataaaccggtggtgctacgaacattggatattggtgccgacaaacaactgccttatatgcccatcagtgaagaaaatccctgtcttggctggcgaggaattcgtatcacgctggatcagccggaaatattcctgattcagctcagagcgatgttgaaagccaatgtgcttatcggtaacctgaaaatattactgccgatggtcaccagcatcgaagaaattgatgaagccaagaagttgatcgacagggcgaaagctgaagttgaacagacaattggcagtacgattaccctgccccagattggcatcatggttgaagtaccctccaccattttcttgttgccgcagttgaagaaacggattgattttatctctattggcacgaatgacttaacccagtatttgcttgcggtggatcgcaataatacacacgttgccgctttgtatgacaatttgcaccctgcggtcattaaggccttgaaactggcctttgatgaaagccagcgtgttggtcttcccgtgagtatatgtggcgaaatggcgggtttgccgatgggagcgttaatcttaattggccttggttaccgtagcctgagcatgagtggccgaagtgttccacgcataaaatatttactgcgtcatttggataccaacgatcttgagctgcttatcaaagaaatattgaaagcagaaaccagtcagcaggtgaaagccctgtctactgaatttatggaggccaatggtctcggtggtttggtgcgggggggtatttag

SEQ ID NO: 4559 - DNA, 531 bp, Xenorhabdus bovienii
  Coding DNA location: Contig name=SeqID_16897; Position on contig =83393..83923bp; Strand=-
gtgattgatgatgatggctaccgcccgaatgtaggaatcgtaatttgtaatcgccaagggcaggtcctttgggctcgccgttatgggcagcattcctggcagtttcctcaggggggtatcaatccaggggaatcaccagaacaagcgatgtatcgcgagttgttcgaagaagttggtttaaatcgcaaagatgtacgggttctcgcatctacccgtagctggctgcgttacaaattacccaagcgtttggtgcgttgggatacaaagcccgtctgtattgggcagaagcagcgttggtttttattacagttgctttgtaatgaagtcgatattaatgtgcagcgcagcaacgcacccgagtttgatggttggcgttgggtcagttattggtatcctgtcaggcaggtggtttcttttaaacgggatgtgtatcgccgcgtaatgaaagaattctcttccattgtgatgccagtgcaggaatccgctccacagctacattcaccttatttacatcgtcgcagaagaagttag

SEQ ID NO: 4560 - DNA, 165 bp, Xenorhabdus bovienii
  Coding DNA location: Contig name=SeqID_16897; Position on contig =83999..84163bp; Strand=-
atggaaaatacttttatatcaatgattagcgtctcaaattcctacgtcggtactagccggatcaggttcgacgggtttttctcagaaatgcggttttacaacagcagcaccccgttgagatggcggtattgtagagacttccgctacggctgcaaagtccaatga

SEQ ID NO: 4561 - DNA, 1014 bp, Xenorhabdus bovienii
  Coding DNA location: Contig name=SeqID_16897; Position on contig =84217..85230bp; Strand=+
gtgtttaaaaacttattttccagatttatcgcaatcagtacgctatcgatctctgcatgtgtctttgctcaaacggcacaggccaaacctacactgacaatttacacttatgattcatttgcttctgaatgggggccgggacctgccattaaaaaagcctttgaagcagagtgtaactgtgaactgaaactcgtcgccctggaagatggagtatccctgctgaaccgagtgagaatggaaggcaaaaagacatcagcagacatcgtgttagggctggataacaacttgattcaggctgcccagcagacagggttgtttacaccaagccatattgatacctcaaaactgaaattacctgtcacatggaacagcgcaaccttcattccttacgattacggttactttgcctttgtttacaacaagaacaccttacctcaccctcccaaaagtatggatgaattaatcaacagtaaccagaactggaagattatttatcaagatccgcgcaccagcacccctggcttgggtctgctactctggatgcaggatatttatggcgataaagcggtacaggaatggccgaaagttgccaaaaaaacgctgaccgtcaccaagggctggagtgaagcctatgggctgttccttaaaggtgaaggagatatggtactcagctataccacatcaccggcctatcacattctgtcagagaaaaaagataactatgctgccgccatattcagcgaaggccattatctgcaaattgaagtcgcagctcagttagcctcaagtaagcaacctgaactggcgcagaaattcatgcagttcatgatttcacctgcattccagcaggcaattccgacgactaactggatgtatacagttatcgacattcctctgcctgaggttttcaagaagcttcctgtgcccgaaaaaccactgcaattcagcgcagatgatgtggccaaacaccgtaatcagtggatccgtacatggcaaagcgccgtaagccgttaa

SEQ ID NO: 4562 - DNA, 1605 bp, Xenorhabdus bovienii
  Coding DNA location: Contig name=SeqID_16897; Position on contig =85206..86810bp; Strand=+
atggcaaagcgccgtaagccgttaattgcgggttggttattgccgggggtgattgcctccggcctgttacttgtcgttgctctgtcagcatttggagcgctttggttcaatgcgcctgaaagccactggcaagggttcttagacgacagttacctgtggcatgtcattcggttcactttttggcaggctttcctgtctgccgttttatcggtgacgccagcgattttcctcgcaagagcactttatcgccgtcgttttcccggtagagcgctgtttctacgcttatgcgccatgacgttggtacttcccgttttagttgccctctttggcatactgaccgtttatggtcgagtcggctggttggcaaatatttcccaatggatgggtattgaataccgttttacgccttacgggctgcaaggaattctactggcacatatttttttcaatatgccaatggcagcccggttactgctccaatcgctggaaaatattgcgatagagcagcggcaactcgcagcacagcttggcatgaatgaatggcagcactttcgttttgtagaatggccttatctgcgccgtcaaattctgccgacgggtgcactgatattcatgctgtgctttgccagttttgccaccgtgctcgcactgggaggcggccccgcagcaaccaccatagagctggccatttatcaggcactcagctatgactacgatctcgcccatgctgccctgcttgcgcttatccagctattttgctgtcttggtctggtgctggtcagccaaaaactcaaaggcacactctttgtcggttacggtcaccagcaacaatggcggaatccgcaggattcatggctgcaaaaagggtgtgatgggctattcatcgttatggcactactacttttgatcccaccgttactggcggtcattgtggacggtctgaacggtgctgtacttaatgtcctacaccagccagctttgtggcaagcttttacgacttcagccattatcgctctgggagcaggtctgctgtgtgtcatgctgactatgatgctgctatggagtagccgtgaattacacttgcgtcactctcctcgctgggggcaggcaatggaaaccagcggtttattaatccttgccatgccaggcattgttcttgcaacaggcttttttattctgctgaacaccaccgttggcttgccgcattctccttacggattggttatcttgaccaatggattaatggcgatcccatatgctctgaaggtattggataacccaatgcgtgatttagcggagcgttacaatcccctgtgccgttctcttaatattcaagggattcaccgactacgctggattgagcttaaggcactgaaaattcctttggctcaagcactggctttctcctgtgttttatcgattggggattttggcgttgtcgcgttatttggcaacgaagatttccgcaccctgcctttctatctttatcagcaaatcggggcatatcgcagtcaagacggtgcagtcaccgccttcttgctgctgcttctctgttttatcttgttcagtgtgcttgaacgcttaccgggccgacgccatgattaa

SEQ ID NO: 4563 - DNA, 696 bp, Xenorhabdus bovienii
  Coding DNA location: Contig name=SeqID_16897; Position on contig =86803..87498bp; Strand=+
atgattaaactcgaaaatgtcatttatacctacgaacaccttgccatgcatttccatgtcaatattgaggcaggcgaacgcgttgcaatcctcggccccagcggagcgggtaaaagcacgctgttaagtttaatggcaggattccaatccgcagaaagtggcgatatctggttaaatgatgaaaatcatacccatacctcgccttccaaacggccagtctcaatgttgtttcaggaaaataacctgttttcccacttaactattgagcaaaatatcggtctggggttacaccccggattacggctaacgggtgagcaacaaaagacgctacagcaaattgctgcccaagtatcactgcaagattatcttaaccgcctgccagcccagctttccggcggccagcgccaacgcgcagcactggcacgctgtctggtacgccagcagcctattttattgctcgatgagccattttcggcacttgatcctgctttgcgcaatgaaatgttggagttactgacgcaagtttgtgatgcgcgccggctcactttaatgatggtgtctcataatcttgatgatgccgccaaaatagcaccgcgttctttacttattgtggatgggcggatttattatgatggtgcaacagcgaagttagttaatggggaagcgcctgaggcggcgattttggggataggatga

SEQ ID NO: 4564 - DNA, 108 bp, Xenorhabdus bovienii
  Coding DNA location: Contig name=SeqID_16897; Position on contig =87451..87558bp; Strand=-
atggcacttcaggcaggggcatggctgcatggagtggcacagatggtgtcatttaaccactcatcctatccccaaaatcgccgcctcaggcgcttccccattaactaa

SEQ ID NO: 4565 - DNA, 492 bp, Xenorhabdus bovienii; identical to SEQ ID NO: 1438
  Coding DNA location: Contig name=SeqID_16897; Position on contig =87675..88166bp; Strand=+

SEQ ID NO: 4566 - DNA, 354 bp, Xenorhabdus bovienii; identical to SEQ ID NO: 1741
  Coding DNA location: Contig name=SeqID_16897; Position on contig =88103..88456bp; Strand=+

SEQ ID NO: 4567 - DNA, 558 bp, Xenorhabdus bovienii
  Coding DNA location: Contig name=SeqID_16897; Position on contig =88453..89010bp; Strand=+
atgacgacaccatctaatcatttaaaaaaatgtcatgatttctatatccgtaatatctacaaaccacaaacacttgttataaaaagaaaatacaaaacagacataaatcgaaatataagtatttcctatgctaaatttgtaatgaaatcattcaaagctatactccaaactgcaagagttggtttcgggttaagacactctaatcagaggacacatatgatgaaaagcttgaagttatcagttgcagcattactggtgttgttttcaagtacagcacttgcagcgccagcagtatcactcgaacacgcttcaaaaacagccaccgcggtagaacataatgtcaaaacggctaaagacaacgttagctcattagaaaagaaagttaccaaaggatcaaaaagccaaaaagcgtcacagaaaaacaacagtaagaaatcaaaagctggaagcgcagagaaaggggctaatagcgccctttgtaaagacggaacctatagtaagagcaaaacccataaaggtgcatgttctcgccacggcggtgtagctaaatggttataa

SEQ ID NO: 4568 - DNA, 288 bp, Xenorhabdus bovienii
  Coding DNA location: Contig name=SeqID_16897; Position on contig =89205..89492bp; Strand=+
atgcgattaactgacgataagaaaatacgaaaatcgataatcaggttatttacctttacagaacaaatcatcatgcttaagagctttagattagttaagcatgaaaccagagatgatttttccaattggttaaagggattagcctataattttatggaatcagcaaaaaatacgacgttcttttccattatcttggccgtttttacttatatcagtccaccaaaatcacactatgctgttttaattttcaacaatcttatttttatctatcctgttttttatgtttag

SEQ ID NO: 4569 - DNA, 441 bp, Xenorhabdus bovienii
  Coding DNA location: Contig name=SeqID_16897; Position on contig =89568..90008bp; Strand=+
atgaaatcgaagatagtcctttctgagcctgaacgaatcacgttgcaacaactcgccctgaatcatcagcatcggggcatccgtacgagaggaaccggtttactcatgctggccagaggattaaaaccgcgccagatcgccgttgagacaggatgcagtgtccgggttatttataactgggttcacacttggcatgacttcgggattgccggtctattgggcggtcatgccggcggccggtatctcgccatgacgcctgaaatgatcgcaaccgcggttgaaatcgcctgttccgaatccctgacgctggcccgaatagctctgggggttgaggaaaagcacggtcctttgccatgcacgcttgaaacgctggcaaagacactgaaaaaacaggggctcacctataaacgagcccgtctgtcgttaaaaaaaacgcgatga

SEQ ID NO: 4570 - DNA, 537 bp, Xenorhabdus bovienii; identical to SEQ ID NO: 2180
  Coding DNA location: Contig name=SeqID_16897; Position on contig =90034..90570bp; Strand=+

SEQ ID NO: 4571 - DNA, 510 bp, Xenorhabdus bovienii
  Coding DNA location: Contig name=SeqID_16897; Position on contig =90580..91089bp; Strand=+
ttgaataaagccagaataattggatgtggctaccttgtcggcataaaattatttatattctgcattaatcacaaaatattttttgtaccggaatcacaaaacaaggcttacccgcccctaaatacacaggggatcaaaatttatattgacgatgataaaaaagcaagaaaacgcatcacagacatttttacatttaaagagcaattaactctgttacggtgtttttctttggagagagaaaatactcatggagattttctggcttggattaataaaacttcagccgactttttttcgtcgataaaaatgatgttaattattctatttatatttttcattatttccataataaaatactatgaagcttggaattatatacttgtcactttctttatttttatgatgcctttaatgacattaatttgcatattttttacatctcacatgatgggctgtaaatttatcacaagtgtaaaattactttattttcatttaagaaatgaaatataa

SEQ ID NO: 4572 - DNA, 774 bp, Xenorhabdus bovienii
  Coding DNA location: Contig name=SeqID_16897; Position on contig =91686..92459bp; Strand=+
atgccctctttaatcatgaggacaactgccgtcttcgctttctttctctcattaatttttaccggtctgagttatgcttcgaccagtacctcaaaaatgaaagagtattctcacaatggcatacaggagagtttgccagatttgcgacaatatccttcaggtacaccccggaagaaagcgtttttaaacattgttgtccctgtcattgatgagcataatcaaaagattatgcaagaccgaaaatggctgctgtcacaccagaaaactcgtcactggtctgtacaggatatcagtcgattgcagaaaatctgcgcaagttacaaaatggcctgcacatcaccgaaacaggtcaattggaacaaactgttaagtcgagttgacattataccgacccattttgtcgctactcaggcagccgcagaatcgggctggggaacatcagaacttgccaagaaaaacaataacctgtttggtatgcgttgcaactcatgcagcaaaaccaaaggaaaaatcaaaggttattcggtttatcgcaatgttgatgattccgtcatcgcctacatgaaaaatatgaatacacaccgtgcctacgaatcacttcgtacttcacgggcaaaacagaggacaacacaaacgcctctgaataccagtaaattgatcgataacctgaacggttattccgagctgggagctcactataatcgctatttgcatcaggtatttaatggcaataaaaagctgatttcacaggcacaggaactgacagacccatag

SEQ ID NO: 4573 - DNA, 1422 bp, Xenorhabdus bovienii
  Coding DNA location: Contig name=SeqID_16897; Position on contig =92825..94246bp; Strand=+
atgaatttcttttcttttgagtttcttggttcgtttgttattctgcttcttgcctattggcttttacaaaaagcccctaagctacagaatggcttattaattttagttagttatttatttatcttctctttcgcagcaaaatttgcctatattctatttgcctataccctgttcatttactttttggcgaatattctcagtcgttatttgtccaacaaggccatattcacgctcctgattttcggtattgtgggttgttttaccgccttcaaatattattctttctttcaagagacgattcagcaatcattagccaatttaggaatttctgtcgaattgcccatacttgagctgctgatgccattaggcttatcattttatgcctttcactccgtcagttacgtgatgtcggtttgcaagaaagaactacctcctgctccgctgcttgatgttattttgtatctctgcttttttccaagcatcgtggccgggccaatcaatagagccaaagatttcctgccgcagatccaagcttcatccagagtgatgctggagccattcaaagctctgttattgattgcactggccatcgcaaagctgtttctgctcagttcgacgctctctgaaaattttgttaatccagtctttgatgaccccactggctatcatgcggggcaagtccttgtcgcgatttatgcttatgcgtggaatatctatttcaacttttcaggttataccgacctcgtgacgggtattgccctgctgttaggttttacagtgccacagaactttaatgccccttatcttgctgagaatttacaggaattttggcggcgctggcacatcagcctgtcgacgtttatccgcgattacgtctacattccactgggcggtaataagaaaggcactgtccgcaagaatatgaatctattctcggcaatggtcatttccggtctatggcatggtgccggattgagctttattatttggggcgccattcatgggttagggttaattttccacaatattaaaaacgcactgtttccctccaccggaaatcgcaataagacgcgaagaaaaaatccgatttcattatttttatcacgcgtgatgacattccattttgtctgttttgcatgggtattcttccgcagcccaacatttaatgacgctctggttgtattaaaccaattgtgctcaggagatgtgttcacggcgctgttgtccagcagcactttattagtcgctttttggggattctttattatctatccttggctggtgaatatcagagacacgatggaaaagaaccatagcctgatgtcatgggtttattacccaatccccttagccctgatcctcactttagtatttatgctgtcaccttctggaatgccaggatttatctatgccaacttctga

SEQ ID NO: 4574 - DNA, 1137 bp, Xenorhabdus bovienii
  Coding DNA location: Contig name=SeqID_16897; Position on contig =94233..95369bp; Strand=+
atgccaacttctgaatttatctctaatcttaaaaaagtcgggcaagtgatgtttatcgtcactttaaccagcctgctgctgatctggctgaatcaacgttcgctggatagtttctggcaacagaagtatcatcgtaatagtccgtggacagcccttaagggagagccagtgtgggatttgggcagcaatatgcagcaaggtgccattgccgccggtgaaatatttatggcatatgtaagggggatacatcaggataatcagcgacaggccctgaatattaatgagactccaagtataattcttcctgattttcaggttggtctgcgttttctggaaggatatacgtactcgatcgagagtcgctatttgacgttccctgatttgctgcacaaagatgtccggcacactcaatcatccttattacgaaatcattcaccatcaaatgcggttatcgaaattaccccaaaaaccaatgtcagtttggggaaaaaagatcaggtactgtttgcaggggattcgatgatgcaaggcgttgctccgcatttaaaacgccgtctttaccaggaacatggcatcgccagtattaatttgagcaagcagagtacagggttggcctatcccggtttctttgattggcccaaaacaatcggcgatacactaaggaaaaatccggatattaaattggttgtggtgtttttaggccccaatgatccctgggatatgccgacaaaacgcggaggagcctatttgaaattcgcgagtgaagattgggaaaacctttatcgtcagcgaatcgaaacgattttaaatgatgctcaccagcataaggtggatgtgatttgggttggcccacccaacatgcggcagaaaaaactttccggcggcatggcttatctcaataaattgtatcaggcagaggtggcaaaaatgggtgagatctatgtctcagttaatgatatgttcaaatatcggtcggagaattattcagactatattggtgatggcagtagtacaatcaagctccgaagtggtgacggtattcatttcagtttgaatgggcagcagaccatcgcgaacgctatcttttcattaatgacatttattcaggagccagttaaaaaagatgcaaccatttag

SEQ ID NO: 4575 - DNA, 1215 bp, Xenorhabdus bovienii
  Coding DNA location: Contig name=SeqID_16897; Position on contig =95356..96570bp; Strand=+
atgcaaccatttagaccgttccgttggttttatcggataacgggtgcaggtctggttatcgcgctctctgtgagcctattatcatgccacggcaaaaaatccaaaccgtcatctgaattgcagacgacgcaaatacatcgccaaaatcaactgacaaattttggcgacccaaatttcccattactggcggataagctgcgccatagcaactcgcgccaactccatttcgtgcaactgggcgattcacataccgccgccgatttttttaccggcaagctgcgtagtttattgcagaatcgctatggtgacgctggccctggttttatcagcccgatcagcattcccggccagcgcacggcgaccgttaagttcacggatgataaaaaaaactggtggctttcgagcagccggaaagataaccgtgctgattatccactggggggttttattgccacaccagaaaatgtcagcagcacaatacggatgaatttatcaccctctgcttttgagaagtacgggataagcgcgctttatcaatcccatgaggcaagccaaatcaggacgcagtttagccagtgggatctgccggccacacaaagcgaatggcagttttcgcaacaacacagtgtttttttcccactcagggtcgatgcacaggatacgcatttgaaaatcggtggctggctgatcaaacgccaaagctccggcattatgttatccgcgttggggattaatggcgccaccatcagtatgttggataaatggcagccacagtggatcaatacactggtccaattgaaaccggatatggtgatccttgcttatggcaccaatgaagccttcaacgattcactggatcttgttgcctatcagaaggaactgacatcaaaagtgcaggaaattcgcaaagcgatgccagaagtagttattctgctgattgggccaagtgattcgctgaaaaacaaaactgccgtcagttgtgccgaacaacaacccgctctgctcaatggcataattcaggctcagcaggccgtcgccaaacagcagcacaccctgttctggaattggcaggagtttatgggtgggtcatgttcaatcagaagctggcagcagcagaaccttgctcgtcccgactatgttcatctctccgccgcagggtatgaacgcagtgccgaagcgctttatagccagattgttggtttgattgagcagtga

SEQ ID NO: 4576 - DNA, 1341 bp, Xenorhabdus bovienii
  Coding DNA location: Contig name=SeqID_16897; Position on contig =96945..98285bp; Strand=-
atgactacattaactttggtgctgacggccgtcggttctgttctcctactattgtttttggtgatgaaagccagaatgcatgcttttatcgctctgatgttggtttcaatgggagcggggatcttctccggtatgccattggaaaaaatcacccagactatgcaaaacgggatgtcaggtactttgggctttctggccattgtggtggcgctgggtgccatgtttggcaagatcctgcatgaaacaggggcgcttgaccagattgccgtgaaattgctgggtagttttggtgaaaaacgcgcgaattatgcattgggcatcgcggggcttatctgtgccttaccactgttttttgatgtggcagttgtgctgttgattggcgtggtatttgccgttgcacgtcgtactggcggtaatgtggtgaaactggcaatcccactgtttgccggtgttgcagccgctgcggcgtttctggttccggggccgacgccgatgttgctggcttctcagatgggagccgattttggctggatgatcctgattggcctgagtgctgcgatccccggcatgttgctggccggcccgatgtacggcaatttcatcagtaaacatgtgacactggaattaccagaggatctgaatacaccgagcattggcaaaagccagatgccttcctttggtttcagcctggcactggtgttattcccgctggtattggtgggtttgaagactattgctgcacgtttcgtcgatcagcagtcaacgttgtatcaatggctggagtttgtcggtcatcctttcaccgcgattttaattgcctgtctggtggcgatttatggcttggcgatccgtcgcggtatgagtaaagacagagttatggaagtgtgctctgcggcgattcagcctgcggggatcatcctgctggttacgggggcaggtggcgtgttcaaacaagtgctggtggattccggtgtcgggccagcgctcggtaatgctttggtgggggctggtctgccaatcgcactggcatgttttattctggcaggggcggtgcgcgtgattcaaggttcggctaccgtagcgtgtctgaccactgtgggtctggtactgccagtcattggtgaactgggttattccggtgcgcaaatggcggcgttgtcagtgtgtattgctggtggttcgttgatactcagccatgtaaacgattcgggcttctggctgttcggtaagtttaccggtgcgacagaagtacagacattgaaaacatggaccattatggaaaccattttgggtactacgggtgccattatcggcatgatctattttgccatgctgagttaa

SEQ ID NO: 4577 - DNA, 540 bp, Xenorhabdus bovienii
  Coding DNA location: Contig name=SeqID_16897; Position on contig =98282..98821bp; Strand=-
atgagcaatacccaacagccaaatcatgtttttgtattgatgggggtatctggcagcggtaaatctgcggttgccagtggggttgctcgtaagttgggcgcggcgtttctggatggtgactttcttcatccccgcgccaatattattaagatggcacaaggccacgctttgaatgacgatgatcggcagccgtggttaaaagcactcaacgatgccatttttgccatgcagcgtacaaataatgtctctttgctcgtgtgctctgccctgaaaaaaaactatcgggatatgctgcgtaatggcaacaaaaacctgtcatttctgtatatgcagggggattttgatttaattgaaagccgtctgaaagctcgcaagggacacttcttcaaaccccaaatgctgatctcgcagtttgaggcattggaagagccgactgacgatgaaaaagatgtctatcacattgatatcaaaccagaccttgatgaagtaatcaaaaacacaataacaacaattgatcgcattaccgaggggcattcatga

SEQ ID NO: 4578 - DNA, 939 bp, Xenorhabdus bovienii
  Coding DNA location: Contig name=SeqID_16897; Position on contig =99043..99981bp; Strand=-
atgacggtcagccgtttcttgcgtaatccggatcaggtctcggaagcattgggaaaacggatcgctgaaacgttggatcaactgggttacattcccaaccgtgtgccggatatcctttccaacgctaccagccgaacgataggggttttacttccttcactgaccaatcaggtatttgccgaagtcattcgtgggatcgagcaggtaactgatcgcaatggttatcagacgatgctcgctcattacggttattccgctcagaaagaagaagagcgcctgctttccctgctttcttacaatattgatggcctgatcttggcagagcggacgcatacgcccaagaccttgaaggtactggagacggcaggcattccggttgtggaactgatggatagcgtctctccctgccttgatattgctgtcgggatcgataattttgaggcggcgcggcagatgacggtggctatgatcgaacgtggctgccaaaacgtgatctaccttggagcgcggcaggatgaacgaacgctgatccgcttggatgggtacgaaatggcgatgcgcagcgtagggttgcagccgaggaatgtgatgacgcctgccagttcgtcctattcactgggcgcgcagcttttgcgggaaacctgccagaaataccctgatgttgatggtctgttttgcaccaatgatgatatcgcgattggtgcgatttttgaatgtcagcgacaggggatcaatgtcccggaacagatcgctgtggctggattccacggccatgatgttggtcaggtgatgatgccaaaattggccagtgtactgactccgcgtgatctgatcggacgcagggcggcggaagccctgtttgctcgtttgaagggacaaaaactggaacaaacccttattgatgttggatttacgctttcattgggagaaagtgtttaa

SEQ ID NO: 4579 - DNA, 975 bp, Xenorhabdus bovienii
  Coding DNA location: Contig name=SeqID_16897; Position on contig =100180..101154bp; Strand=-
atgataacactggaagatgtggcgagttattcaggcgtctcgcgcgccacggtgtcacgcgttgttaatggtgacaaaaaagtgaaggcagcaacccgtaccaaagttgagaatgccatcgtagaattgggttacagtcccaatctggcggcgcgtgaactggcttcaaatcagagcaatacgctggggttggtgaccacttcctatcgtggcggcttctttggtgccttgatggatagcatccagacggaagctgaatcacatggcaaacagcttctggtcatgcaggggagaaatcgtgctgaaaacgaatggcaggctattatgcatctgcatagcctgcgctgcggcgggatgattttacatgtgcgtgccatcagtgatgataagctgaggcaactcgctcaaagtggccgttcgtttgtgttgctggatcgtctggtgtcagggctggagccgcgctgtgttgtgtttgatcaccacaaggccagctatctcgccacgcaaaccttggtcgagcatggacatactcgtattgcatgcgtgagtggccctttgtcacgcaatccaagccagcagcgccgtcaagggttcttggatgccatgcaggatgcgggattgaatcctgttgcttgtctggaaggggagtatgatctgcaaagtggctaccggcaaacccgaaccattctggcaaaatcacggcctgatgccctgtttttctgtagtgaagagatggcgctcggcgcattgctggcgattacagagctggggctgtgtgtaccagaggatatctctatcatctgttatgaccgcggagagcgagcggcatttgtctatcctgcactgactagcgtccattttcccattactgacatggcgtgtttcgcgacgcgtttattgatcgaacctgatacacctcccccagaatttacgccccaaattatttatcggaattctctcagacagagtaagtga

SEQ ID NO: 4580 - DNA, 1311 bp, Xenorhabdus bovienii
  Coding DNA location: Contig name=SeqID_16897; Position on contig =101201..102511bp; Strand=-
atgaaaccgatcaaaattgccgttattggcggcgggagcagttatacaccggaattggtggaaggaattattcagcgtagccaaactattccgctttctgagctggcgctggtggatgtggaagctgggcggcacaagctggaaatcatcgctgcgctgactcgccgtatgctggatcgtcatgatttggattatgttactgtcacggtgcattattcaccggatgaagcgattaagggagccagtttcgtactcactcaactgcgcgttggtcaacttcctgcccgtgccgctgatgagcgtctggggttgaaatatgggttgctcgggcaggaaacaacgggcgtaggcgggtttgccaaagcattgcgtaccattccggtgttactggatatcgctcataaagttgaacgccttgcgccggaggcatggatcatcaatttcagcaatcccgccggcgtcgtcacggaagcggtttcccgctatagcaaagccaagatcatcgggttatgtaatgtgccaatctcgatgcaccatatgatcgccaatatgctgcaacggccatatcaggacgtgcaattacgttttgctggccttaaccatatggtctgggtacatcaggtattagtgaatggcagggatgaaaccgatcaggtattggaattactgtgcaatggcgcagagctgacgatgaacaatatcaaggaagaaccgtggccgccggagtttttacaggcattgggcgcaattccctgcccgtatcatcgctacttctatcaaaccggcaagatgttacaggaagagaaagaaagcgcggcaagcaaagggacacgggcagagcaggtgatgcaagcggagcgggagctgttcgagttgtatgccgatcctaaactggatcacaagcccgctcagctcagttttcgtggcggatctttctattctgaagtggcgttggaattgatctcggctattcataataatctcggtacgcaattggtcgtcaatacggcgaatcggggagctatcatcggcctgccagatgatgcggtgatcgaagctaactgcattgttgatgctcaaggggcgcacccgctggcgtttggtcacctgccggacagtatgtcagccctaacccagcaagtgaaagcatttgagcgcctgaccatcgaagccgccgtccacggtgatcgcaaggtcgcactgctggcgctggtaacccatccgttgattggcgatgcggcgttggattcgtcattattgaatgaaattttagagattaatcacatgtatttgccccagtttaaacggtaa

SEQ ID NO: 4581 - DNA, 348 bp, Xenorhabdus bovienii
  Coding DNA location: Contig name=SeqID_16897; Position on contig =102524..102871bp; Strand=-
gtgaatattagttttgaacagcaggattttgaacaacagatcgtcgaattgctggtacatgcgggcagtgcgcgcagcagtgcgttaatggctttacaacaggcgaaggcgggagattttcagcaagcaggaatgttgatggaagaagcgcgacaggaaacgcgtgccgctcatgctattcagactaaactgatcggattggatgaagggtgcggaaaattaccgattaatctgattactgttcatgcccaggatcacttgatgaatgcgatggtgattcaagatcttgccagcaatatgatcgatctttatcagcgcttgccgccacaagatcgccagtcagaataa

SEQ ID NO: 4582 - DNA, 1311 bp, Xenorhabdus bovienii
  Coding DNA location: Contig name=SeqID_16897; Position on contig =102895..104205bp; Strand=-
atgagtttttatacttccttgacgcgtattgtagaaaatcatattgcgcccattgccggacggatcggtagccaacggcatattattgcgatacgtgatggctttatctcggccatgccctttctgattattggcagtatcatgttgattgtggcaaacccgccatttgatgctcaaacctcctcttcttttggtcaggcttggctggaattcgccaaagcgtattggaaaaccatcaccatgcctttctttatgacgatgggactgatgagtgtgtttgtctccatcggtacggcttatagtctggcgaaatcttatggactggatggactgacatcggccttactgtcgttgatggcatttctgctggcggcggctccgcaggttgataacaaaatgccgctcgattttctgggaggaactggggtatttacggcgctgatctgtgcgatttggtcggtggaattaatccggttgctaaaaaaatacaatatttcgataaagatgccatcacaggttccacctgccattgcccgctcttttgaactgctgtaccccgttgttggtattttgctgacggtttatcccatcagtctgctgctgcaaagcgaatttaatttgctgctgcctgcggctgttatgcagatatttgaaccattgattgcgatcggggatacgttgcccgctgttatgctggtggtgttgattgccaatttattgtggttcgccggtattcatggcgacaatattgtcactgggctgctgaatcccatttttatggcgaatatcgccgctaatgccgccttgatgacacagggcatggcaacgactcaaatcctgaccgcgccttattggtctttttacgtctgtatcggcggctctggttctacgctggtattggcgttcctctatctgcgcagccgctcaattcacctgaaaaccattggcaaactgagtgttgtacccgccatgttcaatatcaatgaaccgttgctgttcggatctccggtggtgatgaatccgacgttattgatcccgctgctggttgtgccgctgattaatgcagtcttggcttatggcgcactgcatctggatctggtgcagaagatgatcgcgattgcgccgtggacagcacccgcgccgatgggagcgctgatttccgccgcgtgggattaccgtgcggtcgtattggttgggctgttgatggtgattgatctgctgatttggtatcccttcttcaaagtatatgaaaaacagcttttggcagaagaacaacagcaggcaaaaagcctcgccgacgctcaggcgtag

SEQ ID NO: 4583 - DNA, 306 bp, Xenorhabdus bovienii
  Coding DNA location: Contig name=SeqID_16897; Position on contig =104233..104538bp; Strand=-
atgaaaaccattctattgtgttgtgcggcggggatgtctaccagcatgttggtacagcgtatgcaggcggaagcggaaaaacgggggctggaagtcgccattaaggcagtgcccgcattggagttggggatgtatatcaatgaagccgatgtgattttactggggccgcaaatcaagtatgaactgcctcgatttaccgctcttgccgagccactgggtaaacccatcagcttgattgagatgatggattacggcgcactgcgtggtgataaggtactggatcacgccttaagcctgctggaataa

SEQ ID NO: 4584 - DNA, 144 bp, Xenorhabdus bovienii
  Coding DNA location: Contig name=SeqID_16897; Position on contig =104850..104993bp; Strand=-
atgaattgtattaattggtgttttacagcaatcatcggtttcatccgtgattttggtgatttgtttggcgacgattatcaaatcataaatgaagccttttttgtatctaaaataagccgttggtacttaagattctgtatatga

SEQ ID NO: 4585 - DNA, 609 bp, Xenorhabdus bovienii
  Coding DNA location: Contig name=SeqID_16897; Position on contig =105426..106034bp; Strand=+
atgacacgaaaaagggggagacctctcaattttgacaaagagttggctcttaaaaaagccatggatattttctgggctaaaggatttgaaggaacccaacttgtagatttaacggcagttatgggaattaatcctccgagcttctacgccgcttttggaagcaaattcaatctattttgtgaagctgtacagctttatattgaaacaataggtaataaaacagtaaatgcactaaatgatgcaaagacaacgaaagaagggcttaaggccatgttagaaaattccataattaacgcatcttcaaatgaagcaggtggttgcttaatgataatgggaatagtcaataatcgtgctgaaaattaccctgcttgggagtatttgagagaagagcgtgccaaaacccttacactgatacagttacgtattgaacgcggtattatggaaggtgatttacccaaaaatactgactcaaaaacattggctgaatattttttgggaattacacaagctatttcatttcaggctagagatggtgtatctaaaaatactttacagcgcctaattgaaccagctttagccgcattgccttcatccaacacactggagtaa

SEQ ID NO: 4586 - DNA, 987 bp, Xenorhabdus bovienii
  Coding DNA location: Contig name=SeqID_16897; Position on contig =106614..107600bp; Strand=+
atgtattatgtcggaatagatgtcagtaagaataaactggatatttgtttgttatatgatggagttaaaggtaaacgcaaaacaaaatcccttctgaataatgaacattcagcctgtatgttaatagcgtggctagctaaatatattcctgccctgcaacaagtcaatatcgttatggaagccaccggagtctatcatgaacggttggcttattcccttcatcaggctgggggaaggattgcaatagccaaccctttacgcgtgcgtgattttgctaaaggtatggggatactgactaaaacagacaaagtagatgcctatattttagcctgttacagtgccttaaaacaacccgatgtctggcaacctcctcctatagaaattcgcgaattgaaggctctcctatgccgtcgggatgcgttattagaagatatccagcgtgaacgtaaccgatatgaaaaaagcggctcaacccataccccaaaaagggttattgagtccatagaggcaatgatgcatcacatgaaaaatgagttagccgagcttgaggctcttattgccgagcatataaaccagcaccctaatttaaaaaaagattttgaacttttaacctcaataaagggggttggaactcagattggtcttaacatgctgattatcttacgtacgaatacctttactcgtgcaacgcaagtcgctgcatatcttggtgttattcctattgcaaagcagtcaggtacatcggtgcatggtcgagtgcgcttatctaaaacggggcctgctaaaatccgtgctaagttgtttatgtctgcactcactgcagttcgttttaacccccacataaatgatttatataatcgattggttaataaagggaaggcaaaaatgttggctttaggcgctgcgatgcgtaagttagttcatttgtgctacggagtattaaatacgcagcaatcatatgatgaaaactatgctattagaacttga

SEQ ID NO: 4587 - DNA, 1200 bp, Xenorhabdus bovienii
  Coding DNA location: Contig name=SeqID_16897; Position on contig =107931..109130bp; Strand=+
atgcaaaatacatctgtcacagacaataaaagtgaaacattgccattggctgtgtacatactggcattcggtatttttgctttggtgacaagcgaatttcaagtagcgggtatgataccggttatggcaagtgatcttggtgtttctatttcacaaattggttacctggtatctttgtatgcactagcaatggcggttggagggccattgctttccataggactattaaaaataccacctaaattcgcacttatgattctttacgtgatatttaccattggtgaggttttaggaactatagcgagtttgtatcactttcttgtagtagcgaggcttattactggtgctgcatctggggctttttatggagtagcgatagcaatctgtgttgaaattgtatcagaacataaaagaggttgggcaatttctattgtgctagctgggattatggcagggacaatactaggtttgccaatggccaatttgattggaacacatcttggttggagagagagcttctgtgttgtaagcgttttagctgtgcttggtttaattgtcagcatattatggataccaagccttccaaagcagcaggcaattggcctaaaaagtgaattaagcgctctaaagagtcctagattatgggctgtattctctacaagtttattaataatcggcgctacattttctgcattcacttatttcacacctatattgaaaaacattactggctatagtgatggtgctgtcgctgtactcctgactgtttatggaatagcaactatgttaggtaatatcgttgttggaaaattagcagatcgccatacaataactattctggctgttagacttgccttactgacaattttccttgccttatttgctatttttgctgagaacaaattaatctctgttctgtccttaataggtattggtttagttggtgtaacaatgaatccggctatggttacacgagtaatcagaactgctaatggtcgtcctctggtaaacactattcacacttctgtaattacactaggcattgtcattggagcatttcttggtggtttaggtattagctttgaccttggtttaacatctccaatgtgggttggctttttcatggctatagtcggtttcacaacgctaattccagatttgcagttataccaccgtgaacgagtaaaactgaacagctaa

SEQ ID NO: 4588 - DNA, 747 bp, Xenorhabdus bovienii
  Coding DNA location: Contig name=SeqID_16897; Position on contig =109152..109898bp; Strand=+
atgtctaatctttctggaaaaatcgctttaataactggtggtagtcgtggaattggtgcgggtattgccaaacgtttagcacaagaaggggctgatgtagtgattacctatgttaataatagtgatgcagcaaaagcagtagtagaggatattatcaactctggtagagttggtaaggctattcgagctgattcagctgatgctgacgctattaagttagcggttaaacaaataataaagcagtttggtcagattgatatattgataaataatgccggtcatatggatgtgagcggaactccactgccacacgtccctttagatgtagttaatcaaactatcatggtgaatattcgaggttcttatctctttgctcaagaggttgcttcccatatttctgacaatgggagaataattaatattggaagctgtttaggtgagcgaatgcctgtagctgggcttactttatacgcaatgagtaaatcagcaatggttggccttaccaaagggttagcgcgtgatttagcgtataaaaaagtaactgttaatcagatatctccagggcctgtggacactgacttaaatccagcagatggacctaatgcagatttttttcgtgaattaacagctttaaaacagtatggtacaactaatgacataacctctatagtgaattttctggtaagtcgagaggcggcttttataacgggggccaacattgctgtggatggaggtatgaatttataa

SEQ ID NO: 4589 - DNA, 204 bp, Xenorhabdus bovienii
  Coding DNA location: Contig name=SeqID_16897; Position on contig =109852..110055bp; Strand=-
atggctttacagcaggcgaaggcggaagattttcagcaagcagaaatgttgatggaagaagcacgacaggaaacgcgtggcactgtagcttacaacagcgccaatattcctaatttttattgtctcctaaaagacataaaaatagataatgataacattataaattcatacctccatccacagcaatgttggcccccgttataa

SEQ ID NO: 4590 - DNA, 117 bp, Xenorhabdus bovienii
  Coding DNA location: Contig name=SeqID_16897; Position on contig =110055..110171bp; Strand=-
atgaaaaccattctattgtgttgtgcggcggggatgtctaccagcatgttggtacagcgtatgcaggcggaagcggaaagaagagggctggaggtagccattaaagcagtgcgttaa

SEQ ID NO: 4591 - DNA, 831 bp, Xenorhabdus bovienii; identical to SEQ ID NO: 2064
  Coding DNA location: Contig name=SeqID_16897; Position on contig =110478..111308bp; Strand=-

SEQ ID NO: 4592 - DNA, 96 bp, Xenorhabdus bovienii
  Coding DNA location: Contig name=SeqID_16897; Position on contig =111265..111360bp; Strand=+
atgatatcggcttcacggtcacagacagaaatcacgttggccatctgctcccctaaccggctgtcggcggtttgtgaggcccgttcccacttataa

SEQ ID NO: 4593 - DNA, 468 bp, Xenorhabdus bovienii; identical to SEQ ID NO: 2062
  Coding DNA location: Contig name=SeqID_16897; Position on contig =111393..111860bp; Strand=-

SEQ ID NO: 4594 - DNA, 219 bp, Xenorhabdus bovienii
  Coding DNA location: Contig name=SeqID_16897; Position on contig =111894..112112bp; Strand=-
ttgtcggctacggtttatccccgtacctacggagaacactgtagatcgcttataccaattcaaaaggcactcggtttatccccgtatctacggggaacacgtgacctttgtcgggggtttaatgcccaatggcggtttatccccgtatctacctgtctttcctacacaaatattttaacccgccccccctcgttattgaacttttacctcatagattga

SEQ ID NO: 4595 - DNA, 630 bp, Xenorhabdus bovienii
  Coding DNA location: Contig name=SeqID_16897; Position on contig =112196..112825bp; Strand=+
atgtccctgatccgaaatgtattcaaacgcctgcattatcctgttgatatcatcgctcagtgcgttcgcgggtatctggcctacgcgctgagcctgcgtaatttgaaagaaattatggctgagtgcggggttaccgttgatcatcccacgctctctcgttgggttcatcgctgggttccgttgatcgttaaacgttatcggcggagcaagcccgaagttgagcgtcggtggcgaatggatgaaacttatatcaaaatcaaaggacaatggcgttacctctaccgtgctgtagactcagacggtaatacagttgaattttttctgacagctcatcgggataaaaaagcggcattgcgtttcttcaaaaaggcgatgcgtcaacatggacaacctgacggggtaactcttgataaaagcggtgccaataaagcggcgttgggcgaaataaacaaggaaaaaccgaaaaataagcagattaatgtcaggcagagtaagtaccttaataacctgattgaacaggatcatcgcaacgtcaaacggcgaacacgtcctatgctgggattcaaaaactttagggggactcagaccctgttagccgggattgaacgggtcagtatgttgcgtaaatga

SEQ ID NO: 4596 - DNA, 123 bp, Xenorhabdus bovienii
  Coding DNA location: Contig name=SeqID_16897; Position on contig =112904..113026bp; Strand=+
atgattttgctcgcgatctctctgttaatgcgacagaaccgtccccacagcataaaggctttaatcctttatgccgcaaaaagggacatttctatattggcgaaaagtgacattactacttag

SEQ ID NO: 4597 - DNA, 405 bp, Xenorhabdus bovienii
  Coding DNA location: Contig name=SeqID_16897; Position on contig =113096..113500bp; Strand=-
atgattaaatatttattagatacaaatatcgtaatatttacgattaaacgtaaaccagaatctctattacctaaatttaatcaacacactaatcaacttgctatttctgcaataacgctcgcagagttaattttcggagctgaaaaaagcatgaatcccactaaaaatctagccactgttaatgactttgtatcacgtttgaccgttttaccttatgacgaacaagcagcatttcactacggtgatataagggctattcttgaaaaaaaaggaaaacgtattggtgataacgacttacacatagcggctcatgccagaagtaaaggacttattgtagtaacaaataatacaagagagtttgaaagagttgatggattaagaatagaagattggactaagccctag

SEQ ID NO: 4598 - DNA, 243 bp, Xenorhabdus bovienii
  Coding DNA location: Contig name=SeqID_16897; Position on contig =113493..113735bp; Strand=-
atgatccagcaaggtaaagtctttatgagtaatcgaactcaaaatgttcgcttaccggcagatacacgtttccctgataacgttaaagaggttattgttcgagttagcggaaaggaacgtataatctctcccgtccaaaacgcatgggatagctttttcttatcagatcagtctgtaacagatgattttttgccaaacagagctgatcagataacaagcgaaagagaatccttcgatgattaa

SEQ ID NO: 4599 - DNA, 183 bp, Xenorhabdus bovienii
  Coding DNA location: Contig name=SeqID_16897; Position on contig =113864..114046bp; Strand=-
atgccagcagggaaagagatagtgcatgtcggtttatccctgtactcacctatcttgttgtgcttcccgtgcctgacgcactttatcctctttatcttgttgtcaaccccgtggatctggaacacgttttttgccaaatcgatgccaatcgttataacagtcatatcgcgcctccgctggtag

SEQ ID NO: 4600 - DNA, 429 bp, Xenorhabdus bovienii
  Coding DNA location: Contig name=SeqID_16897; Position on contig =114845..115273bp; Strand=+
ttgactatcaatacgacaacagaaacgacttactggaaccctatggtgccggaactcacagtgacaaattttcctgtgtccctggatttctatgtacaaatattaggattcaacataatgatacggcgaaaagatcccgattttgcctatcttcatttagggaaagctcaactgatgctggaaacgtttcacgaaactggctggaatacggcagagcttaataagccgctgggacgtggcattaatttgcaaatagaagtagatgatatcaactccattcttaatcgcctgcaaatcaacaagataaaactttaccgtccattgaaggataataactacgccacaggcgatacccacatctgtcagagagaatttctcgttcaagatcctgatggttatttgctaaggttcagtcaatacatagagtaa

SEQ ID NO: 4601 - DNA, 2760 bp, Xenorhabdus bovienii
  Coding DNA location: Contig name=SeqID_16897; Position on contig =115338..118097bp; Strand=+
atgcctacgttaataaataattttggttatatcatccgatattggggcaaggcccagaaaaatatctattctgatgccgattatcaccttctggcttatcactgtctggcttatcactgtctggatgttgcggcagttggcaaatatctactggctccccacaaaaaaattaccgccgatattgcggattttctggaattatcaaaagaagaattacaaaacctatttgtattttttttgcttctgcatgatatcggtaaattttcttccgcattccagcaattatattccccagaacaacacactgaactactgaaacctcagcattgcaaaccctacgatggcaaacattatcgccatgatcgtttagggctgtttttctggaaacagatccaggacgatgtgctgtttgctttggtgggagacaacaacctgcaacgcagagataaagatcgggcgcaggatacgttgatggtcttaatgcagtgtatgctcggtcatcacggcaaaccgattgatgatagcgactggcaggcaattggcgattttaccgaagcccaaaatataactgatgcaaaagccttcacaaatgatctcattgccctattccaacctcacctgtcattggaaaaattactttccaaagaatggaaagataacctgaagcaagtaagttggcagttggctggcatcgttgtcatggccgactggataggctctgacagtgcacgctttcgctatcaaaccagctccatgccattggcagaatactggcaaaccgccgaacaacaggcgcaaattgccctgaatgctattgatatgcaatacacaccagccatatcgccgtataaatctatccagcattattatggtttttcaccaactccattacagcaatgggcagaaaaagtaccgattgatgattctccccagcttttcattctggaagatgtgaccggtgccggaaaaaccgaagccgctctcactttaacccatcgcttgatgcaggccggagtcgcagaaggtttctattttggcctgccgacgatggcaacatctaacgccatgtttagccgcgtcgccaaacactatcgtgagatgttcaataccagcggcaagccaccgagcatcgttctggcacatggcgccagtaagatgaacgatgcattcaatgacatcatcctgacctctgaaaacagcgataacgactacaccaaagatgagatcacagcgacagcacaatgccatcaatggctggcggactcgcgcaaaaaagcactactggcacccgttggcgtagggactatcgatcaggcgctgcttgccgtcttgccccgaaaatatcagtcgctgcgtttgattggcttgaatcgtaaaatcctgatttttgatgaagtccatgctgcggatgaatacatgtttgccctgctggaaaatctgctgaacctgcatcttcatcaagggggatcggtgatattacttactgccacactttccctgaaacaacgccagaaactggcggatatctggctatcttccgcaggccaaacaccgcagaaactgcggcaaacggcctttccgttggcaaccaaaattacgctcactcctgaaaatccgattattgaacaacccctgcacagccgctcagatgtcagccgtgaagtcatcgtgaaaacactggactctctggatgcttgtgtgcaaaccgcccttaacgccgccaaagaagggcaatgcgtggtttgggtacgcaactccgttgatgatgctttacacgctttccgattgattcagtcacagatgaataatccagaagattgcctgttgtttcacagccgctttattttgcacgatcgcaagaagatcgaagatcttgtactggagatatttggcaaaaatagcacccaactgcatcggcaaggcaagattctgattaccacccaagtttttcaggaaagtctggatgctgatgctgacgagatgattgccgatatctgcccaatcgatgatttgatccagcggacaggccgcctgcaccgccatacccgcaatgctgaagggaagtatcagcaaggtattaacgatggtcgtcctgcccctgtgttgtatctccacgccccaaaatgggacgatcaaccacaagcagactggctgagtaaagattttcgcaatacccaatatgtttatcgctcaccggggcgcctgtggctggggttgcgtgaactgcggcgattgggcgccatcagaatgcctgccgaagccagaactttaatcgaagcggtttacagtgacgatgcgtatgaacacatacctgacaccttaagacataaggaaaatgaatttattggagaaggccacagcaaagaggccaaagcagaatcacagaccttgcgatggaaacatggatattgcaatcacagtgccagcggatggtatgacgatgacagcgatatcaacacgcgattcagtgatatcgaaacggttgaggttctgcttgttaaactgactgacaaaggtgcattaataccgtgggcgaacgagggaaaatttgccgttcaactcagtaccatcaggctaccaaaaaacaaatttgccgataagttactggcggttccagaatcgttttctcatgctgtagaacagctaaagagccaattcaaatctgctaaatacctgcaaatctggctgcccgaactcgaccccaatttcagttacgaccctactatcggtttttatgaaatccaccagcaggaggcatga

SEQ ID NO: 4602 - DNA, 789 bp, Xenorhabdus bovienii
  Coding DNA location: Contig name=SeqID_16897; Position on contig =118097..118885bp; Strand=+
atgaaccttattaaagacgcatggctgacctttaaaatgcgggatggtagtcaaaagaaactaccactggcggctatccgagatcccaacgtcatggattttgccctgccacgggcagactttcagggcgcggcctatcagttagccatcggcttgctgcaaacagtgtttgctcccgtagataagtttcaatggcatgatttttatgagactcccccaacacaagcagatttacagacagcctttgaccgcgtggaacatgcctttaatctgtcaggtaacgggccgctatttatgcaggattttgattcgctggagagcgtcaaatcaacgacgatttctggattactcattgaagcgcctggagcgaatacgctcaaacttaacaccgaccattttattaaacgcggccaatgtgaaatcgtctcgcctgaaatggcggctatcgcactttttaccttacagattaatgcgcctgccggtggtgtcgggcatcgtgtcggcttgcggggcggtggccctctgaccactctggttcaaccccaaacgctggataccccactctggcacaaactctggcttaatatcgtcaatcaagaatactgcggctatcccgaagcagacctccacagccccagtgtctttccgtggttaggcaaaaccaaactcagccagcccgccggtacggaaatttacgcttctgatgttcatgaactctatatgtattgggcgatgccacacggcgtatccgtctgcagatcgacgataaacccgctatttgccaactga

SEQ ID NO: 4603 - DNA, 879 bp, Xenorhabdus bovienii
  Coding DNA location: Contig name=SeqID_16897; Position on contig =118822..119700bp; Strand=+
ttgggcgatgccacacggcgtatccgtctgcagatcgacgataaacccgctatttgccaactgaccggacaacccaccgaacaatctgttacccgctatcgaacccaaaactatggcaacaactatgccggaaattggcaacacccactcacgccttataaatggaatccgaaaaaagccaacgacgatcacctttctatcaaagggcaaccgggagggatcacttataaactatggaatagtctggcattttccagaaataacgagggacaaaaagccgctctggtcgtcgatcatttccaccagatttgtgattattttgcagaggaacacagcgcaacaccccggctatgggtctttggctatgatatggacaatatgaaagccagaggctggtattccactacacttcccctgttttccatcgccgttgaaaaacaggatgtcattttccggcgagccagaaatttacagaccctttctgctaatgcactgagccaatgccgttcccaaatcaaaagtggttggttcaatcgcccaaatgatgtgaaaggcgatatgtcatttattgatgctgcgttctatcaacgtactcaaacggctttttttaaagcgatacaacagattatcagcagccagcaagcatcttcttatctctcgccagaagaggccaaaagctggctctaccaactgagaaatacctgtttcgatctgtttgatgaatatgtgctgtcagaaagcgtcgatccgaaaacgctgccgaaaaaagtcaaagcaaggcattttttgactcagtggttatttggtgccaaagagatcaaatcatttatgactgaataccaaatcgaacgccaacagaaagaggtgatcaatgaataa

SEQ ID NO: 4604 - DNA, 552 bp, Xenorhabdus bovienii
  Coding DNA location: Contig name=SeqID_16897; Position on contig =119693..120244bp; Strand=+
atgaataagttgagcgaaagtaccttgctgcgctggtgggaaagcatgtttctatcaccatcagaactgaaagctaaaggcagataccccgctccaacggtgtataaagcgcagttaaaacgctgccagaatatcgacgcggccatgttaaccggaggctttcgcaccttgtggctgagtttacaagaaagaaacgctgaaaccgtcgatgaaaaaaccatcataaaatgggcaatgattgccatgacgggcgtgcatgtgaaacacaatgtaaccacaacactggcaaccgcagccggcaccaaaacagaaaatgataaacctgtcgtcagtgcactccgcttcgcccaattgcagggcgccaaaacccccgacgaatttgttacccgcttacgacgcaccttgcagctcattgatggaaaagtttccatgctggatctggcaaaagatattgagcaatgggctcacgaatgccaccagcaaagaccccgtcgagcgaatcagcgtctcagcgtgcaatgggcgctggagtattacaaagcagcaaaataa

SEQ ID NO: 4605 - DNA, 1038 bp, Xenorhabdus bovienii
  Coding DNA location: Contig name=SeqID_16897; Position on contig =120272..121309bp; Strand=+
atgagccaatttattcaattacatctgctaacctcctacccgcctgccaacctgaaccgtgatgatacagggcgccctaaaacagccagaatggggggttttgatcgattaagaatcagctcccaaagcctgaaacgccactggcgagtctcagatctgtttcaatcagcacttgcgggacaccttggatttcggacaaaacgctttggcctcgaaatttatcaacaattgatcgaagcggacgttaaagaaaagcaggcgacagagtgtgcttctgccattgcgggtgtatttggcaaaaataaaaaagacacgccactggaaatagaacaactggcccatatcagccctacagaaaaagccgccacaatctccctggcaaaacaactggccaacgaaaatcgggcgccaaccaaggaagagttaagtctgttgagcaaagagagaatggctgtggatatcgccctgtttggccgtatgctcgcttccagccccgcctataatattgaggccgcttgtcaggttgcccatgccatcagcgtacatgatgtaatgattgaagatgactattttaccgcggtggatgatctgaacgacggcaaaagtgacacaggttcagcacacatcggagaaaacggatttgcagcggccctgttctacagctatatctgtatcaacaaaaccctgctgatggaaaatctggcagacaaccaaatcctggtcaatcaagccattgctgccctgaccgaagccgccgtcaaaatctccccttccggcaagcaaaacagttttggctcccgcgcctatgccagttatgttctggctgaaaaaggggaatatcagccccgctccttgtcggtcgcatttttgaaacccattaacgatgaagagcaggctgcgtctgccattagagcattggaagaacaggtcgaaaacttcgataacgtttatggtgactgtgctgacgcccgccatagtatcaataccctcaccggaaaaggcagttttgccgaactgattaaattcatcacgaattaa

SEQ ID NO: 4606 - DNA, 753 bp, Xenorhabdus bovienii
  Coding DNA location: Contig name=SeqID_16897; Position on contig =121322..122074bp; Strand=+
atgcaaacctatttggtttttcgattatatggtgtgctggccagttggggcgtagaagccgtcggtgaaagccgccccaccagcctgtatccgactcgttcagcgattttggggctattgggcgcagcactgggcatccggcgtgatgatgaaatgcgccttgccgagttacagcaaagtgtcaacatcgccatcaaacaaatcgtggccagttcattgatgagggattatcacacgagtcaagtcccctcccaaaacaacaaacagcaacacctcacccgtaaaagtgagttgggtgaatctgaactgaatacggttttatcctcacgggattaccgcagtgatgggctgtggatcatcgcaatttcactgaccgaccaagcccatctgacgctggcaaccttgcgtgatgcgctgttaaaaccggttttcaccttaagccttgggcgcaaatcctgccctctgtgcattcctatgatgccgcaaataacccgatctccctgtttgaaggcggctctggatacggaatttccgcctttaacgcagtcggagaaagccgatcactattggctgggcgacaacggtatcgtgagctatttctgggaaggggataaaaacgagattgagatccctgatgtggcggtattgaccagccaattgtgggacgaaccgctttcacgaacccgctggcagttcacccaacgtactatgcaccaattatcactgatggagaaggcacatgtacctgtctaa

SEQ ID NO: 4607 - DNA, 675 bp, Xenorhabdus bovienii
  Coding DNA location: Contig name=SeqID_16897; Position on contig =122061..122735bp; Strand=+
atgtacctgtctaaagtcaccttacgaccttctgcctatcgggaacagtttttgtcaaaaatggcgaaaaacagtgtttattcttcccaccagctattgtggcaactgtttacggaacaggcagagcgcaattttctgttcagggaagatatgagcatcaacggtacacctgagttcttcgtactgtcccatacagcgccaacacccaactcggcgatgttccagattcagagcaaggcatttaccccgcaattacgcagcgggcagaaactggcgtttaagctccggctaaatcccaccatctgcatcacagataaggattccggcaaacagcggcgtcatgatgtactgatgaatgccaaacgtcaggcacagttggcgggtgttagcactgacgaaatccagccgctgatgatgcaggctgtacaggcatggatacaggatgaaaaacgactgactaactggggtattcagtttgatttcgatcctgatgttgaacgctatacccaacatcgctgtcgcaagccttccggccagaaagtggcattttcgagcgttgattttcagggcgtgctcaccctttcagatcatgaactttttctggcgcaatacgctaagggctttggtcgggcgaaatcctttggctgtgggatgatgctgataaggactctgtaa

SEQ ID NO: 4608 - DNA, 219 bp, Xenorhabdus bovienii
  Coding DNA location: Contig name=SeqID_16897; Position on contig =122643..122861bp; Strand=-
ttgaatgtttcggctagtgactttagtaaaaacaattttgtcctgatgagtctgagtcatggagaacactcaaacatttcgcagacgaaatttcagaagggtagtttaaatacctacggggaacacttacagagtccttatcagcatcatcccacagccaaaggatttcgcccgaccaaagcccttagcgtattgcgccagaaaaagttcatgatctga

SEQ ID NO: 4609 - DNA, 993 bp, Xenorhabdus bovienii
  Coding DNA location: Contig name=SeqID_16897; Position on contig =122954..123946bp; Strand=+
atgaccttaactaacttcagcaaattgttagccgctacactttgcctcgcgacttcatacagccatgcagatagtgaacgcccacttttttcattaacgatggcagagtctggtgttcagaagacaaatagcgatggtagtttatctcattctacaaaatcagaatctcgcattctgccaatttggggtgatgaagcgcgagctaaaggctacgatctgcctgagccatttggcgtaagttatggttatatgaatctgcgccaagatatcattatagacagcattaaatttcaatttaccaatccattaattgaagagcgttggaaagaccaaattattgttaatgcgggtgatacccgggaaagaaatgaaacccatatgctgaaactggatacatgggttttacccttcttaaatgtatatggtgtctatggaacaaccaaaggtaaatcaaaaacaaatttagataacattgtcgcttttggcgatgatgaaacctatagaaatattccttttgaactgagttttaaagggaaaacttatggtggtggagcaactttcgctggtggttataaccaattttttgccacgttagatgcaaattatacccgaaccaatttggatattttagacggtgatatttccgccttcgttgttactccacgcgttggttatgagtttgtttttgaaccgctgtttactggtcaaggaaacgccaaagttcaggtgtgggtaggtgccatgtaccaagatatcacccagcgctttaaaggtgatgtcagtaaactcaatttaccctccgaaatatcagagttatttggcatggttcaaagccaaaccgatatcaaattcgacgtcgaacagcaccttgcacataaatggaataacaccgtgggtgcgcgtttcgaaatcactcgtaacttcaatatcctatctgaagtgggtttcggcaaccgaaacagcctctttgtttccggtgagtttcgtttctaa

SEQ ID NO: 4610 - DNA, 1140 bp, Xenorhabdus bovienii
  Coding DNA location: Contig name=SeqID_16897; Position on contig =123958..125097bp; Strand=+
atgacaatcaagaggctggtgatatccagccttcttatttttaccgcatcatcagcacaggctgatatcttgcccgatcggcaaaaaatcgatggttggctcagcgaattaggcggcagtaatcaattcgatgccagcaagaaggttgactggggcgtgctgcccggccctttttacacccctgaaatgggaatgggcattggggtcgctgtagtcgggctttaccgtcccgataactcagaccacaccagccagacctcctcactgggtctcagcggttttggttcatctaccggcgcatttggcctgaattttaccaattataattttctggctcgtgatcagtggcggttatttgtttccgggacgctaaataacacgccgacttactattggggcaagggttatgacgccggtaaaaataatggcaataaagaaaaatatcgagctcaggaatttgatattcgccctcgcctgctctatcgcgtgacagatgctatgtatatgggattaggctggcatttctcatccctcaacgccagtgatccggatatcggtgccgcaaaatatttcgcgcagtccgtcggcggacgctccgtcatcagttccggtgtaagtgcatacttcagttatgacacgcgggatttcctgcctaatgcaaagcacgggcaagcatttgaaatcgtttatacccacttttccccagaattagggggagataatcgtttcaataccacacagttacagttttcgacctatcaccagctatccgaaaaatccgtgctggctttcgataactatgcccgtttcagctctggcgatgtgccgtggaatcaattatccctgctgggcagtagtcaacggatgcgcgggtactatgaagggcgctatcgcgataccaatatcttcacatcacaattagaattaagacataaacttgactggcgccacggtattgtcggctggataggcacaggcacattaagtgattccccttcaaagctaggtgcaaagcactggcttccttctattggtgtgggctatcgtttcgagtttaagccacgcatgaatgtcagattagattttggtgttggtaaagacagcactggattctactttcaggtaggggaagcattttga

SEQ ID NO: 4611 - DNA, 1128 bp, Xenorhabdus bovienii
  Coding DNA location: Contig name=SeqID_16897; Position on contig =125106..126233bp; Strand=+
atgacgctattattcagcttcctgctcatggcatgtcagggtaaatctgctcccgtcatgcctgtagagcctgtactcgtcagtgatactcaagaacagccagagctcgactggccagcgttgacccctattgaaccacctgaaggcttaagagcctgctgcgcatttggttacgatcttaaaaccgaggtggtgggggttcccgttcctttctatgatatcgacaatatcgtggaggccgagaaactgggagaacatcactataacgacagtgctctgggtgccagtgccgctttattggggataagcaatgaaaaaatcggtctgttatatacccagaaaggcgggtttattgatatctcccatgtgagagataccgcagactatacgctgtatctctttagccagatttatgctcacctgggtcaggagcgggaattaagcctaagtaatgagcttgcggcgcgtaaaattcacttttttgcctttactccgccggtagatctcgttgagcgctacaccttaagcgcttatttagcggcaaaactggcatttcagttggcggcttggcacgaaatcgcccaatggtatggctatcaatcagtcccagggttccccgagggcatttccgcgttttccccggaagacctctattccaatctcttgggagcaaggctggctctgaccctgatcctgcaaggtcatgcttcttcggtgactcaatttactacctcaatggcagccatattgccttctgctttgcataaactcgaaccttattccaaatcagacacaaaaaagatgtttaatcagatcgacgggctatggtggaatagtcatgaacgtattccgcaaaaatttttagtcctgcgcaggaattatgaaacccaagacaatcgttatccattaatgccttcaggcaaagaaaagtttgcgctgcgtctgtccctgcctgatgaatataagccgttttcgctggataaattggctgagctacagttatggccaaccgaacagatgaaaaacttacctgttcccaattcctattggacaatgaaagactttaacatgctggcagaacatgcccagcatgaagatgcgcgacagttgttattgagtagcaaataa

SEQ ID NO: 4612 - DNA, 531 bp, Xenorhabdus bovienii
  Coding DNA location: Contig name=SeqID_16897; Position on contig =126301..126831bp; Strand=-
atgaaccttttagaattggaagacaaaacttcccgaaatagaaaggttgttgaaactatgccagattcaaaagtgtttgttgataattacttgcctgctttgcttgggcaagcatggatgctggtttcttctgagtttcatgacatcgttgaggcacgggggttgtccgtgctggagtggcgtgttttatcggcgctggctggaagtggcccgattggtattagcctgctggcgcaaaaaacagtcagtaaacaaccgacaattacccgagtattgcagcgtcttgaattgcaggggcatgtcactcgtttttccaatggtggtggagatcgccgtatcacgttagtgcatcttaccgacagcggccgacaagtggtggtcggattactggcagaagcagaatcccatgagaaaagtatactggagccgctgggaagcggtaaaagtcagttactgaaagaggttttgcaggaactgattaagcggcatacgccgatgcgcagggcgttggggagattcgggaaagagtaa

SEQ ID NO: 4613 - DNA, 114 bp, Xenorhabdus bovienii
  Coding DNA location: Contig name=SeqID_16897; Position on contig =126909..127022bp; Strand=+
atgcagcccaagttgtttcaatatcatgcaggctatcgtaatagatggggagataacgagcgtgagacgtttcagcgccggatacaaagcccgttatggtcagatgccgagtga

SEQ ID NO: 4614 - DNA, 96 bp, Xenorhabdus bovienii
  Coding DNA location: Contig name=SeqID_16897; Position on contig =127044..127139bp; Strand=-
atggcttccctgccacgctgcaatgagattaatgttatgtctaacgtagcccacgcgataacgatgggctgcgttaaattttgtcatataaattaa

SEQ ID NO: 4615 - DNA, 1188 bp, Xenorhabdus bovienii
  Coding DNA location: Contig name=SeqID_16897; Position on contig =127114..128301bp; Strand=-
gtgagatcaaccacaagtcacacgggtgaaacaaatgctttgccattagcgtcattgcttgcactggcaatgacgggctttttggcgctgatgacagaaactgtccctgcgggaatgttggcgcaaattagtatgggattgaatatttcggaatcgatggcaggacaatttgtcacgttgtacgccattggctctgtgattgcggctatcccattaacgacggcaactcaaagctggcgacgtcgtccgcttttattggtagttttaggcgcgttgtttgtttttaatacactgactatattgacatctaattatacttttgcgctgattgcccggttatttgcagggatggccggaggtttgatttggggtatgttggcgggttatgcgcgccggatggcatcagaaccactaaaagggagagcgcttgccattgccggggtaggagcaccactggcactttcattaggcgttcctttaggggcatttctaggctcactgattgggtggcgcatgacgtttggcctactctcattgttgactttagcggtcatggtttggattcgtttacgggtgccagattatcccggacaatcatcagaaaaacgtttatcgataagatcggtatttgccactccaggtgttcgaccagtattaacggtacttattttctgggtgctggcacatagtattctttatacctacatcatgccatttcttgctcctgcgggtctttcccatcgagttgacataattttgctaatcttcggggcttcttcagtccttggcatatggttggttggggtattgatcgataaatatttgcggtcgcttgttttgataagcatcggattatttgctttggtcgcactggcattggggcttgcgggtattttgcctgctgtaatttatatctctatggcgatatgggggctaacttttggcggagcagccgcgctattgcagacggcctctgcggatgctgcgggttctggtgcagatgtcgctcaatcaatcttggttaccgtctggaatttatcgatagctgctggcggtatgttgggaggcatattgctagacactcagggtgttcatatcttcccttggactttgcttggattgcttgtggtgggattgataatcgcttggggagctaaaaaacatggcttccctgccacgctgcaatga

SEQ ID NO: 4616 - DNA, 924 bp, Xenorhabdus bovienii
  Coding DNA location: Contig name=SeqID_16897; Position on contig =128468..129391bp; Strand=+
atgacaaatatgtcatcaataggaaaacgagtaatggataactttagcgtccttgaagtgtttgttcgagtcagtgaagtacggagtttcacggcagcaggcaatcaactcggcgtgtcatcctccgctataagcaaggcaataagtcgcctcgaagaaaagctacgcgtacgacttttccaccgttccacacgcacagtgaccttaactccagaaggtacactttttctcaaacgctgccgccgcattctgaatgaaatagaagccgcagaaaatgaactttcccagtcacaatctgtaccgtatgggaagttaaaagttagtatgccatcaattggcgtactctttatgcccaagtttgccgagttcagtcagcagtacccagaaattgaattagaaatagacagcactgacggcttagttgacttaattgaagaaggattcgatgccgtaatacgcaccggagaacctgctgattcacgattaatggcgcgtgtactaggctcttacaaaagagttatcgtcggttctcccacctactttcaaaaatttgaaatacctaaaaaaccagaagaactgattaatcatttctgcatgatgtatcgttataagagcacaggcaagctggatatttggccaataagtcaagataacccaactttacagctagaatggcctaccagaatggtaactaacacacttgaccctctcgtgtcttttgcagaaaatagtcttggaattacttgtattcctgatttagccatcagagaacagttgaaaacaggaaagctgataacaattctgaatgatttcaataatgacataacgacatgcaggatactttggccttcaagcaaatatttatctcccaagttaagagtatttatcaatttcatggtcgaaaatctatttaagaatgaatga

SEQ ID NO: 4617 - DNA, 1710 bp, Xenorhabdus bovienii
  Coding DNA location: Contig name=SeqID_16897; Position on contig =129445..131154bp; Strand=-
atgaaaacaatggagtcaagtgaaaattacacttttgtaattattggtcaaggtactttagctgttagatgctgtcaattcttactttctataggtatccatcttgaggtagttatgcctttagattcagtatttctttcatgggctaaaaaagaaggtttaaaatgtatcaatactattcaggatttagaatctttagtatctaacaactctgttgaatggctgttatctatatcaaatccaatcattttaacctctgcactattagataatattaaattaggtgcatttaattatcatgatgctccgttacctaaatatgcaggaactcatgcgacttcatgggctctttttgcgatggaggataagtatgcagttacttggcatcgaattgctaccgtggttgacgcgggagatatagcagttcaacaaaatgtagaaattaatcgttctgacacagctctttcattaaatatgaaatgctataatgcggcatttgaaggatttaaaaaattaatatcccttattaaaggagggaaaaccatagaatatgtgaagcaaaatttatcagagagaagttttttttctagtcggaaacgtccatatgctggagcatgtttacagtgggaacattcggccgaagagctgtcagctttagtacgtggtttgtctttcggtgagcgttatcgcaatccgttatgtgttccgaaagtttatttgataaatattataggaatagtgaaaacacttgaagtactttctgtctcaacacataagcaggcaggtattttagtggatatagcacaaaatttctggattgtaactaccggaacaacagatatcagaatagaatttattcaattgaccggggaagatttgcgggcagattttttggctgatatgctttgcataagcgttggtgattcattaccaatcattaataattctgatttagaagatttaactcaggaacatgaggagttagcgccatatgaatcattttgggttaatcgtttagaatcatgtagaccattaaatttcaaatttgacactctgtatcatgacttagattgtatttttgaaatatattataactggaatttttatattgacattgaaaatgttacaagtgaagaaagattggttaatatattgggagcattcgccgtatatttagcattggttaatgatgttcaatattttcatttagattgtgtaactgaactgcctaaacatgaggttatagattactctgtctttttttcagcttcagttccttttgaatttaatattgactttaattgctctgcattgaatttatatagttctatatcagttgagcgttctatacttaataaatttaaaactttccataaagatataatttttcgatatccacaattacgctcaactgaatctgtgtattcaaagtatatctgtaatgttagaattagcattatagatttcataaactcagaagttaaaccagcagcctctcaattatatgaaaaaaacaatgcttctctgacaatgcaaattgatccggttaagggggcttttcgttggatatctaattcatcacatattgaaagtgctgatttaaagagaatggctgatcatataattagtttggataggctccttttatctaattcaaatcttcctttgaagagtttattatctcaatgcggaacccttggaattatttag

SEQ ID NO: 4618 - DNA, 2802 bp, Xenorhabdus bovienii
  Coding DNA location: Contig name=SeqID_16897; Position on contig =131234..134035bp; Strand=-
atgcattcagtaacacaaaataaatcttgggaaaggctattgaatctaaagggatttgaattagatattcgagaattagtggaactaaaaaattcattatcttatgataagataagtatatcttggtctactagtggtcaagaagaacgttttgaatatgccattgatcaatgtttgccaggcctttttttatcaagtgtacgccatataccggataatgtcgctattgtggatggtgatgataaactctgcttctggcaattggcacatcttagtttgcatgttgcaaattatttacgctatctgaattgttctacagatgaatgtataggcctttttgttgaaccatcattagaacaattaattggggtatggggaattattttttcgggagctgcctacttggcattggcaccagattacccacctgagcggttgaagtatatgatagaaaattcttcaatgaaatatatatttgttcaggaaaaggtaaaatttaaaattttagatattattagtagtgatattactttaataacgattagtgatgtcattgattatgtgaaaatgagtgcgaagacaaaatctgctcctaaaccaagggagctacaaccagaaaaccttgcttatattgtgtatacatcaggtagtactggaaaacccaaaggagtaatgatagagcaccgttcaatcgttaaccaaatgctatggttgaataaaaaagggtttttaagcagggataaaaaaataatacataaaacatctattagtttcgatgccgctcaatgggaaatgctatctgtttgttgtggtactcagttaattattagtgattttagtataaacaaaaatatttcgaagttagtagatgatattatagaaaataatgtctctttgttgcagtgtgtaccgactttgttgcaatcgctggttaataggcataagtttgcgaaatgttcatcactttcacatattctttgtggtggagaaagtttaacaaagaaattagcgctgcaatgcttggatatattacctaattgcgaattgattaatgtctatggtccgacagaattcacttgtaatgcatcattctataatgtttcaattggaataaaaaaagaacatcatgaaggagtatcaattggtagaccggttgataatactgagtttcatattttagatgaaaacggtaaatctgtttccagtggtaattctggtgaactctatatatcaggcattcaaatttcacgaggatattttaatcaggaagatttgactaataaacatttcttttctttcatcccaacgggatctaatacgcctattatgtcctataaaacgggagatcttgcttatcaaaacatggatggttcattttatttcattggaagaaaagatactcaaataaaaattagaggtatgagagttgaattagaagaaataaaaatagaattagagtcattacctttaattaatattgctgctgtaatgaataaatatcatgatgttagccaatctattctgatggcatgtgttgaactcagtacagaaggagtgatattaaaagaaaatcacgatcatcaagagttagtttctattctaaaaaaagagttggccagacgtatccctgattacatgattcctactttattcttttttgttgatgttatgcctttaacaataacaggaaaaattgacttttataaaattgaaaatatttttggcaaggagaattttaaagaaaaatatgaaccaaaatctataaacgagagagtgatacaaagtatatggatggaatgcctgaaaaaaaatagtatttctgtttgtgatgacttcttttctcttggtggtgattcattgagtgcggtagatattatacaatcaataaataataaactaggttctaatttgccacttcatattttatttgaagcgtcgacaattgaaaaactggcttgtttagttgatgtaaatcgtaataaatattctgagagattggtttctctacagccacatggggcgttatcatcaattttttgttggcctggattaggtggatatcctatgagccttagactacttgctgaaaaaattggcaaagttcgtcccttttatggaatacaggcgtttggactaaatgaagatgaacgaccatatggttctatccaaaaattagttcatgctgatattactgcaataagaaataaacaaccacaaggcccttatgtcctttggggatactcatttggaactattttagcttttgaagctgcttatcaacttgagcagttgggggaaaaggttgaagaacttgtactgattgctccaggtatgactaaaggacattctttacaactccagtcatcagataaatctagtggctatgagaataaaagtttggtctctctgctattttcagttttctcaagaagttcagatgatcaagatttattggaatgtttagactatgtaaatgatgaggatgatttcgcaagttttattagtaaaagacattcaggattaagccttgatctaattaaaagaatttctagagttgtcataactacctctgaaagcttacgttcggaatcggaaagtatttttcatgatagattaattactgcccctgtaaaaatatttagcgctaagagcgatcaattgtcttattttgaaaccaatagtaattgttttattaatattcctgatgttgtcaagattaatgtacctcattttgagttactaaaagagccagggattaatgagttactgtcaaaaatgcgtatgttgattacttggatgtaa

SEQ ID NO: 4619 - DNA, 1533 bp, Xenorhabdus bovienii
  Coding DNA location: Contig name=SeqID_16897; Position on contig =134074..135606bp; Strand=-
atgtgtggaattgcagccatttttacgacaaaagaaattttaattgaacaattgaatagtaagcttgtctctatgatagaaaggatgaaacatcgaggagatttatctcgttttaatgaacacctagttaaaaaatactttgggattgccacaaatcgcttggcaattgtcgagagagaaaccgcgactcaacctgtttcagacgaagaaagggatattcatgtcatccttaatgggcaaatattcaattataaaaaaatacgtgaaaaacttatcaaaagaggacacgaatttaaaggatatggagatgcagaggtaatattaaaggcatatattgaatatgatttagaatttgtaaatatgctagatggaatgtttgcatttgtcatatatgataataaaaaatcaaagtttctgattggtagagatcacgtgggtataaagcctctttactatgcaaaaaagaatgatgtttggtatgtggcatcagagatgaaagcttttctagaacttgatgttgaagttaagacacttgagcctgggagtctttatgatggcaatgagctttataagtatactcgctatgataaatctatagaaaaaagtaaggattgttatcttgtagcaaaacaaaaagttcgtaagttgatggaagaggcggttgagtctcaagttgacactgatctgccggttgctgttatgtttagtggtggaatagacagtgctattatattggctttagcaaataaatatcattctaatgttactgcaatttcgtttggtttacctggctcagacgatatcaaaatatcaaagagattttgtgaagaaaataaaatacgtcagataatatatacatttacagagcaagatttaattgatgatattgatagcgcagtatattatggagaattcttcgaaaaaatagactcagtagactctattatagcaaattttggttatttgattgctaataagcttggttttaaagtcgctttatgtggagaaggaagtgacgagattttttgcggctatgatttattcaaaacatatccttttattgatgagctttcactttatagattaaataatttacatcgtactgatttgcagcgtgttgatcgcgctagtatgcgtaactctgtagaagcaagagtaccctttatgaataatcaagtggtacgttatgcactaagccttcatgaatcattgaagataaataatggagttgaaaaatatatacttagagaagcgttccgagattttctgccagattacattattgacaggcctaaaattagaatgccagatggcagtggtgtaaagaatatattaattgattatgtcaatagcatcgatctacaaattcctaaagaggtgctcaggatgctagaaagtattggtttgaacgataaaagttctttttattttgcaaataaatatttaaataatggatatcatttacctgatgaaaggtttaaaaaactaggaaaagattatacagcatcaggatatttcgatttcatatcttag

SEQ ID NO: 4620 - DNA, 1332 bp, Xenorhabdus bovienii
  Coding DNA location: Contig name=SeqID_16897; Position on contig =135640..136971bp; Strand=-
atgtctaaaagaattgataaagatagtaaatttgttgaggtgatttattcgaaacgtttacagggtacacttaatttaccagcttctaaaagttcctcaactcgagcccttctaacttcttctattacttctggaaaaagtattatcagaaatattgctactggttttaataccatagcgatgaaatctaattgtgagcgattgggagctgttttcaaagaagataaagataatttgatagtaaatggaattgacgtgagttctatcaaccagcctttagagttaaatccaggtaactcaggggtagtactgaggttattgatgggggtagcgggtttcttaccagagacaaaattcataaccgactatcacgcctctcttggagttcgttctcaaacagaaatggttaatgcgctctgtatgttgaatgttcaatgtagagcattgggagaagagcatcgacttcctatcagaattaagtctgatagaaagttaaatgattatacagaagtatcttgtagaaaaagctcacaatttttaagtggattactatatcttggagcagtgatggataatgacttaactataaaggtagtcgacaaaataacagctccatcaatggttcatacaacaattaataaccttaagaaagcgggtattagaatcgaatatgatagtgattttcgtgaattttttgtacatggtcgatgtggattgcaggcaagtgattttacagtaggttctgatccagctagcactgctgcaatccttgcgctttgtggctccctcgaatcagaagttcaactgaatggtttcttcgaagaagaactgggaaatggtgctgtaattcaatatttaatcgatacgggaactaatatcgaatttattgggaatgaaacgataataattaaagggaatacagaaattcgtcctttagattttgacggttctttggctcctgatgcagttccagcgttagcggctagagcttcattagcctctggtacaagtattttttataacattgagcatatccgttataaagaatctgatcggatatctgattttagaaaagaattatcaaaactaggggtaaaatcagatgaaaaacatgatcaactcatcatccatgggaatcccaaaggatataaaggcggggtggttctagatggacattacgatcatggacttattatgggcctcacaacaatcggccttcattgtagtgagcctgttctgataaaagaaccatttcatgtagggcaaacttacccagaatatttttctgaaattcgttccttaggtgcgaaagttaatgaactggctaaatga

SEQ ID NO: 4621 - DNA, 1302 bp, Xenorhabdus bovienii
  Coding DNA location: Contig name=SeqID_16897; Position on contig =136998..138299bp; Strand=-
atgagcaaggttactgtttttccgagttttggcctgactggtgaagtttttataccgtcatctaaacctcatattcagcgtgcattattactagctttactgaatgaaaatacaacgagaattgttaatatatcttggaatgtagaaactgaaaatcaaattaatgctctgaaaaaatttggtctaaaaatattacacaaagatggaacaacactgttacttcgtggtgtaggtagaaatttatcgtataatggggagatatatgtaggtggttcaggcatgttattcagaatgtgcgcagctttagcatctctcattgataatgaaaaaatagtaataaaatgtaatgaatctttatttaatagagagagtgtgtttgacgaagatttctgtaattatttggatattcatattgaacgtattgaaaatgaaaggattataatcactaagagtgaaactaatataaaaaacccattgactgttttgaatagcactcagttcattacgtttgctctatttgttgctcctttcagcaaacaaaagatagtccctatagtcttggacggcagtaaaatgggctatattgatatgacgataaaatcaatgttacttctaggaagcatagttacatacgaacaaaaacactttaaagtaactaaatatatacctaaagatattgagataaaaataccctctgattttacatcattaagctatatagcctcttctatattaagctcaaaaggtgctagtgatgtactgataagaaattattattttaatgacacaataaatgaacgtgatttatttaaattttatcaaagtataggtctaattattacgtatgattcaacttggaataatttgagaatattcaggcagtcgattaggttatgggatggtgaattttctttgaaagagctcccttcagtagccgtaaacataattgctgcttcatctaatttgaaaggaaataaaatttttagtggggtaagaggaataaataatcataaaagtcaacgagcatttattgttaatgagaatataagaacaatgggagggaatagtgttctaatatttgatagggtaggaatgtttgagtcaatatatattgaaggaaaaggaccgttgaatggaggagttgaacttaaaagttatggtgaccatagaatttgtgctgctaatctcatcgcatcgctcggtgctgaaaaagaatccataatatacgatatagataaattaaatgatggatttcccgattatatcgatacgctgaggaatttaggcgttcatattaaatag

SEQ ID NO: 4622 - DNA, 168 bp, Xenorhabdus bovienii
  Coding DNA location: Contig name=SeqID_16897; Position on contig =138599..138766bp; Strand=-
atgttgtacggcggtaacaatttagccagcgcggcagatttatgctcgggtgaaatacgtgtcatttttttctctatcagtgttgttaatggggatgacaactatgctgacagaaagggtttttttccaaccacttatcgtcttgatgagaaaaactcaggaaagtaa

SEQ ID NO: 4623 - DNA, 456 bp, Xenorhabdus bovienii
  Coding DNA location: Contig name=SeqID_16897; Position on contig =138742..139197bp; Strand=-
atgtcgacgctgattaattgtaatagaattagctttagcgttaattcaaaactactttttaaagagctctccatcacaatcaaagaaaacgatcgcattggattagtaggctataacggaacaggtaaaacacatttactgaaattactggcaggtattgaaacacctgatgagggattgattgaatacgtcagtgggctgagattagagacggtatctcagtttattgatgactcattgcttgagatgtccttacttgaatgtatttcccggaaagtaaaacaattcgatgaatatgcggattataaagccgtatcagtgctgcatagtttcggtttccaagaggcagatttcagcactaaggtggctgatttaagtggtgggcaaaagaccaaactcatgtttccatctgtgcaactgcggcgacagtcatgttgtacggcggtaacaatttag

SEQ ID NO: 4624 - DNA, 147 bp, Xenorhabdus bovienii; identical to SEQ ID NO: 349
  Coding DNA location: Contig name=SeqID_16897; Position on contig =139360..139506bp; Strand=-

SEQ ID NO: 4625 - DNA, 1275 bp, Xenorhabdus bovienii
  Coding DNA location: Contig name=SeqID_16897; Position on contig =140047..141321bp; Strand=+
atgaaattagaaactctatccattcatgcgggttattcgccagatcctgccaccaaagcagttgccgttcccatctaccagacaacgtcttacgccttcgatgatacccagcatggggctgatctatttgatttaaaagttgaaggtaacatttactcccgcatgatgaacccaaccaatgatgtgttggaaaagcgcattgcggccttggaaggtggcattggtgcactgtctgttgcttcaggtatggcagccgtcacctatgctatccaaaccattgcccaagcgggagataacatcatttccgtggcaaaactttatggtggaacctataacgtgatggcgcacactttcccaagcatagggattgagacccgtttcgttgatcacaatgatattgcagccatcgaagcattgattgatgagaaaaccaaagcagtgtattgcgaatccatcaccaatcccggtggtcatatcattgatatccaagcaatggcagatgttgcccataaatatggtatcccgctgattgtcgataataccgtcgcaaccccctacttatgccgtccgtttgaacatggtgcagatatcgtcatccactctctgaccaaatacatcggcggtcatggtaccaccatgggcggtattatcgtcgattcaggcaaattcccgtgggcagaacatcaagatcgttttgctattctcagcacaccggatgcgtcgtatcacggaattatctataccgaacattttggtgcagccgcctatatcgcccgctgtcgtgttgggccactgcgcagcactggtgccacactttcggcattcagtgcattcctgatcctgcaagggcttgaaacattagcgcttcgcatggaacgccatactgaaaatgccttgagagtcgcacaatacttgaatgagcatcctcaagtatcttgggttaaatacgccggattgcctgaacacccagagcatgaattggcggtacgttacatgggggggaaaccttcgtctgtgctgtccttcggcatcaaaggagaagaagaagccggcacacgtttcattgatgcactggaactgatcgtgcgtctggtcaacatcggcgatgccaaatctctggcctgccatccggcatcaaccacacaccgccagttaaacgatgaagaaatggtaaaagcgggtgtatcacgagatttgattcgtctttccattggaatagagcacagcgacgatattattgccgatctttcacaagcgttagatgctgcaaaatag

SEQ ID NO: 4626 - DNA, 975 bp, Xenorhabdus bovienii
  Coding DNA location: Contig name=SeqID_16897; Position on contig =141404..142378bp; Strand=-
atgaattttcttccagattatcgtgatgtagtagaagcgcattcccgaattaaaaaatatatcaataaaacccctgtttttacgtcaaggactgttaaccaaatcttcaatgctgaagtctattttaagtgtgaaaattaccaaagaatgggagcattcaaatttcgtggagctatgaatgcgttatatcaatttagtgatgaacagaaaaaagcgggagtcgttactttttcgtctggaaatcatgcacaagctatttctttggctgctaatttactcaatattcctgctactattgtcatgccacaggatgctccgaaggccaaaattgcagcgacaaaaggttatggtggtaaagtagtaatctacgatagatatactgaagattgtgaagaaataactcgtgatttagcgaatcagtacggtttaacgtttattccaccttacgatcatccacatatcattgctggtcaaggaacatcaactaaagaattgtttgaagaagtgggagaattggatgccttgttcattcctcttggtggtggagggttattatcaggttctgcactttctgctgttcatttttctccaaaatgtcggatttttggtgtagagcctgtagcaggtaatgatggtcagcaatcttttaaaaaaggtgaaattgttcatattgcaacaccaaaaaccattgcggatggagcacaaacacagcatctaggaaaatacacttttcctattattcgtaatctggttgaagatattctggttacttcagatgatgaattggttgatgctatgtactttttagcagaacgaatgaaaacagttgttgaacctacaggatgtttagggtttgctgctgcaagaaaggtgcgggaagagttgaaagggcaacgaatcgggattattcttagtggtggaaatattgatatggaacgatattctaatttattatctaattttaataaaatctga

SEQ ID NO: 4627 - DNA, 408 bp, Xenorhabdus bovienii
  Coding DNA location: Contig name=SeqID_16897; Position on contig =142805..143212bp; Strand=+
ttgttcgttttacttatctattgtattttaattacgaacaatcaaggaggaaaccgtggcttttttggttatgattatcgaaatctgcaagtcgatcctgagtggaaaccaggtgaaaaccaagctgtatcactcgtgataaaagcgggccaatgcgtgatcttctggtcaaccttgatgcatgcttcttaccctaatacttctgagaaacactatcgtatgggatttactacccgctatgcaccaagctatgtcgatatttatcccaatactgattatgtctacgaatatggtggcaatatcccacttgataaatttggctgcgtgatcgtgtcaggtcagagccgtaacaccaacaaccggattgcttctcataacttgctggatcaaccccttataccactatga

SEQ ID NO: 4628 - DNA, 684 bp, Xenorhabdus bovienii
  Coding DNA location: Contig name=SeqID_16897; Position on contig =143227..143910bp; Strand=+
atgactcaaatccagtgctatctcaataatacatactgtttcctctccactggcgaagttatcgccagtggttccgatgaatggggacaatggattgctctaaataacaacctatttcatccacaaggcggggggcaacccgccgatattggctgggtgaataatgtccccgtgaaggttagaaagcaggctacagggcagatagccgtgtatccggaatccacacttcatgccccactgggtgcacaattgaattcaaaactatcagaagaggcccgtatatgtcatgcagcactacacactgctggtcacctgctgaactgggaaatgcgtcaatatggctggatggcaatcagcggccaccactttcccggagagtcacgcgttgagttctctcctataggctccagtgccatacctttcgatcagctatctttacaaaatatcgaaacgactatcaacactaaactacgtgatggcgggcaagtaacaacttggtatgaagcggatacccggctgtgtttaattgaaggcactgaacccatgccctgcgcgggcacacatgtcgataatctgaacaaaatcaataaatttaccattaagtcggtcaagttcaaaaagggaactctacgtatcagctacgatgccagccatattattttaagggctgacaatgtctcatga

SEQ ID NO: 4629 - DNA, 918 bp, Xenorhabdus bovienii
  Coding DNA location: Contig name=SeqID_16897; Position on contig =143900..144817bp; Strand=+
atgtctcatgatgtattacctctatcccgtagacggctttatctgctagatctgggactactggctgttgccctttcttggggtgccagctattcgctgatgcaattgatcattcaagccgggctgactgtaccgttatttttgatgctgcgctttgctctatctgtaccttttatgtttcttggcactcgggtacgcctgcgtaacatcaaaccaggggaaattattaatggccttatattcggctgcctgctgtacgccatcctgacgtttgaaaccttgggagttaagtacactacagcatccaatgctgggttccttatcgccttgtctgtcgttatcgtccccttttttgaacgtatatttagaaaacgtaagcaaagtaagtttatttactttacctgttttatttctttagccggcggtgggatattaagtttttccgatacaggcaactttggctttaataacggtgactggttgatcctgcttgcagcgctgatccgcggtttccaaatctttatgtttggtaagcagacatccggtaaatcctactcattggttaatatcaccctgattgaactggtgacagtctccgtacttgggttagcctttgttttaatgactgacacagcatccctgcacctcattccaaccattacattcgatgtttggggatatattctgtttctgagcttactggcaactgcttttgcttttctgctgcagctctatgcagcaaaaaccaccagtcctactcgggttggcctgattttgtcgttggaacccgcatttgcagccctgtttgctgtcgcaattatgggagaaactatcggtattttgcagagcttcggcggagccattattgtctgtgccgctctgctaggacgtatcgtggaaggaaaacgctatgagtaa

SEQ ID NO: 4630 - DNA, 165 bp, Xenorhabdus bovienii
  Coding DNA location: Contig name=SeqID_16897; Position on contig =144892..145056bp; Strand=-
atggttcatgatggtgtcttaatgttacgactttcaagcgatgaaagtgtgatattaaatcccggtgacttttatgcattctctggtgatgtcatacattcctatatatgtattgatgttgcagttagtgcaacagtagtcatgtcttattcaattcaaagttaa

SEQ ID NO: 4631 - DNA, 111 bp, Xenorhabdus bovienii
  Coding DNA location: Contig name=SeqID_16897; Position on contig =145048..145158bp; Strand=+
atgaaccataatgtgttcatgagtccctactgtatgagcgggactactaataataagttaatcaatgaaattatctgcacttttgttatagtcggtaatacaatacactga

SEQ ID NO: 4632 - DNA, 441 bp, Xenorhabdus bovienii; identical to SEQ ID NO: 2208
  Coding DNA location: Contig name=SeqID_16897; Position on contig =145175..145615bp; Strand=+

SEQ ID NO: 4633 - DNA, 537 bp, Xenorhabdus bovienii; identical to SEQ ID NO: 2180
  Coding DNA location: Contig name=SeqID_16897; Position on contig =145641..146177bp; Strand=+

SEQ ID NO: 4634 - DNA, 300 bp, Xenorhabdus bovienii
  Coding DNA location: Contig name=SeqID_16897; Position on contig =146178..146477bp; Strand=-
ttgcgtttagctagaaatatttctttaaacgaactttctaagttgtctggtgtatctaaggccgcactatctcaattagaatcaggcaactctaaccctcgaattgatacgttagatgctattgcaattgcgctacgtcttccgctgggagatttatttggcagcaataatgagcgctacccctatctggaaaaaaatattccaatggaggatacatattctcaagtgatgaagtttcgtatcggcttgggtagtgttgctgaaatatggcatttacaaatgaatccaggggttaagtaa

SEQ ID NO: 4635 - DNA, 450 bp, Xenorhabdus bovienii
  Coding DNA location: Contig name=SeqID_16897; Position on contig =146700..147149bp; Strand=+
atgcttcagataaacgattgcttcaagataatctataccagtgccctattacttataatgccaggcccaacaaataccttactactctgttcaggattctctcaagggataataaaaagccttaaattaattcttgccgaatgtataggttatttactatcaataagtagttggggactattagttattgttctggcaaagcatagcccacttctcttactcacaataaaactaatttctgctctctatgtcgcttatctggcagtaaaaatatggcatttttccctacaggggtatgattatcatgtgactacaatgacaatattcttcactaccctgctcaaccccaagtcttttatatttgctgcttttattatcccaacatctgcattttcaatcagatatcaagctttgaacgtgatccacggcctgacccttgccacgggctga

SEQ ID NO: 4636 - DNA, 1401 bp, Xenorhabdus bovienii
  Coding DNA location: Contig name=SeqID_16897; Position on contig =147104..148504bp; Strand=-
atgtctacgtttactcgtttacaaaaacgtttatcccgtcagggaatcgaaacccagtacgaaaataatatctatcgtttcaataaagagcaaattgaagctgaagttctactgcctgaatccttgccattggaagaaaaggccgtacagcaattacttgaccttgcttccgttcacgtacccggcagcgacgcgaaagtgtgtcgtaccagagcgacaccggattttcatccgggagcggtggcgccagtgggctgtattgtggcaacgacagaggatctggtgatccctgctgccattgggacagacatcaactgcggtatgcgcctgctgacaacgggtttgagctatgcggaagcgtatagccaaaaagaagccttgattcagcagttaaaaaataccctattgctggatcaacgtgatgtacccgtcacatcaacctcattcagtgccctgtttgacgaagggctggcggcatggttacaggaattacctcaacagggggtctggcaacaggccgatttcaagcgcatgcatgccgaattaaacgcgatactgagtactcaggcagtacaggcgcatagccgatacgcacctgaagcctttttcgagcaacgtgaaatcatccgtccggcaagcttgggtacggtgggttcaggcaaccactttgttgaactgcaaatcgtcgataccattctggacaggcacgcggcttacgcggcaggcctgcatgaaggtgaggtattgatgatgatccacactggctcacgggatgtgggtttttacataggtcagcgttggatggataaagcgagggctttatggccggctacggcaaaatatccatcttctggcctatttggtctgacagatgaacacgctcaggaatattttctggcgatgggttgtgcggcgcgttatgcgtgggcgaatcgcattgttttgacggaactggtgcgcgcggcttggaaacaggtttttgggcaggataaaagtaagttgattgtggatctctcgcataatattatttttcctgagcagggtatgaatctccatcgcaaaggcgctacacctgcacgggcaggggagttggcgttaattcccggctcaatgggggattattcttaccttgtattggggaaaggcaatgaagactggttgtggtcatgttcacacggagccgggcgttcggtacgccgtcaggcaatgcggaataaagtgcctgatctacaaaaaaatagccgattgccgtggcagtgtatcactttgaaaagcgatcgcctgcgtgaagaagcgcctgaggcttacaagccaattacgccggtgattgagatccaagaacagaccggattaattcagcccgtggcaagggtcaggccgtggatcacgttcaaagcttga

SEQ ID NO: 4637 - DNA, 126 bp, Xenorhabdus bovienii
  Coding DNA location: Contig name=SeqID_16897; Position on contig =148856..148981bp; Strand=-
atgcttggagatataaccgagattacgcatgaattggataattttatatgtattctgactctccatataaccttattaataagtatggttttattcgataagattattattttggaaactgtctga

SEQ ID NO: 4638 - DNA, 507 bp, Xenorhabdus bovienii
  Coding DNA location: Contig name=SeqID_16897; Position on contig =149124..149630bp; Strand=-
ttgaagaaattagaacgtcaggaagctccagactgtttatctaattttaaacatggcgtagatagttggggagcggttccgaaggatgaaatatggtcaaaattggagcagatgcaaggtgaattttgtgcttattgtgaatgtagattgaaggggaagagtaaacatatagagcactttaggaagcgtgaaacgtttccagataaagcttttaattggggtaatctgtttggttcctgtggagatcctcaaaaaactggagggtggggacgttgtgggatatataaggataatagaaagctgaacccaccatgtgatatcaataaactgatcaaacctgatgaagaagatcctggtgactatttgcttttcttaatttctggccatgttgtccctcagcgaaatttgtgtgacagagaaagacaaaaagcggaagaaacgatccgtgtatttaatttgaataatgatacatcgttatttaatagtcggaagaatactatagagtaa

SEQ ID NO: 4639 - DNA, 1647 bp, Xenorhabdus bovienii
  Coding DNA location: Contig name=SeqID_16897; Position on contig =149627..151273bp; Strand=-
atgaaaaagaatagacatattcgcgcattggaaatgaatgcaaagaaaggtgatttgctcgctaattttaatctctatcaagaatatttgagcggagaaatgaatgtagaaaagaacgaatcactatcagaatattactttgagcaatgttgtgttctgatagaagaaaataattttatattagagtccttaaagctcatagattttcgtcgattcaaaaaactgaatattgagaaaggattagatagacatcttactgtttttattggcactaatggtgaaggaaaaacttcaattattgaagctatcagtaaaacattaagttggttaaatgctaatatcttaaaagaagatggtcaaggaagtggtataacctatgacgatattcataatgaaagtgaaggttatgctgatatttatactgaattcaagtatggcgttgacactagaataaatgctcgtttatcaagagcaattgaagctgcatcgaaaaaacgtgatagtgaagtagtaggtttgaaatctattgctaatatgtggagaattattaatgataagcgaagaattaatcttcctttatttgcttcatatttaattgaacgttcttatcctttgaaaattaataaaagaaattttctgatcgatatacctgaaaagcgaaggttacgtttcgatgcttatactgatgctcttagaggtactggcaaatttgaaaattttgtagattggtttatttctttgagtaaaataaaaaaatatggaacctcaattttcaatgaagaattgaatcaattaaaaaaacaaattgaaattaaagttatgaatgaaattctttcaacaatctatgatgattctattttaaaggaaatgaaaaataaatatctggaatctttggaagaaaaacaagatgatggttctcatgaatctattattgtttctaaagtgattgaagcaatttcacatgtagtacccagtgttgaagatatttgggtcacagataaatctggtgttgatgagattctcgttttaattgatggaaaagcagttaaattaactcagctttcagatggtcaacgagtatttattgctttagtcgctgatttaactcgaagattggtattattaaaccctgaaaaagaaaaccctttggaaggaaatggtattgtgcttattgatgaaatcgagcttcatctgcatcctaaatggcagcaaagcataattacaacgcttcaggaaacctttcccaatatccaatttattatttctactcatagcccacaagtgttgtccacagtgaatagaaaaaatattcgttattttagtggagaagatgatacaggagcagtttggctgagagtacctgattttcaaacaaagggcgttgcaaatagcgatgttcttgaacaattgatgaatactttttccattccggatcttccagagtcaaaatgggttaacgatctaatcgaattggttgaaaaagataattatgaaaataattcgaatgctaaagagttattcaataagatcaaagaacattttggtgatgagcatccagaagttaaacgttgtgaaagtcacattcgtcttcaaagcttgaaagttaaggctcgtaaaaaatttgataagaaaaaggatgaaaattga

SEQ ID NO: 4640 - DNA, 933 bp, Xenorhabdus bovienii
  Coding DNA location: Contig name=SeqID_16897; Position on contig =151270..152202bp; Strand=-
atgactgttttatttggtttagtaaaaacattagggataagtgagagagaagcgatcacttttctttctgacgccccgaaaaaatataaagtttactctatacctaagcgtagttcaggccatagaatcattgctcaaccaagtaaaaggcttaaagaatatcaaacagctttccttaagtgctgcttgctgcctgttcatcctagtgcaatggcataccgtcagggtttatcgataaaagataatgcaaattatcataaggataatcaatatctactgaaaatggatttggagaattttttcaactcaatcacccctaatattttatgggaaagttggaataaaaaagagctattcattgatgataatgacagaaagatattacaacgtttgttattctggtgtccgagtaaaaaaaatagtggaaaacttgtattaagtattggtgcaccaacatcaccagcagtttcaaattctttcttatacaattttgacgaggaactgtataatttttgtctcaaatatcaaattgcttatactcgctatgcagatgatttaacgttttcaactaatcaaacaggagttttatttactgtacatgagatggtaaagaaattgttgataaaacatttcgataggcagattacgctaaatcatggtaagacaatattttcatcaaaagcacacaatcggcatatcactggagtaactattacgaatgatggaaaattatccataggtagacaaaaaaaaaggtatattaaacatcttgtttaccaattcgaattaggagttctaagtattgaagatatttgttatcttcaaggattgttagcttttgctaaacatattgaacccttgtttattcctcgtttagtacagaagtactcgaaagaaacgttaaaaaatatttttgatatagggtcatcatga

SEQ ID NO: 4641 - DNA, 912 bp, Xenorhabdus bovienii
  Coding DNA location: Contig name=SeqID_16897; Position on contig =152493..153404bp; Strand=+
atgatcgcaatacctttacccgttagtcagaaagcccacatgcttacgatcaagaaactgcaaaccgctatctcaagcctttcggtatggcgcaagggggatcaacgtgcgccccataagccgttattgctactgtatgtactttctcaataccaaaaaaagcatgggcgactgtttaactacggggaagagctccaccagccattactggagttactcaacaattttggcccaaagcgcaaaaatcattacccaaccatgccattctggcggttacgcggcgatgggttctgggagttgcagaataccgaacgctgcacactccaaaaaggcaataaagaaccaccaaagcgcgagttgattgaatatggtgtgataggaggattcgatcaggcaagctaccaattactgcaaactaagcctgagctcatcgataaactggcacagcagattctcagtgaacatttccctgaaagcgtacaggagctaatcgccaatcagttggatttctccttaggtgatatccgcaagttacgcgatccacattttcgtcagaatatattgcgtgcctataactatcagtgtgccgtgtgtggctacaatctacgccatgacaatacccctgtcgggctggaagcggcacacatcaaatggaagcaatatggtggcccctgtactgttaccaacgggcttgcgctgtgctcgctgcaccattccgcattcgatatgggttcaattggtcttgacgatagtatgaagttaatcgtttcaaaaggtattaatggcggccagatggtggagcagcttttctggaattttgccgatcagccaatcgtgctccctcagcaaaaagaatattacccgcaggaagagttcgtcacttggcatcgcagccaagtctttaagcaataa

SEQ ID NO: 4642 - DNA, 1053 bp, Xenorhabdus bovienii
  Coding DNA location: Contig name=SeqID_16897; Position on contig =153462..154514bp; Strand=-
atgaaaaagtggttctatctgctagccgctgggatgatggcatttagcattggttcggtgaatgccgctgccgctgatgatggcaaaacgctgtatttctacaactggactgaatacgttccacctggtttgctcaaccagttcaccaacgaaactgggattaaggtgatttactccacctatgaatccaatgagagcatgtataccaagctgaaaacttataaagacggcgcttatgatttagttgtgccatccacttactttgtctcaaaaatgagtaaagaggggatgctgcaaaagattgatacgagcaaactcagcaatttcaaaaatcttgatccgaatctgctgcataagtcttttgatccgaagaatgaatattctatcccctatatttggggagcaacggccattggcgtcaacagcgataatatcgatccaaaaaccatcagctcttgggccgatttttggaagcctcagtatcaaaacggtctggtgctgactgatgatgctcgtgaagtcttccagatggcattgctgaagctgggttattccggcaatacgaccaatccgaaagagattgaagcggcttatcaggaactgcaaaaactgatgccaaacgtattggcattcaactctgataacccagccaatccatttatggaaggtgaagttgatttaggcatggtgtggacaggttctgcctatgtagcacgccagtcgggaacaccggttgatattatctggccgaaggaaggcggaattttctggatggatagtctggcgatccctgccaatgccaagaatgtcgatggtgcgatgaagttgattaacttcttgctacgcccggagatcgcggcacaggttgcgcagaaaatcggttatccgacgccgaatctggcggcgaaaaaactactgccggcagaaatcacgggagaccagtcactgtatcctgatgaagccattatccagaaaggagaatggcagagcgatgttggcaacgccaatatcctgtacgaaaactatttccagaaactgaaagcgggtcaataa

SEQ ID NO: 4643 - DNA, 141 bp, Xenorhabdus bovienii
  Coding DNA location: Contig name=SeqID_16897; Position on contig =154468..154608bp; Strand=-
atgaaatgtcgcttctataatagccgcttttctaagggtaggttcactccgagcctatacaagactaacgcaccaactgcgagggaaacactgcatgaaaaagtggttctatctgctagccgctgggatgatggcatttag

SEQ ID NO: 4644 - DNA, 780 bp, Xenorhabdus bovienii
  Coding DNA location: Contig name=SeqID_16897; Position on contig =154735..155514bp; Strand=-
atgatcggacgcctgttgcgtggtggtttcatgaccctcgtttatgcttatctgtatatcccgattgtgatcctgatcgtaagttcgtttaaccagtcacgattcggtattagctggcagggttttaccactgaatggtacagcctgctgttcaacaatgacagcttgcttcaagcagccggacattccctgacgatggcggtcacttccgccacgtttgccactctgattggttcactgacggcggttgctctgtaccgttattcgttccgtggcaaaaacttcgtgagcggtatgctgttcgtggtgatgatgtcgccggatattgtcatggcgatttcattgctggtgctgtttatgctgctgggcgtctcactgggattctggtcactgctgttttcgcatatcacgttctgtctgccattcgtggttgtgacggtttactcccgtctgaaagattttgacgtcaaaatgctggaagcggcgcgggatttaggggcgggtgagttgaccattctgcgtaaaatcatcctgccactggcgatgccggcagtgatggcaggttggctgctcagttttaccctgtcgatggatgatgtggttgtttcctcattcgtgacggggccaagctatgaaatcctgccactcaagatttattcgatggtaaaagtgggcgtttcgccggaagttaatgcattagcgactattttgctggtaatgtcactggtactggtgttgttcagccagtttattatgcgtgatcgtactggcaaagcttaa

SEQ ID NO: 4645 - DNA, 816 bp, Xenorhabdus bovienii
  Coding DNA location: Contig name=SeqID_16897; Position on contig =155511..156326bp; Strand=-
atggtgtcttggctgatgctgttcgtctttatgccgaacctgatgatcatcggaaccagctttctgacccgcgatgatgccaatctggtacagatggtattttcactggacaactatacccgcctgttcgatccgctgtatgccgaagtattgctacactcgctgaatatggccatcgtcgcgacgttatgctgtctggtgatcggctacccgttcgcctttttcttggctcggatgccggagaagctgcgtccgctgatgctgttcctgttgatcgtcccgttttggacgaactctttaatccgcatttatggtttgaagatgttcctcagcacccgtggctatctgaatgatttcctgctgtggctggggatcgtcgataaaccgctgcgcattatgtatacctccgaagccgtcgtgctggggctggtttatattctgctgccgtttatggtgatgccactctattccagtattgaaaagttggataaaccttgtctggaagccgcgcgtgatctgggcgcgggaaaattgcagacgtttatccgcatcattatccctttgacgatgccgggcattattgcaggttgcttgttggtactgttgccggcaatggggctgttctacgtggctgacctgatgggcggggcgaaaaacctgctgatcggtaacgtgataaaaagccagttccttaatattcgcgactggccgtttggggcggcaaccagcatatgcctgacgctggtgatggggctgatgctgctggtttactatcgtgcggctaaactgctgaacaagaaggtggaactggaatga

SEQ ID NO: 4646 - DNA, 1116 bp, Xenorhabdus bovienii
  Coding DNA location: Contig name=SeqID_16897; Position on contig =156355..157470bp; Strand=-
atgactgagaatacctctctgacaccactcgttgaactaaacaccctgtgcaagggtttcgacggcaaacaagttatttcacagctcgatctgattatcaatgatggcgagttcctgaccattcttgggccatccggttgcggcaagaccactgtactccgtctgattgccgggctggaagatgcggatagcggcaaaattttactggaagggcaggatattactgatattcccgccgagcaccgtcacgttaatacggtgttccaaagttacgcgctgttcccccatatgaccgtatttgaaaacgtcgcttttggattgcgcatgcagaaaacaccggcaaaggagattgccccgcgtgttgaagaagcgttgcgcatggtgcagcttgaagagtttgcccaacggcgtccggctcagctttctggcggtcagcagcagcgcgtggcgattgcccgtgcggttgtgaacaagccgaaagttttgctgctggatgaatcgctgtcggcactcgactataagctgcgtaagcagatgcaaaatgagttgaaggctcttcagcgcaagctcggtatcacctttatcttcgtgacccatgatcaggaagaagcgctggtgatgtcagaccgtatcgtggttatgcgtgacgggcgcatcgagcaagatggtacgccacgtgagatctacgaggagccgaaaaacctgttcgttgcccgctttatcggcgaaatcaatatctttgatgctaaggtgctgcatcgtattgatgagcagcggatacgcgctgacgtcgaaggccacgaatgcgatattttcacttcgttgccagtcaccgccgggcaaatactaaaagtgctgctgcgcccagaagatctgcgggtcgaagagatcaatcatggcgagcaggtgtcgggtctggttggttatgtgcgtgaacgtaactacaagggcatgacgctggattcggtggtcgaaatggaaaatggcaaaatggtcatggtgagcgaattctttaacgaagacgatcccgatgttgaccactccctgaaccagaagattgcggtcacttgggtagaaagctgggaggttgtgctggtcgatgaagaagacgcgtaa

SEQ ID NO: 4647 - DNA, 321 bp, Xenorhabdus bovienii
  Coding DNA location: Contig name=SeqID_16897; Position on contig =157676..157996bp; Strand=+
atgataacatcgcgctctatgttgtacccagtctacacgcctggaaataatttcctatcgggtattttgcaatcacttttaattttctttactttcaatgagatccttcagacacgaaaacccgctcttccctccattaaaactcacttgaaaacaccgttcatgctactctgccgcacttccggcgttatacagaccctgctatctctcctctccccctcgacaaaaacgcgccatccgattctttttttgaaaaaaataaaattattcgaattattttttattgctttaataacaaaatttataattcattgtttttaa

SEQ ID NO: 4648 - DNA, 1131 bp, Xenorhabdus bovienii
  Coding DNA location: Contig name=SeqID_16897; Position on contig =158205..159335bp; Strand=+
atgtttcatctatcgttaaaagatatccatctagcggcttacgctgacaataaagaaagcgccattcgacaagttaccgctgcactggccgcatcaggctatgtcagtgaaagatacattgaaggaatgctggagcgtgaaatacagtcctcaacctatcttggcaacggcattgccattccacatgggacaacagcaacccgcgaccaagtgctgcacactggcgtacaggtcttgcaatttcctgacggcgtggcatggggaaataaccagaccgtccatattgtcatcggcatcgcggccaaatctgacgaacatcttaccctgctgcatcaactgactcgtattatcagtgatgaaaacctcgccagccagatggcaaaaaccgcttcggcggacgaactctatcgcttattaatgagcacaccctcctcccattttctggatgcgtcaacgatcacactggatatcgacgctcatgacctgacaaccttgcaggccctgaacatcgcccgcctgcaactggccaaagcggtgaatgctgcattcattgccgatgttctagccagaccgccaattcatctcggccaagggctttggttgagtgacagtgcgataggcaacctgcgcaatgccgttgcgattaccagacccaaaacgccattcacaatggatggtcagccagttggagtactaatgaccatcgcctatgcggatgatcaactgcaaagcctgctgagccctatcagcaccctgctgcaacaaaacaaggccgaacgcctgtactccgcacccgatgccgcagccatcatcgcactgctgacaacagctacaccgcaggaagcgacggcactgagcgcagattttatcctgcccaatgagcatggattgcatactcgccccagctcactgctggtcaataccatcaaacaattcaacagccagatcaccatcgcccaccttgatggctcaggcgttcccgttgatggccgcaaactgatgcaagttgcgggtctgggcgtcaaaaaaggcgaacgcattcgcttcaccgcagttggctcagacgcggaacaagcactgacagcgatcacagccttgattgagcagaacatgggtggggaaatcgcatga

SEQ ID NO: 4649 - DNA, 960 bp, Xenorhabdus bovienii
  Coding DNA location: Contig name=SeqID_16897; Position on contig =159332..160291bp; Strand=+
atgagcaaaagagtggcaaccatcacccttaaccctgcttatgatttagtcgggctgaccacggatatcagcatcggtaaggtaaaccgcgtccagaccgccggattataccctgccggcaaaggcatcaacgtaggtaaaatcctcaaaaacctcggtattgacgttaccgttggcggttttctgggagaagataatcaggacagcttccagaacaccttcgccgaactgggcatgaacaatcaataccagcttgtggaaggccggacacgcattaacgtcaaactcaccgaacagagcgacatcgtcactgatttcaatttctcagggttcagcgtcagcaaagaagaatggcaacaattcgccaaccgctccctccaatggctcagtgagttcagtatggtctgcgtcagcggcagcctgcccgctggcgtcgatttggatgacttcacccactggatgcagcgcctgcgcgaagagtgcatgtgcgtggtgtttgacagcagccgggaagccttcgttgccgggcttaaagccctgccctggatggtcaaaccgaatcgccatgaactggagatctgggctggccaaccactgccgacacaagaagatattgtcaccgcagcccatcaactgcgcgctcaaggcgtctctcatgtcgtgatatcactgggagatgaaggcgccattttggtcaacgcctctggcacatggctcgccaaaccaccgcactgtgaaatcgtcagcaccgttggcgcaggggatgcgatggtcggtggactgatttacggcctgatgatggggcaacctagcgagcacaccctacgcctcgccaccgccatatccgccctgaccgtcagccaaagcagcgtcggcagcattgaccgtcagcaactggctcgcatgatggcacgagtagaactcactcctctgcacactcaatcagcgaaaaacaattaa

SEQ ID NO: 4650 - DNA, 1689 bp, Xenorhabdus bovienii
  Coding DNA location: Contig name=SeqID_16897; Position on contig =160330..162018bp; Strand=+
atgaatacattgattcttaccgacaatcagcagggacaggcgcgcgcttaccttgccagacatacactggagaccatcgccgcccaacacggcctctcccttgtcacggatgtgaacaacgcagaactggtgattatcatcggcgattctgcgcctgataacgttaatctgcatggcaaaaaaacttttgcaggcagcgcagaacaggctatccgcgaacccgatacctttatcagtcatgccaaaaaccaggccagcgtttatcaatcccaagatagccatcactcgccggataacgcggttcagcacaacacaatgaacatcgtagcgatcaccgcctgcccgacaggggtggctcatacctttatggcagctaaggcgctggagaccgaagcacaaaaacgcggctggcagatcaaagtagagacccgtggttccgtgggaaccaacaacgccatcacacgcgcagaaatcgtggcagcggacttggtgattgtggcagcagatatcgacgttgaccttaccccattttccggcaagcgcctctaccgcacctccacaggcgcggccttgaaaaaaaccgcccaagaattggataaagcactgaccaccgccgagatttatagcgccaagcgtgaaacttccgcctccaataaccccaaacccgcaggcacaggcgcttaccagcatttaatgaccggcgtttcctacatgctgccgatggtcgtcgcgggggggttgtgcatcgccctgtcatttgtcttcggcatagaagcatttaaagaatccggcacactggccgcagcgctgatgcaaatcggcggcggctccgcactttcgctgatggtgccagtgctctccggttacatcgcctactccatcgcaggacgcaccggactcgctcccggactggtgggtggaatgctcgccgtcagtaccggcgccgggttcctcggcgggatcatttctggctttcttgcgggttacattgccatgttgctcaccacccgactgcgcttaccgcaaagtatggaagccttgaaacccattttgattatcccgctggtcgccacgctggtgacagggctaaccatgatttacgtcgtcggtaatcccgtcgcggcaatgatggaatggctgacccattggctgaaatcaatgggaaccaccaatgcggtgatcctcggtgcgattctgggcgggatgatgtgcacagatatgggcgggccagtgaataaagcggcttatgcgtttggcgtcggtttgttgagcacccagacttacggcccgatggccgcgattatggcggcagggatggttccgccattggcaatgtggctggcgacggtgattgcgcggaataaatttgaccaaagtgaacgcgaaggcggaaaagcggcactggtgctggggctgtgttttatctcagaaggggcgattccatttgcggcgaaagatccggtgcgggtactgccgagttgtattctgggcggcgcagtaacgggggcgctttcgatgtattttggcgtacatctgatggctccgcatggcgggttgtttgtgttgctgataccgggagcgattacgccggtggtgaattatttgggggcgattgtgatcggcacggtgctgactgctggggtttatggggtggttaagaagaaggctgaggtggaggttgttggttga

SEQ ID NO: 4651 - DNA, 249 bp, Xenorhabdus bovienii
  Coding DNA location: Contig name=SeqID_16897; Position on contig =162077..162325bp; Strand=+
atggtttctctactcatcaatccgataacgatttatcccccgcatttgcggggaacagcaaccttgaccgttatatgttcgttaacactacggtttatccccgcatttgcggggaacagagcacctagggctagaatcaattggataccaacggtttatccccgcatttgcggggaacagactaatttcatgctattgtttttaattagttttttcaagggagaaatttctaccgcatttttcccataa

SEQ ID NO: 4652 - DNA, 375 bp, Xenorhabdus bovienii
  Coding DNA location: Contig name=SeqID_16897; Position on contig =162681..163055bp; Strand=-
ttgcgtattccttgtggtgctaagttacgtttcaagctgcgggctaatccggtcaaaaccatcaaagatgagcgacagcgccgtactcgtgacggtgaactcaaatgttgccgcgtaccgctcatccatgaggaacagcaattacagtggttatctcgtaaattagcgggagcggcgctgttatcgactgcttgggtgatatcggagcctccaatctattttcgtaaaagtgatattagtggaaaaattcagccaatatgttttgaggggcaaatcacagtacaggagagtgaagtcttaatttctcttctaagtaaagggattgggccggctaaagctataggttgcggtttgctttctctagcacctgattaa

SEQ ID NO: 4653 - DNA, 231 bp, Xenorhabdus bovienii
  Coding DNA location: Contig name=SeqID_16897; Position on contig =163033..163263bp; Strand=-
atggggctggatcgactgacgctgggcgaaagaaccatatcaactgcatcgggctttatggcagctttccccaatcgtcctgatgatgcgcgcgattttctttttcgggttgaggagtggcaatctgatcggggtgtgggcgttttattgcagtcagcacaggagccttcgtcagtgaaagtggctcaggttatcgctagtaaagccattgcgtattccttgtggtgctaa

SEQ ID NO: 4654 - DNA, 522 bp, Xenorhabdus bovienii
  Coding DNA location: Contig name=SeqID_16897; Position on contig =163372..163893bp; Strand=-
atgtccttgataattgaagaaatcactcaacaacataaccgtaaagcatttgattgcggtgtccgtgaacgtgaattaaatcagttcttacaacaacaagcccgacagaaggccataaaacatatctcaaaaacttacgtcgtttgccgggcttcagaaccaacgactatcctcggatattatactcttagtgggtattccgtgataacacagccgacccacagagattataaaaaatatccccacccacttaatgcggtaaaattagctcgtcttgctgtggatagttcatatcaaggacaaagattaggagagaagttattgattgatgctatctatcgaacggtgttagtttcacagcaaatatcagctatcggattatttgttgatccaatgagtcctgaagtcattccgttttatcagcagtatgattttttatcggttgagcccgatgaacattcatgtcttgaaatgtggttgcctattaaaacttgtatggaagttgctagtgttttgctgtga

SEQ ID NO: 4655 - DNA, 294 bp, Xenorhabdus bovienii
  Coding DNA location: Contig name=SeqID_16897; Position on contig =163877..164170bp; Strand=-
atgggcacttattctgagcgtaaagaaacccgtttggttgcgcgaacatctttagaaatacaagaacttatacaaagagctgccgattactctggtgcaaccctttcgcagtttcttattgaagcggcaatggatagggcacgcaatgttattgaacaagcagaaatattgcagctctcaatggcaggtacagatgcattatttgtggcgttggaaaacccaccaaaagtaagtaagaagcttcttaaagcagccgcagattacaaggatgaagtgaatgtccttgataattga

SEQ ID NO: 4656 - DNA, 231 bp, Xenorhabdus bovienii
  Coding DNA location: Contig name=SeqID_16897; Position on contig =164217..164447bp; Strand=+
atggcacacaaaatcaatttataccaaattgtatgccataatggcatacaaaaatacaatacagttatcacgatggacaaccgcaacgccatttcaagcgtaacgaacctatgcccagagagcaatttgctagcaatggagggatcaatctccattgatttggcgaactgccgtaagcttacattcatgttttccaatgtttcagcaatgatttcactaggatgcacatag

SEQ ID NO: 4657 - DNA, 786 bp, Xenorhabdus bovienii
  Coding DNA location: Contig name=SeqID_16897; Position on contig =164609..165394bp; Strand=-
atgcaaattcagcatagtccatggaaacattgcaattacgaaccgtcacgactgtgccatcataacgattatttactgaggtggcatatgaagaaaataatcggtattcttggcggtatgggccccgctgcaaccgtagatgcaatggagaaaataattaaacatacaccggcaacttgcgatcaagaacatattcctgtcattgcggtttcttttcctgaaattcctgataggacagcgaatattatctctgatggcgcatcgccgttaaataaaatgttagttgcattgagaaagctggaaagcgctggcgctcagtgtattattatgccatgtaatactgcccattactggtataacgaattaaaagcagcaacaaaaattaactttatgaatatgattgatatcacctgtaataaaatcgtaaatgaaaggattaataatgtcgctattcttgccacaacagcaacgataaaatccgaactttatcaatccagattggaaaaagagaatatcaattgtgttattcttgatgatattcaacagcgttgtgttatggaaagtattctggcttataaaggtggaaatgctggaaaggcatattttttactgaaaggagttatatctcaactgcaatcttttggggttgaaaaatttgttatgggatgtactgaaataccgcttattcttagtagggatggtaatgtggataggtatattgatgctacggaggagttgattaaaagtgcggtggattggtgttattctgatgaaatctgcttttag

SEQ ID NO: 4658 - DNA, 897 bp, Xenorhabdus bovienii
  Coding DNA location: Contig name=SeqID_16897; Position on contig =165447..166343bp; Strand=+
atgctgaataacattgagctgaaatggttatatgatgctgtaatgttggaagagctaaggaatttcactcttgcagcagaaagaagaaatatatcccagtcatcttttagcagacggattcaggctcttgagagtgctgtcggctttgaaatattcgaccgtaatttcaatccattacagctttctttgcagggaaggagctttattgtgtatgccagaaatcttctgagcgatatagagcatcaggttggcaaaataaaaggaggagaaatagctaaacaccgaatcaatatcgccgctgcacattcgcttgccatttctctgttgcctgagtttatttctggctttgcagaaaagtcggacaaaatttttaatgttgaatcgatcaatgttgatgaggctgtgcataatcttaaagagggaaaaagtgattttattctgtctttctttaatgaagaactgatgacgtcccccttccttcatcataaggtgctggatgctcagttacatctcgtatcgggctgtaagcctgatggagagccgttatataatctggatagttcacctttgccattaatgaaatacaccgatgaaagttatatggggcggcaagtcaatcaattactggaaaaagatttcagcgacgggttcaattatttttttcattcatccatgagcgaactactgaagcgtatggtgctaaatggtcatggggtgggttggctgccggattattcaatcagtaaggaactcaaaaatcagcaattgtgcattttgggtcaagattatgcctcgataaaaatgggcgtgtacatttaccgcactcactcccggctcaatccttcctcagaacgcttttggcagtatatgcgcaaacgcgaaagcggtagccagtaa

SEQ ID NO: 4659 - DNA, 1269 bp, Xenorhabdus bovienii
  Coding DNA location: Contig name=SeqID_16897; Position on contig =166400..167668bp; Strand=-
atgaacagacaaaaactcatgaagcaaatcatcatcgctattctgcttggaattattactggctggggttttcatcattatcttgatgccagccagaccaaagaagttgcctcctatatcaacatcattaccgatgtattccttcgactgataaaaatgattattgccccactggtattcgccacgattgtcgcaggcctgatatcaatcggcggctcatcatctgtaggccgaattaccattaaagcaatggcctggtttattatcgctggtttggtttcactcggcattggaatgctgatggctaacctgttccagccaggcgttgggcttaatgtcagtgttcctcaacaggacaatgttgatacaggcctcaacaccagcggattcaccctgaaaaactttatcagccatattttccccagtagtttcgcagccgctatgtcgaataatgaaatcttacagatccttattttttcgatattttttggtagtgcgctttcatatgtctgccataacagcaagaaaaaaagcccgatagtgaccttcattgaagatctggggcgtatcatgttccgcatcaccgattacgtgatgtcattcgcaccgattgcggtgtttgcggctattgcttctgcggttacagtgcaaggtctggggctgctttacgattatggcaaacttatcggcctcttttaccttggcttatttttgctatgggctgttttgtcggcggttggatttcttttccttgggaaaagcctattttcactcatgaggctgattagggagcctgtcgcgttggcttttgctaccgcgagcagcgagtcagcctatcccaagaccatgaacgcattggatcgatttggcgtaccgaaaagaatttccagcttcgtcttgcctctgggttattcctttaaccttgatggttcaatgatgtatcaatcctttgcggtactctttattgcacaggcataccatattgacctgagtatcacagagcaaatcataatcatgctgacactaatgatcacgagcaaaggtatggcaggtgtcgcgcgtgcttctgttgtggtcgttgcggcaacgctgcccatgttcaaccttcctgaggcaggtatcttgctgatccttgccattgatcagttcctcgatatggggcgtacagcgaccaacgtcgtcggtaacagcatttccaccgcggtgattgctaaactggaagaaaagcaggggcgttccgaattggaaccggttgaccaagaagcctga

SEQ ID NO: 4660 - DNA, 99 bp, Xenorhabdus bovienii
  Coding DNA location: Contig name=SeqID_16897; Position on contig =168134..168232bp; Strand=-
atgaggcacggctatgggggagatacttcgattgaagcgggctttaatcgtctgaaaacgatggaggttaaacaagccattatcaaagcaggtgcgtag

SEQ ID NO: 4661 - DNA, 267 bp, Xenorhabdus bovienii
  Coding DNA location: Contig name=SeqID_16897; Position on contig =168436..168702bp; Strand=+
atgggaacatttttttgcccattcgaggtatttcttataattgctactggcagagtcggtgatcagagactcttcaatccctgccgaacacatagcatgccattttttaactcgctcaagaattccttgaagagagtcctcctcaccctcaagaggataagaaataacatcactctcatctggatgctatgtgtgtgggttttgagatatccctctcaccaacccccactatcctcaataagcaataaaattttcaactttcgctaa

SEQ ID NO: 4662 - DNA, 852 bp, Xenorhabdus bovienii
  Coding DNA location: Contig name=SeqID_16897; Position on contig =168781..169632bp; Strand=+
atgaatcatacaaaagacaaaaatcaaatagttaaagttgctcaatatcttcgaatgtcaactgaacatcaaaaatattccatagaaaaccaatcggtttacattcaacagtacgctgaacagcacagtatggccattatctacacctatgatgactcagggaagagcggagtaaccctatctggtcgtaacgccttcaaaagactcatcgcggatgtaaccaatcgcgtaatcgatatcgctgcaatcctagtttacgatgtcagtcgttttgggcgatttcctgacccagatgaagcagcccactatagttatattctgaaaacacataatgttaaaataatttactgcgcagaacctctatcagaggatcaccctgaaataagtatgctggctttgcctatcctgagatatggagccgcatccttcagtaagaacttatcagaaaaggtcttcgcgggtcaggctaatcttataaaacaaggatatcatcaaggaggaatggccggatatgggctaaggagacaactaatagatgacaagcatgaaccaaagttgatccttggatatggacagcgaaaaaatattcaaacagacagagtaattttaactcttgggcctaaagatgaaataaaaatcgtgaatgaaatttatgatttatttatttttaaaaacttccctgaatatctgatcgcaacacaactgaaccaaaaaaagataccagccgaaaataatggaatatggacaagggaaaaagttcatcaaatattgacaaatgaaaaatatataggtaataagttaatcaatgaaattatctgcacttttgttatagtcggtaatacaatacactga

SEQ ID NO: 4663 - DNA, 441 bp, Xenorhabdus bovienii; identical to SEQ ID NO: 2208
  Coding DNA location: Contig name=SeqID_16897; Position on contig =169649..170089bp; Strand=+

SEQ ID NO: 4664 - DNA, 537 bp, Xenorhabdus bovienii; identical to SEQ ID NO: 2180
  Coding DNA location: Contig name=SeqID_16897; Position on contig =170115..170651bp; Strand=+

SEQ ID NO: 4665 - DNA, 171 bp, Xenorhabdus bovienii
  Coding DNA location: Contig name=SeqID_16897; Position on contig =170620..170790bp; Strand=+
atggtgctaaatttgcaattaatttttcttgattacttaacatttataataaaacctctttcaaacttaaacaaaaatttgtcaaaaatccaagaaatgaatggatcagatgcgatggtgcatttaaagctattgtccccagaaaaaaatttcttctggctcaacaaataa

SEQ ID NO: 4666 - DNA, 111 bp, Xenorhabdus bovienii
  Coding DNA location: Contig name=SeqID_16897; Position on contig =170834..170944bp; Strand=-
atgagtcctccaaaccgagctttgaatacagaacttgaagggctagtgtcatcttcatctattataaaaccacttaactttcctttttcttcaagtttctttctgagatag

SEQ ID NO: 4667 - DNA, 177 bp, Xenorhabdus bovienii
  Coding DNA location: Contig name=SeqID_16897; Position on contig =171231..171407bp; Strand=+
atggatataaacaatcttaatccagttgattattatatccttccgagattagatatagtttatgaagagttcgttataaaggagaaaaaccctatctttcttgaactttatagatacgataacttagatttattcttcgaaataataaccagacgagaaataatggagtgtatatga

SEQ ID NO: 4668 - DNA, 900 bp, Xenorhabdus bovienii
  Coding DNA location: Contig name=SeqID_16897; Position on contig =171404..172303bp; Strand=+
atgaaagagaaaacaaatgatagtaatcataacattgaaatgattgatatttcattgataaaaatttcaaatccaagaccacgaaataaatttatacaccaggaaattcagagtaacattgatattagtggattacgaaaaccaataacagtcaggagaattaaagataaaaaatataaatattctttgatatgcgggcaaggtcgaatggaagccatatataacctaagcaatactcacattcctgctattattaaagatgttaacgaagaagatggatatataatgagccttagtgaaaatgttgccagacgaaaaccgagagtaactgagctatacgaaaggattagagatatgaaaaataatgggatatgtgatcatgacattgcttctatcatcggttattcagtaagttgggttaaaagtgttattttattattagagaaaggtgaacaaaaattattaactgctgtcgaaagaggacacatacctatttatcttgcagtaaaattcgcgagatctgatgataaatataatcaaaatttacttatagatgcttataatgatggttcaataaccaataagaatatagcaacaataaaaaaaatattggaaaaaagaagcttgggtagtaaaggcggtacaagccacgactatatatatcataaaaacaaccaaaatatcactcctcaggaattactatcaatatacaaaaaaaatgtcgaagagcacagattacttcaagctaaatctgaatatgtcatagacaatttagtattagcaaaacagattattagtgaactacttttagaaccctcattcaactctatattaattacagaaaatctaaccaaaattccatcaataattatggatactgcaaaacctcacgaggattaa

SEQ ID NO: 4669 - DNA, 879 bp, Xenorhabdus bovienii
  Coding DNA location: Contig name=SeqID_16897; Position on contig =172307..173185bp; Strand=+
atgttaaaagtatgttttaataacgaactgattgatttatccatcgaaaaaatgatggccagtaagcccttacctgaaaatgtaaaaagtagtattaaatataaccagataaaattatctataaaagaaattggtcttatagaaccaattattatctattttgatgatactggaaaaagtataaaaattttagatggacatcttcgtattgaggccatgaaagaattaggaataaagaaagcctgctgtattgtatccacaatcaatgattgttatacacctaataaacatgtcaatcacttaactataattgaagaacaaaaaatgcttaaaaaggctttgatatcaggagtttcaatagaaaaattgagtgcggcattaggtatatcacaagaaacacttaaaaatcgttttcgagtaacgcagggaatagcctctgaagcagcatcactactatcagataaacacataccagtagcaagtttaaatgtattaaggaaaatgcaaccattaagacaaattgaatcagcaaacataatgacaagtgttgataatttctcagcgaaatttgcattatctttactccatgccactccagattctttattaaaaaattcaaatgtaaaaaaagaaaaatcagatatccaaaaaaacctaaccagacttgaaaaagaaatggcaatggtccaaacagaaactaaaaaacatgaagagcactatggtgcaaacacacttaaattagttattataaagtcccacatagctaacctattaaataacactaaaatactgcattggctttttgaaaacaaacctgattacttaagtttgttgaaaaaaatttcagatttagactcactaacggaacaagaaaaatga

SEQ ID NO: 4670 - DNA, 819 bp, Xenorhabdus bovienii
  Coding DNA location: Contig name=SeqID_16897; Position on contig =173714..174532bp; Strand=+
atgcacaaaacggctgatatcttagaaagtaaaaaccacgttgaatcaataacaaacataaaaccaacgataggtattattttaggttcagggctggggtcgttcgcagatacgcttgaaggtgcagtccatattccatatagcaatatccctcattttgcaaaatcaggagcggttggccactccaatgaattggttatcggttctattggcggcaaaaatgttgtcgtgatgaaaggacgttttcattactacgaaggctttacgcttgatcaagtgacattccctgtccgtttaatgaaagcactgggtgttgaaaaactcatcatcaccaatgcctgtggtgctgtgaataccgatttcagccccggcgatttaatgctgattaccgatcacattaacttaaccgcaaacaatccattgattgggccaaataatcccgatctcggtgtgcgctttcttgatgtcagcgaagtgtataacaaagcattgagaagcatcgttattgatgtggctaaagcgcaaaatatcacgttacgtcagggcgtttatgcctggtggacggggccgacatatgaaactcctgccgaaatccgcatgattagaacgcttggggctgatgccgtgggtatgtcaacagtaccagaagcactgattgcacgacatgcagggattgatacagtcggtatctcctgcttaacaaatatggcatgcggtattctggatcagcctcttagtcatgaagaagtcattgaaacagcggaaaaagtaaaagcaacgtttcttaaactgatagcagaaaccatttctcgcttctga

SEQ ID NO: 4671 - DNA, 195 bp, Xenorhabdus bovienii
  Coding DNA location: Contig name=SeqID_16897; Position on contig =174869..175063bp; Strand=-
atggtatggccttccagcgtaggtgttgttgtgtttttcataatcgatctccgtttgatattacatcactttgatttttcttggcattcaggtggctttatttgccacctgagcttgtatattaccgcgggagcttgccgatcactacgagtgtcatacgttgtggctgataccaatcgcgataataggctttag

SEQ ID NO: 4672 - DNA, 321 bp, Xenorhabdus bovienii
  Coding DNA location: Contig name=SeqID_16897; Position on contig =175023..175343bp; Strand=+
atgaaaaacacaacaacacctacgctggaaggccataccatcacggaatatctgggtgtcgtcacaggggaaacgattcttggggtcaatattattaaggatttttttgctggggtgagagacatcatcggcgggcgttctggtgcttatgagaaagaattgaaaaatgcacgggaaatcgccttcgtggaaatgaatgcacaagcccaagcgctaggagccaatgcggttgtcggtattgatattgactatgagacggtcggtaaaaatggcggcatgttgatggtcactgtctcggggactgcggtgaagattgtgtaa

SEQ ID NO: 4673 - DNA, 195 bp, Xenorhabdus bovienii
  Coding DNA location: Contig name=SeqID_16897; Position on contig =175880..176074bp; Strand=+
atgaaattttcagccaaagtgcaaggcaacggatttgagctgcggaaagaaataaagcactatttttcgcatatcgggtcgctataccatcccgtgtcgtgctgcttgctcaactattgcatgactatcataggtcccgatctgaacaaatgttcagcctccattccctcaattaatgcttcagcttgtgagtaa

SEQ ID NO: 4674 - DNA, 189 bp, Xenorhabdus bovienii
  Coding DNA location: Contig name=SeqID_16897; Position on contig =176052..176240bp; Strand=-
atgattgatgccagccatatcaaagttcatcctcatgcggcgggtactaaaggcggtaatcaagatatggggcgcacaaaagggggctcaataccaagatacatttggccatggatgcgcatggtatgccgatcagagttcttgttacaagaggtaccacagctgattactcacaagctgaagcattaa

SEQ ID NO: 4675 - DNA, 222 bp, Xenorhabdus bovienii
  Coding DNA location: Contig name=SeqID_16897; Position on contig =176307..176528bp; Strand=-
atgagcacaccatcacaccgccgtcatgatatttcagatcatatttggaacttactggagccgcatttactggggcgtaaaggcgcatggggtcgggaagcccaagataaccgattgtttatcaatgcggtgttttggatcttacggatagggtctccctggcgagatttacctcccgattacggtgactggaaaaatacccatcgccgtttttgccgatga

SEQ ID NO: 4676 - DNA, 942 bp, Xenorhabdus bovienii
  Coding DNA location: Contig name=SeqID_16897; Position on contig =176732..177673bp; Strand=-
atgagatatagaatagggaataaatacatgaatgtttataaagtatccattgattacaaaggctattacgctattgataaagatgattatgaacagcgtacttcgcgtaggtctccttggtataaaactagcgatacagggtctccacagtattttgctatttgcccggcttgcgataaccctatccagataattggattctataagccctcgatcaatactcctcacccatatggcaaacatttcggcagatctgtaccaggggtaggggtctacgatcacgaggcatatacatggtgtccctattccaaaaaaaatatcaacaatcctgatgaacgccctaagcgtgagccaagctaccttacagggcaaatcttaaaaatactgatttgtcattttgataagattgtattttttctaagtaaaaacatgggtatccgtattgatgaaaaattagcggaaagtatgctcctacagtatagagatgaggagggatggctgtacgcccgagctacattaatgaacgtgccttggcaatttgcatatatgactgataatcaagtaattctttttaaaaaaatcctttcttcggatctggctgagatactcatcaaccaagttcctaagtatttgatgctcaatgataatgggtacctgatcaaacatcctgactgtaaaaagtatattgagttgggaacatattatactcgacatcacattcatgttcaggggaatgagttggtagaaaagatggattgtgtttttactttaaaggaaggttataacactccaagagaaatccaccgaataactattgaatttgactatcgttattttgataatttagcaaatttttcccaatggactcgttcaccttataacaataaacttctacagttagcaaatgaaattttggggcctcagcttgctaaatttaagtga

SEQ ID NO: 4677 - DNA, 201 bp, Xenorhabdus bovienii
  Coding DNA location: Contig name=SeqID_16897; Position on contig =177694..177894bp; Strand=-
ttgggaagttttttgtatatttttctgaaaagagtcgattgcagaagccacccagattttttcgaaattcaatcagatgattttgtttatttagccctgctccaatttaatgtaaagggtattttatatgtcaaaggattaaaagatgaatatggactgagttttatcctatacgttattcccccgttcctgatgaggtaa

SEQ ID NO: 4678 - DNA, 744 bp, Xenorhabdus bovienii
  Coding DNA location: Contig name=SeqID_16897; Position on contig =177815..178558bp; Strand=-
atgaatgatagatttacagaaaaaaccaagagggtcattcaggagagggtcgggaatagatgctcaaacccagattgtaatattctgacttccgggcctaatgctcatcctgaaaaatcaactaaaactggggtggccgctcatataacagctgcttctccagggggcgcgagatatgattcgtctttaaattctgaacaacgaaagtctgcagaaaatggtatctggctttgccaaaattgtgctcattttatcgatactgattatttaaaataccctgttcgacgcttgtatgaatggaaaaataaagctgaatgtgaagcagaacgtggaactaaaagaatgatagataagtccacatctagagatgatattaaatttatcgagcaagaagaaggttggatttgccctttctgtgggacagttgttggggttgaaaaattagtttgtataggatgtcatgctgaagtagttccgggtttgactcgagctgaacggaatgagttggtcaaaacaggaatgatggcaggaggcggtttatcggcactcctttttttaatcctaccaagttggatagcttcttattttgatattaggttggatttgtttggtcataattatatttatgtgtttatttgcataagtgtaattatggtttttgttattgggaagttttttgtatatttttctgaaaagagtcgattgcagaagccacccagattttttcgaaattcaatcagatga

SEQ ID NO: 4679 - DNA, 399 bp, Xenorhabdus bovienii
  Coding DNA location: Contig name=SeqID_16897; Position on contig =179189..179587bp; Strand=-
ttggatgagcaagggtcttttgtaggcaataaaaaacaacgtcattggctttggtatgcttttgatacgaaaaggaaacaagtcaccgcccatgtctttggcccccgaacggatgcaacctgccgaaaattgctcaacttattggcgtcttttaatattcgtttcatcaccaccgataactggggaagttacgccagagaaatggtgccagaaaagcatctggtaggcaaaatttttacccagcgtatagagcggcataatctcaatctgcgaattcatatcaagaggttggcgagaagaacaatttgttactcacgttcaatggaaatccacgaaaaactcattggcgcatatattgaaaaacatcattacaactcctttggagtcatgaccaaatag

SEQ ID NO: 4680 - DNA, 282 bp, Xenorhabdus bovienii
  Coding DNA location: Contig name=SeqID_16897; Position on contig =179495..179776bp; Strand=+
atgggcggtgacttgtttccttttcgtatcaaaagcataccaaagccaatgacgttgttttttattgcctacaaaagacccttgctcatccaattcacagataagtgtgacatcgtcataagcgatctgtcgcgatgttacttgttttggcgagagttttttaatgtccgcatcaccgtattgataccgagacctaacacacggcctgtgtctctcacaccagagccattcattgccatatccacaattttttctttcatgcccggtttatggccgttgtaa

SEQ ID NO: 4681 - DNA, 186 bp, Xenorhabdus bovienii
  Coding DNA location: Contig name=SeqID_16897; Position on contig =179764..179949bp; Strand=+
atggccgttgtaacgatagttgagttgaaaggttctttggcagtctttgcaatagtaacgagggaagccagccttacctgtaccgtgtttgcgtacaggttcagcttggtcgcaatatcgacaagtcacttctatcgtaacagtcatgatgatgtcccattaaaaagtacaagaatatcaaattaa

SEQ ID NO: 4682 - DNA, 1368 bp, Xenorhabdus bovienii
  Coding DNA location: Contig name=SeqID_16897; Position on contig =180104..181471bp; Strand=+
atgataaaaagcataacatatgaaggaaagaaaattgagttatataataatattaacaatagagaaaatatattttctattattataggaaagaatggcacaggaaaaagtcgcctgttacagttgatttgtgaagagtattcaaataataacactcctaaaataaaaaattctccttctagaattatagccgtatctacaacccccttcgataaattcccactgaagaataattttaaaaaagggtattattatcaaggaattagagggattcaagcccaagccattagtaaaggatatatctctaagtttataggtgattttttactgggtataacagaaaataaaataaatagtttatctaaggcgttggaatatttgggctatgaagataaaatagcaatttcatttaggtatataggcgggaaaagaatagaaaatataataaatagtaatgaatcagacataaatgaatctttaaaatatcatccttacttcgaaagtatagttttaaataaattaggaatagtaaaagaatattctacaaacagaagagtttatgaattaagatcttatttagttgaaaagttaataaaaggaaaagaagaaataaatcaattcttagtaaaagatgataaatctctacatgaattatttaaatctatttgtaattctccatggttacataagataaggaaattgaaaatgaatataatagggaaaaatgtagaatttaataaagaattatctctttctaaggatttgattaatttaattaattcaggcttattgaaaattgaaaatatcattttaaaaaaaacaaactcaaaagaggcgtttcatatagatagtgctagttcaggtgagcaaagtgtaatcatgaatatattaggtatttcatcggttataaaagataattcactaattttaattgatgaaccagaggtttgcctgcacccagaatggcaagaaaaatatataaaattgttaattgatatatttaaaataaataaaaaatgccactttattattaccactcattctccgcaaatcattgcaaatttaggagaaaagaattgttttataacttcaatagaagatggtaaatctaagaaatccataaattatattaacaaatcctctgattttcagcttgcaacactatttaattctcctggctttaaaaatgagtatttaactcgattatctctaaatttattatctaaaataatatccgaaaaatctgtagaccatgaagataaaaaaatcatggaagaattacttttgataaaaaataaattgcatgaaaaagatccattattggagttgattacttcattagatgaaatggtaaaatactatggctga

SEQ ID NO: 4683 - DNA, 627 bp, Xenorhabdus bovienii
  Coding DNA location: Contig name=SeqID_16897; Position on contig =181464..182090bp; Strand=+
atggctgatattaacgaaccaatatcttatagtaagaactctacagagtttatctgtaaaaaaaaatcgactgaaaatttttctcacactcaatgggatgaagaaaatttaaaaacagttagaaaagaaataagagattattacagaatgaaacaaaatggttgttgtgtttattgccgaaatgaactatccataacttcaccaattaattgtcatatcgagcatattgccccaaaatccagatatttaaatttcatctttgaacctaggaacttatgtgtagtttgtgctgattgcaacacaataaaaaaagataaagaaatcaaaaatgaatgcgaaaacactatatcatcaagtgctaaactttaccctcgtagctcaaaggcattcagcgtttatcatcctcattttgatttttggaaggatcatatcgttaaatttaatggtgaaatttatgctgatttaacagataaaggtgcgaataccataagaatatgtagattaaatagacgcctaagaaaatttggtattaatgaacaaattatatccaatttagataaatttcatttaatgaataaaatcattgaagaaaataaaattgaaaaatttaaagatttttttaaataa

SEQ ID NO: 4684 - DNA, 813 bp, Xenorhabdus bovienii
  Coding DNA location: Contig name=SeqID_16897; Position on contig =182199..183011bp; Strand=-
atgaacaatagggatgtcatcagacaatcaaggattttagacaaactcgactctcatacattaaatatgtatgacacgacttgtcgatggctacctaagggtatttttttatgggtagaaacaaagggtacaggccatacatttatttccgttcatgccgaaagtggaataagtgtatttacctatggtcgttatgctgataccgggccattaggactaactggcgatggtgttttaatttggttacagaataatgaagcaattgaatatatgtcaaccgaactttatagaatggaagctcaagtttataacattagagacgccgatatttttgcaataatgggatattttaaaagtctatggcatacgggtaaaaacataggtggtacatctgtgtctgaatccacccagagatttggaaaaataattgatacttatgatgtaactggagttaactgtacaactcactctgtcaaagcacttaaatacgcaggtagctctgtttttcaaagaaagaatgtattttctgtaaattatacagaagattttaccattccatattcattgcgaatgtacatgaatgacattgatacacttaagaaaagtatgattatcactgatgttacctggagctttaagcaacaaatgagaaatactaaaggattagctcctttaaatgacgcaggaaaagtacaaggagcacttggtgttggcgctaaatcttcaggaacgctaggcactcaaagtagtggttacggtggtgctacttttggtggctcgtccggttggaattacactccagaagaagaataa

SEQ ID NO: 4685 - DNA, 426 bp, Xenorhabdus bovienii
  Coding DNA location: Contig name=SeqID_16897; Position on contig =183008..183433bp; Strand=-
atgtggattaagtcattgtttaatatgctgataataataattttatttgtttttagcaatataggatttatttctattgatttaactataaaagaaataataactctatggacaaataaggaatacaccccatctgaattgtctttttttattcagattaccgattatgtaatgctgactaacaattttctatttgttttgtgcactacaatattttttttaagaaataaactaagatacagtttacgaatgattttttctgtctttttaattaccttactaaataacatctctacgtttatttacgccttaaatttttctatcttttttaaattcattaaaaaccatgatatacatttgatattaattttatttcctgtctcaatgattattatttatattcttgcaaggataaaaaacaaatga

SEQ ID NO: 4686 - DNA, 138 bp, Xenorhabdus bovienii
  Coding DNA location: Contig name=SeqID_16897; Position on contig =183643..183780bp; Strand=-
atggcatgcggtgcaatgggcgaatcaggcctgtggagtgatgatgctatcgagcgccagctaagccatatagaaagcaacaatattagagctgcttatattcacacttctgtggttttaatcggtcgtcttaaataa

SEQ ID NO: 4687 - DNA, 273 bp, Xenorhabdus bovienii
  Coding DNA location: Contig name=SeqID_16897; Position on contig =183717..183989bp; Strand=-
atgaaaatgaaaacggaacacattgtaccgttgagccgtcaggctatttcgcttatcaaaaccttacacagtctgagtggagaaggagaggtgatgtttcccggcgatcacgatccaaagaaagttatgagtgaaaacaccgtaaataatgctttgcgtgctatgggctatgacaccaatacagaatttgtgggcacggattccgcacaatggcatgcggtgcaatgggcgaatcaggcctgtggagtgatgatgctatcgagcgccagctaa

SEQ ID NO: 4688 - DNA, 399 bp, Xenorhabdus bovienii
  Coding DNA location: Contig name=SeqID_16897; Position on contig =184057..184455bp; Strand=-
atgcgaaatctcaaacaatacatttccccctatatcggtacgcttgatgtacgtactttgcgaaccagacaactgttagagcctatcaaagctgttgacaccgacggtaagcacgacgtagttcaaagattacaacaacgtgttactgccatcatgcgttatgccgtccaaaatgacattcttgaatatagtcctgccaatgatacggttggtgctctcaccatagtaaaatctaaacatcacgccgcattaccccatgaacgtttacctgagtttttgatgcgtctttcttgttaccgtgagcgtttaattacccgaatcgcggtagaactgactttattaacgtttgttcgttccagtgagatgaggtttacccgttgggggagagatagatattga

SEQ ID NO: 4689 - DNA, 330 bp, Xenorhabdus bovienii
  Coding DNA location: Contig name=SeqID_16897; Position on contig =184487..184816bp; Strand=-
atgaaactaaacgcccgacaaatcgagactgcgaaatctaaagagacatcctataaattagcgggtggagctggcttatatctcgaaatcacgccgcgcggttcgaaatactggcgcatgaaataccaccaccctaccgataaaaaagaagatcgactggcttttggtgtttatcctgcagtctcattagctgatgcacgcgctaaacgggatgaagctaaaaaattgcttgctcaagggattgatcccaaagcagagaaaaaagacgcacaagccgaatcaaagggcgcatatgcctttgaacagattgccatagtactcaagcaataa

SEQ ID NO: 4690 - DNA, 201 bp, Xenorhabdus bovienii
  Coding DNA location: Contig name=SeqID_16897; Position on contig =184983..185183bp; Strand=+
atggtgccgaaggccggaatcgaaccggcacacccgaaggcggttgattttgaatcaactgcgtctaccgatttcgccacttcggcactgaagtattcgagaagtactcggaaaacggaggccattatacctgtcagaagtccattcgcaacacttatcctttcaatcttgttcaagtgccgaaaaaaaaagcacatctaa

SEQ ID NO: 4691 - DNA, 1218 bp, Xenorhabdus bovienii
  Coding DNA location: Contig name=SeqID_16897; Position on contig =185462..186679bp; Strand=+
atgaacaaacagttatataaactttttgctgtttcagccctgtcatgggcgctttcggcttgtgctgcccccgataatgcacaccagaataattttccgcaatcaggcaaaaaacccgcaaagtggcaagtttttgagggtgatgataataccaagaaaatggcctcatctctggtcgaccagtatgcgcagtcaatctttgatgaaggtaatccgttggggatggcgatggtgattatcgataataatcaggtggtgcatcgcagtttcggggagacttatccagggagtggagcccgtccgcgtcaggattcggtgatccgccttgcttcgataacgaaactgatgaccagcgaggttatgattaagctggcgcagaaggaacgcctcaaaatcaccgatccgttgcagaagtacacttattatggtgtgcgtgtaccagattatgcgatggctcaaccgatccgtctgtatcacctggccagccataccagcgggctgccacgagagcagccgggtggaaaatgggggcggccggtgtttatctggccaacacaatcaaatcgctgggcttggctgaaaacagcaggtatgaatgccgctcccggtacaacggcttcgtattccaatctggcttacgatttactggcggatgcgctctctaaagccacgggggaaccctatacccgtctgctacaagaagaaatcacccgtccttatcgcatgaaggatacgacgctgacgccctctcgttcccaatgtgctcgtttaatggaaggggttaaacccagtccctgtctcagcactaccgcagcagcaggcagtggcgggatttattcgactcccgtagatatgcaacgctggatgcagcagtttttatcctcccacaatcagttgaggaagaagactgccagccgtgagcagggtatctattttaaacgtgaaaatctgacgtcaatcacaggaatggatgtcgcgggtcaagcagacgggatcgggctgggctgggtatatatggatgccaaaaaaggggtgccgggcatctatcagaaaaccggcggtggcggcggattcaatacctatatggccatgatccctgagcagaatatcggtgtgtttgtggtgatgacgcgcaaggaacaaagcaaattcagccgtgtcactaacggggtgaatgaactggtcgcagcattatcacgaaatcatgggaagttatag

SEQ ID NO: 4692 - DNA, 1077 bp, Xenorhabdus bovienii
  Coding DNA location: Contig name=SeqID_16897; Position on contig =186776..187852bp; Strand=-
atgtttggggtactggacagatatattgggcggactatcctgcaaaccattttgatgacgctattcacgctggtgtcgctttccggcatcatcaagtttgtcgatcagcttcgcaaggttgggcagggggaatatagcgcgtttgccgctggtatctatacgctgctgagtattcccaaagatatccagatcttcttcccgatggcggcgctgcttgggggattattgggtctggggatgctggcaacgcgcagtgagctggtggttatgcaggcttctggttttactcgcctgcaagtagcgggttcagtcatgaaaaccgcgatcccgttggtattgctgacaatggtgatcggtgaatgggtcgccccacagggggaacagatcgcccgtaactaccgttcccagaagatgtttggtggttccctgatgtccaccgccaaagggatgtgggcgaaagatggtaatgattttgtctatattaagagtgtagacaaggataatgccctgaaagacgtcagtatctatcattttgatgacaacaaaaaactgctgtcagtaaaatatgcggctactgcggtgtatgaccaaaataacaggcagtggaaattatctcaggttgaggagtctgatttacgtcagattggccggatcactggttcacagcgtatttctgctgaatggaaaagcttgctgacaccggaaaaactgggcgtagtcgctcttgatccggatgcactctccattcgcgggcttcagcagtacattacttacctgaagcaggggcaacaagatgccggtcgttaccagctcaatatgtggaagaaagtctttgcccctctgtctgttgcggtcatgatgctgatggcactttcctttatctttgggccactgcgcagtgtggcaatgggagtcagggtaattgcgggtatcagtacaggcttcatattttatgtcttgaatgagatatttggcccattgagcttggtttacagtatgcctccgctattgggagcgctgctgccaagtctgttattcttcgtcgtgagtgtttacttccttctgcatcgaaaataa

SEQ ID NO: 4693 - DNA, 1101 bp, Xenorhabdus bovienii
  Coding DNA location: Contig name=SeqID_16897; Position on contig =187852..188952bp; Strand=-
gtgatcatcattagatatctagtacgggaaactctgaaaagccaaatcgcaatacttttcatcttattgctgatcttcttcagccaaaaattagttgaagtattgggggcggcggtagaaggaagtgttcccgcaaatttggttctatccttgttaggtttaggtgtgccggaaatggcgcagcttattttacccctgagtctgtttcttggggtattaatgacgttcagcaaactctataccgaaagtgaaattaccgtcatgcatgcctgtgggttgggcaaaggtgtgttggtaaaatcggccttgattctggccctgttcacatcgatgctggcggcggctaacgttctctggttcactccgtggtcttctaaataccaagagcaagtattggcggatgcaaaagccaacccaagtcttgcggccatgatggaaggtcagttcaagccttcccgtgatggcaacatggtgctgtatatcggtaacgtcaagggcaataattttgagaatgtgttccttgcccagctccgtccggtgaataatcagcgtccttccgtggtgattgcggatggcggccatatggaagagcgtccgaatggtaatcaggtcgcggtactccatcaggggatgcgttatgaaggcactgcactgatgcgtgacttccgcattaccgatttcaaaaattatcaggcggtgattgggcacaaagccgctgatattgatagcgataaagttgagcagaagacactctcccaactctggcacaagggtgacgaagattcccgtgcagagctgcactggcgcttgaccttgattgtgtcggtgctggtcatggcgcttatggtggttccattgagtgccgtgaacccgcgtcaggggcgtgtgctcagtatgctgcctgccatgctgctttacctgattttcttcctgctgcaaagttccctgcgctccaatggtggcaggggtaaactcgaccctgcattctggatgtggctggtcaacggagcctattttgccttggcgctggcgctcaatatgtgggataccgtacccatgcgcaaactgcgttctcgctttaagaatcaaggagcggcctga

SEQ ID NO: 4694 - DNA, 111 bp, Xenorhabdus bovienii
  Coding DNA location: Contig name=SeqID_16897; Position on contig =188958..189068bp; Strand=-
atgctttggtatcattttagcaatggggaagccaaactgatgcatataaatggtagatatacgacgaagttagcgactttcctgcaaaaagacaagttttcacaggcgtaa

SEQ ID NO: 4695 - DNA, 1509 bp, Xenorhabdus bovienii
  Coding DNA location: Contig name=SeqID_16897; Position on contig =189233..190741bp; Strand=+
atggagtttagtgtaaaaagcggtagtccggagaaacagcgcagtgcgtgtattattgtcggcgtgtttgaacctcgtcgtctttcccctatcgcagagcaacttgacaaaataagtaacggttatatcagtgccttactacgccgtggtgaacttgaaggcaaagtgggtcaatccctgttgcttcatcatgttcctaatgtgctgtctgagcgtattttgctggttggttgcggaaaagagcgtgagctggatgaacgccagtataagcagattatccagaaaaccatcagtaccctcaatgagaccggctctatggaagcggtctgtttcctgacggaattacacgtcaagggacgtaataactactggaaagtgcgtcaagcggtcgaaacagcaaaagaatcactctatgttttcgatcagcttaaaagcagcaaaaacgaactgcgccgtccattacgtaagatagtgttcaatgtgccaacccgccgtgaattaaccagcggcgaacgcgccattcagcatggccttgccattgcatcgggtatcaaagcgtcgaaagatctggcaaacatgccgccgaatatctgtaatgccgcgtatctggcatcacaggcgcgccagcttgctgacactgccgacaatctgaataccaaggtgattggcgaagagcagatgaaagagctgggcatgaattcctatctggcggtcggtcaaggttcccagaatgaatccctgatgtccgtgatcgagtataaaggcagcaaagacgccaatgcgaaacccatcgtactggtgggcaaagggctgactttcgatgccggcggtatttctctcaaaccaggcgaaggcatggatgagatgaagtatgacatgtgtggcgcagcttctgtttatggtgtcatgcgggttatcgcagaactgcaactgccgctcaatgttattggtgtattagcaggatgcgaaaatatgccgggtgggcgcgcctaccgtccgggagatattttaaccaccatgtccggccagacggttgaagtcctgaacaccgatgcagaaggccgactggtcctgtgtgacgtgttgacctacgttgagcgtttcgatccagaactggttattgatgtggctaccttgactggcgcttgtgtcgttgcgctgggcagtcactataccgggctgatgtccaaccataacccgctggcgcatgaattgctgaatgcctcagaactggctggagatcgtgcatggcgcctgccgatggctgacgaatatttcgagcagctcgattccaattttgcagatatggcaaacattggtgggcgtgcaggcgggacgattaccgcaggctgtttcctgtcccgctttgcgaccaaatacaattgggcgcatctggatattgcaggcacagcatggcgttcaggtaaagccaaaggagcaacaggtcgtccggttgcgctcttagcacaattcctgttaaatcgtgcaggcctgaatgcggatgattaa

SEQ ID NO: 4696 - DNA, 159 bp, Xenorhabdus bovienii
  Coding DNA location: Contig name=SeqID_16897; Position on contig =190709..190867bp; Strand=-
atgatgggaaaagcgatacaaaagggtattgcagccgcaatacccttaattccgttgattcccttgatatctttagactacaccttttatgtcgaactgttaggcaacaaaaagggggcaggggtattaatcatccgcattcaggcctgcacgatttaa

SEQ ID NO: 4697 - DNA, 465 bp, Xenorhabdus bovienii
  Coding DNA location: Contig name=SeqID_16897; Position on contig =190902..191366bp; Strand=+
atgaaaaacgccaccttctatttattggaaaagctctcacaggaacaatcatcgtcttctgatgaattacagccacatgaatggctggcatgccagcttgccgctgatcaatggcgggcagggaagcgggttctgattgcttgcgaaagccagcagcaggccgaaaaactggacgaagcattatggcagcgggagccgagtcaatttgtaccgcacaaccttgccggagaaggccctcgttatggtgcccctgtggagttgtgctggccgcagaaaagaagcaatgttccccgcgatattctggtaacactgcttcctcactttgcagactttgccacagctttccatgaagtgatagacttcgtccctattgatgaaaatctgaaacagttagcgcgcgaacgatataaagtttatcgtagcgtcagctttaatttgaccatggcaacgccgccaatctattga

SEQ ID NO: 4698 - DNA, 2898 bp, Xenorhabdus bovienii
  Coding DNA location: Contig name=SeqID_16897; Position on contig =191380..194277bp; Strand=+
atggaaaaaacactcgctaatcaaacgcaatctgagccatctctcgataaaacctataatccgacagagatagagcaacctctttataaccactgggaaaagaacggttatttcaaaccgaatggcgataccagccgtgaaagtttctgcatcgtcattcctccgccaaacgtcactggcagcctgcatatggggcatgccttccaacagaccatcatggataccatggtgcgttatcagcgcatgcagggcaaaaataccttgtggcaagcagggactgaccacgcaggtatcgcaacgcagatggtcgttgagcgcaaaatcgcggccgaagaaggtaaaacccgccacgattatggccgtgacgcctttatcgacaaaatttggcaatggaaagcggaatcgggtggcaatattaccaaccagatgcgccgtctgggcaactccgtggattgggagcgtgagcgcttcaccatggatgaaggcctgtcaaaagcggtcaaagaagcctttgtccgtctgtatcaggaagacctgatttaccgtggcaaacgtctggttaactgggatccgaaactgcgcaccgccatttctgacttggaagtcgaaaaccgcgaagtgaagggttccatgtggcacctgcgctacccgctggctgatggcaccagaactgccgaaggcaaagattatctgattgtcgccacaactcgtccagaaaccctgctgggggataccggcgttgccgttaacccagaagatccgcgttataaagatctgattggcaaagagatcatcctgcctctgatgaaccgtcgcattcctatcttaggcgatgaacatgcggatatggagaaaggcaccggctgcgtgaaaatcacgccagcgcacgatttcaatgactatgaagtcggtaagcgtcacagcctgccaatgatcaatattctgacatttgacggcgatatccgtgacgaagcggaaattttcgataccaatggcgaagcctctgacgtttattctgctgacattcctgccgcataccgtggcatggagcgtttcgctgcccgtaaagcgattgtggccgaatttgaaaaacagggtctgctggtagaaaccaagcctcatgacctgactgtaccttacggcgaccgtggcggcgtggtgattgagccaatgctgactgaccaatggtatgtccgcactgctccgctggcaaaagtggcgcttgaagccgttgaaaatggcgatatccagttcgtgccaaaacagtacgagaacatgtactactcctggatgcgcgatattcaggattggtgtatctctcgtcaattatggtggggtcatcgtattcctgcatggtacgatactcaaggcaacgtctatgttggccgcgatgaagaagaagttcgccgtgaaaacaatctgggtgcggatattgccctgacccaggacgaagacgtactggatacttggttctcctctggcctgtggacattctccaccctcggctggcctgagcagaccgaagccctgaaaaccttccatccgaccaatgtactggtcagtggcttcgacattatcttcttctggattgcccgcatgatcatgatgaccatgcatttcatcaaagatgaaaacggtaagccgcaagttccgttcaaaaccgtgtacatgaccggcctgattcgtgatgacgaaggccagaagatgtcaaaatccaaagggaacgttatcgatccgctagatatgatcgacggtatttcgctggaaaatttgctggaaaaacgtaccggcaacatgatgcagccacaactggccgagaaaatcggcaaacgtacggaaaaacagttcccggaaggcatcgaagcccacggtactgacgccctgcgtttcacactggcggcactggcttctaccggacgtgatatcaactgggacatgaagcgcctgcaaggttatcgcaacttctgtaacaagttgtggaacgccagccgtttcgtgctgatgaatactgaagggcaggattgcggtcaaaatggcggagaaatgtccctgtcactggccgatcgctggattctggctgaattcaaccagaccgtgaaaacctaccgtgaagcgctggatacctaccgttttgacattgccgccaacattctttacgaattcacatggaaccaattctgtgactggtatctggaactgtcaaaaccggctatcaacaaaggctcagaggcagaagtccgtgcggctcgccatacgctgattgaagtcttagaaggcctgctgcgtctggcgcatcccatcattccatttatcaccgaaaccatctggcagcgcgtgaaagtggtgaaaggcattaatgcagataccatcatgctgcaacccttccctcaatttgatcaggcgaaagtggacgagctggcgctgagcgatctggaatggatcaaagaagccatcattgcggtacgtaacattcgtgcagaaatgaacatcgcgccaagcaagccgctggaggttctgctgcgtgatgccaatgcggatgcacagcgccgtgtggctgaaaacctcaacttcattcaggcgatgggtcgtctttcttccgtcaccgttctggcggtgggcgaagaagcccctgtttctgtcaccaagctgatcaacggtgcagaaatactgatcccaatggccggtctgatcgataaagacgttgaactggcacgtttggataaagaaatcgagaagctggataaagaaatcagcgcgattgaagccaaactgtctaacgacggttttgtcagccgtgcgccggaggccgttgttgccaaagagcgtgagcgtctggcaagcaacaatgcggcaaaagagaaattactggcacagaaagagacgattgctgcgctgtaa

SEQ ID NO: 4699 - DNA, 774 bp, Xenorhabdus bovienii
  Coding DNA location: Contig name=SeqID_16897; Position on contig =194649..195422bp; Strand=+
atgaaaatcgtactcaacatactactggcaactatcatccaattaggcatcacccaactagcgtatgcaaaatccacccttgataatatccaatccacaggcgtattcagaatcgggacagaaggagcctatgcaccattcagttaccatgatgcttccggcaaattaaccggttttgatgtggaaattggccgcgaaattgctctgcgtatgaaagtaaagcctgaatttattgaaggtaagtgggatggtttgattggtggccttgatgccggacgttccgatgcagtaatgaaccaaatcgccattacgccagagcgtgcgaaaaaataccgcttttccctgccctatgtcatttcagaggcggtgctgattacccgaaaagataatcatgacattaaaactttcagtgatttaaaaggcagaacctccgcccataccctgactaataactttgcccagattgcccgccattacggtgcagaaattatcggcaccaatggctttagtcaggaagtggaactggtcagcacaggccgggcagatgccactatcaacgataaactctcttatctcgactataaaaaacatcgcccggatgcacaggtaaaaattgtggcggccgataccaacgcagcacaaaccgccgtgctgctgcgtaagagtgatcctgaattaaaagcggccgttgataaagcgattactgaaattaaaaacgatggcacttatcagcggatttgggataactattttggcggagaggtggctgaataa

SEQ ID NO: 4700 - DNA, 153 bp, Xenorhabdus bovienii
  Coding DNA location: Contig name=SeqID_16897; Position on contig =195367..195519bp; Strand=+
atggcacttatcagcggatttgggataactattttggcggagaggtggctgaataatcagaataagattatgggtgtttttttaattattcatagcccattgaaattaaaaaacacttttaatctcgattttcttacaggatctatcatttaa

SEQ ID NO: 4701 - DNA, 708 bp, Xenorhabdus bovienii
  Coding DNA location: Contig name=SeqID_16897; Position on contig =196421..197128bp; Strand=+
atgactccatcatggctcagtttagcgctggattccctttggccgatgctttacgctggcctgacatttaccattcccctcacgctgattacattcgcacttgggatttctctggggtttatcgtcgccttaatccggctgtacgggccaaaaccactgatcgcagtcgttcggttttatgtctggctgatccgtggtacacctttactggttcaactgtttctgatcttttatgccctgcccagcgtgggcattacgctggaagccttcacctctgccgtcatcggctttaccctgaatgtcggtgcttatacttctgaagtgatccgggcagcgctgatttcggtgcctaaagggcagtgggaagcgtctcactccatcggcatgagttggtggcagtcactgcgccggatcgtactgccacaggcggcgcgagtttctattccaccgctgtcaaatacctttatttcattggtgaaagatacctcactagcttccgtcatcactgttccagagatgttcctggctgcacaacgtatcgccgctgtcacataccaaccgctgatcctgtataccgaagccgctatcctctatttgcttttaagttcagtgctgtcagcactacaagttcgtctggaaaagaaattctcccaacaattttcccaacaccgcagcagtaaggaagcgaaaaatgattcagctctctaa

SEQ ID NO: 4702 - DNA, 765 bp, Xenorhabdus bovienii
  Coding DNA location: Contig name=SeqID_16897; Position on contig =197112..197876bp; Strand=+
atgattcagctctctaacattgaaaaaagtttcgacggacaaaaggtgctgaaaaacattagcttgaccattaaagaaggtagcctgacggcattgatcgggccttctggcagcgggaaaagtaccctgctacgctgcatcaatctgttggagatcccacaggcgggtacattggaaattggcaaagaacagatagccttcaccggcaaagaacgcctgccacacagggaaatccaacggtttagcctgcaaacgggcatggtattccagaattttcagcttttccctcatctcacggtgattgaaaacatcatggaagggctgatttatgtacaaaaatggccacgcgaacgcgccagagaacgagcgcaggaattactgaaaaaagtggacatgttccataaggcagatgtctggccgaacacattatccggtggtcaacaacagcgtgtggctattgccagagcgatggctccctctcccaaagtgctgctctgtgatgagccgacttcagcccttgaccctgaattatcgaaagaagtcgtttctgttctgaagcatttggcagaagaaggcacgaccatggtgatggcaacacacgatctgcgtctggccgccaatcttgcccacaatgtcatctttctggaatcaggcgaaattgtcgaatcgggaacagcacaaaccatgtttacccgcccggataagcagcgcactggcgagtttatctcaaccctgacggaaactttacctgactgggaaatataa

SEQ ID NO: 4703 - DNA, 774 bp, Xenorhabdus bovienii
  Coding DNA location: Contig name=SeqID_16897; Position on contig =197958..198731bp; Strand=+
atgaaagcattcctgagtttgttactggcgggcgccacagccctttcaatctctgcgcccagttatgccggaaaggatttggacacgataaaagcctccggtgtctttaaagttggaacagaagggacataccctccttttacctatcacgatcaggccaataaattaactggttttgatgtagatatcgcccgtgaagttgcacgccgcctgaatgtcaaaccagaattcatggaagttaaatgggatggcttgattgcgggactggatgccaaacgttttgatgctgtgatcaaccaagtgggtgtcacacctgaacgggaagcgaagtacagtttctccattccttataccgcttcccaagtcgtattgattactcgcgataataacaatgacattaaaaccttcgctgatatcaaaggaaaacgttcagcccagtccctgaccagcaactatgggcaactagcaacctataatggggctcatttagtcagtaccgatggctttaaccaagccattgatttggtcgctacgggtcgtgcagatgcgacattaaatgatcgcctttcgtttctggatttcaaaaaacagcgtcctgatgcaccagtgaaaatcgtcgctcaacaagccgatgcaagcaaatcggccgttctgctccgtaaaggagatccagaactgatcgccgtcatcaataaggcactgcaagacatgaaagatgacgggacttatgcccgtatttccgaaaaatacttcggcactgatatttctaaataa

SEQ ID NO: 4704 - DNA, 504 bp, Xenorhabdus bovienii
  Coding DNA location: Contig name=SeqID_16897; Position on contig =198976..199479bp; Strand=+
atgactgaaaaaacaacacaacactacgtcattcgccccattactccgcaagataataccggcattgctgccgttatccgtcaagtatccgccgaacatggcttaaccgcagaccgaggttttgccgtcgcagatcctattctggatacattgtacgaagtatacagccagccacgcagcgcttactgggtcgtcgaaatggatggggaagtcgttggcggcggaggtgttgctccactagctggcggcgatgatgatacctgcgagttgcagaaaatgtatctctcatcagtactgcggggaaaaggcgttgccagacaaatcgtgaaacaatcactggaatttggcaccgagcaaggcttcaagcgctgctatctggaaaccacggagatcttgcaagcggccatcaaactgtatgaaaaactgggattcagctatcttggtgagccactcggcaatactggccacagcgactgtgaggtcaggatgatcaaagcactataa

SEQ ID NO: 4705 - DNA, 432 bp, Xenorhabdus bovienii
  Coding DNA location: Contig name=SeqID_16897; Position on contig =199546..199977bp; Strand=-
atggcagacccacatgctttagaagaacagcgcgaagaaactcgcttgatcattgaagaattattggaagatggcagcgatcctgatgcgctttatattattgagcaccatttttcggcggaaaacttcgatcttttggaaaaagccgccgttgaagcattcaaactcggttatgaagtgacggatgcggaagagctggaaactgaagatcgtgttgtgctgatgtgctgtgatatcatcagtgaaagccgtctggatgctgaactgattaatacgcaggttgagcaactcatgaatctggttgaaaagctcggtgtgaattacgatggttgggggacgtattttgaagatcccaacgcgccagatgatgaggatgaagacgaagctgaagctgaaaatttccctgagcaggacgagcgcaaacttcactaa

SEQ ID NO: 4706 - DNA, 183 bp, Xenorhabdus bovienii
  Coding DNA location: Contig name=SeqID_16897; Position on contig =199925..200107bp; Strand=+
atgatcaagcgagtttcttcgcgctgttcttctaaagcatgtgggtctgccatgccaatcccctccgtcatttggctgtcctgttgcgcattctcccatctttttcctgcgaaggatatagctatccaatttcatcaaaaaggaaatacagaccgtaaactatggcatgaaaaattgtcttga

SEQ ID NO: 4707 - DNA, 1014 bp, Xenorhabdus bovienii
  Coding DNA location: Contig name=SeqID_16897; Position on contig =200211..201224bp; Strand=+
atgaatccattttatcaacgtaacttattaagattacatgactatactccttcagaaatcaatacctttctgacactggcgagtgaattaaaaacgaataagaaatcaggtaaagagtcgcctttactgtcaggtaaaaacatcgcgctgatttttgagaaagactccacccgtacacgctgtgcctttgaagtcgctgctcatgatcagggtgccagcgtcacctatttaagttcaaatggcagccagattggatataaagaatccatcaaggacaccgcacgggtacttgggcgtctgtatgacggcattcagtaccgtggatacggtcaggaagttgtcgaaactctggcgaaatacgccggcgttccggtctggaatggtttgacgaatgaattccacccgactcaactgttagccgatttactgacgatgcaggaacatagccagaagccactgactgaaatcaaattcgcctatttgggcgatgcccgcaataacatgggcaatacgatgctggaagccgctgcattaaccggtatggatctgcgtctggtcgctcccaaagcgtgctggccggatgcggcattgattgccgaatgcgaaaccctggcagaaaaaaccggcggcaggatcgccctgacagaaaacattgccgccggcgttaaagatgccgattttctttacactgatgtttgggtttcgatgggggaacccaaaacagtctggcaagagcgcattacgctgctaaagccctatcaagtgaatatggatgtcattcaactgacgggtaacccagaggtgaagttcctccactgccttcctgcgttccacgatgaagaaacaacgcttggcaaacaactggctgaggagttcaatctgtatggtgggctggaagtcactagtgaggtctttgaatcaaaacacagtattgtgtttgatcaagcagaaaaccgtatgcacacgattaaggcagtgatggtagcaacgctagcgaagggacttagtttttga

SEQ ID NO: 4708 - DNA, 1074 bp, Xenorhabdus bovienii
  Coding DNA location: Contig name=SeqID_16897; Position on contig =201267..202340bp; Strand=-
atgccaagcagggaaaaccagatattacgacttatcaagcaagatccttttattcagcaacaagaaattgctgatattcttggggttagtcgttcatgtgtagcaggacacattatgaatatgaacaaaaaaggtcatataaagggcaaaggatatatttttcctagttctaataatgcttatgctgtcacaattggcgcagccaatatggatttcaccagttatgcctctgaaaagctagtgtatgaagattccaacccagggaaaataatatcgacgccgggaggtgtcggaagaaatattgcacaaaatattgctgcactgaaaagtgaaagccatttcatttctgttgttggcaatgattataatggcaaggtattattcgaacaaacgaaattagctggggttaatattagatatttccataaattagatgaggaaaaaacatcaatctgcaattctatcattgatgaaaatggcaaatgcatagtctctgttaatgacatggacattatggaaaagctcacgcccacattattatctcagtccgaagaattaatccgacgtgctagtgtactggtcattgactgtaatctgacagaaggatcattggaatggctatttaatcatgctggaaatgtgccgatttttattgataccgtttccacatttaaggcgactaagatccgccattggctatctcatatccacaccctgaaacccaatcgatctgaagctgaaattcttagcggaatagaaattgagacccaaaaagatgcggctgtcgccgcatcctggttccatcaacaaggtgttcaacgtttaattttaagcatgggtgcggaaggtgtgtactacagtgaactagataataaatcaggctattcacgtgcgattaccaccagtgtactcaatgccagtggagctggtgatgcgatgatggcaggtctcgcccactgttggttacagagtatgtctctggaagacagcattcgttacgcacaacgatgttctgcactcacgctgtcttctgaggatacttggatactacccaataagtcgtctataccttga

SEQ ID NO: 4709 - DNA, 219 bp, Xenorhabdus bovienii
  Coding DNA location: Contig name=SeqID_16897; Position on contig =202755..202973bp; Strand=-
ttgtttattgaatccaattcattttctgaacctttaaaagtgttgctggcagggctagaagccgaacatgcttttaccaaagcattccctgagtatcgttatcgcaatacagaggaagaacatcagcgctggttacaggcaacacgtaaaaatccaccattattgcaccctgtagtacgtactcatcctgtggcaggaaaagtgttcagtttttactga

SEQ ID NO: 4710 - DNA, 336 bp, Xenorhabdus bovienii
  Coding DNA location: Contig name=SeqID_16897; Position on contig =203354..203689bp; Strand=+
atgaaaccaagcataataatcatagctgaatctatattaaccattccgttcgtatcattacatgccaataccaacgccaagaccaaggccaatgtgaaaattactgattgtaatcaattaaatggaaaacctggtcaggatggtaaaaacgggatacctaatagcaactgtataaatggaggtaacggcagtaacggctcatctcccggtcaatcagaaggaaatggtggcaacggtgcaaacggttcatcgagtgagcaaactcaaggaaatggtggagatggaggcaaagtatccaattatcacaatctccaacatgcaggccgccatgcttaa

SEQ ID NO: 4711 - DNA, 153 bp, Xenorhabdus bovienii
  Coding DNA location: Contig name=SeqID_16897; Position on contig =203634..203786bp; Strand=+
atggaggcaaagtatccaattatcacaatctccaacatgcaggccgccatgcttaaaaccaatacgtatacctggaatcattataagcaaaagagcggaaacgatgaatgccagcagagcatcagtaaccaacatggtaatctccgaaaataa

SEQ ID NO: 4712 - DNA, 147 bp, Xenorhabdus bovienii
  Coding DNA location: Contig name=SeqID_16897; Position on contig =203737..203883bp; Strand=+
atgaatgccagcagagcatcagtaaccaacatggtaatctccgaaaataaaaatctaattgaagcttatatatttgaccgacaccgattttgtcaatcaaacgccattatctgcctgatggaatttaaagctctgttcatgcattaa

SEQ ID NO: 4713 - DNA, 234 bp, Xenorhabdus bovienii
  Coding DNA location: Contig name=SeqID_16897; Position on contig =203898..204131bp; Strand=-
atgtggggcactttattatgctctccggtacaggggcattcaggccaaaaggtcgatattagttatcaagcgcaagtcccgccggcggttttgtatcacggtacagcccccgttttctggattctattttccagcagggattggtggcaggtttgcgccattacgtgcatttatcggcagatgaagccacagccattaaagtcgggcagcgtcatggcaagccgggtaccctaa

SEQ ID NO: 4714 - DNA, 294 bp, Xenorhabdus bovienii
  Coding DNA location: Contig name=SeqID_16897; Position on contig =204145..204438bp; Strand=-
atgagtgtccggtttactaagaaggccagagagcatattcgtgcagtaaagctctattctatgcgccgatggggggtgaatgtcgcggaagcttatgcaacttcgttgcgtgtgactatgacggcaattcttgatcgtcacccatcccccggtcgtgatcgcagtgaggatctttattttggtgtgctaagtttccccgtagagagccacattatttactaccgggaagttccgactggtattgaagtgttggcggtgttgcatcagacgcaagatccacataactatctataa

SEQ ID NO: 4715 - DNA, 270 bp, Xenorhabdus bovienii
  Coding DNA location: Contig name=SeqID_16897; Position on contig =204441..204710bp; Strand=-
atggaaattattcccgcacaactagctaagaaccagtttggtgatctgcttatgaaagttcagcgtgagcctgtggaaattagtaaacatggtaagcgtgtggccgtggttatctctcctgaagagtatgatcagttcacacagctcaagttacagaatttaaaagccgttctggctgaatctattgcacaagctgatcgtggcgaattgcatagtattgatgatgtatttgccccgttgacggttgatgaacttgagggtaaggcttag

SEQ ID NO: 4716 - DNA, 381 bp, Xenorhabdus bovienii
  Coding DNA location: Contig name=SeqID_16897; Position on contig =204758..205138bp; Strand=+
gtgcatagagctaccagtaatcaaaatagccaaccgccaaccagctggtcgagtagcccgagaggatctcacccacaggctactcgaccaggtattgagtgtcattttcagaaaacgattgcacgaaatgtcaggagtcggctgcactcgattgctggagttgtggagcaaatagctgacccgattttgggaggtaggagtttcaggagcaacggaacagtaaaggtgctcatcgaacttgatgtgatattacaaggacccaaaatcggacgtagtcacagttaccgtttaaaccctcagttcggctggaaaggtacggtaaataatcataaaaaagcgcttaccaatggcctgagtgtaattcagggcggccgtgcttaa

SEQ ID NO: 4717 - DNA, 465 bp, Xenorhabdus bovienii
  Coding DNA location: Contig name=SeqID_16897; Position on contig =205168..205632bp; Strand=-
atgattgaattaagagaaatgacaactgctgagtttgaattattccgtttactttttataaatgagcatgcattagacttagcttcaacacgaggttatccggcagacgtatcacttaaaaaagcctctcagttgattgatgtaacccaatcccaagtaacagagaaagtaataaacaaattctggtgcattgtgaaatcagatcatgagctgccagtgattggttatctatggatagaacttcaagagaaagctgcgtgggtttgtgattttcgcttattacccgagtggcgtcgtaagggattaggtaaggcggctctggataaaatgaaaagtaatctcatgtctatgggcatcacagaggtagggttgagagtcgctcccaataatccagttgctaaagcactatacgaaaaaagtggttttcatatcactgggtttaatatgtctaaaactctaagttaa

SEQ ID NO: 4718 - DNA, 546 bp, Xenorhabdus bovienii
  Coding DNA location: Contig name=SeqID_16897; Position on contig =206066..206611bp; Strand=-
atggctcaattcgatacaaaaataagcaaatttttaagttatgtgttgcgtcatcaacctgaatctattggcttaacgctagatagtgaagggtgggcagatatcagtgtactgattaaatgtgcggagaagcacggtaagcacttgaatcatgcgctgatcgcaacgatcgtcgaggccaatgataaaaagcgatttgccatttcagacgatcaaaaacgaatcagagcggtacaggggcattcaagccaaaaggtcaatattagttaccaagcgcaagtcccgccggcggttttgtatcacggtacagccacccgttttctggattcgattttccagcagggattggtggcaggctcgcgccattatgtgcatttatcggcagatgaagccacagccattaaagtcgggcagcgtcatggcaagccgggtatcctaaaaattaacgcccagttaatgcatgaacagggctttaaattccatcaggcagataatggcgtttggttgacaaaatcggtgccggtcaaatatataagcttcaattag

SEQ ID NO: 4719 - DNA, 798 bp, Xenorhabdus bovienii
  Coding DNA location: Contig name=SeqID_16897; Position on contig =206653..207450bp; Strand=-
atggagaggaaaacaacagcggtcagcccggccatgcgcacccgcgttaaacaggaattggcggatatagagaaaaggtatggcgtgcgggtactgtacgcctgtgaatccggcagtcgcgggtggggctttgcctcacctgacagtgattacgatgtgcggtttatttatgtccatcccgtggactggtatctcaccgtagaagcagggcgggatgtgattgaactgccgatcagcgatgagctggatatctgcggatgggaactgcgtaagacactaaagttactgaaacaggcgaacccaacgttaatggaatggttggattcgccgattatttataaagcagatccggccgccactaatggattaaaaacgatggtgccgcatttcttttcggatatcaaagcgcgctatcactacctttcgatggcgaagaaaaacttccgaggttatctgcaaggtgaaaaaattcggcgtaaaaaatatttttacgtattgcgcccgttgcttgctgtacgctggatcgaaatgggcaagggcgtaccaccgattgactttgaaacgctggtggcaggtacagtcgatgatcctcaattgaaagcggaaattggtgatctactgcggcttaaaagatcagcgaatgaggcagaatatggcctgcgtaagctgagggttcacgcctttattgaatcagaacttgatgaaacgttgtctcgttgcgaactcaaggataagcgtgaacgcagtcatgcactactggatgattatttaaggcgttgggtgatgaaacgcgtataa

SEQ ID NO: 4720 - DNA, 1242 bp, Xenorhabdus bovienii
  Coding DNA location: Contig name=SeqID_16897; Position on contig =207476..208717bp; Strand=-
atgacagcaactgaaatgaaaaccaacgcttataacttattgacgcaagaaaatggcactcaaataaaaatgtggactcacggagtcccggttgatccgaaagccattacccaattacagaacacggccaagatgccttttgtattcaaacatctggcggtaatgccggatgtccatgtcggtaaaggatcgactatcggtagcgtgatcccaacacgcggagccatcatacccgcagcggttggcgtggatatcggttgtggaatgattgccgtgcgtacttccctggtggcatcagatttgccggatagtttgctgaatatccgtcatgccatcgaagcggctgtaccacatgggcgtactgtgaaccgtggtggtcgtgataagggttcttggcatcgtgcgccggaaattgtggatcagcattgggcgacgttggcggatggtttcaaatgtattaccgataaatacccaaaattactgaacaccaataaccatcagcatttgggaacactgggaactggtaaccatttcatcgaattgtgccttgatgaaacagatcgtgtctgggtgatgctgcatagcggttcccgtggggtgggtaacgctatcggtaacttatttatttcattggcgcagaaagatatgcagcagcatattgcgaacctgccagaccgtgatttagcttatttcgaagaaggcagccgttattttgatgattacatggaagcggttggttgggcacaggattacgctcgccaaaacagggaagtgatgatgcaccgcgtgcttgaagccttgtcacgcgagatcccaaaaccgtttacaacacaggaggaagccgtgaactgccaccataactacgtccagcgtgaacagcattatggtgaagaggttttggtgacacgtaaaggggcggtatctgcccgtagaggccagatggggatcattccgggttcaatgggcgcgaaaagctatatcgtccgtggcctcggaaacgaagaaagtttctgttcatgcagccacggagcggggcgtgtaatgagccgtactgaggcgaaaaaacgtttcaccgtaagcgatcaaaagcgcgcaaccgcgcatgtggaatgccgtaaagacagcgatgtgattgatgagatcccaatggcgtacaaagatattgatgctgtgatggaagctcagtcatcactggtggaaattgtgcataccctgcgtcaggtggtttgcgtaaaaggataa

SEQ ID NO: 4721 - DNA, 222 bp, Xenorhabdus bovienii
  Coding DNA location: Contig name=SeqID_16897; Position on contig =208714..208935bp; Strand=-
gtgaaaataaaaataattaattttcaaatagataagaaatattcctgcttttttcaaagttggcacgtaattggcaataactcgtatgtgggaacccgtttactgttgaataccgcgaaagtgatggaaagcatcgctgaacgaatcactcaaatttcggtatatggcggcttagatcaagttctgaatgggctggtacaaatcaaaggagaacaaaaatga

SEQ ID NO: 4722 - DNA, 1578 bp, Xenorhabdus bovienii
  Coding DNA location: Contig name=SeqID_16897; Position on contig =209026..210603bp; Strand=+
atgaaacgcagagttgtcattggggttttgggtacgaagttggatagacggggcaaaaaggccaaccgctggacaaaatggcgccctacgattggtatgtgccagcaagcggagttgccgattgacaggctggaactgctctaccaaaccaatgactatggtttagcacaaagagtgaaggaggatatcgcagagacttcgccaaaaacggaagtggtcttgcaggagcttaagattgaagacccgtgggattttgaagaagtctataccgcgcagcttgattttgccgtgcgttatccttttgatactgaaaacgaagaatatctggtacatatcacaacgggcacacacgtcgcccaaatttgctggtttttgctgaccgaagcccgttatctgcccgcccagttgctccagacctcccctagaaatagcgatcgcgagagccatcctgaaggcgtctacaccatcattgatttggatctcagccgctataccaccctgaccagccgctttttgcatgaacagcaagaacaggtcgcatttttgaaatcgggtatcgccacacgcaatgctaatttcaaccgtttgatcgaccaagttgaacgtgtcgccctgcgttcttccgcccccattttgctgatggggctaacgggcgcgggcaagtcttttctggctcgccggatctatcagttgcggcaatctcgccatttaattcaaggccgttttgtggaagtaaactgcgcgaccctgcgcggtgataatgcgatgtccacgctgtttggtcatgttaaaggggcgtttacgggtgccattcagccgcgtacagggctactgcgtgaagccgatggcggcattttgtttcttgacgaagtggcagaactggggttggatgagcaggctatgttgctgaaggccattgaagagaaaagcttcctgccttatggctctgataaagaagttcacagtgattttcagttaattgccggtactcaccgcgatctgcgcgattgggtggcacaagggaaatttcgtgaagatctgtacgcccgtatcaatatgtggacttatcaactccccggtctggcgcagcgtcgtgaagatattgagccgaacattgagtatgaacttgcccgctatgcacagatgcagcagacacaggttcgcttcgataaggaagcgcgactgatttacctgcatttttcctgttcagaacaggctcaatggcggggcaacttccgcgagttaggtgcatccgtcgcacgtatggcaacattcgccgaaaacggacgcatcaatcagcatttagttgaagaggaaattatgcggctcaaacagaattggcaggataataggctctcttccctgctgccgaatcatttgccggaagttgatctgtttgaccgccaacagttggaaacggtcattaaagtttgccgtgaatctgccagtttatccgaagcaggccgcaagctgttcgccgtttcccgccaacaaaagaagcagcccaatgatgccgatagattacgcaagtaccttgcccgattcggtctggactgggatagcattcaacatgattag

SEQ ID NO: 4723 - DNA, 915 bp, Xenorhabdus bovienii
  Coding DNA location: Contig name=SeqID_16897; Position on contig =210616..211530bp; Strand=+
atggaactgaaatttttaggcaccagcgcgggtgttccgacgaaagagcgcaatgtcaccagtctggttctggatttacggggtatccgcaatacactatggatgtttgattgtggtgagggaacacagcaccagatcctcaactcctccatcaagatcccgaaactggagaagatctttatcacccatctacatggcgatcatatctttggcctgccggggttactgtgcagccgttcgatgggcggctccaccgatcccgtgatgctatacgggccaaagggaatacggcagtttgtagaaaccgcattgcagttgagcggctccttcctcacttatccactggatattgtcgaagtgcaatccggactgctgtttgatgatggcgagttgaaagccacggcttacgcccttaaccatcgcgtggaatgctatggctatcgcattgaagaacatgacaaacccggtggtctggatacccagaaacttaatcaggataatattcctcgtggcccgtggatgcaggtcttaaaacaaggcggtacggtgacattagaagatggccgtacggtgtgtggcaaagattatctgggtgcgccgatttccggtaagtcgctggccattttcggcgatacgacaccaacccccgaagcactgaaactggcagccaatgttgatgtgatggtgcatgaaattactctggaagatgcacttgccgaaaaagccaatcacaatgggcattccaccacaaagcaagcggcgacactggcacgcgatgccaaagcaaaacactttattgcaacacatatcagcggacgttatggtatagaagattgcccgcgattattggcagaatgtcgggaaatattccccaataccgatctggcagaagactttgcgatatttatagtttaa

SEQ ID NO: 4724 - DNA, 201 bp, Xenorhabdus bovienii
  Coding DNA location: Contig name=SeqID_16897; Position on contig =211712..211912bp; Strand=-
atgttaatttttatttataatttccttcagtatatttatttattacctaccaataggcgacactacctaaatgctagctttgttgctcgcatgttaagtgaggatgtcattgcgcgcattatattggttaaaaaaatgttaatatgtcacctaaaaatggtgacaaaaaataaaatgataaaaaatggttttattatttaa

SEQ ID NO: 4725 - DNA, 1221 bp, Xenorhabdus bovienii
  Coding DNA location: Contig name=SeqID_16897; Position on contig =212015..213235bp; Strand=+
atgaattcaatcataaaaacagatattaaagaaagtatggctaatatttccacagaaaatacagttaatatctggtctgactggcttgatgaaaaagaattaaaaaaattgacagatcaccctgtactccagtcatttaatgacagtacagccagtgaagaaatgttaaaaacattcctaattcaacactgctattattctcgtcattttacacgttatttaatcgcgcttataagtaaattagacgtatttgaagatataaaagatcttcttcataatttactggaagaaatgggattagaggatgaaaacaagatcactcacgctgagctttttcagagaacattgaaaactgtcggtgctgatatcaatagtcaaaagccttttgaaaatacaaccgctatggttgacgctatgttttctttctgtctttcagatgatccattagagggtctgtcagccatgtgccttggcgctgaagctatcgttcccttaatttataagcccgtattaaatcgtttaatgacgttgaattacaataaaaatgcaacagaattcttcacactccatattgaagaagatgaagatcatgctattaaaatgtttgaaatcatagatagactcactagtcaggacgaatcattacgcctcaaagccatcaatattggcagtgaaatgataagaaatcgcgtaaaaatgctggatagtgtctgggagagtgaagtcgttcgtaagaacaacgcagaaaaggccgacttaaataatcaaaaaaatgatctttcctttcattctgctgatttttggcgtgtcaactacaaaccaacaccttctattcctgagaaattgattcataaagatgtcatcaacagtaatagtcatggtgaaaatcaattttcagcagaaagaaaacataaagtcaatatcgtcaatttgcctactaaaaccatcagtatgacattaggccatcttgacgccgaacaatcgacgaatctacatcgacataattatgaaactgtcatctatatcattgaaggaaatggcgtatcaaaaataggaaataatgatgttgcttggtcaggaggagatgctatttatatcccatcctgggtcgaacataaacatagtaatatgggtcaggataaatgcctttatattgcttgtgagaatgccccattattacaaaatattggtaacatcgcacttcgtgaagaattagaataa

SEQ ID NO: 4726 - DNA, 1611 bp, Xenorhabdus bovienii
  Coding DNA location: Contig name=SeqID_16897; Position on contig =213258..214868bp; Strand=+
atgtcattagccacatttcctacacttgaagctattgttagcacaactaaatcaataaatttagcgcaacgatttgttatggaaaactcatctcttgataaagattgttttatcggaccagacggctcattgagttattcccagcttgcattttttgtccaaaaaagtgcttctgctatgtcgttaaaaaaaatagaaaaaaatacagcagtcatcctctgtctcaatgacagccgggaattagctattattttctttgccagtttagcaattggagcgttaccggtcgttattaacccgaaattaccagctaatactcttaattacatactgggtgaatttgataccccctttattttcctcgatgagggtaatgaaatatctatcgcacctgaagcgaaagaaaatactatccgtattaaaaggagtgccgatctttcggcattctgtgattggatgcctgaaaacaccaatgataaatggcatgattttttggaaaaaacccatcttgagcctgctttcattcaatatacctcaggatcgactggaaaacccaagggagttattcacagcgttacatcaattttgtcttcctgtgaacatttttccaaacatcaattaggtttaactacaacagacattatctattcaacaccaaaaacattttttggttatggtatgggaaataccctatttttcccgctatatatcggtgccactgcaattatagacagcctttggccttcaataataagagttacgagcaatatcaaaaaatttcagccaacggttcttttggcggggccgatgatatttcgcttgttacttgaagatgctgaatttaaacaatattgccatcttcgcttggtcgtttcttctggctcaatgttacctgcaccgttaaaagaatcctggtttcagcggctcaatatcgtcatacatgatgcatttggcgcaactgaagcatgccatgcttttgcgacaacttatggccatccatctcgttcgggtagcattggaaaattgattaccgggtgtacaggaaagattgttgataaagatggaaaaaccgttccggctagggaaactggcgtgcttatgctgagttcagaatccttagccctgggatattggaataaccatcaagatacaaatatcaagttttccaacggttggtatcgcactggcgatctattttcgcaagacgaagaaggattcctttattatcacggccgtgaagatgaacagttcaaagtattggggcgctggttggtgccggtagaaatagaaaaactcgtccattccgctttcccagaaattggtgatgcatttatgatcccctgggtggatagcacccaagaatgcagacctgttttatgtctgaaaacttcttccagtgaatttgaagccatcagtcaacagatagccaattttatcagccaccaagtggaaagttataaacatccctatgtttatctcaacttagaacaattcccactgaatggaaacggtaaaattgaccgtaagtcgatgatcgaaatcgctcgccaaaaaattactgacgaaaatatgtcttctcatcctcggagaattaattatgcacaatcttaa

SEQ ID NO: 4727 - DNA, 1503 bp, Xenorhabdus bovienii
  Coding DNA location: Contig name=SeqID_16897; Position on contig =214855..216357bp; Strand=+
atgcacaatcttaatgaatttcttgcttatggtgaagaaggatataatttggtgccagtatggaaaaatatcaaaaaaacacagatatctcctattagcatttacgaagccttagccaacaaaagctatagttatcttttcgaattatctgaaaaacatgaggataaatatagggcaacttattctattgttgggcttccatgccatcaacggatcgaaataaaagattattcaatcaaagtatttgacgagaataatactccgacttatataacagatattcccccgctggatgccctgcggcaaatactggcaagctatcgcgtgccaaaaattgatcaattacccaattatgctggtgggttgtttggttattttggctttgaaaccacacggcttatcgagcctaagctccaagccaatacacgtaaaaaaacattaattgatttaccggacatattacaaatagtcagtcaagaattgatcgttgtagatcatagaaatgatctcatctatgtcattgtccatgcaaaacctactgaatcccaaaattttgctgatgcaaatctaagaataaaccagattatcagtgaactggaaaagatcccccatcaacaacaggctaacttcagtccttctactaccaccgatagaacgacttggttcaaggacatggagtctcattttccacagcatgactttcaaatggccgtcaacaagatcaaggagtacatcaaggcaggtgatgccatgcaggttgttttatcccaagccatgtcacgaccattaaaggccaatgccatacagctttatcaagcactaaccagcatgacaaacacgccgtactgttatttgatgaatgtcgaagatagccatgttgttggcgcatcccctgaaatgatggtctccctgcatcaaaacaaattgatcagccatccgatggcaggaactcggcatcgtggcatgaaccagcaagaagatgatgcactgaaagccgagctacttgcagataataaagaaattgccgaacacattatgcttgtcgatctggcacgcaatgatattggacgcgtagctaaaacaggcagtgttacggtcaataacctgttaagtgttgagtatttctctcacgttatgcacattgtgtcggaagtatccggtgaaaaaatggatggtatcgatgaaatagacgtcatcagtagcacttttcctgcgggaacactcagtggagcacccaaaatccgagcactggagatcatccatgaattagaaccctatggcaggggcgtttatggtggttgcttaggttacatcacttggaacggcgatattaatctcgctattaccatccggacagggttacttcatcagggacaactgtatgtacaggctggtgctggaattatcgatgcctccagagcggaacgtgagtggcaagaaacgatcgaaaaaaatagcatgatgatgcatgcagcatatcaagcagagcaattttctttatga

SEQ ID NO: 4728 - DNA, 597 bp, Xenorhabdus bovienii
  Coding DNA location: Contig name=SeqID_16897; Position on contig =216378..216974bp; Strand=+
atgtatttcattatagataactatgactcctttacttacaatatcgcccaatatttgggtatgcttggtatagaggttttagtcaaaaaaaatgatcgaattaccttagaatatatagaacaacataatccgactggattaattatttcacccggcccttgtaccccgaatgaagcaggaatatcaacacttgccattcaacattttgctggaaaaattccaattttaggtatttgccttggtcatcaatgtatagcacaagaatttggtgggcaagttctcagagccaataaagtgtatcatggtcacacttcaacaatcacccataataataaaaacttatttgccaatttaccccaagatatcaaagttggctgttatcattcattggtagtagatgacttgccggaatgtttaacagtgacagcaaggtcatgtgatgaatacaatgacattatggcactcaaacataatgattttcctatatatggagtacaattccaccctgaatctattctctctgatttcggactggatatgcttaaaaatttcatcaaaataacacaagaatggaagctgatgaatagcatacaataa

SEQ ID NO: 4729 - DNA, 1617 bp, Xenorhabdus bovienii
  Coding DNA location: Contig name=SeqID_16897; Position on contig =217087..218703bp; Strand=+
atgattacaccagaagaaataaaaaagattattagctcggaaaatattggtgctggtaactttattcaccaccttaataactattttagtgaacgaggaattagcccaaaaataacatgtgatgtaccaacatatgataatccagaagaagaaaaatcacagtttgaaatcaatgatcttgttaagatatcagatcaattgtcaggagcttatattgcgctaggcgtccaaaaacgtgaacccgtggcattatattttgatgatactattgactatttaattcactttattgcactgaacaatataggctcgttccctatttttgtgaatggcgatctcagtagtcatattgctatgtcgtttatgcgtaatagcggaacaaaatttattatttcaacggaagaaaggattaactcactggatgataaatctactgacatccagtttattactcccaacgaactgaatttatttaaaaaacccatttcaagctattatcggcatcatgcagacgatattattctgttagggcatacttccggcacaaccggtttgccaaagccagttatttttacccatgaatctatgtttcacggtatttttaaagaagtcagtaagcaacgcggaaaacaaatattatccatgttcccgcactctcacggagcctcgatgacattgatcatgttgacattgacacgaggtgcagcaatacatattcaatcaaagaaaaccgcttttgacattttagattccattgaacaaatcaaacctgacaccgttgctgcttttcccaaaatatttgttgatctatgcagagaagacctcaatgactgggatcttgattctatttcccactgggtttccacgggtgacgcgaatcacgaaccccatatacgaaagctgatttcttatggtcatcatttcgttgatggcaaaaaagagcgtggatcttttttcatcgacaatcttggctcttcagaattcgcatttgccatgttcagaaatattcatcaaccaaaaacagacagatatgatcgttgtattggaatacctttttcctgggttgatgctgccatacttgatgcagacggaaatgttctccccaataaccaagtaggtatgttgggcgttatttcaaaatcagtaaccatgggttactggaataaccatctcctgaccgagaaaaaccgggttaatggttattggttaacaggtgatttggtttaccgtaccaacgacggtttcttttaccacgttgatcgtacatcagattggattaagactcctcaagagccactttacagtacccaatgtgaagagtggctgttgaaaaatattgatagtatttttgatatcagcatcgtcgctacttccctgcccaatggcgatcaacagacaacggctatcgtcgagctgaaagcagggcacgaaatttcgccggccacactgttacaaaaaatcaacgcctgccatcaggaaaaacaatggccattgatcgacaatattgtttatcaatccgctgacaacgatctcggagtcacagggaaaaaactcaaaagaaaaatcagagatcgtatgcctgaagataattcaatggtaactgaagaaggaaattaa

SEQ ID NO: 4730 - DNA, 732 bp, Xenorhabdus bovienii
  Coding DNA location: Contig name=SeqID_16897; Position on contig =218705..219436bp; Strand=+
atgaaaacttgcttaattacgggtgccaacagaggcatcggatttgaaattgctaaaaaattgggtgaacgaggccatcgggtaatcctttcaggccgtgatatacctgcgcttgagcacagtgttttacaattgaaccaaatgggaataaccgccgatttgcttcatttggatgtcacagatccagaatccataaaatctgcggcaaatttactgctcagcaccaatacaacccttgatatactgattaataatgctggcgtttttctggattcaatccaaaaacccagcgaaacctctctggatgacatccataaaagtctgacggtcaatttggttggcccctggctcatcacccaagcctttttacccctgctctctcgttcagaagaagctcgactcattttcttatctaccgatcttgccgctttatcccaagctgctgacccgcattcaaaatacaacagaatcgaaggtccagcttatcgagcctccaaagccgctctgaacatgctcgctttacagtgggcgaaagaatttcgtgattcgaagatttctgtcagtgtatgcagcccgggttggtgcagaactgacttagatagccaaattagttcagaacaggcacccaattctgctgccgaaggtgctgatacggttgtttggctggccttagataagggcagagaacaacacggccatttttattcagctcgccagactattgattggtaa

SEQ ID NO: 4731 - DNA, 1362 bp, Xenorhabdus bovienii
  Coding DNA location: Contig name=SeqID_16897; Position on contig =219471..220832bp; Strand=+
atgacaatgaatgaaaatatcgatattaccgttcagcaaactgaaacagcgtcctatatagacaaactggttgaccagggaaaaatcgcccaaaaagaattggaaaaacagtcagatgaagatattgataacgttcttcatcatttggcaaaaatattttccactcactgccgggaatgggctgaaaaagagcttgctgtgacccgtatcggcaatgccgacgataaagaacacaaattagctttagtagtcaaccaagtatttaagggattatatggcactaaaacctatggtcgtcttggtggaacccaaaggctcattgaatatgccagtccagttggattgatctttgccgttgtcccattgacaaacccgattccaaactcgcttttcaagatcatgctttccatcaaaactcgcaacgctatcattttcagttatcccggtaaaactggcaaattagcaaatgaatttattgatctggtacaacaggttcttaccgagcacggattgcccgtttcattggttcaagtctgcacgcctccaagccatgataaaacccatatgctgatgcagcaccccggtgtagacatgatccttgcgacaggaggaagaaatctggtacatgcggcttacagttctggtaaacctgcgtttggcgtggggcctggcaatgtccctgtctatatcagccgttccgctcacattccgaaaactgccgccaatattgttaatggaaagatatatgataatggcatcgtttgcggttcagaaagcaacctcatagtacatcctgccagcaaaaatgacctgatctcagctttagaagccaatggcgcggcaatcttgacaagcagcgaagttgagcaggctatccagacgttatttaacccagaaacccagtatgtaagccgtgaaaatattggtgtctgcgcggcatctttggccgctaaagccaacatttcacgcgcttatcccattaaattgctggttatacccgctgaaataggcaggaatgattttctcagcaacgaaaaaatggcacccatactgactctttatactgccgatgaagaaaatgggatttctcttgcctattcattgatttgtaacgaaggcgcggggcatacggctgtaatacacagcgaagatccagatgaaattcatcaattctcaaccgtcatgcctgccggacgcattttggtgaatacatcagcaacacagggcatgctcggggaaacaactgagctacctgtgtcattcatgcaaggcagtgggacttttggccacaatcattcaaccgatccgatcgtctggaagcacttagtgaatatcaagcgtgtcgcatacggcctacactga

SEQ ID NO: 4732 - DNA, 1119 bp, Xenorhabdus bovienii
  Coding DNA location: Contig name=SeqID_16897; Position on contig =220878..221996bp; Strand=+
atgaagatacagtgtattggtgcaggccccgcagggttagtgttctccattctggcaaaaatgcaggatcataaccgtgatgtcgttgtatacgaacgtaatttatcaaacgttacaacgggttgggggcttgtactttctgagccgatgttacagcaattagccaatatcgatcccagtattgttgaacagctcagacctcatatttcaacattaaaccatattgatattcatataaaagaaaaaactttccgttcatctggataccaattccttgcgatcagtcggttagaaatgatcaatacccttaggaaaaaggcactggatctgggtatcaagattaattacgactcttcattgaatgctgaagatcttattaacttccccgctgatttgactgttattagtgatggcgccaacagtaagataaggcatcagttaaaaaatgaattcgacactgacattgatgaaggaaagaacctatacttatggttaggaacttcacatctatttaacgatacctttaactttattttcgagcagacagaaacaggttggttttgggcacattgttacaaatttgagaatgatcattctacatttgttgtcgaatgtactcatgaaacttgggcaaaaacaggatttgcacatatggatgagaaagaaaccattgcatttcttgaaaaggtctttcaccgacatttatgcggccatccattgcaaattaatgatacgtgccgtgaaaaagcttattggcggcgttttgttacaccagtcagcaaacactggtctcacgataaaaaagttttattaggaaatgcagcgcattccgcccacttttccattggttctgggactaagctagcaataggtgatgccattgcactggcagaaaatctgaaatcaagcaataaactggattcagcctgttttacagattatcaacacaatcgtcaaaatgaatcatctaatttacatattgcagcacaaaattctcaatcttggtttgaaaatgttgaatcattaattgaaaatgacccattagagttttctatatctttgctcttgaggagtggtagactatcacgcgatgaactcaccataaacctgttagaataa

SEQ ID NO: 4733 - DNA, 423 bp, Xenorhabdus bovienii
  Coding DNA location: Contig name=SeqID_16897; Position on contig =222069..222491bp; Strand=+
atgaattacgcaaaaatttcacctaaaataattaaccctctgtataaatgttatgatgaaatacagaaatgtgaattagaccaatcacttattcttttggttgaaatgcgaacctcacaaattaacggctgtgcctactgttgtagactccatgcagaaatggggcgtaaactaggtattgaggaagaaaagctggataagttacccggttggtttaactcccgtatttacaatcaaaaagaagtactggcactggaatggtgtgaagcattaaccattggtcttagggacaaagatcttaatgatcttagagaacgtcttgaagaattattttcagaaaaagaacttgttgatctgacctcagccatatcagtaatgaatgccttaaacagaatggcaataagtatcggtgataacaactaa

SEQ ID NO: 4734 - DNA, 444 bp, Xenorhabdus bovienii
  Coding DNA location: Contig name=SeqID_16897; Position on contig =222604..223047bp; Strand=+
atgttaaacggaactcaattaagatatgcagctttaatcgcacgttattcacttgcgattgcgtatttggtcgcagtggctgacagacttggtttatgtggtgaatatggtgatccacagattacgtggggtaatttcacggtattccttggtgttgttaagcacttgaacccttgggcacccgattttatgatccctatttttggttggggagtcactattcttgaagttgctctgcctatattcctaataataggttttaaaatcaaagaaaccgctttagtcagcgcagccttgttgttaatttttgctgttacaatgacaacggctggcttacttaaaagcgtgtttgactatagcgttttatctgcattttcctgttcacttctactctactgttttgaaaaattcagagtgagtgaagataaaaagcaattaaattaa

SEQ ID NO: 4735 - DNA, 738 bp, Xenorhabdus bovienii
  Coding DNA location: Contig name=SeqID_16897; Position on contig =223425..224162bp; Strand=+
atgatttttaatcaaaaagaaatgaatataatccaagccagggatttcatgaatgaaattttggtgtcaaaaaaaacaacagatattttaagacagatgatacaaaaagatacgattatcaaaagccctattggaacttatgttggatttgaatcttttatagcactgttgaaaatttggtacagagcctttcctaatttggtatataaagaaaataacctttacgttcataatgaaaatattattattgattgggaagcaaaaggaaaacatcttggtgaattttatgcaatttctgcgacaggtaaacaggttacttgccagggaacaaccgaaattgttatgaacgatggaaaaattctcgattatcatacaaaaataaatattcaaaatattattacacaacttataggcttaccctgctctccaacacttgacataagaaatatcgaaatatatcaattaattaatcagatattaggatatcagttatcttgcagacaaatagaatgcctctcactttccactctgaatacatcaattaaagatatagcaagattattatctatagaaagcaatactgtgaaaacgcacttaaaaagagctttcgaaatcatcggtattagcaataaaaaaatgcttatggaattcgttattgaatgccaagcgattgaaattctggttcgacttggcttatttttaagagtccaaacaaaaagaaataattatttagaataa

SEQ ID NO: 4736 - DNA, 231 bp, Xenorhabdus bovienii
  Coding DNA location: Contig name=SeqID_16897; Position on contig =224154..224384bp; Strand=-
atgctttgtaacatcgtgtgtggtgcagtatttcatgttttctcccagcaaatcgtcgcgcattatactcacgatagcattcatcgcaaggtttgccggaagaaatttttattctgcgtgatatggagaaggctgatgattgagggatacaacctagtcatcgttactcggaacagatggataatggtttcaatttggattgagtccctctctggtgttccattattctaa

SEQ ID NO: 4737 - DNA, 171 bp, Xenorhabdus bovienii
  Coding DNA location: Contig name=SeqID_16897; Position on contig =224301..224471bp; Strand=+
atgaatgctatcgtgagtataatgcgcgacgatttgctgggagaaaacatgaaatactgcaccacacacgatgttacaaagcatcaagctaacgaaaaactgcctgctggcagcttgggcgtattattttttccattgcaaaaccgatcattgaaaaagcccctcaaatga

SEQ ID NO: 4738 - DNA, 942 bp, Xenorhabdus bovienii
  Coding DNA location: Contig name=SeqID_16897; Position on contig =224527..225468bp; Strand=+
atggctaatccgttatatcgcaagcatatcatttcaattaatgatctgagccgcacggatctggaattggtattgcagacggcagcagcattgaaagccaatccacagactgaattactgaaacacaaggtgatcgcaagctgcttttttgaagcctctacacgcacccgcctctcttttgaaacggccattcagcgactcggtgcttccgttgtcggctttgctgacagcaacaatacttccttgggtaaaaaaggggaaacactggccgataccatttctatcatcagccagtatgccgacgcgattgtgatgcgccatccacaggaaggtgccgctcgtcttgcttctgaattttccggccatattcctgtcattaacgccggtgatggtgcaaaccagcacccaacccagactctgctcgatctgttcaccattcaagaaacccaacacaagctagataacctgaaaattgctatggtcggtgacttgaaatatggccggactgtccactcgttgacgcaggcactggcaaaattcagcggcaaccacttctgctttattgccccagatgccttagccatgccaagctatatcctgcatatgctggataagaaacaggtcagttacagcattcaccataactttgaagatgtcatgcctgaactggatatcctgtatatgacacgtgtgcagaaagagcgtcttgacccttccgagtacgccaatatcaaagctcagttcgtgctgcacgccgctgatctggttaatgttaaagagaacttgaaagtgctgcatccgctgccacgtatcgatgaaatcaccgtagatgtcgataaaaccccttatgcctactatttccaacaggcaggtaacggcattttcgcccgccaggcgttgctggcgctggtattgaatgagagtgtcatcatagaaaaatga

SEQ ID NO: 4739 - DNA, 1128 bp, Xenorhabdus bovienii
  Coding DNA location: Contig name=SeqID_16897; Position on contig =225746..226873bp; Strand=-
atgcttaataaactggttttttcatactttaatacttcatttggatattggcttgctggttttttgattcctttaatcgttttggatgtgtcgaaatctcctcttttagtatctgtttcatatgcattaaatataattccgtatataatatttaccccattcgcaggggtgataggtgatatggtaaataggaaaaaggtgattattttaggggaattaatttgtgctataactgcaactgtgttgcttttagtgcctttcaacaacgaatttgtatgggagatgattttactaggatttgtgatttcatctatgtcagctattcatcatccaatatttcaggctatcataccagatatatataaaggagatgacttaaagaaaatcaactctaatattaacataattgataacttggtaagcatattatccccagttattcttggtgtgatattactaagtatggataagcattatgtaatagtgttgataatcttttgttatgttctttcattttcctcttttagctttattctctatgcctcccaccataataacgtcgcctttcgatttagtaatatcatgagttccatgtctgatggggttaagtatgtatttaatgtaaaaggactaaggaatatatcaattctcttctttttcgtgaatttcggaataagagtaattgctgttaatttattttggatatatagcatggtcttttatttgaaagatgatgagttggctttatgttttgttatcataggattgggttcttttttgggagctaaggctgcaatttatttgataggtaaatttaatgatgaaaatataattgcaggaagtactttctttattggtgtattgagtctgctgcttttggtagctaataatgctattgtaatgtctttgattttgtctcttagttcattcgttcagtcaattatcgtggttacattttttacctatcgacaaaaaataacagaagggtttattttaagtagagttatctcggttactcggttgatttcatttatggctattcctttgtcatctctaataagtgggtatattttacagaaaacagaaaacagaaaacagaaaacagaaaacagaaaacagaaaatgtaa

SEQ ID NO: 4740 - DNA, 150 bp, Xenorhabdus bovienii
  Coding DNA location: Contig name=SeqID_16897; Position on contig =226944..227093bp; Strand=-
atgataatactatcaatttacattaagggacacagcctagtatcaattacagcaggcattatggtttgtgaagccattaaattgttaagcaaatctcaacatgctggtttgactaataaaagaaaatctttcatatttgatgatctgtaa

SEQ ID NO: 4741 - DNA, 459 bp, Xenorhabdus bovienii
  Coding DNA location: Contig name=SeqID_16897; Position on contig =227124..227582bp; Strand=+
atggcacgctacgacattcctgatgacgcatggatagtgatagaaccttgtttacctccggtccattcagagcgggcaggacgtccacatgttgaacaccgccgagtgatgaatggggtgttctgggtcttgtgctctggggcaccgtggcgtgatttacctgaacgctatggtccttggaaaacggtctataaccgatttaaccgcgggtcaaaatcgggcattatcaacaagatatttaaccggttactgtccattctggatgaaaaaggcttgattgactgggctgaaatttgcctggatggcagcaatattcgcgcgagtaaagatgccgcatgcgcgaaaaaaaacctcccgatatcgctgacgatcatgcgctgggtcgctcacgcggtggttatggcaccaaaatccatctggcaaccgacagacggggttttcccctcaacctgcttttga

SEQ ID NO: 4742 - DNA, 507 bp, Xenorhabdus bovienii
  Coding DNA location: Contig name=SeqID_16897; Position on contig =227459..227965bp; Strand=+
atgcgcgaaaaaaaacctcccgatatcgctgacgatcatgcgctgggtcgctcacgcggtggttatggcaccaaaatccatctggcaaccgacagacggggttttcccctcaacctgcttttgacggcggggcaagcccacgaaagtcgatccgccatccctttgctcgacggcattggtatacagcgcaaaaatggtttcatgaaacggcgcggcaaagcggtgctggcagataaaggctattcgggcggaaaactccgcggttatctgcgtaagttgcggataaagagcattattccgtataaaatcaatgaaaaaggcagtactgatggtcgcacacaatttgatgagcaggcttatcgtgaccgtaatgttgtcgaacgttgtttcggttttcttaaaggaaatcggcgtatcgcaacccgttacgaaaaaaccgctcgaaactatttgtccagggtgaaattaggctgtattcgactcttttacaggcggttatctaattaa

SEQ ID NO: 4743 - DNA, 429 bp, Xenorhabdus bovienii
  Coding DNA location: Contig name=SeqID_16897; Position on contig =228101..228529bp; Strand=+
atggttctgggtccacctattaaggttcaacgtaagcttccaaaccccgatttgtgtacagcaaggttttgctatgatcatattgctggttttcttggcacaagcatttataaattcttaatttctcagaatttcatattgcaagataacaatcatttggttttaaacaaaaacatagacaatttacttaatctactaagagtagataattttgaagatctgtgcagaggaagaaaaatagcttatgcatgcatcgactggagtgaacgaactccacatatcgcaggagcgttaggaacagcattagcttatgcatttattgataataaatgcataaagagaagagaaaactccagagttattgaaattactaccctaggtaaaatatctctctcagagaatttcaatataaatattgacgaaaaataa

SEQ ID NO: 4744 - DNA, 2319 bp, Xenorhabdus bovienii
  Coding DNA location: Contig name=SeqID_16897; Position on contig =228781..231099bp; Strand=-
atgaaattcaaatcaaaaatagaaccttatcactccgctgcgggtggttggggttcactagaagcaacaacacgttttgtttttgatagtaaacaagccttaaaaaatatggttaacctgatgcgcatgaacaaagccaaaggctttgattgcccgggatgcgcgtggggagatgacaacaaaagcctgttcagtttctgtgagaacggggctaaggcaatgacttgggaggcgactcgccggcatgtcgatcgggcattttttgcgacttatagcgtcagtaaactctaccaacagagtgactacttccttgaatatcaggggcgggttgttgaaccgatgcgttataaccatcagacggatcactatgaaccgattagctgggatgatgcttttaccttgatagccaaacacattaaggcgatggaaaaccctaatcagctagagttgtatacctccggtcgagccagtaatgaagcgtcatggctttatcagttgtttggccgcgtgttgggaacgaataattttccagattgctcaaatatgtgccatgaagccagtggttacggcctgctgaagagtttgggtgtgggtaagggaaccattcggctggatgattttgatcatgctgatgccatcttcgttttcggtcagaatcctggtacaaaccacccacggatgctacacagtttacgccatgcggctgaacgcggcgcacggatcgtcacctttaataccctacgcgaacggggtttagaacgttttgccgatccacaaaagccgctcgaagtgattaccccaatggcaggcgctatcagccatcgttattatcagcccaaacttggcggagatatggctgtggtcaggggaatggtcaaggcactgttagaaactcacaacgcatttctggcggctggcaaatcaggtatttttgatctggaatttatttcgactcatacggaaggtgtggacgcttatttgcaagaagttgctgtaacggaatgggcatttattgagagccaatccggtttgacgcaggcacagatacgtgaggcggccaccatttatcagcatgctgatcgggttatctgtacttgggcaatggggattactcaacataaacactctttggatactgtccgtgaaatcgcaaaccttcaattgctgtttgggcagttgggtaaaagcggtgcggggctttgtccggtgcgtggtcacagtaatgtgcagggtaatcgcacgatggggattaatgaacaaccctcgaaggctttccttgatagcatggctgaacattttggtttcgagcctcctcgttcccacggccatcatgttgtgaaagcattgagtgccatgctgcgtgatgaagtaagagtactgatcgcgttgggaggaaaccttgcggtagcagcgccagatagcccacgcacagaagaggcgcttcgacactgtgatcttactgttcatatcagtacaaaacttaaccggagtcatcttgttaccggtaaaaaagatgcccttatcctgccggcactggggcgtactgaacaggatattcagctcagtggagcgcagtttattacggtagaagattctttcagcatggtgcatgcttcagaagggctgaacaaacctttatttgatactcaacgctctgagacggcgattgttgctggtattgccaatgcggtagtgggaaatacagcaacgattaactggttagcattagccggagattacaataaaatccgcgatcacattgctgcgaccattccggggtttgccgattttaataaaaaatgtgaacaacccggtggtttctatcttggcaatgcagcggcggatctgcgtttttctacaccgagtaaaaaggcgcagttcagtgatgcctcactgccggaaaatctcttcccgcaactgggtaaaacagacgttccttttactctgcaaaccttgcgctctcacgatcaatataacaccaccatctatggtttggatgaccgttatcgtggggtttatggtcagcgggaggtgctctttatgaatccagaagatattgctttattggggtatcaagcgggagatcgggttgatatcgagacggtatggaatgatggtattgagcgcaaagtgtatggctttaagctggttccttacgccattccacgcgggaatcttgcggcctattacccggaaaccaatccattagtgccgatggatagtatcggcaatggcacgggcacaccaacgtcaaaatctgtgccggttaaattatctctgactgagataggtgaagcggaacttcagcgccttgtataa

SEQ ID NO: 4745 - DNA, 216 bp, Xenorhabdus bovienii
  Coding DNA location: Contig name=SeqID_16897; Position on contig =231255..231470bp; Strand=+
atggtttcctctttaataatgatccattgtgatacttattccgttcttaggcaacggaaaaaccgatctattgctattgagagtgctatgtcagctcctcaaattaaccatactatttctattggtaactttatagacaactgttttataactgattgcttatttgggatgattttcgtgatgtttacgataacgactgagacgtatacaaaatag

SEQ ID NO: 4746 - DNA, 1218 bp, Xenorhabdus bovienii
  Coding DNA location: Contig name=SeqID_16897; Position on contig =231719..232936bp; Strand=-
atgaacaatactttaattacatctgataattcattaatgctttgggcttttattatgattgcggttgctgcggcaattatggtagagcagcgataccgatgggcatctaaaataccaggtgcagttatcgcactgattattgcggtattagcgtctaacttaaatatcattccaacagaagctcccgtttacgatgcggtttggggatatatcgtgccattagcgatccccttgttgttattaaaaaccaatttacacagtattatcaaagaaagttggcgattactgatcttatttttgatttcttccgttgccaccatgattggcgcgatagtttctttccggcttttcaaggatcatatcccggaactagataaaatcagcggtatgatttcggcttcatatacaggaggaggtgttaactttgcggcaatggcagctaaattggaaccttcccaaagtatgacggcatccactatcgtggcggataatatgatgatggcaggttactttattatcctgatcgcattatctggctggacagtggcaaggaagttctggggcagtcctcatactgacgcaatagataacgatccagacttggataaatcccagacttttgcagccgcttattggaagccgaaaaatatcgctctgaaagacatcgccttatcgctggcatggtcgatttttatcgtcgcgctgtcatttcagttatctacatggctaaaagccctgctggggcaaccaaacagtatttatcaggaactgcttttcagtttgatatccgataaatacctgatcctcacaaccgtgacgtttaccctcgtctcgatctttaaagagacattcagcaaactgaatggcacacaggaattggggacttatgccatttatatgttctttgtcgtgattggcattccggcatcaattgaagccatcattagccatgcaccactgctgtttgctttcgtctttgtgattgccatgatcaacctgttactgacttttgccgtggggaaagtgtttaaattcagtctggaagagaacattctggcctgtaacgccaatatcggggggccaacaacggcagccgctatggcaattagccgcggctgggtcaatctggtcggcccgattatggtgattggtacagtcggttatgtgattggcaactatgtggggacttttgtgtactttattgtggggcggatgtaa

SEQ ID NO: 4747 - DNA, 732 bp, Xenorhabdus bovienii
  Coding DNA location: Contig name=SeqID_16897; Position on contig =233010..233741bp; Strand=-
atgtttctatctattgctatggaaaataacaccgtggataaaatcgctgtggaaaaactttttgattgggaagtgattaatggagtatctatcaatgaatgtcatgaacctttagaaataattactgatacagataagttaaaacagcaatctgcttattttcttgctgatataaaaggttccattgattattgcaccgtaagagaaagtgtcgccagaaaattagtgatggcatcacaattgctacctcctcatttagggcttttggtattagatggctggcgttcgcgggaaacccagcaggcattacaggagcaaacacagataaaaatagctgaccaatatcgccatttatctgttgaagaacagaaggcacttttgcagcagtttgtggctcctgctcctacggaacagcaccaaatcagtccccatctgacgggcggttccgtggatgtgacgctatttgacgtggcatctggcaagcccctgtttctggggactgaatttgacgaagtgacagagctgtcttatacggcggcgttagaaaaagaacctgaaaaaaatatgccggccaccttatatcgtcggttattgtataacgccatgattcaggttggttttaccaacttacctacggaatggtggcattatgattacggtaattctctgtgggcattttataaaaacgatattgccatttatggtgctgtagatggaacgcgaaaaagataa

SEQ ID NO: 4748 - DNA, 465 bp, Xenorhabdus bovienii
  Coding DNA location: Contig name=SeqID_16897; Position on contig =234167..234631bp; Strand=+
atgacccaagaccatcaattacaagtagaagccattaaatgtggcaccgttatcgatcacattccggctcacatcggtttcaaattattgtccctgttcaaactcacagaaacagatcagcgcattaccattggcttgaacctgccttccaatcaactgggcagaaaagacctgatcaagattgaaaatacttttctcacagaacagcaggcgaaccagctcgcgatgtatgctccccatgccacagtcaataatattgaaaattacgaagtcgtgaagaaggtacccatcaacctgccagagcagatagacagtattctcgtgtgtccgaacagtaattgtatcagtcacaatgaacccgttgagagcagcttttatgtcatacccaccgccgacgatgtgatcgttcgctgcaaatactgtgagaaagaatttgaccgtcaggcagtcattaacaacgactag

SEQ ID NO: 4749 - DNA, 387 bp, Xenorhabdus bovienii
  Coding DNA location: Contig name=SeqID_16897; Position on contig =234773..235159bp; Strand=+
atgtcacgttccatttataccgaaaatgcaccagcagcaatcggcccttatgttcagggtgttgatctgggcagtatggttatcacttccggccagatccctgttgatccaaaaaccggtgacatccctgaagacattaccgcccaagctcgccaatctctggagaacgtcaaggcgatcatcgaacagtctggtctgaaagtggctgatatcgtgaaaacgacggtatttgtcaaagacttgaatgacttcgccaccgtaaacgcagcttatgaagcgttcttcaacgaacataacgcgccattccctgctcgttcatgtgttgaagttgcccgtctgccaaaagacgtgaaaatcgaaatcgaagccattgcggttcgcagctaa

SEQ ID NO: 4750 - DNA, 432 bp, Xenorhabdus bovienii
  Coding DNA location: Contig name=SeqID_16897; Position on contig =235284..235715bp; Strand=-
atggaattaaatgaaaatttcttaactatccgccgatacctcgccaaacaacatgtcttcactctctgcacttcctcaccacaagatctatggtgtgcaagttgcttctatgcgtttgatgccgatagtatggcattctggtttatgaccgaaccggatacccgccacggccagatgatgcagcaaaacccagtagttgccggcactgttgcagggcaaccccgtaacattgcccaaatcaaaggtattcaattccgtggtgaaatcacaccgctgacaggcgaagccgaaactcttgccagagcacgttattgccgtcgttttcccgtcgccctcgctgcaaaatcccctatctggcgactcagcctgagtgaaatcaaaatggtggataacacccttggttttggcaaaaaactgaattggcaacgttaa

SEQ ID NO: 4751 - DNA, 252 bp, Xenorhabdus bovienii
  Coding DNA location: Contig name=SeqID_16897; Position on contig =235832..236083bp; Strand=-
atgaaagctgtaaaacatatcgtcgctattttggcattaactgctatttcatttggctctatggctgcaactgaagtgcaatatgctaagggagagaaggttggggttgtttcagttactggtgcagagaccctggatagtctgaccgctgagttatccaaaaaagctgataaagcgggtgcatcatatttccgtgttatttcagcaaatggtcagaataaactcagtggagttgctgaaatctataaataa

SEQ ID NO: 4752 - DNA, 345 bp, Xenorhabdus bovienii
  Coding DNA location: Contig name=SeqID_16897; Position on contig =236361..236705bp; Strand=+
atgaaatcaacccactggtatctctatctgataagaacccgaaacagctctctgtatactgggattaccacagatatcgcccgtcgatttatgcagcacgtgtctggaaaaggcgccaaggccttaaaaggaaaagggccattaacattggtctaccacagtttggtggaagatcgaggcatggccctgaagttggaatatcgcgtgaagaaactcagtaaaaagcaaaaagagaggctggtcactctccaacctgtctgtatagcaacctatttgtccgagatgttggtgccaaaaatagctcagtcagtcatcactcatgaccaaaatggtcagaatacgtaa

SEQ ID NO: 4753 - DNA, 504 bp, Xenorhabdus bovienii
  Coding DNA location: Contig name=SeqID_16897; Position on contig =236674..237177bp; Strand=-
atgttaatcagggtcgaaattccggtcgatgccatgggtattgatcgcttgttacgtcaatcctttgagacatcggcagaagctgagttagttcatcgattgagagaagatggtctgttgacgctgggtattgttgcgactgacgatgaaggtcatgtgattggctatgtcggtttcactcctgttgatgtcaatggtcaggatcatcaatgggttgggctagcgccattagcggtggctgaaccgtaccgtcgtcagggaatcggtgaaaaattggtttatgaagggctggatagcctaaacgaatttggctatggcgcggttgttgtattgggggagcctgcgtattaccgtcgttttggtttcaggcttgccaaagaataccaattgcattgccaatggcctgattgtgaggataacttccagatctacacgttggcggatgtctcactggaaaattgccacggtctgattacgtattctgaccattttggtcatgagtga

SEQ ID NO: 4754 - DNA, 381 bp, Xenorhabdus bovienii
  Coding DNA location: Contig name=SeqID_16897; Position on contig =237171..237551bp; Strand=-
gtgttaggtaaaatccactcccatttggtcagtcaggggccaacattactgcgtctttcattgaaggtgactccttttgctttaccgcgtcaggtgctggaacaactgcttggctggcagttccacgaggcattggctgagggagaactggcgtttttggagtctcgcagggaagatcctgatacactgttttttcagcatcatttaaggattgaaggaaatacagaattgggactgcatgtgaaaaatttggtggattccattaggctgggatccatgccatccattctccgcttgggtttattgtgtctggctgaatttaccaaagcgggacaaaaagagggcgttgatcagcacgatcgcgcattatcgtcatgttaa

SEQ ID NO: 4755 - DNA, 1104 bp, Xenorhabdus bovienii
  Coding DNA location: Contig name=SeqID_16897; Position on contig =237599..238702bp; Strand=-
ttggtttgtagagggaagtttttattcaacaacgttagtatctgttgttctttcgtcaggttatatattgacttttttattctgccaaaaataggtttttttattgattcaaactctgctaaaaaagcgttaaataatatttatattctaggtcttttaaatagcgttgtttttttgtttttaacaaatataaatttgaatgaaattgttcttatagccaccgttattatacttacaagtatatttacattcattcgttcatccgatcaggtaataagagcaacttacataaaaagagttgtctctagcgaagaactttataaagctaataaaaaccttgaattaattaggcagggaattacttttctgtctggcggtatagccttctttattttagaagataaatcgataagtaatgtctgtattgtaagtattttttgtttttctatttctctatttataaatatttatgttaaaaaagataatgcagataaatttgatcgtgttattgacaataatagtggaatcaaaaatacttataaaataggatatggtttttttaatggtgaagtaaaaagacacgttgttctattgtcaatatttccatatatttgtgtcgtatcattaaattcaatataccctgctttttttaatgttataaatgcgcagatacagtattatgcgctgttagttgttccatatggggtaggggctataatgggtagtttgattggttcaaagcgatcatctttgtcactaaaaaataactatatcatattcggaactatctctataataggtctttttttacctgttttttttaatcatctttattctgtttatttgtgtctttttctaatttctttaagtcactcacgtattcgggtaataagaaatacaattattatgaatgaagcaggtaatcaaattctaggaagattattatcattcaatgaaatgatatttatcactctttctgttggactgagtatattgctgggtgtattgtctgattttctaggtttttgggttgcatggtttatggtgatttttttgaatgtgactgtgttattttttatccttctttcgaaggataaaaaatag

SEQ ID NO: 4756 - DNA, 141 bp, Xenorhabdus bovienii
  Coding DNA location: Contig name=SeqID_16897; Position on contig =238706..238846bp; Strand=+
atggcagtaaaaaaaactgccattgatataccagatgttaaagcagaaattaatattgggatcatgttaaacaccgaaatagtcgactcgttgtcgaggtatataattcccttgctttgtataatattcctctatttctaa

SEQ ID NO: 4757 - DNA, 417 bp, Xenorhabdus bovienii
  Coding DNA location: Contig name=SeqID_16897; Position on contig =238927..239343bp; Strand=-
atggctagtaagaattatttagaaaaacctaaatttattcataatttatggactcaaaatgaagacgatgaatattatttacgttttaccaaagggttgtatgaagtagactcaaatgatgcaagagattttattacaatacgaggatattgtactgggcataatacaataacagatatccatgagaaaacaggaatgccaaaagatagaattgttgacataatttcatctcttcatgaaataggaatgttaaggaatgaagaaattgtcagtgaagaagatttttttgataagatcattattgcctgtgagatgtgggcagagcaaatagaagagacacatttattcaataagtttttatatggtgacgtaagctataatgtcttgttaggttttatgctggaaaactatcattaa

SEQ ID NO: 4758 - DNA, 1194 bp, Xenorhabdus bovienii
  Coding DNA location: Contig name=SeqID_16897; Position on contig =239858..241051bp; Strand=-
atgccattcgtgatatatgtattctcgctttgtgcatttgcgatagggtttacggagttcatcactattggactgatatctgtgatgtcagtaaatcttggcgcagatgtaaccagtatcgggttaacggtgacagcctatgcattaggtgttgtgattggggcacctgttttgacggcactggcatctaattggtcgaggaaacgcttactgcttactgcgatgttggtattcactcttggaaatctgctagcagccgcatcagcaaacttggctcttcttttagctgcacgcttgttatctggtttggcacacggggtcttttttgctgtggcttccggtgttgcgactcgactggttccacctgaacgtgccggaacagcccttgctttggtattcggtggtgttaccattgccatgtctttaggggtgccggccggaacttggcttggtagtatattggattggcgagttatatttttaattatctcagcctgcgggttgctgggaacgcttggtattggatttaaaatgccaaaagatgccggagagcagattgtgaagacatctgctagctggcgccatctcactatactttttgatcgacgtttactggcaggggcgagtgttccaatgctttcctataccgcttcatttgctttgtacacctttattacccctatactactgagtattacaggagtaagtgttgaaacagccagtggagtattgcttgcttatggtattggcgctgctgttggtacggtttggggtgggcgattgactgatcgacaaggaatggatctcgcatcacttattcttcttgtcggtattgcggttgtgcttgccgctatgagttttagtctgacccattctctactgatgattggcttgacggctctactcggattggccacttatggagcaattccgccattgcagtcaaggatactcatgctagcgaaacgtcacacaccctatgcaatggatatcgcgtcaggaatgaatatcgcggcttttaatgctggggtcgttctaggctctgtgattggtggcgcaacagtacgagagtggggattagaaacattaacatgggtaggggcagtgacgggtgtactggccatcgtatcccttgtctggcaaatggttattccatctatgcgtgagcaacgttcaatccctgaatcacgataa

SEQ ID NO: 4759 - DNA, 138 bp, Xenorhabdus bovienii
  Coding DNA location: Contig name=SeqID_16897; Position on contig =240990..241127bp; Strand=+
atgaactccgtaaaccctatcgcaaatgcacaaagcgagaatacatatatcacgaatggcattaaaaactctccttatacgctcaaaacgcgccaacctgaattcaaagtaagtaatcagtatcaggcttccatttag

SEQ ID NO: 4760 - DNA, 909 bp, Xenorhabdus bovienii
  Coding DNA location: Contig name=SeqID_16897; Position on contig =241176..242084bp; Strand=+
atggtacttcgtaaccttgaagacctaagtgtatttatcagaatcatcgacacaggcagtttcactgctaccgctcaagccttgggactgtctcccacaactgtcagtaaacagattgcacgtctggagaaaaatcttggcatagttctctttgtacgaagtacccgttcattgcgcattacacctgaaggcaaagcaatcgctgaaaaagtgagggcggcgctgacactggtggaagaagcggctgaaattgccaaggatggaagtgaatctctcacaggtttgattagacttaccgcgccagtaccgcttggtcgaacttatgtcgcggcagcaattgcagagtttagaaaaaaatatccatcagtaggattcaccttgcatttgacagataaaattgttgatctttataaggtcgagatggatttagctatcagagtcgcaaatttaactgattcaggtttaattgccaggcgcttaacagataacaaacgaattttagtcgcatcacctgattacctcaggctgcatggcgaacttcagcacccagaagagctgattaaccataattgcctgcttttttccgcctctggaaataagagtacaatatggtcacttcacgataggaaagacaccaaagctatctcactctcaagtgatttaatcgctaataatggtgatgtcttgcgaacttggtgtacggcaggtttaggtatagcactgcgagaaacatgggatgtagtcgatttaattcgctcaaaaaaactcacccagatactgccagaatggcaagaagaaacctctccaattaatgtcgtgagagccggaaaacggcctgttccgcaacgcatcaaaagcttcatcgagttcctcaccgaggaatggagaactcccccgtgggataaataa

SEQ ID NO: 4761 - DNA, 786 bp, Xenorhabdus bovienii
  Coding DNA location: Contig name=SeqID_16897; Position on contig =242133..242918bp; Strand=-
atgaatataaatttaaaagggaaaattgctttagtaacaggttcgacagcagggattggattagctattgctcagggtatgcataaggctggtgcttctgtcattttgaatggaagaagtgaagagaggctcatacaggcggttaataaatttgactgcttggatcgcgtttttactgtagctgctgatgttggcaccaaagcaggctgtgaactcattaacaaaaattttccggatattgatatcctggttaataacgccggaattttttctcctaagccaatttttgaaattagcgatgatgagtggcttaattattttaatattaacgtcctaagtggaattcgtctggcacgttcatacattccactaatgattgggaaacgatggggacgtgtggtattcatctcaagtgagtcagccttacaaatcccggtagaaatgccacattatggcctgaccaagactgctcaagtcgcagcagcaagagggttcgcacaagccgctacaggaacaggagtcactgtcaacagcgttttacctggacccactgaaagtgaaggggtagagcgatttgtcagggaacttatcacggacccaacactttcaatggaagaagcaggaaaacgctttattgaaacagcacgtcccgcatcgttgctgggtcggttagccacagccgaagaagtcgctaatgctgttctctttttagcttcaccactagcgtctgcaataacaggtactgccctgcgtgttgatggtggcgtcattcaaagtattttgtaa

SEQ ID NO: 4762 - DNA, 789 bp, Xenorhabdus bovienii
  Coding DNA location: Contig name=SeqID_16897; Position on contig =242973..243761bp; Strand=-
atggagcgtagtttagcgggtaaagcagtaataatcactggggcaggttcaggtattgggcttgctgctaccacggaatttttaaatgcgggggcgtatgttataggaggggatattaaccttgagaaactttatgagttgcagggaggggaatacctatttccttatcagtttaatgtcagagatccctcagatattgatggtcttatcaatacagccatcagtcaatttgggaagatagatatcctgattaataatgctgcattagtagaaccgaggaaaagttttcttgatgtaaccgatgacgactggaattctacaatcgaaaccaatctgcttggctacatccgaatggctcgcggtgtactaccttatatgtgcaatcagaaaaagggtattttactccacatcgcttctgaagcagcattaatgccaaatttgcttctccctgattacagtatcttgaaatcttcagttctaactctgtctaaggtgatatcaagggagtttggcaaatatggcattcgatctaatgttatttctcctgcttttattcatacctctatttacgataaacctgaaggattgataactcagcttgaacaaaagtataaggttggacgtgaagaagcattgcaacgttatattgaagaagttgatatcgctgttggtaggctagggcaacctgaagaagtggcggttttgctcttatttttggcctcagaatctgctgcattcatcactggggcaaattatttagtcgatggcggagtgactccttttatctaa

SEQ ID NO: 4763 - DNA, 1278 bp, Xenorhabdus bovienii
  Coding DNA location: Contig name=SeqID_16897; Position on contig =243751..245028bp; Strand=-
atgactaatgactattcgaaattaccgattcctatttttgaacaagttcttgtcgctgatcaattacgagatggatattggcttgaagcaccagatataaataaggatggtttatttgacctttttggatatggtctttctctaggtgaaatatattggtaccgtaaccctgattggaagcggcaccttgtcgtcgataatataagaatgcctgtaggtggggattatgccgatgtatccggcaatggctatccagacatcatcgtctgttatgacttgtatggccctggcggtacactttacgatgcaaatcccaccggaggcaaaatagactggattgagaatcccggatctgaatttgtcgaatctgagcgttgggagcgtcactatgttggtcgtacaacaggaatgcatcgtttacgagcaggtttttttactcaaactgatcgccttgagattttagggcttcccattgttcctcacggaaatatccattcactacttccggtggttttattcacaaaacccgataatgtaaaaacagccaatgaatggccaatggagatcattgagaacacatttttccgtttgattcatggcgcggagaaaaaacgtgggctgatccctggatcggatcgtgattcattgttactggcatcagatgaaggaattacttggctttattatgacgaccaaaaatcgcaatggatcaaagtattaattggcgtaggagaacttacacaatttgagagtactggctttcgtggtagcggtgaccttgatgtgggacgggcaggtggcgattccttcgcttatgtcgcggcagttgagccattccacggtaatacggttgctgtctatgttaaagataaactgggcactcccgctgaactggcgacttggaaacgtttcatattggatgtttttggtgatcctaatgaaaatggagaaggtcctgggcatcaagttctttgtgcagattttgatggtgatggcgatgatgagttccttgttgctttaagagggccgtggccttggcaaggcgttttttactacaaagccattgacctatcgagaggtatttttacacgttggcgtgtttccagtgaatcagttgctcgcatagcggcggcggacttcaatcaagatggaaagcttgacttcgcaactattgcctattcagtaccaaattattttgtcgcaaaacaagcacgaatcgttgtacatcttaaccagatcaaacgagatgttactgtaggagatactgatggagcgtag

SEQ ID NO: 4764 - DNA, 756 bp, Xenorhabdus bovienii
  Coding DNA location: Contig name=SeqID_16897; Position on contig =245021..245776bp; Strand=-
atgaaaataaaaggtactaaccatcaaagattattaacattttcaaatgacttgttaccctctatagttgtctttgatgaagggaatctatctcttgatggttccgctattgttgttaatttaggaaataaaactgcgttaattgatgagttcgaaaaagataatattctaccaatgacatcaacgaaactacgtaatgttgatctctctggtggtgatctattattgttttttgatacggataaattattttcagctaaagaattatgtgggaaatcacagtggtctaaatttttcaaaaggacagaaagaaataaggatggagggaattttgatataaacctatggcgttctccacaagattttacagctgaaataaatgttaattttttaccttattatctttcaaagaaatcgaaattagacaaaatcgaacacacatcacgatttatcgttaagactaatctgtggtttgcgtcagccggaacgcattgccaaatacaccgtgagcacccttttattgagatccatacacaaatatttggtcttgggcatatgcagaagttcaaagataaagactttaatacactttatgaagatattggaatgtatcctgggttcacgacaactcctccgttttgttctgctttgagttgcacagaatttgaatatccatggcatcaatattacgcagaaaccgattgtatttggctggcagtagaatatcacccaattattggagggcaatatgactaa

SEQ ID NO: 4765 - DNA, 1209 bp, Xenorhabdus bovienii
  Coding DNA location: Contig name=SeqID_16897; Position on contig =245789..246997bp; Strand=-
atgttaaaacttggatttgtgatagggacgagacctgaagctattaagtgtgctcttccaattatagaaatgcgtaaagatgaacgctttgaccccgttcttatatccaccgggcaacataatgagatgctacattctactctttcggtatttggaataactgcagacgcagatttgaaagtcatgcgcgaaaggcaaactatttctggtgtgacacatagaatattagatgggttatctaaactcccggtgatgcagaaaattgatgccattgtcgtacatggagatactgcgtccactgttgccggagcattatttggtttccaaaacaaaattcctgtaattcatattgaagctggattacgtagtggaaacctctattctccttttcctgaagaaggtaatcggcgtctagtctcacagataagttcactgcatcttgctcctactgtaggaaattatttaaatcttctgcatgagggaatttctgccgattctattgcgatcaccggaaatacagtgatagatgcattgaattggagtattcctaaggtaaatcaatttaataatactgttcttgacgatattgaacgtgacagttcacgtattattctggcttctacacatcgtcgtgaaagctggtctaagctgactcaaatagccgaagcgttggctgatgtcgcatcgttgccaaatgtacgtgtggtggttccgttacacaagaaccctatcatcagagacgctttgcttcccctattacagaaacatcctaatataaccctcttggagcctttaccttatcttggctttgttcggttgatgttgcgtgcggatgtgattctttccgacagcagtggcgctgaggaagaaggtccggctcttggtaagcctacgctgatactgcgtgagattacagaacgtccagaagcaattttctcaaattctgcaaaattagttggtaatgatcgaatggaaatcgttaattctgtacgagaagtactttcgaataaagaggtgtacgatcgttttgtggctggtggctgtccatatggcgatggaaaatcgacacatagaattcttgatgctattgaccaattttttaacagaggatgcttaagcggcaaggaaataaataggctgaaacaatcttctttaacaccagccccctctttaacaaagatatctcctttaatatcatctatcttatga

SEQ ID NO: 4766 - DNA, 303 bp, Xenorhabdus bovienii
  Coding DNA location: Contig name=SeqID_16897; Position on contig =248310..248612bp; Strand=-
atggctgtttccttcacgaaaaggcggaaaattatcgcgtcagtgggttcatgttttttaatggggcgatacggagaacaggtgggtttatccattaggttgcacccacacaagttgcgacactcctgcgggtttgaattggcaaatcaaggattagatacccggctgattcaggattatttggggtatcgtaatattcaccataccatgcattacactgccagcaatccagaacgatttcagaaagcctggcagcagaatcaacagttgaaaattgatggtggcaaatatcctgctccttaa

SEQ ID NO: 4767 - DNA, 231 bp, Xenorhabdus bovienii
  Coding DNA location: Contig name=SeqID_16897; Position on contig =248659..248889bp; Strand=-
atgaatggaatcgtgtttttttctgtattaaacaatgctacaaataaagagcgcgatcagtgtctgctgtacttaacttatattcatggcctacgtgtgagtgagttgacttcattaaaagtctccgatatcgatatcgcagggaaaaccatttatataaagcggttaaaaaatggattttcaacaacacaacacaccctgtctcaaaaacagaaaaagagcttatcttaa

SEQ ID NO: 4768 - DNA, 225 bp, Xenorhabdus bovienii
  Coding DNA location: Contig name=SeqID_16897; Position on contig =249066..249290bp; Strand=-
atgagtattgcgttattttcgagatcaaaaaatagacaaaaaataacattaataatttattatgtaagcatggctacactgttcattactctttacaattatttattgtgcttattgtgcttattgtgcttattgtgctttagattttatttatattctgcaaaatctcacacaggtcatataattactaaagctaaaaagcttgacgcaatagatcaaaaatga

SEQ ID NO: 4769 - DNA, 159 bp, Xenorhabdus bovienii
  Coding DNA location: Contig name=SeqID_16897; Position on contig =249542..249700bp; Strand=+
atgtctttaccatcaaaatatactattcataaagctatcaaatccttcttattgatttccattatatttaatatgtttgctaacgaaagttatattgatcaaaaaatgattttatgttggaataaaaatctacatataagacatatatcagccaaataa

SEQ ID NO: 4770 - DNA, 3072 bp, Xenorhabdus bovienii
  Coding DNA location: Contig name=SeqID_16897; Position on contig =249741..252812bp; Strand=+
atgatgtatcaagtcagccaatgtcgtgtggtcaacattctatttcggcattactggcgtttttttattgttataggtatagctatgcacagaaaattcgataagtcgtggccgcagaatcagcctcccctgctgaaacgaatggcttgggcgaacattatcatccaactgacgttaccggtagcaggtgcatttacccccattatcgccgcagccaaaacgcatacgacttctcacgatcaacaattgacggcactaccgacaaaaccttatatcctgaaatccggggaaacgatcgatttaatagctaaacgttatagcttaaccgtcgatgatctaaaaaaaatcaatcaattgcgtacctttagcaaatccttttcaacattgggtatcggtgatgaaattgatgtaccccgacctcgcctcaataagtttctaccttttaattattctccgttagacgaatctgacagcaaagatgggacaaatagccgtctgtctaatgccgccattcgcgtcggcgatgtgctgaaaagtaataacatcagcaatagcgcaaaaatccagttaaacggtcttgcagtcagtgaggttaatcagcagatacagaattggctgggacactacggcactgcacgggtacaggccaatataagtgatcggggccgattagatggcagccagcttgatatgctgctccctctgtatgatacaaagagccagctgactttcacccaattcggcctgcggcggctgaataaacgcaataccgtcaatctcggtgttgggcaacgccgtttctttgacggcggaatgctgggatataacgccttttttgaccatgactttaccggagaaaatacccgatgggggattggggctgaatatgcccgcaattatctgaaattgggtgctaatggttacttccgcttaagcaattggaaagaatcccaccttctgaccgattacgatgagcgcccggctaatggttttgatctgcgagttcagggctatgtacctaccttgccacaactcggcggcaagttgatgtatgaacattacttcgggagtgaagttgggttaatcaatcaaaatcatcgccagaaagatccttctgcctttaccgtaggaattaattatacgccgatcccattgctgactttcggcattgttcgaaagcagagtacttccggtggtggcgaaacccagttcaatatggagttgaactatgaaatagggacaccgtgggagaagctaattgatcccgatgccacggatttcaagcgcaccctacaaggcagtcgctatgatctggtcgaccgcaataaccagattgtgctggaataccgcaagcgtgaaattatccgcctcacaatggacagcctgattaccggacatgctggtgatatcaagccacttcaccttaccgtggacagtaaatatggtttgaaaaatattcagtgggaagccgtaaatctgtttgccgatgggggtgagatcgagcgccaaggcggctctcactatctgctgactctgccggaataccaccatcagggcaacaatacttatattctcagtgccgtggcctatgatgagcacggcaatgcttctcagcgggtagaaactcaagtacaggtgctgccagccgcagtacgtgacaataagtccactttcacagcaaaagataatgaactgctggctgatgaccgtgccaccaccatgctgaaattaaccttagaggataaagagggtaaaccaatccgtgatgttgccggcgatatcaaatgggttactaatcagttgagtggagaaggcagcgatccgacgatcggaaaaataaaagaaactcaatcaggtgtctatgaagccatactcacggccggcaaaaaaatagggatactgaaaattacgcctgaagtggatggagttcatatcaagccattaaaaatcacatttgtgcatcctgacgcaccgtttgtcaaaaatctgactattgttggtaaattggaaatcgggcaaaaattgagtgcaacttatacctttaaccctaatggtggcgaaaaagtggataaatcccgctatgtatggggtgacaaaggtaatatcgatattaccaatggtcatacgatcgtcgaatcaggcaagctccctaactatacattggaactgtcagatgcaggccgggtaaaagccgttgcagtgcaggcacaaaatggccttggactcatcgggaatactatgattgttaataccagcatgagccaagagagtggcaaccgtactcacggtggcagtgaaggcggaaaagtcagagggattgcggatgatatcgctgccacagtgaatactgataatactaaaaaaagcaacgcaatcactttgaccgtaaagacattcaaacacgggcaacccgtcagaaatgtggccgttgaggtgcaagcgacccaagcaataaaccgccagaataaacctcagacgattaccgtgctgataggcggcaaacctgctctctatcaaggcgtgacagatgagcagggcgtgctgtctattcctgtcaccgatccaaacgggaacggtgtaaaaaccgctcttaagataacagcatatggttctgcaaaacctaaaactcaggatctcatctttaccgtcccgaccagccccgatacccctctggcaaacttttggggacatatgtccgaatcagtaatgggtgccaatggcgctgtctttatgcgcccccagttgcaaattgaactgaaagggaatatgaaagggatggccacattttttgaaagcggtgaaatatggccgcgtcgggtttacagaggagctaaatggtactgcggaaaaatacatgccaatttgccaacacaagaggatttgcagagcctgtatcgtgcatattcggcaaatgaaatgcacgatctgcacggctggccacaacaccgctcttatcgttcttcaacgcctgcagagggtaacaaagtgcatattgccgtgaatatagacaatggaatagcacatcccatcgaggacaacattgtcagcgattatgtcatttgccgtcagtaa

SEQ ID NO: 4771 - DNA, 1698 bp, Xenorhabdus bovienii
  Coding DNA location: Contig name=SeqID_16897; Position on contig =252988..254685bp; Strand=+
atgcatgaatttaatcttgttttgttactacttcagcaaatgtgtgtctatttggttatcgcctggctgctgagtaaaacgcctctgtttatccccctgctgcaagtttccgttcgcttgccacataagctgatgtgttatctcattttctccattttttgcattatggggacgtattttggattgagtgtcaatgattccatcgccaatacccgcgccatcggtgctgtactgggtggctttctcggcgggccggcggtcggtgctatggtaggattcactgggggattgcaccgctattccctcggtggaatgaccgcgtttagttgtatggtgtccactattgtagaaggcatacttggcggccttgtgcacagttatctgatgaagcggggacaaatcaataagctgctgaatccgtggactgccgctatcgtcaccttcctggctgaatgtatccagatgggcattatcctgctgcttgccaatccgttcagtgatgctcttaagttggtgaaaaatatcgccgctcccatgattattgccaatagcatcggagcggccatgttcattcggatactgctcgacaggcgcgccatctttgaaaaatataccagcgccttttctgcccaagccctgaaaatcgccgtctgtacagaaggaatactgcgtaaagggttcaatgaggataacagtatgcgcgtagcaaaggttatttatcaggagttagaaatcggggcggttgcaattaccgacagggaaaaattactggcgtttatcggtatcggctccgatcaccatttgtctggtactcccattgtttccgagcaatcacatcgtgcgatagaaaataatgaagtcgtgtatgccgatggtaatgaaacgccctattgctgctctctcagcccaatctgtaaactcggctcggctttggtgatccctttacggggagaaaaccaacaggtgattggcaccatcaaactttatgaagccaagaatcgtctattcagttcaatcaatcgtacattaggtgagggcattgccagcctgctttctgcccaaattcttgccggacaatacgagcggaacaagcaatctttgctgcaatcagaagtgaagctacttcacgcgcaagtaaatcctcactttttatttaatgccttaaatacgttacaggcggtgatccggcgggatagccaacaggccgggcagcttgtgcaatatctttcaacatttttccgcaagaatctgaaacgaccagaggaaattgccacgctggagaatgaaatagagcatgtgaatgcttacttacaaatagagaaagcccgtttccgtgagcgtctccagattgccatagcaatacctgaatccctgcacagcgcaaaattgcccgccttttccctgcaacctatggtagaaaacgccataaaacatggcacttcacagttactggatacaggccgaattactatccgagcccatcaggaagctaatttattactggttgagattgaagataatgcaggactttattgtctaaaaaaaatgggggatggacttggaatgagtctggtagataaacgtcttcagcttcgctatggtgagcgctatggtgtgcatgttgattgccaaccagaaaaatttacccgtgtcattttatgtttaccattggaaaaagaagctgacaaagcggtgtaa

SEQ ID NO: 4772 - DNA, 720 bp, Xenorhabdus bovienii
  Coding DNA location: Contig name=SeqID_16897; Position on contig =254688..255407bp; Strand=+
atgaatgtattgattgttgatgatgaaccactggctcgtgagaatctgcgttgcctgctagaagaggaaacggatattcaaatcatcggtgagtgtgccaacgcagtggaagcgattggtgctatccatcgcctgaaaccggatgtggttttcctcgatattcagatgccccgcattaccgggcttgaaatggtggggctgcttgatcctgagcatcgcccttatattgtttttctcactgcctttgatgaatacgcagtgcaagcctttgaagaacacgcgtttgattatttgctgaaaccgctggaaaaggagcgtctgagcaaaacgttgcagcggctgcgttcaggctatcagaagcaaaatctggcagatctgcaacaggaagatgagcagcttaaatatattccctgtacagggcacagccggatatggctgatgcagctggatgaggtgctgtatgtcacctcacgcctgagtggagtttatgtgatgagcgctaatgaacaggaaggttttaccgagttaaccctgcgcacgctagaaacccggacttccttgacccgctgccatcgccaatatctggtcaatatgactcatttgcgggaaatcatttttggagagaatggacaggcagaactggtgttacgaaataatgagcgtattccagtcagtcgccggtatttaaaaccactaaaagaagttctggggttaaattaa

SEQ ID NO: 4773 - DNA, 1989 bp, Xenorhabdus bovienii
  Coding DNA location: Contig name=SeqID_16897; Position on contig =255723..257711bp; Strand=-
atgaccactgagactgaaatctcttttgctgatttaggtttatcagcacctattcttgctgcactgggagacatgggctatgagaagccttcccctatccaacaacaatgtattcctcacctgttaaacggtcgtgatgtgctgggtatggcacagaccggtagtggtaaaactgcagcatttaccttgcctttgctgcacaacattgatgctgagcttaaagctccacagatccttgtgttagcgccaacccgtgaactggcggtacaggttgctgaagcatgttcagagttctccaagcaaatgcgtagtgtaaacgttgttgcactctacggtggacagcgttacgacgtacaattgcgtgcactgcgtcaagggccacaggttgtggtaggcacgccgggtcgtctgctggatcacctgaagcgtggtactttggatctgtccaacctgaaaggtctggtactggatgaagccgacgaaatgctgcgcatgggctttatcgaagatgttgagaacatcatgagccagatccctgctgagcaccagactgccttgttctcagcaactatgcctgaagcgattcgtcgtattactcgtcgtttcatgaaggatccacaggaagttcgtattcagagcagtgttactactcgtccagatatcagccagagctactggtctgtacatggcgtgcgtaaaaacgaagcactggtacgtttccttgaaacagaagattttgacgctacgattattttcgtgcgtaccaaaaatgcaacgctggaagtagcagaaaccctggaacgtcatggttataactctgcggcattgaatggtgacatgaatcaggcgctgcgtgagcagacactggaacgtttgaaagatggccgtttggatatcctgattgcgacagatgtagcggctcgtggtctggatgttgagcgcatcagtctggtcgtgaactacgatatcccaatggatgcggaatcatatgtacaccgaatcggccgtactggtcgtgctggtcgtgctggccgtgctctgctgtttgttgaaaaccgcgagcgtcgtctgctgcgtaacgttgaacgtaccatgaaactgaccatcccggaagttgaactgccgaatgcagaacttctgagccagcgtcgtctggagaaatttgcggctaaggttcagcagcaactggaaagcagcgatctggatcagtatcgtgcactgttgtctaaactgagcactaacgatgagctggatatggaaacgctggcagcgtcattgctgaaaatggcacagggtgagcgcccactgattctgccaccagacccagttcgtcgtcctcgtcgtgaattcaatgatcgtgatgaccgtcgccgtgatggtttcgtcagtcgtgaaagaaatgacagaggtgacagaaacgaccgtggcgacaaaagtgatcgtccgcgccgcgaacgccgtgacgtaggagacatggaactgtaccgtattgaagtgggtcgtgatgatggtgttgaagtgcgtcacattgttggtgcaatcgccaacgaaggtgatatcagcagccgttatatcggtaacatcaagctgttcgctactcactccaccattgagctgccaaaaggaatgccgggggatttattgtctcacttcacacgtacccgcatcctgaacaagccactgaatatgcagttgatgggtgatgcacaaccgtttgaacgtcgcgaacgtcgtggcggtggtagtggtcgtactggtaacggtagcaacggtagcaacggtagcaacggtagcaatagcggtaatggtagcactggcggtaacggtagcaacagcggtaatgctccacgtcgtgatcgtgaaggctttggtaatggtggccgtcgttttagcactgaacgccgtggcgatcgcgctaattcccgtggccgcagtggtgatgagagcaatagcgcaccacgtcgtcgtcaaaacagcggcaacgcataa

SEQ ID NO: 4774 - DNA, 885 bp, Xenorhabdus bovienii
  Coding DNA location: Contig name=SeqID_16897; Position on contig =257882..258766bp; Strand=-
atgaattcttttctgcgctggtgttatgttgcggttatctttctccttgtgggatgtagcagcactggatggcgtaaaaatgaaatgattgctattccattacaaccgacattgcaacaagaggtcatcctggctcgtatggaacaaatacttgccagtcgctcgcttacggaagatgagtatgcacagcttttatatgagagaggtgtgctgtatgatagcctcgggctgagggcattggcgcagaatgatttttcagtggctttgtctatccgtcctgatattcccgaaattttcaattacttagggatttattttacgcaggcaggcaattttgatgctgcctatgaagcgtttgattctgttttagagcttgatccaacttacaactacgcgcgaatgaatcgcggcattacactgtattatggtggccgctatcgtttagcgcaggatgatctgcaggcgttttatcaagacgatccaaatgatcccttccgttcgttgtggttgtaccttgtggaagataaaatcgatcccaaggttgcaatgaccaatttgtcacgccattttgacaaagcgaaccgggggctatggggctggaatattgttgagttctatttaggcaaaatcagtgagaaaacactgatggatcgcctgaaggagaattcatcagataacacttcgctcgctgagcatctcagtgaaactgacttctatttaggtaagcattacctaagtctgggggatgaggataacgcggttgcgttattcaagctgacggtagctaacaatgtccataattttgttgagcaccgctatgcattgttggaattagcgctgctaggccagagacaagatgacctatcggaatcgaaccaacaatag

SEQ ID NO: 4775 - DNA, 2151 bp, Xenorhabdus bovienii
  Coding DNA location: Contig name=SeqID_16897; Position on contig =258896..261046bp; Strand=-
atgattttgctgaatccgattgttcgtaaattccagtatggtcagcataccgtgaccattgaaaccggcatgatggctcgtcaggcgacagcggccgttatggtaaatatggatgacactgcggtatttgttaccgttgttggccagaaaaaaatgaaagcaggtcagaatttcttcccactgaccgttaactatcaggagcgtacctacgctgctggtcgtattccaggaagtttctttcgccgtgaaggccgtccaggtgaaggtgaaacccttgttgcccgtttgattgaccgtcctctgcgtccactgttcccagaaggttttctgaacgaagttcaaatcatcgcgacagttgtttctgttaatccactggtgaaccctgatatcgttgccatgattggtgcatccgctgcactggcactgtcaggcattccattcaatggcccaattggtgctgcacgcgtcggttacatcaacgatcaatacgtgttgaacccaaccagtgatgaactgaaaaacagccgtttagatttagtggttgcgggtacagcaggcgcggtactgatggtcgaatctgaagcggagctgctgactgaagagcagatgctgggtgccgttgtctttggtcacgaacagcagcagattgtgattgatcacatcaatgcattagttgctgaaacgggtaaagataagtgggactgggcaccagaatctatcaaccagccactgcatgatcgcgttgctgaactggcagaaagccgtctgggtgatgcttaccgtattaccgaaaaacaggaacgttacgctcaggttaatgccatcaaagaagaagtttctgcgattatcgttacagaagcagcagaaaaaggtgttgaactggaaggatcagaagttcttgacgtgctgtctgttctggagaaaaacgtcgttcgtggccgtgtcctgcgtggtgagcctcgcattgacggccgtgaaaaagacatggttcgcgcgctggacgttcgtactggtgtactgccacgtactcacggttcatccctgttcacccgtggggagactcaggcgttggttgcagcgacactgggtactgagcgtgatgcccaagttattgatgaactgatgggcgagcgtgccgatcgcttcttgttccattacaacttccctccgtactctgttggtgaaacgggtatggtcggctcaccaaaacgtcgtgaaattggtcacggtcgtctggcgaaacgtggtgttctggctgtaatgccaaccgccaacgaattcccatatactattcgcgtagtttctgaaattaccgaatctaacggttcttcttctatggcttctgtctgtggtgcttcactggcactgatggatgctggtgtacccattaaggctgcggttgctggtatcgctatgggtctggtgaaagaaggggataactttgttgttctgtctgatattctgggtgacgaagatcatctgggtgacatggactttaaagtcgcgggtagccgtgatggtatcagcgcattgcagatggatatcaaaattgaaggtatcaccagcgaaatcatgcaggttgctctgaatcaagccaaaggtgctcgtctgcacattcttggcgtgatggaacaggctatccaaagcccacgcaatgatatctctgaatttgcgccacgcatccacactattaagatcaatccagacaaaatcaaagatgtgattggtaaaggcggttcagtgatccgtgcgctgacagaagaaactggcacaaccatcgaaatcgaagatgatggtactgtgaagattgcagccactgacagtgataaagcccatcacgctatcagacgtatcgaagagattactgctgaagttgaagttggccgcatttataatggtaaagtgacccgtattgttgacttcggtgcgttcgttgctattggtggtggcaaagaaggtctggtacatatttctcagatcgcagacaagcgtgttgagaaagtgacagactatctgcaactcgctcaggaagtgcctgtcaaggtactggagatcgaccgtcagggccgtattcgtctgagcatgaaagaagctgtgaccaataccactaccgatgaagcactacaatcaccggaatcatcagtagaataa

SEQ ID NO: 4776 - DNA, 159 bp, Xenorhabdus bovienii
  Coding DNA location: Contig name=SeqID_16897; Position on contig =260999..261157bp; Strand=+
atgctgaccatactggaatttacgaacaatcggattcagcaaaatcatattccttggttagtgttgccgactctaaatatcagcaacaatagacattctctttttgctacaccctcacgactaatgacaacacttaattcccttaagcactctcattag

SEQ ID NO: 4777 - DNA, 270 bp, Xenorhabdus bovienii
  Coding DNA location: Contig name=SeqID_16897; Position on contig =261290..261559bp; Strand=-
atgtctctaagtactgaagcaaaagcgcaaatcgttgctgagtttggccgtggcactaacgacagtggttctagcgaagttcaggttgccctgctgaccgctcaaatcaaccacctgcaaggccacttttcagagcacaaaaaagatcaccacagccgtcgtggtctgctgcgcatggttgcacagcgtcgtaagctactgaactacctgaagcgtaaagatcttgcacgttacactgcactgatcgagcgtctgggactgcgtcgctaa

SEQ ID NO: 4778 - DNA, 948 bp, Xenorhabdus bovienii
  Coding DNA location: Contig name=SeqID_16897; Position on contig =261766..262713bp; Strand=-
atggggcgtcgtcgtaggggccgtgcgatacacggcgtattgctgctggataagccgcaggatatttcctctaatgatgcgttacagaaagtaaggcggatcttcaatgccagcaaagcgggccatacgggggcactagatccactggctaccggaatgctgccaatttgccttggtgaagcgaccaaattttcccagttcctgctggattctgacaaacgctatcgggtaattgcccgtttgggacagcgcacagacacttcggattcacatggaaaaatcatttgtgaacgtgaagtgcagatcacccagccccagcttgcagccgcattggatacattccgtggtgataccatgcaggttccttccatgtattctgcgctgaaacatcagggaaaaccgctgtatgaatatgcccgtcagggaattgaaattaagcgggaagcgcgtccgattactgtttacgaattgcagttcattcgctgggaaggtgatgagctagagctggaaatacactgttccaagggaacgtatatccgtaccatcattgatgatttaggcgagctattgggctgtggtgcgcatgtgatttatctgcgccgtttgcaggttgccaattatcccactcatagaatggtgacactggaacagttgcatgaattaaaaaaacaatctgaagagcaagagattgatgcgggagaattgctcgactcattgttattgccaatggatacagcggttgcacattttccagtcattcagttggcatcagttgttgctgcttattttaagcaggggcagccagttcgcggtaaacacagtttaacgtccggtgaatgggtgcgagtcactgaaggggatgaaaacaaattcatcggcatcgcagtgattgatgatgatggtctggtagctccgcgtcgtctggtggtagaaacagaacaactataa

SEQ ID NO: 4779 - DNA, 411 bp, Xenorhabdus bovienii
  Coding DNA location: Contig name=SeqID_16897; Position on contig =262713..263123bp; Strand=-
atggcaagagaattcagtcgaactcagcgcgttgcacaggaaatgcaaaaagaaattgccatcattttacagcgcgaagttaaagatccccgtatcggtatggcaacagtctctggtgttgaggtttctcgtgatctggcttatgccaaagtatttgtaacttttctgaatgtgctggtcgaaggacaagattcggagatggtcaacgggggcattaaggccttgaatgaagcttctggttttattcgttccttgctgggcaaagctatgcgtctgcgtgttatccccgaactcacgttctcttacgacagctctctggtagacggaatgcgcatgtcgaaccttgttactaaagtcgtgaaaaacgatgagcagcgtcgtgtttctgcggatcacaacgaggaaaagtga

SEQ ID NO: 4780 - DNA, 2775 bp, Xenorhabdus bovienii
  Coding DNA location: Contig name=SeqID_16897; Position on contig =263190..265964bp; Strand=-
atgacagaggtaaccgtaaaattactggcagaagagatccagacatcggttgaacgcctgatccagcaattcgctgatgctggcattcagaaaaccgcaactgactctgtttcccagagagaaaaagaatctttgctggcacacttgaaccgcgaacaaggtggttctggcggccagccaggtaaattgacactacagcgtaagactcgcagtacactaaacgttcctggcaccggtggcaaaagtaaatcggtagcgattgaagtccgcaaaaaacgcacatatgtgaaccgtgacgcgattgaacaatctcaaacggaagaacaggcgaagcgtgaagcggaagagcaggctcggcgcgaggtagaagaaaaggcgcggcttgaaactgaagcgaaaaaattcgcggaagagcaagctaaacgtgatgctgaagaacaggcaaaacgtgaagcagcaaagagcgctcaacgtgaagcagaagaaaaagctaaacgcgaaggggttgaaatgactcagcgtgaggcggcggaaaaagaaaaagtgactaagcaacataccgaaaacaaaccaaaatcagttcagactgagcctgccgtgcaaagtgaaaaagcgcgccgtgaagccgaagcagcagatttaaaacgcaaagctgaagaagaggtgcaccgcaaagttgaagcggaagcgaaacgtgtcgcggaagaagcacgtcgcatggcagaagaaaataaagataaatggtcagaaaccgctgaacccagcgaaagtactgatgattatcacgtaaccacttcccatcacgcccgtgctgcggaagacgaaaatgacgctaaagttgaaggcgatcgccgtacccgtagccgtggcggcaaagctacccgccagaagaagaataacaaacattctgaatcgaaagccgatcgcgaagaagcacgtgcagtcggccgtaccaaaggcaaacagcgtaaaccgagtaccttacagcagagcttcaccaagccagttgccgcagttaaccgtgatgttgtgattggtgaaaccattaccgtagctgaactggccaacaagatggcggtcaaaggttcccaagttatcaagaccatgatgaagatgggcgcaatggcgaccattaatcaagttgttgatcaggaaaccgcacagctagttgctgaagaaatggggcacaaagttatcctgcgtcgtgaaaacgaactggaagaagcgctgatgagcgatcgtgacacaggtgaaacgctggctgaatcacgtgcgcctgttgttaccatcatgggtcacgttgaccacggtaaaacctcactgctggactacattcgttctactaaagtagcttctggcgaagcaggtggcattacccagcatatcggtgcgtaccatgtacaaactgaaaaaggtatgatcaccttccttgataccccaggacatgctgcgtttacttctatgcgtgctcgtggtgccaaggcgacggatatcgtagttctggttgtcgcagcggatgatggcgtgatgcctcagaccgtggaagccatccagcacgccaaggcagctaatgtacctgttgttgttgctgtgaacaaaatcgataagccagacgctgatccagatcgcgtcaagaatgaactgacacaatacggtatcattcctgaggaatggggtggtgaaaaccagttcatgaacgtttctgccaaagcaggtatcggtattgatgaattgctggaatctattctgctacaggctgaactgcttgaactgaacgctgtgcgtactggtatggctaatggtgtggtcattgaatccttcttggataaaggccgtggcccagttgcaaccattctggttcaatcaggtactctgaataagggcgacatcgtcctgtgtggctttgagtatggccgtatccgtgcgatgcgtgacgaacttggctttgaagtcatgtctgctggcccatccattccagtcgaaattctaggtctttccagcgtaccgtcagcgggtgatgaagcgactgtggtacgtgacgagaagaaagctcgtgaagtggccttgtaccgtcagggtaaattccgcgaagtgaaactggctcgccagcagaaatctaaactggaaaacatgtttgccaacatggaagaaggtaaggtatctgaactgaacatcgtcctgaaaaccgacgttcagggtacatgtgaagcgatctgcgactcactgctgaaactgtctactgatgaagtgaaagtgaaaatcatcggttctggtgtcggcgggatcactgaaactgatgcgactcttgccgcagcgtctaacgcaatcattctgggcttcaacgtccgtgcggatgcttctgcacgtcgtatcattgaaagcgaaagtgttgatctgcgttactactccgttatctatagtctgattgatgaaatcaaacaggcaatgagtggtatgctggcgccagaatacaaacagcagatcatgggtcttgcagaagtccgtgatgtctttaaatcaccgaagtttggtgctattgctggctgtatggtgacagaaggctccatcaagcgtaataatcctatccgcgtcctgcgtgacaacgtggttatctacgaaggtgagctggaatccctgcgtcgctttaaggatgacgttaacgaagtccgtaatggtatggaatgtggtatcggtgtgaagaactacaatgacgtccgtgttggtgacatgattgaagtctttgaaattattgaaatcaaacgctccatcgtttaa

SEQ ID NO: 4781 - DNA, 1509 bp, Xenorhabdus bovienii
  Coding DNA location: Contig name=SeqID_16897; Position on contig =265990..267498bp; Strand=-
atgaataaagaaattctggctgttgtggaagcggtttctaatgaaaaatctctcccccgcgaaaaaatcttcgaagcattagaaattgcactggcgacagccaccaagaaaaagtatgagcaggaaatcgacgttcgtgtttgcatcgatcgtaaatccggtgatttcgataccttccgtcgttgggtggcggttgatgaagtaaccctgccaacccgcgaaatcacgctggaagctgcaaaatatgaagacccagaaatggaactgggtggttatattgaagatcaaattgaatcagtaacttttgaccgtatcacgacccagaccgcaaaacaggttatcgtacagaaagtacgtgaagctgaacgtgcgatggtggttgatcagttccgtgagcagcagggtgagatcgtgactgctcaggtcaagaaagtgaaccgtgagaatattacccttgatttgggtaataacgctgaagcggtcattttacgtgaagatatgttgccacgggaaaacttccgtccaggtgaccgtgtgcgtggtgtcctgtatgatgttcgtccagaagctcgtggtgcacagcttttcatcacccgctctcgtcctgagatgttggttgagctgttccgcattgaggtgcctgagattggcgaagagatcattgagattaaagcagccgcccgtgatccaggttctcgcgcgaaaatcgcggtaaaaaccaacgacaaacgtattgatccagttggtgcctgcgtaggtatgcgtggtgcgagggtacaggccgtttccagcgaactgggcggtgaaagaattgacattgtgctgtgggatgataaccctgcacagtttgtcattaatgcaatggctccggcggatgttgcatctatcgtagttgatgaagataactgcacgatggatgttgccgtggaaaacagcaatcttgctcaggcgattggccgtaatggtcaaaacgtccgcctggcggcacaactgctgaaaaaacatcgtggtgatgacaagtgggaactgaacgtcatgactgcggaagagctgcaagcaaaacatcaggcagaagcacatgcttctattgatacatttaccaagcatctcgacattgatgtagatttcgccaccgtattggtcgaggaaggcttctctacgctagaagaactggcttatgtgccaatcaatgaacttctggcaatagaaggccttgatgaggaaaccgttgaagttcttcgtgaacgtgcaaaagcggccttgacgacgctggaactggctcagaaagagagccttggtgatcagcaacctgccgaagatttattgaatttatctggcatggatcgtactttggcgtttaacctggctgcccatggcatctgtactctggaagatcttgccgagcagggtatcgacgacttatctgatatcgaaggactgagtgatgagaaagcaggagaactcattatggcagcccgtaatatctgttggtttggcgatgatgcataa

SEQ ID NO: 4782 - DNA, 423 bp, Xenorhabdus bovienii
  Coding DNA location: Contig name=SeqID_16897; Position on contig =267520..267942bp; Strand=-
atgatttcagcaccagttgaagctttggggtttgaattagtgggcctggagtttatccgtgcacgtgtatcaacactgcgggtctatatcgatagtgaggagggtatcactgttgataattgtgctgatgtgagccaccaggtcagtgcagtactcgatgtcgaagatccgatctcagtgctttataacctggaaatatcttcaccaggacttgaacgtccactgtttaaggctgaacattaccagcgttttatgggtgaagaagttagtctggttttacgtatggcaatgcagaatcgccgtagatggcaaggtattatcaaagttgtcgatggtgaaatgattacggttacggtggatggaaaagacgaagtgttcgcactgagcaacatccagaaagcgaacctggtaccccacttttaa

SEQ ID NO: 4783 - DNA, 138 bp, Xenorhabdus bovienii
  Coding DNA location: Contig name=SeqID_16897; Position on contig =268163..268300bp; Strand=+
atgactcttgaaaaggtacatgttgttaagaagtggttgcgggagccggatttgaaccgacgaccttcgggttatgagcccgacgagctaccatgctgctccatcccgcgttcgaaaacgtggcaaatcttacgctga

SEQ ID NO: 4784 - DNA, 138 bp, Xenorhabdus bovienii
  Coding DNA location: Contig name=SeqID_16897; Position on contig =268255..268392bp; Strand=+
atgctgctccatcccgcgttcgaaaacgtggcaaatcttacgctgataatactaaaaacgcaagtttctagattatggtgccgaggacgggacttgaacccgtacgcccgttgtttaggcactaccacctcaaggtag

SEQ ID NO: 4785 - DNA, 339 bp, Xenorhabdus bovienii
  Coding DNA location: Contig name=SeqID_16897; Position on contig =268504..268842bp; Strand=-
atgtatgaagctcttttaggtgtattcttgctagctggtcttggagtgattgctctggttctgctacagcagggtaaaggtgctgatatgggtgcttctttcggtgcgggtgcgtctgcaacactgtttggttcatcgggctctagtaattttatgacccgtatgacggctgttttcgctacattgttttttgttatcagtttgattctgggtaacatgaccagtaaccgaactggttcagacagtaagtgggaaaatcttgctgagcctgtaaaagtcgaaaaacaagcagaagtaccagcatcgccagtaaaaccaaatagtgatatcccacagtaa

SEQ ID NO: 4786 - DNA, 1338 bp, Xenorhabdus bovienii
  Coding DNA location: Contig name=SeqID_16897; Position on contig =269021..270358bp; Strand=-
atgagtagccgtaaatattttggtactgatggtattcgtggcaaagtgggtgatagcccaattacccctgattttgttttgaaactcggttgggctgcgggaaaagtactggcgcgtcatggttctcgcaaaattatcattggtaaagatacgcgtatttccggctatatgctggagtctgctctagaagcagggttggcagcagcgggtttatcggcatcttttactggccccatgccaacaccggctgtggcctatttgacacgtactttccgcgcagaagcgggaattgtcatttcagcttctcacaatccttactatgacaacggtattaaattcttctctatcgatggaaccaaactgcctgataatgttgaagaagccattgaagctgaaatggaaaaaccactgacctgcgtagagtctgctgagttggggcgtgccaatcggattgttgatgcggctggtcgttacattgaattctgtaaaggcacattcccgagtgaacaaagcctgaatggattgaaagttgtattggattgtgccaatggtgcaacctaccatattgccccgaacgttctcagagaactgggtgcaaatgttgtgaccattggctgtgagccgaatggcatcaacattaatgaagagtgtggtgcaacagatgttcgcctgttacagaagcgggtacaggaagagcaggctgatgttggtctggcatttgatggtgatggtgatcgcattatcatggttgatcatctgggacagaaagtggatggagaccagatcctctatatcatcgcgcgtgaggcattgagacaggggcaactgcgcggtggtgcggttggtactctgatgagcaatatggggctggaattagcgcttaaacagcttggtatcccatttgagcgagcaaaagtgggcgatcgctacgtactggaaaaattgcaagaaaaaggttggcgtctgggggcggaaaattccggccatgtgattttgctggacaaaaccacgactggcgatggcattgtggcaggattgcaggtactgagcgcaatggtacggaataatatgagcctgcatgacctgtgcagcggtatgaaacttctgccacaaattctggtaaatgtccgttttacgggtgacaacgatcctttgcaatcagaacctgtgctagaagccgttaaatcggttgaggctgaattgaacggctgtggtcgagtactgctacgtaaatcgggtacagagccacttatccgtgtgatggtggaaggtgaagatgaagaattggtcactgcattggcacaccgtattgctgatgccgtgaaaaaaataggatga

SEQ ID NO: 4787 - DNA, 858 bp, Xenorhabdus bovienii
  Coding DNA location: Contig name=SeqID_16897; Position on contig =270394..271251bp; Strand=-
atgaaactgacagccagaggcagtgtcctcgatctttcccgtccacaagtgatggggattctgaacgttactcctgattctttttcagatggaggcaatcacaatacctttgatgccgcgctgcggtacgcagccaccatgatcgaggaaggtgcagccattattgatgtgggtggagaatcgacacgccctggtgccgtggatgtgagtgagcaggaagaactggatcgcgttgtcgccgtggttgaagcattggcgcagcgctttgatgtatggatctccatcgatacctcaaaagccatagtgatgcaggaatctgctaaagtcggtgctcatatgatcaatgacattcgttcgttgcaggagtttggtgcacttgacgcagcggtaaagacgggattgcctgtttgcctgatgcatatgcagggacagccctgcacgatgcaggcagagccatactacgaagatgtcgtttgggaagccaaaacatttttgacgaggcagattgatcgctgtggtgcggcaggcatcgcaaaaaacaaactgatcattgatccaggcttcggcttcggaaagaacttatcgcataattatcagctattggctcatttggaagaattccatcatcttggcttgcctattctggctggaatgtcacgcaaatcgatgattggccaattgcttcatgtaccaccgcaggagcgtgtgacaggaagcatcgcctgcgctgtgattgcagcgatgcaaggagcccagattattcgtgtgcatgatgtaaaagaaactgtacagacaatgcaaattgttcaggcaacactgtcagcgaaaaacacactggctgccaagaacacgctgtga

SEQ ID NO: 4788 - DNA, 1908 bp, Xenorhabdus bovienii
  Coding DNA location: Contig name=SeqID_16897; Position on contig =271371..273278bp; Strand=-
atggcgaaaaacctgattctctggttagtcatcgcagttgtcttgatggtattgttccagagttttggtcctggcgattctagcggtcgcagggtagattactctaatttcatcagtgagttatctcagaatcaagtgcgagaagtacgtatatcgggtcgtgatattgattacagtaagaaagacgacggtaaaaaatacagcacttacatgccaattcaggatgagaagctgctggatactctactgaataagcaggtgaaagttgttggtgaaccaccagaacaacagggcctgctcgcgactctctttatttcctggttcccaatgctattgctgattggcgtctggatattctttatgcgccaaatgcaaggtggtggcggtaaaggggcgatgtcttttggtaagagcaaagcccgcatgttgacagaagatcagattaaaaccacgtttgcggatgttgctggctgcgatgaagcaaaagaagaagtgggagaactggtggaatatctgcgtgaacctggccgtttccagaaactgggtggtaagatcccgaaaggtatcttaatggttggtcctcctggtacaggtaaaacgttgctggcaaaagccatcgcaggtgaggctaaagtgcctttctttaccatttccggttctgacttcgttgaaatgttcgttggtgtgggagcttcccgtgttcgtgatatgtttgaacaggcgaaaaaatccgcgccttgtatcatcttcatcgacgaaattgatgctgtaggccgtcaacgtggtgctggtctgggtggtggacacgatgaacgtgaacagacactgaaccagatgctggttgaaatggatggtttcgaaggtaacgaaggcatcatcgttattgccgcaactaaccgtcctgatgtgctggaccctgcattgctgcgtccgggtcgcttcgaccgccaagtcgttgttggcctgccagatgttcgcggtcgtgagcagattctgaaagtgcatatgcgtcgtatcccgctggataccgacgttgacgcttccatcattgctcgtggtacaccaggtttctctggtgcggatcttgcgaaccttgcgaacgaagctgccttgtttgccgctcgtggcaataagcgtgttgtttccatggtggagtttgaaaaagcaaaagataagatcatgatgggtgcagaacgccgttccatggtcatgacggaagagcagaaagaatccacggcttatcatgaagcaggacacgccatcattggccgtctagtaccagaacatgatcctgttcataaagtcacgattattcctcgcggtcgtgcgttgggtgtgactttcttcctgccagaaggtgatcagatcagcgcgagccgccagaaactggaaagccagctttcaacattatacggtggccgtttggcagaagaaattatctacggtgtagacagtgtttctactggcgcatccaacgatattaaggtggcgacatccattgcccgtaacatggtgacacagtggggcttctcggaaaaactgggcccactgctgtatgcggaagaagaaggcgaaatcttccttggccgttcggttgctaaagcgaaacatatgtcggaagatactgcgcgtttaattgatcatgaagtgaaagctatcgtcgatcgtaactatcaacgcgcccgtaaaattctgatggataatctggatatcctgcattcgatgaaagatgcgttgatgaagtatgaaaccattgatgcacctcagattgatgacttgatgaatcgaacaacagtacgtccaccagcaggttgggaaggtgacaacaataatggcggtaataaccgtcataatacgtcatccccgcagcagactgtgaaacctgcggatggtaatccaaccgcataa

SEQ ID NO: 4789 - DNA, 630 bp, Xenorhabdus bovienii
  Coding DNA location: Contig name=SeqID_16897; Position on contig =273336..273965bp; Strand=-
atggccaataaaaaacgctcagcaagctccagtcgctggttacaggaacattttagtgataaatatgttcttcaggcgcagaaaaaagggcttcgctctcgtgcttggtttaaacttgatgggatacagcaaagcgacaaaatctttaaaccgggtatgaccgttgttgatctaggcgctgctccgggagggtggtctcaatacgtagtcagtcagattggtgatcgtgggcgggtgattgcctgcgaccttttaccaatggatccgattgttggagtcgatttccttcaaggcgattttcgtgatgaacttgtattgaaagcattgcttgagagagtgggtgataataaagtccaggtcgtcatgtcggatatggctcccaatatgagtggaacccccgcggtcgatattcctcgatccatgtatctgattgagttagcgttaggtatgtgtcgtgatgtgctggcccctggcggtagttttatcgttaaagtgtttcagggagaaggctttgatgaatacctgagggaaatacgctccctttttacgaaggttaaagttcgtaaaccagaagcttcgcgggcacgatcgcgtgaagtatacattgtagcgacagggcggaaactgtag

SEQ ID NO: 4790 - DNA, 294 bp, Xenorhabdus bovienii
  Coding DNA location: Contig name=SeqID_16897; Position on contig =274100..274393bp; Strand=+
atgactcttaacaagaaacaagtgcaatacctgaaaagtctcgctcattcattaaaacctgtcgttatgattggtaacaacgggctgactgaaggcgtgttggctgaaatcaagcaaactctttcgcatcacgagcttatcaaagtcaaagttgcaggcgaagaccgtgaaatcaaaactttgatcgctgaagcgattgttcgtgaaactggtgcatataatgtgcaaatcattgggaaaatgctagttctctaccgtccatcgaaagaacgcaggattagtttaccgaaataa

SEQ ID NO: 4791 - DNA, 477 bp, Xenorhabdus bovienii
  Coding DNA location: Contig name=SeqID_16897; Position on contig =274548..275024bp; Strand=-
atgaaacaaattccgatgacggtacgtggcgcggataaattgcgcgaagaattagaaaatctgaaaaatgtacgtcgccctaaaattattaccgcaatcgctgatgcgcgtgcgcatggtgatttgaaagaaaatgcggaatatcatgctgctcgtgagcagcaagggttctgcgaaggccgtattcaggaaatcgaagctaaactttccaatgcgcaggtgattgatatcacgaagatgactaataatggtcgtgtgatctttggggcaacggtaacggtattgaatgtgggttctgatgaagagcagacttaccgtatcgtgggtgacgatgaagcgaatatcaaagagaacctgatttcggtgaattcacccattgctcgtgggctgattggtaaagaagtggatgatgctgttgtgatcagtacgccaggcggcaaagtggaatatgaagttctgaatgtcgagtatctctga

SEQ ID NO: 4792 - DNA, 105 bp, Xenorhabdus bovienii
  Coding DNA location: Contig name=SeqID_16897; Position on contig =275091..275195bp; Strand=+
atgagcacaccttatcaggcgggtctccagacaataaaaggagagcaaactacagtataccctgaagttcacatacctattttgcctgctaatctattattctaa

SEQ ID NO: 4793 - DNA, 1542 bp, Xenorhabdus bovienii
  Coding DNA location: Contig name=SeqID_16897; Position on contig =275206..276747bp; Strand=+
atgatggatcatcgtttacttttacctgaattgcaccttagtattattgatgtaaatattattagaatacttccaccttcatatgcgagatctatggctcttttaaaaattaccagcaaaatagcttgtatgctcagttttagcctgagcattttcagcgcaaatgcgtcctcaatagaagaagatgctcaatatttgcctgcgggaactgacttctcatttattgcccagaaaatcggctcaaaaacgtccttatttgattataatgggcagcagttggcattacctgccagtactcagaaaattgtgacggcattggcagccttgttacagcttggcaaggattaccgttttatcaccacactggaaagtaatgctgatatttcagatgggatattgagaggcaacctaactgctcgctttgttggtgatccaaccctgacacgttcgcaactgcgcaatatggtagaaacgttgaaacaatccggcataaaacagattgatggcgatctcatcatagacagttcaattttctcaagccatgataaagctccgggttgggtatggaatgacatgacccaatgcttcagtgcacctccagccgccgcaattgtcgataaaaactgcttttctgtttcgctgtatagttcagaacaacccggtgaactggcgtttgtccgcgttccttctttttatcctgtcagtatattcagtgaagtaaaaacgctgtctaaaggctctccagaagcaaaatactgtgagctggatgttacctcaggtgaattaaaccgatttactctgacaggctgtctgacacagcgcagtgaaccactgccactggcattcgccatccagaatggagcaagttatgtgggtgctattttgaaaaatgaactgcacatcgctgacattgagctaaaaggccatctacggcgccaatcgaatcctgagcaaccagagaagattctcgctttgaatgaatctgttccattacatgatctgctcaaaatcatgctgaaaaagtcagataacatgattgccgataccatctttcgcaccctcggccatcgctattttaacgtacccggaacatggcggactggttctgatgccattcgtcagatactgaaacaaaaagcaggcattgatctaggcagtaccgtcatggttgatggttccggcctttcacgtcacaatttaatcacaccagcaaccatgatggaaatcttgcaatttatcgcgcagcacaatgatgatctcgattttatatccatgctgccaaaatcaggttatgacggtaccctgtcctatcgtccgggactccatgaagcaggtgtaaatggtcaagtctttgcaaaaacagggtcactgcaaggggtttataatcttgcgggctttattaccgcagccagcggacagcagatcgcctttgtccagtttatctcttcttattctgttttacctgacgctcaacgtacccgccgtgttcctttggctcgtttcgaaagccatttatataaatcgttataccaaaatcattga

SEQ ID NO: 4794 - DNA, 1179 bp, Xenorhabdus bovienii
  Coding DNA location: Contig name=SeqID_16897; Position on contig =276807..277985bp; Strand=-
atgaaatttgtagatgaagccagcatactggttgtagcgggagatggtggcaatggttgtgtcagcttccgtcgagaaaaatatattccaaaaggtgggccagacggcggtgatggtggtgacggcggtgatgtctatctgctggcagatgaaaatctcaatacgctgattgactaccgttttgaaaaatccttccgtgctgaacgtggtcaaaacggacaaagccgtggttgtaccggtagacgtggccaagacattaccatcaaagtaccagtaggaacccgtgtgcgcgatatcgcgactggggaagtccttgcggatatggtgcgtcatgagcagcgtcagatggttgccaaagggggatttcacggccttggtaatacccgctttaaatcttctgttaaccgcgctcctcgccaaaaaacgatggggacgccaggtgaaagccgtgagctgatgctggaactgatgctgctggcagacgtgggaatgttggggatgccaaatgcaggtaaatccaccttcattcgctctgtttcggcggcgaaacctaaagtggcggattatccatttacgacactggtgccaagccttggcgtcgtgcggatggataacgagcaaagctttgtcgtggcagatattcccggtttgatcgaaggtgcgtcagacggtgtgggcttgggtattcgtttcctgaaacatttggagcgttgccgtgtcttacttcacttaattgatctttgcccgatcgatgaatctgatccggttgaaaatgcccgtatcatcattaaagagctgcacaaatacagcgaaaaactggcagaaaaaccgcgttggctggtattcaataaagtcgatttaaccgatccggaagaagctaaacagcgggcaaaagctattgctgatgagcttggctgggaaggcgactattatatgatttcggcgataaatcgtcagggtgtgaaagatctttgctgggacatcatggaattcatgaaaactcagcctcgccatatggacgtggaggaagaagcccagccggaaaaagttgaattcatgtgggatgattaccataaggaacagttacaacaatcatctgatacggatgttgacgatgatttggatgatgactgggatgagggagacgaagaaggcattgagtttatttataaacactag

SEQ ID NO: 4795 - DNA, 111 bp, Xenorhabdus bovienii
  Coding DNA location: Contig name=SeqID_16897; Position on contig =277969..278079bp; Strand=-
atgtgtgttgcggggctttttatattctggattacgccatctctgggtacagcagccatccagctttacggtggttatcctacggagaaaagtgatgaaatttgtagatga

SEQ ID NO: 4796 - DNA, 258 bp, Xenorhabdus bovienii
  Coding DNA location: Contig name=SeqID_16897; Position on contig =278115..278372bp; Strand=-
atggcacacaaaaaggctggcggctcgactcgtaacggtcgcgattctgaaagcaaacgtctgggtgtaaaacgttttggtggtgagtctgttttggcaggcagcatcattgttcgtcaacgtggtactaaattccacgcaggcagcaacgtaggttgcggccgtgaccataccctgttcgcattagctgacggaaaaattaaattcgaagttaaaggttcaaaaaatcgtaagtttatcagtatcgtagctgaataa

SEQ ID NO: 4797 - DNA, 309 bp, Xenorhabdus bovienii
  Coding DNA location: Contig name=SeqID_16897; Position on contig =278393..278701bp; Strand=-
atgtacgcagttttccaaagtggtggtaaacaacaccgagtaagcgaaggtcagacaattcgcttggaaaagctggacatcgcaaccggtgaaactgttgagtttgaccaggttctgatggtcgctaatggtgaagatatcaagatcggcgctccagtagttgaaggcgttaaagttaaagctgaagttgttgctcatggccgtggcgagaaaattaaaatcgttaagtttcgtcgtcgtaaacacagccgtaagcagcagggccaccgtcagtggttcactgatgttaaaatcactggcatcgcttaa

SEQ ID NO: 4798 - DNA, 972 bp, Xenorhabdus bovienii
  Coding DNA location: Contig name=SeqID_16897; Position on contig =278954..279925bp; Strand=+
atgaatttagaatcaataattaaacttaccgctgatgatatggcagcggttaatgaaaccattcttaatcaattaaattctgatgttgcgctgatcaaccaacttggctactacattatcagcggcggtggtaagcgtattcgcccaatgattgcggtactggctgggaaagcacttcattgtgaagaagaaaaacatatcacagttgccgccttgatcgaatttattcacacggcaacgctattgcatgacgatgttgtcgatgaatccgacatgcgccgaggcaaggcgacagccaacgctatgtatggcaatgcggccagtgttctggttggtgatttcatctacactcgatcgtttcagatgatgactgatctcgattccatgcgggtactgaaattgatgtccgacgccacgaatgtcattgccgaaggtgaggtgatgcagttgatgaactgcaatgatcctgatacctcagaagatgattatatgcgtgtgatttacagtaaaaccgctcgcctgtttgaggtagcggcgcactctgcggccattttatccggcgcgacaccagagcaggaagctgcactgcgtgactatggccgttatcttggcacggcgtttcaattgattgatgacctgctggattacgattcagatgataacacgctcggtaaaaacaccggggacgacttaaacgaaggcaaacctacactgccccttctgcatgccatgcatcatggagcccctgagcagtctgcattgatacgcagtgccattgagcaaggcaatggccgccatttgttagataccgtactagcaacaatgaaacagtgtggttcacttaagtacacccgccaacgggcggaagaagaagcagataaagccatttcagcgttacaagtactggatgagtctccatataaggcggcccttgtgggattagcccatgtcgcggtacagcgactttcctga

SEQ ID NO: 4799 - DNA, 381 bp, Xenorhabdus bovienii
  Coding DNA location: Contig name=SeqID_16897; Position on contig =279953..280333bp; Strand=-
atgaaaaaagattggtattctgcaaaggaactcattggcctcgcaggtctgccatcgtctccccaaggcgtcaacttgatggcaaggcgcgagggttgggaacaacgccgtaagcgcggagtgcaggggaaagctctcgaatatcatgtcaacagcttgcccgaagaagttctgaatgtactgtccgtcagtgaaaattcggttgagtattatcggaataagcgacaggatccgttcatgatttggattgaagcttattatcaattgaccaaacccgaaagggaacgcatggttaagttcattttgaggaaagggctggctagcctagtccaatacataggaattcaagaggttgaaaataaagacagtatcccagattga

SEQ ID NO: 4800 - DNA, 348 bp, Xenorhabdus bovienii
  Coding DNA location: Contig name=SeqID_16897; Position on contig =280409..280756bp; Strand=-
atgaaaaaagagtggtatacggcaatggagttgaccggtgtaggtgagttacctagatcaccacaaggagttaatgccagagcaaaacgtgaagaatggttgagacagaaacgagcaggtgttcaaggtagggcgattgaatatcactattcgtgttttcctgaatcaacattgtcggctctggagcttcatgaaatatcacctgaatatcaggttcagaaacaagatcctctatccatttgggtgagtgcatttaatttactcgccgatgaagaaaaggaggcgattacagaagtgatattacgagatggcataagaagttttttggaaaaaatcatagcgacttga

SEQ ID NO: 4801 - DNA, 267 bp, Xenorhabdus bovienii
  Coding DNA location: Contig name=SeqID_16897; Position on contig =280944..281210bp; Strand=+
atgatttctatgaaatcggattggcatcctgctgatattattgctgctttacgtaaacgcggaacgacactggctgccgtttcacgcgaagcagggttaagctcatcaactttggcgaatacactttctcgcccatggcctaagggagaatggataatagcgaattacttaggattacatccgtctgaaatatggcctagtcgttatttcgatccacatacaggagaactattagaaaggaaagttagagaaaaaaagaataattag

SEQ ID NO: 4802 - DNA, 939 bp, Xenorhabdus bovienii
  Coding DNA location: Contig name=SeqID_16897; Position on contig =281323..282261bp; Strand=-
atgaaagttgcagttctcggtgcagccggtggtattggtcaggcacttgcccttctactcaagacccaacttccttcaggttcagaactttccttgtatgacattgctccggtgactccaggtgtggcagccgatcttagtcatatcccaacggaagtcaaagtcactggttttgctggtgaagatgcaacccctgcattggtaggcgcagatgttgtattaatctctgcgggtgtggcgcgtaaaccaggcatggatcgttcagatctgttcaatattaatgcggggatcattcgtaatctggtccagcaggcagctaaggcttgtccaaaagcattaatcggtattatcacgaaccctgtgaatactactgtggcgatcgcggctgaggttctgaaaaaagaaggcgtttacgacagaaaccgtctgttcggtgttacgacgctggatatcatccgttccaatacttttgttgcagaactgaaaggtaagaactctgaggagttggaagtgcctgttattggtgggcactctggtgtgactatcctaccattgctgtcacaaattcagggcgtcagcttcactgatgaagaagttgaagcgttaaccaaacgtattcagaacgcaggtactgaagtggttgaagcgaaagcaggtggcggatctgccactctgtctatggggcaggcagcggcacgtctgggtctttctttgatccgtggcttgcagggtgaaagcaatgtcatcgagtgcagctatgtagaaggtgatggcaaatatgcccgattcttcgctcagcctgttcgcttaggtaaaaatggtatcgaagaacgtttagatatcggcaaacttagcgattttgaacagaagtcactggatagtatgttggacgttctcaaaaaagatatcgaattaggcgagaaatttattaacggttaa

SEQ ID NO: 4803 - DNA, 471 bp, Xenorhabdus bovienii
  Coding DNA location: Contig name=SeqID_16897; Position on contig =282790..283260bp; Strand=+
atgcgtgctccttcgaaacaggaagatttggtcaaggctttcaaagccttattgaaagaagaaaaattcagctctcaaggtgaaattgtcgcagcacttcaggaagagggctttgaaaacattaaccaatctaaagtttctagaatgctgactaaatttggcgcagtccgaacccgtaatgcaaaaatggagatggtctactgcttacccgcagaattaggtgttcccacagccacaagcccattgaaaaatctggtcttggatgtcgattataatcattgtgttgtggttattcgcaccagcccgggcgctgcacagttgattgcacgcctgctggattccctgggtaaagcagaaggaatacttggcagtattgcgggagatgacactatttttacgacaccagcacaggactttacaacaaagcaactctacgaggctattctcgatctctttgatcaagaactttaa

SEQ ID NO: 4804 - DNA, 1371 bp, Xenorhabdus bovienii
  Coding DNA location: Contig name=SeqID_16897; Position on contig =283398..284768bp; Strand=-
atgcgtattcatattcttggcatctgcggtactttcatgggagggctggcgatcctcgctcgttcactgggtcatgaagttaccggctctgatgccaatgtgtatcctccaatgagtacccttctggaaaaacagggcattgagctgattcaaggatatgatccttcacagctcgatcctgagccagacatggtaatcattggcaatgccatgacacgtggtaatccctgtgtggaagcggtgctggatcgtggcattccttatacatctggcccacagtggctacatgatcatgttttgccagaacgctgggtgttagccgtcgcgggaacgcatggtaaaacgacaaccgcaggaatgctagcatggatcttagaagcctgcggttataagccgggattcctgatcggcggtgtgccgggcaattttgacgtttcagcacaaatcggtgaaagtccatttttcgtgattgaagcggatgagtatgactgcgcgttttttgataaacgttcaaaattcgtgcattacggcccccgcacactaatcatgaataaccttgaatttgatcatgctgatatttttgaaaatctagcggccgtccaaaaacagttccaccatctcgtcagggttgtgccgggcagtggtaagattctggtacccgataatgacattaacctgaaacatgtgctcggaatgggatgctggagtgagctggaacatatcggggaaacgggtaactggcaagcgaagaaagtcagtcaggatagcagcatctaccaagtgttccatcaaagtgaacaggttggcgaagtgaactggtcattggtgggtgaacacaacatgcacaatggtttgatcgcaattgcggctgcccatcatgttggtgttcagcctgcggatgcttgtcaggtactgggcgattttatcaatgcgcgccgccgtcttgaattgcgtggtgaagtgaatggtatctcagtttatgatgattttgctcatcatcccactgcaattttggcgacactggcagcgctgagaagtaaagttggcggtgtcgctcgtatccttgctgtgctagaaccgcgttcaaataccatgaaaatgggcatgagcaaaaatgatattgcgccttctctgggacgtgctgatgaagtcttcttgtatcagcctgccaatattccgtggcaggtcgcagaaattgcggaacactgcatccaacctgctcgctggagtgcggatattgatgctttggtacgtatgattgttgaggtggcacaaccgggtgattacattcttatcatgagtaatggtggattcgatggcattcacgagaagttgctgactgagctgggtaagaaagtgcacgaggcttga

SEQ ID NO: 4805 - DNA, 1158 bp, Xenorhabdus bovienii
  Coding DNA location: Contig name=SeqID_16897; Position on contig =284787..285944bp; Strand=+
atgaggtgtgtcactattctaaccatcaatgctgagattagaaatgcaatagcctatcaatcaccccattctttagctaaactgccgcgcatgagtgcgacacgcaagtgcagcacgctctctaaaaccacaacaaaattcagggctttcgtcatgaaaacattaggcgaattcatcgtcgagaaacagcacgactttcctcatgctacgggtgaactgaccgcactgctttctgccatcaaactgggtgccaaaatcattcatcgggacatcaataaggctggtctggtggatattttgggcaccagcggcgtatcgaatgttcagggcgaagttcagatgaagctggatttgtatgccaatgaaaaactgaaggctgcattgaaagcccgcggtgaagtagcaggtattgcttccgaagaagaagatgagatcgttgtctttgatggcgaccgtgcagaaaatgcgaagtatgttgttttgatggacccactggatggttcttcgaatattgatgtaaacgtttccgtcgggactattttctcaatttaccgtcgaattacacctattgggcagccggttaccgaagaagatttcctgcaaccggggaatcgtcaggttgcggcgggttatgtggtctatggctcgtccactatgttggtttacaccacgggttgcggagttcatacattcacttacgatccctcactcggcgtattttgcctgactcatgagaaagttcaattccctgccaaaggcaatatgtactccatcaacgaagggaactacatcaaattcccgatgggcgtgaagaagtacatcaaatattgccaagagcaagacgaagccacccagcgcccttacaccacccgctatattggctcgctggttgcagatttccaccgcaacctgctgaaaggcggtatctatatttatccaagcaccgcaagtcacccaacaggaaaattgcgtctgctgtatgaatgcaacccaattgcttttttggctgagcaggctggcggcaaggccagtgatggcaaaaaccgaattctagatatcacaccaacccaattgcatcagcgagttcctttcttcgtgggaacagaatcaatggtggaaaaagctgaaagctttatggctgaatttccaggtgagtaa

SEQ ID NO: 4806 - DNA, 531 bp, Xenorhabdus bovienii
  Coding DNA location: Contig name=SeqID_16897; Position on contig =286361..286891bp; Strand=+
atgagcctgaacaatgtaccggccggtaaagaactgcctgaagatatctatgtcatcattgagatccctgcaaacgcagatccgatcaaatatgaagtagataaagactccggcgcactgtttgtagaccgtttcatgtctacggcaatgttctatccttgcaactacggttacatcaacaatactctgtcccttgatggcgaccctgttgacgtgctggttcctacgccatacccattacaaccaggttccgttattcgctgccgtccagttggcgttctgaaaatgtccgacgaatccggtgaagatgcgaaattggtcgctgttcctcacaccaaactgagcaaagaatacgatcacatcaaagatgtgaacgatctgccagaactgctgcgtgcccaaatcacccatttctttgaacattataaagatctggaaaaaggcaaatgggtgaaagttgacggttgggacaatgttgaagccgctaaagctgaaattctgtcttctttcgaacgcgctgctaaaaaataa

SEQ ID NO: 4807 - DNA, 348 bp, Xenorhabdus bovienii
  Coding DNA location: Contig name=SeqID_16897; Position on contig =286961..287308bp; Strand=-
atgcgagtgattgtttatggcagcctgaggcgcaaacaaggtaaccatcactggatgacctatgcccaacttctaggagaacataggttagaaggttatgaaatttatgacctgggacattatccagcggtgatccgtggcgaagggacaattgaatgcgaagtatatcgcattacgccatccatcctgacagaactggatgctttgaaaaagaattctcaggaatacgaaagggaactgattaaaacaccttacggcagtgcatggatctatttatatagactgcctgtcgatggactgcatcggataacatgtggtgactggatcaagcgccacgaagaagaataa

SEQ ID NO: 4808 - DNA, 3780 bp, Xenorhabdus bovienii
  Coding DNA location: Contig name=SeqID_16897; Position on contig =287311..291090bp; Strand=-
atgaggtggatcaaaaggttcagtattgcttttctgctgcttgttggcctgttgctgataaccgttatgggattggttggcacacaaactggcctgcattttatgattaacagcgcagcacgttgggttcccggactggatatcgccaatgtcagcgggggctggcgcgatttaaccttaaaaggtgttaaatatcagatgccgggagtaaatgtcagtgctgacaatttacacctttcgttacgcttatcctgcctgaaacacagtcatttgtgtgtcaatgcgttgactacagaaggtgcggcagtttcggtgaatacggctgagcttcctccatcagaagagtcacctgcatcagaaccattgactgaattgaaaacaccgtatcctatttcactggatttgctttctttgaagaatacccacgtcaaggttgacgatatagtgattgcgttggatgaatttaaaacaggagcgcagtggagggaaaaacagctgacattgaaaccaacggaaatcagcaatctgttggttgctttgcctaaaacgccgcctgaacaaagcggtacagtggaaaatacagcgcaaaagggtaaacaaaagcctgaacctgaaaaatcattgggtgaaaccttgaaggcgctatttgccaaacctttcttagctgaattgcccaatgttcctattcctctcgatattacggcagaaaacattcatggcagtcagcttcgcctgacaggtgatacaggtatcacgattaatgatctacggctgcaagccagtaatcaggggcagcaggttgatatgaaaaccttcagtgtaagtgcaccggaaggctcactttcgctacaggggacggtggggctatttggacagtggccagtcaaactggcgattaagggcaatacaaatctgaatgaactaaaagggcaaaaggttgatttaaccctgaatggtgctctgttgcagcagcttaatctggcattgcatctttcagggcctgttgttgccaatctgagtgctcagactgagttggcgaaggcgggtttgcctgtacgcctgacattggaaagcaaacaacttcagtggccattgacgggtgaaccggaatatcgacttgatggcgttaagcttcgactgaatggcaaagccagtggctacgatctctccctccgttcagatattaaaggtcgtgatattcctcctgcattactgatgctggatgcgaagggtaatgaagaactgctcaggctaacccgtctgcgtctgtctgccttgcaggggaaggcggagatcactggcgttgttgactggagtaaagcgattagctggaatgcgaacctgattctggatggcatcaatacagctaaacagtggccagaatggccagctaaaatgaatggcaaaatggctgtgcgcggtagcctgtatggtggtagttggcaactccagatccctgaaattgctcttgacggtgatgtgaaacaaaataccgtcaaggcgcatggcaaggcgtcaggtaatgcggcgggacagtggaatattccgcagtttgacctcacttttggccgcaataggctgaatgttcaagggcagcttacagatgaaaagtggaagttggacggtgaaattaatgcaccacagttaaatggactactgccgggattggctggtgtggttatcggtaatgtgaaactgcgcggtaacatgaaagcgccacaaatagtggcagatttaaatgcacgtaatgtgcggtggcagaatgagctgaaagtggatagcgccacgattaagggagatgtgcgctcggctgaacagattgaaggacagctcttagttactgttcatcaattgaaacaggcggatttaatcatcaataacttgatgctaaatgccaagggcacggaaaagcagcatgatttacatttgaaaattgagggtaaccccgtatcaggtcaattggcactcaatggccgctttgaccgcgggcaggagcgttggcaagggactatcaacaatacctactttgatactcctgttggtgagtggcgcttaagtaaggcgattgccattgattacctgaatctacagcagaaagtgacagtaggaacacattgctggcttaacccgaatgcacagatctgtgtccccaaaccgattgaggcgggagccagtggtcatgctgaagtggtgcttaagcgttttgatttggccatgattcagccattccttgataaaatgacccaacttaaaggcgtgttcagcgggaatgccaatgtcaaatggactgcgggacaggttttgccacaggctaaagtcgtcttgcaaggaaatggggttcagcttcaccaaatggttgaggggactgcattacctgttgattttgaaacattaacagtgaatgcaggactaacaaatggtaaggcaaatgtggcatggttgtttaagctggcaggcaatgggcaattgaatggcaatgttcaggtggctgacctggaaggccgccgcaagctgtctgggaatgtggatattcaagctctttctttaaagctgattaaaccgattttgggtaaagacgagaaagcagaaggggatttgaacgctaacctccgtctcggtggtaatgtaaaaaacccgctgttgtttggtcagcttaagacggatgatctccaaatcgtcagtcattggctgccttttgatatcacccaaggccagctagctatctattttgatggtgtccgctctggcttggagggcgttatcaaaacgcctaaagggcagctaaaccttaacggcaatgctgactggcgtaatttgaacgcatggtatgccaagattgccgcgaatggtgaaaaattgcgtgtgacagtgccgccaatggtgaaaattgatgttagccctaatctggtacttgaagccacgcctgatctactgaaacttgatgggaatgtggatattccatgggcacgcattacggtgcaggaattaccagagtctgctgtgggtatttcttctgacgaagtcatgctggataaaaatctccagccgatagagaagaaaaaatcgtccattctggttaaaagtaacttaaatattcgcattggtgatgatgtccgtttgaatgcatttggtctgaaagctcaacttaagggagccttgaaagtcattcaggataaacaggggctggggctgaatggccagattgatattccagatggtcgtttccatgcctacgggcaggatttgctggtacgcaagggtacaatcatattttctggcccgccggaacagccgatgttgaacattgaagcaatccgtaaccccgactcgacggcgaataaggttgtcgctggtgtgaaagttacgggattggcggataaacccaaagttgaaattttctctgagccagcaaaatcacagcaggaagcactgtcttatcttctgcgtggtgaaggtttggagaagagtggttctgacaataaccaaatgacttccatgctgattggtttgggcgtttcccaaagtggtcaattggttggcaagattggtgaaacttttggtgtttctgatttagctttagatactcagggtgtgggtgacaaatctcaggttgtcgtcagtggcaagataaccaacaacttgcaggtgaaatacggtgttggtatttttgattctctggcgaccttgacattacgctatcgtgtaatgccaagattgtatctcgatgcggtatctggtattgatcaggctttagatctgctctatgagtttgagttttaa

SEQ ID NO: 4809 - DNA, 1743 bp, Xenorhabdus bovienii
  Coding DNA location: Contig name=SeqID_16897; Position on contig =291087..292829bp; Strand=-
gtgtcacgataccccttcatatttgtgctttgcgtgtctgtcgcaactccatcggcctatagtgcaaatttacgattgaaagtggaaggactttctggcgaactggaaaaaaatgccagagtacagctctcaaacataagtaccgatgaagtcgctcccgatgggcgcttccaggcccgtgtcgagaaagccatacagcaagggttaaggccattgggatactacgatcccactgttgaattcacttatcaggagaaaacacccccttcccgccctgttttgacagcgaacgtgacaccgggtgaaccggtacgggtagtcgaagtcaatgttgatttggaaggtagcgcaaaaaccgataaagattatgcgtcactcatcaaaaaaaatatgccaaaggaaggggtgatccttaatcatggtgaatacgaacatttcaagggcgcattgaatagtctggcagttagaaaaggttactttgatgctgcgatgaaaaaaagtgaattagaagtatcacgggaacagcataaatcctattggaacttcgatttcgacagcggagatcgttaccgctttggctccgtgagataccacggctcgcaaattcgtgaaaattacctgaacaatcttttgccctttaaacaaggtgagtattacacctcggatcaacttgcggagttcagcagtcgtctggcgaatacgggatggttcaattctgtggttgtcgtgcctgattttaaggtaggccacacgagccaggataagttattgccactggatgcctccttggttcccagctctgccaattatgttgaactaggggggggttatgcaacggatgtcggcccccgcgttaaagcaaaatggaaaaagccatggcttaactcgcgtgggcatagcctgagtaccaatattaatctgtcggcacctgaacaagttattgatgcatcctacaaaatgccactcaaatctaatccgcttgaacaatattacgagttgcagacaggttataaacgtaaagatattaacgataccatttctgatactgcaacattgaacctttcccgcaattgggatctctccaccggatggcaatatggtatcaatttacgctggagtcttagtcactttacgcaggccaatgtgacaaatacgacgatgctgctctatccgggagcgaatgtcagccgaattcgccagcgtggtggcaccatgccttattggggagatagccagcgttattcgatagatttttccgataaaacctgggattcgaatgtggatttcttggtgttacaggctcatcacgtctggatcaggacttataaggataagcaccgctttgtggtacggggggatctgggctggattgaaaccaatgaattcagcaaggttccaccggatttacgtttcttcgccgggggggatcgcagcatccgtggttataaataccaaaaaatttcaccaaaaaatagtgaggggaagctgactggggcatcgaaactagccgttggctcactggagtatcaatacaatatctatgggaattggtggagtgcgttgtttgtagatgcgggtgaagcggtggatgatattaaaaaaagtgattttaaaaccggcgcaggggttggtgtgcgttgggcttcacctgtcgggccaattaaatttgatcttgcagcgccagtaggagacgcaagcaatcatggtattgagttttacatcggtttaggggctgaactatga

SEQ ID NO: 4810 - DNA, 648 bp, Xenorhabdus bovienii
  Coding DNA location: Contig name=SeqID_16897; Position on contig =292966..293613bp; Strand=+
ttgccaaattcagccaacgaaagccaacatgtttccacacaggatgcattactgggtagggcaatcccattaactgtatcaccctaccacgtcgtcacacagcattcgataaacgacattcctgaaaacatggagatagcttatataggaatggggtgtttctggggagttgaacgcctgttctggcaacaggaaggtatttacacgacctctgtgggttacagtggcggtactacgccaaatccaacttatgaagaagtctgcacagggttaaccggacatgccgaagtgatcaggatcgtatttgatccaaccaaaatcacttatgggcagttattgacgcttttctgggaaaatcacgatcccgcccaaggtatgcgtcagcatggtgatgtcggtacacaatatcgctctgccatttacactatttcatctcagcagtacgagcaggcactcgctacccgcgaacaattccagcaagcgatggatgaaaatggcgaccagcgcacaatcaccacggagatccgcgcagcggagccattctattttgcggaagattatcaccagcagtatctcttcaaaaatcctgaagggtattgtggactcggtggtattggagtatgcctccttcctacgcacaaaaactag

SEQ ID NO: 4811 - DNA, 1332 bp, Xenorhabdus bovienii
  Coding DNA location: Contig name=SeqID_16897; Position on contig =293769..295100bp; Strand=+
atgttaaatagtttattaataatatttttgctatgtgcaatcagcgcatttttttcgctatctgaaatttctctggccgcctcaagaaggatcaaattaaaactcatggccgatgaagggaacctcaatgctgcccatgtgcttaagttacaagaaacgccaggcatgttctttactattgttcaaattggtttgaatgcagtagcgatcctcgcgggcgtcgtgggagaatccgcattttcacccgccctgaaaacactattctcaaactttatgcgtcaggaatgggccgatcaacttggctttatctgttctttcattatcgtcaccagcctctttattctgcttgctgatttgatccctaaacgcattggcatgattaagcccgaagccgttgcagtgagaattgtcaatccaatgcgtttctgtctggcaacttttcgcccgttggtatggctgttcaatggccttgctgactgtttcttaaaaatctttaaaatccctatggcacgtaatgaagacatcacttccgatgatatttatgccgttgttgcagccggagcgttagcgggtgtattacgtaaacaggagcatgagctgattgaaaatgttttcgaactggaatcccgtaccgtgccttctgccatgacttcccgtgaaagcgtcatttattttgacaagaatgaagacgaaaacagtatcaaggaaaagatctccacccatccgcattcaaaatttctcgtttgtgatggcggtattgaccatgttactggctatgtggattccaaagacttactcaaccgtgttctaaacgggcagagcctcagcttgaaagatggcgttcaaacccgcaatgccctgatgatccctgatacgctctcactctctgatacgctggaaagtttcaaagcggctggtgaagattttgcgatcatcctcaacgagtacgcattggtgatgggagtcattaccttgaatgacgtaatgaccaccttaatgggcgatttagttgatcaggggcaggaagagcagattgttgtccgtgatgaaaattcatggcttgttgaaggtggcacaccgatcgaagatgtgttgcgagtactggatatcgatgatttccctgactccagcaattatgaaaccatcgcaggatttatgatgtttcgcctgcggaaaattccaaagcgtacagattttgtgaaattcagcggctacaagtttgaagtggtggatatcgataattacaaaatcgaccaattgctggtgacgaaaattgtggacacaccaacccaatccaacccatctcccagcggtcaagcacaaacccagtaa

SEQ ID NO: 4812 - DNA, 207 bp, Xenorhabdus bovienii
  Coding DNA location: Contig name=SeqID_16897; Position on contig =295207..295413bp; Strand=-
atgaaaatctttcaccattataacccactgaaagttgctctttacgtaaaaactctatttcgtgggcgtttgtatattaaggacatgggcgcttttgaatttaactacgggaagatcttaccacccaagataaaagataaacgtcacttgcatgtaatgagcgaaattaatcagcaagtgttgcgcctacaggctgaaatagggtag

SEQ ID NO: 4813 - DNA, 558 bp, Xenorhabdus bovienii
  Coding DNA location: Contig name=SeqID_16897; Position on contig =295740..296297bp; Strand=+
atgataaaaaacattgtgttatctgcaatgctgagtttaacttcagtattcgcattcgcccataacatcacagtaggacagccagtccctgcggtcagcgtgacagataaaggtgagttactgctcaacaatgacaagttcagctaccaaaattggaacagtacagaacttcctggaaaagtaagaaccatccagcatattgctggccgcagttctgcaaaagagatgaatgatcctctgattcaagcgttgaaacaagccgaccttccaaaggcaaaatatcaaacaaccagcatcgtgaatactgatgatgctatttttggtaccagcgtcttcgttcgtaatagcctcgaagacagtaaaaaagagtttccgtggtcacagtttattgtcgatagcgaaggtttagccaagaaagcctggggtctggaacccaaaagttcggcaatcatcgtgttggataaaaacggtaacgtgaaatttgttaaagatggtaaattgagcaacgaagatatcacccatgttctcaatctaatcaaagaagaattgaacaactaa

SEQ ID NO: 4814 - DNA, 693 bp, Xenorhabdus bovienii
  Coding DNA location: Contig name=SeqID_16897; Position on contig =296392..297084bp; Strand=-
atggcggtttatcaggatgagcagccgttgaaagtagagcataaaatggatgactcacctgttactgctgcggatattgccgcccacaagattattaaagcgggattgatgcgtattgcaccggatatcccgttgctgtcagaagaagatcctcctgtatgggaggagcgcaaaaactggcagcgttattggttggttgatccgttggatggtacgaaagagtttatccagagaaacggcgaatttaccgtcaatattgcactgattgaggatggtgtcccggtgatgggcgtcgtttatgttcctgtgctgaatgttttgtacgcagggcagggacatcaggcttggaaggaaaccaatgggcagacaattcctattaaggttgctgctgcaatgctgccgactgtggtgatcagccgttctcacatggacgaggaattgaaggattatcttactcaattaggaactcatcagacactttcggtcggatcttcacttaaattttgtatggttgcagaaggaaaagctcaactttacccgcgttttgggccaactaatatttgggataccgccgcaggccacgctgttgcgattgccgcaggtgcacatgtcacggattgggaaggtaagaagttaaattacgcgccgcgtgaatcttttctgaatccgggattcagagtcactattttttag

SEQ ID NO: 4815 - DNA, 1302 bp, Xenorhabdus bovienii
  Coding DNA location: Contig name=SeqID_16898; Position on contig =678..1979bp; Strand=-
atgttaaatatccaaaatcaaatattacagccaaattatgatgtggtgattgttggtggtggtcaggcaggtttatgcatcagtcactatttgcaaaaagcaggtattgatcatgtggtgttggaaaaagaatctgagttgacccatagctggcgccgtaaacgttgggataattttaccttggtgacaccgaactggcagtgcctgttgcctgaacatccttatcaaaggcaagatcccgacggatttatgaaaaagcacgaaatcgtggaatatcttgatgagtttattgaaaaactcaatccacctgccattttaaacattcaggtagaacatgtggaaaaagaggcagcatataagtttgtcattaaaactaattacggcacaaccacagccaaacagcttgtagtcgcagcaggcgggtatcacaccccgatttatccaaaattaagcgatgttttgcctgagaatataaaagtaatgcattcggaagaatatttgaatgcagatcaactgcctgaaggtgcggtgttggtggtcgggtcaggacagtctggagcacaaattgccgaagacttacatctggcaggcaaaaaagtctatttatcgacaggtgatgccccacgttgtgcccggttctatcgcggcaaagatgtggtgaattggctgtttgatatgggccattacaaaactactgcgaaagatcatcgctatagtgaagaagtacgtaacagtaccaaccactatgttacaggccgtgatggcggacatgatattgatctgcgtaaatttgctttagaaggtatgcagttgcttggccgttttgatgactataaagagggtcaactctggttcaggccagatttatcagaaaatctggatagtgccgatgctacttataatcggattaatgcctctattgatgaatatttagctaaaaacaacattgagactgatgagcctgtatcggtatatcagcctgtttggcagccagaacaggaaatcatacacattaatttagcaaaagcaaatattacttccgtgatttggtgtataggttttaggccggattattcatggattgatttagatatttttcaagccaatggttatccaaaacatgatcggggtattaccattgatccggatgtcacgtttattggtttgccgtggttacatacatggggctctgggcggtttctggggatcgatcaggatgctgcctatgtggtacggcatattgagcaaaaaataagtcagcaaaatagtcataacaagcagattgcggaaatggccgagtga

SEQ ID NO: 4816 - DNA, 291 bp, Xenorhabdus bovienii
  Coding DNA location: Contig name=SeqID_16898; Position on contig =1992..2282bp; Strand=-
atgcccagtgtgaattttactgtgaagtggtccaatggagaacaaactcaatattactcaccctcaaccgtgatttatgaatatttgtccattggccagtgttacccgagtacgcagtttttgcatcaggttgaagatggtctgtatgccgcatcagaaagagtacgggcatgttatggctttggctgtagttcagctatggacaatctggcaatgattcaacaccaagccaaactgttcgaactcagtccggaagatcaaattacagttattgaaatgacgcataaatga

SEQ ID NO: 4817 - DNA, 1011 bp, Xenorhabdus bovienii
  Coding DNA location: Contig name=SeqID_16898; Position on contig =2370..3380bp; Strand=-
atggaactcaatcaattactcgaaatattgagacacacacccgccatgcagtccaagcaggcgattgcatccagtatttcaaccaatacagtttcagccaatacaacctgccatgttgattcattggatagcttatatgcttaccctggggatgatgcggcagcactgccattgaatggtcagtatgtattgcacgcctgtgaaggtatgttgccaaattttgtggccaatcatccttattttgcaggatgggcggcagtcatggcgaatattagtgatattgcagccatgggcggtcgggcgttgtcagtggtgaacagtctttggcataccaacagcaaacaggcacagttgttaatgcaaggcatgcaggatgcttgtcatgcttatggtgtgccattagtcggtggacataccaatcttggtacagtttatcagcccgctttatcggttgcgattcaaggcacggcgcgaaaattgctttcagtgctgcatgtcaaaccacaacaaaaaatcctgatggctttaaatctgcaagggcaattccaccccaataccacttattggaaatgctttgagcaggtatctgactgcgttttacagtcacaaattgccttgttgccgcaattggctgaagcagctttggttcatgcagcccgtgatatcagcaatgccggcattttaggcagtttgttgatgttgctcgaagctacagcctcgggggctcatatcaacctagatgccatgcctaaacctgatgatgtggactggtctaaatggctgcaaatttttcccagctttggttttttactgactgccaatgtcgataaatgtgaagaaattatcaagctgtttcacagtcaggacattgcctgcacagtgattgctgaaaccaatgtcagtggtgtggtcacagtgcagcaacaacagcaacacggcatattttgggattttaataaccaagtatttaccggtttttgttatgccaatgtcttgaaaacatttaattga

SEQ ID NO: 4818 - DNA, 564 bp, Xenorhabdus bovienii
  Coding DNA location: Contig name=SeqID_16898; Position on contig =3380..3943bp; Strand=-
atggaactttctcgttatgcttgtctgtttgggctaaatgaagagctgaaacaatttattagcgatgacattgccatcaaaatggtgtcggaagattgggaacgccgccaatattatcgtttgcgtgaagtgacctttcgcgatgaacagaaaatcttaaaagaagatcgtgacgagtacgatgttaaagcattaggtattgttgccattgggaaaatggcgggtgagcatgaccgtgtgattggcgcagtacggattttccccgatggcgaacagacgtggtatggcgggcgtttatgtgtagagcctctataccgacgtcaccataccattggtaaagcgttaatcaatgcagcggtatcgaccgccaagaacttgggatgctgtacttttttagccaccgtgcaaagtcaaaatgaacactacttccaaagattgtgttgggatagtttgtgtcagttgaccgttgccaacattccacatgtgttaatgcaggcacagattgaaaactatccattgcagtatatcccgatgcaaacctatatgcagaaggagacgcaatga

SEQ ID NO: 4819 - DNA, 1080 bp, Xenorhabdus bovienii
  Coding DNA location: Contig name=SeqID_16898; Position on contig =3956..5035bp; Strand=-
atgtctgcaatacaattactgaccgatttgcaatgtaatggtctgaaatgggaaggcgagtttggtttatcccgcaaaggtggcgcagggccaagcgatcataaggcactgagccttgacggaaaaaccatgatgattcctgtgctgaaccttgcagcacaagactctccctatactgcaaagcctgatctgaactctgacaaggtgactgtctttaaaaaccggatcccggtggcaatcttaactatacctgcacgaccgcgattttatgatttaaaaaccgccgaaggtattgcctatgagcaaattgcgaccttacatagccatgatgtgttggcaacgacagtgttacagcattgcattcgtatgaatgacaaggcaacggcgtgccagttttgctcaattgatcagtctttgataggggatcgaaccttgatccgtaaacgcccggaacaattggcagaggtagcgaaagcagccgttgagctggatggtatcaagcaaatggtgatcaccacaggtacgccaaatacgggagatcgcggagcaaaaatcttatgtgactcggtcaaggcgattaaggcacaagtagatttaccaatacaggtacagtgcgagccacccgatgattttgcatggtttcaacgtttaaaagatgcaggcgctgtatcaattggaatgcaccttgaggcggtgagtgagcgtgtacggcaaaagattatgccgggcaaagctgaagtatcgctggaaaagtatttttcagcatttgaggcagccgttgccgtgttcggccgaggacaagtcagtacttacattttggctggattgggcgacaccgaaccggaaatcgtggaaatgactgccaaactgactgaaataggggtgtatccatttgtggtgccgtttgtgccaattcaaggcacaccattagaacatcatcctaaacctgatcacgcctttatgcagtcgctttacccgaaaatcggattgcaactcaaacaacatagcttgaactcagaaaatactcaggcaggttgtgccaaatgcggcgcttgttcttcgctgaaagcatatgaataa

SEQ ID NO: 4820 - DNA, 993 bp, Xenorhabdus bovienii
  Coding DNA location: Contig name=SeqID_16898; Position on contig =5072..6064bp; Strand=-
atgaaccgaatcattaaagctgccgcagtgcaatgtagccctgtgctttatagccaagccgcaacggtaaaaaaaatctgtgacattatttcagagcttggaaaacaaggtgtgcaatttgccgtttttcctgaaaccgtcgtgccttattacccttatttttcctttgtacaaccgccatttgccatgggaaaagagcatttaaagttgttgaatgaatcggtggttgtaccttccgaagcaactctggcgattggtcaagcctgccttgaagccaacatggtggtatcgattggtattaatgaacgtgcgggcggtacgatctataacgcacagctgttatttgatgccgatggttcaatcattcagcatcgccgcaaaattacgccaacttaccatgagcgaatggtttggggccaaggtgatggcagtggcctgcatgccattgactctgcggtggggcgtgttggttcgctggcatgctgggaacactacaacccgttggcacgttttgccttgatggcagatggtgagcaaattcatgcgtccatgtttcctggttcgttggtaggacaaatttttgccgatcaaatcagtgcaaccattcaacaccatgcgttagaatccggctgttttgtggtcaatgccaccgcatggctgcatcccgaacagcagcagcagattatgcaggatacaggctgtaacatcggtccaatttcagggggatgttttaccgccattgtttctcccgaaggaaagttcttagctgaaccgctcacgcaagatgaaggttactgcattgccgatctggatcttagcctgattaataaacgcaaacgcatgatggattcagtgggacattacagtcgccctgaattgtttagcttattgattgatcgccgtccgacaaatgtattgcacgaactgaaaattgaaacaccagatcaaaatcatctcgaaaaacacgcgaaatttaatgaaacccagatctga

SEQ ID NO: 4821 - DNA, 483 bp, Xenorhabdus bovienii
  Coding DNA location: Contig name=SeqID_16898; Position on contig =6095..6577bp; Strand=-
atgccaaaaattgatatcgaacaatataaagatggcgattttcttgttgattacgaagaaaaagtgtttgaggacgtcaaagcacagccgggtgaaaaggcactgttgactttccataccgttgcatttgaaggatcaattggcctgatcaatgtgttacaggcaaagcgtttattgcgtaagggctttgaaaccaaaatcttgctttacggcccgggtgtgcaattgggtgttcaacgtggttttccaactttaggggctgaggcttttccgggtcatttggccgtcaataaccaattgaaagcctttatggaagaaggcggcgaagtctatgcctgtcgttttgcgttgcaagcaatgtatggtcaaacagagaaagcacttattccgggaattcgcccgattaatccattggatgtgatggatttaaaactgctgatgcgtcgtgaaaatgccttaattattgatacttggactgtttaa

SEQ ID NO: 4822 - DNA, 1926 bp, Xenorhabdus bovienii
  Coding DNA location: Contig name=SeqID_16898; Position on contig =6829..8754bp; Strand=+
atgaatacaactgattttatttcggattgggtaacttctgaaaactcgattcgcccgttggtatttgaacacacatcacaggcattaattgtgttagatccacatcaaaaccagtttattgatgtgaatatcagtgccactcgattattgcgttatgaacgtcatgaaattattcaaaaaacaataacttccgtttttggtcatttaagccaactgccacacctgctggcatttaccgaagaagctttggaaaaagattgggcttggaacaatgagctatgttcctttgataaacatggtgaaaaaatccagttagatatcacttctatttcattgccctataaaaacaaaacattgttgatatggtcgctggtggatgtcagagagttagaactgcgccaacttaagaaaaataccgataaagccatccgtacagatttaaaagaatggcaagccttacaagaattgtttatcgactccgacacaggcaagcatttattactgagttcagtcggggacggtatttacagtatcaacaagcaaggcttgtgcacctttatcaatcctgccggggctaaaatgctggggctgcaacctgaggatgtgctgagtaataatattcataaaatccatcaccatacccatgacaatggcgatcattatcctgttgaggagtgcccgatttacgcggcagtacatgatggtattgtgtatgaaggtattcaggaaaatttttggcggcgtgacggcagttactttccagtggaatttaccagtaccccagtgatccgtgacagtgaaattatcggtgcagtggtggtatttcgcgatattaccgatcggctgaataccgaaaaacaactgacccatgcccttgaagaactgcaagatttaaaaagccgactggaacagcaaaacgaatatttgcaggaagaaattttacaagaaaataaataccatgaaattgtcggcaatagtgcatctattttacagattatcgaaaaaatcaaggtagtcgcctcaacggatgccaacgtgatgatttatggtgaatccggtacaggcaaggaactgattgcccgcgcaattcaccaattcagtcaccgtaaacaacaaccacttattcgggtcaattgtgccgcgattccttcggaactgtttgaaagtgaatttttcgggcatgtcaaaggtgcatttactggggctgtgcgtgaccgtatcggtcgttttgaattggcagaccaaggcacattatttttagatgaaattggcgatattcaaccagagttacaaagtaagctactgcgtgtattgcaagaaggcacctttgagcgggtcggcgaagaaaaaacgcggcatgtgaatgtgcggattattgccgccaccaaccgtaatttaaaagaagatgtgaaatataaacgctttcgtgaagacctgtatttccgtttaaatgtatttccgattcattcccctgccttgcgtgaccgtagggaagatattccgcttttggttacacattttaccagactgatttgtgacaatcgtaaaattaagtatctgccattttcacaaaagcatattttggagcttcagcaatatgactggcccggtaatatccgtgagttgcaaaatgtcatcgaacgggcgctaattacggcaaggcaaggcgctgtttcctttaaatatttgttggaacaagatcaacagcaacctaagattcagcgtcaggatatttacaatgaatatcaacaaaccgaaggcgttctgactatagaacaattcaaggagttggaaattaaaaatctttcccttgcggttaaacaatgcaaagggaaaatttttggtgataacggcgcagcgagattgttgggaataaacccaacaaccttgatctcacgcttaaagaaattagggattgattattaa

SEQ ID NO: 4823 - DNA, 216 bp, Xenorhabdus bovienii
  Coding DNA location: Contig name=SeqID_16898; Position on contig =9254..9469bp; Strand=+
atgtctaatacaatgactggtacagttaaatggttcaacagcgataaaggttttggctttatctctccaaaagatggaagcaaagatgtttttgttcatttttctgcaattcagagcaatgattataaaactttagatgaaggccaggaagtttctttctcagtagaaagtggcgctaaaggcccatcagcaactaacgtgattgctttatcttaa

SEQ ID NO: 4824 - DNA, 717 bp, Xenorhabdus bovienii
  Coding DNA location: Contig name=SeqID_16898; Position on contig =9929..10645bp; Strand=-
atgaaaaagaaactaacaacagaacaacttgcagatgccaaacgtttgaagcgcatatttgtgtcaaggcaaaagcagctcggtatctcttctcaagatgcattcgcagacgagcttggcatgactcaaagcgccgtttcacactatctcaatggtataaacgcccttaatttggagagagcggccgacttcgctaataaattgggcgttcgcattgcagatttcagtccatcattagatcaacaggccaggaaactcctgaaggtgatctatggtgatgatcctactcttgccgctcatcaacatcctcaaaaacaatatccattgctgaactgggcaaatgcaggtagttggtgtgaagaacctgcaccgctatatcctggaaacgatattgaacaatggtatgaaacttctattgaatgttcacctcatgctttctggctggaagttaaaggtaattcaatggcatcatcgaatgaattaaacatacagcaaggtatgatcattttgattgaccctgatgttaagcctacggctaataacttggtgatagcaaaacttgagggagaaaaagagctgacttttaagcaattaattaccgaaggatacgatgcctatttaaagcctctgaatcctcaatacaatatgatacctctcaatgagaaagtgcatattgttggtgttgtcgtagaagccaagatagctaagttaccctga

SEQ ID NO: 4825 - DNA, 195 bp, Xenorhabdus bovienii
  Coding DNA location: Contig name=SeqID_16898; Position on contig =10746..10940bp; Strand=+
atggaaaagatcttattatcagaatatgtgaagaaaaatggccaagtgaaagcagcaagtctggtcggtgttcatcaaaccgccataagtaaagcgttgcgagcaggtcgtaaaatatttttgatccgccaggaagatggcagttacaaagctgaagaatgtcggccatttcccagtcagaaacaggctgtatag

SEQ ID NO: 4826 - DNA, 399 bp, Xenorhabdus bovienii
  Coding DNA location: Contig name=SeqID_16898; Position on contig =11107..11505bp; Strand=+
atgcccgcaaacgattatcgcgagatcttggattctgatttatcagatagaaattcctcggaaagtcaggtgatttctcgttgttctgaaccgcttccatcccctgatgtgttgaagaactacgagtcaatcctgtctggttgtgcagaaagaatattgtctttcagagaaaaagagcagcgtttccggcatgataatcagaaaaaggcacttgatagcatgatcacaaaggataaaagggggcagtggatgggattttccattgcgatgtttatcttaaccatagcgactgtctttgcgttcaagggcgaaatgttgtttgcaggaacgctaattaccattgatctggttgggctggcagccgtgtttgccatagggcgtaaatcaaacatcaaatga

SEQ ID NO: 4827 - DNA, 555 bp, Xenorhabdus bovienii
  Coding DNA location: Contig name=SeqID_16898; Position on contig =11704..12258bp; Strand=+
atgagaatttatatggacatgagaactttatgtgaacgttatcaatcaggaaaaaagattaaatatctttttttctgggggcataaaaataatcatactgattacataacaaaatcctgcctaagccagtggtatccagcaccatttatcgttaataacgtaagttattccagtactgaacattatatgatggcagaaaaggcgcgtttatttaatgattctgcaacactggaaaaaattatcaatgctaaaaacccaggtgcagcgaaagcgtatgggcgcgaggttcgtgggtttaaccaatcgatttgggatgaacatcgattggcgatcgtgattgacggtaatctggcaaaattttctcaagataatgctttggcagagtttttattgaatacgggagataaaatactggtcgaagcgagtcctgttgatcgtatttggggtatcgggctggcagaagattttgccaatattgagaatccgttgacgtggaatggtttgaatttattaggatttgccttgatggctgtacgtgaagaattaaaaatataa

SEQ ID NO: 4828 - DNA, 603 bp, Xenorhabdus bovienii
  Coding DNA location: Contig name=SeqID_16898; Position on contig =12369..12971bp; Strand=+
atgacacaacgaacgataagtagtagcgacctattttctggcaaaaagattattattgtgcatggatatagtgcctcaccttcatcacattggttcccttggttaaaagaagtgcttactgagcaaggtgcggaggttatggtgcctgcaatgcctgagtcattggcaccgatacctgaaatgtgggccaagatgttgattgatgtaataccaaaggcagatgatgatacaatttttattggtcatagcctcggttgtgtcacgttattgcggcatttagaggcgataagttctacggctgaccgaattggagggtatattttagtttctgggtttgattctccgctggagaatttgccaaaattaaacatttttacagccgaaccattgagctatacattcttgcgtgaagtgacggaacatcgtatttcaatcatttcttccaacgattatattgtttctccgcaatcttctcacgctctggctaattcattgcaaaccaaaatcattaatgtcgataatgctgggcattttcttgatagagagggctttacccgtctgttacctgtctatgatgctctaaaaaccatcgtttcaggatga

SEQ ID NO: 4829 - DNA, 783 bp, Xenorhabdus bovienii
  Coding DNA location: Contig name=SeqID_16898; Position on contig =13372..14154bp; Strand=+
atggcacctgtcgatttaacttctactgctaatcaaagtcatgatgatttaattaacgtgaattttgaccataaagtagggaaatattctgctaaggatttcaaatctgactggggtatttcaccttcagcttcgtcaggtcttaatcaaggccgtttaaatattgttgttgatcctcaacatgatcgaaataaagtactagagataacttatcttgctaatatcgtcagttccaaagcgggaacatcctttgatgtgcctctgaaaggtgctcatcaggcgttatggctacaatataaggtgatgttcagtaaagactttatgtgggtcaaaggtggtaagttgccggggctggcaggtggtgatcgcccgtcagggtgcatagataatggagattttgatggattcagtagtcgtttaatgtggcgagagcgaggggaattgaagggatatctctattatcctgagaaagaatcacgatgcggtgattattttaaatttgatatcacgttaaataaaggagtctggtataccttaacccaatacgtaaaactgaatagcatcggcaaacatgatggtatttatatacaatatgttaatgataaagaagtatttaaattgaaggatgtaaaatggcgtaatgaagggaatgtttttatagatgctataaaatggagttcattttttggtggttcaacgttagactgggctcctccggtagagcaatatgcttattttgacaattttattgtcagtatagaaaaaccgaatagtattaaatag

SEQ ID NO: 4830 - DNA, 174 bp, Xenorhabdus bovienii
  Coding DNA location: Contig name=SeqID_16898; Position on contig =14362..14535bp; Strand=+
atgttatctactcatgaatatgcaaacgatcttattttgtttgctttgattgttgactgtggatcgttcagtaaagcggcagaaagcgcaggtatcactagttcagtcatcagtaagcgtattgggcgtctggaaatcccttggcgcacgtcttttgtatcgtactacacgtag

SEQ ID NO: 4831 - DNA, 624 bp, Xenorhabdus bovienii
  Coding DNA location: Contig name=SeqID_16898; Position on contig =14657..15280bp; Strand=+
atgtcagtacccacagtttcaggcgaattgctgctgagtgaaaaagttgctgagttttgtagtttgcatcctaaattgaaagttgagatacggttagaaaatcatttcgctgatttggtcaatgaaagaatcgatctggcaattcgtactggcacgatgccggattccagtttaattgccaggcctatcttgaattcgcgctgggtgattgtatgttctcccggctatctggaaatgtatccgcaactcaaatccgcggaagatcttctcaatcataactgtctcacttatacccatcaggaaagcggtacggccaactggttgatgaaacagcctgatagccgggatatctacgaattacaggtaaatggaaatttttcctcaaataatgcattggcaatccgcaaagctgtattgggtgggttcggtattgcaatggttccgcgtgtcatggtgtatgaagatttgcagacaggaaaattggtggaaatacttaagggatatagtggaaaagttttgggtgtttatgctgtttatccttatacccgaaatttacctttgaaaatccgaatgttgattgagcatattatgatctcttacaaaaatatcagtcattatttttga

SEQ ID NO: 4832 - DNA, 1614 bp, Xenorhabdus bovienii
  Coding DNA location: Contig name=SeqID_16898; Position on contig =15565..17178bp; Strand=+
ttgccttataaaaatagtcactatgaggattttatgcccttatttttcagcattgctccgattgtcctgctgatttggatgatgaccaagcgtaacggtattccatcctatatggctctgccattgactgcggttatagtttatttcacacaactattttggtttgaatcttcgtcattattgttacatgcaaacatcattacggctttggtttccgttcttactcctattaccattatcttaggcgcaatattacttaataaactgatgcaaatcagcggagccgaagatgttgtacgcaactggctggaaaatatcagtcccaaccccgtcgctcagttgatgattattggttgggcttttgcttttatgattgaaggagccagtggttttggtacaccagcggcgattgccgctccaatattggttggtttgggattcaatcccttgcgtgttgctttgctgactttggtgatgaattctgtacccgtttctttcggcgcggtggggactcccacatggttcggtttcgccaaccttggcttacctgatggcaatttattagaaattgggcgcttaagtgcgttgattcactttgtcgctggctttgtcattccgttactggcactgcggtttattgtgtcgtggcaggaaattcgtggaaacatcctatttatcttcttaagtattttgagctgtaccacgccttatttgttattagctcaggtcaattatgagtttcctgcattgataggcggtgcgattggactggctctgtcagtattatttgctcgcttgggtatcggaataaaacgttacgagaaaaaaggtactgttcgggttgtgcctttcagcaagattatcaaggcgatgatgccaaccttgttattaattgtgatcctgataattacccgtattcaccaattagggatcaaggagctattgaacaatgccgatatccagtggcaattgaatttgggatggttaggtgaacttaatgtcagtaaatctctgattattaacttacaacaagtgttgggtacgtcagcttctgccagctacaaaatattatatgcaccggcaattatcccgttcctgttggttgtgctgttgtgcatcccactttttcagctgaaccgctatcaggtaaaacagatgttctgtgaaacaggatcacggattttcaagccattcattgcgctgtttggtgcattagtgatggtcaacatcatgatgttgggcggagaaaatgcaccagtgattatcattggtaaggcattggccgtaatgacgggggaaagttggctcctgttctcttcgttccttggggcgctcggctcattcttttcgggatccaataccgtttctaacctgacattcggcggaattcagtattccatcgccctgaacggcggaatgaatgccaatttgatgctggcgctccaatctgttggtggtgctatgggcaatatgatttgtctgaacaatattattgctgtctgctctattttgggtatcgccaatgcagagggacaaatcatgaaaaaaaccattttacccatgctggtttatggggccatcgcggctgttatggccctgattctgacattctaa

SEQ ID NO: 4833 - DNA, 1143 bp, Xenorhabdus bovienii
  Coding DNA location: Contig name=SeqID_16898; Position on contig =17217..18359bp; Strand=+
atgattatttccgcttcaactgattatcgggcagcagcacaggccaaattaccgccttttctgtttcactatatcgatggcggagcttatgcagagcatacccttaaacgtaataccgaagatttatctagcattgagttgcgccagcgtgtattgaaaaatatgtctgaactgaacctggaaacccgtttatttggggaaaaaatggcaatgcccgtggcgttggctcctgtgggtttgtccggtatgtatgcacgtcgtggtgaagtgcaggcagcacgggctgcggccaaaaagggaattccgtttactttatctactgtatcggtatgcccgattgaagaagtagcttcagctattgaccgtccaatatggtttcagctttatgtactgaaagatcgtggttttatgcgcaatgtactggagagggcgcaggcggcgggagttaaaaatttggtgtttaccgttgatatgccgattcctggagcgcgctatcgtgatgcacattctggcatgagtggcccgaatgcttccatgagacaaatcttgcaagcgatgactcatcctcaatgggcatgggatgtggggctaatgggcaagccgcatgatctcggcaatatttccgcgtaccgtggtataccaaccaagctaaaagattacattggctggttgggaaataattttgatccgtcaatatcctggaaagacttggaatggatccgcgatttctggaaagggccaatgattctcaaaggtattcttgatccagaagatgccaaagatgctgtgcgttttggtgctgatgggattgtggtttccaaccatgggggacgccagcttgatggtgttttatcgacggcgcgtgctttgccagcgattgcagatgctgtcaagaatgacatcaccattctgactgattctggtatccgtactggattagatgtggtgagaatgctcgctttgggagcggatagtgtcttgttggggcgcgcttttgtttacgcgctggcagcagcaggggaagccggtgtttccaatctgctggatctgattgataaagagatgcgagtagcaatgacattgacaggtgcgaagtcaattgcagagatcaattcaaatttgctggtaggcaagcaaggttaa

SEQ ID NO: 4834 - DNA, 507 bp, Xenorhabdus bovienii
  Coding DNA location: Contig name=SeqID_16898; Position on contig =18416..18922bp; Strand=-
atgactcggttatatatgttttatctgggtggcaatgccggaaaatccaatatcgaagttcacgatgtccaatttgttgcagtggatcaggtcgaaaaagcctatcctgtattacgtgaggtctggtttggcgataaagataaactgcatctggatggttatatgcccatcacatgggctgacggttacgatattacgctcagtcatgatgaatatcctggagaaatgcagctctatttcgtcaacgttggaggctaccaaaaagattcactggcagaagcccatgagttcgggttctttgtagcccgcacagttgaagaagctaaacaaaaagccaaagaaagcttacttgctggttacggccaactgcataaagataacctgaaagatgttgatgactgcttgcttttggggtcagtgaatagctattacatccatttagttgaaaatcctgacggtcagcctgataaaccggaatggcaggggtatcgtcccatcggaatctaa

SEQ ID NO: 4835 - DNA, 789 bp, Xenorhabdus bovienii
  Coding DNA location: Contig name=SeqID_16898; Position on contig =18976..19764bp; Strand=-
atgccttcataccctatttatcatgtcgatgctttcacggaaaaatccttttctggcaaccctgccgctgttgttttgctggataaatggctgacagatgaagcgttgattgccattgccgcagaaattaatctttcagagacagcctttctggtaggaaatcaactacgttggtttacacctaaagtcgaagtgaatttatgtgggcatgggacgctggcaaccgctttcgtcctcatcgaacaccaatcttgccaagataacccgatcacgttcacaagcctttccggtgagcttcgtgtatctcatcaagagggtattttcacattggattttgccgctactgattgtcatgaagaaaaaacgctcgtctctattatgcaggacgctctggggcaaaatatcaacgaagtgttcgcctcacatgatcgctatatttgcgtgatggattctgctgatcaagttctcaatacccaacctgactttaataaaatcgcagctcttcccttagctgggcttaccattaccgctcccggtgagtcacctgttgattttgtttcacgttattttgctccagcaaaaggtgtcaatgaagatcccgtgacgggttcaacccactgtgttctcacgcccttctggggagaaaggctcaataaatcaatactccatgcacgtcaactctccgaacgaggaggcgatatattatgtaaaacagacggcaatcgcgtttatttgactggaaaagcaaaactcttttcccatgggcaaatattgcttgaagaccagtaa

SEQ ID NO: 4836 - DNA, 405 bp, Xenorhabdus bovienii
  Coding DNA location: Contig name=SeqID_16898; Position on contig =19959..20363bp; Strand=+
ttgttttttattttatcaatgggctgtacccaagcgttggcgctggattttagctacaaaagtgagatgcctactgataacaaaccttcagaggagtatctgaaaaaaagagcggggttagactccaaatattggaatgttgatacgctgacacaggataacgtgctggcggaaaaacgagaggaagagatgaaacagtacaacaaaaaattcgagaataaaaatggaatcggactttcttatgattgggagagtaaaaacctaaaatcctttcaacatatgcaacaaacgagtcatctctccaatcgccgctgttatcgagctactcgacagaaattagaaaaagactttggaaatagctattcttattcagatattgctgatacttgtggttcttttcactga

SEQ ID NO: 4837 - DNA, 1464 bp, Xenorhabdus bovienii
  Coding DNA location: Contig name=SeqID_16898; Position on contig =20525..21988bp; Strand=-
atgacagaaatgtgggaacgtttttcattttatggcattcgcccccttctgattttattcatgtctgcggcaatttttgaagggggaatgggtatccctcgtgagcaggcatccgccattgtcggaatttttgccggcagtatttacctgacatcactcccaggcggctggttagccgacaactggttaggtcaacgacttgcagtctggtatggctcgattattatcgcattagggcacttgtccatcgcattatcggggatctggaacaataatctgttctttatcgggctgctgctcattactattggtactggcctgttcaagacctgtgtgaccgtcatggtaggaactctgtacaaaaaagatgatccccgtcgtgatggtggtttctccctgttttatatgggcatcaatctgggttccttgatcgctgcattaattacaggttggctggtgaaggattacggctggcactggggctttggtgttggtggattaggtatgttagtcgccctgctgattttccgcttttacactatcccactaatgcgccgttatgataaagaagcgggtctggattccagttgggatcatccaatggtaaaacgcaaaaacgttggtaaatggatcggcgcactcttagtcgttatctgttcgattgttgcaacagtagctatgggcgttattccctttaacccagtgatggttgccaatgtgctggtgtatattatctcattaagcgttatcctctattttgcctatttattcctatttgcagggttagaccgcaatgagaaaacccgcttgttcatttgttttatcctgctggtttcagccgctctattctggtcagcatttgagcaaaaaccaacttcatttaacttattcgccaaagactacactgaccgtatagtactgggttatgaaattccggccgtctggttccagtcgattaatcctctgtacattattctgctggcaccgctatttagctggctgtggcctatgctggcaaaacgtaatatgaacccaagcagtatcggtaagtttatgattgctatgctgtttgcggcgggtggttttggcatcatgatgcttgcatcacagtacgtactggcaactggggggacggtttcccctctatggctgatttttagtattcttttgctgacactgggtgaactttgcctcagtccaatcggactggcaaccatgaccgtactggcaccttcccgcatgcgtggacaggtaatgggattatggttctgtgccagcgcactgggaaatctggctgctggcctgattggtggtaacgtgcgcgcagataaacttgatagcctgccagaattgttttccaatgtttcactatcgttgattatctgttctgctgttctgcttgttttaatcatcccgattcgccgtttaatgagcaatcttcaccaagcggaaacgaaatcttaa

SEQ ID NO: 4838 - DNA, 942 bp, Xenorhabdus bovienii
  Coding DNA location: Contig name=SeqID_16898; Position on contig =22841..23782bp; Strand=-
atgatacaagcaccatcttttcaacgttcatttttacacccccgttattggctgacttggctaggtatcgggatactttatttactggttttactcccttatccggtgatttactggataggaacccggcttggccggctttcacagcgctttttgaaaaaacgagccaaaatcgctgaacgcaatttagctctctgtttccctgatatgtcaccagaaaaacggaatgaattactagtcagaaattttgagtctgttggtatggggttgtttgaaactggcatagcatggttttggcctgactggagaatcaagcgttggttcaaaatcacaggagaagaaaatctccaaaaagtgctgtccagtaatcagggattcattgttattgggatccattttctaacactggaattgggtgcacgtatcctgggtctgctaaatccggggatcggtgtttatcgcccaaatgacaatcccgtcatggattggctgcaaacttggggacgactgcgttccaataaatatatgctggacagaaaagatgtgaagggcatgatccgttgtctgaaaaatggtgaaatggtttggtatgcgccagaccatgattatggcccacgtaaaagcgtattcgccccattattcgcagttgaacacgccgcaacaacgacgggtacttcgattcttgtccgtttgtccgacccagccctgctcccttttactccccgtagattgccggatggaaaaggttatgagctgatgatccagccagcggtggaaggttttccaaaaaacgatgaagtcgaagcggcagcatttatgaacaaggtggttgaacgggagattatgcaggcaccagaccagtacatgtggctacaccgtcgttttaaaacacgtcccgaaggcatgccatccctgtacgatgacaacaataacattcactaa

SEQ ID NO: 4839 - DNA, 1059 bp, Xenorhabdus bovienii
  Coding DNA location: Contig name=SeqID_16898; Position on contig =24180..25238bp; Strand=+
atgtcagtgttacataaccgtatttctaataaagagctgaaagagcgcatgttagctgaaactgagccgcgcacgactatctctttttataaatattttacgatttccgaactacaggcttttcgcgatagcctgtatcaaaaatttaccgagttgtctgtttttgggcggatttacattgctaaagaaggcatcaatgcgcaaatcagcgtgccttctaaaaatgttgatgctttgaaagcgttattggatgcgactgatccggctttatgtcatttgcggctgaatattgcgctggaagatgatggcaagtcattttgggtattgcgcatgaaattgcgtgagcgtattgttgctgatggtatcgaagatgaaacctttaatccatcaagcacaggcgaatacttaaaagcggaacaggttaaccaaatgctggatgatcctgataccttattcgtcgatatgcgtaaccactacgaatatgaagtggggcatttcgaaaacgctatcgaaattccttcagatacatttcgtgagcaattgccaatggcagtagaaatgttgaaggataataaagacaaaaatatcgttatgtattgtactggtggaattcgttgtgaaaaagctagtgcttacatgctgcataatggttttgacaaagtctaccacgtagaaggtggcgttattgagtatgcccgtaaagcgaaagaacaggggttacctgtccgttttatgggtaaaaactttgtttttgatgagcgtatgggtgagcgcatttctgaagatatcattgcgcactgtcatcagtgcggtaccgcctgtgatagccatatcaattgtaaaaatgatggttgtcacctgttgttcatccagtgtctctcctgcgcagagcggtttgaaggatgttgcagtgatatttgtcgggaagagatgaaactgcctgaagaagaacagcgttttcgtcgggcgggaagagaaaatggggcaaaaatttttaataagtctcgctatcgtttaaatgatggtctgaatattacatcacgggaatccattaagtga

SEQ ID NO: 4840 - DNA, 594 bp, Xenorhabdus bovienii
  Coding DNA location: Contig name=SeqID_16898; Position on contig =25331..25924bp; Strand=-
atgaaattgttagtcattgataagtgccattatacacgtttaggaattattgaatctctgaaagaaaatatagatattttctcaatcggggctgtatcaattcatgacgccatgaatattttgcctgtattttctccagatgtcattttagtgaacttgacgaattatggccaccacagagaatattgtgaacaactgaaattatttatttcgttagttaatgatgcccgtatttatacctacatcgacaaaccatatcccttgtgcgatacgagcatacaattgacaaataaggattttattttacccaaaaggaatctcagcacattattggttcggataaaagaaatggcagaacacgatattcaacgttattttgccaattttaatacacaaagttctattttcagccttcaggaaaatcgaattatccattattggatgcgagagaccgatacacataaaattgctaaaatgctaaaaatcagcaatagtacggtttattcacacaaaagacatattatagaaaaaatcggcatttctaacaaaatagagttactttttatttacaatatttttaaatatatctgctaa

SEQ ID NO: 4841 - DNA, 255 bp, Xenorhabdus bovienii
  Coding DNA location: Contig name=SeqID_16898; Position on contig =26140..26394bp; Strand=-
atggaacaaaaaaatgaaattattcaaactcatcctgttgtaggttgggacatcagcactgtcgacgcctatgacgcaatgatgatacgtcttcattacttatcctcccaagatcaaaccccaggcaatgtcaatattgacaaaacattgtggttgacaacaggagtagccaagcaactcatcctcattttgcaggctgggattgaaaagatagaagcatctgaatacagtcagcttgatcatattaaacattaa

SEQ ID NO: 4842 - DNA, 651 bp, Xenorhabdus bovienii
  Coding DNA location: Contig name=SeqID_16898; Position on contig =26630..27280bp; Strand=-
gtgcctctgctgattcatggtgaagtcactgcatcccatattgatatttttgatcgggaagctcggtttatagagcaggtgatggaaccattgcgtaagcagtttcctgaattgaaagttgtttttgagcatattacaaccaaggaagccgccgaatacattctttcaggcaatgataaattagcggcaacactgacaccacaacacttaatgtttaatcgtaatcacatgttggttggcggtattcgtcctcacctctactgtttaccggtattaaagcgcaatatccatcaagaagcattgcgttccgcggtagccagtggctgtaatcgattctttctgggaacagattcagcccctcatttacagcatcgcaaagaatcttcctgcggttgtgcgggcgtcttcaatgcgcctactgctcttgcagcctatgccaccgtttttgaagaaatggaggcaatagctcactttgaagcattctgctctttgaatggccctaagttttatggtctgcccgttaatgaaggcttcgttgaactcacacgtaaacctacgccagtcacagagtatatcgaatgcggtgatgagaaattaatcccatttctggccgacgaggatgccagatgggaagtaaaggtatgtgaataa

SEQ ID NO: 4843 - DNA, 501 bp, Xenorhabdus bovienii
  unsure (1)..(501): unsure at all n locations
  Coding DNA location: Contig name=SeqID_16899; Position on contig =33..533bp; Strand=-
atgaccactgaatcatatacaattaaaatccgccgccctgacgactggcatgtccatttccgcgatgatgatatgctaaaaatcattgttcctcataccagccgtttctttggccgagctattgtcatgcccaacctagcccctccagtgacagatgttgccagtgccaaagcctatagggatcggataattgccgccattccgtcagaccatcatttccaacccctcatgacctgctacttgactgactcaacagacagttcacaaattgaaattggttataaagaagggatctttactgcctgtaaactttatccggccaatgcaacaaccaattccagccacggtgtttctgataccaaaaagatctatcccttattggaaaccatggaagaattgngagtgcctctgctgattcatggtgaagtcactgcatcccatattgatatttttgatncgggaagctcggtttatagagcaggtgatggaaccattgcgtaa

SEQ ID NO: 4844 - DNA, 309 bp, Xenorhabdus bovienii
  Coding DNA location: Contig name=SeqID_16900; Position on contig =32..340bp; Strand=+
atggttggtgttgcttataacgcggatattgatgaagtgaaaagagtgctgggtgatgtggttaaagcggacaaacgcattcaacatgaaaaaggtatcaccattcgtctgcacgaaatggcaccttcatcactgaactttattgtgcgtgtatggacaagcaatgatgatgcctggagtgtttactgggatctgatggaaggtttcaaacgtactctggatcagcacaatatcagcattccattcccacaaatggatgtctatctgcatcagcagcaagctgccgtacagaagaagatagacgaataa

SEQ ID NO: 4845 - DNA, 624 bp, Xenorhabdus bovienii
  Coding DNA location: Contig name=SeqID_16900; Position on contig =557..1180bp; Strand=+
atgctttcgacatttatacagggcttttttcttggtgctgccatgatcctcccgcttggaccacaaaatgtttttgtgatgcagcagggaagtagaaaacagtttcatttaatgagcgcaacgttatgtgccaccagcgacattgttctcatcacggcgggggtatttggaggaagtgctttgcttgggcaatcggcgttcctgctgcaagcggtgacatggggcggagtggcatttttgctatggtatggatggagtgcttttcgagtggcgttatcagcgaatatcgaactctcccgttctgagaatattgtccagaaccgctggcgagtcatcgtgacattatttgctgtaacgtggctgaatccgcatgtttatctggatacctttgtggtattaggtagcgtgggaggaggactgtcatcggaacttagaccgtggtttaccgttggggctgctacggcatccataagctggttttttgcattgtcaattctggctgcctggttttcacccgtactcaatcagcctcgatcacaaagaatcattaacctctttgttggttgtgtgatgtggtatatcgcatggagtttgctcaaacagggattacagattttttattga

SEQ ID NO: 4846 - DNA, 216 bp, Xenorhabdus bovienii
  Coding DNA location: Contig name=SeqID_16900; Position on contig =1194..1409bp; Strand=-
atgatcgcattaccagaagtagatatatgtggggcggggggtaattcagcagcagaagcagccatacaggacaaacttcctactgccatcattgcagcgaatatcagtgatttatgtttcacaaaacctccttcggatacaacaagtaaacaggcactttttacagtttacagtaagacaaagcgctttccagaaacattagcacactatctataa

SEQ ID NO: 4847 - DNA, 708 bp, Xenorhabdus bovienii
  Coding DNA location: Contig name=SeqID_16900; Position on contig =1318..2025bp; Strand=+
atgatggcagtaggaagtttgtcctgtatggctgcttctgctgctgaattaccccccgccccacatatatctacttctggtaatgcgatcatcaaagcagcgccggatatagcgactttgatgatccatgtgaaagtgactcaaaaaagtgcagcagacgcaaagcagaaagtggatgaacgcgtcgcaaaatattttgatttcttgaaaaccaatggtattgacaagaaagagattaatgcggccaatttacgcactcagccagaatatcaatacgaacaaaagacgggtaaatcaactattacgggttatagtgcatcacgttcagttgaagtcaaagttcgtcagttggatcaactgagtacattattggatggtgcattgaaagcaggattgaatgagatcagttcagtgcagttcagtgtcgataatccacagcgttatcgtgatgaagctagacagaaagccattgaaaatgcgattcagcaggcgactgcactggcaaaaggcttcaacagcaagttaggccctgtgtatagcgtcacttatcgttcccctgaagccgtgccttttccaatgagccgcctgaaatacaggtcagcgcttatggccgcagctcctgctgaggattcagccagtgaaacttatgaaccacaaagcatcgaattctctgatcaggttgaagcggtttttgaattgcaacgctaa

SEQ ID NO: 4848 - DNA, 906 bp, Xenorhabdus bovienii
  Coding DNA location: Contig name=SeqID_16900; Position on contig =2022..2927bp; Strand=-
atgaaacgtcctgattaccgatccctacaagcgttggatacagtgatccgagagcgcggtttcgagcgtgcggcgcaaaaactctgtattacccagtcagcggtatcccaacgtatcaagcaattagagaatatgtttgggcagcccttattagtacgcaccgttccccctcaccctacagaacaaggacaaaaactgctcgcactattacatcaggtagaattgctggaagcacaatggctcggcgatgaaaatggtaacgatatcccgttactgctctcacttgcagtcaatgccgacagtttggcaacgtggctcttgccagcgctccatcctgttttatccgatgtccctatccgactcaatattcaggtggaagatgagacccgtactcaagaaagtttgcggcgcggagaagtcgtcggagctatcagtattcaatcacagccactgccaagctgcctggtggataaattaggcgccctcgattatctgtttgtggcatcgcctaaattcgctgaacgattctttccgaatggcgtcactcgttcagctttactaaaagcccctgcggttgcattcgaccatttggatgatatgcatcaggcatttttacagcagcattttgatttatcaccgggcagtgttccctgccatattgtgaattcctctgaagcattcgttcaattagcaaaacaaggctcgacatgctgcatgatcccacacctgcaagtcgacaaagagctgcaagccggcgaattaattgatttaactccagggctatgtcagcgccgtatgctttattggcaccgttttgctccagaaagtggcgcgatgagaaaagtcactgacaccctactgaaactagggcgccagatgttacgtcaggaagatgaaattagttag

SEQ ID NO: 4849 - DNA, 159 bp, Xenorhabdus bovienii
  Coding DNA location: Contig name=SeqID_16900; Position on contig =2976..3134bp; Strand=-
gtgctgcccaacctactgcttttttcagttcgtcctgtgtcatatcaatcacagcctataatcagttacaaggaaaaatccggccaccagtataaacaatattttgcctcacccggcgaaaaaatatggcatagtgctgtgcagcacaaaaaaatatag

SEQ ID NO: 4850 - DNA, 660 bp, Xenorhabdus bovienii
  Coding DNA location: Contig name=SeqID_16900; Position on contig =3092..3751bp; Strand=+
atgacacaggacgaactgaaaaaagcagtaggttgggcagcactggaatacgtcaaacccggcacaatcgtaggtgttggtacaggttcaacggcatcgcatttcattgatgcattagggacaatcaaaaatcaaatcgaaggcgcagtgtccagctcggaagcatcgactgaaaaattaaaaagtctgggcattcccatttttgactgtaatgaagttgatagcttggatatttatgttgatggtgctgacgaaatcaatggccatatgcatatgatcaagggaggcggcgcagcattgacgcgagaaaaaattattgccgctgttgcaaagaaatttatctgtgtcattgatgaatcaaaacaagtcgatgtgctgggtaaattcccgctgccggttgaggttatcccaatggcgcgctcttacgttgctcgtgaactggtgaaattaggtggaaccccagtttatcgccagaatgtggtcacggataatggcaatgtcattctggatgttcataatcttgccattcttgatcccgttgcgttggaaaataaaataaatggtatcgttggcgtggtgacggtcggcctatttgcccgtcgtggtgctgacgtggtgctggtcgggacagcggatggcgttaaaacgatcgcagaataa

SEQ ID NO: 4851 - DNA, 1242 bp, Xenorhabdus bovienii
  Coding DNA location: Contig name=SeqID_16900; Position on contig =4027..5268bp; Strand=+
atggtcaaggtatctttagaaaaggataagattaaatttttgctactggaaggcgttcatcagaacacagttgataacctgcgggctgcgggatacagcaatattgaatatcacaaaggggcgttggaacctgaagaattgaaagaagcgattcgtgatgctcgctttgtgggtatccgttctcgtactcaattgactgaagaaattttcgaagcggccgaaaaactggttgctgtgggatgtttctgtatcggcaccaatcaggttgacctgaaagcggctgaaaaacgtggtattcccgtatttaacgcaccattctccaatacacgttccgtggctgagatggtgttgggtgagttactgttgctattacgtcgtattcctattgcaaatgcgaaagcacacagaggaatatgggataaacaggccaaaggctgttatgaagcacgaggtaagaagctcggcattattggttacggtcatatcggtacacagcttggcattctggctgaaaatatcggcatgcatgttcatttctatgatattgaaaataaactgccgttgggaaatgcacagcaagtacatcatctgtctgaattgttgaatatgagcgatgttgtcagcctgcatgtacctgaaacaggctcaacaaaaaacatgatcggcgtggaagagctggagctgatgaagccgggtgcaatcctgattaatgcctcacgtggcatggtagtggatattcctgcactccatgacgcgctggagagcgagcacctttccggtgcggcacttgatgtgtttccgagtgaaccagcaacgaacaatgagcctttcatttcgcctctgagcaaatttgataatgtattgctgactccgcatattggcggatcaacacaagaagcccaagagaatattggttacgaagtcgcgggtaaactggtcaaatattctgacaatggttctacgctgtcagcggtcaacttccctgaagtttcactgcctgttcatgccaaagatactcaccgactactgcatatccatgagaaccgtcctggcattttgactagcatcaaccaagttttcaccgatcaggaaatcaatattgaggcacaatacctgcgtaccaacggagatattggctatgtggtcattgatatcacgacgcaaaattcggctcaggctgaaatggttctgcaaaacctgaaagctctgcctggcacgatccgctctcgcctgctttactga

SEQ ID NO: 4852 - DNA, 594 bp, Xenorhabdus bovienii
  Coding DNA location: Contig name=SeqID_16900; Position on contig =5340..5933bp; Strand=-
atgcaatcagatccttttttatctctccgaaaatccataagaaaacaaattcgacagttacgtcaaaatctatccccagagcagcaatcgcaatttgcccagcaggtcgctcaaaatgccatgtctcatcccaagatccagcaggcgaacaagattgccctgtatctcgcctttgatggtgaattagacactcgaccgctgattcagcagttttggcaacaaaataaacaagtttatctacccgtattgcacccattcagtcaacatcatctgctgttcctgcattaccatcctgagacttccctccactacaatcgttttaacatagaagaaccaccattagatgttcggcaggttttgcccgtctctgagcttgatgtgatgtttattccactggtggcttttgatagcacagggcaacgtttggggatgggaggcggtttctacgacagaacgctcgccaaatggcaacagcagaatttttatccgattgggttggcgcacgatttccaattagttaattcattgccaagtgcaagctgggatattcctctgccagaaatcattacgcctgaaaaaatatggcgctggtaa

SEQ ID NO: 4853 - DNA, 186 bp, Xenorhabdus bovienii
  Coding DNA location: Contig name=SeqID_16900; Position on contig =5994..6179bp; Strand=+
atgccgcggcaggtggtaacccttgaacccttggttcaaggtgaacgtagtgtcgcccctattaggcttcttggtctagccaagcatgctcacaagaaacggagcaccacattctataggtatgaaatatcggctcaggggacttacctgctcacgcacacctcagagaaattttgtagcacttaa

SEQ ID NO: 4854 - DNA, 162 bp, Xenorhabdus bovienii
  Coding DNA location: Contig name=SeqID_16900; Position on contig =6115..6276bp; Strand=+
atgaaatatcggctcaggggacttacctgctcacgcacacctcagagaaattttgtagcacttaaaaccaatcagttaagaattcatccgtcaagaacctgtctgtcgggatccattcatcaggctttaagcaacgctatagagcctattgtatggaactaa

SEQ ID NO: 4855 - DNA, 306 bp, Xenorhabdus bovienii
  Coding DNA location: Contig name=SeqID_16900; Position on contig =6361..6666bp; Strand=-
atgtctgcacaaccagtagatattcagatttttgggcgatcattacgtgtcaattgtccaccagagcaggtagaggctttgcaagctgctgcgaaggaacttgatcagcgtttgcataacctcaaagaacgcaccagagtaacgaacactgagcaactggtttttattgtggcgctgaacgtttgtcacgagttagcacaggaaaagatgaaaacccgtgattactcctacaatatggaacaaaaaataaaaatgctccagcagactattgaacaagctttgttagaacaaggtaaaattacctga

SEQ ID NO: 4856 - DNA, 309 bp, Xenorhabdus bovienii
  Coding DNA location: Contig name=SeqID_16900; Position on contig =6563..6871bp; Strand=-
atgtatattgatcatcgttggcgatataagttcatgctatgctaccatcaaggggagtcgctataccagacagcacacaccgatataaggagggttgccttttggtattgtacggtaatgattgttgtcggccttgttttaataccaaaatctgcttttatgccagaatcaaggtatcggcacagtaataaatcaggaaggtgtcatgtctgcacaaccagtagatattcagatttttgggcgatcattacgtgtcaattgtccaccagagcaggtagaggctttgcaagctgctgcgaaggaacttga

SEQ ID NO: 4857 - DNA, 579 bp, Xenorhabdus bovienii
  Coding DNA location: Contig name=SeqID_16900; Position on contig =6870..7448bp; Strand=+
atgtctatacaaaactcattacctaattatcaatcatttgatgaaattttgcatcaacagtcagttgcgctgacagccgccgaaatgcacggtctaatcagtggcctattatgcggtggaaatcatgacagtagctggcaggcactaatgcatgatcttactaatgatggccttgcattttcacaggtgttggcacagccgatcagggaattatacgaaacgacttttgaatcacttgatgatagtgattttgtttttaatctactgcttcctgatgatgaggcgagtgtttttgactgtgctgatgcgttggcgggatgggtaaatcatttcctgttgggattaggcgtggcgaatccgaagctgacagaaaaacaggaaatacaggaagtcattactgatttacgtaacatcggtatgctgggatacgatgaagacgaagatcaggaagaattgtcccaagctctggaagaagtattggagtacgtccgtgttgcagtacaactctgctacattgccttggcgacaccgaaaacggcaaatagcgtgaaaaaaaatgaaaagccaacgctacactga

SEQ ID NO: 4858 - DNA, 1317 bp, Xenorhabdus bovienii
  Coding DNA location: Contig name=SeqID_16900; Position on contig =7493..8809bp; Strand=+
atgactaaacaagaatatttgtcccgtcgtcaggcattattgtcaaacatggcaccggccagtgcggccattatttttgcagccccgcctgcgatgcggaattcagattgtgaatatccctatcgccagcacagtgatcttctttacctgactgggttcaacgagccggaagcggttcttgttctgatcaaaagtgatgaaaaccacaaccatagcgtgttgtttaaccgtgttcgtgatctaactgcggaaatttggtttggtcgtcggcttggtcaggatgctgcactggaaaaacttggggtggatcgcgccctgccatttgatgatctcagtaaacagctttacctgctactgaatggtttggacgtagtttatcatgcccagggagagtttgaatacgctgacaatatcgtattcagcgccttggatacattgcggaaaaataaccgtcgtaacctcagcgcaccatcaatgatggcagattggcgtccgtggctgcatgaaatgcggctgttcaaatcggcagccgaactggacatcatgcgcaaggcaggcgacatcagtgcgaaggctcatacgagagccatgcagaattgtcgcccaggcatgtttgaatatcagcttgaggctgaaatccatcatgaatttactcgtcagggagcacgttatcctgcttataacaccatcgttggtgcaggagaaaacgcctgtattctgcattacacagaaaacgagcgccgcatgaaagagggcgatttggtattgatcgatgcgggttgtgaatatgaaggatatgccggcgacattacgcggacattcccggttaacggtaaattcacccgtccccagcgagaaatttatgacattgtgctgcaatctatcaatgtctctcttgaactgtacaggccgggcaccagtattcgcaaagtgacggagcatgtggtgcgcatcatggttgaagggctggtcaaattggggatcatgcatggcgaagtagaacaattgatcgagaccaatgcttatcgtcaatttttcatgcatggtttaagtcattggctgggattggatgtgcacgatgtcgggcattatggcatagatcgcgatcgcattctggaacccggcatggtgctgactgttgaaccagggctttatatcgcgccggatgctgatgtaccaccggaataccgcggtattggtatccgcattgaagacgatattgtaattacggaagtaggcaatgagaatctgaccgagcatgtcgtgaaagatccggatgaaattgaagcactgatggcacaggcgaaacagaattaa

SEQ ID NO: 4859 - DNA, 1191 bp, Xenorhabdus bovienii
  Coding DNA location: Contig name=SeqID_16900; Position on contig =8834..10024bp; Strand=+
atgaacgtgattattgtggggggaggagtggctggtgcaacactggcgctggccatttcttccttaagtcgggggcagttacaggtctctttgattgaatcgacagaaccaacacaagaacatccgggttttgatgcaagagctattgccttggcttatggcacatgccagcgcctgagccaaataggtgtctggcctgtgctgaaagattgcgttaccccaattactcacgttcatgtcagcgatcgaggtcatagcggtttcgttaacattcgagccgatgactatgctattccggcattgggtaatgtcattgaattgcacgatgccgggattcgtctgtttaatctgttaagacaggcatctaatgtcaaacttcactgtccggctaaagtgaattccgttgagcgtctggatacttcggttgtggtcaagctggacaatggcgaaaagatcacgggagagttgttggttgctgccgacggaagctattctgccgtggcgaaagcgtgcaatattccgtggcagcagcaaacttacggtcaggttgccatgattgccaatgtcctgacatctgaacatcctcagggacgggcatttgaacgctttaccgaacacggcccgctggcattgttgcccatgtctgaaggtcgcagcgctttggtatggtgccacccgctggaaaaacagacggaaatcaacgactggagcaatgaggaatttcttcaacaattgcaaaaagcctttggctggcgtttgggtaaaatgctggaaacgggtcaacggcatagttatccactggctttatccactgccagccagcagatcagtcatcgtctggcgttggtaggcaatgcgtcccaaacgttacatccgattgccgggcagggttttaacttaggaatgcgtgatgttatgacactggcacaagtcatttcagcggcggcagattcagggcaagatattggtgcttatgatgttttggctcgttaccagcagcaacgccataccgatcgtgaaacaacgattggcattacggatgggctggtcagaatattcgccaatgactatttccctttgaagatagggcgtaactttggcctgataacgatggaaacgttgtctccgttgcggaatttatttgcccgtcagacactgggttgggttgcccatcactcatcggtagaataa

SEQ ID NO: 4860 - DNA, 1233 bp, Xenorhabdus bovienii
  Coding DNA location: Contig name=SeqID_16900; Position on contig =10049..11281bp; Strand=+
atgcaatcatttgatgtggtgatcgcagggggcggtatggttggccttgcgctgtcctgtggttttcagggtagcggtttgcgcatcgcgattgtagaagagcacccaccgacaggcacgtttcatgctaacgacgaacatgcgctgcgtgtttctgccatcaatgcagccagtgagcggttattaactcatcttggtgtctggcagcacattactacgatgcgagccagtgcttatcagggtatggaagtccgggatcaggatagttttggtcgcattaaattcgatgcgacagaaaatggtctgacacatcttgggcacatcatcgaaaaccatgtgatccggcaggcactttggcagcaggcggaaagtttgcctgatgtgacgatttttacacccgcatccctcaaaaatgtcgcgtggggagaaaacgaagctttcattactttgtccgatgagcgaatgctcacttcacggctggttgttggtgctgatggtgcgaattcatggctgcgtcaacatgcggatattccactgaccttttgggattatgagcaccatgcgttggtcgccaccattcgtaccgaagaacctcatcaggctgttgcgcgtcaggtctttcatggtgatgggattctggctttcctgccgttgtctgatccccatttatgctcgattgtctggtcactgcctgctgaagctgcgcaacagagcaaagcaatcgacgctgtattatttaatcggcaattgggcgttacatttgatatgcagcttggtcagtgtgaattagtcagtgagcgccaggccattccattgatggggcgctatgcccgtaactttgcagcccatcggttagccctgctgggggatgctgcacatactattcatcctttggcgggacaaggcgttaatttgggatttatggatgtggcagagttgattggagaactgagccgcctgcaccgccaggggaaagatatcggtcagtatctctatctggggcgtttcgaacgccgccgcaagcacagtgcagcggtgatgctggcaggcatgcaagggttccgtcagctatttgatggcaataatccggctaaaaaactattgcgtgatattggattaacgttcgctgatcacttaccgggagtgaaatcgcaactgcttcgtcatgccatggggctaaatgatctccctgattggctgattcctcaaacctcttcggttgaaaaaatctaa

SEQ ID NO: 4861 - DNA, 1098 bp, Xenorhabdus bovienii
  Coding DNA location: Contig name=SeqID_16900; Position on contig =11653..12750bp; Strand=+
atgtcaaaacacaccccactatatgatcaacatctggcatacggagcgcgcatggtagattttcatggctggatgatgccccttcaatacggttcacaaatcgacgagcatcacacggtgcgtactgatgctggtatgttcgatgtttcccacatgaccattgtggatctgcatggcacaggttgccgtgattttctccgctatcttctggcaaatgacatcaccaaactgaccgaacagggcaaggcactttataccggaatgttgaatgcctccggtggtgttattgatgacctgatagtctatttcttcactgatgacttctatcgcatggttgtaaattctgcgacccgtgacaaagacttagcgtggattcaacagcatgccacgaattaccccgtcgaaattacggtgcgtgatgacttggcattgatcgcggttcaaggcccgaatgcgcagactaaaacacaatccctgctgaatgatgaacaaaaacaggccgtgacaggcatgaagccttttttcggtgttcaatctggcgatttatttatcgcaacgaccggttataccggcgaagcaggttatgaaattgcgttaccgaaagaacaagctgctgatttttggcagcagttgttggcagtaggcgtcaaacccgccgggttgggcgcacgggatacactacgtctcgaagcgggtatgaacctttatggccaggaaatggatgagaccatttcgcctttagcggccaatatgggatggacgattgcgtggaaaccggaagatcgtcaattcattggccgtgaagcgctggaaagacagcgcgaagtaggtacagaacaactggttggtttaattatgcgcgacaagggcgtattgcgtggtggtttaactgtccacttcaccgataaagcgggtgaaatgcggtctggtgtcattaccagcggaacattctctccaactttgggattcagcatagctcttgcacgggttcctcagggaattggagaacaagcgattgttcagatccgtaaccgtgaaatgcctgttcaggtggttaaaccgggttttgtacggatgggcaaaccgctcgtagagtaa

SEQ ID NO: 4862 - DNA, 393 bp, Xenorhabdus bovienii
  Coding DNA location: Contig name=SeqID_16900; Position on contig =12802..13194bp; Strand=+
atgagtcatgtaccagcagaattaaaatatacctcatcacacgaatgggttcgtgtggaagaaaacggtgaatacactgtaggtattaccgaacacgctcaggaactcttgggtgatatggtattcgttgatttgcctgaagtcggtgcagttgtaaatagtggtagtgactgtgctgttgtagaatcagtcaaagcggcttctgatatttatgcccccttgagtggtgaagttaccgctgttaattcagagttggaaagttctcctgaattagtcaacagtgaaccttataacgaaggttggctgttccgccttaagatctctgacgagagtgaactcacccatctgcttgatgcggaaggttatcagtcacttttggcagaagaagaataa

SEQ ID NO: 4863 - DNA, 2931 bp, Xenorhabdus bovienii
  Coding DNA location: Contig name=SeqID_16900; Position on contig =13225..16155bp; Strand=+
atggggcgttttttatgtgtgccgtttttagctagtttcaggaaattatcatcaatgactcagacactaatccaacttgaaaatcaaggtgaattcactcgtcgccacattggttcttctgctgaacagcaaaaagagatgctggcgacagttggtgcaaattctcttgacgatctgacgaataaaatcgttcctcgtgatatcgcattgtcagaaccgcctgctgtaggcgaaggcgcgacagaacaacaggcactggctgaactgaaagtgatggccagccagaacaggcgttatcaatcttatatcggcatgggatacgcgccatcggtactccctccggttattctgcgtaatttgctggagaacccaggctggtacacggcatataccccgtatcagccagaagtttcccaaggccgtcttgaagccttactgaacttccagcaagtcactattgatctaaccggattggatcttgcttctgcctcattactggatgaagctacggcagcggctgaagctatggcgatggcaaaacgggttagtaagttgaaaggcgcagagcgtttctttgtggcggatgatattcatccacagacgctggacgttgttcgtacccgtgcggaaacatttggatttgaagtcattgttgatgaagccgaaaaagtactggaactggaaggcgtcttcggtgtcctgctacaacaggttggtacaacgggcgaagttcatgattacagtgttctgattgcaaaactgaaagagaaaaagatcattgtcagtgtcgcggcggatttcatggcactggtcatgttgactgcgccgggtaaacaaggtgctgacatggtatttggtgcggcacagcgttttggtgtcccgatgggatacggcggcccacatgctgcattctttgtctgccgtgatgaattcaagcgttccatgccgggtcgcattattggcgtttcccgtgacgcggcgggtaaccgcgctctgcggatggccatgcaaacccgtgaacagcatatccgtcgcgaaaaagcgaactccaatatctgtacctcgcaagttctgctggctaatattgctggcatgtacgcggtttaccacggtgctgaaggcttgaagagaatcgctggccgtattcaccgattgaccgacattctggccgctggcctgcaaaaagcgggcataacactgcgtcataaaacatggtttgatacgctgaccgttgaagttgcagataaaacaccggtgctggcacgggcggagaaggctcaaattaacctgcgtactgatattcttggtgcggttggtgtggcattgagtgagaaaaccagccgcgacgatttgcagacgctgttccaagtcctgactggctctgatgctatgctggatatcgatacgcttgatagtgaaatgtcggcaggcagtcaatctattccggcttcaatgctgcgcaatgatgacatcctgacgcatgacaacttccgccgttatcacagcgaaaccgacatgatgcgctacatgcacagcctggagcgtaaagatctggcattgaatcaggcgatgatcccgctagggtcgtgtaccatgaaactgaatgcggcggctgaaatcatgccgatcacatggcctgaattcactgacatgcatcctttctgtccaccagaacaggcacagggttatcaccaactgatcagccaactctcccattggctagtattgctgactggctacgacgcagtttgtatgcagccaaactccggtgctcagggagaatatgctggtttactcgccattcgtcgctattacgccagtcgtggagaacagcatcgccatatctgcttgattccaagctctgctcacggcacaaaccctgcttccgcgcatatggcgggtatgacagtggtggtggtgaattgtgacaaagaaggtaatattgatctgacagatttacgcgaaaaagcggaaaaacatcgtgatgaactggcctgcatcatggtgacctacccatcgactcacggtgtgtatgaagaaaccatccgtcagatttgcgacatcattcaccagaatggtggtcaggtttaccttgatggtgccaacatgaacgcccaagtcggtattaccacgccgggctttattggtgctgacgtttcccacctgaacctgcataaaaccttttgtatcccacacggtggcggtggcccgggcatggggccgattggtgtgaaaaaacacctcgcgccatttgttccggggcattctgtggtggaaatggacacagtaaccacattgggcgcagtatcagccgcaccatttggcagtgcttccattttgcccattagctggatgtatatccgcatgatgggagcaaaaggactgaaacaagccagccaagttgcgatcctgaatgcgaactacatcgcagctcgcctgaaaggagcttacgaaatcctctataccgggcgtgatggctacgttgcccacgaatgtattctggatattcgcccactgaaagacgaatttggcatcagtgaaatggatatcgccaagcgtttggttgactacggtttccatgcaccaactatgtcattccccgtagcgggaaccttgatggttgagccgacggaatccgaaagcaaagtcgaaatcgatcgctttattgacgcaatgctggcaattcgcgaagaaatcagcaaagtggcaaaaggggagtggccgctggaagacaacccactggtaaatgcgccacatgttcagacagagctggtttctgactgggaacacgcatacagccgtgaaatcgctgtcttcccaacagcagaaaccaaagccaataaatactggccaacggttaaacgtctcgacgatgtatatggtgaccgcaatttacattgctcctgtgcaccgattgaagattatcgttaa

SEQ ID NO: 4864 - DNA, 1560 bp, Xenorhabdus bovienii
  Coding DNA location: Contig name=SeqID_16900; Position on contig =16658..18217bp; Strand=+
atgttggcacatcttttcaatacttcagttataacgggagaagttaaggttatgtcattaaatagagtcgtgagtactcataaacgagcagaatttcgtacttggtttggattattgatcttaatgttaccggttttattggtcacggtggacaatactattttgggatttgccttgccaaaaattgccagggctttggaaccgagtgcaaatcagcaattatggatcattgatgcttattcattggtactggcaggattgttggtgtctatgggaaatatcggtgatcgtgttggtcaccgtctgctattgctatccggatcattgggattcaccattgtttcagttatgacggcattatcttcctcgccagaacaattaattgccgggcgtgcagctcttggtttttttggtgcaatgttgatgccttcgacactggctttgatcagccatctttttacagatcgtgaacagcgccgattagctattgctatttgggcgactactctcactgttggatcggcacttggccctgttataggcggtgttttattgcagtattttaactggcaagccatttttctattagccgtgcctgtattggtgcctttgttggtttttgcacctattttgttgcctgaatcggacaaaaagcagataggagtcattgatggttatagtgtcttgttatccattattgcaatggctggcattgtgtatgcgattaaacatgttgccagtgatgggtttgaggtcagtgttattgtggagtttgcgattggtcttatcgccggaacgttatttatacgtagacagcagagtctgcaaataccgctgatggatatttccttgttccgtaatggtgcatttactggttcgatcatagtcaatttattgagtctcgggttactgattggctttgtcttttttgccactcagtatctgcaaattgtgcttaatatgaaaccgcttgccgccagtcttgcactggttcccggacaaattatggcaattgttttcggcatggtgatcgtgccgattgcccagagagtgccttcccactggcttgtacctcttttattggctttggcgggaaccgcatttttattgattgcctgtgttggcagtaacctgacttcaatcgtgattgctttcgcattattgagtattggcgtcggtgcgatagcttctgtttccaatgatctggtgctttcagccgtaccttcttccaaggcaggtgccgcctcagcaatcagcgaaacggcctatgaagttggtgttgtattcggtacaaccattctgggtggattggtaacggcgttttatcgtttaaatttgcaattgccgaaaagtatttctcaggaacaagccggtttggctttggaaacgttagctggggcgtatgtgatagcggcttcattaattgaaacggaaggcaggcaattgatggatgccgcagcgcattccttcaccagcgccattcatattactagctggctgacagtggtattggcaggatgtgtagtcttgatggcatcatatcttctgagaaaactgtag

SEQ ID NO: 4865 - DNA, 174 bp, Xenorhabdus bovienii
  Coding DNA location: Contig name=SeqID_16900; Position on contig =18258..18431bp; Strand=+
atgtttaaggctgacagagtaaatgattccctgcatctgacagcctgcttattcaaggagaaggcgtacctgacgtcatttcttacagttacgctttcaaccaacctttctctttcgcggcttccaattgtggtagcagatattgccacagctcagggtaagcctcagaaataa

SEQ ID NO: 4866 - DNA, 609 bp, Xenorhabdus bovienii
  Coding DNA location: Contig name=SeqID_16900; Position on contig =18346..18954bp; Strand=-
atgtcattagctgtacctcctgttgatttcggcccatttactaatatcatcgcatttattatggagctggataagttaaaatcggttcatcgcaaaactaaattgctgaacaatcagcgtcatgagaattcggctgaacatagctggcatttcgccctcgctgtcatgagttttgcgccttatgtaggagaaatgaatattggccacgttgtgcagatggcgctgatccacgatattgtcgaaatcgatgcaggagatgttatcgcattcgatttagctgcccgtgaagcaatccatgaacatgaagttaaggccgcccatcgtattttcggtttactgccggaagcgcagagagattattttctggcgctgtggaatgaatacgaagattctgaaacacctgaagcaatttttgccaaaacgctcgacagagtcatgccggtactcatgaacctgcataacgatggccaaagctgggttgagaatggtatccactttgaacaggttttcaatctgcttcattttatttctgaggcttaccctgagctgtggcaatatctgctaccacaattggaagccgcgaaagagaaaggttggttgaaagcgtaa

SEQ ID NO: 4867 - DNA, 1011 bp, Xenorhabdus bovienii
  Coding DNA location: Contig name=SeqID_16900; Position on contig =18970..19980bp; Strand=-
atggctgaccaaattctattttctgctcaaatttctgcacaactcccatctccttcagcagcacttcccctgactttaatttcccttaatgattgggggatgataagcgtaacaggcgcagatgcggaaaagtatctgcaaggccaagtcacatcagatgtcgccttgctcaaccaaaaacatatgttgagcgcacattgtgatgccaaaggaaagatgtggagtaacctgcggctgtttcaccgtggtgaaggttttgcctatattgaacgtcgcacagtattggatccccagctgactgaattgaaaaagtatgctgtgttttccaaagtgacctttgctaaagatgaagaaagcatcctgcttggtgttgccggagcggaaagcaggaacgcgctggcagaaatgtttcccaccctgcccggtgccgaaacaaccgttattcaacacgaaacaactacccttcttcacttcgccttccccacagaacgtttccttttagtcaccgatcaggctaccgcagcccagttagcggaaacgttagcagagaaatttcaggcgcaattgagcgacagtcagcagtggttggcactggagattgaagcaggcttcccggtcattgactcagccagcagcgcccagttcattccacaagcgatgaatattcaggctcttgagggtagtattagcttcaagaaaggctgttataccggtcaggagatggtggctcgtgccaaataccgaggtgctaataaacgagcaatgtactggctggctggtacggcttcttctcttcccgtcgccggagacaatctggagtggcaactaggtgataaatggcgcagaacgggctcggttctgactgcggtcagactcgctgatggttcaatctgggtgcaagttgtcatgaacaatgatatggctgctgacagtattttccgtatccgtgaagatgaaggaagttctcttaccattcaaccgcttccttattcattagatgaagaaaaataa

SEQ ID NO: 4868 - DNA, 432 bp, Xenorhabdus bovienii
  Coding DNA location: Contig name=SeqID_16900; Position on contig =19908..20339bp; Strand=-
atgcccagtgaatacgcgctttattgtcaatatccatgtttaaaaagcctcttgattattttcattcgtgccattgagacggcaatgctgatgtcgcgaaagattaacaagttacctgtcatttcagaaatgatcacggttgcaaaatttcacagtcaaagggaattatcaacgattctggactgtttttcatcattcgtgacagttgaatcaagatatatcgataatatgcgaagagcatcgcaacaaatcacctttaacgtccagtcagtaaataacaagaataactcctttgcattaagccccatctcttttaccattagccttatttctcagatagtttactggcaggagctgttatggctgaccaaattctattttctgctcaaatttctgcacaactcccatctccttcagcagcacttcccctga

SEQ ID NO: 4869 - DNA, 267 bp, Xenorhabdus bovienii
  Coding DNA location: Contig name=SeqID_16900; Position on contig =20303..20569bp; Strand=+
atggatattgacaataaagcgcgtattcactgggcatgtcgtcgtggaatgcgtgaactggatatttctatcatgccgttttttgaatatgaatatgactcattgaatgatgatgataagcggcttttcgttcgtttactggagtgtgcagatcctgatctctttaactggctcatgaatcatggtcgtccagaagatgatgagctgttccgcatggtgcaattgattcagagcagaaaccaagcccgtggccctgtggcactgtga

SEQ ID NO: 4870 - DNA, 351 bp, Xenorhabdus bovienii
  Coding DNA location: Contig name=SeqID_16900; Position on contig =20625..20975bp; Strand=+
atgcttgccgcgtcattggctccgtggcctgccagtggtttttatctctggcttccactgtttgtcatcattatggtgagctgggtgtggagccaaaaaaacattagacggtgtcagggaaggctggtgctgttcagtggccagaaaatgcattggcaaaaagcggcgtggaaactcactaggccaccgtggttaagccgctatggtatggtgatcacacttcacgcctttgacaaaacagaaagtatccgccatcggtcgttaattcggttatgggtggcatcagacagtgtgccaccaaagatgtggcgtcatttgaaccagcttatgcgtcagtatcctgatatatag

SEQ ID NO: 4871 - DNA, 522 bp, Xenorhabdus bovienii
  Coding DNA location: Contig name=SeqID_16900; Position on contig =20981..21502bp; Strand=-
atgatgaaaattggtctcttttacggctccagtacatgctatacagaaatggtagcagaaaaaatacgcgatatactcggcgaagatctgatcgaactgcataatgtcaaagattgtgatccccaattgatggaaggttattctgtcctgattctcggcattcctacttgggatttcggtgaattacaggaagattggctggctatctgggatcagcttccatcattggatctggcgggaaaaatcgttgccatgtatggcatgggggatcagatcgactacagtgaatggtttctggattcgttgggaatgctgtatcaccatttgctgcctgcgggtgcgcagtttgttggtttttggccaacagaaggttatgaattcaccagccctaaaccactgaccgaagatggcaaacaatttgtcggcctggctctggatgatgtaaaccagttcgagcaaactgatgaacgtttgagcgaatggtgtatgcagatattggcagaaatggaagcgctgttttaa

SEQ ID NO: 4872 - DNA, 147 bp, Xenorhabdus bovienii
  Coding DNA location: Contig name=SeqID_16900; Position on contig =21526..21672bp; Strand=-
atggggtctgttccgatgacttatcttgcgaggaatagttttctgataaatcgtgtttttttggcacaagccctcctttatatctgcgacttccgagcggctattatgcctgaaaaaacaattcttctgttacaatgcggcccctga

SEQ ID NO: 4873 - DNA, 957 bp, Xenorhabdus bovienii
  Coding DNA location: Contig name=SeqID_16900; Position on contig =21606..22562bp; Strand=+
gtgccaaaaaaacacgatttatcagaaaactattcctcgcaagataagtcatcggaacagaccccatcggctaatctccttatagagcaatttctggataccatctggctggaaaaggatctggctgaaaatacgctatcttcttatcggctggatttacaagccctagatagttggctggtatatggtggtcatgatttactttctgtggaatctattgaactacaattatttttggctgaacgggtagatagcggttataaagccagtagttcagcccgcttgctgagtgcaatgcggcggttgtttcagtatctttatcgtgaaaaaatgcgtttggatgatccaacagcacttttatctgcccctaaattgcctaaacgcttacccaaagatttaagcgaaaaacaagttgaggatttgcttaatgctcccttgattgaccaaccgattgaactgcgagataaagccatgtttgaagtgctttatgcctgcggattgcgggtgtctgagttggttgggctgacattatcggatgtgagcttacgtcagggtgtggttagggtagtgggtaagggaaacaaggaaagattggttcctttgggagaagaagcgctttactggttggaaaaatacctagagtatgggcgtccgtggttattaaatggttcggtatctgacgttttcttccccagcaaaaggggaacgcagatgacccgccagactttctggcatcggatcaaacattatgccgtactgtctggcattgataccgaacgcttatcaccccatgttttgcgtcatgcttttgcaacgcatttactcaaccatggtgcagacttacgcgttgtgcagatgctgctgggtcacagtgatctctccacgactcaaatttatactcatgtggcgactgaacgtcttaaagcgctgcatcaacaacatcatcctcgtggataa

SEQ ID NO: 4874 - DNA, 702 bp, Xenorhabdus bovienii
  Coding DNA location: Contig name=SeqID_16900; Position on contig =22595..23296bp; Strand=+
atgaagaagctagcgttttgtttttccttattattgacggcctttgccagcaatgtatttgctaatgacagtgcggttaataactcattgtcaaaaatgggacttaaagccgaaagtatcacgccatcacaactggctggcgtgagcacggttttgacagatcagggtattattcatatctccaacgatggtaagtatttgttcaaagcccaggtttacgatattagtggcaaattaccaaagaatgtcaccaatcaggttctggtgaaaaaactggatgctctgaaaaatcaaatgattgtttacaaggcaccaaaagaaaaacatgtcgtgactgtttttactgatattacctgtggttattgccgcaagttgcatgaggaaatgaaagagtataacgatttgggtatcaccatccgttatttggcatttcctcgccatagtctgcaacatcaatcagccaaagatatgcaatccatctggtgcagtgcgacacctaataaagcgctggatgccgctttcaaaggggataacatttctccgatcaagagctgtaaaaatgatatagcgaaacaataccagttaggcttgcagtttggtgttcagggaacacctgcgattgtacttcaggatggcagcgtgtttggtggttttatgccgccaaaagatctgaaagaagctctggaacaaaatggtgaataa

SEQ ID NO: 4875 - DNA, 105 bp, Xenorhabdus bovienii
  Coding DNA location: Contig name=SeqID_16900; Position on contig =23301..23405bp; Strand=-
atggatgaatactattgggaagatgactgtcatccgccaccgggcggcggcggagttgtgtttctatattcactgggggttgcttcactgaatttgagtcattga

SEQ ID NO: 4876 - DNA, 1641 bp, Xenorhabdus bovienii
  Coding DNA location: Contig name=SeqID_16900; Position on contig =23426..25066bp; Strand=+
atgcggggtattcgtcaggctgatgaactggaacgtggggccaaagggctactcaattatcaatctctcaatggcattgaacaggctgtttccttgctgataacagcattgcacgaccattggcgtattgttattgtcggtgatttcgatacagatggggcaaccagtacagcattgtgtatccgtgctttgcgggcgatgggctatcgcaatcttgattatcttgtgccaaatcgttttgaagacggttatggcttaagtgttcaggttgttaatgaagtcgtcaaaaaaggcgctgatctgatcattactgtggacaatggcatctcttcccacgaaggggtggcagcggcacatcagcacagcatcaaagtgcttgtcaccgatcatcacttgcccggagagacactaccagccgcaggtgccattatcaaccctaacctgcatgattgtgctttcccctcgaaagcgctggctggtgtgggggtggcattttatctgatgtcggcactcagggcagaattacgtaaaacagcgtggtttgagcagcagggtattccgctgcccaatctggcggaactacttgatctggtggcactcggaaccgtggcagacgtggttcctcttgataccaataaccgtatttttgtgtatcaaggattgaaccgcattcgtgctggtcgctgttgcgtgggaattcgggcgctgcttgaaatttccaaacgggaatccaccaaactgactgccagtgatttggggttttcgcttgggccacgactgaacgcagccggacggctggatgatatgtccgttggcgtggctttattgttgacggatgatatggtgcaagctcgtcagatagcctgtgaacttgatggactgaaccaaacccgccgtgaaattgagcaggggatgaagcaggaagctttgcagatttgtgatcaattcgaacgtacccatactcagctaccttacggactagtcatttatcatccagagtggcatcagggcgtagtgggtattctggcctcgcgtattaaagaacgttttcaccgtccggttattgcctttgctccggcaggcgatggaacattaaaaggttcaggccgttcagtgaatggattgcatatgcgtgatgcgcttgagcgcctcgatactctgcatccgggcttgatattgaaatttggcggccatgctatggctgcgggcttgtcaattaagcaggataaatttgatctgtttcagcgccatttctctgcgttgatggccgattggctggatatcgcccagcttgagggagtggtctggagcgatggcgagctggccttaggggagttatcgctggaaattgcggaaattctgcgagaaggtggtccgtgggggcaggcatttgccgaaccgatatttgatggcaaattcaaactgctgcaacagcggattgttggcgaaaaacacctgaaagtcatgcttgagccattaaacggtgggccgatgttggatggcattgcgtttaatatcgatactcatcgctggccggataacagcgtcaaaacagtggaattagcctataaactggatatcaacgaatttcgcggtaatcgcgatgtccaacttttgatccagtacatctggcctgactga

SEQ ID NO: 4877 - DNA, 660 bp, Xenorhabdus bovienii
  Coding DNA location: Contig name=SeqID_16900; Position on contig =25663..26322bp; Strand=+
atgttgatgcgtatgtttttgcgctgggctgagtccaaaggtttcaaaactgaaattatcgaagagtctgatggtgacgttgctggtttgaaatctgcaaccattaaaatcatcggtgaatatgcttacggttggttgcgtacagaaactggtgtgcatcgtttggtacgtaaaagtccgtttgactcaggtggccgtcgtcatacctcattcagctctgcctttatttacccagaagtggatgatgacattgatatcgaaatcaacccggttgatttgcgtattgatgtataccgtgcttccggtgcaggtggtcagcacgtcaacaaaactgaatctgcggtgcgtatcacccacataccgactggccttgtaacccagtgccagaatgatcgttctcagcataaaaacaaagaccaggcgatgaaacagttgaaagccaaactgtatgaactggaaatgcagaagaagaatgctgataaacaggcgatggaagaaaacaaatcggatatcggttggggcagtcagatccgctcttacgttttggatgattcccgcattaaagatttgcgtactggcgttgaaactcgcaatacgcagtctgtgctggatggggatttggacaaattcattgaagctagcttaaaagccggcctatga

SEQ ID NO: 4878 - DNA, 1515 bp, Xenorhabdus bovienii
  Coding DNA location: Contig name=SeqID_16900; Position on contig =26332..27846bp; Strand=+
atgtcacaacagcagcagggagctgaacaggctcctgatttaaataatgaactgaaaactcgccgtgaaaaactggctgcactgcgcggcaacggtatcgcattcccaaatgattttcgtcgtgagaacatttctgaagatctgcatgcaaaatatgatgacaagactcaggaagaactggaagcgctaaacattgaagtgaccgtagcaggccgtatgatgactcgtcgtatcatgggcaaggcatcctttgcgaccttgcaggacatgggaggacgtattcaggtttacgtttcccgtgatgacctgccggaaggcatttataatgaacagttcaaaaaatgggatttgggtgacattttaggcgctcgcggtaaattgtttaaaaccaaaacgggtgaactttccattcactgtactgaactgcgcttgctgaccaaagcactgcgtccgctgccggataaattccacggcttggcggatcaggaaatgcgctaccgtcagcgttatctggatctgatctcgaatgacgaatcacgcaagacattccagatccgttcccgcatcatggctgcattgcgtaacttcatggtcaaaaaagacttcatggaagttgaaaccccaatgatgcaggcgatcccaggcggagcgagtgcgcgcccatttactacgcaccacaacgcgctggacatcgatatgtacctgcgcattgcaccggaactgtatctgaaacgtctggtagtgggtggttttgagcgcgttttcgaaatcaaccgtaacttccgtaacgaaggtatttctccgcgtcataacccagagttcaccatgatggaactctacatggcttatgcggattaccaggatctgatcgtactgaccgaagaactgttccgtactttgactcaggaagtgctgggtactacgttggtgaaatacggtgaacaagaattcgatttcggtaagcctttcaccaaaatgaccatgaaagaagcgatttgcaaatatcgcccagaaaccaatattgcggatctggatgacatggataaagctgtcgttatcgcgaagtctcttggtattgatattgaaaaaagctggggcttgggtcgtattcagtgcgaaatctttgaagaaaccgctgaaagccacctgattcaaccgactttcattactgaatacccagcagaagtttctccgctggcacgccgtaatgatgacaacccattcattacagaccgttttgaattcttcatcggtggccgtgaaattggtaacggcttctccgagctgaacgatgcagaagatcaggcagaacgttttgcagagcaagttcgtcataaagacgaaggtgacgacgaagcgatgttctacgatgatgactacgttactgcactggaacacggtttgccaccaacggcaggcttggggattggtatcgaccgtatggttatgttgttcacggatagccataccattcgtgacgtgatcctgttcccagcaatgcgcccgaataaataa

SEQ ID NO: 4879 - DNA, 1161 bp, Xenorhabdus bovienii
  Coding DNA location: Contig name=SeqID_16900; Position on contig =28070..29230bp; Strand=-
atgataaccgtagaaactgccatgcaagcaaccacgcttagtcacgcctttggacacctcactgatctgcgtatcaaccgcactaaacagtatgccctcatcgatattttaaccatttcgatttgtgccgtgatctgcggttgcgaaggtttcaatgcgattgaagaatacggtaaatccaaggaagattggtttcggcagtttctggatcttcccaatggcatccccagtcacgacacctttaacgatgtgataaatcggcttgatccccaagaatttggggacgcttttacccaatgggtgagcagcttagccaaaatctccgatgacattattgcgttggatggcaaaacattgcggggaacgctcgacaaagccaatggcgcaccggctctccatctggtcagcgcctggtcagtcgcgaatcaactctgctttggtcaggtgaaagtctcggacaaatcgaatgaaatcactgcgatccccaagttgttggcgctactggatattggcggttcgaccatcacgattgacgcgatgggctgccagtacaaaatcgctgaccagattgtcgagaaccaagccgattatgtgctggcgttaaaaagcaaccagggcgagtttcatgatgatatcaaactctttttagaaacccagctggcgaacgattttacgggaatatctcacgccaaaacccagtgcacggagggcgatcatggccgtattgaagagcgtcggttgtggctggttaacgatatcggttggttgcgggctcggcaccctcagtggcatacgctgggcggcattgcggttgtggagtcctggcgtgaagagcagggaaaatcagcgcgttatgaaagacgttactttatcaccagtcaccgtgataagtcggcggactttatcgcgtgcgcgatacgcagtcattggcacattgaaacgaagctgcactggcagttagacgtcagttttggtgaagacggccagcgtctgagaagtggttatgccgctgaaaacatggcattaatgaataaaatagcccttaacctactgaaaaatgagaaaaccgttaaggtgggtgtgaaaaccaagcgccagaaagctggatgggataatggttatatgctgaaggttctaacgggagggtttacgtcagtataa

SEQ ID NO: 4880 - DNA, 96 bp, Xenorhabdus bovienii
  Coding DNA location: Contig name=SeqID_16900; Position on contig =29208..29303bp; Strand=+
atggcagtttctacggttatcatggtcagtatgcgaattataaatcacaaacatcgactcatgccctatgtttatgtgccgaatgcgtccagttaa

SEQ ID NO: 4881 - DNA, 123 bp, Xenorhabdus bovienii
  Coding DNA location: Contig name=SeqID_16900; Position on contig =29313..29435bp; Strand=-
atggcttctggtttatggcgataccgcgcaagggtctggttttatcaaatatacaaagcatcagtttttaactcagctgaaaatgacgactttaacaaagcagggcaaacgggtctaaattga

SEQ ID NO: 4882 - DNA, 123 bp, Xenorhabdus bovienii
  Coding DNA location: Contig name=SeqID_16900; Position on contig =29375..29497bp; Strand=+
atgctttgtatatttgataaaaccagacccttgcgcggtatcgccataaaccagaagccattaccgttccagccttgtgccacgcgtacccagcaggacatgccatcatcggctttgtcgtaa

SEQ ID NO: 4883 - DNA, 132 bp, Xenorhabdus bovienii
  Coding DNA location: Contig name=SeqID_16900; Position on contig =29681..29812bp; Strand=-
atgcagataaaattcataccattgggaaatcatgtttttttattaaggatctatgagttaaaaataaatgataaaaatatcacagataaagagagtgagtttttatcatcttgtttaattcatttaaactga

SEQ ID NO: 4884 - DNA, 138 bp, Xenorhabdus bovienii
  Coding DNA location: Contig name=SeqID_16900; Position on contig =29780..29917bp; Strand=+
atgatttcccaatggtatgaattttatctgcattgctgttatttccatgttatcaatttttctgaaaaggcattgacattaccatgttatattatcttatcttatataacaaatcgtctgtatactcaccccgattaa

SEQ ID NO: 4885 - DNA, 273 bp, Xenorhabdus bovienii
  Coding DNA location: Contig name=SeqID_16900; Position on contig =30171..30443bp; Strand=+
atggccaaagttgacgtctattgccgttattgtcacaaatcagagcatgtcaaaggacatggaaaagggaatggcgggtatcctcgttatcgttgctatacctgctgtaaggtttttcagttggaatacacttatcaagcctgcaaacccggcgttaaagagcagattgtcgacatagcgatgaataatgggggaattcgtgacaccactcggatcctgagagtcgcaacagctactgttataaaaacgttaaaaaactcccccgaaacgtaa

SEQ ID NO: 4886 - DNA, 354 bp, Xenorhabdus bovienii
  Coding DNA location: Contig name=SeqID_16900; Position on contig =30508..30861bp; Strand=+
gtggggaacaagaaaaatcaacgcgggctttggtatgcttgggaaccccgcctaaaacgaatagtggcccatgtttttggcgatcgcagtagaaaaacgttagacaagctactggctcttttatcgtcctttaatattcggttttactgcacagatgattatgttgtttatgataaccttcccgaggaagatcacctgactggaaagatgtttactcagcgtatagagagaacgaatttaactcagcgtactcgagtaaaaagactgaatagaaaaactatcagttattcaaaatccgaagaaatgcacgataaggtgatagggacttttattgagcgtgagtactatttttga

SEQ ID NO: 4887 - DNA, 1683 bp, Xenorhabdus bovienii
  Coding DNA location: Contig name=SeqID_16900; Position on contig =31404..33086bp; Strand=+
atgaacgaaaggataataattcccattctcttaatattgtgcagtccttttcaggcagtggccttatctgaaaatattgacaatacttcatcatcatttatggatgaagatatgaaaacattgcaggaaagttcaagaaatatcagaggactacttgaaaaacgcagtcaccagagttttataaaccgtgcggagtcggttccagagaaaaaagaattacaggcatttacgggaattggacaatgtttacagattagtggtgtctaccttaaaggaataactttattatcattgaaagatctaacaacattaagtgctataccgactacctgcattactagtaataatataaataaattaacctccgaaattgaaaatatttatattaaaaaaggttatgtcaccgcacgtttgcaatttgttcctccttcccatgatcggaggttagggataaatgtgattgaaggttttattgagggtattgaagggggaacccgttggactaatagccaaacccttttccctcatttaacgaataagccattgaatctcaatcagcttgatcaaggattggatcaggcaaatcgcctacaatcaaataaaacaacaattgatatattgcccggaactaagaaaggtggttccattattaagctgcataaccagcattcttcaccgtggaaagtagttgttaaaactgataattatggacagaaaagtacgggagaatgggtcggtagattaaataccagttttgacagcccattaggactatcagatttcattagttttagtggaagcaatacgttggataaacacaacacgaaatatagtcgaagttatattctactttattcaattccctatggtgatgcaacaatcagtggattcagcggttattccgaatataccagaaatgctgatttacggatgagctcggtaaatttccacggaaattctcaacaatcaggggtacgctctgattgggtgttttatcgtgatcaaatgcagatagatacacttagtacgcaattaacttataaaaatagcaataactacatagaaggttcaaaaattgctattaacagcccgacattgagcgtgtttacattggggataagtcacctgaaaattactccaggaagattgattatccttgatgcaaatattgagaaaggaatgcggtggtttggtgcgcagacagccgctcctttccaagataagacgttcatcaaaggaagtttgtctgcgaaattacaacagcattttgcggtgtttaatttaccttttcaattcaatacccaattctatgctcagtacagtccaaatagcctaccgggtattgaatggttaaatattagcgataacagcgcattgcgtgggtttagtaaaaattctgtatccgctgataacggttggtatctgaggaacaccctttcccattcgattcccatacctaaaggttcagttacattaaatatcggtgcagatattggtcaggttcttggctataaaagcaaagttggttggcaaagtagcgctggattgagtacaggcattacattgaattaccaaaacctgttcgctgatgttgagctaagccaaggaaaaattctatcccatcaaaataagaatgctggtgagctgatacaattactgactcgtttttctttccgcttttaa

SEQ ID NO: 4888 - DNA, 4245 bp, Xenorhabdus bovienii
  Coding DNA location: Contig name=SeqID_16900; Position on contig =33167..37411bp; Strand=+
atgagaaacaaaagatttaaattatctcctacagggaaatttgctgcatccatggccattattctggtttccagttcaacgagtttagctaatggtattaccccgggaggtgattctgcacatcaaccagggacgactaattcaaagacaggagcagcagtcgttaatattgtcgctccttcacaatcagggctgtcacataaccaatataatgattttaacgtcgagcaggcgggtgtggtttttaataactcattgtcggctggctcatcaaagctggcaggagaattatctgctaatagtaatttgggtggacatacagcaaaaattattctaaatgaagtgattagccgcaacccttctttaatattggggaaacaagaaatttttggtatggcggctgattatgtgctggcaaacccgaatggtattacttatcggaatggggaatttattaatacgaatcaagtatcactggttgttggtaatccactggttgaaaacggattgttaaatggatttagcaccttgggtaataaacattccttaaatattgggagtgcgggtcttgtaaaaagtaggattgtaaatcttattgctccaaaaatcgacaatcgtggtcaaattattgtgacgaaagatattaatattataacgggtaataaccgtgtctcaactgacggaaaagtattggattcacaacagacaagcgcgaatgcacttgatagttattatcttggtagtatgcaggctggacgtattcgattgctgaatactgccaaaggaaattgggttaatttgcaagggacaatggtcgctgatgacagtatcaatgtcgattccaatggaaggcttaacttggaaggtgccatagtgaaaggaaacgatgttaaatttaaagctgaacatattttatctcaaggaaatattaatgaatattcatcagagagtcatggtaaagataattatcataatattttcggtggtattgatgctcatcaaaaacaaactaaacagtcgctcactcggactaaattagagggtaagaacatcacccttatttccaatcaagacaatcaatttatggcaacggatattgagggagataatgttactctaagtggcgccaatctgaaattaaacggacaacaatttcatcagagtacacaagaaactgagaataaaagcaaatttttgtggaaacataaccgcagtaataccgatgaacagtaccagcagaaaggtaataccattaaggctcatggtaatattaaattaattgcgaacaaaggtgacttagaaatttctggcagtaagattggtgctggcgaaaaaatatcactgtctgccaaaaatgatgtgaaattagctaatctgatagaaacaaaaatcacgactgaaaaaaaatatcaacggaacgagacagcagcattaacaacaggagagagctttaaacgtaaagtcagacaaaaaaatatctccagtgagctgaacgcagatgatgatttaggcattaatgcgggcggaaatgttgaaattgttggtgcgaagattcatgctaaaaataatttgatactcaaagcagataagcaggtgaaaatttccacacaatctctcaataacattgatactgatgacaataaaacaaaaaattggggcggtgtcgctggcggaaaaaataaaaataatcactatgaagataaaacgcaggtatcttctgaaattactacggatggccgtgtactgttgacgggaaagacggggatcagtatcactggcagtaaggtgaaagggaaacagggtagttattctgatgcagttgatggagaattaactattgataatgcagtaaataataccaataaaaatattaatgaaagaacaggtgcgatttttaacattactaatcaatcaaataaaaataatagtatagaagagcgttcagtaaagagtgaagtaacttctgatgcggatctaaaattaattagcaataaagatatcaatgttattggtagtttagttaaaagtgcagatgaactgaatattaatacacttggaaatctcaatgtccattcttctgatgagaaaaagagtggttctaaagaaatcagttctctgaattggaaaaaccattttattaagcctgatgttaaagaaagtaagtcaattagcgttgaagtcggcctgaaaaataccagagatgattcgaaatacgatgttactgaacaaaaatcatcggaattgaatggtggaaatatcaagattaatgctgacaaagatgtttctatcactggctcagatattataacaaaaaaagggaatgctgatatcaaagctgataatatttctctgctttcggccgatgagtcaaaatctatggataaatcgcattcaatacacaattgggatgtggctgttacgcctgatagtaataaatttgaagctggctttaaagggactaaacaaagcgaaaacaattcccagagtcagaaaacaagtaaagtttcaacaacaaatattactggcgatctcaagctgaatgcgacaaaggaattaaagcaacaaggagctcggcataatgtagcaggtaattatgacgctaatgccggtagagttaataatctgtcaacagaaaatacagaatcaagttcctcaactaacacgcaggtgaagaataaatttggtatttcaattaaaggtaagaacgctcaaccttattctgatgttgatcttaaagctaacggcagtagacattcagaaaataccagcaagacaactaatgataccactttgatcaacgctaataaaatcaagctcgttgccgatggtgagatttatgatcaaggaacgcaatatcaggcgaccaaaaacgatatcgttttgcaggcagatagccacaagagtgatgcggtgttcaatcatgaggagagaaaaacttctgataccacgggtgatgctaatctggaggttggtgttaagcctgttattcaaagtacagaactcagtggtaagggaaaaggagacacactgtcgcattctcaatccagtactgatgcaattaccggttctcttaaggctaaaaacggcattacaattcggatgaaacatgatgctgcatatcagggaacatctatggatgcaggtactggtaaagttaacttagatgtggaaggaaatatcaacatcagtcaggccgataacatcaagcaagtcactgagaagtcttatagcggggatgtttcaactaaactggaagccaatataaaaccagtttcctctgatgccggtggcaagaatatcgcgaagactcaaagaacgactatggcaaaaatcagtgagatccatggaaaacagggcgtcagtttgaacgctggcaataatttgactctgcaaggtgccaacgttgatggagaagatataaatctaaccgcaaggcagggtaatgttgaactgacgtcagcccaagatacatccaataatgataatttgagtatggatgtcgattcttatgcgaatttgggaacaaataacagcactagcgataaatatggtgtaggtattaatccgaaattagcaaaaaaccatcttgatacgacgattaatcataatagccatattgcaggtaaaaaagttacgttggtcagtgataaggataccttcctcaaaggagcgaatatcacagcagataaagtaacgagtaataccagcggtaaactcaatattgaaacagttaaaaacacgacccatagccaaaatatcaaggtaagtatcggttctgactctccaaatgatgttcagagtactgatgtggcaaaagcagacgttaagaagaaggaaattttcagtaaaacggcttctgcttcacctgaaattaaaaacaagctgaaggccactttggatatggataccaaggaatcattagctgaacagtcaggtattgaagggactgaagaggttaatctgaatgttactggcaaaacctatttgacaggtgccaaaattgacagcaaaaaaggttccgttacgttgaatactcaagagatcgttaatcgggccagtacaacatatgacaagaacgaaaaagacagagttgaattaccgaactctcttacaaattttgttactgaaataccggaatatatttcagatattacatcagggaaaattccatttgtgaaaaaacagaatcatgagactaaaactcaggagcttcagagtacagtcaaagggcatgaattagattaa

SEQ ID NO: 4889 - DNA, 1356 bp, Xenorhabdus bovienii
  Coding DNA location: Contig name=SeqID_16900; Position on contig =37721..39076bp; Strand=+
atgttcatcggttttgactatggcacatcaaattgctcagtagcgaggatgatgggtaatacaccacaactgcttgctattgagcatgacaatttctacatgccttcaacgttagcagctccgactcgtgaatcggtttctgaacacttatttcgtcaccggaatatccgacccggtaatcaagtgggggagcagcttcttcgcagcgcgatggctacaaatcgtgaggaaggtatcgagcttctttcggaagatatcgtcttcgggcaggcggcgttgaatcgatatatggaagatccgcaagaaatttactacgtgaaatcgccgaaatctttcttgggtgcaatggggttgagagagatacaaatcagcttctttgaggatttggtctgcgccatgatggccaatatcaaacagcgggcagaagctaatacacagcagatcattgaagaagtggtgattgggcggccgattaactttcatggtcgtggcggggataaatctaaccaacaggctgagaccattttgcttcatgctgcaaagcgtgctgggtttcgcaacattgaattccaatttgaacctgtggcagcaggtttggaatatgaagataccctgaccgaaaacaaaattgttctggtggtcgatattggcggcggaacaacagattgttccctcatccaaatggggccagactggaaagggaagtctgagcgcaacgagagtctattggcgcatagtgggcaacgtgtcggcggtaatgatttagatatcaatctgacctttaaacaattgatgcatccttttggattgggaagtcaatttgcatcaggcatcgagatgccactgacccaattttggaaccccattgccatcaacgatatacaagcgcaaaaagaattttactctcgtgagaacctgagagcgttaaaatctctgcatatggaagcacaggagccagagaaattagcgcgattattgaaggtatatcacgacacattgggatatagcctagtccgcagtgcagaagaagccaaaattgccctctcggatcaatctgagcatcgtgtgaaattgaatctactatcggaagtgattgagattgatcttcatcgtgatcaaatgattacagcgattgaatctaccaaagacaaaatggctaaattagtcagtgaagcggtggaacagggtggcactaagccagatgttatcttcatgaccggtggttcagcgagttccccgatccttcgccaggcggtggagcaagtattgccgggtatcccgctggtcagcggtaactactttggttcagtgactaccggtttagcgcgttgggcaaaagtttgtttcgctcaatga

SEQ ID NO: 4890 - DNA, 261 bp, Xenorhabdus bovienii
  Coding DNA location: Contig name=SeqID_16900; Position on contig =39033..39293bp; Strand=-
atgtctctaatacgaaataccttcaaacgtttacattatcttgttgatatcattactcagtgtgtacgctggtatccggcttactcgctgaatttacggaatttagcaaaatccgctgtaaaccctcgcccagtgcgagggtgtcaacgactcgtaggtcaccggagccttacaaatatcaaagataagtatcgaaactacgataatcagactcacgtcattgagcgaaacaaacttttgcccaacgcgctaaaccggtag

SEQ ID NO: 4891 - DNA, 516 bp, Xenorhabdus bovienii
  Coding DNA location: Contig name=SeqID_16900; Position on contig =39370..39885bp; Strand=-
atgcacaatgagctgctcaaattttctcacaaaagcgcaaaagaaggacaatggctgttatcagaaggtaatttttatcgagttgtagctactggtgcagaaaccaatagtcgttacagtctggttgaaatcattgttgaaccagggaaaggggctccatttcatttccataaattagaggaagaagctttcttcatattagaaggtgaaatggttttttatacgcagactgaaacaatgtatggaaaacaaggagcttttttaaacttttctgttggacaaatccgcggttttcgtaatgaaacagatgaaaatacacgaatgctcattatgctttcacctccgggaatggaacaaatgttttttgaagatggtaaggcaattgatgcacctattgatttgaatacaacatttgtagaaaacataggtcaaccagtaacctgcccagaaattgcaggacgatacggcatagaaagtgttcctttaccattaccggaaaaaaagacaaccgcttga

SEQ ID NO: 4892 - DNA, 198 bp, Xenorhabdus bovienii
  Coding DNA location: Contig name=SeqID_16900; Position on contig =40043..40240bp; Strand=+
gtggaagaacccacgaaaatgacgagtactggagcacttatcgttccaaaaatgttgtttcacatgctcttccagtatcaacgacatggcatcaacatcaagttccccgttactttttttgaaatgatagcggccagcaaacagcagtggctccaggctattggcgatatccggataaattcatcaataatctcctga

SEQ ID NO: 4893 - DNA, 180 bp, Xenorhabdus bovienii
  Coding DNA location: Contig name=SeqID_16900; Position on contig =40226..40405bp; Strand=-
atgtcgacaagctctcgcaccagaaagaggtgttccggtttcagcatcgggccagcacccgcatcacctcaggcaacagagtcaacgggtaggagatggcataaccgtaccgaggcttaccatcaacttaagagtaatataagaaaaacctatcagcagcgtatctcaggagattattga

SEQ ID NO: 4894 - DNA, 117 bp, Xenorhabdus bovienii
  Coding DNA location: Contig name=SeqID_16900; Position on contig =40359..40475bp; Strand=+
atgctgaaaccggaacacctctttctggtgcgagagcttgtcgacatgcgccgggggattgatgccctgacccaacatatcgaggggttaaacctgcgctgtgacctggatgactag

SEQ ID NO: 4895 - DNA, 24348 bp, Xenorhabdus bovienii
  Coding DNA location: Contig name=SeqID_16900; Position on contig =40507..64854bp; Strand=-
atgataaggaatgacatgaacctcgataatctgaaacgtgctgtgctaaaaaagaaaatcaaacaacaattgcaaactcagcaacagcagcggccatccatcaagcaggttgatcggaatcttcctctgccattgtctttcgcccagcaacgactgtggttccttgctcagctcgatcccgccgccagcctggcctaccatatcccggtagcgctgcgtctcaccggccagcttgaccgccacgccctgaccaccgcactcgatcacctaatcgcccggcacgaaagcctgcgcacccgcttcgtattggtcgagggtcaaccctgccagcacatcgatcccgctgatatcggctttgtcctgtcctgccaggatctgcgttcgctagacccggcaatgcacagcaaccgtatcgccgagcttgccgaccttgaggcgcagacacctttcgactttacccaaggcccgctgatccgcggccaactgctgcaactgacagacgaagcgcatgtgttactgctcacccagcaccacatcatcgctgacggctggtctatcggtgtgctggtgcacgaactgggcaccctctaccgcgccgcccttgatggccactgcgatcccttgccaccgctgcccattcagtacgccgactatgccgtctggcaacgcgactggctacagggggatatcctcacggaacaacgtgacttctggtgcagtcagctccaggatgccccggctttgctggcactccccaccgaccggccacgtcccccggtgcaacgctatgccggcggccaagttcccttccagctcgatgcgaccttgctagcgtcgcttaaggaactcggacaacgccataacaccaccctgtttatgaccgtgctgaccgcctggagcatcgtcctcacccggctcagtggtcaggatgacattgtcatcggcactccggtcgctaaccgcccgcgccatgagcttgagaaccagatcggcttcttcgttaataccctggctctgcgcgtcaccccgggtgatacctcccgtgtgaccgacctgctcgcgcaggttcgtgaacgggcacttgccgcctatgcccatcaggatctgcccttcgagcaggtggtggaagcgttgcagcccgaccgtagcctgagctacagcccggtcttccaggtgatgctgaccttaaacaacaccccgtcccaaaacctgacattgcccggtttgcagctcacgccagtcgaacaaatacgctatggtgcccacttcgacctaacgttatcgctgaccgaaaccgaagccggtctgatcggtgatttggaatatgccgcggatctgttcgaccccgcgaccgttgagcgcatggtcggctatttggaaaatgtgctggcggcaatggcagctgatgcaacacaagccattgcgagcctgccaatgctgccattctcggagcgacaacaactactggtggacttcaacgccacccaggcagacttcccgcaggatgccctgatccatcaactgttcgaggctcaggcggcacacagtcccggtgcaacggccgtggtatgtggggagcaaacactcagctatgacgaactgaaccaccgcgccaatcgtctggcccactatctgctcgcgctaggcgtacgtccggacgatcgggtggcgatttgtctggaacgcagcccggagatggtggtgagcctgctcgctatccttaaggcaggcggtgcctatgtaccgctcgatccgacttatccggccgagcggctggcgtatatgctcgatgacgcagcaccggtagctttgctcacccagacggcgtggatcgacatgctgtccagcaccatccccacggtggtgctcgacgccccagaatcgtctatgacgacacaatcggcctacaatccggagccacaggcgctggggctgacgtcacgccatctggcgtatgtcatttatacctcaggctcgaccggccagcccaagggagtggcgatcgcccaccgcaatacggtgaatttcctcacctgggcgcaacggactttcagcccggaggaattggcacatactctttttgccacctcgcttaattttgatttagcggtgtacgaatgctttgtgccgttgatcgctggcggtacggttcacctcgtcccagatgcgctgtcgctgatgaccaccgcacagccggtcagcctgatcaataccgtaccgtcagccatcgcgcacttgattgaagccaaggcggttcccatgaccgcccggacggtcaatttggccggtgaagcattaaaaccccacgtcattgagcatttgtttgccgatacatccgtacaggatgtatgcaatctgtatggtccttctgaggcgacgacttattcaacctggatacggatgaaccgggcggagggctttgccagtcatatcggccgcccgatcgccaatacccggatctatattctcgatgcctacggtcagcccgttccgctcggtgtgaccggcgaaatccatatcgccggtgccggcgttgcccgcggttacctgaaccgccccgaactgacggccgagcgtttccttgccgatccgttctcctccgatccggatgctcgtatgtataagaccggcgacctcggccgctggcatcccgacggcaatatcgactatctcggccgcaatgactttcaggttaaattgcgcggcttccgcattgagcttggcgagatagagacccaactgatgcaatgtcgcggtgtgcgcgaagcggtggtgctagcgcgtgaagacgagccgggccagaaacgtctggtcgcctatctgcgacctctggacggcgttgagctggttccagcggaactgcgtcaacagcttgcccagcgcctcgccgagtatatgctgcccagtgcctttatgacgctcgacgctttcccgctcacccccaacggcaaactcgaccgtcaggcgcttcccgcccccggcctgtctgctgtggtcgctcgcggctatgaaaccccggtcggtgaggtggaaatcgctctggcacaaatctggcaagatctgttgcggctggagcaagtcggccgtcacgaccacttctttgaactcggcggccactcgctgatgatcgtcaatctgatcgaacggctgcatggccttggttggcggctcgacgtccgcagcgtgttcgccacccccgttctcactgagatggcgcaggctattcagggtgacaccaacgccttcgtcgtgcagcctaactgtatccccgaaggctgcaccgccctcacccccgatatgctgcccttggtctcactgtcccaggctgaaattgatgctatcgtcgacaccattcccggcggggcaagcaatgtgcaggatatctatccgctggcaccgttacaggagggtatcctgttccatcatctgctacaggaacaaggcgatgcctatctgttgcagagcctgctcgcctttgacagccgcgagcgtcttgatactttcctggccgcgctgcaacaagttatcgaccgccacgatatcctgcgtaccgccgcctactggcagggattggcgcagccggttcaggtggtctggcgtcaggcaccgctgtgtgtcaatcgctttactccagccacagcggacgatgtcccggctcagttattggctcacaccaatccacgccaacaccgtctcgacctgagccgtgcgccgctgttcgctggcgacatcgcccatgatccggcacaggatgaatggctgctcgctctgcgtttccaccatctggtcagcgaccatatgacgctggagctgattttcgctgagattgctcaggtgttacaggggcaggccgagacactccccacagcgctgccctaccgcgactttatcgcccagaccctgaatgtgccggccgcagtgcatgaggcctatttccgcgcccagcttgccgacgtcaacacaccgacggcaccgttcggcgtgctcaaggtgcagggcgataacgagcctgtcaccgaagcccgtctcccgctcactcccgctctggcggaggccatccgtacccaggctcgccgtctgggggtcagcccaggtgtactgttccatgtcgcctgggctcaggtgctggcacaaaccagcggccataatgatgtcgtcttcggctctgtactgctgggtcgcctgttaggggtcgctggcgctgatcgtatactggggatgtttatcaataccctgccagtacgagtctctctggccggccgcagtgtgcaggaagtggtgcaggccacctaccgcgatttgatgacgctgctggagcacgagcaggcaccgttggcgctggcacaacgctgtagtggcgtgccgcagtcgatgccactgttcagtgccctgcttaattaccgtcatagccaaaccagcgaggcagacgcggttaacacgatttggaccggtatacgcgtggtcgccgttgaggaacagagcaactatccgctcaccctgtcggtggatgatctgggcgccggtttccacctgactgctcaggccgtagtcgggatcgatccggctcgcgtaaccgcctatctggttactgccatcagcggtctggtcgatgccctggctcgcgacccgcaacgattgattcaggatgtaccgatcctgccaccctccgagcggcaacaactattgatggatttcaacgcgactcaggcggacttcccgcaggacgccctgatccaccagctgttcgaggctcaggtagcacacaaccccggcgccactgccgtagtgtacgaggatcagacactcagctatggcgaactaaaccgccgcgccaatcgtctggcccatcatctgatcgcgctgggcgtgcgtccggacgatcgggtggcgatttgtgtcgaacgcagcccggagctggtggtcggcctactcgctatcctcaaggcaggcggcgcctatgtgccactcgatccggcctatccggccgagcggttggcctatatgctcgatgacgcggcaccggtagttttactcacccaagcgacactggctaacacgctgatcaaccccatctctacgcccgtacccacaatcgtactcgatgcccaagaatcggctatggcagcgcaatctgctcataacccggatacgcaggcactgggtctgacatcacgccatctggcgtatgtcatctacacctccggctccaccggactacccaagggggtaatgatcgagcatcgcggtctgagcagcctgatcgccactcagcaggacactctggcgatcaaacccgacagccgtatcctgcaatttgcctcaaacagctttgacgccggtatctgggaatgcggcatggcactgctggcaggcgcttgcctccatcttgcccagcgtatccatctcctgcctggtgctgccctgctgaatacgctggagacccatgccattacccatgtgctgctgtcacccaccgcgctggcggctctggatacagttcctgtgacactgcaaactctgatcgtaggcggtgagacctgctcacccgcgctggtcaaacgctgggctgaaggtcggcgtatggtcaatgcctatggaccgactgaaagtacggtctgcgcagctatttatctgtgcgatagccaggaagaaggagcaccgcccatcggccagccgatcgccaacacccggatttatatcctggatacacaagggcagcctgttcctctcggcgtggccggcgaaattcatatcgccggcgcgggtgttgcccgcggctacctgaaccgccccgaactgactgccgaacgttttcttaccgatcccttttctgcagatccgggcgcccgtatgtacaagaccggcgatctcggccgctggcgccccgacggcaacatcgaatatctcggccgcaatgactttcaagtcaaattgcgcggcttccgtatcgagctcggtgaaattgaagctcaattggtgcaatgccccggtgtacgcgaagctgtggtgctgacccgcgaagacgagccgggccacaagcgcctggtcgcctatctgctgccccagtctgatgttaagctggtgccagccgaactgcgtcagcagctctctcaacaccttgccgagtacatgctgcccagtgcttttatgacgctcgacgccttcccgctcacccccaacggcaaactcgatcgtcaggcgctccccgcccctgatccgtcggcggtagtggcacgcggctatgaaaccccggtcggtaaagtagaaatcacactggctcagatctggcaagacctgctgaggctggaacgggtcggccgtcacgaccacttctttgaactcggcggtcattcgttgcttgccgtccagcttgtggcacgcgtgcgtcaggatctggcgcgggagttgccactacaacagattttcgcccaacccctgctggcagaactcgcccagacgctgaccggcacgtcggcaaccactcaggtcgctatccccgccgccgatcacagccgaccgctaccattatctttcgcccagcaacggctgtggttcctgggtcagcttgatcccgccgccagcctggcctaccatatcccggtagcgctgcgtctcaccggccagcttgaccgccacgccctgatcaccgcactcgatcgcctggttgcccggcaggagagcctgcgcacccgctttatcctgatcgaaggacaaccctgccagcacatcgatcccgccgatatcggctttaccctgtcctatcaggacctgcgcccactggaaccgccggcgcacactcatcgtgtcgccgaactcgccaccctcgaagcgcagacgcccttcgactttacccaaggcccgctgatccgcggtcaactgctgcaactggcagacgaagagcatgtgttactgctcacccagcatcacatcatggctgacggctggtccatcagtgtgctggtgcacgaactgggcgccctctaccgcgctatcctcggcggtcatagcgatctgttgccgccgctgcccattcagtacgccgattatgcggtctggcaacgcgactggctgcaaggaaccgttcttactgagcagcgcgatttctggtgcgcccagctccagaacgccccgacctttttggaactccccaccgatcggccgcgcccgtcagtacaaacctatgccggcgatcgggttcccttccagcttgatgcgaccttgctgacatcgcttaaggggctaggacagcgccacaacaccaccttgtttatgaccgtactgaccggctggagcatcgtcctctcccggctcagtggtcaggatgatattgttatcggtaccccagtcgccaatcgtccacaccgtgagcttgagaacctgatcggcttctttgtcaataccctggccctgcgcgtcacgccgggtaataccccgcgtgtggccgatctgctcgcgcaggttcgtgagcgtgcgctcgccgcctatgcccatcaggatctgcccttcgagcaggtggtggaagccttgcagcccgatcgcagcctgagctacagcccggtctttcaggtgatgctgaccttaaacaacaccccagcccaagatctgacattgcccggcctacagctcacgccacttgaacaagtgcgccatagcgcccactttgacctgacgttatcgctgaccgaaaccgaggcgggtctggtcggtgatctggaatatgccgccgacctgttcggctccgcaaccgttgaacgcatggtcggctatctggaaaatgtgctgaaggcgatggcggccgatgcgacacaaactattgcggatctgccgatactgccggcatcggagcggcaacaattgctgaccggcttcaatgccatccaagtagacttcccgcagaacaccttgatccatcagcggttcgaggctcaggcggcacattctcccgatgccaccgccgtggtgtttgaggatcagacgctcagctatggtgaactcaaccgccgcgccaatcgtctcgcccatcatctgattgcgctgggcgtgcgtccggatgatcgggtggcaatttgtgtcgaacgcagcccggaactggtgatcggtttgctcgcgatcctcaaggccggtggcgcctatgtgccgctcgatccgacttatccggccgaacggctggcgcatatgctcaatgatgccgcacctgtggtattgctgacccagacgacgtgggttgacacactgaccagcccagtatctacgtccgtacccacaatcgtactcgatgcccaagaggcgtccctgatggcacaaccggatcataatccggacacacaagcgctggggctgacgtcacgccatctggcatatgtcatctacacctccggctccaccgggctacccaagggggtgatggtcgagcacgcccatgtcacccgcctgttagccgccacccaagaacgtttccagtttgatggcaatgatgtgtggaccctattccattcctttgctttcgatttctcggtgtgggaactttggggtgccttgtctcatggcggccggctgatcgtcgtaccgactgactgtctccattcaccgcaggcgttctatgcgctgctgtgccgtgagcaagtcaccgtactgaatcaaacgcccagtgcttttcgtcagttgatttctgctcaggatgccacgccgcattccctgcgctgcatcatctttgggggggaagcgttggagttgcatacacttgccccgtgggtcacccgtaaccccacccgacagacccgtctggtcaatatgtacggcatcaccgagatcaccgtgcatgccacctatcgtgaactcacggaatccgacatcaccctgggacgcggcagcttgatcggccagccgctacccgatttgcgggcatatatccttgatgcccacggtcagcttgttcctctcggtgtcactggcgaaatccatatcgccggtgccggcgtcgcccgtggctacctgaaccgtcctgaactgaccgcggagcgcttccttgccgatccgttctccttcgatccggacgcccgtatgtacaagaccggcgacctcggccgctggcgttccgacggccatctcgaatatctcggccgcaatgactttcaagtcaaactacgcggcttccgaattgagctcggcgagattgagtcccgattagtgcagtgccccggcgtacgggaagccgtcgttctggcacgcgaagacgaaccgggccacaagcgtctagtcgcttatctgctgccccagaccggcgctgaactggtgccggctgaactgcgtcaacaactcgcccagcaccttgccgagtatatgctacccagtgcctttgtgacgctcgacgctttcccgctcacccccaacggcaaactcgaccgtcaggcgcttcctgtccccggcgcgtccgccgtagtggtgcgcggctatgaagccccggtcggtgaggtggagaccgccctggcacaaatctggcaaaacctgttgggactggaacggatcggccgccacgaccatttctttgaactgggtggtcattcgctgatgatcgtcagcctgatcgaagagctgcgcggccttggttggcggcttgaggttcgcagcgtgttcgccgcgcccgtcctcgccgaaatggtacaaaccatccagagtgacaccgacgctttcgtggtgccgcccaatcgcatccccgaaggctgtaccgcccttactcccgacatgctacccctggtcacgctgtctcaggctgagattgatgccatcaccgatgtgatccccggtggggcgaccaatgtgcaggatatctatccgctggcgccgttgcaggagggtatcctgttccatcacctgctacagacacaaggtgatgactatctactacagagcctgctcgcctttgacagccgcgagcgtcttcatacttttctggacgccctgcaacaggtcatcgaccgccacgatatcctgcgtaccgccgcctgttggcagggattggtgcagccggttcaggtggtctggcgtcaggcacccctgtgtatcaatgactttaccccagacacggcggacgatgttccggctcggctacgggctcacactgatccacgccgtcaccgtctcgacctgagccgtgcgccgctgtttgccgccgatatcacccacgatccggcacaggatgaatggctgctggctctgcgtttccaccatctggtcagcgatcatatgacgctggagctcgttttcgctgagattgccctgatattgcagggacataccgacaggctgcccacagtgctgccctaccgcaattttattgcccagaccctgagcataccggccgcagttcatgaggcttacttccgcgatcaactcgccgacgtcgacgaaccgacggtgccgttcggtatactcaaagtgcaggctgacggcgaactcgtcaccgaagcccgtcttccacttatacctgctttggcggaggctatccgcgctcaggctcgccgtctgggggtcagtccgggcgtactgttccatgtggcctgggctcaggtactggcgcagaccagcggccgcgatgatgtggtctttggctccgtgctgctgggtcgtctgcaagggggcgcaggtgctgaccgaatactgggtatgtttatcaatactctgccagtgcgggtctctctggccgaccacagcgtgcaagccgtagtacaggcgacctaccgcggtctgaccatgctattggagcacgagcaagcaccgttggcgctggctcaacgctgtagcggcatggcgcagtcgataccgctgttcagtaccttgctcaattaccgtcataatcaggccggcaaggcagatacagctgagacgacttgggcaggtatgcgcattttaacaacagaggagcgaaccaactatccgatcaccctgtcagtcgatgatctgggaactggtttccatctgaccgctcagactgtgacggggatcgacccgatccgcgtcaccgcgtatctggctacggcgatcagtggcttggtcgatgctttgacccacaatccgcaacagttgattcgagatgtgccgatcctgccaccagcagagcggcaacaactgctggtgaacttcaacgccacccaggcgcacttcccacagaacgctctgatccaccaactgttcgagtctcaggtggcatacaaacccgatgccaccgctgtggtgtttgaggatcaggtactgagctatggcgaactgaactgccgcgccaaccaactggctcatcatctgatcgcgctgggtgtacggccggacgatcgggtggcgatttgtctggaacgcagtttggagctggtagtcggcttactcgctattcttaaggcaggcggcgcttatgtgccgctcgatccggcttatccggccgagcggttggcctatatgcttgatgacgcggcacccgtggtcttgctcacacagacggcatgggttgacacgctggtcagccccgtgactacgcctgtacctataatagtactcgatgctcaggaaccgactgtggcagcacaacccatccacaacccggagccgcagacactagggctgacgtcacgccatctggcatatgtaatctacacttcaggctccaccgggttgcccaaaggcgtcatggtcgaacaccggaatgtccttcgtctcatcatcaataatggttttgccgatattggagaagaagactgtattgcccattgtgccaatattgcctttgatgcttcaacgtgggaaatctggtctgctctgctcaatggtgggcgtttatatgtggtttcaccctcagtgctgctcgatccggtacgtttccgcgattcgctgatcaaagggcaagtcaccgccctctggctaacggccggcttgttcaacgaatatctcagcgatctcggccccctgttcggacaactacgctacctgctcatcggcggcgatgtactcgaccccaggaagattcaacgtgcacaattggctgagtctcagccggcacatctcatcaacggctatggtccgacagaaaccacgacgtttgccacaacctatcacattgcatcacccgtcgatgttgctcacgctattcccatcggccgtccgatcgccaatacccggatctatatccttgattgccacaaccagcccgcccccctcggtgtggccggcgaaatctatattgccggtgccggcgtcgcccgtggctacctgaaccgtcccgaactgaccgccgagcgcttcgtttccgatccgttctccgccgatccagacgcgcgcatgtataaaaccggcgacctcggccgctggcttttcgatggcaacatcgactatctcggccgcaatgactatcaggttaaactgcgtggcttccgtattgagcccggtgaggtagaggctcgacttgtacaatgtcacggggtgcgcgaagcggtggttctgacccgcgaagacgagccgggccacaagcgcctggtcgcctatctgctgccccaaaccggtgtcgaactggttccggccgaactgcgtcagcaactttctcaacacctcgccgaatacatgttgcccagcgcttttatgacgcttaagtccttcccgctgacccccaatggtaaactcgaccgtcaggcactccccgtccccgactcgtctgccgtggtgatacgcggctatgagccgccacagggaagaatagaaaccgctctggcccagatctggcaagacttgctggggctggagcaggtcggccgtcatgaccacttctttgaactcggcggccattctctgcttgccgtccaactcgccgcgcgtgtacgccaagatctggcgcgggaattgccgctacaacaactctttgcccagcccatcctgacggatctggcccacgcactcaccggcgcttccgtgacgactcaggtcatcatccctgtggccgaccgcagccagttgcttccgctatccttcgcccagcaacggctatggttccttgggcagctcgatcccgctgccagccaggcctaccatattccggcagcgctgcgtcttactggctcactcaaccgccacgcgctgaccaccgcactcgatcacctggttgcccggcaagagagcctgcgcacccgctttgtcctagtcgaaggccaaccctgccagcacattgatcccgccgatatcggctttgcgctatcctgccaggatctgcgcccgttagactcagcagtgcgtaacaaccgtgtcaccgagctcgccgcccttgaagcgcagacgccattcgactttatccgaggtcctctgatccgcggtcagctgctgcaattgacggacgaagagcatgtattgctgctcacccagcatcacatcatcgctgacggctggtccatcggtgtgctggtacacgaacttgttgccctctaccgtgccgcccttgacggccacagcgatccgctgccgccactgcccattcagtacgccgactatgccgtctggcagcgtaacgggttgcagggagccgtcctcaccgaacagcacgacttctggagcagacagctccaaggcgccccggccttgctgacactccccaccgatcggccacgcccacccgtacagagctatgccggcggccgggtgcctctccaccttgatactacgttgctggcatcacttaagggacttggacagcgccataacaccaccttgtttatgaccgtattgaccgcctggagcatcgttcttgcccggctcagtggtcaggatgatatcgttgtcggcaccccggtcgctaaccgccagcatcgcgaattcgagggtttgatcggcttctttgtcaataccctggccttacgcgtcacgccaggtgacgtcaccaatgtggccgggttgctcacgcaggttcgtgagcgagcactcgccgcctatgcccatcaggatcttcccttcgagcaagtggtagaagccttgcagcccgaccgtagcctgagctacagcccggtcttccaagtcatgctggccttaaataacactccgacccaagacttgtcgttgcccggcctacagctcgctcccgttgaacaggtacgctatggcgctcactttgacctgatgctatcgctgaccgaaactgaggctggtttggtcggtgatctagaatatgccgccgatctgttcgaccacgcgaccgttgagcgcatggtcggctatgtgactcatgtgctgacggcgatggcggctgacacgacacaagccattgccggcctgccgatgctgccgacctcggaacgacaacagctgctggtgaacttcaacgccacccaggcggacttcccgcaagacaccctgatccaccagctattcgaagctcaggcggcacaccaccccaccgacaccgccgtggtgtgcggggatcaggcgctcaactatgacgaactgaaccgccgcgccaatcggctggctcatcatctgatcaatctgggtgtacgcccggacgatcgggtagcaatttgtgtcgaacgcagtctggagatggtggtcggtttgctcgctatcctcaaggcaggcggtgcctatgtgccgctcgatccggcttacccgaccgagcggttggcgtatatgcttgatgacgcggcacccgtggtcttactcacccagatggcatgggtcgacacactgaacagcgccatacctacggtggtactcgatacccaagaaccgtttatggaagcacagctaacccacaacccagaagcacagacgctgggtctgacatcatgccatctggcgtatgtgatctacacttccggctccaccggcctacccaagggggtgatgagtagccatcaagccctgtgtaaccggctgttgtggttcgttcgcgatatcgtgacaccaccactggtggcggcgctgaaaaccagcatcagcttcgtcgattcagtgaccgagacacttggcgtattactggccggtggcaaactggttgttttcgataaccatgaagtgaaagatcttacgcgtttcggcgaaggcttacgccacgccgatgttaactatctggtggtggtgccttcgctgctgaaactcctgatacaggggagtggcgattacctgaaatcgattaggacgttgatttgcagcggggaacgacttgcgcctgagctcgctcggcaggtaataacggattacccttggatccatctgctgaatttctacggttcatccgaaatcaatggcgatgcgacttggtatgaatactgtgctacggccagcgtgccggatgtttcggtcatcggcagacccatcgccaatacccaaagctatatcctcgatccccacggccaacccgttcccttgggcgtcactggcgaaatccatatcgccggtgccggcgttgcccgcggctacctgaaccgccccgaactgaccgccgaacgtttccttgccgatccgttctccgccgatccggatgcccgtatgtacaagaccggcgatctcggccgctggcttcccgacggcaatatcgaatatctcggccgcaatgactttcaggttaaactgcgcggcttccgtatcgaactcggcgagatcgaggctaaattggtacaatgccacggcgtgcgcgaggcggtggtgctggcgcgcgaagacgagccgggtcacaagcgtctggtcgcctatctgctgcctcagaccgacgttgaattggttccggccgagctacgtctgcaactctcccgacagctcgccgagtatatgctgcccagtgcctttatgacgctggaggctttcccactcaccccaaacggcaaacttgaccgccaggcgcttcccgcgcctgacccgtccgctgtggtaacacgtcattatgaagcaccagtgggcgaagtggaaaacgccttggcgcagatctggcaaaccctgctggggctagaacgggtcggccgtcacgatcacttctttgaactcggtggacattcgctgatgatcgtcagtttgatcgagcgactacgtggcttcggctggcgactcgacgttcgcagcgtattcgccacccccgtccttgctgaactggcgcaaaccatcctgatacatcaggacgctgccgacgccttcgtggtgctgcccaaccgcatccccgcaggctgcactgccctcacgcccgatatgctgtccctggtttcactgtctcaggctgagattgatgctatcgtcggcatgatccccggcggagcgagcaatgtacaggatatctatccattggcaccgttgcaggaaggtatcctgttccatcacctgctacaggcacaaggcgatgcctatctgttgcagactctgcttgccttcgacacctgccaacatctcgatgcttttctggtcgcgctgcaacaagtcatcgaccgccacgatatcctgcgtaccgctgcctgctggcaagggctggtgcagccggttcaagtggtttggcgtcaggcgccactgtcggtcaatcactttaccccgacctcagcggacgacgtcccggctcagttacgggctcatactgatccacaccagcaccatctcgacctgaaccgcgcgccactgtttgccgccgacattgcccacgatccggcacaggatgaatggctgctggccctgcgtttccatcatctggtcagcgaccaaatgacgctggcacttatctttaccgagattgccctgctgttgcaggggcatgcccaagcactgcccgccgcgctgccctaccgcgactttatcgcccagaccctgagcgtggcggacacggtgcatgaggcctacttccgctcccaactcgctgatgtcgacgaaccgacagcgccatttggtgtgctcaacgtgcagggcgacggtgaacccgtcaccgaagcccgtctcttgctcacccccaatttggcagaggctatccgcactcaggcccgccgtctgggagtcagtccaagcgtgctgttccatgtcgcttgggggcaagtgctggcacaaaccagcggccgcgacgatgtgatctttggctccgtgctgctgggtcgcctgcaaggaggcgcgggtgccgaccgagttctgggcatgtttatcaataccctgccggtgcggatctctctggccgattgcagcgtacaggaagcggttcaagccacctaccgcagcctcacaatgttgctagagcacgaacaggcaccgttggcgctggcgcagcgctgtagtggtgtggctcaaccgatgccgctgttcagtgccttgctcaattaccgtcatagtcaagccgacgaagccggcgcggttgatacgatttgggcaggcatgcgtatcgtcgcaaccgaagggcgaaccaactatccggttaccctctcggtggatgatcagggggtcggtttccgcctgactgcccagactgtgacgagtatcgatccggctcgcgtgaccacttatctagccaccgctatcagcggcttggtcaaggcgctggtcagcgacccgcaacaacccatcctgcaagtgccaatcttgccggcatcggagcggcaacaattgctgaccggcttcaatgctatccaagtagacttcccgcagaacaccttgatccatcagcggttcgaggctcaggcggcacattctcccgatgccaccgccgtggtgtttgaagaccagacgctcagctatggtgaactgaaccgccgcgccaatcgtctcgcccatcgtttgattgcgctgggcgtgcgtccggacgatcgggtggcgatttgtgtcgaacgcagcctagagctggtggtcggtttgctcgctatcctcaaggccggtggtgcctatgtgccgctcgatccgacttatccggccgagcggctggcgtatatgctcaatgatgcgacaccagtagctttgctgacccagacaacacaggtcgacacgctgaccagccacgtcccggcgcccatacccacaatcgtactcgatgcccaggatgcatccctgatggcgcaatcggatcacaatccggatacacaggcactggggctgacgtcacgccatctggcgtatgtcatctacacctccggctccaccggattacccaagggggtgatggtcgagcacgcccatgtcacccgcctgttagccgccacccaagaacgtttccagtttgatggcaatgatgtgtggaccctgttccattcctttgctttcgatttctcggtgtgggaactctggggcgccttgtctcatggtggccggctgatcgtcgtaccggctgactgtctccgttcaccgcaggcgttctatgcgctgctgtgccgtgagcaagtcaccgtactgaatcaaacgcccagtgcttttcgtcagttgatctctgcccaggatgccacgccgcattccctgcgctgcattatctttgggggtgaagcgctggagttgcatacgcttgctccgtgggtcgcccgtaaccccacccgacagacccgtctggtcaatatgtacggcatcaccgagatcaccgtgcatgccacctatcgtgaactcacggaatccgacatcaccctgggacgtggcagtttgatcggtcagccgctacctgatctgcgggcatatatcctcggcacccacggccaacccgttcctctcggtgtcactggcgaaatctatattgccggtgccggtgtcgcccgtggctacctgaaccgtcctgaactgaccgcggaacgtttccttgccgatccgttctcttctgatccggacgcccgtatgtacaagaccggcgacctcggccgctggcgttccgacggccatctcgactatctcggccgcaatgactttcaggtcaaactgcgcggcttccgtatcgaactcggtgagatcgaagcccgattagtgcaatgtcccggcgtacgggaagccgtcgttctggcacgcgaagacgagccgggacagaaacgtctggtcgcctatttgcggcctcaggacggcgttgaactggttcccgccgaactgcgtcagcagcttacccaacatcttgccgagtacatgctgcccagcgcctttatgacgctcgacgctttcccgctgacccccaatggcaaacttgaccgtcaggcgctccccacgcccgactcgtccgccgtggtggcacgcggctatgaagccccggtcggtgaggtggaaaccgccctagcgcaaatctggcaaaacctattgggactggagcgggtcggccgccacgaccatttctttgaactgggtggtcattcgctgatgatcgtcagtctgattgagcggctgcgtggccttggttggcagctcgacgttcgcagcgtgttctccgtacctgtcctcatcgatatggcgcaagctatcctgaacgccgacaccttcgtggtgccgcccaatcgcatccccgaaggctgtaccgccatcacgcccgatatgctgcctctggtctcgctgtcccaggctgagattgatgccatcgctgacgcgatccccgacggagtgactcatgtgcaggatatctatccgctcgcgccgctacaggaaggtatcctgttccatcacctgcttcagccgaacagagatccatacgttatatcgtcgctgttgagcgtcgaaaaccagacaaaactcgatgcattcattgcggcattacaagccgtcatcgaccggcacgatattctgcgtacgtctatccactggatcgggttatcccaacccgttcaagtggtacatcgacacgcaccattgccggtcaatgtcctgacattcgatgacgatagtgacgtggttgccagcatgcaagcacgcatggcgctgtcacatcagcacatggatttgtcccatgctccactgatacggttgcaagtcgccaccgaaccatattcgtccaagttatacgtcttgttccagttgcatcacatcatcgacgataacctctcactccggtgcttgctcgcagaaacgaccgctttcctgatgggacttggcgcggatttactgccatccgttccttatcgtaactttgtcgcctatgcacgtcaggaaggtaaaactcaggaagcggaagccttctttcggacattgctggccgatatcgatgaggtcaccgcaccttttggcctagctgatgttcaggggaatggcgagcataacgcggcggcacggaaggttcttgatgttgaactctcacaagccattcgtaaaacagcgcgccgctttggtactaaccccgcaattttgttccacgcagcttgggcgctcgtcgtcgcacgcacgagtggacgcgatgacattgtatttggcaccgttttgtcaggccgcatgtcgggagttgatgggagtgcacgcgctttaggcatgttcatcaataccctgcccttgagattgaagctaagaggaagcagcgtagatgaactcgttaaaatgacgaacgacgcatgcgccagcctgctgctttacgaacagactccattgtcgcttgcacagcgttgcagtggactcggtggcatgtccctgttcagtgccctgctaaatttccgacacggtaatgacaaaaatacccgtacacctagtctggatctgtttggtctggcaagtttggatagttgcgagcgcaccaattacccatttgaaatgtccattgatgatgatggtgaatattttgtactgtcagctcaaaccgtcaatgatattgatccaaatagaataaatacctatctcacaagagcgatagaacaattgatatcgatactaattgaagcgccagatacgcctgcgctggacttggacgtgctgcccgaagacgaacgccaacaattgctggtggacttcaacgcgactcaggcggacttcccgcaaaacgcgctgatccaccaactgttcgaagctcaggcagcgcaccatcccgatgccaccgccgtggtatgcggggagcatgcgctcagttatggagaactgaaccgccgcgccaatcgtctggctcatcatctgattgcgctgggggtgcgcccagatgatcgggtggcaatttgtctggaacgcagcccggagatggtggtgagcctgctcgctattctcaaagcgggcggcgcctatgtgccgctcgatccggcttatccgaccgaacgactggtgtatatgcttgatgacgcggcacccgtagccttactgacccagacgacatgggttaacagactgatcagccccgtgcctacggtggtgctcgacgcccaagaaccagctctggcagcacaaccaactgacaatccggagccgcagacgctggggctgacgtcacgccatctggcgtatgtgatctacacttccggttctactggcttacccaaaggggtggcgatcgctcaccgtaataccgtgaatttcctcatctgggcgcagcggactttcagcccagaggaattggcacatacgcttttcgctacttcacttaattttgatttagcggtgtacgaatgctttgcaccactcgtctctggcggcacggttcatctcgttcctgatgcgttgtcgctggtcaccaccgaacagccggtcagcctgatcaacaccgtgccgtcggccatcgcgcatttgatcgaggttaacgcggttcccgcaaccgcccggacggtcaatttggccggtgaagcattgaaaccgcacgttgttgagcatttgtttgcccactcattcgtacaggatgtgtgcaatctgtatggtccctctgagacaacgacttattcgacctggatacggatgaaccgggcggagggctttgccagtcatatcggccgcccgatcgccaacacccagatctatattctcaacccacatggtcagcccgtcccccttggtgtggccggcgaaatccatatcgctggtgccggcgttgcccgtggctacctaaaccgccccgaactgaccgccgaacgcttccccgccgatccgttctccccgacaccggacggccgcatgtacaagaccggcgacctcggccgctggcgccccgacggcaatatcgaatatctcggccgcaatgactttcaggtcaaactgcgcggcttccgtatagaactcggtgagatcgaggcgcaactgatgcaatgtcacggcgtgcgcgaagcggtggtgctggcacgcgaagacgagccgggccagaaacgtctggtcgcctatgtacggcctctggatggcgttgagctggttcccgctgaactgcgccagcagcttgcccagcacctcgccgagtacatgctgcccagcgcctttatgacgcttaaatccttcccgctgacccccaacggcaaacttgaccgtcaggtgctccccgcgcctgattcgtccgccgtggtggcgcatggctatcaggtcccgatcggtgcggcggaaaccgccttggcgcagatctggcaagacttattaggactggagcgggtcggtcgtcacgaccacttttttgagcttggcggtcactcgctgctcgctgtgcagttgctgaaccgcatgcgcgagcaagacatggcggttccgctgaccaccttgttcgctcatccgacgttgtgtgatctggcgatagccattggcgagcgttttgcccaatcaacgtccccgttcgatgcgaatcccgtgccgctaaacccaacaggctgcctgccacccttgttcttggtacacgagacttccggcgatccactggtctattcgccactggcagccttactgccgcctgagcttcccgtctatgcgctgcaagcccttggcatccacacgctggagcatcccccagcgtcgcttgaggcgctcgcggcctgccatattcaggctattcgtcgcgttcagccacaaggcccctatcgtctcgccggatggtcaattggtggcttgatcgcctatgaaatggcgcaacaattcatgagctgcggcgagacggtagaatttctcggtatgatcgattcctataactccataaatgggctagaaatcaccaccgaccaaccagtagacaaggaagcaaaacgaattgagataatcattgactcactgcgtgctcaaatcggcgctaatgatgagcagatattagaagaacttcacgatctcagtgatgtgaaccaaatccttgaccgctgtattgaacaccaatggctgccgatcagtatcacacgcgaggatatcctccttcgcctatacacctccgagatcattacacaactgggtcaagactatatcgcgccaaaatcccccttgcccatccacctgtataccgcggatgaagcactcaacggggaaatttggcacggttggcatgatatcgtcggcactgattcgacactccacgctatcggtggaacgcatttctccatcatgcgtcccccttcgctcaaccagatagcggattcactcaccgagcatttattgcccgctcctgcctacgacccacgcgttatcatccaaagcgggtctcggtcggttccgccgctattttgcatgcccggtgcaggtgccagcgcctctagcctcctcggactggcgctgtcgttcccacagcaactcccagtctacgccttacaggcacgcggcctgggcctgactgacgaacacaattttccctatgtcagtgtcgaaggtgccgctcgtgcctatatccagatcatccgtcaaacgcaaccccatggtccctatcacctgctgggtcattctttcggtggctggatcgcctttgagatggccttgcaactgcaagcagaaggggaacaagtctccgaccttatcctcgtcgataccgatgaacctgatccgcaaggtcgtactcccaagccagtcaaccgtaccgaaacgataatgaagctgatcgagatctacaatatgatattggatcgaccgctgccgcttacgaagcaggattttgacaatctggctccggacgaacagcttcaatacctacttcgtgctctggtaaacgcaggtctcttcccggccaaaacaccaatgtcactgctgcaaggtgtcgttcgcgtcatgcaagccaatctgaacacttgctatacacctcgtacccgctatgagggtcttgttcatctgattagcgcagaagagggagatgtggatgaaacgaaaacgcgcgaaaccctgtggaatacacacgttgctcaactcagcactatgcatgtacccggtaaccacatgaccatgttgtccagcccgcagattgagcactttgttactgggctatggcagaaattggattacgcgaacaacccaaggtctgcggtttggttcggatatgtaaaacctcacggatctggtcggaaggataaatga

SEQ ID NO: 4896 - DNA, 6633 bp, Xenorhabdus bovienii
  Coding DNA location: Contig name=SeqID_16900; Position on contig =64851..71483bp; Strand=-
atgacaaggattaacatgaatcttgatgacctgaaacgggctgttctggagaagaaaattgacgaacaattgaaagcccgcggaggtcagcagcgacggccattgattgaacaggtaaatcgacatcagcctctgccgttgtccttcgctcagcaacggttgtggttcctcagccaactcgatccggccgccagcctggcctaccatatgtcggtggtactgcgtctcacgggtcaacttgaccgcgatgccctgaccacagccctcgatcgcctggtcgcccggcatgagagcctgcgtacccgcttcgtgctagtcgaaggccagccctgccagcacatcgatcccgctgacgtcaatttcgccctgtcctgccaagacctgcgtccgctgaacccggcaatgcacactacccgtatcgccgagctctccgccctcgaagcacagacacccttcgattttgtccgcggcccgctgatccgcggtcaactgctgcaactgacagacgaatcacatatgttgctgcttacccagcaccacatcatcgctgatgcctggtccgtcggtgtactggtacacgaactgggcgccctctaccgcgccgccctcaacggccacggcgatcctttaccaccgctacccattcagtacgccgactattccgtctggcagcgcgatgggttacaggaggccgtcctcactgaacagcgtgacttctggtgtagccagcttcagaacgccccggccttactgacactccccaccgaccggccacgcccatcggtacaaacctatgtcggcgatcaggtgtccttccagctcgataccaccttactggcatcgcttaaggaactcggacagcgccatcacaccaccttgtttatgactgtactgaccgcctggagcatcgtcctctcccggctcagtggtcaggatgacattgttatcggtactccggtcgctaaccgcccacaccaagagttagaaagcctgatcggtttcttcgtcaatactctggccctgcgcgtcacgccgggtgaggcgccccgtgtggccgatctgctcgcacaggttcgtgagcgtgcactcgcggcctatgcccatcaagatctgcccttcgaacaggtagtagaagcgctacagcccgaacgcagcctgagctacagcccggtcttccaggtgatgctaaccttaaacaacacgcctgcccaagatctggcgttacctagcctacagctctctccggttgaacaggcgcgttatagcgcccacttcgatctgacgttatcgctgaccgaaaacgagacgggtcttaccggtgatctggaatatgcctcggacttgttcgatccaacgaccattgagcgcatggtagagtactttaagcaggtgctgacggcgatggccgccgatgcggcacaagccatcgcacgtctgccaatcctgccagcttcggagcggcaacagttgctggtagacttcaacgccacccagacggacttcccgcaggacgccctgatccatcaattgttcgaagctcaggcgacacaccgtcccaatgccaccgctgtcgtgtttgaagatcagacactcagctatggcgaactgaaccgccgtgccaatcgcctggcccatcatctgatcgccttaggtgtacgcccggacgatcgggtggcaatttgtctggaacgcagcccggagatggtcgtcggcctgctggctgtcctcaaggccggcggcgcctatgtgccgctcgatccagcctatccggccgagcggctggcctatatgctcgatgatgcggcaccggtggctttgctgaccctgacagcacagatcgatagactaaccagccccgtaaccacggtggtgctcgatgcccaagaatcatccctggcgacacaaccgacccacaatccggacgctcaggcactggggctgacgtcacgccatctggcgtatgtcatctacacctccggctccaccggattacccaagggggtgatggtcgagcaccgcaatgtcctgcgtctgattatcaataatggttttgccgatattagccccgatgactgtattgcccattgcgccaacgtctcattcgatgcggccacctgggaggtatggtctggtttagtgcatggcgcacgtatcctgttgatcccggaaaaaaccttattacaacctgattattttggtcagcgtttatcatcggaaggcgtcagtgcgcttttcctcacaaccgcgttgttcaatcaatacgcgagtttaatcgcgccgtcattgtcgggtttacgttatgtccttttcggcggtgaacaggccgatatccgtcctgcgatccgccttagagtcgattacccgccacagcacctgctacatgtgtacgggccaacggaaaccaccacctttgccacggcctatgaaatcccactgactgaaggcgaagagaggaaaatccccatcggccatccgattgccaacacccggatctatattctggatacccaaggccagcccgttcctctcggtgttgcaggtgaaatccatattgccggtgcgggtgttgcccgtggctatctgaaccgccccgaactgactgccgagcgcttccctgccgatccgttctccgccgatccggatgcccacatgtacaagaccggcgacctcggccgctggcttcctgacggcaatatcgagtatctcagccgcaatgatttccaggttaaattgcgtggcttccgtattgagctgggcgagatcgaagcccgattggtgcaatgtcacggcgtacgcgaggccgtggttctcacccgcgaagacgaaccgggccagaagcgtctggtcgcctatctgcggccgctggacggtgttgaactggttcccgccgaactacgtcagcagcttgcccagcatcttgccgagtacatgctgcccagcgcttttatgatgctcgacgccttcccgctcacccccaacggcaaacttgaccgtcaggcgcttcccgcccccgactcatcctccgtggtggcgcgtggctatgaagccccggtcggcgaggtagaagccgccttaacccagatctggcaagacctgttaggactgacgcaggtcggccgtcacgatcacttctttgaactcggtggccattcgctgatgatcgtcagtttgatcgagcggctacgcagcttcggctggcgactcgacgtccgcagcgtgttcgccgcccccgtgcttgccgagatggcacaaaccatactggcacatcaggatgacattgacgccttcgtggtgccacctaaccatattcccgaaggctgcaccagcctcacccccgacatgctgtcgctcatctcactgtcccagaccgagattgatatcctcgtcggcgccatccccggcggagcgagtaatgtgcaggatatctatccgctggcgccgttgcaggaaggtatcctgttccatcacctgatgcaggcacaaggcgatacttatctattgcagagcctgcttgccttcgacagccgcgaacgtctcgatactttcctggccgccctgcaacaggtcatcgaccgtcacgatatcctgcgcaccgccgcctgctggcagggattattgcagccggttcaggtggtctggcgtcaggcaccgctgtatgtcaatctctttacgccagccacggcggacgacgttccggctcagttattggctcatactgatccgcgccggcatcgtctcgacctgaaccgtgcaccgctgttcgccgccgacatcgcctacgatccggctcagaatgaatggctactggttctgcgtttccaccatctggtcagcgaccatatgacgctggagcttatctttgccgagattgcccaaatactacaggggcaggccgagacactccccacagcactgccttaccgcgactttatcgcccagaccctgaatgtgccggccgcagtgcacgaaacctactttagcgctcaactcgccgatgtcgacgcccccaccgcaccgttcggtatgctcacgataccggacgataatgaatccatcgccgaagcccgtctcccgctcacccccgacctggcgggagccgtccgcacccaagcccgtcgtctgggggtcagtccgagtgtgctgttccatgtggcctgggctcaggtgctggcacaaaccagcggccgcgacgacgtgatctttggttccgtgctgctgggtcgcctgcaaggaagcgctggcgccgaccgagtactgggcatgttcatcaataccctgccgatacgagtctctctggccagtcgcaacgtgcaggaagtggtgcaggccacctaccacaatttaatgacgctgctggaacatgaacaggctccgttaacactggcacagcgctgtagtggcgtggcccagccgatgccgctgttcagtgccctgctcaattaccgccacagccaaattggcgaagcagaggcggttgacacaacttgggcaggcatgcgcatcatcgcgacaaaggaacgaaccaactatccgctcaccctgtcggtggatgatctgggagccgatttctatctgaccgctcaggccgtggccgggatcgatccggctcgtgtcaccgtctatctggttaatgctatccgcggtctggttgatgccctggctcacgacccgcaacagttgattctggatgtgccgctcctgccactggcagagcggcaacaactgctggtggacttcaacgccaccgagacggacttcccgcaggacgccctgatccaccagctgttcgaggctcaggcagcgatccagccagccacaacagccgtagtgtacgaagaccagacgatgagctatgacgaactgaaccgccgcgccaatcgtctggctcatcatctgatcgccctgggcgtacggccggatgatcgggtggcaatttgtctggaacgcagcccggagatggtagtcggcttactcgctatcctcaaggcgggcggtgcctatgtgccgctcgatccgacctatccagtcgagcggttagcttatatgctcgatgacgcggcaccggtggccttgctgacccaaacagcatgggtcgacaagctaatcagccccgggccagcggtagtactagacacccaagaatcatctctggcggctcagccagactacaacccggacgctcaggcactggggctgacgtcacgccatctggcgtatgtcatctacacctccggctccaccggattacccaagggggtgatggtcgagcaccgcaatgtcctgcgcctgattatcaataatggctttgccgatattggccccgatgactgtattgcccattgcgccaacgtctcatttgatgcggccacctgggaggtgtgggcggggttagtgcatggcgcacgtatcctgttgatcccggaaaagaccttattacaacccgactattttgggcagcgattaacatcggaaggcgtcagtgcgctcttcctcacaactgcgttgttcaatcaatacgcgagtttgatcgcctcatcattgtcgggtttacgttatgtccttttcggcggtgaacaggccgatatccgtcctgcgatcagtcttagaaccgattacccgccagagcatctgctgcatgtgtatgggccaacggaaaccaccaccttcgctacagcttatgaaatcccgctgactgaaagcgaatatagaaaaatccctatcggccacccgattgccaacacccggatttatatcctggatacccaaggccagccggttcctctcggtgtcaccggcgaaattcatattgctggtgccggcgtcgcccgcggttacctgaaccgccccgaactgactgccgaatgtttcctcaccgatccctttgtctccgatccgggcgcccgcatgtacaaaaccggcgacctcggccgctggcttcccgacggcaatatcgaatatctcggccgcaatgactttcaggtcaaactgcgtggcttccgcattgaactcggcgagatcgaagcccgattggtgcaatgtcacggggtacgtgaggcagtgattctggtacgcgaagacgaaccggatcacaagcgtctggtcgcctatgtacggcctctggacggcgttgaactggtgccggccgaactgcgtcagcagctcgcccaacaccttgccgagtatatgctgcccagcgcctttatggtgctcgacgctttcccgctcacccccaacggcaaacttaaccgtcaggcgctccccgcccccgacgcgtccgccgtggtagccagtggctacgaagccccgctcggtgaggaggaaaccactctggctcggatctggcaagacctgctggggctggaacgagtcggccgtcacgaccacttctttgaactcggcggtcactcgctgatggccgtgcaattgacaacgcgcatacaaaccgaatttctggtcgatatccctatcgcctcgttgtttctttcccccaaattggcagaacaggccaacatcattttttcagcacaaatggatgcgataggggaaaacgatattgaatcgatacaaaactcacttgatttaatgtcaacagaagaactgatggcaattttaggcggagacagtaatcaatga

SEQ ID NO: 4897 - DNA, 28953 bp, Xenorhabdus bovienii
  Coding DNA location: Contig name=SeqID_16900; Position on contig =71480..100432bp; Strand=-
atgcctatgccatgcaatcgtatcaacaaagatcagcttgcgtttgaaagttcctctgaatcctcctcttgcaaattttcgctcagttctacccaacaagttgtctggcttgaccaaattctccatcctgacagccccagctacaatctcggttcacttgtcctcattgatggaaagctggatgaaacactgttagtacgcgcctttgaagccgttgtttatcgtcatgatgcattgcgtttacgactcatcaatactcaaaaactgccacttcaggaactcgtggacacgctcccggtgtccgtgacaattcacgacttctcacatcatgccgacgcagaagcccaagccgcacaacacatacgcactgctttcatgcgtccatacgacttgaatggggagttatggcgtgccgaactgctacgagtcagtgatacacgctggtactggcatttttgttgccatcatttgatcggagatgctacgaatttagcgctaattcccgaagagcttgctaacacttatcgtcacttaatcagaggggaggcactaccagaagccgctccttcctatctcgattttattgccgaggatcgtgcctatctcgattcacaacgctatgtaaacgaccggcaattctggttggaacgttatgtgaacttgcctcctgcattgctccaaccgcctaatccggataaaacgacagatcacggacaaaccgaaccggtactttggcaattggataaggggcttttccagcgcatcgaagctattgtgaccgagcatgggttgtctgttctgcactttatgtatgccgttctggcttgctatttcgcccgtaccactcaggcggaggaaatcgtcatcggcattcccgtgcacaaccgtaagaatgccaggcaaaaacgcacgttgggcatgttctcgtcagtcattcccgtcggcataaccattacgcctcatgacaccttccttgatgttatgcgcaaagcggcagcagagttgcgtcgttgctataaacgtcagcgcttaccgatcgcggagattaatcggcatacacaaatccagcagaagacgggacgcgctcaactatttgacatcatgctgtcatttgagtcgttccaagcgaacgctgagatgcccggtgccacgatcaaatactcaaaaatacaacgtggaacaccgtttcctttcttcgtcgcgatttaccaatacgcattcgctaacgatgaggctgtcaatcagcccgtcacgattgaattcaattactcaacccactacctgaactgcgctgaagtcatggctctccaatcgcgtttagccatgttgatggaggccgctctctcttctcccgagacccagatccgaagtttacctgtcttgccgccggcagagcggcagcaactgctggtgaacttcaacgccacccagacggacttgccgcaggacgcgttgatccacccactgtttgaggctcaggctacacacaaccccaacgccaccgccgtagtgtacgaagaccagacactcagctatgacgaattgaaccgccgcgctaatcgcctggctcaccatctaattgcgctgggcgtgcgtccggacgaccgggtggcgatttgtgtcgaacgcagccttgagatggtggtgggcctgctcggtatccttaaggcgggcggcgcctatgtgccgctcgatccggcttatccggccgagcggctggcgtatatgctcgatgacgcggcaccggtggtcttactcacccagacggggctgaccgacaggctgaccagccatgtgcccacggtggtacttgacgcccaagaattcgccatgacggcgcagtcagtccacaatccggatacgcaggcgctggggctgatgtcacaccatctggcgtatgtcatctacacctccggctccacgggtctgcccaagggagtggaaatgtctctggcagcattgtcgaacttgttgcaatggcaccgtcaaaatccttcacatctatccggaaccggtaaaacgctacaatttgccgctcttggattcgatgtcgctttccaggagatatttacgacgctgtgcgaaggcggatgtctggtcttgattaatgaagaaacacgtcgggatcctcaacaattcctccgcctgattcagcaaaaacagattgatagaatcttcctcccctacattgcgctacaacatcttgccgaagcggccagtcgcattgagggagatttttcttgcttggctcacatcattaccgctggtgagcagttgcgcattacgcctgccattcgccactttctacaacgctccggatcatgccagttgcacaatcactatggcccgactgaaagccatgtggttacggcatatacgctgggcaagaatatggatcagtggccaactcttcctcccatcggtcgcccgattgctaacacccaaatctatctccttgacccgcagggtcaacccgttcccctcggtgtcgccggcgaaattcatatcgccggcgcaggtgttgcccgcggctacctgaaccgccccgaactgactgccgaacgttttcttaccgatcccttttctgcagatccgggcgcccgtatgtacaagaccggcgacctcggtcgctggcttcccgacggcaatattgaatacctcggccgcaatgactatcaggttaaactgcgcggtttccgcattgagctcggtgagatcgagtctcggctcatgcaatgccacggtgtgcgcgaagcggtagttctggcgcgcgaagacgagccgggtcacaagcgcctggtcgcttatctgcggccaatggacggcgttgaactggttcccgccgaactgcgtcaacaactcacccggcaccttgctgaatatatgctgcccagcgcctttatgacgctcgacgccttcccgctcacccccaatggcaaactcgaccgttcagcgttccctgcccccgactcgtccgccgtagtcacgcgcggctatgccgctccggtcggcgaaatagaaaccattctggcccaaatctggcaagatttgctgagactggagcgggtcggccgtcacgaccatttctttgaactcggcggccattcgctgcttgctgtccagctcgccgcacgcgtacgtcaggatctggcgcgggaactaccactacagcaactttttgccctgcctcttctggcggatttggcccaggcgctctacggggcttcggcaaccgctcaggtcgttatccccgccgccgatcgcagccagccgctcgcgctgtccttcgcccaacagcggttatggttcctcggccaactcgatcccgccgccagtctggcctaccatatcccggtgacactacgccttaccggccaacttgaccgccacgcgctgaccaccgcgctcgatcgtctggtcgcccggcacgagagcctacgtacccgcttcgtactgatcgaaggccaaccctgccagcacattgatcccgccgacgccggctttgccctgtcctatcaggatctgcgcccgctggacccggcaatgcacgctcaccgcatcgccgaacttgccgaccttgaggcgcagacgcccttcaactttacccaaggcccgctgattcgtggtcaactgctgcaattgacggacgaggagcatgtgttgttgctcacccagcatcacatcatctctgacggctggtctatcggggtgctggtgcacgagctgggcaccctctaccacgccgccctcgacggcgacagcgatcccctgccgccactgtccctccagtacgccgactatgcggtctggcaacgcgactggctgcaaggaaccgtcctcactgagcagcgtgacttctggtgtgcgcagctccagaatgccccggccttgctggcactccctaccgatcgaccacgcccacccgtacagcgctatgccggcggccaagtccccttccggctcgacagcgccttactgacgtcgcttaaggcgctcggacaacgccacaacaccaccctgtttatgaccgtactgaccgcctggagcatcgtcctcacccggctcagtggtcaggatgacattgtcatcggcacccccgtcgctaaccgtccacaccgcgagttggagggtctgatcggtttcttcgtcaatactctggccctgcgcgttacaccgggtgatgcgccccgtgtagccgatttgctcgcacaggtccgtgaacgtgcactcgccgcctatgcccatcaggatctgcccttcgagcaggtggtagaagcgctacagcccgaacgcagcctgagctatagcccggtctttcaggtgatgctgtccttaaacaacacgccggcccaagaccagacattacccagtttgcagatctctcaggttgaacaggagagtcatagcgcgcattttgacctgatgctgttgctgaccgaaaccgaagcgggtctggtcggggggctggaatatgccgccgatctgttcgacaccgcgaccgttgagcgcatggtcggctatttgcagcaggtgctgacagcaatggcagccgatgcgacacaaactctcgcatgtctgccaatgctgccagactcggaacggcaacagttgctggtggacttcaacgccacccaagtagacttcccacaggatgccctgatccaccaactgttcgagactcaagcggcacacagtcccgatgccaccgccgtggtatgcggggagcaagtgctcagctatggcgaactgaaccgccgcgccaatcgtctcgcccatcatctgatcgcactgggcgtacagccggacgatcgggtggcgatttgtatgacacgcagcccggagatggtggtcagtttattgggtatcctcaaggcgggcggcgcctatgtgccactcgatccggcctatcctgccgaacggctggcctatatgctcgatgacgccgcaccggtggccttgctcacccagacggcgtgggtcgatacgctgaccagccccgtgcctacggtggtactcgacgcccaagcaccggctctgtcggcacaatcgatccacaacccagaggcacaggcgctggggctgacgtcacgtcatctggcgtatgtgatctacacttccggctccaccggcctgcccaaaggggtggcgatcgcccaccgcaatacggtgaatttcctcacctgggcgcaacggactttcaatccagaggagttggcgcataccctgttcgccacctcactgaattttgacttggcggtgtacgaatgctttgcgccactcgtctctggcggtacggttcatctcgttcctgatgcgctgtcactggtcaccaccggacagccggtcagcctgatcaataccgtgccgtcagctatcgcgcatttgatcgaggctaacgcggttcccgtgaccgcccggacagtcaatttggccggtgaagcattgaaaccgcatgtcgttgagcatttgtttgcccacgcctccatacagaatgtgtgcaatctgtatggcccctctgagacgacgacttattcaacctggatacggatgaaccggacggagggctttgtcagtcatatcggccgcccgatcgccaacacgcaaatctatattctcgatgcctacggtcagcccgttccccttggcgtggccggcgaaatccatatcgccggtgccggtgtggcccgtggctacctgaaccgccccgaactgactgccgagcgctttcttactgatccgttctccgccgattcaaatgcccggatgtacaagactggcgacctcggccgctggcgccccgacggcaatatcgagtatctcggccgcgatgattttcaggtcaaactacgtggcttccgtatcgaactcggtgagatcgaggcgcaactgatgcaatgtcgcggtgtgcgcgaagcggtggtgctggcacgcgaagacgaaccgggacagaaacgtctgattgcctatctgcggcctctggacggcgttgaactggttcccgccgaactgcgtcagcaactcgcccggcatcttgccgagtacatgttacccagcgcatttatgacgctcgatacgttcccgctcacccccaacggcaaactcgaccgtcaggcactccctgctcccgacctgtctgctgtggtggcacgcggctatgaagccccgatcagtgaggcagaaaccgccttggcgcagatctggcaaaacctgttggggctggagcgagtcagccgtcacgatcacttctttgaactcggcggccattcgctgatgatcgtcggtctgatcgaacagctatacgactttggttggcgacttgatgtccgcagtgtgttcgccgcccccgttctcactgagatggcgcaggctattcagagtgacgccagtgccttcgtcgtaccgcctaactgtatccccgaaggctgtaccgccctcacccccgacatgctgtctctggtctcgctatctcaggccgagattgaggccatcgtcgaagcaactcccggcggagcaagcaatgtgcaggatatctatccgctggcaccgttgcaggaaggtatcctgttccatcacctgttgcaggcgcaaggcgatacctatttgttgcagagcctgattgcctttaacacccgcgagcatcttgatactttcctgtccgccttgcagcaggtcatcgaccgccacgatatcctgcgcaccgccgcctgctggcaggggttggcgcagccggttcaggtggtctggcgtcaggcgccactgtgtgtcaatcacttcacaccggccacggccgacgatatcccggctcagttatcagcccacaccgatccgcgtcggcaccgtctcgacctgagccgtgcaccgctgttcaccgctgacatcgcccacgatccggcacaggatgaatggctgctggcgctgcgtttccaccatctggtcagcgaccatatgacactggaactgattttcgcggagattgcccaaattcagcaggggcatgccgagtcgctgcccgccgcactgccctaccgcaactttatcgcccagactctgagcgtaccggccgcagtgcatgaggcctacttccgtgaccaactcgctgacgttgatgcaccgacgacaccgttcggcgtgctcaccctgccgggcaatgatgaacccattgccgaagcccatctcccgctcacccccgctctggcagaagctatccatgcccaggctcgtcgtctgggggtcagtccgggcgtactgttccatgtggcctgggctcaggtactggcgcagaccagcggccgcgacgacgtggtctttggctccgtgctactgggccgtctacaaggggtcgcgggcgctgcccgaatattggggatgtttatcaataccctaccggtgcgggtttctctggccggccacagcgtgcaagaggtggtgcaggccacctatcgcagtctgacaacgctgctggaacacgaacaagcaccgttagcactggcgcaacgctgtagcagtgtgacccaaccgatgcctctgttcagtaccttgcttaattaccgtcacagccagaccagtgaggccaacgcggttgagacgacccgggcagggatgcgcatcgtcgccacagaggaacgaaccaactatccgctcaccctgtcggtcgatgatctgggaaccggtttccgtctgaccgcccagacggtggcgggaatcgatccgacccgcgtcaccgcctatctcgtcacggccatcagcggcttagttgatgccctggcacataacccgcaacgattgatccggaatgtgccgatcttaccgccgacagagcggcaacaactgctggtggggttcaacgccacccagtcggacttcccgcaggacgcgctgatccatcaattgtttgaggctcaggcggcgcaccatcccgatgccaccgccgtggtatttgaaggtcaatcgctgagttatcacgaactgaaccaccgcgccaatcgtctggctcattatttgatcgcgctgggcgtgcgcccggatgatcgggtggcgatttgtgtcgaacgcagtctggagctggtgatcggcttgctcggtatcctcaaggcgggcggcgcctatgtgccgctcgatccggcttatccggccgagcgactggcctatatgcttaatgacgccgcgccggtggccttgctgacccaaacgacacagatcgacaagctgatccatcatatccccacagtggtactcgacgcccaagaatcggctatagcagcacaaccgacccacaatccggacgctcaggcactggggctgatgtcacgccatctggcgtatgtgatctacacctccggctccaccgggctgcccaagggagtgatggtcgagcaccgcagtatcaatcggctggtcatcaataatccctatgcagacatcggttcggacgactgtgttgcccattgtgccaatattgcctttgatgcatcaacatgggagatctggtctgccctgctgaacggcgggcgcctgcatgtagtttcaccatcagcgctgctcgatccggtacgtttccgcgattcgctggtcaaaggacaagtcaccgccctctggttaacggccggcttgtttaacgaatatctcggcgatcttgaacccctgtttggacaattgcgttacctgctcatcggcggcgatgtactcgacccgcggaagatccagcgtgcacagttggctgagtgtcagccggcacacctgatcaacggctatggcccaacggaaaccacgacgtttgccgcaacctatcgtattacctcacccgtcgatgtgactcgtcccattcctatcggctgtccaatcgccaatacccaaatctatctcctcgactcttatggtcaacccgttcccctcggtgtcgccggcgaaatttatattgccggggccggcgttgcccgcggttatctgaaccgccctgaactgactgccgagcgcttcctagccgatccgttctcttcagacccgaacgcccgtatgtacaagaccggcgacctcggctactggcgacccgacggcaatctcgaatacctcggccgcaatgaccttcaggttaaactgctcggcttccgtatcgaactcggtgaaatcgaagcccggctggtgcaatgccacggcgtgcgcgaagccgtggttgtggcccgtgaagacgaaccgggccacaagcgtctggtcgcctatctgctgccacaaaccggcgttgaactggtgccggccgaactgcgccagcagcttgcccaacacctcgccgaatacatgcagcccagcgcctttatgacgctcgacgccttcccgttgacccccaacggcaaactcgaccgtcaggcgctccctgcccccgacctgtctgccatagtgacacgcggctatgaagcgccggtcggtgaaatagaaatcgcactggctcagatctggcaaaacctgctgaaactggaacaggtcggccgacacgaccacttctttgaactcggcggtcactcattgcttgccgtccaactcgccgcacgcgtacgccagcaactggcacagaagctgtcattgcagcaactctttgcccagcccctcctgacggatctggctcagacgctcaccgacgcttcggcaatcgctcaggttgttattcctgctgccaatcgcagccagccgctcgcgctgtccttcgcgcagcagcggttgtggttcctcggccagctcgatcccgccgccagtctggcctaccatattccgatagcactgcgcctcaccggtaaacttgaccgtcacacgctgaccagcgcgctcgatcgtctggtcgcccggcacgaaagcctgcgcacccgatttgtattgatcgaaggccaaccctgccagcacatcgatcccgccgatatcggctttactctgtctttccaagatctgcgcccgttggatctgacggcgcgtgcgaatcgtgtcgccgagcttaccgccttcgaaacccagacacccttcgactttgtgcgggagccgctcattcgcggtcaactgctgcaactgacggacgcggagcatgtattgctgctcacccagcatcacatcatcgctgacggctggtccattggcgtcctgatgcacgaactgggcgcgctctaccgcgccgccctcgacggccacgatgatcccctgccaccgctatctctccagtacgccgactatgccgtctggcagcgtgactggctgcaaggcgctgtcctcactgaacagcgtgatttctggtacagccaactccagaacgccccggctctgctgacactccccaccgaccgaccacgcccgtcggtgcagcgctacgctggcgaccggatacctcttcagctcgataccgccctgctggcatcgcttaaggcgctcggacagcaccatcacaccaccctgtttatgaccttgctgaccgcctggagcatcgtcctcacccggctgagtggtcaggatgatattgttatcggcaccccggtcgctaaccgcccacacacggagttggaaaacctgatcggtttctttgtcaataccctggccttgcgcgtcacaccgggtgaggctccccgtgtggcggatctgctcacgcaggttcgtgaacgggcgcttgctgcctatgcccatcaggatttgcccttcgagcaggtagtggaagcattgcagcccgagcgcagcctgagctacagtccggtcttccaggtgatgctggctttaaacaatactccgtcccaaaacctggcattgcccggtctgcaactcgctcccgttgaacaggtgcgccatagtgctcatttcgatctgacgttatcgctgaccgaaactgaggccggtctggttggtgatctggaatattctaccgacctgttcgactctgcgactgttgagcgtatggtcggttatttggagaatgtgctgacggcgatggctgccgatgcgacacaaactgttgcgggtctaccgatgctgtcggcctcagagcggcgactgttgctgaccgatttcaatgccacccaagcggatttcccgcaggacgccttgatccaccaattattcgaagcccaagcggcacactcccctgatgccaccgccgtggtgtttgaaggtcaatcactgagttatcacaagttgaaccaccgcgccaaccgcctggctcatcatttgatcgcgctgggtgtgcgcccggatgatcgggtggcgatttgtgtcgaacgtagcccggaactggtgataggcttgctcgctatcctcaaggccgggggcgcctatgtgccgctcgatccaacctatccggccgaacggctggcctatatgcttggtgacgccgcaccggtggccctgctgacccagacagcacaggtcgacacgctggtcagccccgtgcctatagtcatgctcgacgcactcgcgccatctctggcagcgcaaccgactcataacccggatgctcaggcactggggctgacatcacgccatctggcgtatgtcatctacacctccggctccaccggacagcccaaaggcgtgatggttgagcatcgcggcctgagcaacctgatcgccactcagcaggacactctggcgatcaatcccgacagccgtatcctgcaatttgcctcaaacagcttcgacgccggtatctgggaatgcggcatggcacttctggcgggcgccagcctccatcttgctcagcgaactcacctcctacctggcactgccctgttggagacgctggagactcatgccattacccatgtgctgctgtcacccaccgcgctggcggcactggattcagtccctgtgacattgcagaccctgatcgtggggggtgaggcctgcccatcttcgctggtcaaacgctgggctgtcggccggcgtatggtcaatgcctatggacccactgaaagtacggtctgtgcggctatttatctgtgcgataaccaagaagaaggcgctccgcctatcggccgtccgatcgccaatacccggatctatattctcgatgcctacgggcaacccgttcctctcggtgtggccggcgaaattcatatcgccggcgccggcactgcccgtggctacctgaaccgacccgaactcacggccgaacgtttcccggccgatcctttttcttccgatccggatgcccgcatgtacaagaccggcgacctcggccgctggcgtcccaacggcaatctcgaatacctcggccgcaatgactttcaggtcaaactgcgcggcttccgtattgagcttggcgaaatcgagacgcaactgatgcaatgtgacggtgtgcgcgaggtggtggtgctggcacgcgaagacgatcccggccacccgcgtctggtcgcttatgtgcagccgctggacggcattgaactggttcccgccgagctgcgtcagcaactcgcccggcatcttgccgagtacatgctgcccagcgcctttatgacgctcgacgctttcccgctcacccccaacggcaaactcgaccgccaagcgctccccgcccccgacgcgtccgccgtagtcgcacgcggctatgaagccccggtcggtgaagcggaaaccatcctggcgcaaatctggcaagacttgctggggctggaacgggtcggccgtcacgaccacttctttgaactcggcggccattcactgatgatcgtcagtctgatcgagcggctacgcggcttcgggcggcggcttgaagttcgtagtgtgttctccgcccccgttcttgctgaaatggcgcagtccacccaggataataccaacgcctttgtcgtgccgcccaaccgtatccccgaaaattgcaccgcccttacccccgacatgctgtccctcgtctcgctgtcccaggctgagattgagactatcatcgaggcaactcccggcggagcgggcaatgtgcaggatatctatccgctggcaccgttgcaggagggtatcctgttccatcacctgttgcagactcaaggcgatacttatctgttgcagagcctgctcgcctttgacagccgcgagcatctcgataccttcctggttgccctgcaacaagtcatcgaccgccacgatattctgcgcaccgctgcctgttggcagggactcgcgcagccggttcaggtggtctggcgtcaggcgccgctgtatgttaatcactttacgccggccacggcagacaatgtcccggctcagctattaactcacaccgatccacgccggcatcgtctcgacctgagccgtgcgccattattcgctgccgatatcgcccacgatccggcacaggatgaatggctgctggcactgcgcttccaccatctggtcagcgaccacatgacgctggagttgattttcgctgaaattgcccaagttcaacaggggcatgccgagtcgctgcccgccgcactgccctaccgcaactttatcgctcagaccctgagtgtgccggccgcagtgcacgagacctacttccgtacccaactcgctgacgttgacacaccgacggcgccgtttggcgtgctcacgatgccgggcgataacgaatccatcgccgaagcccgtctcccgctcacccccgctctggcagaggccatccgcgttcaggcgcgccgtctgcgggtcagtccgggcgtgctgttccatgtggcctgggctcaggtgttggcacagaccagcggccatgacgatgtcgtcttcggctctgtgctgctgggtcgtctacagggggtcgcgggcgctgaccaaatattggggatgtttatcaataccctgccggtacgggtttctctggccggccgtagtgtgcaggaagtggtacaggccacctatcgcagcctgacgacgctgctggagcacgaacaggctccgttggcactggcacaacgttgcagcggcgtggcgcaatcactaccactgttcagtaccttgcttaattaccgtcacagccaaaccagcggggcagacgccgttgatataccccgaacaggtatgcgtatcgtcgccacaggggagcggactaactatccgctcaccctgtcggtggatgatctgggaaccggtttccatctgaccgctctgaccatggccgggatcgatccggctcgcgtaaccgcctatctggttaccgccatcagcggcctagtcgatgccctggcccgcgacccgcaacaattgctccgggatgtgccgatcttaccgccgttagaacggcaacaactactgctagagttcaacgccacccagacggattttccgcaggatgcgctgatccaccaattgtttgaggctcaggcggtgcaccatcccgacgccatcgccgtggtgtttgaaggtcaatcgctgagttatcacgaactgaaccaccgtgctaaccgcctggctcatcatctgctcgccttgggtgtgcgtccggatgatcgggtggcgatttgtgtcgaacgtagcctggatctggtcgtgggtctgctcggtattctcaaggccggcggcgcctatgtgcccctcgatccggcttatccggccgagcgactggcgtatatgcttgacgacgcagcaccggtggccttgctgatccaaacagcattgaccgacacactggccagcgccatacccacgatcgtactcgacggctcagaaccgctcctgatgacgcaaccgactcacaatccggacgcgcaagcgctgggtctgacgtcacgccatctggcgtatgtcatctacacctccggctcgaccggtttacccaagggggtgatggtcgagcatcgcggcctgagcaatctgatcgccactcagcaggacactctggcaatcaagcccagcagccgtatcctgcaatttgcctcaaacagcttcgacgccggtatctgggaatgcagcatggcacttctggccggtgccagcctccatcttgcccagcgaactcacctcctgccgggtgctgccctgttgaatactctggagacccatgccattacccatgtgctgctgtcgccaaccgcgttggcggcactggattcagtaccagtaacactgcaaaccctgatcgtaggcggtgaggcctgctcaccctcattggtcaaacgctgggctactggtcggcgtatggtcaatgcctatggaccgacggaaagtacggtctgtgcggccatttatctgtgtgatagccagcaagaaggagcaccgcctatcggccgtccgatcgccaacactcaaatctatctccttgatcatgacggccagcccgttcctctcggtgtcgccggcgaaatctatattgccggcgccggtatcgcccgtggctacctgaaccgacccgaactgactgccgaacgtttccttgctgatccgttctcctcagccccggacgcccgcatgtataagaccggcgacctcggccgctggcgttccgacggcaatcttgaatacctcggccgcaatgactttcaggttaaactgcgtggcttccgtatcgaactgggcgaaattgaagcgcgattaatgcaatgccccggcgtgcgcgaagccgtggtactggcgcgcgaagatgaatccggtcacaagcgactgatcgcctatttgctgccccagaccggcattgaactggtgtcggccgaactacgtcaacaactcgctcagtacctcgccgagtatatgctgcccagcgcctttatggtgctcgacgccttcccgctcacccccaacggtaaacttgaccgtcaggcacttcctgcccccgacgcgtccgccgtggtgacacgcggctatgaagccccgctcggtgaaatagaaatcgcgctggctcagatttggcaagacttgctgagactggaacagatcggccgtcacgaccatttctttgaactcggcggccattcgctgcttgccgtccaactggtggcacgcgtacgtcaggatctggcgcaggagttaccgctacagcaactgtttgacctgcctcttctggtggatttggctcaggcactcagcgggactttggcaaccgctcaggtcgtcatccccgccgccgatcgcagtcggctgctaccgttatctttcgcccagcagcggctgtggttccttggtcagctcgatccggccgccagtctagcctaccatatcccggtagccctgcgcctcaccggccaacttgaccgccacgcgctgaccaccgcgctcaatcgtctggtcgcccggcatgaaagcctgcgtacccgctttgtcctagtcgagggccaaccctaccagcatatcgatcccgctgacatcggctttgccctgtcctgtcaggatctgcgcctgctggaacccgcggcacacaccaaccgtatcgccgatctcgctgcccgcgaagcgcaggcaccctttgactttatccaaggaccattgattcgcggtcaactgcttcaattgacagatgaagcgcatatgttgctgcttacccagcaccacatcatctctgacggctggtccatcggggtgttggtgcatgaattgggcaccctctaccgcgccgctctcgacggccacggtgatcccctgccgccgctgtctctccagtacgccgactatgccatttggcagcgcgaccggctgcaagcaacggccctcactgagcagcgtgacttctggtacgctcagctccagaacgccccggccttgctggtactccccaccgaccggccacgcccacccgtgcagacctatgtcggcggccgggtgtctttccagctcgataccgccttgttgacatcactcaaggggcttggacaacgccataacaccactctgtttatgactgtgctcactgcctggagcatcgtcctcacccggctcagtggtcaggatgatattgttatcggtaccccggtcgccaaccgcccacactcagagttggaaaacctgatcggtttcttcgtcaatactctggccgtgcgcgtcacgccgggtaatgcgcctcgtgtggccgatctgctcgcgcaggtccgtgagcgggcgcttagcgcctatgcccatcaggatttgccttttgagcaggtggtggaagcgcttcagccggaacgcagcctgagctacagcccggtctttcaggtgatgctggtcttaaacaacatgccggctgagaatctcgtattacccgatctgcaactttcttgggttgaacaggcacaccatagcgcgcacttcgacctgacgttgtcgctgactgaaaccgaggcgggtctggcgggtgatctgatctatgccgccgatctgttcgaccccgcgaccgttgaacgcatggtcggctatctggaaaatgtactggcggcgatggcagccgatgcgacacaaactgttgcgggtctactgatgctgccggcctcggagcggcaacagctgctggtgaacttcaacgccacccaagcggacttcccgcaggacgctttgattcaccaactgttcgaggctcaggcggcacacagccctgacgcaacggccgtagtatgtggggagcaagcgctcagctatgacgaactgaaccgccgcgccaatcgcctggctcatcatctgctcgcccaaggcgtacacccggacgatcgggtggcgatttgtctggaacgcagcccggagatggtggtgggcctgctcgctattctcaaagcaggcggcgcttatgtgccgctcgatccggcttatccggccgaacggctggcgtatatgctcgatgacgcggctccagtggtcttactcacccagacgacgtggatcgacacactggccagccccgtgcccacggtggtgctcgacgcccaagacacgtctctaatagcgcaaccggatcataatccggatacacaggcactggggctgacgtcacgccatctggcctatgtgatctatacctcaggctccaccggactgcccaaaggggtggcgatcactcaccgcaataccgtgaatttcctcacttgggcgcaacggactttcagcccggaggagttggcgcataccctttttgccacctcacttaattttgatctggcggtgtacgaatgctttacaccgctgctctctggcggcacggttcaccttgtccccaatgtgctgtcattgcttacgacagaacagccggtcagcctgatcaacacagtgccgtcggccatcgcacacttgattgaatctgatgcgatccccatgaccacccggacggtcaatttggccggcgaggcattgaaaccgcacgtcattgagcatttgtttgcccgtgaatccatacagaatgtgtgtaatctgtatggtccctctgagacgacgacctattcaacctggatacggatgagccgggcggagggctttgtcagtcatatcggccgcccgatcgccaatacccagatctatattctcgactcgctgggtcatcctgttcccctcggtgtgaccggcgaaattcatatcgccggcgccggcgttgcccgcggctacctgaaccgccccgaactgactgccgaacatttccttgccgatccgttctccgccgatccggacgctcgtatgtacaagaccggcgacctcggccgctggcgctccgatggcaatctcgactatctcggccgcaatgactttcaggtcaaactgcgcggcttccgcattgagctgggcgaaatcgaggcgcaactgatgcaatgtcacggcgtgcgcgaggcggtggtactggcacgcgaagacgagccaggggagaagcgcctgattgcctatcttcggcctctggacggcgttgaactggttcccgccgaactgcgtcagcaactcgcccggcacctcgctgagtacatgctgcccagcgcctttatgacacttgaggccttcccgctcacccccaacggcaagctcgaccgtcaggcacttcctgcccccgacgcgtccgccgtggtcgcacacggctacgaaaccccggtcggtgaggcggaagccattctggcgcagatttggcaagacctgttggggctggagcaaatcggccgtcacgaccacttctttgaactcggcggccattctctgatgatcgtcagtctgatcgagcggctacgcggcttcggctggtggcttgacgtccgtagtgtgttcgccgcccccgtcctcgccgaaatggcgcaggctattcagggtgacgccagcgcctttgtggtgccacccaaccgtattcccgaaaattgcactatcctcactcccgacatgctgtctctggtctcgctgtctcaggctgagatcaatgccatcgtcgaggcaactcccgacggagcgagcaatgtgcaggatatttatccactggcaccgttgcaggaaggtattctgttccatcacctgttgcagactcaaggggatacttatctgttgcagagcctgctcgcctttaacagccgcgagcatcttgatactttcctaaccgccctgcaacaggtcatcgaccgccacgatatcctgcgcacggctgcctgctggcaaggtctggcgcagccggttcaggtggtctggcgtcaggcgccactgtgtgtcaatcgcttcaccccagccacggcggatgatatcccggctcagttatcagcacacaccgatccgcgccaacatcgtctcgacctgagccgcgcgccgctgttcaccgctgacatcgcccacgatccggcacaggatgaatggctgctggctctgcgcttccaccatctggtcagcgaccatatgacgctggaactcattttcgctgaaattgcccaaatccagcaggggcaagccgaatcgctgcccgccgcattgccctatcgcaactttatcgcccagaccctgagcgtgccggccgcagtacatgaggactatttccgcgcccagcttgctgacatcgacgcaccgacggcaccgttcggcgtactcacgataccgagcgatagcgaatccatcaccgaagccggtctctcgctcactcccgctctggcggaggccatccgtgccgcagcccgtctcatgggcgtcagtccgggcgtgctgttccatgtggcctgggcccaagtactggcacagaccagcggtcacgacgatgtcgtctttggctccgtgctgctgggtcgcttgcaagggggcgctggtgccgaccgaatactgggtatgtttatcaataccttgccagtgcgagtctctctggctggtcgcagtgtacgggaagtagtacaagccacctaccgcgatttgatgacgctactggagcacgagcaggcaccgttggcgctggcacaacgctgtagtggcatggcgcagtcgataccgctgttcagtgctttgctcaattatcgtcacagccagaccagcgagtccgacgcggttgagacgagccgggcaggtatgcgcatcgtcgccacagaggagcggaccaactatccgctcatcctgtcggtcgatgatctgggaaccggtttccatctgactgctcaggccgtggccggaattgatccgacccgcgtaaccgcctatctggttaccgccatcagtggtctggtcgatgccctggttcgcgacccgcaacagttgatccgaaatgtgcccatcttgccgtcattagagcggcaacaactgctggtgaacttcaatgcgactcaggcggaattcccacaggacgcgctgatccaccaattgttcgaagttcaggcggcgcgttatcccgatgctatcgccgtggtgtttgaggatcagggactgagctatggcgagctgaaccgccgcgccaatcgcctggctcatcatctgatcactttgggcgtacgtccggatgatcgggtggcgatttgtctggaacgcagcttagaactggtggtcggcctgctcggtattctcaagtcaggcggtgcctacgtgccactggatccaacctatccggccgaacggctggcctatatgctcgatgacgccgcaccggtggccttgctgacccaaacgatacaagtcgataagttggctcattccatccccacagtgatactcgacggccaggaaccggctatggcagtacaaccgacccacaatccggatgctcaggcactgggtctgacgtcacgccatctggcctatgtgatctacacctccggctccaccggattacccaagggggtgatggtcgagcaccgcaatgtcctgcgcctgattatcaataatggttttgccgatattggccccgatgactgtattgctcattgcgccaatgtttcattcgatgcggccacctgggaggtgtggacgggcttagtgcatggtgcacgtatcctgttgatcccggaaaaaaccttactacaacccgactattttggtcagcgcttagcattggaaggcgtcagtgcgcttttcctcacaactgcattgttcaatcaatacgcgagtttgattgcctcatcattgtcgggtttacgttatgtccttttcggcggtgaacagatcgatatccgtcctgcgatccaccttagagctgattatccgccacagcatctgctgcatgtgtatgggccaacagagaccaccaccttcgccacctcctatgaaattccattcactgacagcgaatgtaagacaattcccatcggccacccgattgctaatacccagatctatattctggatacacaagggcagcctgttcctctcggtgtcaccggcgaaattcatatcgcgggtgccggtgtcgcccgcggctacctgaaccgccccgaactcactgccgagcgcttccttaccgatccgttctcttcagaccttgacgctcgtatgtacaagaccggcgacctcggctactggcgacccgacggcaatatcgaatacctcggccgcaatgatcttcaggttaaactgcgtggcttccgtatcgagctcggtgaaatcgaagcccggctggtgcaatgtcacggggtacgcgaggcggtggttctggcgcgtgaagacgaaccgggtcacaagcgcctgatcgcctatctactacctcaggcaggcgttgaactggtgccggctgaactgcgtcagcaactcgcccggcacatcgccgagtatatgctgcccagcgcttttatgacgctcgacgctttcccgctcactcccaacggcaaaatcgaccgtccggcattcccggtacctgatcagtccgccatcgtgatgcgcggctatgccgacccgatcggcgagacggaaaccgctctggcgcagatctggcaagacctgctgggactggagcaggtcggccgtcacgaccatttctttgaactcggcggccattcgctgcttgccgtccaactggtggcacgcgtgcgccaagatctggcgcgggagttgcctctacagcaactgtttgacctgcccatcctgacggatttggctcaggcactcagcggagcggcgacaaccgctcaggtcgttattcccacagccgatcgcaaccggctgctgccgttgtctttcgcccagcagcgattgtggttcctgggtcagctcgatcccgccgccaatctggcttaccatatcccggtagcgctgcgcctcaccggccagcttgaccgccacgcgctgaccactgcactcgagcgcctaattacccggcatgaaaacctgcgcacctgctttgtcctggtcgatggccaaccctgccagcatatcgctcccgccgacatcgactttgccctgccctatcaggatctgcgtccgctggaatccgcggcacacatccaccgtattgccgaactcgccaccttcgaagcacagacgcccttcgattttgctcagggcccacttatccgcagtcaactgctgcaattgacggatgaagcgcatttgttgctacttaccctgcatcacattatcgctgacggctggtccatcggggtgctgatgtacgaactggacgccctctaccgcgccgcccttgacggccacggtgatccgctgctgccactgcccattcagtacgccgactatgctgtttggcagcgtaactggttgcagggaaccgtcctcactgagcagcgcaatttctggtgcgcccagcttcaggacgccccggccttattgacactccccaccgaccggccacgtccgtcggtgcagacctatgccggcggccgggtatccttccagctcgatgccactttgctggcgtcgctcaaggggctaggacaacgccataacaccaccctgtttatgaccgtgctaaccgcttggaatatcgttctcgcccggctcagtggccaggatgatatcgttatcggcactccggtcgctaaccgcccgcacccggagttggaaaacctgatcggtttcttcgtcaataccttagccttacgcgtcacactcagtaacactacccgtgtagacgagttgcttgcgcaggttcgtgagcgggcgctcgccgcttatgcccatcaggatctgccctttgagcaggtggtggaagcgttgcaacccgaacgcaacctgagctacagcccggtcttccaagtgatgctggccttaaacaacacgccggctcaaaacctgacattgcccggtctccagcttgcatcaattgaacagacacaccatagcgcgcacttcgacctgacgttgtcgctgactgaaaccgaatcaggtctggcgggtgacttagaatatgccgccgatttattcgactctgcgaccgttgagcgcatggtcggctatctggagagtgtgctggcggcaatggcagccgatgcgacgcagaccattgcaattctgccgatgctgtcggccccggaacggcaacagcttctggtggacttcaacaccacccagacggacttcccgcaggacgcgctgatccatcaactgttcgaggctcaggcggcgcagcgtcccgacgccaccgccgtggtgtttgaggatcaggtgctcagctatggcgaactgaaccaccgcgccaatcgcctggctcatcatttgatcgccttgggcgtacgtccggacgatccggtggcaatttgtctggaacgcagtttggaattggtggtgggattactcgctatcctgaaggcaggcggcgcctatgtgccgctcgatccggcctacccgaccgagcgactggcgtatatgctcaatgatgccgcgccggtagtcttactcactcaggcggcacaggtcgatacactggccagccctgtgcctacggtcatactcgatgcccaagacccgtccctgatggcgcaaccggctcataatccggatactcaggcactggggctgatggcacgtcatctggcgtatgtcatctacacctccggctcgaccggattacccaaaggggtgatggtcgagcaccgcaatgtccttcgcctgattatcaataatggttttgccgacattggacccgatgactgtattgcccattgtgccaatattgcgtttgacgcatcaacatgggaaatctggtctgccctgctgaacgggggacgtttgcatgtggtttcaccctcagtactactcgatccggtacgtttctgcgattcgctggtcaagggacaagttaccgccctctggttgacggccggtctgtttaacgaatatctcagcgatctcaagcccctgtttggtcaattacgctacctgctcatcggcggcgatgtactcgacccgcggaagatacgacgtgcacagttggcggaatctcagccgacacacctgattaacggctatggtccaacggaaaccaccacatttgcggcaacctacgccattgcctcccccgtcgatgtgactcgctccattcctattggccgtccgatcgccaacacgcagatctatattcttgacccacaggggcagcccgttcctctcggcgtggccggcgagatccatattgccggtgccggggttgcccgcagctacctgaaccgtcctgaactgactgccgaacgcttccctgccgatccgttctccgctgatccagatgcccgcatgtacagaaccggcgacctcggccgctggcgccccgacggcaacatcgactatctcggccgcaatgattttcaggttaaactacgcggcttccgcattgagcttggcgaaatcgaagcccgactcacgcaatgtcgcggagtgagcgaagcggtggtgctggcacgtgaagacgaaccgggccagaagcgcctgatcgcctatgtgctgccacagaccggcattgaactggttcccgccgaactgcgtcagcaacttgcccggcacctcgccgagtatatgttgcccagtgcctttatggtgcttgatgctttcccgctcaccctcaatggcaaacttgaccgtcaggcactccccgcccctgattcatccgctgtgatcacacgcggctatgaagctccggtcggcgaggcggaaaccgctctggcgcagatctggcaagacctgttggggctggagcgggtcggccgttacgaccacttctttgaactcggcggccactcgctgatgatcgtcagtctgatcgaacggctacgtgaccttgattggcgactcgatgtccgcagtgtgttcgccgcccccgtccttgccgaaatggcacaggctattcaggacgactccgacacctttgtcgtaccgcctaaccgtattcctaagggctgcactgccctcacccccgacatgctgcccttggtctccctgtctcaggccgaaattgagtccatcgtcgggacgatccccggtggggcgagcaacgtgcaggatatctatccactggcgccgttgcaggagggtatcctgttccatcacctgctacaggcacaaggcgatacctatctgttgcagagtctgattgctttcgacacccgcgaacgtcttgataccttcctggctgccctgcaacaggttatcgaccgccacgatatcctgcgtaccgctgcctgctggcaagatctcacaaaaccggttcaggtggtctggcgtcaggcgccgctggggatcaatctcttcaccccggctacggcggacgacgttccagcccagttacgcgcccacactgatccgcatctgcaccgcctcaacctgaatcgtgcaccgctgttcgccgccgatatcgcccacgatccggcacaggatgaatggctgctggctctgcgcttccaccatctggtcagcgaccatatgacgctggaactgattttcactgagattgcccaaatccagcaggggcatgccgagtcgctgcccgccgcactgccctaccgcaattttatcgcccagaccctgaacgtgccggcgacagcacatgaggcctatttccgtacccagctcgctgatgtcgatgcgccgacggcgccgtttggcgtgctcacgatgccaggcgatagccagcctgttgccgaagcccgtctcccgctcgctcccgccttggcggagaccatccgcgtccaggcccggcgtctgggggtcagtccgagcgtgctgttccatgtggcctgggctcaggtgctggctcagaccagcggccgcgatgacgtggtctttggctccgtgctgctgggtcgcttgcaaggggtcgcgggcgctgatcgcatactggggatgtttattaataccctgccaatgcgggtttctctggccgaccgcagcgtacaggaagtggttcaggccacctatcgcagtctgacggcgctgctggagcacgagcaggcaccgttagcgctggcacaacgctgtagtggcgtagcccagccgatgccgctgttcagtgccttgcttaattaccgtcatagtcaaatcgacaaggccgacgcaattgacacggcctgggcaggcatgcgcatcgtggcaatcgaagagcgaactaactacccgctcaccctgtcggtggatgatctgggggtcggtttccatctgaccgtccagaccgtggccggaatcgatccggttcgcgtaaccgcttatctggccaccgccatcaacggtctggtcgatgccctggttcgcgacccgcaacagccaatcctgcaagtctccatcctgccagcctctgagcggcaacaaattgtggtggattttaacgccacccaggcagacttcccgcaggacacgctgatccaccagctgttcgaagctcaggcagcgcacaatcccgccgccaccgccgtggtatgcggggaacaagcgctcagttatggcgaactgaaccgccgcgccaatcgtctggctcatcacctgattgcgctggggctacgtccggatgatcgggtggcgatttgcgttgaacgcagcccggaaatgatggtcggtttattgggtatcctcaaagcaggcggtgcctatgtgccactcgatccggcttatccgaccgaacgactggcgtatatgattgatgacgcggcacctgtggccttactcacccagatggcgtggatcgatacactgtccagccccgtgcctacggtggtgctcgacggccaggaatcggctatagcagcacagccaacccacaatccggaaccgcagaagctggggttaacgtcacaccatctggcgtatgtgatctacacttccggctccaccggcctgcccaaaggggtggcgatcactcaccgcaataccgtgaatttcctcatctggacgcagcggactttcagcccggaggaattggcgcataccctttttgctacctcgcttaattttgatttggcggtgtacgaatgctttgcaccgctgctctccggcggcacagttcatctcgttcctgatgtgctgtcactgatcaccaccgagcagccggtcagcctgatcaacacggtgccgtcagccatcgcacacttgatcgaagccaaggcagttcccataaccgcccggacggtcaatctggccggtgaagcattgaaaccgcacgtcattgaacatttgtttgcccactcatccgtacaggatgtgtgcaatctgtatggtccttctgagacaacaacttattcaacctggatacggatgaaccgggcggagggctttgtcaatcatatcggccgcccgatcgccaacacgcagatctatattctcaactcgctgggtcagcccgttcctcttggtgtagccggcgaaatccatatcgccggtgccggtgttgcccgcggctacctgaaccgacctgaactgactgccgaacgtttcctcgccgatccgttctcctccgatccggatgcccgcatgtacaagaccggcgacctcggccgctggcgtcccgacagcaacatcgactatctcggccgcaatgattttcagatcaaactgcgcggcttccgtatcgaactcggtgagatcgagacccaactgatgcaatgtcacggcgtgcgcgaagcaatagttctgacacgtgaagacgaaccgggccacaagcgtctaatcgcctatgtgcggcctcaggacggtgttgaactggttcccgctgaactacgccaacagctcgcccagcatctcgctgagtacatgctacccagcgcctttatgacgctcgacgccttcccgctgacccccaacggcaaactcgaccgtcaggcgctccctgcccccgatgcgtccgccgtggtggcacgcggctatgaatccccacagggaagaatagaaacggccctggcgcagatctggcaaaacctgctggagctggtacgcatcggccgtcacgaccacttctttgaactcggcggtcactcactgatggtcgtgcaattgataacacgtataaaagccaaattcctggtcgatatccccctcacttcgttgttcctttcccccaaattagcggaacaggccaacatcatcttttcagcgcaaatgaatgcggtcggggaaaacgatattgaatcgatacaaaactcgcttgatttaatgtcaacagaagaattgctggcaatgttagacggggacaataaccgcggagacaataaccaatga

SEQ ID NO: 4898 - DNA, 129 bp, Xenorhabdus bovienii
  Coding DNA location: Contig name=SeqID_16900; Position on contig =100640..100768bp; Strand=-
atgttattttgttataattttattaaatataatcatagtgatataccttttttcattctctgttgttgctgtaataaagctgattttataaataccttaatgttattaaataattgccacatatactga

SEQ ID NO: 4899 - DNA, 108 bp, Xenorhabdus bovienii
  Coding DNA location: Contig name=SeqID_16900; Position on contig =101050..101157bp; Strand=-
atgattattattaataatcatattttagtttgtgatttaaatcacgcgtcgttatatagatatataatttttagttataatgaaataattataaccatactattttag

SEQ ID NO: 4900 - DNA, 873 bp, Xenorhabdus bovienii
  Coding DNA location: Contig name=SeqID_16900; Position on contig =101137..102009bp; Strand=+
atgattattaataataatcattgtcctcttattaataatttaaaatggaaggttgtaatgtctgatattattgtaacccaaagtaatgaagaaaaaatgtggtgggaagaagatgctggtttctttgggaaactatataaagaagcggatgattcaacgcagactttttttgaaggagaaaataatttagtacaaagaacaaataaagaggttgacggagttatcaatttatgtagtcttaaatcagggcagtatcttatcgattgtccctgtggatatggaaggcacagtgttgctcttagagaaaagggtatcaatgttatcggaatagatgttaatgaagaacacttatctattgcacgtaggcatgcagaagtacagaattcagatgtgattttcaaaaaagatgatatgcgtacattcaaagtggaaaggcaagtggatgcgctaataaatatgttttattcttttggatttttttccgatgaagaaaatgttaatgccgcaaggaatttttatgatgcattgaaaaagggcggtaaattccttatgcacaccatgataacagttcctgcattcggagatggtagaattccgttggaagaaaaaagaaaattgcaatcagggagaaccttagtttcaaaacgaagatttaatcatataacaaaaagagaagaggggatatggtctttattaaacgaaaataatgaagagatttctttgagaccatatgatgtgagaatttatactgatattgaattcaaagaactttgtcttgaagctggattttctaaagtcgaattatatggggattgggatggttctccatacaatgataattcaacttatttaattgtggttgctgaaaaatag

SEQ ID NO: 4901 - DNA, 138 bp, Xenorhabdus bovienii
  Coding DNA location: Contig name=SeqID_16900; Position on contig =102052..102189bp; Strand=+
atgatatatgtaaaatcagttaccctcattgacaaatttaagttttttgcggcgttgatgatgtttttttatcatatttcatctgaaaaatattcagtacgaatattcaaaatgaaatttacaaaaaatattttctaa

SEQ ID NO: 4902 - DNA, 96 bp, Xenorhabdus bovienii
  Coding DNA location: Contig name=SeqID_16900; Position on contig =102307..102402bp; Strand=+
atgatgaaaatagatattgtcccagccagtcataacgaacagttcggttataacgttcgatataagtattctgctagggctttcccggctgaataa

SEQ ID NO: 4903 - DNA, 261 bp, Xenorhabdus bovienii
  Coding DNA location: Contig name=SeqID_16900; Position on contig =102380..102640bp; Strand=-
ttgaatgcaaaacaaaaaacacgctttactgacagtcagatcttagccatcttgaaacaggctgaagcgggaacccctgttcctgaactttgtcgatggaataattaccgagcagtcgtgttaaacgaacgttggaaccgctcattgaatggggaggaaaataggtttcaatccgatgtgacactggcccggaatacaccagccatgaatttcaggagtggacgaaggaacattaattttattcagccgggaaagccctag

SEQ ID NO: 4904 - DNA, 3105 bp, Xenorhabdus bovienii
  Coding DNA location: Contig name=SeqID_16900; Position on contig =102932..106036bp; Strand=+
atgctattggtgataggaaataatatgaaaaagaaacttttatttgaagttatttcagagatagcatctaaaaatcctgaaaatattgctgtcaatttttgtggtaatacactgatttatagtcaattagaacagcaatctgacttattagcacattatttattatcaaaatatccaatgcatcgcaaagggaagatagcaatctatattgaacctggcctgatattgccagtggctttgttagctattttgaaagccggtttttcatacgtgccgatttcccatttttacccagtagaaagaatggcaaaaattttagatgactcttctgcttttttgttactctctacgcggtcgattattaataaaagagggctagacacgtggtttcactcagtgctcgctttagaagatattgacttctcagccccaacaaatacaggatgtttaccgaccgtatttagcaatgatttagcttatattttatatacctctggatctacagggatacctaaaggtgtcgccatagagcactgtaacttgagctattatgtagattggtttaatcaggatctttggtctcaaacgcaagcactattaccattaacgtcttcgcttagttttgctgctgcggtagcacagttatatgcaccattattgcgtggggacaccttgcatatcctgccagctgatagcttgtatgagcctgaagttttattcaactggtatcagcagtactctaatggagcgatttattgtgttcctaccatctgggatgaactactgaattatataattaatacgaataattcaattaccctccctaaagtggtctttctttctggtgaacctgtttcttgtgatttaaaagaacgtacttttcagcagctccctggcgtaagaatatttaatctctatgggccgacagaaacaacagcgaatggagcattcaccgaattagaaaaagaaaaaccggttactctgggaaaagcgttgcggggtagtgaaattattattgtgaatgacgatttacaatcggttcctgctgggcagagtggtgagatctgtatcatcggtgaaggtgttgcacggggatatgttaatcgtgaatctttgaccaaacagcgctttttcaattatacaacagagtatgttttcagcagaggatatcgtacgggagatttaggaaaagttaattctcaaggtgagatcatctatttaggacgcattgatcgtcaaatgaagattaatggtgtgcgaattgaacccgctgagatagagaaggttttacgtcaatttcctaacattaataaagcattggtctgtttattgagtgaaaaaacagaccagccgtatttggtcgcataccttgtcagtcaagaaaagcacatctcaatcagcgaaattagactgttcttgcggaagaaactaccggatgtgatggttccatctcactatctctttattgaaactttacctaaattacctaacggcaagctggatatcaatcgattaccattaccttgcccagttcgaccagagttaggatacccttgtgttaaagccgtcagcaatttgcaacaagatctaatcgatatttggcaggaggcattggggtttcgggagctaggtatccatgataatttttttgatttaggcgggaattctttacaagccattcaggtgagacagataattaagcgtagattgtcttgtgatattaattattctctattttttaataatgcaacccctcacttattatcttttattattcctgattacatcaatgataaggttgctgatgttagtgaagacgaaatactagatggagacaattgcttattatctgatgaacaaaattattttttgatgttagatcaaatcagcccagatcccacatcctattatattaatttctatctaattattaatggagagctaaacaattcagcaatcgaatggagcctaaagcgtattttggaatgtaattcagtgctacagagtcgttttgatcttgatgaattttctcgtattgaagaaaattatcctgtagagatgatacaaatattgcaacaggtctacacccgttctctggatttaattgacgaaatgaacattaaacatttactggattttgttgatttcccagaggtagatttagaacagactctacctatttcttttaaattactttctttggaaaaacaaaaaaatatattattagtcagtgtgcatcatgtcgtttttgatcatgattctattaatttgttttttaatcagtttattaattatatgcgagcctatatagccggggattttcattataaattaggaaatggaatacaatatcagcgatattgtcaatggcaaaaaaaaataaaacccatacgttatcagcaagagcagaaattttgggtgaagacgatggaagattaccttcttgctggtgcagatgcatctgaatttagaacgattgaagaggtaaaaggtgagaaccactggttttccatatcagtagaattaaccttggctctgacgcaatttgcaaaaaaacggaaaactaccctttttatttgtatgttgaccgcatttaacaagttacttaaatgtacccttcgttataaaaatagcgctattggtattccggtgtctaatcggatgctatatgaagacatctcactattaggttgttttgttaacatggtgacttattatgatgttataaatcctcacgatagtttcaggactatgttgttacgttgtcaacagaaaatgaatactatcctggataacccaatgtttccttataatgaattaatcaatgaagtacgcgctaaaggatggagtgagaagttacgtttccctgtttgttttaactacctatcgtcaatgcctgaaagaatatatttagatagttgtgaataccaaatcggctatattatgaataaacaagccagattcgaactgacactttctgtcaatgaagggaaatctttttcgctctgttttaactacgctaagaatgtatttaacatagatgaaataaaagagttatctgaaaaatatcactctttattatcggaaatgatatttgatgagtaa

SEQ ID NO: 4905 - DNA, 1788 bp, Xenorhabdus bovienii
  Coding DNA location: Contig name=SeqID_16900; Position on contig =106096..107883bp; Strand=+
atggcatctgaaaaaattattcattctaaggtcttactgcaaaccaataagacacccgatttaattgcgcttaggtgtgatgaaagtataataacgtatcaacaattagaacaacgttctaatgcattagctgattatttaattaaacatggcgtaaaacccggtaatattgttggtgtttatattaataaaggaattgatttggtaatcagtttgttaggaatattgaaagcaggaggatgttacttaccattagacccctattatcctcatgaacgcttgacatatatgattagtcattctaaaacagcatttattattactgataatgaacaaatattaacgttgtttcaatgcgactgtaattttattaatattaaaacactcaatttaacgctcaataatcaactgacactccctaaggtgaatgatgaccatctgtgttatgtcatgtacacatctggatcaacaggagtccctaaaggtgtgatggtgagtcaccggactgttgttaattatttggaatggatgcaaagcgagtttatcttaaagtatgaggacgtagtgcttaaccaatctacttttagttttgatgtttccgtttgggaaatcttctggccattaattgccggtgcaagctgcgcattaattacagaagagattaaattcgatccatttctaatagcaaaattcattacccgacaccatgtaacagtcgctcagtttgttcctacagcattaaggacaattgccggcgctaatgtattgtcaggctgtccatcgctaaaacatctatttgccggtggagaagtgcttgatcaatccttagttaatgagttaactgagcaatttaaggggcagattcacaacctatatgggccaactgaagcaacaatttttgcttgtcactggtattgccgggcgggagagaaagaaaaaacagtaccgattggtaaagccattccacatgctcgtacctatgtgctgaatgaatattttcaacccgttcccgttggtgagtgtggcgaactttatttagccggagatatcctggctaaagggtatctctacgaggagtcactgacccaaaaatgttttgttaacgactctttttcctgttatagcaaccaaaaaatgtatcgtacgggggatttagtaaaacaatgccctgataatatattggaatttataggcagaatcgatgatcagataaaaatgcgaggatatcgtattgaactgaaagaaatagaaaggcaccttttgtcccacccctatatcactcatgctgctgtagtgattgacgatcccccagaaaataaaaactcatcattatctgcatattatgtattacatcatcaacaatcagttaacgttcaggatataaaaaaatatctattaaaatttttaccttactttatgttaccttcttgttttattgaattagataaaattccggttcacccgaatggaaaaatagacaaatcaaattttagtttatatgtgaatgaaaataataagtattttgttgatgagaattcaaatacaggcattgaggaaataataatttcaatctggaaacctgtactgaacaaccgaaatttttcgaagcaggataatttttttgatattggggggaactctttacttatgtcaaaggtatataggcaaattaagaaaaaattctctgtccctatttcaataatggatttatttcagtacccatcagtacaaatgctgagtaggtatatttgtgaaaagcgtgcgggtattttgagagagaaggaataa

SEQ ID NO: 4906 - DNA, 5493 bp, Xenorhabdus bovienii
  Coding DNA location: Contig name=SeqID_16900; Position on contig =107921..113413bp; Strand=+
atgaaagatcaaaaaaaattgcacgagaaagatattgccattgtgggcatgtcagctcgttttcctggtgctgaagatgtcactctattttggcagaatttattagatggtgttgaaagtatcagcacattcagtgaagaagaattgcgggcatctggcgtagaagaagaagtgttagcctcaccaaattatatacgtcgccgtggtattttaggcaatgccctgcactttgacgctaatttttttgatatcacaccccgagacgcagaaattatggatccgcaacatcgggtctttctagaatgctgttggcatgcgtttgaagatgcgggttatgttcctgatacttatgctggcaaagtcggcgtgtttggtggtacgggtacggcatggcatctgaatacagtgaataaacaccctgatgtgctgaaatataccagcggcgcttcaatcgtcactaataacgacaaagactacgtcacaacgcgtgtttcgtacaaacttaacctgcaagggccgagtattaacgtccagactgcttgttcgacatcgatggtcgctgtggtgatgggcatcaatagtttactgaatagagaaagtgatctggtaattgcagggggcgtttccatcgatatacccgagcgcagaggttacccctatatgcagggcggtatggaatcggctgatggccgctgttatgcatttgactctcgggcgaatggcactgtatttagccgaggtgccggggtcgttgtgttgaaacgactaaaagatgcagtaaatgatggtgatcatatttatgcagtgctgaaaggcggcgcaattaataacgacggaaatacgaaagtcggctataccgcacccagtatccaagggcagatcgcagtggctaaacaagcgattattaacgcgcagatagaaccggtaaccatcagttttgtggaagctcatggcacggcaacgacattgggagacccaatagaatttacttcattgagccaaacttttcgggaattcacagataaaactcagttttgtcgtatggggtcagttaagaccaatattggccacactgatgccgcttctggcatagccagtttgattaaggcttctcttgctctggaaaatgggaagttacccgcttcattacattatatgtcaccgaatccccacattgacttcgagactagcccgtttgtgatgaatactaagctgcatatactggaagcatctgatatacctcatcgtgctttagtgaattcattcggtgtggggggaacgaatgcctgtgttattcttgaaagcgcacctgacacaattcctggtgatccgtatgaaggcctgataatgttgcctttctctgccaaaagtgccgctgcactggaaatgatgaaacagcgtatgtgtgattatctgaaaaatcacgaagagattaatttatctgatgtcgcttataccttacaaattggccgtaaacacttttctcacagcacagtactgataggaaataatcgtaataaattattggagaaacttgaacaaccctccccgataattcacttaccagaaaaatcgtctaagtccgtggtatttatgttcccgggacaaggtaatcaatatataaatatggcccatgatctttatattacctacagtgtgtttagggaaatcatggtttattgttgtcaatatctggagccaattcttgggctgaatctacaatccattattttccagaaagaaaacagttctgaaaaagaacgtatcaatgaaactcaatttactcaacctgcattgttcgttgtggaatatagtctggcgcaattatggatctcttggggcatcaaaccagatgtaatgattggtcacagtgtcggagaatatgttgctgcctgtatttctggcgtgttctcactggaagatgccttaaaggcaatagcattaaggggaaaacttgtacaagggttaccgacaggcagtatgctggcagtactgatggatgagaaggctctgagtgcccaaatacaaggctacaaattggaaattgctgctgtcaattatcccggcctgtgtgtcgtggcaggagagacagacgaaaccgtacgtttccagaagcagttggaagataacaatatattttgcaaaccattggatacttcacatgggttccattcttatatgatggaacccatactccctgcgttcaaagaaatcattgataatattgatttacattcaccacgcattccatttatttcgacggtaactggcgaatggatgacggattcattagctaaagacagtaactactgggtcagacatgtacgtaatcctgtattgttctcccatgcgttcaacacactgataaccaaagacgatccggattttatttttcttgaagtcggccctggtcgttctctggaatcagcggccaggcaacatatcaaatcacagagtggcgttttcatttattcttcgctacccattgcaaaagatattacgacgactggggagtccttgctcatggcattaggtaatttgtgggcttgtggtattaccgttgcttgggagggtttttacaccggaaaacgccgtttacgtctgcctctgccgggttatccttttgaacgcaaggaattcaaattacctgacattaaccataaccagaatggtgctggcacatacgatacccagtcagttaatgcccgtaaacgtaagaaagccgatattggtgattggttctatatcccaaggtggaagcaaactattcctgccaaatttatggaaagtaaatttattaatcctgagacggaatgctggttactgtttgtcgacgaaatgggggttgctgaacatattcaacggcaattaacaaattcggggcataaggtgctgactgtttgtcaggggcatcaataccaagaaaaccacgactcaggaagctatgttatttcaccagaaactcatgggaattatattcttcttttacaaagcattaaggcgcaaggtttacggccaacccgtattgttaatctatggaacctatcaccagagatagtagaaccccagtttctggattattgtgattcattatatataaataccttttacagcccgctttacctacagcaagcattaatcagtgaaaatttgttggaaaatttacatttactgtttgtaacaaacaatattttcagtattactgatgaaaaactctattcaccggaaaaagccttgcttattgggcctgcaagggtgttttatcatgaatatcctgaagtgcagtgtcatctggtggatatagaggtatttagcgatatatcgacagagaatattgcccaatacctgattgcagaaagtcatatcttaactcatggtagtcttgtggcttaccgaggttgtaatcgctgggaagaggattatcaggcaatccacttaacgcaacataatgccgatcagacaatcacactgaaagatgatggcgtgtatcttattacaggaggtttagggggattgggggcattagtggcgggttatttgtctgaaattagcaatgcgacattgatcctgacttatttaacgggtttaccagccagaaatgaatggcaatcttggctgcaatcgcacccgattgacgatccaaccagtaagaagattgctgcgatcttgtctttggaagataacggtaatcaagtgcatcttgctcaggttgatatttgtgattacagcggtatgtgcgatctgttgtcacaattttcacaaattgatggtgtatttcatacagcgggtattgctggtggcggaattatcccactgaaagataaggcagattgtgcccgcgtgttgaaccctaaggtgtctggcagtttaatcttgcatgagcttctgaaagataaacagcctgatttctttattatgttttcctctattacttccattgctggtgatgctggccgtatcgattattgttctggaaatgcatttatggatgcctttgctcactatcgtaaccagtatcataaaggtcgtaccgtttccattaattgggggagatggggagatgtgggaatggcagtgaattggagcaatcagaaaaaagaccgtaaagatacaatacaagaaaaagtcaacagcgagctattggtattagtgaaacgtgaagggttgcaagaaatctacagggttaatcttaccgtagaagattgggtgattaacgaacatcgattaatacagcagcctacattggtgggaacaactgtcctgtccttactgcacgattggataacccactgcaaatcgggcgaaagtttgcaggtaaaaagcctgtttttgacacagccactcatttaccacaatggttggccacgattagtgaacctctttgttatatttgaaaataatagctataaattcagcctgaaaagccggggtgtattagataaacagtggcaagaacatgcattgggcgtgatcggtttaagtgacaatgtttctgatcaggcagcagagtcattggatactatacgcactcgctgtacaaccaaaattccattccatccattaaaagcctatttagatacggttggactcctttctttaagtcatcgttggaataaccatcaggaaatgtttcagggagataataatgaatggttaatacacatagtgctggatcctgcatattcgggtgattttatacgttatcaatatcacccggctatcatcgatgccgcatcgattcgcggtataatcaacgtcaccaaagatgagtttctgcctatcagttacggcaacgtaacctactactcctcattaagcccggattgctatgcgcatgttaaattgaaaggggcttatcaacctcaagatccctctattgtcatggatgttattttcttctcaacagagggtagcccgttgttgaagttggaaaagtatacgcttatcaaactatctccagataatttgtcggcagagtctggttatgtgttgaccaataaggaagatactttacccgtaaaagttaacctagcagataaagatatcctgttttatgaaggacttgatgcgttaaaacgccagtttttacatctggaatttggccagttggttgtggtaaccagtgatattcatcagctgattgatgagtcagtcccagagcataacgataatattgttgaaacgctaagtgagacagaaaggaatatacatactaggcctgcgttatcagtggagtgtgtggagccggaaaatgatattgaaagagaaattgttaagatttggcaattgactctcggtatttatggaatcggtgtagatgataatttcactgagcttggcggtaattctctgttagcggtacaaattatatcggcagtgtctaatgtcttcgaaatcgatattagtgttgatcttttctatcaagatcaaactgtaagaggtttatcagaactgataatttctgaattggaagagttattacgggataaataa

SEQ ID NO: 4907 - DNA, 4074 bp, Xenorhabdus bovienii
  Coding DNA location: Contig name=SeqID_16900; Position on contig =113498..117571bp; Strand=+
atggctaatatcaagcacaccgaactaaagtcattgaaattagatgaattaaaaagattggtcagacagaaaaagataaaagataattcaattccaaaggaaaccattaagaaaaatactgatccggacagaaaatattttcctgtgaccagtgcacaaaaaaatatttggatgcttaaccaatatcttgatgataaaaaagtttatagccttccgttagccattacatgtcaacttaaatatgaggtagatctactgttagttaagcaggcactcacgtatttagctcaaaagcatgatattttgcgtacaactttccacctgacaggaaaggaactatgtcaatatgtctctgatgatgctgtatttgattttcgttatgatgacattacctatttgtcggaaagagataaaaaacgacaagtagaagcaatggctaaagcagaaggaaataggtgctttgatttagccggtggccctttagcctatttgtatattgttagaactaatagtcatgaatacgtatttttactgagcttccaccatattattgctgatggttggacagttgggctgtttttaaaagagtttatagaaacgtatttaagtctgcttagcggagaaataacactgaaggcagaagaaaatctacagttctcagattatgctctggctgaagatcagtggcatgctgaaggaaaatatcaacaagggctggaatactgggctaaaaagctgggtaatgtgcaaggcatactgaatattgcaactgatcgacctcgtccctccaaaatgaatacggcggggaggataatgagtctgttttttgatggtgacttttgccaacgtttgcaaacttgtgcagtacagtataacgcaactcagttccacgttattctggccgcttatgagattttgctgtacaaatatagcgggcaacaggaaatcagtattggtattcctttcgctaatcgtaatcaatctgccacacaaaacataatggggttgttcatgaataccttaccattgtgtttcagaatagatccagaaatcacattatctactttagttcaaataaccgctaaagagtgtgagcagtcgatggtttatcaggatattccattcaaccacattttggataaaattgcttacgtacgtaatccccaagttaatccgatatttcaggcaatcttaacctatcagatattcccacattaccaagcaacctctttatttaaataccaaccactgaaaattgattacggcgtggcaaagctagatttaaacctatgggtagaaaaagaacgcgacggtttgttgtttaccatgaactatagtacggcgctgttcaacggtgacacgatccaacgtatgctggcagatttacgcactatccttgacgcttttatagggcaacccaagttggcagtacgagagttgtcgctattaagccacacggaacgcacaagtttattggctggttgtcaccctacacctgatatttcacccgccgcggtacaccaacagtttgagcagcaagcatgcttaattcccaatgcaatagcggtgcgttgtaccggccgtacactcagttataaacaactcaatcagcaagcgaaccgtttggctcattatttattggagaagggtttatcttgtggagaacgtgtagcgttattaatggcaaaaagtgaagattgtgtcgtggctttgttggcggtgttgaaggcggggggatgttatgtgcctgttgatattaatcttccacagcagcaggttgattttatcctgactaatgcttctgtacgttatgttttggttgaaagtgaagaacgggttacaaacgtaccgtgtatcaacgttaatcaaaaatttaatggcatgccagaaagtaatccacagcgacaggaaccaccggaggatactccagcctatattatttatacttcaggcagtagcagtaagccgaaaggtgtccaagttaaccattcccatttaagtcactactgtcaggcaatcactcctgttcttgatcaacagccaggagcccgatatggcatgttttcatcctttactaccgatttggcacatacgatgttgtttcctgcactggttaaccaagggcaattagagattattcattcacaacatctcagtaatccacaggaactgtttgattatttagcagcgtcaccattggactgtatgaaaattacaccaacacatttggccgcattattgggaacacctgaagcgagcaaactgataccgaaaaatttgctggtattgggcggggaaaaagtgcccgtgtcgttgattcaacctattcgtgaattcaatgcgaattgccgcatcgtcaatcattatggtccgactgaatgcacagtcggagtgacgacatataacttacccgctgaacttgatagattagaaagtgattatcttcctataggtacgccattgacggatagccatgtccttgtgttagatgctaatcaaaaacttgtacccgctaaagtacccggtgaaatttatattggcggtgcgcatttggcggccgggtatattgatcgtacagaaaaaaatagcgattgctttatcccacatccttatcttgctggtgagcgcctctatcgtagcggtgacaaaggacgtctgttgccagacggaaatattgaatttttgggacgcatcgaccgccaagtcaaagttcgtgggtatcgtgttgaattaaccgccattgaagatgtgttacggcagtttcctgaggtgactaatgccgccgtaatccaatctcagtcgcctacaggagcaacatcgctggtggcttatctgtgcggagtaggggaaagatatcaagctaccgtgcaatctgagttacaaaaaaaactaccccattatatgcaaccagaacagtggatctggttggaatctctgccgcttacttttagtggaaaaatcaattataccgcattaccacgcctgagacccgatactcaccagtgtacacaagagctaaaaagtaaaacagaacatcgactacatgatatttattgtacagtcctcgaatgtaacaaggttgatacccagaaaagttttttcagccttggggggaattctattaatgcattacaactgattattgaagtaaatcaccaatttgattcttgtttatcactagggcaactatttgaaaacagcagtattagccaactggcaactttattagaacagactgctccctcgatggcttcgccattagtgatgtttaattatggtcttccagacaataaaccaaccttactgatgatccacccggcagggggtaatattttgtgttatcacccgttagtgcgggaaatgggggctgattatccggcatatggtctacaggtagcaaactttagtcaggatgccccttataaccatgatatcaaatcactggccgaattttatctgactcaatctggaagtcttctccagcgaacaagattggtattagggggatggtcgcttggagcaacgatcgcttttgaaatggctcagcagttagttcagaagacaggggtagcgcctacggtgctggtactggatcaacccgcacctcaagtaaacattgataattcagtacaaatgaataaagacgagagattagtgcgttttgtacgtaaggtggagctgtttctcggtacgtcacttaatatctcctgttcagtgttagcggaaatgtcagaggtacaaagatcagaactattcctgacagaattcaaacgggttcatttagtgccagataatatcagcaacagggaattccagtatttcttagtcattctgcgtgcacatattcatgctacagatcaatatcaagggaaaatctaccctggaaaaattttggtagtagaagcagaagaaactctacccggacgcataaaactggatgagtcaggattaggctggcaaccattgtcttatgatcgtttaaaaatcatcaatgcgatgggcaatcatgtttccatgatgcaagagccctatatcactcatattgctaaccagcttcgggaagttcttccatga

SEQ ID NO: 4908 - DNA, 1587 bp, Xenorhabdus bovienii
  Coding DNA location: Contig name=SeqID_16900; Position on contig =117568..119154bp; Strand=+
atgaggagtgaggttataacaatggggtcagaacgatctcaactgactcgccgtcaatggtgtgctatttctggtgggttaatgggtggttttatggctattttggatattcagatcaccaattcatcaatgaacgtgattcaaggtgcattatccgcgagtctggatgaaagctcatggttgatgacttcatattttacatctgagatcgttgctatcccactatgtggttggctttgtcaggcactgggaaccgggcgctatgctctgtggtgcattagcggatttttaggagcatcactgctttgttcctccgcttggagcctcaattcaatgattgtttttcgttcattacaaggattttgcggtggggcattaattcccatttcattccgtctgattattgaattttttccaccggaaaagcgcccgttaggtatgtcattattcagtatcatcagcacctttgctcctgcggttgggcctgcattaggggggtggttgaccgaaaatttatcctggcacgcgatattttatatcaacgcaatccctgcgttattatcatgggtattaattaactattctctaaaacatcaatcaattaactggaatattattcgatttggtgattttgttggtattatttctatcatgttgtgtttagggacattaatcgtcattttggaaaaagggagtgcggaaaattggcttgaatctgacatgatttgtgtattagccgtgatttctaccattagtttcattatatttctgtatgatcaattgacttatcgttacccactaataaatattaaattatttaaggattactatttttcattttctctcatcatttttgccctgtttggattggcaatttatggtacgttatttctagtgccgtattatctgacaatgacacagagttataatgcctcagaaattggtagggtagtgatttggatgggattgccacaattaattattcttccatttattccttttttgatgcaacgattcaatctaaagtatttgatctgcattggctttgccggattggcgttgagtgcttttatggactgtagtatggatggaaactttgctggatcacagatgagtgggtctatgctgatacgtgctctgggacaaccgtttatcatggttccactttctttgttagcgacccgccatgtacagcaaaaggacagtgcttcctctgccgtcctaataaatgtctttcgtagtttgggtggatcatgtggtactgctatattgaccacatttttcatttcgcgtattaacatccatattgataatattaaaacatcgctactatctagtagcagtgcatttattaattatcttaacaatgttaaaagcctgctgattcagcatggtttggcaactgatactcagagtgtgaaacatacagctatcactatcttgggtcagcggatagcgaggcaagctgaaattatggctttcaacgatctgtttttaatcatgggaggaataatgttggtcacaacgttgttggtattgttttctacccatgacttttacttatatttaactaggaagaaatcataa

SEQ ID NO: 4909 - DNA, 624 bp, Xenorhabdus bovienii
  Coding DNA location: Contig name=SeqID_16900; Position on contig =119154..119777bp; Strand=+
atgaatcaacaaaaaccaatgactatttggcattacttattatcacgtgatgcgctaatgactattattatccccattgtactttacaacatcatattttggataatgggtacaggtattgctgtgttgatggttgcgctttattcggggggcgtgcagttatttagcagacggagaggatctttagctattatcgccctaattatggtttcaggggtgagtcactacctttaccttcatggatatgctttgtttaacattagtaaagaaaatgtctttttatctatcagtggtgctctttctgtcgtggtggtattcagcttttattccttcatggggcaacccgttgtacaaacaatggctgaacaagctatgccgagactgaaggatattcctgcttatggtacagcgttgtatgccagagtttggcatgaagtttccatagtctggattttagtttttttattgaaagctttcggggtctatatgctttcatgtcaaaatagcgtgtctattgatacaattatttttattggtggttggccattaacattgctgatggtaatgtttagtttccgttggccaaaatatcgttggaaatccaatgcccataataaagagtaa

SEQ ID NO: 4910 - DNA, 1002 bp, Xenorhabdus bovienii
  Coding DNA location: Contig name=SeqID_16900; Position on contig =119843..120844bp; Strand=+
atgatgaaatacattagagtaattatcattatttttttatcgttgctagttctttatttatattggtatttttattggcgttattttcagacaacaaataatgcttatgtacagacaaatattacacatattaatgctcgtgtaagttccgtagtattggaatccaatattcaggataaccataaagtaaaaaaaggcgactttttggtacaactggatgagcgtgaatttatgctcaataaacaaaaaacggcggcggcattggaacagaatgaaaatgccttaattaatgcacaagcaagctaccaaatgcagaagaatgtgattgaagaacatcgtagtagtttgatttcggctaaagcaagtctgaaatatgcacgccaacaattagatcgttatcagcttctaaaagaaaaacgttatgtctctcaaagtgatgtggataatgttatctcgaactacaaaattgctgagtctagatatggtgaagcacaggcaaaattaaaaacacaaattagcaaacttgttgtgcaagacagccagctcaaacaagccaaagccaatgtacaacaggcgatggcttcgctaaaccaagcagaacttatgttgagttatacacgaatagctgcacccaatgatggagtgatcagtaaccgtagtgtacaagttggtacgatggtacaagctggacaaggcattgccagcattgtatcgaatcaaacgtcatggatacaagccaactttaaggaaacgcaaatttcacgtatgcataaaggccagccagtaaaagtttctattgatgcttacccggataaaattttccacgcaaaaatagacagtatttcacctgcaacaggggctatttttgccttacttcccccaaataacgcgacaggaaattttacaagggtagtgcagcgattatcggtaaagattgtgtttgaccagtcagaagaaattgatagtgggttatctgctacggtaacggtggatacccgttaa

SEQ ID NO: 4911 - DNA, 291 bp, Xenorhabdus bovienii
  Coding DNA location: Contig name=SeqID_16900; Position on contig =120819..121109bp; Strand=-
gtggtaaagccagcatgtttgattcacatccgccttcacaggagcgtgctcaacacgttcgtgatcgtatcgcagcagacaagaaataataagttctgtacagattgtagcggtgtcagtggcaccgctttttttgtttgcccaacgaagctggcaaacctacaggagggtatggagcagcgaagcatcacgagcatcttcgcccgctttaagcagggcaacaccgaaacgccgctaaggagaatgtcagccggaactaccgacattaacgggtatccaccgttaccgtag

SEQ ID NO: 4912 - DNA, 753 bp, Xenorhabdus bovienii
  Coding DNA location: Contig name=SeqID_16900; Position on contig =121021..121773bp; Strand=-
atgaaaattaaaactcttgttgcagtagcagtttctgctgtaattttgacaggttgtaagaatattgatcaaggaatgctggctaactccggaatgcaattattccaggcggcgacgctaagtgattctgatgtcaaacagttatctgaccaagcatgtaaggatatggatgcacagaataaaactgcaccggcatccagccaatacactaaacgtctgaacaaaatcgccaaagcattaggtagcgaagttaacggtacaccggttaactataaagtttatctgactgatgatgtgaacgcatgggcaatggctaacggttgtgtgcgtgtatacagcggcctgatgaacatgatgaacgacaatgaagtcgaaggcgttctgggccatgaaatgggtcacgttgcactgggtcactcccgtaaagcaatgcagattgcttatgcgacagttgctgcacgtaccgcagctacatcagccggtggtgtagcagcacagctgagcgattctcaatttgcagcactgggtgaaaaactgatcaactcgcagttctcacagcatcaggaaagtcaggctgatgacttctcttatgatctgctgaaaaaacgcagtatcaacactggaggtttagtaaccagcttcgagaaactggctaaactgggcagtggtaaagccagcatgtttgattcacatccgccttcacaggagcgtgctcaacacgttcgtgatcgtatcgcagcagacaagaaataa

SEQ ID NO: 4913 - DNA, 114 bp, Xenorhabdus bovienii
  Coding DNA location: Contig name=SeqID_16900; Position on contig =121775..121888bp; Strand=+
atgttgtttttccctttgccatacaagcaacttttttattttaaaagcattaaaagaccgtggattctgctaaaaataataatagaaataaacctaatatttatgattatgtga

SEQ ID NO: 4914 - DNA, 405 bp, Xenorhabdus bovienii
  Coding DNA location: Contig name=SeqID_16900; Position on contig =122075..122479bp; Strand=-
atgtcaaggatatccagtgaaaaaagtaacaatgactatagaaagtcactttactctgaatatggcgctttatttctcacaaataaagccaaggagattttttcaatcaccacaccctttttatttaatcatttagatgaaaatgagtattttaatggtaactggtgggccaatgacgatgtcacaatacgggattcatggctaaaagatttaccatttttgaaaatcaagaaaaatccatttgtcaatttatatgaaagcggaggtaaagttctttgtcctgctacatatagtggacttttatctcattataacaatgatgatgatcatatagctgtatattcaaggtgtgatgacccgtttgtaggggaaaaggtcataagacagggcgggattccactttaa

SEQ ID NO: 4915 - DNA, 543 bp, Xenorhabdus bovienii
  Coding DNA location: Contig name=SeqID_16900; Position on contig =122344..122886bp; Strand=-
atggaaagaacattccctttactggaaaaacttaggaatagtgttgttgttgactgcggtcatatcatcatatctggaacaagtaaaaaataccgtttcggtttaaagggaaactgtagcgaaggggaattactctccttcagaacaggaataaatcttgtatccagccttagacaattaaataaaaaagcaatgttgaacctctatctttctgatctttccggaataagtggaggcaatgaagaaagatatgctatatatgaaaaaattaaatctgaagataaatgtcagtttattccaaaagagtatgtttcactgttggaagatgctggatttaatgaacatgacattgaaataaacctccagtcaaagggaaacgaaaggtttaaaaagattataaaaaaacgatgtcaaggatatccagtgaaaaaagtaacaatgactatagaaagtcactttactctgaatatggcgctttatttctcacaaataaagccaaggagattttttcaatcaccacaccctttttatttaatcatttag

SEQ ID NO: 4916 - DNA, 321 bp, Xenorhabdus bovienii
  Coding DNA location: Contig name=SeqID_16900; Position on contig =122903..123223bp; Strand=-
ttgcatacccgttttattggacttttcatcattacgacaactgccagaccttttggtatttggcgagattgggttttcaaaaaattcaaaatttctaatgaggacaaaggaataaaaccttacctggttgatactttagcctatctttcatttgagatgcctttatatattaccaatcttacgattagtggggcttctttagaacagatgattaaaagtattcttttctttgctttcattgccggcatggtgggacgcccatacggtatttatagaaacttcatcagatgcagaatatttaagcttaactctagtttataa

SEQ ID NO: 4917 - DNA, 159 bp, Xenorhabdus bovienii
  Coding DNA location: Contig name=SeqID_16900; Position on contig =123218..123376bp; Strand=+
atgcaaatatatcagaaagaaaatttatttttcttttattgtgaggttgagttgctttttcttccatgtttttattcctccactattttaaaatacattaataagctggttgtggttttacaagtgaggttattggttacaataactgtatttttgtaa

SEQ ID NO: 4918 - DNA, 1314 bp, Xenorhabdus bovienii
  Coding DNA location: Contig name=SeqID_16900; Position on contig =123696..125009bp; Strand=-
atgagtcaacaatggacatcccgtctggggcacgtattagcagcaaccggatctgccgttggcattggtgccatctggaaattctcgtatgtttcagcaacaaatggtggcggtgcatttttggttgtatttttattatttagctttgtgattggattagcgattctgttagctgaaaacatactgggaagcagtacgggtgaagtggccattaatgcgtttaaaaaattacttggtaaacactgggggtgggttggttttataggtatattcagttcatggtgtatctatagcttctacagtgttgtcggtggttggaccataggttacacggtgatggcgagtacaggaaagttgaatattacagacatctctcaactgacatctattttcaccaatttcatcagcgatccatggtggccgataatcgcacatctgatattttcagggctaacctgtttcgtagtattatctggtgtgcaaaaaggtttggaaaaatcagttaaggtcatgatgccactgttatttttgatcatgatcgtgttaattattgtcggcatccgtttacctggttcatcagaagggctaaaattattcttatacccagacttcagtagcttgaccggaaaaggtgttttagatgcattagggttggcatttttttcactgtctatcggtttgggaattcacattacgtacagctcctatttgcctaataacaaaggtattggtaaatcgagtatctgggttgtaatcctctcctgtttggtctgtatattggctggcctgatgatttttcctgctttggcagctgctggtttaaaaccaaatgcgggacccggcttaacgtttatgacgatgccaatttatttcgccaatcttcctggtggctcaatcttagcagtcactttctttttactgttattaatggccgcactaacctcatcaatttcattacttgagcacattgttgcttatgttcagacgcgttttcagtggtcgcgtcgtaaagcaagcttaatcgtcacggcatcgattatgttaatggggattcctgtttccttatcttttggcccgctaagtcacgtcacattaggtggaaaatccatcttcgacatgctggactttattacttccaatgttcttatgccattgttcgggattatcatttgcctcgtatttggctggtcacgtaaggtcaatgcactaataccggataatatgtcatcgtggaaccgtcagtgtttactatttatatggagatatgtcggacctttatgtatcggagtgattttggtccacggacttatttaa

SEQ ID NO: 4919 - DNA, 258 bp, Xenorhabdus bovienii
  Coding DNA location: Contig name=SeqID_16900; Position on contig =124977..125234bp; Strand=+
gtgccccagacgggatgtccattgttgactcatgctaacccccgaatagatacagtgtcagcacatgtacttaggcccacagccgtaagcaaaaaaccagcagcattcgaaacatgcttacccgcttgcaggccaatcataggcggggaaatgatatttcctgccccgatgaatagggcaaaggtcataaagcccaatgcccaaatatttttagatgataaacggtatgtcataataattgttaacttattgttgtaa

SEQ ID NO: 4920 - DNA, 153 bp, Xenorhabdus bovienii
  Coding DNA location: Contig name=SeqID_16900; Position on contig =125354..125506bp; Strand=+
atgatagtggtaataacagctagaatcgccaacaactgctcacaagtaaaacttttaagtgctaaaaggcatgcaccaacgccttgtgaggtgtccaagattattactccattacagctgatcatgttgctcacagttaatgctactaaatga

SEQ ID NO: 4921 - DNA, 135 bp, Xenorhabdus bovienii
  Coding DNA location: Contig name=SeqID_16900; Position on contig =125796..125930bp; Strand=+
atgatttatttatttttggttattattattgataagactagagcagataaaattgacaaaattacaattccaaatgtaaccactaatacagattttaatttttcttcattatttaatgatgatgtcatcacgtag

SEQ ID NO: 4922 - DNA, 102 bp, Xenorhabdus bovienii
  Coding DNA location: Contig name=SeqID_16900; Position on contig =125911..126012bp; Strand=+
atgatgatgtcatcacgtagaaaaaatttggccaagaagaaagaggagccaaaaaatgaacaaatattaaggttgcaatcattttttaatatgcgtcaatag

SEQ ID NO: 4923 - DNA, 132 bp, Xenorhabdus bovienii
  Coding DNA location: Contig name=SeqID_16900; Position on contig =126150..126281bp; Strand=-
atgaaagagaacaaaaatttctcacgaatattaggatttacagttaccccacttgtacaagtggaacataggaaatcgggtaacaaagttgaacacctaaaatatcattcctccctgaaagaacacatataa

SEQ ID NO: 4924 - DNA, 105 bp, Xenorhabdus bovienii
  Coding DNA location: Contig name=SeqID_16900; Position on contig =126324..126428bp; Strand=+
atggatgcttatctttatctgatagataattatctctaccaatccgaaatctttctgatctttacaaggtatcttggattgtattggtgtaactattttcagtaa

SEQ ID NO: 4925 - DNA, 267 bp, Xenorhabdus bovienii
  Coding DNA location: Contig name=SeqID_16900; Position on contig =126649..126915bp; Strand=+
atggctaaagttgatgtttattgtcgttattatcacatatcagaacttgtcaaagggcatggaaaaggaaatggtggccatcgctgttatgcctgctgtaaggtctttcagttggaatacacctatcaagcctgcaaacccggtgttaaagagcagattatcaatatggcaatgaataacggcgggatccgcgacaccgcccgtgtcctgcaagtggccacaagcaccgtcatgacaacgctaaaaaactcatcccccgaaacgtga

SEQ ID NO: 4926 - DNA, 219 bp, Xenorhabdus bovienii
  Coding DNA location: Contig name=SeqID_16900; Position on contig =126960..127178bp; Strand=+
atggatgagcagtggtcatttgtggggaacaagaaaaatcaacgcgggctctggtatgcttgggaaccctgtctgaaacgaatagtggcgcatgtttttggggatcgcagccgaaaaacactagacaaactgcttgcccttttatcgcctttaatactcggttttattgtacggatgattatgctgtgtatgaccgcctcccagaggaagaacacctga

SEQ ID NO: 4927 - DNA, 174 bp, Xenorhabdus bovienii
  Coding DNA location: Contig name=SeqID_16900; Position on contig =127138..127311bp; Strand=-
atgaaagtgccaatcactttatcgtgcatttccgccgatttagaataccctatcgttttgcgattcagtctttttatccgggttcgatgcgttaaattatttctttctcaacgttgggtgaatgtcttcccagtcaggtgttcttcctctgggaggcggtcatacacagcataa

SEQ ID NO: 4928 - DNA, 129 bp, Xenorhabdus bovienii
  Coding DNA location: Contig name=SeqID_16900; Position on contig =127342..127470bp; Strand=-
atgaaagagctattaccaaatgaattaacaattatatccggggctggtgattcattgaataaactaacagaaaatgtagcttggggagctggtataggcgccgctacggatcgtgtattaaatagttag

SEQ ID NO: 4929 - DNA, 300 bp, Xenorhabdus bovienii
  Coding DNA location: Contig name=SeqID_16900; Position on contig =127448..127747bp; Strand=-
atgtcatttatttctttttcattctctcctatttggctatcttttattagttttattatcttcatacatgttaatgaaaataaatctagcattaccgtaaatataattgccttggtgataatttctttttctatttgttttgtttatccatttactaacattttcattactgaaaaatatttttattttgacaagtttattattttttgtttattatctgccgcgatatctatgttcataaatctgataatactttacatatataggataatgataaatgaaagagctattaccaaatga

SEQ ID NO: 4930 - DNA, 141 bp, Xenorhabdus bovienii
  Coding DNA location: Contig name=SeqID_16900; Position on contig =127683..127823bp; Strand=+
atgaagataataaaactaataaaagatagccaaataggagagaatgaaaaagaaataaatgacatagataatccttatgaatgtattttacacataatacacgttgatatttttttgtgcaaaaaaataataaattcttaa

SEQ ID NO: 4931 - DNA, 153 bp, Xenorhabdus bovienii
  Coding DNA location: Contig name=SeqID_16900; Position on contig =127830..127982bp; Strand=-
atggtctggcggcgattcaagttgtcaggcgagacttctttagcggctttatcgcataagtgccccaagcttttttatgctctcactgtttcggcatgcaccaaaacattgttcctggaacaggctttacgtcaatttcttatccagaattag

SEQ ID NO: 4932 - DNA, 2361 bp, Xenorhabdus bovienii
  Coding DNA location: Contig name=SeqID_16900; Position on contig =128079..130439bp; Strand=+
atgtctgacactaatttttctcaaacggctgcttttatctggtcggttgctgacctgcttcgcggtgattttaagcaatcccagtatgggcgtgtgatcctgccttttacgctgctgcgtcgtcttgagtgcgtgttagccgccactaaagatgccgtggtagccgaggctgaaaaactgaaaaccagcttgctgccagaagaagcaaaagagaaatttctgctccgtgccagcggcctgacattcttcaactcctctccgatggatctcggaaagatggggcaaaacgatatcaaggacaacctggagaactacatccagtctttctcaaaggatgcgcgtgaaatcttcggacactttaatttcagtgagtttgtcagccttctgcaggatgccaacctactgtacaaagtggtgaaaaaatttgccactactgatctcagccccaaaaaaatctctaaccatgacatgggcatggtgtttgaagagttaatccgccgctttgcagaaagctcaaacgagacggcgggggagcactttaccccgcgcgatatcgtacgtttaaccacctcgctggtatttatggaggatgatgaagctttatcgaaagacggcattatccgcaccatttacgacccaaccgcaggaacgggggggtttctctcttccggcatggaatacgtgcatgaactgaatcctaacgcggtgatgcgtgcttttggtcaggaattaaacccggaatcctacgccatctgtaaagccgatatgctgatcaaagggcaggacgtcagccgcatcaaactgggcaacaccctttccaacgaccagttaccactggaccagttcgactacatgctgtctaacccgccgtttggcgtggactggaagaagattgaaggcgagatcaacaacgagcatcagcagaagggttttaacggccgttttggtccaggtctgccgcgtgtctctgatggctcgctgctgtttctactgcatctcatcagcaaaatgcgcgacagccataatgtggatggtaccgtgactaatggtgggcgtatcggaattatcctcaacggctcaccgttgtttaccggtggtgcaggtagcggtgaaagtgaaatccgtcgctatatcctggaagctgatttgctggaaggcatcgtcgcgctgccgaccgatatgttctacaacaccggtattgcgacctacgtctggatcctgtcgaataagaaatcgtcagaacgtaaaggcaaagtgcaactgattgatggtacaaacctgtgcggcaagatgcgtaaatcgctgggttctaaacgtaacctgatgggtgaagatgatattaaactcatcacccgtacctttggtaattttgaggtggtgaatgccacgccgctgcaagaattaggtctggagaaagccgcagagcaaaaatctaaccgtggtcgtcagtctgccacggcaaaagtcgaagcgccgaaaaccttcgccagcaaaatttttaacagcaccgactttggctatcgccgtctgaccattgaacgcccgctgcgtttgtctgcacaagtgactgatgaagtgattgcaaccctgcgttttgcgccgaagccatttaacgcgccgatggaacgtctgtatgaagagttcgtcacacagtggcaggacgataactatggcgatttcgcagagatcgaagcggaagctcgcacaatcatcaaagcggaatttgccgagctgaaagagaagcaaattaaagacctgctcgatagcaagctatggctggcacagcgcacgttaatggagaaagcgcagcagattcaaaccgcattgggtgtgcaggcgggtggtaagacgcaggtcagcgacgacttcaaccattttcagcttactctgaaaggtgcgctgaaaactgcaggcgttaagctggataccaaagaaaacaaacagtttattggtgctatcactaccaaaaatcctgctgcagagccggttgtgaaaaaggtactgaaagaaaccgccctgccgctgtatggtgcttttgagtacaaaggcaaagtggtggagtttgatcaggatggcgacctgcgtgataacgagaacgtgccgctgaatccgtctgtctccaccagcgatctgatcgagaactacttcaaagcggaagtgctgccgcatgtggttgatgcctggattaataccgataagcgcgatgagaaagacggtgaggtggggattgtcggctatgagattccttttaaccgccatttctacgtttaccagcctccacgtccgctggaagagattgatgctgatttggatgcggtaagtgctgaaattatgaaactgctgcaggaggtacattcctga

SEQ ID NO: 4933 - DNA, 1263 bp, Xenorhabdus bovienii
  Coding DNA location: Contig name=SeqID_16900; Position on contig =130439..131701bp; Strand=+
atggctgggttaaataaatataaggcgtatccggaatataaggactctggggttgagtggctgggggagattcctaagcattgggctgtttgtagattaaaaaatctggcaacaataaaaaatggtcaggattataagtctgttcaagcagagtgtggctaccctgtgatagggtctggtggacaatttatgtttgcatcaaaatatatgtatgataaaccatctgtactgcttgggcgtaaggggactatagataaaccattatatataaatgagccattttggaccgttgatacaatgtattacactgaattaaacgatgatgtggatgcaaagtatttttattatctggctctcacaatacaattttcacgctactcaacaaatactgcgttgccaagtatgacgcaggagcatttgagtaattataaattcgcagctccaaaggttgaatcagatcgtaagcagatcactgattttctggatcacgaaaccgcaaaaatcgataacctgatcgagaagcaacagcaactgatcaatctgctgaaagaaaaacgtcaggcagtgattagccatgccgtaaccaaagggctaaaccctgatgtgccgatgaaagattctggtgttaaatggttgggggaagtgccggaacattggattgtcagcccaattaaacatgtgcttgctaaccaagactttagaaggattccgttgagcagtgaagaaagaggtaaacgtagtggtgaatatccttactacggtgcgtcgggtattattgattatatagataattatatttttgatgaaccaactgttttagttggtgaggatggtgctaatttggttgcacgcaacacatctcttgcattttctgctgttggtgagtattgggtaaataatcatgctcatatactaaagccgtatgatggtctggtcgactattgggcagaggcgatcgaacatatagatattaatccaattgtaagtggttctgcgcaacctaaacttacagcagaggcgcttaataatttgaaaattgcttactcgccacaattagaagaacgcagccagattgaaggttgtatcaatgttcaaaagaataaatataaaaagctaatcagtattgcggcggaacaagttattctacttcaagagcgccgcaccgctcttatctccgccgctgtcaccggtaaaatcgatgtacgcaactgggtagcaccagacatgtcagacattgaggagtcacaggaggccgccgcatga

SEQ ID NO: 4934 - DNA, 3249 bp, Xenorhabdus bovienii
  Coding DNA location: Contig name=SeqID_16900; Position on contig =131698..134946bp; Strand=+
atgagtatggataccaccaaagagctggttttccagaatgaaatgattgctcagatggtcgatagaggctggattgttggcaaaagtgacggctatgaccgcgaacgtgccttgtacttgcaagatgcactggctttcgttcagacgacgcagccgcaggaatgggagaaattttcgaagatttatcccaccgatacagaacgtcatttcctcgatgcactggtggcgcaactgaaaaaagcagatatcaacgccaccgatatgctgtcgcgcacttacgggacgctgggggtattgcgccacggcatcaaaagtcataacgcccgtttttctctgtgccagtttaagccggagcataacctcaatccagaaacccttgcgcgatataaacagaacatctgccgcattgtgccggagctggtttatagccctcatgcctcgaaagcagcatttgaagaatctggcgtaaaagcgaagaaatggcgtatcgatttggtgctgtttgtgaacggcctgccagtggcgacgcttgagttgaagtccgagtttaagcaggcggtgcaaaatgcgatcaaacaatataagaaaacgcgtttgccgaaagatcctggcaccaacaaacctgagccactgctcaccttcaaacgcggtgctctggtgcacttcgccgtcagccagtatgaagtgtttatggcgaccaaacttgatggcgataaaacctttttcctgcccttcaacaaagggactaaagatggtggcgcggggaacgatatcccggaagatgaaaatgaatacgccaccaactacctgtggaatgaagtgcttctcccggacaatctgctaaatattcttgcaaattttgtacatctgcaaatcgaagagaaagaagagtggaatggcctgaaaggcaagaaagaaagcctgatcttcccgcgttatcaccagtgggatgtggtgaataaattgatcactgctgctgcgattgaaggcaccggtaataagtatctgattcagcacagtgcgggttccggtaaatctaactcgattgcctggaccgtccaccagctttcccggctgtatgatgagaaaggcgagaagcagttccattcggtgattgtggtgacggaccgtaccgtactggacgatcagcttcaggacaccatttatcagtttgagcatcaggatggtgtggttggacgcatcaacaataaagaaggcgatggttcgaagtctgaaaagctcgccagcgcgctggaaaactcgcagccgattattatcgtcaccattcagaccttcccgtttgtgctgaaggcgattgaaaatagtgtcagcctcaaacagcgtaaatatgcggtgattgccgacgaagcccactcttcacaaagcggctctacggcacgtcagcttaaagaagtgctgatgaccgacgaagcggatgacgatgtagtgctgtcttctgaagatattctggatgccaccgtcgccgcacgtaaaggtagtaataatcttaactactatgcgtttaccgcgacgccgaaggccaaaacgctggaactgtttggtcgtctccccaatccgcttgaacctgcgtcaaaaaccaatatgcccaaagcgttccatgtctactctatgcgtcaggctattgaagaaggctttatccttgatgtcctgaagaactacaccaactacaaggtggcctataagctcttgcagaagctggacgatccagaccgggaagtcgacagcaaaaaagcgaaggtcaaattgaatcagtgggtagcgctgcacgaacataacgtctcgcagaaagtaaaaatcattgttgagcactaccgtaagcatgtgatgcatttgctgggtgggcaagctaaagcgatggtcgttaccagctcacgtaaagcggcggtacgttataaactggcgtttgataaatacattgctgagaacagttaccagaagatcaacgcgatggtggcgttttcaggcgaagtcgaattcgttgacagcgaccacaacagcctcgcgctgctgaaccagaagtttactgaaattagtatgaaccctgggctgaagggccgggatatgcgtaaagcttttgatagtgatgactatcaggtgatgctggtggcgaataaattccagaccggttttgaccaacctaagctgtgcgccatgtatgtcgacaaagctttgggtggggtggagtgcgtgcagacactttcacggctaaatcgtacctatctgggtaaagcagaatcagggacatttgtgctcgatttctataacgagccggatgacattctggcggcattccagccttactaccaaacggcagagctgactgatgtcagcgatccacagctagtcttcgagctgtatgagaagcttcgctctagcggtattttcctgtggaacgaagttgagcaattctgcgaggcattcttcaccaaaaacaaatcaaatgcggcaataagcaacatctgtaagcctgccgttgaacgctggaaacagcgttacagctctgcgattgatgcctatgttctggcgaaagaaatgtttgaacgtaccaaaaagactggcgatgtggtgctgattactaacgcggaaaacaactttaaagcgagcaaacaggaaaaagacaaactggatatcttcaaaaaagatctcggcagctttgtccgtttctacgaatttatatcgcagatcgttgactacgatgacaaggatttagagaggctgagcctgtttgctcgtcaccttcgcccgttgctccatgagcagcgtattgaagaagatgagattgatttaagtaatgtggagatgagccattaccgtttgtcaaaacttcacgaacagcatctcaaacttcaggaagatgctgaagaatacaaaatcaaaccgggcaatgatattggtacggcgaagccaaaggataagaaagaagagtttctgtcgaatattctggtacgtctgaacgacctgtttatcactgacaatctcaccgacaaagacatgatcaattatgtctttaccgtgcgtgataagctgtcggaaaaccaggcggtgatgacgcagattgctaataacacacgcgagcaggccatgttaggtgattttcctaaagccattgatgatgcggttatggatagcaatgacgctcagcaagagatgatgatgcagtacctgtctaaccctgagctggcaaaagggtttgcacgagtggtgtttgatatgttgaaaggggcttga

SEQ ID NO: 4935 - DNA, 150 bp, Xenorhabdus bovienii
  Coding DNA location: Contig name=SeqID_16900; Position on contig =135304..135453bp; Strand=-
atgggtgatccttgcaggcgagggatcactgagataacaaaaaagatattaaacgattgcatcaataacggtcaaacattgactcatacaaatttgggtcacgcattcaatccgttgattgatattgaatatagtagttttgttcaatga

SEQ ID NO: 4936 - DNA, 303 bp, Xenorhabdus bovienii
  Coding DNA location: Contig name=SeqID_16900; Position on contig =135392..135694bp; Strand=+
atgcaatcgtttaatatcttttttgttatctcagtgatccctcgcctgcaaggatcacccatcggtcggcgaaataaaaactctcgtagcctgaaagggagtgtaagcattgcggtacatctgcacacttttggaagcagatatcttcggacacctaaccctccgtctgatgatgaaagtttcccggtgttattcaccacaccggctattcacccagcagggcagaacaggctctgtcttacactgaacgataccgttttcatcggtacacccttcactgacattttcaatgcatcacgataa

SEQ ID NO: 4937 - DNA, 573 bp, Xenorhabdus bovienii
  Coding DNA location: Contig name=SeqID_16900; Position on contig =135681..136253bp; Strand=+
atgcatcacgataaacgtcccgaaaactgcgcggcgtcacttgtgttaaagcacagcgattaccaagtgacgccgccgggcggccaacgtccagagcacgtccgtcctgacttcacaacggatttgatccacattttactcaataaaacctctctcaaacacactatttaccgtccccgccggatccgggctcaaccaccgccccgcccggtacccgtagtagtacagtcctgtcgcatctcgctccttacccgagtaacgaacagtcttataacccgcttccgtctggttcctcgccgtccacactgctgtgcctccgtacgggtagtattcttccatactgataatttgtctgtctccgtccacctccagaccactgctgcccaccagattatcgtagctatagcgcatctgattgttactgatgtcgtccggttttccgctttcccaatgcagtacctggtttatgggcgaagcggtattaccggagcaggtcactcaccgggatgtgctgcggtggcggtatcattcgttggtggagaagaaacaatccggtcatacttggaacaataa

SEQ ID NO: 4938 - DNA, 333 bp, Xenorhabdus bovienii
  Coding DNA location: Contig name=SeqID_16900; Position on contig =136105..136437bp; Strand=+
atgtcgtccggttttccgctttcccaatgcagtacctggtttatgggcgaagcggtattaccggagcaggtcactcaccgggatgtgctgcggtggcggtatcattcgttggtggagaagaaacaatccggtcatacttggaacaataaggtggctcacctgcggacgatttttaatttcggcatggcaaggacactcctgccacagactgaaaacccgtttaacgatgccgcagtgaaaaaagagaagaaaaagaagaaaattctgagtaaatcccagatcattcatctctatctgctgatgagacaatacgaggaagaggaaagaagataa

SEQ ID NO: 4939 - DNA, 513 bp, Xenorhabdus bovienii
  Coding DNA location: Contig name=SeqID_16900; Position on contig =136519..137031bp; Strand=+
atgcgccagaaccagttattgcacctgcggttgcaggatatcagtttggaaggcaattatattgtcctgcgtgttgaaggcagcaaaaaccacagtgaatggcgggtgccgatgatccggcagcttaaaccccggctggcgcagttggccgggcaagcaagagcctgtggtgaaaaagacgatgatccgctgtttgatttaacccgcctgcgttttcgtcatcacggacgaacaatcagttatcagtataattacgataaagaaatgcagcatatccgttctttcttcaaccggttgtctaaagagtgcggtttttccgtctcctctcaccgttttcgtcatacactggcaacggaactgatgaaagcaccagaccgtaatctgcaactggtcagaagtctgctgggacaccgcagtctggcaaccacgatggaatacattgatatcgatatggaaatcgcgggtaaaacgctggagaatgaactggcgatatatctggatatttcggtgtaa

SEQ ID NO: 4940 - DNA, 168 bp, Xenorhabdus bovienii
  Coding DNA location: Contig name=SeqID_16900; Position on contig =137120..137287bp; Strand=+
atgaaaaaatggctaattccgatcctgcatcccgtgaagtcttcacctgacttgacatcagaatcaattactgaaatcattaccctgaacgaaaaaagagtgcttgcaaatgcaggcactctgtattctttatttacggcttttttaaaaattgagtatgcagactaa

SEQ ID NO: 4941 - DNA, 888 bp, Xenorhabdus bovienii
  Coding DNA location: Contig name=SeqID_16900; Position on contig =137496..138383bp; Strand=+
atgataattcttcccataatttcccccaaagggggcgaaggtaaatcgacccacgcggctaatctggccggtttttttgccgatgccgatttacgtgttctcctgattgatgcggattattcgcaacccaccgccagcagtatttttcccctgaactatgaagcccccgcgggtttatatgagttactgatgcaaacggtggatctgcaccagcctgagcagatcatttcccgttcggccatcaacaatctggatgtgctgatctccaacgatccggatgaacttctgccaacggcaatgctgcacgcgcccgacgggcgtttgcgtctgcgcaatgtcctgcaacatcccctcttcagtcaatacgatattattttcattgattccaaaggggcgaccggcgtgatgagcgagctggttgtactggcggccacgcagggcgtgctgggggttatcaagcctattttacccgacgtccgcgagttcctgcgcggcaccctgcggatgctgacccggctccggccttttgaaaactacggtatccggctgccggctatccagatactggtcaacgggattgaaggaacgaatctcgaccgggatacgctgagtgaactggccgacattatcaataatcaacgttatgatgcttccgcactgggcggcaggcaggtttaccagctgctggaaacccggatagacctgctggatatctacaaactggggcatgtccgtgcccagcccgttcatcgccttgagtataaaaccacccgaaaaagcccggctgccgcgcaaaccatgcaccgcctcgcctgtgagttagtgcccttatgggcggaaaaattcgacgcggtattgactgtgcaaccgacaggagaggcgcaatga

SEQ ID NO: 4942 - DNA, 432 bp, Xenorhabdus bovienii
  Coding DNA location: Contig name=SeqID_16900; Position on contig =138326..138757bp; Strand=+
atgggcggaaaaattcgacgcggtattgactgtgcaaccgacaggagaggcgcaatgaatgttatctggcgggcggtctgctttcgttatgagcgcgttgaattactgttcagtgatgatgagtggtttgtgtttgtggatgcgccggatcgtgaaaccgcgcaggcgaaacttcagatcctgttgccagctgttcccgacgtttctccggaaagggtagagcattattatccccgtatgcgcaggcaggccatgcgccccgatgcgtttccggatttggcgttgctggaatgtggctgggaaaatgaccagccgcagtatctgacccataaagaggtgctgttctgggtttcttcccctcatctgcaacagcgtttaatcgctgccctgaatgcgatcagcagggaggtcgccgatgaatctgccgcatga

SEQ ID NO: 4943 - DNA, 1401 bp, Xenorhabdus bovienii
  Coding DNA location: Contig name=SeqID_16900; Position on contig =138717..140117bp; Strand=+
atgcgatcagcagggaggtcgccgatgaatctgccgcatgaacatttacagatcatcagtgaagaggcgcccagctatgcgtatgccgaagtgggggtgttggggggtctggtactggagaatgagtgctgggatagcgttgtccagctattggctgccgacgatttttattttccggcacaccggataatatttcaggccatcgctgaactgagcgaaaaaaactgtccgttcgacctgattaccctgaccgataggctgacccagcgcgggcaaattgatcgggcatgcggttttgcttatgtagcggaagtgtgtaaaaacacgcccagtgccgccaatattgaggagtatgcccgtattgtggcggaaaaaagccggttacgtcagttactggcactggggaaatccctcagcgctgacgtttttcagccgaatattcagtcagataccctgatagagaaggcagaaagtcagttgtttaatctggctgaaaaaggttcgacccgccaacatcaggaaatgaccctgttgcagggtgcagacagcctgattgcccatctggagcgaatacaaggcgcacagggaataaccggaacaccgaccggatttcaggatcttgatgaaaaaacctgcggcttgcaggccggtgatctcattttgctggctgcccgcccttcgatgggaaaaaccgcactggggctggcctgttgtctgggtgccctgcggcaccgggatgatgcggtggtacagattttcagtctggaaatgccggcggcacaactgatgctgcgtctcaccgctatggaaggcggggtttctctgggtgccctgcgcagcgggatgctggatgatgagcagtggggacgtatcagccagagtctggatcagtttgcccgctgggatcatcgtctggtgattgatgattgcagtcaccagacgcccgcattattacgcgcccgtgcccgccgctatacccgcaaatacggtaaacccgccctgattatggttgactacctccagctgatgagtgcgcccgggcaggaaaaccggacacaggaaattgccgatatctcccgtaacctgaaagcgttaggcaaagaactgggctgcccggtactggcgctgtctcaactgaacagacaggtcgaaaaccgttccgataaacgtcctaacaatggtgacctgcgtgattccggctcactggagcaggacgccgacctgatactgcatctctatcgcgatgaagtctatcacccggacacacccgatacaggtaccgctgaaatcattattggtaagcagcgtcagggtccaacgggcgtggttcgtgtgggatttgacggccaatatacgcggttttcggacttatccgcagacagtgatggttacggggagtaa

SEQ ID NO: 4944 - DNA, 1581 bp, Xenorhabdus bovienii
  Coding DNA location: Contig name=SeqID_16900; Position on contig =140118..141698bp; Strand=+
atgatggcacggcaacatctcaatatgggcaatgccctgttacaacaagggcgccaggccacggcgacactcagtgaacaaccccctgtgtcggaaatgccgatggtactgacactggatcaactccgccccaatccggataacccccgcaccagtcggaacccgcgttatgaggatatcaaggcctcgatcaaagtacgcgggctggatacggtgccgaaagtcacccgcgatccggaaggtgaagatgtctatatcttcagtgacggcggcaatacccgttatcaggttttgtccgaactgtggcaggaaaccggcgatgagcgtttttatcgtgttcactgcctgtttaaaccgtggccgggcagattgcagtgtgtcatcgggcatctggcggaaaatgaactgcgcggtgaactcagttttattgaaaaagccctgggggtctgcaaggccagaaccctttttgaagtacagaaacagcagaaaatcacccaaagtgagttgtctgcactactgggggaagccggttttcctgtcagccgcagttatatcagccggatggaagataccgtgcaatatctctatccgtggatgcctgatctgctgaactcggggctgaaggtaccccaaattcgtttgttactggcattacggcaggatgccgaggccgtctggctacaacatgttgtcagtgcaatatcggagcctgcctgttcctttgatgcgatttttggtgcctgttgccgcaaatttgactccccggaatcctggtcaccggagatgttccgggatgaacttatcggcgatttattgcaggtattgccgcacccgcagctgaattatgaccgctgggtactggaactcgatccgaaggaaagtaaccgccggcaactctttggtgaacaggccaccccggttgaccctgtgccggaaaagccggatacgcctaaagcggatcgggctcgggcgccagacagggaaccgaaccggcgcataatgtctcaacccgtcacggatgcggagcaggcatcggagacaacatgcgctccggtcgataagacacccgtgcctgctccgtcttcccgaaacaatccggtgctcccgccttatcagccggatagtccgtctgaaccggcgctgtctgagcctgaagccgacgatctccactttgcccggaccgggctggagccggtcagctcagtctggcacatttccccgatgcaggacgatatcgagcatttgcaaaatatggcgtttcgcctggcgtttgaactggccgaagtgatgggctgtgaccgtgatttgctgccggtatcggatgaacggtcggcgggattttgcctgattgacgggccggatgttcatcctttttcgtgtttattgcactccctgaccggggaaatctcgattgaccgtcatgaactgacgctgactgccgttctgctcggcaccgccggacggaaggcggtaccattactggatgacagccagaccgtgaagtttctgcggctgctgcggattatccgtcgcctgcgtgaacttcagcgcgaaattgtaccagagatattgacgatgtag

SEQ ID NO: 4945 - DNA, 582 bp, Xenorhabdus bovienii
  Coding DNA location: Contig name=SeqID_16900; Position on contig =141779..142360bp; Strand=+
atgaatcatttatcgcaagcgaccaacagcctgctgttgcagttggtgatggatttgaagaacggctatatccgccgttgcgaagcactggggctggcaccctcggagatgctgatgttacagagcctgacgattgaggatttgcattatctgggcaacagcccggtatcggtgctgagtgtgcaaattcatcacgccaatctggcccgcatcttacatcaggcgcgtatcgaacagcagcggatacaacgcattgaccgggcactggcactcagcggatcgattgacctgatgcactatttttttggcctgtccagtctggaggtggcggcgcgccggcgtattgccggtattgccgtgaagtcggggcgggtttcggtgctgacggaagcggaaaaccgtgacctgtggcagcgctggcaggcggcaaagatgagggatgcagacagtgccgacgggctggatatcatgatggacgtggctgagcatcatgatatttcgctgacgtccgtctggaatgccgtcaaagaatggcagcaacagggtgcatccggatcggtctctgtgaaaaaacaggtataa

SEQ ID NO: 4946 - DNA, 330 bp, Xenorhabdus bovienii
  Coding DNA location: Contig name=SeqID_16900; Position on contig =142309..142638bp; Strand=+
atggcagcaacagggtgcatccggatcggtctctgtgaaaaaacaggtataaaacgggtcatacaggaaacgatgtcaggaaaattaaccgaaatcatgcccggcctgcatgtgccggtaacggcaccgctgtcctttcgccgtaaggcgcaatatcaggtgaaatgttatcggcggggccagcgtaattacgtccggctgaaggaaaaaggcaccgggtatctgaaaattaacgtggggctgttctggcggctgttaagccgtgatagcgggcaatcgtgggagctgatgcaccacgaacgctacaacaatgaaattcgtaaatcgtaa

SEQ ID NO: 4947 - DNA, 1224 bp, Xenorhabdus bovienii
  Coding DNA location: Contig name=SeqID_16900; Position on contig =142734..143957bp; Strand=+
atgataaacctgtcagcagacagcttaattgcccacaccatagccaaaatgaaaagccgtctggaacaacgcaccggcgatgacgtttcacagctgcgcagtggtctgctgtttatgggtaacattcaggatgcctatccccgtcgcctgttactggatgatcgcctgtcaccactggataaaacgggctggatgatgatccgtttgtatgcgcaacaaaataaaggggcggttttccccagctacgatgaattgcagctgctgctggcctcgccctataaaggcaaagcctcccgtgaaaccgtcagccgggtattgctgatgctgcgaataaccggctggctgagtttatgcaagcgtatccgagacgagcatgggcgggtgcggggcaatatctatgcgcaacacgatgaaccgctgacctgccgtgatgccgagattctcgatcctcactggctggatactgtggcagaagcctgtcgcagcaaaaaccgcactatcagccagacggcacgggaggtactgactgacattcaagaagatccactgatgcgtcatcgtcacagtcatatccgtttgctggaagcgcggctgaatgcggtgcagacgccacagcaaagggtcatgaggcaggcgcttcaacagggaaaacagcaaaccgaactcagggaaatgaaaccgggttcggaaaccgaatccggtcagttaaaagggcagaataagccgaattcggaaaccgaactcagccttaaatcaacggtttatcgtcaaaccactaaaccgaactgttatgtacgttctttcacacagagtgtgaataaaaaaacatacgtagatacaccgtccgctatttttctgccggaaaagttatgcaggcaactggagccggaagatggggggatgctgaacagccagttgcaggcactgcctgctgaacaggcgcagactgtgttgacttgtctggataaagcgttacaggcaggtaaaatcggtaatccggtcggctggctgctggcgatgatgaaacgggcacgggagggaaaactgtatgtgcaggccgaaccggctgtcacgacgacggcggctgcgaagaaacccgttgaattcacacgggaaacggcgcgttctgttccctcctcttcacaagcccatgtcagcagtgtagtgaaagacattcgtcagcggctggcgcaggcaaaatatcaccgtgatgacatggggtaa

SEQ ID NO: 4948 - DNA, 249 bp, Xenorhabdus bovienii
  Coding DNA location: Contig name=SeqID_16900; Position on contig =143944..144192bp; Strand=+
atgacatggggtaaaaaccgggttgtgttgcccggaacagccatgattgaaaattatactggtgtgcccggggcacaggcgactaaaaattgtacttccttgtttgaggcaggcaagtctgaaaatctaccgtattgcctgagacagcagtggttgaaaatcatactggtgtgcccggggcacaggcgactaaaaattgtgctgccttgtttgaggcaggcaagtctgaaaatctaccgtattgcctga

SEQ ID NO: 4949 - DNA, 159 bp, Xenorhabdus bovienii
  Coding DNA location: Contig name=SeqID_16900; Position on contig =144328..144486bp; Strand=-
atggttaacgcggatttcagtgcaccggcacgacgggggggcgacggtgcggttttttcgtcaggctcagacataaagagcaactcctgtttggtcggtttatgtctgtgggactatcaggggaaaggtgtctgcgactcaatagataatcagttatga

SEQ ID NO: 4950 - DNA, 726 bp, Xenorhabdus bovienii
  Coding DNA location: Contig name=SeqID_16900; Position on contig =144413..145138bp; Strand=+
atgtctgagcctgacgaaaaaaccgcaccgtcgcccccccgtcgtgccggtgcactgaaatccgcgttaaccattgaactgcacacccactatgcgatccgcctctgggaaggacgtaaaaaagaagatcttatcggtcgtcgtcaatacccggacattatcggcatgccgcaggtgattaaacgtgccggcaccatcagcgtggatgccgctgccgataacccgtatgccgacagctggctgcttaaactggaacaggcattggtgacggcgtcggccagtcttcagcagagtattgccaccttgcaggagatcctgaatgccctgccggcgcagattacgttatcctccgtctcctccgtcgaaccgctgaatatcggcgtctacagccattctccgctgggttaccgctgtgtctggctgctggtcggttatgaccagctggcgatgaaaacctttcaggcctttcattacggttttatttcccgctcagagcgggatacgttgctgcataacggcagccgggtgatccgccagatttatggtctggtgcgttcgtaccgtcccctgaaggtgacccgcgcggatattgaggaaaaaacgccggccggccttgaagccattaaatggctgggcgaaccggaccccgatattctgtcgggccggttgcgttctgatttttcaccccccctgcgcccagtggctcaggatgcggggaggggatga

SEQ ID NO: 4951 - DNA, 2013 bp, Xenorhabdus bovienii
  Coding DNA location: Contig name=SeqID_16900; Position on contig =145122..147134bp; Strand=+
atgcggggaggggatgatatgccactttatttatgtgaaaagccctctcaggccagagatatcgcccgggtgctgggcgtgaagcagcgcggacagggctatctctttggcgacagtattacggtcacctgggctatcgggcatttgctggaaatggctgcacccgaatactatggcgaacaattcggcccgccgtggcgcatggaacccctgccggtactgcctgtgcagtggcaatggacagtgaagaaagagactgccgatcagtttgctgtgatcagacagttactgaaacaggccgatgaagtgattatcgccaccgatgccgaccgtgaaggggaggtgatcgcccgtgaactgctggaattctgccgtttcaccggtcccgtcaggcggctgtggctgtctgcactggatgaaaccagtatccggcaggcactcgccgcaatattaccgggggagaaaaccgagtcgctctggcaggccggactcggacgggcacgggctgactggctgatgggaataaacctgacccgcctgtataccctgaaagcgcaggcacagggatttggtgaggtgctgtccatcgggcgggtacagacgccgacactggcactggtcgtgaaccgcgacaacgatattgcccggtttgagccaaaaccctactggcaggtgattgccgcattgcaaaaagatgacattagctttcgggttaaatggctgcctgcgcccgacgattgcgatgaagaaaaacgctgcatccgggaggatatcgcgcagagtgtggttcagcgctgtcagcaggcacaagatgctgtggtgactgaactcacgcagaaacgggagaaaaccccgccgccgctctgttttgatttggggacgctccagcaggtggcttcccgtcaatggggaatgggggctggtcaggtgctgacgattgcccagtcgttgtatgaaacccataaagcgaccacctatccgcgcacggattgcggttatctgcctgtttcaatgcgggagggcattccggccgtgttcactgcgctgacccgtaccgatcctgcgatgaacgccattatcagccagctggatgccagcactctttcccgagtctggaatgacagccaaatcacggcgcaccatgccattatcccgacccgccacccctttgatatgacaaaactgaccgcggatgagttaaaggtttatcagttgatccgccactattatctggcgcagtttctgcccgtgcaggaaacagatgtgactgaggtgacattcactatcggcgggcagttctttcaggcgaaagggcggatcagtgtggtcaggggctggaaggcgctgtttgccgatgaaaaacaggcgcaggagcaggacgacaataccgctctgcctgcactgaaaaaagcggaaacctgcccggtactccgtgctgaaatacagccccggcaaacccggccgcctgcgccttttaccgaaggtacgctgattgccaccatgaaaaatgcggctgcgtttatcagtgatccacagcttaaaaaagtgctgcgggaaagtgccggactgggcacggaggccacacgggcaggtatcattgaagccctgtttaaacgccagttactggcgcgaaaaaagaaaaacctgcatgcaacgcagctggcgcaggagctgattgctgggctgccggacgtcctgacccatccgggcatgacggcactctgggaacagtcactggacgacattgcccagggccgggccacactggatggctttatgcagaaacaggcgcaatggctggcgcatttagtggaaaagggcaaaacacagccgatccgatttaccctgccgaaaaccccggcttgcccgcgctgtggcggcccgatgcaaaaacgggcgggaaaaacaaccccgttctggggctgcacttgctatccggcatgcaaagggatgctgaacgctaacgcggtgaccggttcgcgaaaaacccggcggggaaattcgccggactga

SEQ ID NO: 4952 - DNA, 117 bp, Xenorhabdus bovienii
  Coding DNA location: Contig name=SeqID_16900; Position on contig =147318..147434bp; Strand=+
atgcgtctgacgcccggcgggaaaaatcattcccgtcagggaacaggattttctccgtcacaccttattttttactccatggagaacatcgaatgtctgagaacaccgtatccttaa

SEQ ID NO: 4953 - DNA, 465 bp, Xenorhabdus bovienii
  Coding DNA location: Contig name=SeqID_16900; Position on contig =147410..147874bp; Strand=+
atgtctgagaacaccgtatccttaaccaaaaacgactatttcaacctgaatattaagggactgggctatctgaataatatccgccatgtcagcaccgccagcgggacgttcctgagctgtgtgatcaatgcgctgaacgggccgggtgataacccggtctatgtgcgttttgatattaccgttgtcggcaaggaggcgaccagtctgatcggtcgttgccagaaatccgtagacgaggacaaaaaagtgttgttgggcttcacgttaagcaatccctcaaccgatatttttaccctgaaacgcggagatcatgctggtgaacagcgcgtcagcctgaaagcccgtctgatcaaggtcgactggattaaaatcggtcaggaaaaagtgtatcaggccgaacaatccgactcgatgccgcctcagaacggcatcacgcaaaaagaatatgcagagaactctttctga

SEQ ID NO: 4954 - DNA, 210 bp, Xenorhabdus bovienii
  Coding DNA location: Contig name=SeqID_16900; Position on contig =147953..148162bp; Strand=+
atgaatgttgcaccgattggggttctggccctgcaatattgccataaacaattaccgttaatcgttttgcgccgccgtgcggggttttatatcggcacgatggatgaaggcattccctgctctcgtgagtcagtggagtattttgcccgacgtgaacaggcggagtttgccctgaaacaggggcaatggacacaacgtcacccccgataa

SEQ ID NO: 4955 - DNA, 552 bp, Xenorhabdus bovienii
  Coding DNA location: Contig name=SeqID_16900; Position on contig =148138..148689bp; Strand=+
atggacacaacgtcacccccgataacaggagaaaacaagatgtcttcacgcggtgtgaacaaagtcattttactgggatatctggggcaggatccggagatccgctacctgccgacaggtggtacagtggcaacactttcactggctacgtcagaaaactggaaggataaacaaaccggcgaactgcgggaaaaaaccgaatggcaccgggtggtaatttttggcaagttagcagaaattgccgaggaatatttgcagaaaggggctcaggtttacattgaagggcaactgcaaacgcgtaaatggcaggataatcagggccaggatcgctattcaacggaagtggtagtgaatgtgaatggttcaatacagatgctggggagccgtaatgattcaaagagtatggcacctcaacaggcagggcataagccagcacaaaagcagccatcacctaaacctgcgaatcaggaaagaaaaaacacccgtgcgttacaaccgctagcgttaccggtaaaagaagacgctgattgggattcggagatcccgttctga

SEQ ID NO: 4956 - DNA, 765 bp, Xenorhabdus bovienii
  Coding DNA location: Contig name=SeqID_16900; Position on contig =148789..149553bp; Strand=-
atgaggaagatttttctcaatggctcgaaaactattcactgggtgaattatgggctaagaacgtcatcgccggagggccaacttatgagtaattacatcgaagtcatggctatagttgaaggtaaaacagaacaaatttttattgaaaaaatgcttcaaccttatctggctgagaaaatgattttcatctctgcaactcaggtgtctaagcctggacaaaaaggtggagatgtgcgtttttcaagagtcaagaaagacattgagatgcatcttaaacaacgtccaacgacctatgtgacaacatttattgattattacggtaccaatgaatggcctggattagagacgttaaatagacattgggaaccaaaacaaatagccgagcatctgcatctttcaacacaaaatgaagttcgtcaattcctgccagcacagagagttgatgaacgttttatcccatacattgttatgcatgaatttgaagctttactctttagtgacaaagagatacttgccaatgaattaaatattgatgaacaagaagtggagcaagtacttcaggaatgcagggaaccggaatctattaacaatagcccacaaacagcgccttcaaagagattgggaaaatggtcagcgaatggagtatttgccaaaaccacaactggaatcgctattgccgagaaaataggcatccctaagatgagagaaaagtgcccattatttgatgaatggctacataaacttgagatattgataacaatttaa

SEQ ID NO: 4957 - DNA, 1179 bp, Xenorhabdus bovienii
  Coding DNA location: Contig name=SeqID_16900; Position on contig =149462..150640bp; Strand=-
atgcatgatttatcatcaatagttatccccttgtctgataccgaagtaaagcatttcaaaggaggcgatatgactacgtctttagacaagctcacgattaaaggatttaaatcaatccatgagcttaatgaatttgaacttaaaagcttaaacgtaattgttggcgctaacggcgcaggtaaaagcaatttgatctccttttttaaaatgctgcgggcattaatagacggcacattaaatcgctatgtccgcgatagtggtggtgcaagtgatttactttttaatggcaataaagtcacgcaaaaaatggagtttgatacacgcttcggggaaagaggatttcgctttaaattagttcccacgccagcagatagctgtgcgattgaagacgaagctcgctattacataaagagtgctggcgacggatggtgggaattgggcgatagtgatgatggcagatccagaatggttgctgaaatcgagaaaaagtcccttgatgcaaggcattcaaaacccgtttatgatgccatagcgtcctggcagatttatcattttcatgataccagcgctacagccggaatgcggaaatatgaaatcatccaggataacaaaacattacgtacagatgcgtctaacattggagcgttcttattaaaacttaaaaatgatgctccaaatgaatacaaatcaattgtaaatgcaatcagattagtcacccctttctttgataactttattctggaacctcgccaaagcggttcaaaagaagaagttaacattagctggacgcaaaaaggctcagattatccgatgcagccttatcatctatcagatggttcaatacgctttatttgtctggcaaccgcattattacaaccaaatccgccatcgaccattattattgatgaacctgagctgggtctgcaccctgcggctattgtgatccttgcagagttaatccaacaaacggctcagcgtacccaagttattatcgccactcaatcccctattttaatcgatcaattctccgccgcagatattgtcatcgtaaatcgtaaaaagggggcttcaagctttgaacgtttaaatgaggaagatttttctcaatggctcgaaaactattcactgggtgaattatgggctaagaacgtcatcgccggagggccaacttatgagtaa

SEQ ID NO: 4958 - DNA, 129 bp, Xenorhabdus bovienii
  Coding DNA location: Contig name=SeqID_16900; Position on contig =150661..150789bp; Strand=-
ttgatacatcgttttattcattcaacaataccaaaactgaagttgaagtgcttatctctaacagtaagcataaccaaagaaacacttgattcagagaatagtgccccggccatcagcgggttatgttaa

SEQ ID NO: 4959 - DNA, 285 bp, Xenorhabdus bovienii
  Coding DNA location: Contig name=SeqID_16900; Position on contig =151102..151386bp; Strand=+
atgactatgactcacactcagaaagactggcacccagccgaaattatttgtgcattacgcaaacgtggtacaaccctcgccgccgtctcccgcgaagccggattaagctcttcaactctcgccaacaccctgtcccgcgcctggccaaaaggggaatggatcattgcgaattatcttgacgttcatccctctgaaatctggccgagccgttattttgaccaatatggtcagttgattgagcgtaccgtgcgcaaagcggtttcagcagaatcttcagagcaataa

SEQ ID NO: 4960 - DNA, 537 bp, Xenorhabdus bovienii
  Coding DNA location: Contig name=SeqID_16900; Position on contig =151492..152028bp; Strand=+
atgagaataaccgtattaatgggcgtattggtcacaatcctgacgggttgtcatgccccgtcaaagcaactgccatctaaatgtactcccgaaaaagccatttcagcaacgcagctcacgcgcaatattcagcccgtctcacccgatatttatcaacaagcaccggaagttgtccgttacggtcgttatatactggtaagtaccgacccaacagcagcacagcgtgacccactttctcaattgattgaggtgcatattcctgcttctcagaatcccaccgtggccgatgccctgcgtgacgtattgcgtcagtcgggttatcggttatgtacgcctgaaaaaaccaatgacattttatatcgtcagccgctgctgtcggtacattatcagttagctcccatccggctgcgtaccgctttgcagcttatggctggcccggcctggcaactggaggtggatgaggtgcaacgtgaggtttgtcaccatttgcggccgggttatcagcttccacaaccccggcagggaaagcagccatga

SEQ ID NO: 4961 - DNA, 696 bp, Xenorhabdus bovienii
  Coding DNA location: Contig name=SeqID_16900; Position on contig =152025..152720bp; Strand=+
atgagattgcatcaaatcggtctggtaacgtggatagtactcagcagcccaacatgggcagccacaccgtcacccttaacgtcgcagcaggcacatacggtggaaagccaaaagcaaacattgagaatacaggccgggcaatggggattgaacgcggatgaatatcagcgttatcagcaattattgaatggtccaaggggtatccagtcgccggggcttgacccgttgacaaccctggggattgaagctgaaagtgatgtcgaacgtcgccgttatgctgaacagtgggtcaaagccgagtttgcccgtactgaaaaagaactgcgttttcagcgggaagtggatgccgcctggcaacgattatttccggatatgttgccggtcaatatggagaaatccggtgaggcaaaggagcgtttggcgttgtttgtcaaaatcaacgattgcccgccgtgtgatgcccgtttagcggaagttctggcgttaatgcaaccggttgacatttatctggtcgacagcaagggcaatgacgacacattacggcaatgggccaaaaaacaccgaatccctgttgagcgagtgcgcaaccggcaagtcaccctgaatcatgatgcagggtactggttcaggtttgggcagggtgttatgccggtcttattgcggcagggagagcagggatggcatatcacgtcatga

SEQ ID NO: 4962 - DNA, 543 bp, Xenorhabdus bovienii
  Coding DNA location: Contig name=SeqID_16900; Position on contig =152702..153244bp; Strand=+
atggcatatcacgtcatgataatgaaagggttgcgcgtattccccattatcgggatgctctggttcaatacctgccatgcggagctgaacgtcattgccgatttaggcggcaaagatgcctcgcctttttatgaaagcattaatgctgagcaacgcgatgaccctgtgtcatcggtgcagaattcctcacccgaaatggcaggtgaagcggcgatgttgcctgtcaaaacaccggaactgacgccgggaaaagtggcaagcagaccactgcaactgccgggaattggcgcactgtttctgattggggatgatcccggttcacgccagtggctcagtcagaatgcggccacattgacgaaactgcatgctgtgggtctggtggtcaatgtcagtgaaatggcgggattacaatcactcagggtatcagcgccggatttattgttatcgcctgcttccggcacagaactggctcaccgtttgccgttgcagcattatccggtgttgatcacggaaaccgcactttcccaacagttgtcaccatga

SEQ ID NO: 4963 - DNA, 2064 bp, Xenorhabdus bovienii
  Coding DNA location: Contig name=SeqID_16900; Position on contig =153241..155304bp; Strand=+
atgagccgctgttatgtggtcgaagcgctgctgcgtcctgccgttgaactgaatactgctgtggtctcagtcgttgcggcttttgtctgtatccgggcaccctgggccatcgcactggcaccttcagtcagctatgtgatggccggtggttttactgtattagcgatgatacgcacatggcagggtattcaggtcatccgttatcgcagaaacctgcgtcgcctgccacgttaccagatgagcacaaagcaaattcctgtcagtcacaggcaattgtttctgggcaggggatttcgctggcaacagaagcatattcagcgtttgcaggatacgcgacgaccggaggtcgaacgatttgtgcaacctgcccggctctatcagcttgcccgcgcactggagcgtcgaactgaataccgttggccaaaattatcggcgttgttacgtcaggattcgccatttaatccggtacgtccgttgccaccagtgggtggcaatcttgctatccacggtattgggccacaggaagccgatgtttttatggatctgcgcgagcgggtcgggcatacgctggtgatggggactacccgtgtgggaaaaacccgtctggcagagttgctgattacacaggatatccggcgtggcgaggtaacgattgtctttgatcccaaaggcgatgctgacctgttaaaacgcatctgggcggaagcacatcgggtaggtcgcggcaatgaactctccctttttcatctgggctggccggagatatcagcccgttataatgccgtcgggcggtttggccgggtatccgaagtggcttcccgtctggccgggcagctcagtggtgaaggcaacagtgccgcattccgtgaatttgcctggcggtttgtcaatattgttgcccgtgctttggtggcactggggcatcggccggattaccagcttatcacccgctacgtcaataatatcagcgaactgtatcagcgttatgccaccagagtgatggaggagaggatgccggcattattgtcacagattaaccattacctcggcaccctgaaagaaaaggatgtgccgcgcaatatgcaggggcaacccgatgccctccggctctgggccatggaaatgacgctgagttctgacacaggaaaacaactctatgacccgattttggacggattacgttcggccgtgcgttatgaccgcacttattttgataaaattgtggcgtctctgctgccgctgctggaaaaactgaccacaggcaaaattgccgaactgttatcgccggattacctcaatatgacggatatgcggcccatctttgactgggagcaggtgatccgcaaaaacggcattgtttatatcgggctggatgcactgtctgacagcgatgtggcttcggcggtaggtaacagcatgtttgcggatttggtcagtgtcgcggggcagatttacaaatatggtatgaacgccggattaccggtacgtcatgatggcaaactggcgatcaacctgcattgcgatgaattcaatgaactgatgggcgatgaatttattccgctgattaataaaggtggcggcgcgggcatgcaggtgacggcatatacccagacctcctccgatatcgaggcccgtatcggcagcccggccaaaacggcgcaggtgataggtaacttcaacactttgattatgttgcgtgtgcgggataaccggacggcggagttgctcaccagtcagttacctgaagtggaaatctacagcaagaccctggtatccgggcattcggatattgccgatgttgaacagggacaggatttcacctcttccacacaggacagggtaggcaccgtcaaaacgccgcttgtcactcccgctgaaatgattaacctgccgaaagggcaggcgttcgcgttactggagggtggacagctgtggaaaatccgcatgcctttgcccacaggcaatgaggatgatgccctgatgccagccaatttgcagaaaattgccgaacagatgcgcaggtactaccgcaccagtgaatcctggtgggaagagaaggggtag

SEQ ID NO: 4964 - DNA, 759 bp, Xenorhabdus bovienii
  Coding DNA location: Contig name=SeqID_16900; Position on contig =155313..156071bp; Strand=+
atggcacagtcagaaaatcagtcccgcccatcttcccaaccgccccgcaagcatggtttgttgtatcgtgtgttatgggaatggccgtggcaactcattgggtttatggcgatgtcttggctattcagcctgttactggaatatcttggtatggcttttttctggccggaagagggtgccactcacagtcagaatatgatgaaggcagagcttaactatctctcctcggaatttacccgaagcctgttgctgtcagaaccctcacaaaccgtttcggcatggctggcgcaagcctatcaatgggtgtttgtggacagtggttttatgggctgggttcagggacagtcgcaataccagttcaatagccgcaatgattttatgcgtgaattcaattccgtattacagggtgtatcgagctatttgcaagaatattggctggccacggtgtttatcacgatggtgacgttgacccggatagccattctgctgttatccgtccctttgtttgtgatggtgatttttgtggcactggttgacgggctgggacgtcgggatttacggcgttatggtgcagggtatgaatccagttttgtttaccatcatgcaaaacgggggataaaaccggcctgcactgttccctgtgtactgtatttatcgtggccggatgtggtgtatcccacggtgatattgttgcctgcggcgatagtgctgggcatggcgattgtgataacaacatccatgtttaagaaatatttgtaa

SEQ ID NO: 4965 - DNA, 693 bp, Xenorhabdus bovienii
  Coding DNA location: Contig name=SeqID_16900; Position on contig =156164..156856bp; Strand=-
atgctgcggattgatttaagcgtccctgatgaggaatacgagcaggcacggaagctgggtgcgcactgggatgccgtcgaacaaatctggtatatcgacaacagcattgacccgacgccgtttatcaactggctgccgttctacaatgtccatgcagaatactggtatctcgcccagactcagacagcctgcccgcactgtcaggaaaacaccaccgtcacggcctgtatgctgcctgccggacataagctgctggaagcggacagcgacgatgaacccaacacagaaattgactataccgagcaggacagatcggcgttcttgttttatctcgccgatcttcctaccctcatgcgtaacgtgctgcctggctttcaccaccgccttcgcaaagtcgtcagccagccgctgcaacggcagcactggataaaccactgcgaacactgtgatgcgccgctggatgataccgaactgtttaccgaaattggcggcgcgttttttccagcatctaaggagcaggccgcaaggattcagttacaccgtatcgatcagccgtttgtcgggtattgtgaagatatttcgcatcatcactaccattttgacccgaagcaggataaccgtatctgtaaagcgtgtgactggtttgaatggatgacgcaggtggtgaatgcaccgtcaaaataccagcattag

SEQ ID NO: 4966 - DNA, 96 bp, Xenorhabdus bovienii
  Coding DNA location: Contig name=SeqID_16900; Position on contig =156937..157032bp; Strand=-
atgggacagggaaaagcaactgcgcataaacattcacctcgtgatggatttcaggccatcgaggatgcgaggttttttacggcaaatcagcaataa

SEQ ID NO: 4967 - DNA, 336 bp, Xenorhabdus bovienii
  Coding DNA location: Contig name=SeqID_16900; Position on contig =157000..157335bp; Strand=+
atgtttatgcgcagttgcttttccctgtcccattctgcctgcctgctgagtctgatcttggtgtgtgtaccgcttgcgcaggcggccgagaaagacgaactggcgagtgccaaaaaactgattgagcaggtacaaatggcactggaacgtgccaatattgccgaaaagcccgctgacaccgaaaaacagccccgctatcactttgattacacccgaatcaaaaccgatctcaataccatcaaaaccggtattgatcactacctgatgccctcccgcgatcagccggatgagccagccccgttatccggtcagtatcgtcaggaacgtcggcaatga

SEQ ID NO: 4968 - DNA, 237 bp, Xenorhabdus bovienii
  Coding DNA location: Contig name=SeqID_16900; Position on contig =157332..157568bp; Strand=+
atgacccccacccagcgcaatgcctttgaggtagcctcggggcattttgatatcacttttttgtatctggtctgcgtcggatttttcctggccaccctgtttctttgggcagcctgggccgcggtcgatgtctggaacggctgggcgaatgaaaaagtacgtaaccagaccatcagccagtttgctatgcgaaccgccatcttactggtggttgcggtctggatgtttgccagctga

SEQ ID NO: 4969 - DNA, 216 bp, Xenorhabdus bovienii
  Coding DNA location: Contig name=SeqID_16900; Position on contig =157480..157695bp; Strand=+
atgaaaaagtacgtaaccagaccatcagccagtttgctatgcgaaccgccatcttactggtggttgcggtctggatgtttgccagctgatgcaacgaacataatgaacaaggaatggattgaacatgaagtcaatttttactgtctgtcgtcgtatcagcacgaacctgataaccagaataagcacctttcttttgctgttcggtttttcctgtga

SEQ ID NO: 4970 - DNA, 417 bp, Xenorhabdus bovienii
  Coding DNA location: Contig name=SeqID_16900; Position on contig =157754..158170bp; Strand=-
atgaacagcatacccgtcggtatcatgacccaaccggctaacgggataaaaggaaggctcgccatcagcccgaatgccagccccagcaaagcggccagccccatttccggcgtggtgaatccgcgaaatacgaccggttcggcatttaagcgatcaggtaagaaagggatcgtctgcatcagcgacaccttaaaaaataatgccggccgatttcgccagcagccaaatcaccgcaaccaacagcaccacgccgaccacaataatggagccaaactgtgtccaggtggctttgccgtcccgcacttccgaaaaggtttcaaccgccgccgaggcgaccttaaagaacgcgactgccgaaaggatcagcccgccaatcacaatgccgtcctgcgcatagcctttcacctgtcccagtaa

SEQ ID NO: 4971 - DNA, 282 bp, Xenorhabdus bovienii
  Coding DNA location: Contig name=SeqID_16900; Position on contig =158067..158348bp; Strand=+
atggggctggccgctttgctggggctggcattcgggctgatggcgagccttccttttatcccgttagccggttgggtcatgataccgacgggtatgctgttcatgcccttgttattgattagttttagcggtcgctggctcgttcagcttaagcgcggtaagccggaaaattatctctggctgaagctggaagagaaaaaacgccgaatgggcatcggtgatccggcattgattattacggctcagggctggtcgttgcgccgcagcaggagcctgcgatga

SEQ ID NO: 4972 - DNA, 657 bp, Xenorhabdus bovienii
  Coding DNA location: Contig name=SeqID_16900; Position on contig =158345..159001bp; Strand=+
atgagtcggtttcgtcatgcgctgaaaaaccgtgaccagcatatcctgaccctgcggcttgcctgcggggtgctggtattggtcttgctgatcacgctcacgggctggatgatgtcaccgcgcaatctcactatccataatccgccggacttacgcagcggcagtacccgcccgtggtgggaagtgcctgcgccgagtgtctacagttttgccttttatcttttccagcaactgaacgcctggccgaaaaatggggcacaggactacccggctaaaattgcggccttgtcgtcttatctgacccccgcctgtcaggattttttgcaggcggatgccaaaacccgggccgacagtggtgagctgcttgatcgggtgcgggtggtgtatgagatccccggccggggctacgggacgaaaagtgtgacggtgcgtaaccgggataactgggtggtgcggctggatttggtggctgatgaatattatcacgccgaacctgtcaaacgggcgctggtgcgctatcccctgaaagtggtgcgctgggagggcgatgcggagcgtaatcctttcgggctggcactggattgttacgacgggatgccgcagcgtctggaagccatgccgcaacctgtggaagagaaaaagggcgtgttccaatga

SEQ ID NO: 4973 - DNA, 837 bp, Xenorhabdus bovienii
  Coding DNA location: Contig name=SeqID_16900; Position on contig =158998..159834bp; Strand=+
atgaaaagatatcaatcttgctcttctgcctgtttttggctggggttggtcagccttttgttgttcagcctcggggcaaaggccgatgaactggtgaaatgggaacgcattccgttatccattgccctcaaagtaggacaggagcggattattttcgtagatagaaatgtccgtgttggtttgtctccgtcactcagcgataaactgcgggtgcagagcgcaggcggggcggtttacctgaaagccagccaatcttttccgtctacccgtctgcaattgcaggacagtgaaaacggcgaaattatcttactggatatcaccgccaccaaaatggggtcaacggaacccgtccgcattctttatccggatgaaaaaaattctgctccaaaagaggggtcaccgcatcagagaaaatcagcactttcggctcccgcgcctgtgatattaacccgctatgccgctcagcagctttatgccccgctgcgtaccgtcgagccggttacggggatccacccggtcaatctgcatttacccggatccatcacgacactctacccttcagaaccgattgcggtttccccgctggtcggctggggtgtgcaaaattacacagtggtagccctgaaactgcgtaatacggctaaacgcaacatcacgctcgacccacgggctttgcaggggcagtttgtggcagcgacgtttcagcatcgctggctgggcgaagcagggacaccggaagataccacagtgctgtatcttgtgacccgaggacagccggataatgcctttatccctgagccggtaacggtgaaaccgggaggccgtcatgcaggttaa

SEQ ID NO: 4974 - DNA, 1431 bp, Xenorhabdus bovienii
  Coding DNA location: Contig name=SeqID_16900; Position on contig =159824..161254bp; Strand=+
atgcaggttaaatccaacagtctggtgaaaatcctggtgccgatggtgctgatggtcggcgggtttatcggcatcaaaagttgcagctcaacagacagtaccgcacccaacacaccccagaataatgttctgtccacgttgtcaccggaggagttacaggcgctgggtgtcggcggtgatacgccggaagataccttgcgtacgctggtgggaacactcaataaagtgcggtcagagcagcaacgcttaggtcagcagaatgccgatatcctgaaagaaaatgaccagttaaaaaatcagcgtcaggatgtcgccggtcagatagacgcggcggtggcagctatccggcaggacgatgaacagcgccgacgtgaattacaggatgaacagcagggattgctggcacagattgatttactgacagaacggctgaattcaacgcctttgtctgcgccggacagtccgataccacttgggtcgggaagtattccgtattctgccaattcaggcacagggcagaatgaacttatctggataacacccgccgatgaaaagcccgcagacatacaaacccccggcagtggaaaagccacggcgcagttcccggcctcttttttaagtgaacaacctgctaccgggcaaaataaaccccaaagcccatcgcttcaaaacccatcaaaggaagaaagtgaacagccaatctataccctgcctgaaaatgccacgttagtcggtagtcaggccatgaccgcattattaggccgtgtccctgtaaatgggacagtgaccgacccttatcctttcaaaattcttatcggtaaagacaacctgacggccaacggcattgaactgccggaggtggaaggggcggtggtgtccggctcggccagtggtgactggacactctcctgcgtgcgtggtcaggttaattccatcacggttgtctttcaggacggcacggtgcgtaccttgccgggggcagggcaaaacacccacggcagtgcgaacggcatcggctggctgtccgatgaaaacggcattccctgtatcagcggtgaacgcaaatccaacgccgccacttatctgccgacattgtttgcgctctcggccatgaattcggccggcgatgccctgagtgaaagtcagcgtaccgcccaggccaacggcacaggcggtatcacgaccgcgttaacgggcaatgccggacaggccgcattaggcaaagcgatgtcaggtggcatgaatgacatgagtgaatggctcaaacagcgctacagccagacgtttgatgcggtttacgtcccgcccggtgcccgtgttgtggtgcatatcacacaacgcctggcgattgattatgaaacgaaaggacgtaaggtgcgctacggcgtgagtgagccagcccaacgtgataatcaggaagcattagattaa

SEQ ID NO: 4975 - DNA, 357 bp, Xenorhabdus bovienii
  Coding DNA location: Contig name=SeqID_16900; Position on contig =161254..161610bp; Strand=+
atggaaaagaccccttctcagtggatattcagtgcgggttccccgtattgcctgcaagtgtcggtgatgtcactgactgaacccgcacgggtgcagctttactggcgtgcggtgcgcaaaaaagagtgtcggttgtatctcttaaccgacagagaatgtcagccgttgagtgacggtgattttactgtcttccgcctgaccgaaacccagaggcaggcagtggttgacggtaaagtcagcatggcgcctgaacagtgggtacctttgccttttaccttatcagagctggcggtacacccggaatttgccacgtttaccgtccttggcaccccggaggctgccgtatgcggaaaataa

SEQ ID NO: 4976 - DNA, 402 bp, Xenorhabdus bovienii
  Coding DNA location: Contig name=SeqID_16900; Position on contig =161598..161999bp; Strand=+
atgcggaaaataaaatattattggctattggggttggcagggctattagtcggatgtaccacttcgaaagacgccttactccctgccggaaagcagacagtactggcaatgtggcaggggaataaggcaggtcatgccaccgaatcggcaagggaaacactgcgccgttctttaactgtatctgaacggctcagggcactggaagaaccttatcattacagccgttcggcagcgcaggaaatcagccagcaatttccccgcttacccaatcccgatatggtgatgtatgtttttccgcatctggtcgctggcaatacgccgataccgggttacagtacagtattcccgttttatcagcaggtacagtatgccctgccgggtgaacgcatggaggcactgtaa

SEQ ID NO: 4977 - DNA, 2766 bp, Xenorhabdus bovienii
  Coding DNA location: Contig name=SeqID_16900; Position on contig =161999..164764bp; Strand=+
atgaacatccccaaggcactgaaccgtcccggtaaattgcgtgaggtggatgaagccgcgatttaccaggcgaacccttccatcatcgattacctgccctgggtggaatatctggaagacgggcaatgtttattgttggatgacgggatttccgtcggcgcggtctatcagattgaatccattgctaccgaaggccgtcccgctgagcggttgactgaaatccgggatcaactggaagatgcgatccaggacagtctggaagaagatgatatttcgccgtgggtggtgcagtttttttgtcaggatgaagatgatcctgctgactatctcaacaccttgcggggctatgtgaaaccctgggcacagggaacactgtttactgacgcctttctggcggaatctgagcatcacctgaacagcattgcccggcctgacgggatatttcaggacagcttaatcaccgggcaaccgtggcggggccagcagcgccagacccgcatggtggtttaccggtggctgcctgacgggcgcagatcccctgtcaaccatctgaccttatcggcggtggctgcgctcaatcaggtctgcgagcggctggtttcatcactggcttctgtcggtgtgattgcccgccgacaacatggcgggcagatccaccgttggttgctgcgtcattttaatccggcgccggattgggggatggcaaaagccgatttttaccgtaccgtcagttatgaagcccctacacaatcggatctccccgtcagtaatgactttgccgaaagcctgtggttcaccccgccggtgtctgatcccgacgcgggcgtctggtggtttgacgggttgccgcataaagcggtgctggttgagcgtctgcgccgtccgccggaaccgggaacactgacaggcgaagtgaaacggggcgacaatatcaatgccctggtggacatgatgccggcagggacggtggtttcgctgaccattgtggcgcaggcacaggacagactggaagaggactttacccggctgtcgaaaaatgcggtgggagaaaatactgaatcgctgcgcgtccggcaggatgtgcaggaagtgaaggaacttctggggcggcggcataaattgtaccgcagtgcgctggcctttctggtgaggggcaaggatctggatgatataaaccaccgggtgcatcaattatcctccaccctgctgacagcaggattacagcccgtccggccggaattcagtgtgtcaccgctgaatgcctacttacgggcactgccgatgtgctttaacccgcagaaagacaaaaaacactggtacagccgcctgacctgggtacagcatctggccgggttattgccggtgacaggccgttcgaccggcaccgggcatccggggttcagtttctttaaccggggcggggcaccgctgacctttgatccgatgaacaaacaggatcgcacccagaatgcccatttactgctgtttggtccgaccggcgcggggaaatccgccacactgtgcgcctcgttgatccaattaatggcagtacaccggccgcgtctgtttattgtggaggcgggaaacagttttggcttgctggccgattactatgaaagtctggggctgacggtcaataaaatcggtatcagaccgggttgtggcgtcagtctggcactgtttgccgatgcccatcaactgctgcaactcagtcctgagcaattgcgcattaacgaagctgatattcctgataccgatgaacaacaggaagaggaagctgatgaacagcgcgatattctgggcgaaatggaaattgccgcccgactgatgatcaccggcggtgagaaaagagaggaaaagcgtctgacccgctctgatcggggtttaattcgtgaggccattatgcaggcggcacagaccagctttgacgagtcccgccagatggtggcgtcagacttacaaaatgcgctttatgccatcgcccgtaatcaccagcaggatgagcacggtcagcctttaattactgcacaccggcgggcacgggcggatgaaatggccagcgccatgtcgatgtttacacaggggtttgagggagaattatttaaccgtcccggtacgccgtggccggaagtggatgtcaccctgattgatttggggacactggcgcgggagaattactcggcgcagatggcactggcgatggtctcgctgattaacaaagtcaataacctggctgaacgggatcaatatcaggatcgcgaactgcaactggtgattgatgaagggcatatcaccaccaccaatccactgttatcaccctatatgactaaagtggtcaaaatgtggcgtaaactcggcgcctggctgtggctcgccacacaaaacttagcggactatcctgacaccgccgaaaagatgctgaatatggccgaatggtggctgtgtctgaccatgccacccgatgaggtggagcaaatcgcccgttttaagaagctgactgaagagcagaaagcggtgctgctctctgccagtaaattaccccgttgttataccgaaggcgtggtgctggcaaagaaaatcgaagccttattccgggttgtacccccgagcctgtatctggcgctgggcatgacagaaaaagaagaaaaagccgaacggcgggcattgatgcgggaacatcagtgcagtgaactggaagctgcggtatgggtggtcagaaaaatggatgttgcgcggggattgaaggttaattctgtagaacactga

SEQ ID NO: 4978 - DNA, 342 bp, Xenorhabdus bovienii
  Coding DNA location: Contig name=SeqID_16900; Position on contig =164851..165192bp; Strand=-
atgagtttagacgataaaatatatgctgaaataggtcagttactatacaattcagcgcctgattatgcaaaaaaaatcataatggatacagaattatctcctgagggagattgctgtcagtttaaatatgattatattaactcagctgatgagatgaattggttttcccctcaagagaacgatgggttaacaaatgaaagaattagagaattgttagtttcactcaggcaattttttgtagaaaacatccatttgaagcaaccgccgcattggtcaggctgtatagtgaccgtggatgtggaaaaaatgaagctcaatgtcgacttcaaatacgaagactaa

SEQ ID NO: 4979 - DNA, 336 bp, Xenorhabdus bovienii
  Coding DNA location: Contig name=SeqID_16900; Position on contig =165257..165592bp; Strand=-
atgataaatgatgatgaactttattcagaaattggtcgtatattatatgaagcggctcctgatgatgcacagacgattttactggatgcagagttatctcccggaaatgatcatgtgaagtttctatatgactatattgatgaaagtgggtgtaaaaagtggtatttccccccatcaccaaaaacagatagagagcttatagaaaatttagcaatgctgcgtaaatactacgtagaaaataacctgactaatgatcatccctcatggtctggctgtttggtcactgttgatcttaagaagatgaaaattaatatagaattcaaatacgaagattga

SEQ ID NO: 4980 - DNA, 3258 bp, Xenorhabdus bovienii
  Coding DNA location: Contig name=SeqID_16900; Position on contig =165748..169005bp; Strand=+
gtgttgcaaaaattccaattctctctgtccaataacgcgaattttctgattatcggcctgttgagtctattgcttagttttcaggggcaggccacgtcagaacagaaaaacgaaggtaatctttctgcccacaaactggctgacatcgcctcacaattagggcagcaacttcaccaatcgcaatcccccaccgacgccgcacaatcaatcgctgctcagcagctgtcgtcggcagtcactgccacattaaccccgtggctcaaccaattaggcaatgcccggatatcactcccttttgatcacgctttttcgttaaaagaagccgtgctggattggatgctgccgtggtataccaccccgggctataccgcattcagccagtggggagttaaagccgggcacggtcagacgaccacccatcttggtatgggataccgctatctgactgataactggctctggggggctaatgcgttctgggatgctgagtggccagctcaacatcatcgctacagtatcggggcagaagcgtggcgcgataacttcaaactctctgccaacctttaccggcgcttatccggctggaaaacgtcccgaaaagtcaccgattatgatgcgcgtcccgctaatggctgggatatccgggtagaaggcgggttacccgtgttgccgcactggggcgggcaggtggtgtttgaacaatactacgggcagcaagtggatttattcggtgacagcagacgtcagtacaacccctacagcctgacggccgggctgacatacacgccggtgccgttagttacattgggcgcggattttcggcacgggaagcaggatcaccgggataaccgttttacgctggcacttaattaccagctgggcgtccccctggcacaacagcttgatcccaacgcagtcgcgccgttacgcagcctgacattcagacggacagattttgtcaaccgggagcataatatggtgctggactaccgcaagcagacgctgataacattggactttcccgttcagcttaaaggcgatgcaggcaaaatcatcacctttacgccacgaattacctccaaatatccccttgcgcgtttagaactccgggctgatgaattacagcaagcgggcggtaaaattattcaccagacgcctgacaaagttaggctgcttttgccaaaagcagccgataaaataatccggctttccggtattgccattgacaggcacggcaatcgttcccggccatcggaaaccaccctttttatccagccgacggaaacccatgtgcaggttaccgcaaaccggacgcaggcaagggcggacggtcaggacagtgtgatgtataccgtgatggtgaaagatcgtgacggtgaacctgttcccgatcaaacggtgagctggtcaagtgacaaaggcaaactttcacaaaccacacagaaaaccgatgcacagggactggcggcggtgttgttgagcagccattatgatggggagcatagcgtacaggtctcggtcggtgataatgtcaccgtggccctgccggtgcacttcagcgcggtattgaaacttgttatcaccgcagacaaaacacaggtcagagccaatggtcaggatgcagtgacgtttaccgtcaccgtaaagggtgctgctggcgttcccgttcctcaacagtccgttaagtggcaaaccagccggggcaagttcctgaccttgtcgtcaacaaccaataatcacgggcaggccaccgccgcattagtcagtttaccctctggtatcgcagaggtgtcggtgactatcggtgaagaaacgcttatggcatcaccggttgaatttttacctgcactgacccacacgttgacctgtgacaaaagtacggccattgctgatggacaggacagtgtgctttgcacggttgacgtgcgtgatgcggctgaccagccgatggtggggagggaaatcgtgtggtcaacagatcatggccagattggcgatgaacaggttatcaccgacagcaggggaaaagcccgggcacgggttatcagccggaaagccggtgtcgcccgtgtccgcgctgacatatcaggtaccatcatcacggcggacggggtcacgtttaaacgtcagttgcaatccgttatcatcgcggataaaacccacgccaacggaaacgggcaggaagctatcgtgctgaccgcgattgttgaagatgcgctggggttaccggttgaaaaccaggctgtcatctggcacaccgacagcggtgtcctgtcatcagcagagacccgaaccgactcgcaaggggtgacacaaattcaactgaccagcactgttgccggtgaacatcgggtatggattcaggttgatgataagacggtgactgccccgacgctctggtttgatgatgtgctgacatcaaccctgcatgcagataaaacccgcatgattgccaatggtcaggatagcgtcatattgaccgtgacggtgaaaaacctgaccggacaacccgccgtcggtatccctgtctggtggcgctcggacaacggtcactttacagacgctcagattgaaaccgatgaaaacggtgaagcccgtgcgacactgagcagccagaaggcaggcacagcttcagtaacaaccattattgatgaccaggaagttatctcgccaacggtggaatttatcccgccattacgtattgccgataccgttgccgttgacagtcagggcggtaatgccaaccagaaatcctttggcacccgggggccttcagttttctggcgtggcgcgaaattccgcatcatcatcgccgataatacaggccgggtgaactggcagagtgattctccggcggtcacagtatccggtgatacggtggtcgtacagcaacgtcctgatggtgtgagactgacaggtaccgatgaagcagggcagcaggtggtactaaccttaacaagcgatacctggttcgagcgttcaggcataacgaaagatttttattttagtgcaacgcaaatttgccaatcactcggcagccagattgcgcccaaatatgcacttgaacggctttatgaagaatggggaaatttttatcactatgaaggctgggtgagggaattttatgtggtttccacggattatctttctgccagttccggttcaatgaatgcgcagacaaaatgggcattctgggcagaatcggatagctggatgcgtaatgcctggcatcggctggcgtttgcgtgtggtgggtag

SEQ ID NO: 4981 - DNA, 276 bp, Xenorhabdus bovienii
  Coding DNA location: Contig name=SeqID_16900; Position on contig =169226..169501bp; Strand=+
atggctaaagtagatgttgattgtcgttattgtcacaaatcagaagatgtcaaaggacatggaaaaggtcatagaggttatccccgctaccgctgctatgcctgcagtaaagtctttcagttggcatactcctatcaagcctgcaaaccgggagtcaaagagcagattattgatatggcgatgaataacagcggcatccgtgacacggcccgcgtattgaaggtggcaatagctactgtgatgaaaacgcttaaaaactcaacccccggaacgtga

SEQ ID NO: 4982 - DNA, 423 bp, Xenorhabdus bovienii
  Coding DNA location: Contig name=SeqID_16900; Position on contig =169498..169920bp; Strand=+
gtgacgacgcttcctcttgacggggataacatacatcttatctgtgaagtggatgagcagtggtcgtttgtgggcagtaagaaaaatcagcgcgggctctggtatgcctgggagccgcgtatgaaacggatagtggcacatacttttggtgatcgcagcagaaaaacattggaaaaactgctggcactcttgtcaccctttaatatccggttttactgtacggatgattatgccgtttatgattgccttcctgaagaagtccatcttactggaaagatatttacccaacgtatagagagaaccaaccttacccatcgtacccgaataaaaaggctgaatagaaaaacaatcggttattccaaatctgaagaaatgcacgataaagtgataggcactttcattgaacgtgaaaactatatttag

SEQ ID NO: 4983 - DNA, 93 bp, Xenorhabdus bovienii
  Coding DNA location: Contig name=SeqID_16900; Position on contig =169990..170082bp; Strand=+
atgctgagtagcctctccaaattcttcaataaagtaaccgaaattatcatcacgcattatttttccccttactccgacataattctaacataa

SEQ ID NO: 4984 - DNA, 636 bp, Xenorhabdus bovienii
  Coding DNA location: Contig name=SeqID_16900; Position on contig =170146..170781bp; Strand=-
atgcgagatgaattttttgaatgcttcattgacgatttgggagaagcaacccaacataggcctgtaccatctgaatctatagataaatgggtgggaaaacttccgggacaattattgtattactggaaacatgaaggatggaatagttatcaagatggtatgtttagtattgtcaatcctgacgattatgaagatattgttgatatgtggttagaagatacccctttcgaatcaatggactcttaccacgtcatcgccagaagtggttttggtaaactttacctctgcggcgaacaaaccggaattaatttaacacttgattgtgtttttaatacctttttttattctccccaaagagcttataaaaaagaaaagaaagaattagatcacgatatatcttctttttttgctgtgaaatcaatcgacgatattgatttaaaaggcagcgcaaaaacaggtattttttccaaatccgtagaaaaatacggcctattaggagagcacgaaatatttggttttgaacccgccattgttttaggcggcgaaatcaaacttgaaaatgtcaggaaattagatatgcacatccacctcgatattcttcgccaattcgatgatcctgatatatttgaaatttga

SEQ ID NO: 4985 - DNA, 1275 bp, Xenorhabdus bovienii
  Coding DNA location: Contig name=SeqID_16900; Position on contig =170781..172055bp; Strand=-
atggcaaaaaaaaccaaaaaaacaccgcccacggtgagtgataaacccttgctggaacaaaaggcgcgcaatgatgccccgacgggggaaggcaacacgataggtgaaattgtcgggcaaccgcctcaggtcacgaaagcgcccggtgaagcaagtccgatactcaagcccggcccacagaacgaaaaaaatttcgccagtcaggcgtatgacagcgcgaaaaacgtggttgttgaggcagggaaaagcgctgctgaaatgggtaaaggcgcggcaaaagatacctggaattttggggttgatatcgcggaacttgcgtatccggctgcccaactggaggcggcacgtgccatggaagacgcggcaaggtggcatgatatttttggcaataaagagcaggcaaaggtgttatcggaagccgctgaagaggccagaggaagagcagccaccggtaatcttgatgaactcagggtgacattagacaatccggagcaggaactcggtgcggtactggctgatctgaacccgaaaggagcggttaaaggtgtcgttaaaggcatagtcgggggcgttaagaatataggtaaagcaattgaaaaagtgaccgccaaagagggaaagaaaaaaacagtgaataaggttgaaaaaccgaaggagagcgcaggcaagcctaacgagccagaaaaaaaaggcgggaaagttaagggggctaaactaactaaagttccgtgttttaatccttataacagcaaacgctataagcgattaaaaacagagaaagaacgtcaggcattcctgaaagaatattctgcacaactgcgcagacagcaggatgccattaataatatgtcgcctgaagagtttaaaattgcacgggatgcttataagaagaataagcggaatagcttggcagggaaagcacaggaagactttagagacagtgcgaaaggtgaaataaaaataaatatatttaacagccagataaaaaaaggaacctcagtaaaagaagctaaaataatatcacaaaacaaagcagacgagatattcgatggattggctgcactgcacgaaccagacatggttgcaggtggttatggtcaatatgcacctaagaagatgggtgatactggaattaacagtgccataggaggtagctggagaggaaaacgaataaaatcattagataatgctgctaaagaggcaattgacagcgggttaggtgacgctaaaatgaacgttcaattagagttatgtcggggtaaggggaaaaaataa

SEQ ID NO: 4986 - DNA, 375 bp, Xenorhabdus bovienii
  Coding DNA location: Contig name=SeqID_16900; Position on contig =172066..172440bp; Strand=-
atggcaaggagttgcactatggctgataactatttcgcccgaacagcaacgcaatggatggtcgtcagcattgtgccggatgtgtgcaaaacgccgataggtgcatcaacgccgcccattccctatccggtggtggccaaactggcggaaagctctgtgtcggtcaaatccgtgcgggcaaacggcaaacccatggtggttttcgcacaaagttttgtgccgcagacactgggcgaccagcccggcgtcgccaatggcatcaaaagcggcaccgtgggaggcaagtgccatcctaaagagcactcaaaaagtgtccgggcaggcaataaacttctgcttcggcacggtgacaaattctggatgaacggcgcataa

SEQ ID NO: 4987 - DNA, 1194 bp, Xenorhabdus bovienii
  Coding DNA location: Contig name=SeqID_16900; Position on contig =172415..173608bp; Strand=-
atgcactacaagatgctcgataccgaagacgaagaatatcatgttgtcgcgatgaaaatcgtctatcagttccggcctgtcggcgacgggccatattatcaggccgtattaaccgagccgtttggtgagctggcattacaggatgaattcagtggtgaactcaaccagtcctccgtccgacaggaaagtgacttagcgccgttaaagccgaaatgtgatgtgattgtcaacggggtggcctatgcaccgggcggcattccggctgaaagagtgcccgtccggttactcgtcacgacagcggactggcagccgcttatcgataaaaccttactggtgtggggagaacgtgagtttcaacgcacgtctgaggacgaatggcagctgacaccgccgcaaaaattcacggaattaccgatagactaccagtacgcctttggggggcaatgcagggtctatgaagacgatgtggcggccgctgccgtggttgatgaattcaggctgtccgctgagcaactgggacagcatccggaaaaagactcccctcccatcgcccatgccactttcgaatacaacccaattggcaggggatttgtcgcgccgtggtatgccaaagcgaaagccctttcccgctatcccgcgccgcgtattgaacaccctgatgcccctgtcatcggggagtacttcgccccatgctcagagccgccgaccgccatcaccgaacccggctaccggcctgcaggtttcggtatgattggccgtccctggctgccccgccgcacaaaagcgggtacctacgatgagacctggctgaaagagcgccacccttatctccctgacgattttgattttagctactggaataacgcgccggaagaccagcaaattgaccacccggataacaatatccgtatcagcctgttccatttaacccgtgagggcatactgcgggtgcagctgccgggacaccgcccttttatcctgctgagaatgctgagtggcgaaatgttacctgacctgatgtatccggataccttaattatcgacagcgaagcgctcacactttccatgacctatcgttaccacgctgaaatggacgagtccatccggttgatggaagcccggtttgagatgaatccggatgctcccctggtcagggtcgatttaggcgatggcaaggagttgcactatggctga

SEQ ID NO: 4988 - DNA, 1842 bp, Xenorhabdus bovienii
  Coding DNA location: Contig name=SeqID_16900; Position on contig =173653..175494bp; Strand=-
atgatgaagaatatcattgacaggctgcccgccgccaaaagtggattgcggtttacttttcaggtcgcggggctccccggggatacgttcagcgtgggggagttttccctgcaggaggggttatccgagctgtttatcctgaacctgacactggtcaaaacccatagcctgaatccgttcaagccgttagacgaggtggatttgaccgctttactgatgcaggaagcggagttgcaaatctttcacggcgtacaggtgcagcgtaaaatcaccggtatcatctctcacgctgactgggccggtaccgacggcaataaaaccctttataccctgaccgttcgcccggcactctggcgcctgacgctcaatcaggaaagccggatattccatcagcaaaatgtgcccgctatcctgaatggtctgctgaaaaagcacaaagtgcgggcggattcgaagctctatgacccccatcaggaccgggaatacgtgacccagaaacgcgaatccgattatgggtttttcagccgattagccgcagaagaggggatcagtttctggtttgaggatgaaacgctgtttttcagtgacagccatctcgggatgaccgccggcctgccactgacgtacagcccgcaaccggaaaccgcccatgggatagatacgatttatcaggtacgactgggggtcgggatgagtccgcagcgcagtctccacaaagattttaattacgacaatccgcgttatcacctttcccatatgaccagcagcgaaggtttccgcgattttggtacccaaaccccgtataccgtgtttgaaagctacgggcgttttcagaaagatgccgccgccaaaccgtttctcaaataccgtcatgaagcactggataaccagaaaaaaaccggcagtggcagcagtaactgcatcaaactgatgccgggcaaaatcttcgaaataaaaagtcatccgcacgccccgctcaatgcccgctggcagattgtcggtatcagccatcacggccgctgcccacaggccatgggcgataacagtggtgacggcaccacactgaccaaccagttcagctttattgacggccttgccgactggcgtccgccgttccattacaagccactggccgatggcgatgaaaccgccacggttgtcggccctgaaggggaagaaatcttcgtcaataaagacggtgccatcaaagtgcatttccactggaaccgttatgacaaggcggatgatggcgcttcctgctgggtacgggtggcacagggctggaacggcaacggctttggctttatggcgatcccccgcatcgggcaggaagtcatcgtctcttacctcaacggcgatattgaccgcccgattgtcaccgggtgtgtctacaacggcttgaaccgtcctccattggatttgccggcccagaaaacccgcaccacctttaagaccaaaacccataaaggcaaaggttttaacgaactgcgctttgaggatgcgaaaggcagtgaagaggtgtttatccatgcccagaaggacatgaacaccaaagtactcaatgaccgtgatacccatgtgctggcaaaccattctgagaccgtcgagaaaaaccagaccattgatgtccatgaacaccgggaagagaccattggcctgacggatacacttgacgtcggtgaatccttatccattaccgcaggcacggtgattgaactgcgctgcggcagtagtgtcctgcgcatggataaactgggtaatgtcaccatccaggggaataacttcctgttccaggccagtgatgccattcaaatcagcgcacaggacattgacctgaactaa

SEQ ID NO: 4989 - DNA, 1758 bp, Xenorhabdus bovienii
  Coding DNA location: Contig name=SeqID_16900; Position on contig =175531..177288bp; Strand=-
atgaaaaacaacaaggagtctatgtacctgcaagaaagagcctatctgcgggaactggctcaacgcgtggcgaaagagtcgcctcatctggccgattttctgacctcatcccatgatcccgatactgaacgtgttttcgaagcgtttgccctattgattgcccgcttacgggataaaattgaggatgatctccccgaaattacccacggcattctgtcccgtatctggccgtcagccctgagtcccattccgcctacaacagtcatgcagtttcatcccaccgacggagaacatcagggcaccgttgacatcccggcaggcacgccggtttccgccgatgtcaacgggcagttactcacctttaaaacctgccgttccctgcatatcgaaccccttatcgtgcgggacaggacagtgaagaaaaccggcacacacagtgagatagtgctgacgctttgccagacaggcacgccttcccctgtctggcaaagcggatcactgtcttttttcctcggtacggacaatgaacgggcagcacaattaactttgtggctggatcagcatatctgtgatatgcacctcagaacgcagggagaacaacgcaaactgaatagtttcccttatggctggcataacctgttcgatgctctcctcctgccgatgggaaatcgcacttatgccggcctgcaattactgctggaatattatgcactgccccacctgtataactttatgacggtggatatcagtgacagttgccgcgaaattccgttaaatgccgacggcagctttgagctggtttttcgttttgaaggtgagttgccgctggataatgtcgacgatgcttttatactgcactgtgttccggccattcatctggaaaccctgaccagccttcccctcccgctgaatgaaggcaatcatcgttatcccttgcttcttggcgagtccgtgcagttgttccggctgcgcgatattcaggtggttcagcaacctgatgaaacacagcaacggggttcgccctaccgttatctgcccatcgaccagtttaccccgtcatcgcccagtctggcggaagacggggagccggagacgctttattatttgctccagaacgagcgtgatttactgggcaggctcacgcaccagctgcatttttttgacctgaccggcaaactggctcaacacctgcctgccctgtccgtcgtgggtgatattctgggctatcacacgcaggccatcaccttaaaacccggtgaaattaccctcacgcaggaaggttccccggcccatctcaatgtacacaatattctccccgtctccgccgattacccatctctgttgcaggacaattccggctggccgttgctttcctgcctctccagcccgccggtgttgttatttgccaccgacagcctgaaacagtttctccgcctgtttgacccttaccccgaactcaatcgcccgctgagccgccatatccgccggcatatcgacggcattgcccgggtggaagaacaccttaccgatcgtatgaagcggggacgtcctgtccgcgggcactgggtaggactcacgctcaatcctgactgttaccacaattcgggagaaatgtaccgcttctgccggttaatcaatgaagccatggcatgttttatcagccagtccaccttcgtcaggctggatgtgtataccccagacactcgcggcgtcttgtggacatttaaggaagtctatggtacgcgcagagatatgtaa

SEQ ID NO: 4990 - DNA, 762 bp, Xenorhabdus bovienii
  Coding DNA location: Contig name=SeqID_16900; Position on contig =177437..178198bp; Strand=-
atgctacgaactaggttaacagatcccgtctgggataagctatctgcactaatgcaacacactgggctcgtttatcataaagccgaacatcgtcttatccttgaggggatcctttatcggatgagaacaggtatcccatggcgtgacctgccgttggaatttggtcgatggaatacggtctttgtgcgttttaatgcgtggtcaaaaaagggcgttttaaatctgatattcaaagggttatctggacttgctgatagggaatggctatttattgatggcagtattgttcgagcgcatcaacacagtgccggggcagcaacaaatgaagaggaagcgataggcaaaagccgtggcggacgttcaacgaaacttcatttggccgtagacagtcagggtttacccgtccactttgaactgtcaggggggcaaacgcacgacattaagcatgcggaaagtctggtgaataactccccggcatcagattttgtgattgcagataaaggctatgatagtgacgctttcagaaatatcgtcgaacaaacaggggcaacacccgtcattccttatcgaaaaaacagccgaaaatcagaagagccaatagacaaagggttatatcgttaccgacatttagtggagaatgcctttgccagaataaaacattttcgggctatagcaacgagatacgataaattagaacgaaattatgccagtatgttagcactggcatttactctcgtttggttaccaatgtgggctgattga

SEQ ID NO: 4991 - DNA, 192 bp, Xenorhabdus bovienii
  Coding DNA location: Contig name=SeqID_16900; Position on contig =178343..178534bp; Strand=-
ttgcaccgacggacagtgacaccatccatcccatcaggagcagtaaacccggctttttcatcgtgtcctttccatgtcataaaacgtcagagcagcgtgaagaaagccggcacaaaagtcagcaaacaattcatttttgcagaatgtgaaaaaacactccaatctcagtgccctttccaccatgacgggtag

SEQ ID NO: 4992 - DNA, 372 bp, Xenorhabdus bovienii
  Coding DNA location: Contig name=SeqID_16900; Position on contig =178501..178872bp; Strand=+
atgggatggatggtgtcactgtccgtcggtgcaaaaacggtgatctatactgacagtcagcacctgccggttaatttgccccctgagacacgggtcatttggctggatgcaccggagcaacagcaaaggcaaatctttgcacaccttcctgcagactcacaacaggcggcaactcaggcccgggccatacttcagtctcctcagtggcgcgggcaggaacagcaacttatcaacgcttatcgtgctgttgtccatgcctggcaatccggtgtgcgcaaatacccggcggtggtatttgatgatcgtgatgtggtgtatggtacggccgatatggccaaagcgacggcgctcagggagcagcatcagccatga

SEQ ID NO: 4993 - DNA, 969 bp, Xenorhabdus bovienii
  Coding DNA location: Contig name=SeqID_16900; Position on contig =178869..179837bp; Strand=+
atgaagacgtcacgctttgcttttccggtggttatcacgctggctgtggcatgtgcgcctgtcacacaagccgccatcaataccgcccaaatcgtggccggcagtgtctcgcccgcctgtattcagtggcgggtcagtggcatttgttactggctgttttgttcctggcacggctgcacggtgaaaacctcggtcaaagtgacccatttcctgccgcaggcggtggtctccacctatcatgcgcccggtgggaacccgtggtcagaaatggcgcaaatcagcccgttatccggcggactggaaaatgcggtgacgggggcgttatccggcctgaccaccggaggcggcaatcacacggttcagattgccgggaagcagagttcccgtctgcgtttcaaatacgctgatgctatcgggcatcccgctaccactctgattggcggacaaatcccggggtattcctgtcgcagtgcggccacaccgctgatgccttattttctgagtacgctggatactgtcgcgtggcgcagcgggctgccggagtcgctttatcctgaagcacttatccccggtctgcgagaactgggcagccagccggcgggcaatatgtggggcaatctctacccccgttccggttttgtcacgcaggttgatgaggataaagccgctgccgtggtggcacagcgggtggcggacattatcacccgtaccgggcagccccatgtttatcagccactggccgggcaacgccgtgacggctactggccgccggccccggttaccgaaaataccggcacgaaaaatcaccaatggcaacggttgtcaccacagttaagtcagtcctgtgcagtattcccggatggccgccacacagcggcggcagacagcaatcaggcgtatgccctgtggcagccctacagctgttgccagcggcgcgggcaacgttttctcggcagtacggacatataa

SEQ ID NO: 4994 - DNA, 1440 bp, Xenorhabdus bovienii
  Coding DNA location: Contig name=SeqID_16900; Position on contig =179850..181289bp; Strand=+
atgataagaaaaccgggactgctgattgcgggcgggctggcactcgctaccgctcaggttcaggcatcagaactgtcggtttccttaccggccgtcagtcacagtgcactggggtatggtgcacaaagcagcggggcggtctccgatacgctgttctacaccctcggtggcggctcggtgatttctgagccggccagtcgcgcggggtcaaccaggctggccgggctggaactcggctggcgttcggatttgatgtgcggcaattttgacctgaaaaccacggtcagtaatcagctcaacggtatcacggcgggcatgaaaaatctgatgagcgaagtcattcagggtgccaccggggcggtcgccagtctccccgccatgataatccagcgggccaatccggggctatatgacatgctgaccaatggcgttttgcaggccaatgtcgcgttcgacaaagcccagttcaactgccagaacatggccaagcggatgggggattttgcgcaaaacaataaatggacgcagtctgcggcgatgcaggaatacaaggcacaggttaacagcggggatgctgacgcggtgcgggccaataacgccggcaccaaagccaccgggacgggcgggcatccgtggattggcggccggaagcagggaggaaaagggcagagcgccattcgaccgacccgtgatttagccagcgccgggtttaatatgatgaaccatcagccggtactgagcactgctaccatccggcatcaggattgcagcggcagcagctgcaccaaattcagcagtgcgcgtgaggcggcagaagccgtcgtcaacgtattgggcgaccgggcaatacgtacttgtgccaacgcggcggagtgcatcagcggcggcgaggcgcaccaaccgggcgcgacggttgccggcacgggttttgcacccatgctggaagcacagactcaggccaatatggaacagctggtgaagctggtcaacgggacggaaaaagtgacggcggcaaatctggccaaactgaaaaccggcagcctgacggtcacccagggcgtgatccaggcattgcaacgtgatccggacaatgccgcgctgacggcacgtctggcgggtgaactggcgatggcagagaccacggagacggcattgctgatgcgtcggatgcttattaccggcatgtccgaacccaatgccgccgcgcaggccgaagccctcaatgagggcgaacggcggattgcggcgctggacagggaaatcaatgccctgaaaaatgaaatgacattgaaacgcgaactggcacacaacgccatcctgaccattattgagcgggaaaaccaccggattgaaacacatccgcagaaacacgtgacggaaagcagtgataagcgtttctatcaactggaaaatccggcaaaccgggtgacgggaaggtaa

SEQ ID NO: 4995 - DNA, 345 bp, Xenorhabdus bovienii
  Coding DNA location: Contig name=SeqID_16900; Position on contig =181293..181637bp; Strand=+
atgaccggtaacgcaaaagcatcgtccaggctgaaaaaaggcgctggcatcgtgctggctattgcggcagtgataatccttacgttgctgacgggctgggcagggatgcgctatcccgaacacctgttcgcctttcgtcaccggatggaaaaccatcaatcgctgtggctggtctggcggttaagcctttatgcgctgttgggctggggcagccggaagatttttcaggcaacgcaacataaacccgcgtaccggacaccgttgatccgtatgatgacggccagtctgctgtttatcctgctgtgtgaatacgccctgtcaggcagcatggggggcagcgcatga

SEQ ID NO: 4996 - DNA, 1515 bp, Xenorhabdus bovienii
  Coding DNA location: Contig name=SeqID_16900; Position on contig =181634..183148bp; Strand=+
atgacgacaaacagttatctggaatactttctgaccctgctcggctgggtggtgaataatggcctgtggcaggtactgattgccaccgggctgtttaccgtgccgttgttgtttaaaatcatggcgctgtggctgaaaatccgtgaagacagcgtggaagaaggcaatgcggggctccagtcgctctcccgtctcgaaaatatcctgtacggggcgttctttgtcatgatcgcctgttgcgtcccgctggttcaggtgagcctcagtaccctgcaatatgatccgtcccgggccaaaacctgcggcacctggacgccgaaatcaccgcaggaaacggggtatgccccggtgatttccagtctgggcgaacacacggctgccgtgccggtctggtgggcggtggtgcaccggttatcgaaaggactaacccaggcggcgattgcttccgtgccctgccggccggatttgcggcaactgcgttttgaggtgcagcacacccgtattgccaacgccgcactggcagcagaattgcaggattttacccacgattgctatgccctggcgctttatcagtggaaacaacgcgatcagggacaaactggtgatcccgcggtgctgcaggatatcgactggctggggagtcagaccttcctgtcaggggattacactaccctgcaatcacgcacaccccgggcacattttccgtggatggcgagccgggacagcggccggcccgataccggccggggcggctatccgacctgtaaagtctggtggtcagccccgcaaaccggactggaagcccgggtgctggcacaggccgatccggggctgtggctgcgtttgtcggcagccctgaaaatgctgggcaagggaagccgtgaatataaagaggcggtgatccgtcgtctggtcagtccggtcaacctgacggtatcacaggaggggtatgtctacgcgggttatggcggtaatgccgattttacggtctggaacggctctaaccgggccggggcctctgcgggggtgatgttgggtggcctgcttgcttacccgatgctggatgccgtgcggcaggcgctgccgatggtgcaggccgttctcctgatggcgctgtatatcctgctgccgttgatcctgctgttggctgcctatgaatttaagaccgtcctgacgctgacatttgtgatttttgcgctgaatttcctcaccttctggtgggagctggcccgctggctggacagttacctgttggatgcgctgtacggttcagaaacccacagcctgtttaatctggccgggttgcagaacacctcggatgatttaatcatggcgctggtgatggggatgctgtttattgtcctgccgatggtctggctgggtgcactggcctgggcgggggtgagaatgggcgatatcagcggcatgatgaaccagggcgtgggacaggtcaggcagtcagccgggatgttcggacagatagtgatgcagaagatgatgtcgaaaggaaagtag

SEQ ID NO: 4997 - DNA, 165 bp, Xenorhabdus bovienii
  Coding DNA location: Contig name=SeqID_16900; Position on contig =183084..183248bp; Strand=-
atgataaacaggttaaacaggcgaaaaaataaaactcacacaccattcacactctgcttaagggataacgccctgtcccttaagttttcccctggcttgactactttcctttcgacatcatcttctgcatcactatctgtccgaacatcccggctgactgcctga

SEQ ID NO: 4998 - DNA, 105 bp, Xenorhabdus bovienii
  Coding DNA location: Contig name=SeqID_16900; Position on contig =183445..183549bp; Strand=-
atgacattaagttatttgctttttgtgatgtacttcatgaatattgagttaatacaattccaatatgaaaaaacagaaaaggaatataaaaccgccctgaattaa

SEQ ID NO: 4999 - DNA, 219 bp, Xenorhabdus bovienii
  Coding DNA location: Contig name=SeqID_16900; Position on contig =183560..183778bp; Strand=+
atgacttacactaaaaacgttatacttgagatgttctattacattaactctcttgtttttggtagtagacaatttatagaagcctcaatggtcgaagccattgaggcttcgccgtttatgataatgaaaataaacaaggccggacccggcttacctattcagtttagttttttcgctattgaattaataatgaaatcggttaaattggaacatctttaa

SEQ ID NO: 5000 - DNA, 411 bp, Xenorhabdus bovienii
  Coding DNA location: Contig name=SeqID_16900; Position on contig =183807..184217bp; Strand=+
atgagcgataccgataaaaaggataagagcaagaaaattcaaaaacaatccagtcattttattccttataaaacgacgtatgatttgcgtttaaataaaagagaacccaatttaatcaacatactgatgcagattcagggttatgaatatggctttttgacggtgttaggtgtccgccctttatcgcaacggggtaaccataaaaacagtgccatctatgtcgtgcggtgccggtgtggtaaatacgccgtcaggacgctcaaggcaatcagaaatccggctaatgtgactgacatgtgtgagcattgtcttcacctgtacaacctgaggcgcagaaacctctttctcactgagggaaaagaggttggtttgtcagagttaaccggtattaaatataaaaaacctttataa

SEQ ID NO: 5001 - DNA, 96 bp, Xenorhabdus bovienii
  Coding DNA location: Contig name=SeqID_16900; Position on contig =184240..184335bp; Strand=+
ttgcgcttcgacgttgaatgcccagcatacaccttattctctctccgtaagatcagtttgtcagagatgataaaagggacatttgacccggcctga

SEQ ID NO: 5002 - DNA, 105 bp, Xenorhabdus bovienii
  Coding DNA location: Contig name=SeqID_16900; Position on contig =184352..184456bp; Strand=-
atgtaccgcaatcttgctctcccttgcaggctacgagagttttgttttcgccactcagaagaggtgatccttgcaggcgatcagatcacaggtagtcacatttag

SEQ ID NO: 5003 - DNA, 123 bp, Xenorhabdus bovienii
  Coding DNA location: Contig name=SeqID_16900; Position on contig =184725..184847bp; Strand=+
gtgacgccgcaaagcggccaacgtccagagcacgtccggtctggctttacgaccgatttgaaccctgcattactcagtgaaaccactaaaaatagaccattaaccaccctgttgtttgattga

SEQ ID NO: 5004 - DNA, 918 bp, Xenorhabdus bovienii
  Coding DNA location: Contig name=SeqID_16900; Position on contig =185144..186061bp; Strand=+
atggcgcagggatcgacacgttcaaaggttgagctgttcagaaaagcctttatcacgcatgcccgacaggcgggcggaagttttgttacggtggcggatcgtgagcgtatggcccggcagttccttgattatttgaaaaacaatggcatcaaactccggcaaatggatagcctgaaggtgaaatatattgagcgctatatggctgagcgcaaagccaacaatctcagtcaccggacactgcaaaatgaaatgtcggtgctgcgagctattttaacgcaggccggaaagcacaagctggctgatcccgagaatgaccgtctgagtaaccgggcattgggtatcgctgagacgagccgcaagggaacaaaaattacgctgacaccggctgcattccgggacatttttcagcaggtggagcaaaaagaccggagcgtggcagcggtgatgcaactggcgtatgtgctggggctgcgcaccaaagaagcggtggaagcctacaaatcgttagcgacctggaagaaagcactggaaaacgggcatacgtctgtgcgggtggtgttcggtactaaaggtggacggtctcgacagacgaccatattggatcgggcagcgctgcaacatgccattgcctatgcggagcaagagcaggcaggacatagcggcaaactgattgataagccgactatcactcaggccatagaccgttaccgctatattgtcagacgtgcaggactgagcggcaataaagcgccacacagtatgcgttatcattttgctcagcaatccggagagcattatatagcgcaaggattcagtgagcgggaagcgctggcactggtctcgatggatttaggacatggtgacgggcgaggacgttatattcggcaggtgtattaccagaatattgagggtgaataa

SEQ ID NO: 5005 - DNA, 3120 bp, Xenorhabdus bovienii
  Coding DNA location: Contig name=SeqID_16900; Position on contig =186308..189427bp; Strand=-
gtgacctacactagtgaagcccaatttgaacaagatgttatcactgaactatgcaaaaaaggctgggaagataaggtcttaaccaacctcaccgaaaccgatttgctgaaaaattgggcggatattctttatcaaaataacaacagtattgatcgcctaaacaatgtgccactcagccagagtgaggtgcagcaaattatagagcaaatcattgcgcttaaaacacctctcaaactaaacggttttattaacggtaaaacggtctctattaaacgtgacaatgccgcagacactttgcactatggcaaagagatcagtctcaatatttacgaccgccaagaaatagccgcggggaaaagccggtatcaaattgttcagcaacctcgatttgagcgcaaaagtgccgtccagcacgataggcgcggtgatcttttgttgctgattaatggcatgcccgttatccaccttgaactcaaacgttctggcgtcccagtgattgaagcgtgtaaccagatagaaaaatacacacatgaagggcattttagcggcggcatcatggcgttagtgcaggtgtttgttgcaatgaatccagataacaccttgtattttgctaaccctggaaaggacgggatctttaatcatgattaccacttccagtgggccgatttttctaatgaacccatcaaccactggcagaaagtgatcgaagggttactatccatcccgatggctcaccagttaattggtttttataccgttgccgacaatgccgatggcattcttaaagtgatgcgcagctatcagtattacgctgcgaatgctatttcaagtaaagtcgccagcctggactggtctattaaaaataaaggtggctacatttggcataccactggctcgggtaaaaccatgaccagctttaagtctgcgcaactgattgctaactctggcgatgccgataaagtggtgtttttgatggaccgcatcgagttaggaacacaatccttagaagaatatcgtagctttgccgatgccagtgatgatgtgcaaggaacagaaaatacccatgttctgatcgccaaactgaaaagcataaagccaagcgatggcttgattgtgacttcaattcaaaagatgagcaacatccacgatgaaggacaattaaaaactgcggatatcgactgtattaatcaaaagcgcattgtgttcattgtcgacgaagcccatcgatcaacctttggcgatatgctttctatcatcaaagccactttccctaatgcggtgttctttggctttacgggaacgccaatccaagaagaaaaccagaagaaggacagcacaaccagtacgatttttggtgatgagttacatcgttatagcattgcggatggtattcgagatggtaacgtgctggggttcgacccttgcaaagtgatgacgtatcgtgatgatgacttacgcgaggcggttgcgcttgaaaaagccaaagcaacgagtgttgctgaagtgtttgctgacactgcaaaaactaaaatttatgaaaagtacatggacagtgctcgagtgccaatggcgacccaagaaatcaatggtaaaaaagtgcgaggcattgaagaattactgcctgccacgcaatatgatcgcatagagcataaacagcaagtcattaatgatattctggctaactgggtacgttttagccgtggtaatcaatttcatggcatttttgccacacacagtattactgatgccttacagtattatcgattattcaaacagcaagctcctcaactgaagataacagcgttgtttgatcctaatcttgataacaaaggtaacgccgtgactaaagaggctgggttagttgaggttattgaggactataacaaaacctacaatacgacctataccttacccactcatgcgcaatttaaaaaggatattgcgacacgtcttgcacacaaaaagccttatcaatatgtcgaacaacaaccggaccagcaattacatttactgattgttgttgctcagatgctcaccggttatgactccaaatgggtgaataccctgtatttggataaagaacttgagtatgcaaatatcattcaagcgttttctcgcactaaccgattgtttggtatcgataaaccttttggcaacatccgttattatcgcaaaccgcacactatggaactcaacatcaataaagcgctcaaactctattctggagaccgtccttatggtgtatttgtggagaaattggaagataacttacattctctcaatgaaaaatttgccgaaatagaaatcattttcaaaaacgcgaagatcagcgattttagtcagttaccaaaagatgaagagactcgtgctaagtttgccagcctgtttaatgagttcagcaaaaccttagaggcggcaaaagttcaaggttttaactggcaggaaaacagctattcatttgaagaaacgggtaataccgtggatattgattttgatgagaatcagtatcaagcgatgttacaacgttataaagagttgtcatcctcttcgggtaatggtggcagtgcgcctgctgtgccttatgccattttgggctatttaaccaagcaaaacacggggcgaattgatcataactatatgaacgctcagttcaccaaatttcttaagcaatgcgatcaaccgaatgtcacgtcagaggagatgcaacaaacgcttgatgaactgcataaatcctttgctaccttaagccaagcggaacaaaaacaggcaaacaagctactgcttgatgtacaagcaggtaatttaatcatcgaagcaggcagatccttacaggattacattacccgtgctcaagcagaggaagaagataaagccttgcaggtaatggtcgatgctttgggacttgatggtaagcagcttaaaaaactaacgaaaggaaatctcaccgccgctaacttaaacgattatggtcgttttgatgcacttaaggcaacagtggataaagccaaagctaaggcctatctagaagataaattaggcacaaagctaacgccacctaaagtcaatattgaactgaacaagctactgcgggagtttattttgcagggtgccacagattag

SEQ ID NO: 5006 - DNA, 1170 bp, Xenorhabdus bovienii
  Coding DNA location: Contig name=SeqID_16900; Position on contig =189558..190727bp; Strand=-
atgagtaaggaaaaaacgtttcaacctgctctgcgtttcaatcgttttgaaggtgattggcaagaattaccactgagccaaatagccctatcatttgagtatggactaaatgcaagtgctgttaaatatgatggtgttcataagtatattcgtattactgatatcaatgatgatactcgtgagtttgataaagattcattaactacaccagaaacaaaccttgctcttgcagataattataagcttgaatatggcgatttgttatttgcaagaacaggggcaagtgttggtaaaacctattattataaacaaacggatgggttagtttactacgcaggatttttaatcagagcaaaaattagaccagatcatgatgttcgttttatttttcagaacacgctgacttatgattatgagcggtttataaaagtcatgtctcaacgttctggtcaaccaggtgttaatgcaaatgagtacggacagtttgaaatcaaaataccgggactcaaagaacaaacccaaatcggtacttttttccaacatatcgatcaacaactaaagctccatcaatccaaacacaccaagttgcagcagttaaaaaagtcaatgttgggtaagatgttcccaaaagcaggggcaaaagtgccagaggtgcgttttgctggttgtgacggtgattggaagcccactagtcttgccgatgttgttgatgtccgaagtggtcgtgattataaacacttaaacaaaggtagcatcccagtatatggtacaggcggatatatgcttagtgttaataaggctctgtcttataatgaagatgctataggtattgggcgaaaagggacaattgatcgcccattcgttcttagagcgccattttggaccgtcgacacattgttctactcagttcctaaattaaacaatgaattacaatttacatatgctctttttcagaaagtaaattggaaagataaagatgagtcaactggcgtacctagtttatcaaaagttgcaattaatgggattcctgtcatttcctgttcattaagagaacaaactaaaattggcaagtattttcaaaacctcgatcgcttaatagaacttcaacagcaacacattaataagctgaaaaatattaagcaagcgtgcttagaaaaaatgtttgtttaa

SEQ ID NO: 5007 - DNA, 2595 bp, Xenorhabdus bovienii
  Coding DNA location: Contig name=SeqID_16900; Position on contig =190720..193314bp; Strand=-
atgaataaacaacaactggccgccaagatttgggaatcggctaaccaaatgcgttctaaaatcgaagcaaacgattacaaagattatatcttaggcttcattttttataaatttttgtctgataagcaaattcagttcttaatccaaaacgaatttgatgagcaatcgatcaaagaattgaatgagggcgataccgacaccctcaaatacattcaagacgaattaggttacttcatcgcttatgacaatctgttctcaacttggatcagtgatggtaaagatttcgacattgcttatgtgcgtgatgcgttatcggcgttcagccgcttgattaatccagatcataaagacttgtttgacggtatttttactaccctggaaacaggactaagcaagttgggtgaaagtgcagcagcacaaaccaaagcggcgatgaatctgattcacctgattgatggtattccgatgaaagacaagcatgattatgatgtgcttggttttatctacgaatacctgatcagttcgtttgctgcgaatgcggggaaaaaagccggagaattctacactccccatgaagtctcggtattgatgtcagaaattatggctgagcacctgaaaaaccacaaacatatcaaaatttacgatccaaccagtggttccggttctctgttgatcaacatcggtcaatcggtagaaagacgtcttgatggtgaaaataacatccgttattacgcgcaagagctcaagcaaaacacctataacttaactcgtatgaacttgtttatgcgtggtattttgccaaataacatcatcacccgtaacgccgatacactcgaagacgattggcctctggatgaagataaaacccatgaaccgatgcgtgtggatgcggttgtctctaaccctccttattcacaaaagtgggacccagaatttaaagacaaagaccctcgctattcgccttttggtttagcgccaaaaacgaaggcagattatgcattcttgctacacgatctgtaccacttgaaacccgatggcattatgaccatcgttttaccacacggggtattattccgtggtggtgatgaaagaaagatccgtgagaacctcattgaaaagaatcatattgatgccattatcggcttaccggcaaatatcttcttcggtacgggcattccaaccattattttggtgcttaagcaaacacgtaacaatgacgatgtattgatcatcgacgcctcaaaagggttcgtcaaagagggtaagaacaacaaacttcgcgcttgcgacataaaacgtattgtggatgctgtggtcactcgtaaaccacaggaaaaatttgcagccttagttagccgtgacaccattcgcgataatggttataacctcaatattccgcgttatgtggattcttcagatgcagcggaaagttgggatatttacgcctctatgtttggtggtatccctaataacgaactggatgcgctaaaacactattggcaatcgatgcctaacctcaaggcaagcctgtttaaactaacatccagtaattactcagcattaaaagttgccgatgtgagagcagagattgaagctgactgtgatgtgcagcaatttatggcaacgtatcaaaaagcttttagtgattttgaggcttatttgacaaagagcttgattaaagagctgttacaagtcaaaccttcgcgccaacaagatatcatcagtgaagagattttccgccgtttagaagggatcgcactgattgataaatacgatgcttatcaattgcttgatgatcaatggcagcaactcagtgcggatttggaaatgatccaaaccgaaggtatgaatacctgtaaagtagttgaaccgaatatggtaaccaaaaagcaaaaaggcaaagacgttcaggttcaagacggttggtttggtcgcatcttcccctttgcgttggttgaaaaaacctactttgtagaagacctagcaaaaatccaaatcatggcagagcgtttgcaaagcatcgaatctgaggttcaggagatcttcgattcgctgagcgaagacgataaagaagcggaatatgttaatgacgacaaaaccgcatttgttaacgcaacactaaacaaagaagtgaaacaaatcaaagccgacaaaaagaaaggcgaaacacttgataatgacagctttgaaagcaaattgcttgccgtagacaaattacaaacagaagataaatcactgaaggtaaacctcaaagccgccaatgaagctttgctggaagcaacacgtaaaaaaatcgaaaacttaactcaagatgaaattgatcatctactgctgcttaaatggataaaacctattgttaactccctgggtaaactgccaaatcaggtcttgcagcaattaaccagtaagctggaagctttggcaggaaagtatacacaaacttatgccgatattgctcaagaaacccgacaagtggagcaaagcttggcggcaatgatgggcgaactgcaaggcaatgaatttgatatgcagggcttaaaagagctgcaacagttcctttttggtgaaaagttgcaaggtggcaccgatgagtaa

SEQ ID NO: 5008 - DNA, 945 bp, Xenorhabdus bovienii
  Coding DNA location: Contig name=SeqID_16900; Position on contig =193323..194267bp; Strand=-
atgaaaaaattaaaagatcaattcttagaggtttccgatgccttagagctcggaaacccagccattattgaaaaagattactgggtagtggctttgcttgctgagttagcaaagcttgcttttgatacgcatcaaatggtcttttctggcgggacggcactggctaaatccaatgtaaaaatcctcaggatgtcggaagatgtcgacatcaaactcatcccaacggatgcatttaactcattcggtcgtgacaagcgcaaggcgacacgtaaagctctggtgcaacaaatagaaaaatctctaactcaccaatcaagccatttttctattaaagaaaaaaaagcccgtgatgaataccgctacgtcgaatatgaactgaaatacccacagcaatttagacaagcaccttgcttgcgcccaatcattaaactggaactcatggagaccatacctctgcttcaaatagaacagcgtagcattcaatcactggttgctgagctgtatcatcagcctcacgaagtcaacgcattttcttgtatctccgttcaatccactttggtggagaaagtcatttctatgctgcgccgtaccatgctagtcaaacgagattttgagcgcaaagatgatgctacgttgatacgccatatctacgatgtacattgtattgacgcagagcagaaacttgattttgaaactcttatgccccttttccaaaccgtgttacaagaagacgttatgcgatttggtaatcagcatgcggagtttgttgccaaccctgtccaagaattacagctaggtttgcaagaactagagtctaatcagctgtttcgtaaaaggtttacagactttgtcaccccaatggtgtttgatacagaaacacccgatttcgatacctgctttgcctcatttaagcgcattgctcagtcattgatgaatagtaattag

SEQ ID NO: 5009 - DNA, 405 bp, Xenorhabdus bovienii
  Coding DNA location: Contig name=SeqID_16900; Position on contig =194270..194674bp; Strand=-
atgacagcagcagatcgaatcaatcaaaagttgaaacgttcgagacgttacgtctttgaacgcaaagattttgaagacattgccagttatgaccagatcggccgtgcgcttaatcaattgatcaagcaaggtgaactgatgaaaatcggatatggcctgtatactaaagcacgtaagaacagcctcacaggtcgcctaatgccaacgaatcctggtggcaccgatgcgattttacgtgaaattcttaagatgaaaggcgtagacttcgaagtagatagtctatcgttgcaaagtctttccggtaatagcacacaaatcccttcatctgtgcagtattcgtggaatcctaagcaatttaatcgcaagctggttgttggtaatcgcgtacttaactcaccaagttaa

SEQ ID NO: 5010 - DNA, 156 bp, Xenorhabdus bovienii
  Coding DNA location: Contig name=SeqID_16900; Position on contig =194859..195014bp; Strand=-
atgagaagaaccaaagcaactttgatttatgccagaactaaaaatattcgggcagttcagctcttactcgggcatgtcaaactcgataacacaattcggtatttgggtgttgaaattgaagatgctctgaaactatccgaaaatattgattcataa

SEQ ID NO: 5011 - DNA, 222 bp, Xenorhabdus bovienii
  Coding DNA location: Contig name=SeqID_16900; Position on contig =195060..195281bp; Strand=-
atgatattagtaggaatggtgttatccattaacagagtgttttatcggcaaaacaagactgatcgcgatgttcaatttgaaataacctcaagaacagcgcaatccattacactgtgggtatcacttcgaaggttaactacttctgattatctttttcccagtccccgtaaaatcggtaatcctatgagttatagttattacgccagcataattcgacgatag

SEQ ID NO: 5012 - DNA, 189 bp, Xenorhabdus bovienii
  Coding DNA location: Contig name=SeqID_16900; Position on contig =195556..195744bp; Strand=-
ttgaagtgtattagtcgtcactcgaacttgacctggcagttagccatatattttctcatcatcgtcagatcgttacctacctttgggttaactcatttatgcccaaggacatatcggggcatgatcatcgccagcatgtttctgccccataatcatttaagccaaccactaccattaggctttacatga

SEQ ID NO: 5013 - DNA, 192 bp, Xenorhabdus bovienii
  Coding DNA location: Contig name=SeqID_16900; Position on contig =195908..196099bp; Strand=-
atgtgcgttatgttttttcataaatatctcctatgtgccttgaaacccacctcatccgcagatgagattaagaagttacaagttcgcctcacaaaggaagggattgatcagcacaaagcccccgtctcgacgaacctttggtcgcccaaaaggttcgagtacccacccatgttcatgctgtcactaatatag

SEQ ID NO: 5014 - DNA, 162 bp, Xenorhabdus bovienii
  Coding DNA location: Contig name=SeqID_16900; Position on contig =196079..196240bp; Strand=+
atgaaaaaacataacgcacatcaagatcagcaagtaaaccaaaagacacgcccgaagaagtgggaaaccgttttttcaatcattaagttcatactcgtatggatttatagaatctggctcttactacgtatgttagaaggaacagaaaggggtgacgagtaa

SEQ ID NO: 5015 - DNA, 321 bp, Xenorhabdus bovienii
  Coding DNA location: Contig name=SeqID_16900; Position on contig =196269..196589bp; Strand=+
atggactacctaatgatccacaaagctttaaaattaattcgacaatatcatgaactaacggttagcgatttagctaacgagtttggtttgacgccgttgtatttaaaagaacttgaatcaggtaataggcctatcgagagcgaattacttgagatgtattcatcaaagtttgatatccccgtaacttctcttgtaatgttttctcagaacatccacaaggaagggaagttagccaaaaaattcagacaattaatggttggtaaagttctagtaattgcagactgggcgatcaataaaaatgacaaaaaaatcaaagcttaa

SEQ ID NO: 5016 - DNA, 951 bp, Xenorhabdus bovienii
  Coding DNA location: Contig name=SeqID_16900; Position on contig =196567..197517bp; Strand=+
atgacaaaaaaatcaaagcttaaaatagttaccagaaaaaaatcctataccttacaagattctcctttctacaaacttaagtcaaaaaagaagttaacaaatctactcaaagttgatatggaaactctgcttcgtatgatgaacgatacggaaaactacaacgagtttgaggaaaaaggtaagaagggtaaggtacgtaaaatacagcatccagtaggcgaattagatgtagttcacacacggatcgcaagtctaatttgccgaattgctacaccgagttttttgcattctggaaagaaacaacactcaaatgtaggtaatgctcgtattcactgtaacagttttccactcatgacaacggatgtttgttctttttttccatcgacaaaaagaagcatggttttttcgtttttctacacagttatggaatgttcatcagatgtcgcagatatcttaagccatatttgcacaattcacggtcaccttccaacaggtagtcgcatcagtatgccactcgcttactgggctaactgtagaatgtttagcgagctcgaacagttagctattaagcacaatgtaacaatgactttgtatgtcgatgaccttactttctcgggaaaccacgtaaacccacttttcaagtccataactcgtcagattattgaaaggcatggacaccaaatgcacccgaccaaaacaaaattgtatcgcggcaaagaaccgaagcttgtaacaggcattgtgataaaggatgaaatagtgttcgtacgtaatgagcagcgaatgaagctagtttcagacattacatgttggaaatctataaaagacattcctaatgccatcaatatgcagattacactcacattactaggtagattgtatgcactaagttctattgaccctaagttcaaagatagagccagaactattaaggccaacactcaaaaataa

SEQ ID NO: 5017 - DNA, 1383 bp, Xenorhabdus bovienii
  Coding DNA location: Contig name=SeqID_16900; Position on contig =197691..199073bp; Strand=-
atgttttcaacctgcgccgaacaatgggcaaatgacacgtttcaacacgcggaattaggtgataaacgccgtaccaaccgcctggtgaaagtggcctgttcgttggctaaccatataggacaatcgctcgtgcaatctcttgactctcctgccgatgttgaagcggcctaccgactgacccgaaattccgccattgtgcctcaagccatcgccgaagccggatttaccgccaccgtcgctcacgctcaacgttatcattgcctgttagcgctggaagacacgacaaccctgtcattttcccatgcgtcggtcgccgatgaactcggttataccacctcgaagaaaaaatcccggggcatgcaggcacactcggtgttgttatttgcacctgaagaacaacaggtcgtggggttgatagagcaacagcgctggtgccgagatgtcagtgattatggcaaaagccgacaacgcgacacacgcccttatgaagggaaagagagttataagtgggaacgggcctcacaagccgtcgacagccggttaggggagcagatggccaacgtgatttctgtctgtgaccgtgaagccgatatcatcgaatatctgcgttataaaacgagccaaaaacaacgtttcgttatccgttcgatgcacagccggcgtattgaggaaagtcaggatagactttatgactttatcagtcagttacagagtgctggagcacggttagttcaggtcagacagaaaggcgggcgtcaggcgcgtgtcgcgcattgtgatatcagttatgccgaagtgacgttgaaaatccccgaaggaaaaagcggtgaagcggtgcggatattttatgtcggttgctacgaaaaaggtacggaggatgggctttgctggcatcttctgacctccgaacccgtcaacagtcaggaagacgcccataaaatattcagttattacgagcgccgctggctgatagaagaatttcacaaagcatggaaaacgggcggcacgcaggtagaagcgctgcgtatgcaaagcaaagataatctggagcgcatgatagtgctgctggcctttattgcggtacggatacacccgctccgttttatgggtctgaacaaagaagaggcagagaaagagagctgtgagacagtattaagccccctggcgtggaaattactgtggtcaaaacaagaaaaacggcgtccaccgaaaaaagccccgagcttgcattgggccttcatcaatctgggaaaactggccggctggtacgattccaaacgcacgggtcgagtcggatgggaacgactttgggaaggttggtttcggctgcaaaccctgatagacggctatttgctggctaaatcggttgatttggagatctga

SEQ ID NO: 5018 - DNA, 597 bp, Xenorhabdus bovienii
  Coding DNA location: Contig name=SeqID_16900; Position on contig =199197..199793bp; Strand=-
atggtcgtatcaaacaaaagtcgacgtagtggtatcaaaaagccttttagactcgaagaaatctggcatatccgaacaaggctcgaaatcgaaaataacctgatgcaactggcgttactcaatttggcaatcgatagcaaactccgagcgagtgatttgctgactctcaaagtttgcgatgtttcgtcacaaggtatggtatttgatagggttagacatgctcagaggaaaactgatattgaagtccaatttgagattacctctaagactcagaatagcttaattaagtggatgctctctgcttctttgactgctggcaattatcttttcccaagtttgagacgtaagcagcaaccaattagttactcatactataggcatctcgttagaacgtgggcatcaaatcttgggttagacccaaatttctatggcactcactcgatgaggagaacgaaagcaacgcttgtatacgctaaaactaagaacattcgtgcagttcaactattacttgggcacgcaaaggtagataatactatccgttatcttggtgttgaattggaggatgccctccgactttcagaaggaacagatggttaa

SEQ ID NO: 5019 - DNA, 1773 bp, Xenorhabdus bovienii
  Coding DNA location: Contig name=SeqID_16900; Position on contig =200056..201828bp; Strand=-
atgtcagaaatgatacatagttctttattaccatctcaatcatttaattcaatcagagtaatatctgcaaaagaatttggcattgagtctggagtttgtaataggaaattattacaggatctacaagatagatctgaattattgcggatcccgatagatttttcaggtattcgagaaatatgtttcgatggttacatttctatcggtgattggtttcattggcgctcatccggccgatttgataccacgataaaacctgtgtcattaaccagagcaaccgttggttcaaatggctatggtatttatgcgtggtttacacgaaaagatcccgaacaaaatctcacttacgccatgcttgaagatattggaatggatggtcaatatcaaggtggatatgaaattaaggtggaatcactaatcaggggattttgttggcatgcagatagagattctgttttaactgatatcacagcattgcgctgccactttaaaaatatgcctcatgaagcctgggaaggttacacaactaatggaggaacaatagatggtatacgatatttatattgttcatctgaaggcgaagacccagaaaaaacctcagtaggattcaatgcgtttaaatgtatgaatggctccatagactcaccatcagagtatggaatatatacaatacgcaatattgtaagccgaggaaatacagcaagagggcatagaacattgaccgatttgaaacgcggttgtgaaaagtggagcatttctttatgtaatacatatgatatgaatgattgccaccattctactgatggctctagagacggaattttttctgataacattggagaacaaacaggaaagtcttataggaataaaaacttccttgaaattcagggggaaaatataactgtaacatcctctatattcaaaggagcaccggatgataaaagagcgggagtcgcgggtattttaatcactaactatcagtatccttcattaccaggaagtaatgaaagtaaaaatatacatattagtaactgtcaagtaaacaacattgataatggagccatcagaattattaatgcgtcaaatgtaaaagtaaatggcttgagcattaataattgcaaaaatggagtttcatttgagcgaaatctcggaatgaataaacctttatttaatacaatcgaagatattgtaactcatgattccgatacaggtttaattgtctctactgactatccattgttaattaacactccacctatcaatggaaaaatggcttgtaaaattaataacggcactataatttacagattcaaaaaaccatatttttgtaattacccccccagcatagaaaattcggatatactacttaaaaatattgctggtacctcatccgatgatagacctattggtataccttatgctattgaattagatgattcagaaccattatcagtacgggaatattctgctgcattaatccctgttctggaagatgatattatttatttctcttgccatgtaaaagaattgggttccccagagtcttcatttttaattagagaatacattgataatgagattaaatatagtgaatttattagaactggagcacggaatgactggaatgaatttttcgttatttatcatccatcagttcaaggagttaataaaatagaaattctgttatgtccagcaaccgatgatttaggaaatacgtcactgcaagggaaaacactattttcgaagatgattatatcaaaaagacctatatga

SEQ ID NO: 5020 - DNA, 1041 bp, Xenorhabdus bovienii
  Coding DNA location: Contig name=SeqID_16900; Position on contig =202215..203255bp; Strand=+
atgccaatcatagcacccataccccgaagtgaacgacgtcagatgaaaaaatttattcataaaacccgggataaagattatgcacgccgactcatagcactcttaatgttacatgaaggaaaaaccgtttctggcatctccaggacccttcattgttcacgttcttcggttaatcgttggataaattggtttacgttgtatgggctggaaggattaaaaagtttaccatcaggaagacctaccacctggaatttagcgccactttttagtttgctgtcgttcttattacagcactccccgcaggattttggctgcctgcgttcacgttggagcattgagctgattactcgaataatcaatgaattattcggtttgtcgctttcgcaaagtacgttctatcgtgacttctgtcaggtcggtattgtctggcgaagggcagcacctaccgtaaaaaagcctgatcctgagtatgacgaaaaaagggcaaaaatcactgaagctttatccagcgtgtcagaacaacatcctgttttttacgaagatgaagtcgatattgaccttaaccccaaaatcggagcggactggtgtctgaaaggacaacaaaaacgggtcatgacgccgggaaaaaatcaaaaacactaccttgcgggctgccttgacgcccaaacaggccaagtgacttatgtcagcggtataaagaaaaattctgatttatttatcaaaatgttaaaaaaactgaatggccaatatcgccatgcaaaaaacatcacattgattttagataactatggcattcataaaagccggaaagtcagtgcatggctacaacaaaatcctaaatttaatctgttgtttttaccggtctattcgccatggataaataagattgaacgcctatggcaatcattgcatgaaaccgtcacacggaatcattgttgtcagtatatgtggcaactcttgaaatgcgttgaagcgtttattaacgcattttcatcagggcaacaaccgggaatgagaaaaatgagtgtatcactattatga

SEQ ID NO: 5021 - DNA, 1779 bp, Xenorhabdus bovienii
  Coding DNA location: Contig name=SeqID_16900; Position on contig =203320..205098bp; Strand=-
atgagtatagcaattggtgaagtaatttcagttaaaggcactaatatcactgtagaattatacgaagagtccaacaacgagacgttgttctataacggcgaaaaattcaacggtgtatcgatccaggagttcattttaattcgtcgtgggttcaaggatatcgttgctagagtacaaggcgaatacctagatgaacgactaaaagacgaagagagcggctgctatatccgtaaagttgagttagtaccaattgggcatttccagttcaatgaattccatgaaggcataaaacaccttccgatgatccgtgatattgcgtatttaatgagtgacactcaggttaaatctatctttggaaagcctgacgacaacttcgttgtcggtgaaacgcttactgaagaaatacctatatcgctaccttgggtaaagctattcaacactcatataggaattttcggcaatactggtagtggcaaatctaatacgctgactaacatatacacaacgctatttcgcaataagctggacaagctcataaacaagagtcactttgttgttatcgactttaatggagagtacacaaataaccagctaatatcaaaagacaagtataagaaggtataccaactagatactcgcaatgatgatggcgataaatttccactcactagcgatgtattctgggatgaagaattattcggcatcttattcaaagcaactgagaatactcagaagccgttcttaaagcggatagtttctggtcgaaacaggttcaaagacaatccagatagcttgcagaagtacgtcaagtcaactatcgagcgtgctctcacaagtaccgcacaaaagaaagagtttgtagctcttattgaagagattgcaaaacttgttggctcccaagacctagagaaaaaagttagggaaataggctggcatggtgaacgatctcggttgtatttcccaaacaccccccacccaaattattttaatggtggtgataatgaccttacgtacaatcatcattgcagagcatacgtagacgacatcaacattagagagttatcgccattcaatgagttaaaactgagaatcaacactcaacttctttctgacctcattagcggttatgttcagttcgaccatatacaacctctactaaagagagtagaagcgtcattgacagcactagatcgtgtgtttgacgttagagaagaacgaccagcaaacatgttattgtcagtggtatcacttcgaaggactaatcaagaaattaagaaggttatgccacttttgcttgctaagttttattatggtgaacacaagcagaaggttatgaaccagagtccaccagagcaaacattccacatgataattgatgaagctcataacatactgtcgacccaatcgagtcgtgaaagtgagagttggaaggattatcgtttggagctatttgaggaaattatcaaagaaggccgtaaatttggtttcttcttaactttgtcaagtcagaggccagcagatatctcacctacgattatgtctcagctacataatttttttattcatcgcttagtcaatgagcgtgacctcaagttgctagagaacactattagctcacttgatgaactctcacgacaaatgattcccaacctttcaaagggttgttcgataattataggaacatcattcgatgtcccaatggttgttcaattcaatgtgatgcctgacggtagtaggccagacagtgacgatattgatattgagtctctttggaattag

SEQ ID NO: 5022 - DNA, 1203 bp, Xenorhabdus bovienii
  Coding DNA location: Contig name=SeqID_16900; Position on contig =205095..206297bp; Strand=-
atgactgctgaatttaacttacatcaaatctacgatcataacctgaactttcttgtcggtgctggtgcttcaaatggttttctaccgacgttagcactagaggtaaaggggctagatggtagtaagtgcacattcgagacacttgcaaagaaatatgaaagcaacaaagaaatgacaacactgctgttcatgttgtactaccgagaatgtattaagcctggtttaccctcagttccagccaaaggtattcctgctcctcctagaccgccacatgaagaaagcgtcattcaagaatataagcggttcatgaccactttgattcacctcttaaacaagcaaaaaccatcagccaaaaaagcaaacattttcacaactaactacgataattgctttgaaattgctagcgaagagttgatggcagaaagaacatctcagttcgaagttaatgatggcagcactggttttcaagcgcgtactttccacacaagaaacttcaataaccgtatcgtaaataaaggcgtgtttgaccgtcacgaacagtttcttcctcaagtaaaccttctgcatgctcacggctcagtacattggatgaaaggcaacaaagatggtgatattgaacttaattacggtactagctgttacaacatagacttcaatcaagacgaaaataatattctagatgcttgcaaggtgattctttatgatacaaataaatcgctcaatgacctgagtgtatttgaagctcacacagattttacgaaacttcgttctgagcaatttgggcaggactataacaaaatgcctatcgtgaaccccacaaagtggaagtttcatgaaaccgtctttgaagaggcttactatcagattcttcgtcacctaagttatgaacttgaacgccctcattcagtattaattgctttcggcttctcttttgccgacgagcacattctcagtcttgtacagcgagcattgtctaatccgtcattgactatgtacgtaatgtgctatgacgagtcaacgaaagacaggatgtcggaaatattcagaaagtacccgaatgttaagttgatttactccgaagatagaaaattagattttacgcttttcaatgatgaatacttcacggtaaataaactaaacaaacctatgcctgaagaaaccatgaagccaatgcttgaagctgtagttggtggtgtcaaatga

SEQ ID NO: 5023 - DNA, 165 bp, Xenorhabdus bovienii
  Coding DNA location: Contig name=SeqID_16900; Position on contig =206323..206487bp; Strand=+
atgtcgatagaaagactgaatagccaccgaatcagaagacacaggctggccacacagatacaaaacttaacacatattgattcattagctaaatttggtcaaagagaaaagctaaagcgtatgactttttggagcataaaacagtttggggcaaaagcgagttag

SEQ ID NO: 5024 - DNA, 93 bp, Xenorhabdus bovienii
  Coding DNA location: Contig name=SeqID_16900; Position on contig =206549..206641bp; Strand=-
atgatctgtcagtcgaagtcagagatctcacaatatatttatttcattttggtacaattgacgccatacagggcatccatctcatcagattag

SEQ ID NO: 5025 - DNA, 912 bp, Xenorhabdus bovienii
  Coding DNA location: Contig name=SeqID_16900; Position on contig =206749..207660bp; Strand=+
atggatattcgaactactctccgggctgcgagtctttctctcgctcttgtaagtacggttactgttgccaatgaagccctggtgtttcagacagatttcggcctaaaagatggggcagtatcggttatgaaagggatatctttcaaggtgaatcctagccagcctatttatgatctaacacatgaaattccaccttataatatttgggaagcttcatatcgcctttaccagactctaccatactggcccaaagggactgtctttgtaagcgtggtggatccgggagtgggcactgacaggcgctcagtggttctcaagacacagagtggtcattacatagtctcaccggataacggaacattgaccttggtagctgaacactttggtattgaatctgtacgtcagattgacgagaagttcaaccgtgtacctggctctgaaaaatcatatacttttcatggacgtgatgtatacgcatatactggggcacgacttgcttcaggtattattagctatgaacaggtggggccgctgttaccaaataaagtagtaaagatcccttatcagactggtgtagctgaaagggatggaactcttaaggggactattccagttctagatgtacggtttgggaatgtctggagtaatatcaatgacagccaggtcagtaaggtgggtattcacaaaggggatcaggtctgcattaaaataagtgaaggggataagatccggtatgaaggcaaagccccatatgtcagcagctttggtgaagttcctgaaggtcaacctttggtgtatctcaacagcctgctacaggtatcggtagcactcaatatggataacttcgctgccagataccaagtgcagtctggtgataactggcgcatcagcctaaaaaagtgctcagattaa

SEQ ID NO: 5026 - DNA, 129 bp, Xenorhabdus bovienii
  Coding DNA location: Contig name=SeqID_16900; Position on contig =207957..208085bp; Strand=-
ttgggggagtcagagagaggctgtcaatacgaggtgacccgttctggtcgtttgtctaaatcatttatgccccaaaatgtgttgcacactactcctgttaaaaaagttaaactggatggggtcacctag

SEQ ID NO: 5027 - DNA, 249 bp, Xenorhabdus bovienii
  Coding DNA location: Contig name=SeqID_16900; Position on contig =208027..208275bp; Strand=-
gtgcgcagatgtaccacacagtgtgtactcccttgcaggctacaggagtgttgctgtcgctgcccgaaggtgatcctcacaagcgaccggatcatggataagtctgactacgctaataaacggaaatcattaggtcaatgggtaattcatttctcgggacaaaaaataatgtcaggaacacgacgggattttgggggagtcagagagaggctgtcaatacgaggtgacccgttctggtcgtttgtctaa

SEQ ID NO: 5028 - DNA, 285 bp, Xenorhabdus bovienii
  Coding DNA location: Contig name=SeqID_16900; Position on contig =208181..208465bp; Strand=+
atgatccggtcgcttgtgaggatcaccttcgggcagcgacagcaacactcctgtagcctgcaagggagtacacactgtgtggtacatctgcgcacctttggaagcagatatcgtcagtctgatgacgatgaaggtctcttaatctcatccatgatggccaacaggccagtcacccaacggggaacacatttcccattgggtcaggtgttctccgttgttttatcaggagaataccatgcaacaaaatacaatcccggccacggtgcacactgtgtccccggctga

SEQ ID NO: 5029 - DNA, 435 bp, Xenorhabdus bovienii
  Coding DNA location: Contig name=SeqID_16900; Position on contig =208416..208850bp; Strand=+
atgcaacaaaatacaatcccggccacggtgcacactgtgtccccggctgaattatccccttttgctgaaatttttccgcacaccggttcactggaactgatgctgctggagcacacgttcattaaagctgctgctgtgctttgtgacgatgaccggtgtgaccgatggcagtaccggaaagtgtcagacagcatcgcctatatcgtgccgatgcggccggattcttctgtggttaacgtggatacgactgactttaaaggtgaagtctccgccgatgcctttggactgatggtgaccctgagcgtgttgggttatctggcggccctgatgaagctggacgggtacgctgaacggttttgcgacctgcgtgaatatgcgctgcaacatcctcaggcttcgtgtatccgggctgctttgggcttaaagggtgcataa

SEQ ID NO: 5030 - DNA, 462 bp, Xenorhabdus bovienii
  Coding DNA location: Contig name=SeqID_16900; Position on contig =208863..209324bp; Strand=+
atgccaaataatgaactgattatgctggacagtcttgcgctgtcggtcgtgtttcccgacaaaaccccgctggaacggttgtttctgggattcctgctggcgaataccgcatcgacgttatgcggcgattatcagcctgaacagtggacaagccgacaggtgtctgaatcgctgacttatatggtgccgacacgggcaaaaacgtattccgtttacctgccggttacgcagctgacggtcacgctttccgccgatgccttcgggctggcggtcacggccatcgtatcagcccgtatcgcggtgccggatacacagaatgaggaggcgtaccggttctgcgcattgcaggcgtatgcgcagcagcacctggaaagcggcctgatagcctcggtcatgacactgaaacccgaagaggacgttatcagtccgtcacttatccctaacaaaaataatcatcattaa

SEQ ID NO: 5031 - DNA, 126 bp, Xenorhabdus bovienii
  Coding DNA location: Contig name=SeqID_16900; Position on contig =209330..209455bp; Strand=-
atggagttcatggtgttgttccttgattttatgtcaatgaaagaaaacacccgcccgataccgggaaggtgttttggcttccccggtcaggcgcttaagaaaagcgttaacagcctcatgggctga

SEQ ID NO: 5032 - DNA, 558 bp, Xenorhabdus bovienii
  Coding DNA location: Contig name=SeqID_16900; Position on contig =209445..210002bp; Strand=+
atgaactccatttttttaccggcaccggatgaaaccgataccgcattacgtgaagagctgtttaccgctcaggtcaccggcctgaggcaacacccgaaagcaccacagtcattgccgccggaaaccctgatggtgtgcgaagcctccaccgtcacggaagtggtgcagcggctgaaggtgatccatcttctgggggactggccggtgccggagaggttatctgctcaggttgcgggggctttttttccgctgaccgtcatgatttttgatgcacaggacagaaaagtgctcggtggccggtttgatgaagaaattatctgggcgcagccggtcacactgacgtcagaacgcctgtcattggaacagcaacagcagcggttatgtcaggcagcgatgcttgagcagagctggcagaatactccggcggcgcgtgcgttgtggcacaaggtgcatttattgtcactgcatggggtttcctcctgttatcagcagtgccatgaagtgcgggatattctccggtatggcgtctccgtcagtgctttttctgagggggcatga

SEQ ID NO: 5033 - DNA, 297 bp, Xenorhabdus bovienii
  Coding DNA location: Contig name=SeqID_16900; Position on contig =210002..210298bp; Strand=+
atggccacattacatttaacggtctggcaggtgattgccgcagccctgttgaaacggcattttggcctgagcctgactgacacggcactgtgtgaaaccgacacggtggcggaactgatagcagggggtgtccggccttctgaagccattaacgaattggtggataaatacgacttaacccggctgaatacgcaggttatcccgcgcagtacgccttatctggatatccacgatgaactgacggtcatttttgacagcggtctggctgaaatgctgttcaggcaaaccaggccgtaa

SEQ ID NO: 5034 - DNA, 924 bp, Xenorhabdus bovienii
  Coding DNA location: Contig name=SeqID_16900; Position on contig =210391..211314bp; Strand=+
atggcagaatggtgcaccaatcaactggaaatcaccggcaaatccgtctgtctcgatgtgatgcaacagtgggtctgcggggaagaagtccctcgttaccgtcaggcggtgttacaaagcctgcggttatttctggcgggttgtgcgggaatactgaaaccgaccaaaccacaaacctacaccccgtacccagcgctggtgcgcggcacggcggtgccaacggcgcagcatctggcctttgagcagtggttgttgttgttacagaataatgtgccgttgaatacggacaatatcaaacgcattgataacctgtatcgtcagtccggtctcagcctgatgtcctgggacaaggtgccggaagcggcgcgtgatattatggcccgtcttctgacccgccagtataccgactggttcggcatggtgggctggtctgacacacccgatatcggggcatgctgggataagctgaatgcgtacccgcaggcggcacagccctgcgatatgctgatgatgatgtcaacgaatctggcgactgaaatcaacggtaacagcaccctgctgaaaggcattgccacgacagcgcagttttacgatgaacaatacgggatggaatggccgtttggtcaccatgtccgctgggaacgccgcaatgtcagcagcttaaccgtgcggtttgattccccctgggcaccgccttcggcggagctgatgggggagctgtccgcgatgtttgactgtgaaatccgccactggtacagcgaagcatcaggccagctcaaaggctacgattgctatgaccaaggcgagcacgtggacagcggtcacgggcagtcaggacgggaaaaccggccggcactctatctggtcaccggtgagcaggcggaaacggcactggctctgccggctatcgcggttgggcaatag

SEQ ID NO: 5035 - DNA, 687 bp, Xenorhabdus bovienii
  Coding DNA location: Contig name=SeqID_16900; Position on contig =211429..212115bp; Strand=+
atggcatcccgaaccgatcatcagaaagaattcatttcgctgtttaagcaaacggcccgttatcatacccgttatcaggtcttccgggatttttgcaattgtgctatggcagcgatccacaataaacactgtttcagtgaggagctggagcagtattatctgaaaaccattaacaagtacgaacgggccgatgttgaccggatcgtacaattgttttcgcatgtggtgctcggactggcgcaggaacccggtgattttctgggtagtgtgtttatgcggctggaactgggtgataaggatcttcagcagttctttaccccctggagtgtggccagaatgatggtacagatgcagttgcaggatgccgccgggctgttacagacacaaccgtttgtcaccttgtgcgagccgtgctgtggggcgggctgtataactttggccgccgctgaagtgctgagggagctggggcacgatccgttgtgcagtctgtgggtttatgcgattgatattgacccgctggcggccgtgatggcgtatattcaattatccctgaccggtattccggccgccgtcaccatcggcaatgccctgcatgatggtggtgacaagcgaacccgttatacgcccgcgcattatctgggcaactggtctcagcgtttgcgggaggcggagcttatcgccgcctga

SEQ ID NO: 5036 - DNA, 1059 bp, Xenorhabdus bovienii
  Coding DNA location: Contig name=SeqID_16900; Position on contig =212173..213231bp; Strand=+
atggtgttaatacaatgggttatggtgaaaattaagctgattttgtcagtcagtcaggggatgaaccgggtcagattaattttcatttttgcaaaaagagttgttccttgtttccggccgggattcaccgacactgagccaaatctgaaccgaaagaggaaaaccatgtttcagcgttttaaatcccgttttacccgtgacctttccccgtcacaaaaagcgcccggactagcgcctgaaagagtacgcggtgccggaggttatttccgtccacagtcagcagaggtgctgctggtaacttcagagcgtggccagtatctccgccaactgtgggaaaacagtgcgctgcccgccgggttgtatcagcaattctatctggatccgctccggcaattatgcgcccgtgtgcagcatgttcccgcgacacaagagggcatctggtcttatcgcggcggatttatcgatctgaccctgcaatttactgcctgtgccgtgcggctggcaaaagggcatatgttgcctccgggggtggcgccggaaacacaggccgcacaaagtctgctgtggcagtcggtggtgttctgggcggcgctgttttaccacctgcctctgctgcggcaactggaaggggaactggaagacgggcatcactggcagccgggattgtggatacctgaacgtcgtttccgcttccggtttcaggcaccgcggcctgagctgccagtcctttataaaacgttgctggctgcccgtttgttaccggaggaagcggtgacctggttgtctttagtgcccggtgcgtggcagtgcctgatgttgcatcttggcggacatccgtcttctgtcccgttgacggactcactgcttcagtctgccgctgagcaggtgcagtcaccgctgctgaatcccgttgaatctgctaaaccggctaccgataccaggctgtcatcatcagaacccgatccggttattccgcctgtcacaccgggaacagtccctgcgcccgacaccaccgaggatacccggagattactgtcattgtttcaggcagaggaatga

SEQ ID NO: 5037 - DNA, 123 bp, Xenorhabdus bovienii
  Coding DNA location: Contig name=SeqID_16900; Position on contig =213216..213338bp; Strand=-
atgaccttttgtacattgcagaaacaaggccttccggcgctgatgcggtgcgttcggacaatttcgaatcgttatcgttaccatttgcattctttctcatcaaaatttcattcctctgcctga

SEQ ID NO: 5038 - DNA, 1008 bp, Xenorhabdus bovienii
  Coding DNA location: Contig name=SeqID_16900; Position on contig =213442..214449bp; Strand=+
atgttaaataatgaggaaaaaatgggctgggatgcgttactggacgagtattttttttcacggatgttacggccggcaaccgaatggagttatcgcaaggtggtgcgggtctttatccggtatatgggggaaacggggttgccggagagcgtgactcaccgggatgtcctgtgctggcggcgtcatctgctgatggaaaaaaatcagtccggctatacgtggaacaataaggtggcgcacctgcgggccatttttaatttcgggatggaaagaaaactgttgtcacaccccaaaaatccgtttaatgacgcggcagtcaaaaaagagaagaaacaaaagaaaaccctgagtaaggctcagataaccgggatttacctgcggatgcagcagtatgaagaggaagaacgtttacagaccgccccgcggggcggacgctgtgccttatacccgacggggtactggctgaccgtactggataccttccggctgacgggcatgcgcctgaaccagctgctgcatctgcggttacgggatattaatctggacaacagttacattgagttgcgtgtggaaggcagtaaaaaccacagtgagtggcgggtgccgatgatcccgcagctgaaaccccggctggcgcagttggttgaacaggcaaaagcctgtggcgcgaaagaggatgatccgctgtttgatttaacccgcctgcgtttttgtcatcacggacgccatgtcagtcaccagtatcatcatgacagagaaaagcaacatctccgttctttctttaaccgcctgtctaaagaatgtggttttgctgtctccccccaccgcttccgtcatacgctggcgacagagctgatgaaagcccccgaccgcaatttgcagctggtcaggtgtttgctgggacaccgcagtgtggcgaccacgatggagtatattgatatcgatatggaaatcgcgggtaaaactctggcgaatgaactggcgttttatctggatcttgctgtgtaa

SEQ ID NO: 5039 - DNA, 276 bp, Xenorhabdus bovienii
  Coding DNA location: Contig name=SeqID_16902; Position on contig =829..1104bp; Strand=-
atgcgctatagctacgataatctggtgggcagcagtggtctggaggtggacggagacagacaaattatcagtatggaagaatactacccgtacggaggcacagcagtgtggacggcgaggaaccagacggaagcgggttataagactgttcgttactcgggtaaggagcgagatgcgacaggactgtactactacgggtaccgggcggggcggtggttgagcccggatccggcggggacggtaaatagtgtgtttgagagaggttttattgagtaa

SEQ ID NO: 5040 - DNA, 291 bp, Xenorhabdus bovienii
  Coding DNA location: Contig name=SeqID_16902; Position on contig =1160..1450bp; Strand=+
atgggcgaagcggtattaccggagcaggtcactcaccgggatgtgctgcggtggcggtatcattcgttggtggagaagaaacaatccggtcatacttggaacaataaggtggctcacctgcggacgatttttaatttcggcatggcaaggacactcctgccacagactgaaaacccgtttaacgatgccgcagtgaaaaaagagaagaaaaagaagaaaattctgagtaaatcccagatcattcatctctatctgctgatgagacaatacgaggaagaggaaagaagataa

SEQ ID NO: 5041 - DNA, 414 bp, Xenorhabdus bovienii
  unsure (1)..(414): unsure at all n locations
  Coding DNA location: Contig name=SeqID_16902; Position on contig =1478..1891bp; Strand=+
ttgtacctgacagggtattggttgaccgtgttagacaccttccggttaacgggtatgcgccagaaccagttattgcacctgcggttgcaggatatcagtttggaaggcaattatattgtcctgcgtgttgaaggcagcaaaaaccacagtgaatggcgggtgccgatgatccggcagcttaaaccccggctggcgcagttggccgggcaagcaagagcctgtggtgaaaaagacgatgatccgctgtttgatttaacccgcctgcgttttcgtcatcacggacgaacaatcagttatcagtataattacgataaagaaatgcagcatatccgttctttcttcaaccggttgtctaaagagtgcggntttccgtctcctctcaccgttttcgtcatacactggcaacggaactga

SEQ ID NO: 5042 - DNA, 1074 bp, Xenorhabdus bovienii
  Coding DNA location: Contig name=SeqID_16902; Position on contig =2621..3694bp; Strand=-
atgaaaagactgctggctctgattcttctcactccactcctgatttcctgctctagcaaaaaagatattgaatacaatgaagcatacgtaaaagatacaaatggttttgatatcttaatggggcaatttgcccataacattgaaaatatctggggcttacaagaagttttaatcgcaggccctaaagattacgtaaaatacacggatcaataccaaactcgcagccatatcaattttgatgcgggaaccatcacaattgaaaccctatcgcctattgaaccctctgaacatttacgcaaggcgattattaccaccttgctgatgggtgacgatcctggctctgttgatctttattctgacatcaatgacattcagatcagcaaagagccatttctttatgggcaagttttggataatgcgggtgagacaattcgttgggagtggcgtgcacgtcattttgcaaattaccttctccagaataaattacaaaaacgccaatcagggctacatatgatttggaccgtcaccattcaattggttcctaatcatttagataaacgggcacataaatacctgccgatggttcgcaaagccgccatcaaatatggcgttgatgaatccctgatccttgccattatgcaaaatgaatccagctttaacccttacgctgtcagtcgttctgatgcactgggattaatgcaggtcatgcagcataccgctgggcgagatgtcttcaaaatgcaaggaaaatccggccagcctagtcgcagttatctcttcgatcctgaaaataacattgatgcaggtaccgcatatctatcgatcttgcagaatatctatttaggggaaatcaacaacgcaacctcacgtcgatatgccgttattaccgcctacaatggcggtgctggcagtgtattgagagtgttctccagtgataagaaaaaagcggcacaaatcatcaataccatggcacctggtgatgtttatgaaacactgaccaataaacatccagcttctgaatcgcgccgttatttgatgaaagtgaataatacccagaaagtctatcgtcgatag

SEQ ID NO: 5043 - DNA, 273 bp, Xenorhabdus bovienii
  Coding DNA location: Contig name=SeqID_16902; Position on contig =3847..4119bp; Strand=-
atgagcagaaccattttttgtacttttttgcaacgagaagccgaaggccaagattttcagctctatccaggagaactgggcaagcgcattttcaatgagatttctaaagaggcgtggcagcaatggatgagtaaacaaaccatgctgatcaatgaaaaaaaattgaacactataaacccagaacatcgcaaactactcgaacaagaaatggtgaagttcttgtttgaagggcatgatattaaaatcgacggttatacaccgccggaaaaataa

SEQ ID NO: 5044 - DNA, 1038 bp, Xenorhabdus bovienii
  Coding DNA location: Contig name=SeqID_16902; Position on contig =4149..5186bp; Strand=-
atggaagccgagcaattttcacaggcggtacttgaatggtatcaccgctatggtcgtaagaccctgccgtggcagttggaaaaaacgtcctatcacgtctggctttcagaggtgatgctgcaacaaacgcaggtcgcgactgtcattccctatttccagaattttatttcacgtttccccgatgttgcctcactggccgccgcaccattggatgaggttctgcacttatggacgggtctgggttattacgcacgcgcccgtaacctgcacaaagctgcccagcagattgttgcgatacacagtggtcaattcccgacgacatttgatggtgttattgccctgcccggtgttggccgctctaccgcaggtgccattctttcactgtctcagggaaagcacttcccgattctcgatggcaacgtaaagcgcgttctggctcgctgctacgctattgctggctggccggggaaaaaagaagtagaaaaccagttatgggatatcagtacccatgttaccccagaacagggtgtcgagtattttaatcaggcaatgatggatttgggcgcgatggtctgcacccgcagcaaacccaaatgtgaaatctgcccactcaatacaggctgcatcgcctacgccaatcatagttgggcaagctatccagggaaaaaaccgaaacaaaccatccctgagaaaacggcctattttttattgatgcagcatggcgacacggtttggttggagcaacgtccactttcaggcatttggggcgggttattcgcattccctcaattcacagatcaggcttcactggaacagtggttgaaagactccggtatctctcacagcaaacctgatcaactgattgcatttcgccatacattcagccactttcatctcgatatcgtaccgattaaaatcgatattttatcttttgattcctgcatggatgaaagcaagggactttggtataacttacgccagccagcaactattggattggcagctcccgttgaatatcttttgcaacagctgggataa

SEQ ID NO: 5045 - DNA, 723 bp, Xenorhabdus bovienii
  unsure (1)..(723): unsure at all n locations
  Coding DNA location: Contig name=SeqID_16902; Position on contig =5433..6155bp; Strand=+
atgataaataacgtaatttcaccggaatatgatgaaaatggcagggctttgcgccgtgtccgcagttttgtgcgtcggcagggccggttaacgagtcgtcagcagcaagcacttgatgatgtgtggccaaagatgggcatggattatcagccggaactgttcgatatgagcgaactctttggtcgtgaagcgcctgtcgtactggagattggcttcggaatgggagcatctctggtgatgatggcaggccagaatccagagaaaaatttttttgggatcgaagttcatgtgccgggagtaggtgcatgtctggcttccgcagaagatgaaaatctcagtaatctgcgtgtaatgtgtcatgatgccattgaagttttggaaaatatgctgccggaacagagtctggaaatggtgcaacttttcttccctgatccgtggcataaagcccgtcataacaaacgtcggattgtacagcctgagtttgcccaacttatcagaagtaagctgaaaatcggtggtgtcttccatatggcaaccgactggcagccgtatgctgaacatatgctgaaagtgatgagcgtggctgaagggtattgcaacgtgtcggaaaatagtgattatgtaccacgtcctgattcacgtccggtcacgaaatttgagatgcgcggtcagcgtttggggcatggcgtatgggatctaatgtttaagagggtaaaatannnn

SEQ ID NO: 5046 - DNA, 651 bp, Xenorhabdus bovienii
  unsure (1)..(651): unsure at all n locations
  Coding DNA location: Contig name=SeqID_16903; Position on contig =117..767bp; Strand=+
gtgcgtcgncaggcccggttaacgagtcgtcagcagcaagcacttgatgatgtgtggccaaagatgggcatggattatcagccggaactgttcgatatgagcgaactctttggtcgtgaagcgcctgtcgtactggagattggcttcggaatgggagcatctctggtgatgatggcaggccagaatccagagaaaaatttttttgggatcgaagttcatgtgccgggagtaggtgcatgtctggcttccgcagaagatgaaaatctcagtaatctgcgtgtaatgtgtcatgatgccattgaagttttggaaaatatgctgccggaacagagtctggaaatggtgcaacttttcttccctgatccgtggcataaagcccgtcataacaaacgtcggattgtacagcctgagtttgcccaacttatcagaagtaagctgaaaatcggtggtgtcttccatatggcaaccgactggcagccgtatgctgaacatatgctgaaagtgatgagcgtggctgaagggtattgcaacgtgtcggaaaatagtgattatgtaccacgtcctgattcacgtccggtcacgaaatttgagatgcgcggtcagcgtttggggcatggcgtatgggatctaatgtttaagagggtaaaataa

SEQ ID NO: 5047 - DNA, 93 bp, Xenorhabdus bovienii
  Coding DNA location: Contig name=SeqID_16904; Position on contig =96..188bp; Strand=+
ttgacagcacagttgatgcctttattgaagaactggttgaaccaaacggtctggcgctggatgccagcggctatttacagtgggaaggtttga

SEQ ID NO: 5048 - DNA, 126 bp, Xenorhabdus bovienii
  Coding DNA location: Contig name=SeqID_16904; Position on contig =185..310bp; Strand=+
ttgatctgcctacagaaaatcggtaaatgtaccgaagaacaccgccagttggtggagaaatggctgaaagatcgcggtatggaagacgttgccctatcagaattgtttgatgtgtggtgggattga

SEQ ID NO: 5049 - DNA, 111 bp, Xenorhabdus bovienii
  Coding DNA location: Contig name=SeqID_16904; Position on contig =294..404bp; Strand=+
atgtgtggtgggattgattcgctattgcataaaaatagtgttttatacagaaataacgctgtatacaggggctcctttggggcccttgtttgtctggagaaaaagtggtga

SEQ ID NO: 5050 - DNA, 927 bp, Xenorhabdus bovienii
  Coding DNA location: Contig name=SeqID_16904; Position on contig =401..1327bp; Strand=+
gtgaaggtaaggttctctaattcgttattggcagatatcttagatgaagtacgccctttgattggccaaggaaaagtggcaggttacatacctgctttggcagaagttgcggtaaataatctggcgatggccatctgtacggttgatgggcaggtttttaaagcgggagatgcggaaaagcgcttttccatacaatccatttccaaggtattgagcctgacactggcgatgacgcgctatcaagagcaggatatctggcagcgagtggggacggaaccttcgggacagccgtttaattcattagtacagttggaactggaaaaaggtattccccgtaatcccttcattaatgcaggtgccttggttatctgtgacatgttgcaatcacggttaagtgcgcctaagcatagaatgctggagttcgttcgtagcctcactgggcaaaagcacatttgctatgatgatatcgttgcccgttcagaaatggatcattccagccgcaatgctgcaattgcttatttgatgaaatcgttcggtaattttgagaatgatgtgctcacggttctacaaacttatttccactattgtgccttgaaaatgaattgtgttgaactggcccaatgttttatctacttagcgaatcaaggccgtatgatcggttctggacaacaaattttaagtcttcggcaaaccagacagattaatgcgctgatgctaacgtgtggtatgtatgatggctctggagagtttgctttcaggatcggaatgcccgggaaatccggtgttggcggaggaatagtctgtgttgtgccaggggagttcacggttgctgtatggtctcctgaactgaatagctccggtaactcactggcgggttgtgcggcattggaaaaattggctgagcgtatcgggcgttctattttttag

SEQ ID NO: 5051 - DNA, 723 bp, Xenorhabdus bovienii
  Coding DNA location: Contig name=SeqID_16904; Position on contig =1408..2130bp; Strand=+
atgttacgcagaatcgcgattgctgcatcgttattatttgtcgctcaggtacaggcaggttctgactgtcagacgacaattcaggatgacattattgtcacgtcaaagtcggttcagattgttggagccagtggaaacctgagaattttgccagatggttctatgctccgtaacggtaaagcactgtcattgaattcagaacagcgtggtaaggctcagcaatatcagcaggctattcggcaggatctaccgtgggttaagacagaagcactgagccatctgacaagtgcccgtcaagcgctggataaagttgtcgtaaatacaatggggaaggagagtaatatccgtaaccgtttatcccaattggaatctggcctcaataagcaaattgataaagtacttgaaactcgttctgatggcgttgcattcaactctcaggccattaagaaggtggaatccgaagggcagaatcttattcagcagagccttggcggtattttgcaggatagcattaacgaaatgagccgtaagaagagtgagcagaatggtgatggcaaacagatgttgatgtctcttctcggtggattgggcgggatgcaaaatggttttgatgcagaatggaaaaagcaggaacaagagctgaaccgctttaaaggcgaagtttgcagtaaagctaaccaattggaacaactacgcaccaatctcatgaattctattaagtaa

SEQ ID NO: 5052 - DNA, 168 bp, Xenorhabdus bovienii
  Coding DNA location: Contig name=SeqID_16904; Position on contig =2132..2299bp; Strand=-
gtgacagaaagtagtgacgctaaaacaactggcaggatttttttcattgttacacctgaattacgcatgttagtaataagtgactcgcattctaggtggcaacactacgatgtcaatcaaataagaatcaatttcatattgattcttatttttagtgatgtgcagtga

SEQ ID NO: 5053 - DNA, 966 bp, Xenorhabdus bovienii
  Coding DNA location: Contig name=SeqID_16904; Position on contig =2232..3197bp; Strand=+
atgcgtaattcaggtgtaacaatgaaaaaaatcctgccagttgttttagcgtcactactttctgtcactagttattctgcattcagtcagccatcagtgttattcacccctaattccgtgatagtacaatctggtgatttcgtcacagtaaaacatctttctggtgaaacacaggttaaaaagaaccctgagcggatcgtcctgtttgattttgggatttatgattcactggtaaaactgggtttatccgatcgcgttatcgcattacctgtcggcaatgcccctgaatatgtgcgtggcaatatgtcagcaaatatgcagaatgcagggggaatgaaagaaccggatttagaaaaattggctggcatgaaaccggatctgattgtgattaccgggcgtcaggggaatttctatccatctctgtcaaaaattgccccaacagtgaatttagatactgacagtaaaaattatttgtcgtctgttgaaagcaatttaaagttattaggtgaactatttaacaagcaggatgcggttaaggcccagattgtagatctggaaaaaacgattgccacagcgcaggaaaaagccaaatcttcagatagtaaggtattagttcttttacataacgccggcaacttatatccgaacaaccaagcaattgtttatgacgtggttaaagcacagcgtgcggaattaccacttcctacagataaagaaaagtcccgtgttgtaacggcagaaatgattgctcaggcaaaccctgatgctatttttatcatcgaccgcagcaaagcgattggtgcaggcgaattgacaaaagatcagtttgaaaatgatcaggtaaaatcaaccaatgcctataaaaatggcaagattgtttatctgcaacctgatctatggtatttgtctggcggtggactggacagtatgactcgacaaattaatgcggttgctgatgtactgtaa

SEQ ID NO: 5054 - DNA, 105 bp, Xenorhabdus bovienii
  Coding DNA location: Contig name=SeqID_16904; Position on contig =3221..3325bp; Strand=-
atgccttgcaagaattgctttaagtcccgtttatttttgatggtaatgatatcaataccaaccaactcattagaatttagtattcattttccgaggctgatttaa

SEQ ID NO: 5055 - DNA, 1131 bp, Xenorhabdus bovienii
  Coding DNA location: Contig name=SeqID_16904; Position on contig =3373..4503bp; Strand=-
atgcttaaattacctccactaagtctttatatccatattccctggtgtgtacaaaagtgcccttactgtgatttcaattcacatgcgttaaagggagatgtaccacatcaggagtatgttgatcacctgctggcagacttacgtgctgacttgccgatgattgaaaatcgtgaagtatcgacaatttttatcggcggcggaacccccagcctgctcagcgctgagggtatgcaacgcctgcttgacggagtacgggcgtcactgccactctccgcgcaggcagaaattacaatggaagccaatccgggaaccgttgaagctggccgtttcagcgcttaccagaaagcaggcatcaatcgaatttccatcggcgtacagagctttggttcagataagttgattcgcctagggcgcatccatggcccagacgaagcaaaacgggcagcacatttggctgccgaccttggtttacgcagtttcaatctggacttgatgcacgggttgcccaaccaaacactgaatgaagcattagatgatttacgtcaggcgattgaactttccccgccgcatctgtcttggtatcaattgacgattgaacccaataccagttttgcttcccgtccgcccgttctgccggacgatgatgcgctatgggatatcttctcccaagggcatcaattattgacagctgcgggctaccagcaatatgaaacttcggcctatgccaaagcgggttatcaatgtcagcataatctcaattactggcgttttggtgattacttaggtattggctgcggcgcacatggaaaaatctcgtttgaagatggccgtattctccgtacagtcaaaaccaagcacccggctggctatatgcagggacgttatctggatcagcaaaatcaagtggataatgaagatcgtccatttgaattcttcatgaaccgttttcgcttgctggaagctatgccacgacacgatttcagtgattttaccggattaccggaaagtgccattcgtccacaacttgatgaagcactggctaaaggttatatcactgaaaacgcgacgcactggcagatcaccaaacacggcaagttattcctgaattcactgttagaactgtttctttaa

SEQ ID NO: 5056 - DNA, 594 bp, Xenorhabdus bovienii
  Coding DNA location: Contig name=SeqID_16904; Position on contig =4496..5089bp; Strand=-
atgcaaaaagttgttctcgccacaggtaatgctggcaaagttcgtgagttggctgatttactgactgactttggcttagatatcgtggctcaaaccgagctgggtgttgattcagccgatgaaacaggcctgactttcattgaaaatgccatcatcaaggctcgccatgcagcggcaataacgggattacccgcaatagcagatgattcagggctatcagtcaacgccttaggtgatgcaccgggcatctattctgcccgctacgcaggtattgatgcttccgatcggaataatctggaaaagctgctggaagcgatgcgtgatattcctgatgaagagcgccaggcacaattcaactgtgtgctggtctatctacgccatgcagaagatccgactccactgattttccacggtcgctggtctggcatcattacccatgaacccgctggcaatggcggttttggctatgacccgattttttatgtgccagaatttagctgtacggcagcagagctgagtcgcgaacaaaaaagtgcagtttcacatcgtggacaagcgttgaaaatgctgttggaagccatgcttaatgcttaa

SEQ ID NO: 5057 - DNA, 573 bp, Xenorhabdus bovienii
  Coding DNA location: Contig name=SeqID_16904; Position on contig =5111..5683bp; Strand=-
atgcaattcttaaactttatctttcttacaattctagatttatatattgcggttttactgcttcgagtctggatgcaatgggtacgttgtgatttttataatccattcgcgcaatttatcgttaaaatcacccaacccgtggtacgcccattacgcagggtcatccccgccattggtcctctcgatacagcatccatagtatttgcctatctgatcgttcttcttaagatgctgatacctgcatggctcgcaacgggacaatttgtgatacctctcgcgattctgttccctgtcgggctgattgaactacttaccgcagccggaaaactcatattctggctcgtcattgcccgtgcattattaagttggatcagtcaagggcgcaatccggttgactatgttttgattcaactgactgaaccgttaatgtcacctatccgtcgtatcattcctgccatgggtggcattgatttttctgccatgattgtcatattagttctctacgcgctgaatgccctacgttacgatgtcatgggcgtggttaatttcaatgataagcggttgattagataa

SEQ ID NO: 5058 - DNA, 957 bp, Xenorhabdus bovienii
  Coding DNA location: Contig name=SeqID_16904; Position on contig =5717..6673bp; Strand=-
atgatatggaagccgctatctcctgcggctctacattggtgcgcattggaacggcaattttcggtgcccgtcagtacaatactcaaccctaaattaactggccaaaatcaactgattaatatgcgagactatttaatggaaaatcgtaaaatcacctttattggcgctggaaatatggctcatgccattatcgccggactggtcagaacaggttatcctgctggactcatcactgtctgctccccaaatacaacccgtcgtgacgttctggcaaaagagtatggcatcaacagcgaaaacgataacattcgttatgcccaagaagccgatgtcattgttctggcagtaaaacctcaaatgatggaagaagtttgtgattcactgcgttcacaaatagatttcagtcataaactagtactctccattgccgctggcattcctgttagccgtttttacacgctattacaggatcaactcaacatcatccgcatcatgccaaatacgcccgcacttgtagggcaggggctcagtggattatttgcgcctgaacacgtcactcagcctgatcgccagtttaccgaatcgctgatgtgcggtgttggtaaagtctgctgggtcaatgatgagaatggcatcaacaatattattgccgtcgcaggcagtgcgccggcctattttttcctgttcatggaatccatgcagcaagaagctgaacgtctgggattcgatagccaaactgccagggaacttgtcctgcaagcggttacgggttcggctaaacttgctgagtcacaggcagatcttccttttgctattctgcgcgagcaggtaacatctaaaggcggtacaactgccgaagctctgcgcattttttatgaaggccatctaccagagatcgtatcccgcgccatgcaggcagcaatccgccgagcgcaggaaatggaaaaactattttaa

SEQ ID NO: 5059 - DNA, 702 bp, Xenorhabdus bovienii
  Coding DNA location: Contig name=SeqID_16904; Position on contig =6582..7283bp; Strand=-
atgaacaatatcaaacaaaatcttcacgatgtcaggaaccgcatagcccttacagcacagaattgcggacgctctccacaagaaattacattgcttgcagtcagtaaaaccaaacctgcggacgctatcgcaaaagccatagcgactggtcagcgggaatttggtgaaaattacgttcaagaaggggttgagaaagttcaacactttgccaatcatcatgatttggtatggcactttatcggccccttgcagtccaataaaagccgcttggtagcagaacattttgactggtgccataccatagacagattaaaaatcgcccagcgcttaagtgagcaacgccctgaaaacatggcgccacttaatatcctgattcaaattaatatcagtggagaagacagcaaatcgggcattattttggaatcactgccggaactggcaaagaccatcaatgcgctacccaatctggtattacgtgggctgatggcgatcccggcaccagaaagcgattttgaacgtcagatggcgatattccaccaaatggaacaggcgtttattgaattgaaaacgcaatatccacgagttgatacactttcaatgggtatgacggatgatatggaagccgctatctcctgcggctctacattggtgcgcattggaacggcaattttcggtgcccgtcagtacaatactcaaccctaa

SEQ ID NO: 5060 - DNA, 1011 bp, Xenorhabdus bovienii
  Coding DNA location: Contig name=SeqID_16904; Position on contig =7306..8316bp; Strand=+
atgaatatggaaaaattggtggctcttagtgtaaagcataatgcttctgatctgcatctttgtgtcgggaaagttccggttttgcgtatcaatggtgtgctgtacccacagatgcaactggcagaaatgcagggtgataccctcatggcatggagcagaaaaatattgaccgaagaacaacagcagcagttacaggaatacggtcatgttgattttgtggtggaaatgccagataaacagcggctcagagggaatctgttttaccaacagtgtcaggtttcattggtattgaggttaatcgcggataaatgtcctactctggaacaattatatgcgccggacattatccaacgtctgattttgcaggagaaaagtgggctggtattagtgacaggcgcaacgggaagcggtaagtctactactttgtcggcgataatcaatgcgttcaataatcatggcaacaaacatattatcacgttggaagacccgatagaattcgttcatcaaagccgaaattgcctgatacagcaaagacaaatcggcagggatgtgcaggattatcaaacggctttgaaaggtgcattacggcaagatcctgatgtgattttgctgggagaattgcgtgacaaagagacgatccgtttggcattgacagcggctgaaacaggacatttggttctgtcaacattacatacccgtggggcaattcaagcactagatcgtttggttgatgttttcagcgcagaagaaaagggctggatctgcagccaattggcaggaagtttaaaagcagtcatttctcaacaactgcttctggccagagaggggggaagagtagccatttatgaagttttggtcgttaaccaagcggtcagccatttgatcagggaaggaaaaaatcatcaaatcgcgacattaatgcagacaggtgctgcctgcggtatgcaaactcatgagcaaagccggcaacaacgtgagttgttgggattgctggctgttgttccacaatga

SEQ ID NO: 5061 - DNA, 426 bp, Xenorhabdus bovienii
  Coding DNA location: Contig name=SeqID_16904; Position on contig =8327..8752bp; Strand=-
atgaaaaatcgcacaataatcgcattcgatttcggtactcacagcattggtaccgctatcggacaagaaataaccggtacagccagagcattgagcgccttcaaagccaaagagggttctcccagttgggaattaattgaaaaactactcaaagagtggcaacccgatctggtcattgtcggattaccactgaatatggatggcacagaacaactcgtcactgctcaggcgcgtaaatttgccaatcggctacacgggcgttttggcgttcaggttgaactgcacgatgagcgattgaccaccatagaagcacgctctcacctgttcgatcacggtggttacaaggcactggataaaggcaaagttgattctgcttctgctgtcgtcattctggaaagttggtttgaacaacaatactcacaatga

SEQ ID NO: 5062 - DNA, 564 bp, Xenorhabdus bovienii
  Coding DNA location: Contig name=SeqID_16904; Position on contig =8752..9315bp; Strand=-
atgaacctacagcaccattttcttattgccatgccttcgctctctgatccttatttcaaccgttcggtagtttatatctgcgaacacgatcaaaacggggcaatggggttagttatcaataaacctatagcccaaatttctatccaaagcatcctagaaaagttggatatcactcccgaagatagagacgatagcatcaatttaaataaacccgtgatggcaggtggcccactgtctgaagaacatggctttatcttgcacactccgcaatccgggttcagttcaagtatccagatctctgatgaaacgatgataaccacgtccaaagacatgctggaagcattaggcactccacgccagcccgaaaatgttttaatgaccctggggtattcgagctgggaaaaaggccagttagaacaagagatcatggaaaatagctggctgaccgtcagtgctgaatcttccatcatttttcatacccccgttgccgatcgctggtatgaagccgcttcactgctcgggatcaatatttacaacctcgcaccacaagcagggcatgcctga

SEQ ID NO: 5063 - DNA, 960 bp, Xenorhabdus bovienii
  Coding DNA location: Contig name=SeqID_16904; Position on contig =9407..10366bp; Strand=-
atgatcaagctcggcatagtgatggacccaatttcatccatcaaaatcaagaaagacacaagttttgccatgttgctggaagcgcagaaacgcgggtgggaaatccattacatggagatgaatgatctctatctatatcaaggagaggctcgggcccgtacccgcctgctcacgatcgaagaaaacccgcagcaatggtatcagttcggcagcgagcaagagattgctctcgataccttgcaggtgattctgatgcgtaaagatcctccttttgatacagaatacatctacgctacttatattctggaaagagctgaagccaaaggcagcctgatcgttaacaagccgcagagtctgcgcgactgcaacgaaaaactgttcacagcctggttcccagaattgacaccagatacactggtgactcgcaatgcaaaaaccttacgtgagttccatcaaaaacatggcgatgttatctttaagccactggacggtatgggaggcgcttccatcttccgtttaaaacaagatgacccgaatacaggtgtcattattgaaacgctgaccgagcatggcagccgttattgtatggcgcaaaatttcttgccggccattaaggacggggataaacgtgttctggttgttgacggcgaacctgtaccctattgccttgcacgcattcctgcacaaggggagacccgcggtaaccttgcggcaggtgggcgcggagaagcccgacctctgacagaaagtgactgggcaattgcccatgctgttgcgccagtcttgaaagagaaagggttaatctttgtcgggctcgatatcattggcgaccgtttgactgaaatcaacgtcaccagcccgacctgtgtacgtgaaatagaagctgcattcccagaaatttctattactggtatgctgatggatgccatcgaaaaacgattggaaaaacagccggcataa

SEQ ID NO: 5064 - DNA, 732 bp, Xenorhabdus bovienii
  Coding DNA location: Contig name=SeqID_16904; Position on contig =10376..11107bp; Strand=-
atgcgaattccccgcatctatcaccctgaacggctctccgtagagacggaaatctatctgagtgatgaggctgccaaccatgttggccgggtacttagaatgagtaatgggcagccattacagttgtttgatggcagcaatcaggttttcgatgcagaacttattgaggccaataaaaaaacaatcaaagtacgtattactgatggcaaactatccgatcatgaatcaccactaaacctgcatctggggcaagtgatgtcccgtggggaaaagatggaattcacaattcaaaaatcggttgagttgggtgtcaatactattactccattactttctgaacgctgtggtgtgaagctggatgcggaaaggctagaaaaaaaattacagcaatggaaaaaaattgtgatctctgcctgtgaacaatgtgggcgtaaccgtattccagaaatccgcccggtcatgtcactcgaagcatggtgtgcggaaaacgatggcagcctaaaattaaatctgcatccccgtgccagccaaagtatcaacacactgccactgccagtggaaaaagtacgcctgttaatcggccctgaagggggattatccgctgaagagatcgaaatgacggcaaatcaccaatttactgatatcctgttaggccctcgcgtcttgaggacagaaactacggcactcaccgcaattacggcattgcaagtgcgtttcggtgatctgggttaa

SEQ ID NO: 5065 - DNA, 138 bp, Xenorhabdus bovienii
  Coding DNA location: Contig name=SeqID_16904; Position on contig =11065..11202bp; Strand=-
ttgatcacgcaatcagcgctcatttatcatggcgatgagtcagctttgtactatggctattgcgtcataccggaaaaaagaaggaaagaagaaatatgcgaattccccgcatctatcaccctgaacggctctccgtag

SEQ ID NO: 5066 - DNA, 105 bp, Xenorhabdus bovienii
  Coding DNA location: Contig name=SeqID_16904; Position on contig =11180..11284bp; Strand=+
atgagcgctgattgcgtgatcaagctatctcttaaaccacagggaacacggtatgcacttgcgagccgactcgcatatttatttcataatgactgttttaactga

SEQ ID NO: 5067 - DNA, 147 bp, Xenorhabdus bovienii
  Coding DNA location: Contig name=SeqID_16904; Position on contig =11263..11409bp; Strand=-
atgaaaatattcgacatggcactcgtgaataacatccctgtcattatattccttatctatttttctgaccgaaatcagaacacgaggaatattaatttatcactcaattggttagcaataaaaaatcagttaaaacagtcattatga

SEQ ID NO: 5068 - DNA, 519 bp, Xenorhabdus bovienii
  Coding DNA location: Contig name=SeqID_16904; Position on contig =11388..11906bp; Strand=+
gtgccatgtcgaatattttcatggatgataataaaggatggtttagccaacatggataatatcatgattatgattttctgtagtgcattgatttttttatcaatgattgatattagaatttatcaattgccagatattattactcagcctttattatggattggtcttgtttttaatagcagtgaaaatttagtttcgatcaagagtgcgatatatggcgctatatcagggtatttatttttatggttattaaatagagtctgtcgatataccttaaagaaagagggaataggatatggcgatctgaaattaacagctgctattggtgcgtggctgggtatggaaacgatccctgtattgatgttgttgtcctcaacatctggattgttcgggtttatgatagtttggtttaaaagaaaaacataccctgactttattgcgtttgggccttatatttgtttgtctgcgatagtgttgatggggtttagagtaagtggtatcaatatcatggggatttaa

SEQ ID NO: 5069 - DNA, 879 bp, Xenorhabdus bovienii
  Coding DNA location: Contig name=SeqID_16904; Position on contig =11918..12796bp; Strand=+
ttgcaggttttgtgtaaaaagttcattctctcactttatttattggagaagagaatttctattatggtattaaagattacggcactactggaaaatcaggtttttgcaccctacaaaacggttttgacgggtaaacccgggctaagtttactgattcaggatcaagatactacaatcctttttgacactgggccagatggtagctttattgataacgcaaagaaattaaatatcgacttatctaaggtttcagcggttgtgatatcacatggtcattttgatcattgcggtgggctgccttttttctctactgatgctaaagttatttgccatcctgaggttaaaaatgaaagatattatggttgggtaatcacggacaacaaagcacttacattcaaaaaattatccaaacaagtggattacggaaaatttgatacttttttttcaaagggtgagacttatattaatgataacttcatctattcaggagaaataaaaaaagaagagaataaacgctatggcgttattgttggagaaaaatctgaaggaaaatattctcctgactttgttaaagatgaaggtgttttaatttataaatctaaacatgggttaattatttttattggatgtgggcattgtggtgttattgaaattatcaaattttgtaagcagataacgggcattgatcaagtttatgcggttattggtgggctacatttacgttatgcttcgccgtttaaactattgcctatcagaaagtacatcaaaaaagaaaatatacagcatgtttatgcttgccactgtagtggtatgtgggggaggttatggttacctaatgctaaaagtctttctactgggcagtcaattgagattgattaa

SEQ ID NO: 5070 - DNA, 885 bp, Xenorhabdus bovienii
  Coding DNA location: Contig name=SeqID_16904; Position on contig =12937..13821bp; Strand=-
atggctcgcaaaacaacattaaatatcgctctggcggcgaccctttctctgggaatagcatcgctggctcaagcagccaatctcaagttggatatctacaatccaggtgaaaccggtatatttcctgtttcttctgaaatcatcagtggtgaccatgaagttgttctgattgacgcgcaatttaaaaagagtgacgcccaagcgctggtcaaaatgatccagcaaaccggaaaaaaactgacaacgatctatatcagccaatctgatcctgatttttactttggccttgatgtgatcacgaccgccttccctgaagccaaagtgatcgcttcacctgaaaccatcaaagccatcaatgaaaccaaagacggtaaactggcatattggggtggtattctgcaagatcaggcaccgaaaaaggttattgtgccagagccactgaaaggaaataccttcaccgttgacggtgaaaaactgattgtggaaggtttggatggcccagccgcagatcgtactttcgtttgggtgcctaaattgaaagctgttgttggcggcgtcaccgtttctggcaatatccatgtatggattgcagatactcaaaccaaagtatcacgccagcactggatgcagacattagatcgcatcaaaagcctgaaacctgacactgttgtacctggccattatgtgggtagtgcaccgatgacgctggaatcagtcacatttacgcaaaagtatctgaccacactggaaaaagagctaccaaaagccaaagattcagaggcgttgattgcagccatgaagaaacactatccaaaccttgctgatgaatccagccttgagctgagtgccaaagtattgaaaggtgaaatgaagtggcctcagtaa

SEQ ID NO: 5071 - DNA, 132 bp, Xenorhabdus bovienii
  Coding DNA location: Contig name=SeqID_16904; Position on contig =13761..13892bp; Strand=+
atgctattcccagagaaagggtcgccgccagagcgatatttaatgttgttttgcgagccattattgaattcctgtatcaaaatgtttatttgcttgaatggcacgtataataagttgcatatttcgatttaa

SEQ ID NO: 5072 - DNA, 915 bp, Xenorhabdus bovienii
  Coding DNA location: Contig name=SeqID_16904; Position on contig =13961..14875bp; Strand=+
atggataggatcacggcagcacaggtttttgtcacgattgtggagcaggggagcttggttgcggcggcggaacggcttgatatgtcacgggcaatggtgtcgcgctatctggctgaaatggagaaatgggcaggtgttcgtctactgcatcgtacaacacgtaaaatcagtctgacttcggcaggagaaaacgcttatcagcgcagtctaaagttgttggaattagcggagacaatgccagttcagcaatcactggaatcacaaaccctgagagggctgctgagagtgagttgttctcaatcgctgggtactagcgcgttgtctgttgctattcctgaatttatgcgcaggtatccacaaattgccgtcaacttacaaattaacaacagagtcatcaatttggttgaagagcgtattgatttagcgattcgcattactaataatttggaaccgaatctgattgcccgtccattatccatttgtcattctgttgtttgtgcggcgccctcttacttagatggaaaaattattccgcagaaacccactgatttagcctcacataactgcctgacatataatttttttggcaaaagtttgtggctgtttgaaaaacagcatgagcagtattcagttcctgtcagtggtacgcttagtgccaacgaatcaactgtgctgatggaagcgacattacagggagcaggcatcgccatgcagccttattattctgccgctccgtatttaatatccgggcagttggttgagttattgccggattatcaacctcaggcaatggggatctatggtatttatgccagtcgtcagaatatgccggttactttgcgggcattgttggattttctggtggactggtttgctaatgcaccccactggcagcagttaatgttgaaaagctaa

SEQ ID NO: 5073 - DNA, 930 bp, Xenorhabdus bovienii
  Coding DNA location: Contig name=SeqID_16904; Position on contig =14858..15787bp; Strand=-
atgcactcttgttcatggcgacacattgagatttttcatgcagtaatgaccaccaaaaacctgactgacgccgcggtattgttgaaaacttcgcaacccactgtcagccgtgagctcgcgcgttttgaacagttgctgaaattcaggttatttgatcggatcaaagggcgtttatttcccacggcacagggattgcggttatttgaagaagtccagcgttcttattatgggctggagaggatactcaatgcagcagaaagcattcgtcaatttgaacatgcacagctttccattgcctgcctgccggtgttttcccaatctttactgccaaaagcctgccatagttttattcaacgctatccggaagcgaaactgaccatcgtcccgcaagaatccccactgctggaggaatggctttcagcacaacgccacgatatcggtttaaccgaacatttgcaggctcccgcaggtactgagcaagaaacgttgattaccttgaatgaagtctgcgtcctccctgccagtcatccactcagtcaaaaatcacgactgatgcccgaagattttcatgagcaaaaatttatcagcctgtcgataacagatagttacagacagctcatcgataccatatttagcgaacatcatgtcaatcgcaatatgatcatggaaactcacagcgcagcttcaatctgtgccatgatcagtgaaggtatcggtatgtctgtcgtgaatcccctgactgccttggattatctggataagaatgcggggatctgcgtccggccattcagcatagacatcccattcacggtcagtttaatcaagcccatacatcggccattctcggaacccgtcgaaatattcattacccatttaaaacaacagaccggcctgtttccgagaaaattggcattagcttttcaacattaa

SEQ ID NO: 5074 - DNA, 144 bp, Xenorhabdus bovienii
  Coding DNA location: Contig name=SeqID_16904; Position on contig =15839..15982bp; Strand=-
atgtcgtcattgaaatttctcacaagaccagcagatgcttcattattgacagcaataaggcaggaagaaaaatatccatttagctatagtctatttatttatgatatcgttttgattgtttttcaaactaatcatgttatgtag

SEQ ID NO: 5075 - DNA, 1284 bp, Xenorhabdus bovienii
  Coding DNA location: Contig name=SeqID_16904; Position on contig =15973..17256bp; Strand=+
atgacgacatcaacttttactggtttttcaggagaaaactttactccagagaatctgcttcgtttgcccgttgattacggaacaccattatgggtctatgacagtgacattattattcgaaaaatcaataaattaaaacgattcgatatcattcggtttgcacagaaagcctgttccaatacccatatcctgcgtttgatgagagcacagggagtaaaagtggatgcggtgtcattaggggaaattgaacgggcactttacgctggatatcagcccggccgtgatcgatccgaaattgtgttcacggcggatttgattgatgaagcaacacttaatcgagtgattgagttggatattccagtcaatgtcggttccattgatatgctggagcagatgggtacacgtcagtcgggtcatcctatctggctgcgcattaatccgggattcggtcatggtcatagtcagaaaaccaatacgggcggtgaaaacagcaaacacgggatctggtttcaggatttaccgctggcgattgagaaagtccgccaatatgggctgaaattggtgggactgcatatgcacattggttctggagtggattatcagcatcttgccaatgtctgtaacgctatggtggaacaagtcatattgtgcggtgaggatattcaggccatttcagcaggaggcggattatcaattccttataaaatgggtgacgaagtagtggatactgaacactattacagtctgtggcatgaagctcgccagcgcattgaacggcacttggggcatcatgttaaactggaaattgaaccaggccgttttctggtggctgaatcaggtattttgatggctgaagtgagggcggtgaaatcaatggggaaccgtcattatgtgctggtggatgcgggtttcagcgatttgatgcgcccaacgatgtatggaagttaccatcatatttctgttttgtcggtggatagcaaacatattgatgaggctaattcgcaggatgctgagttacatgaaacgttagttgcaggaccgttatgtgaatccggtgatgtgtttacccaatcagcaggtggggatgttataccgcgtttgttgcctcacgttcgtgtaggggattatttggttttccacgacacaggcgcttatggtgcatctatgtcttcaaactacaatagccgccctttgatccctgaaatcttgtttattgagggtgacgctcgtttgattcgacgtgggcaaacaatagaagaattgctggcattggaagcggtataa

SEQ ID NO: 5076 - DNA, 2481 bp, Xenorhabdus bovienii
  Coding DNA location: Contig name=SeqID_16904; Position on contig =17317..19797bp; Strand=-
atgtctcacctgagattaacaggagtttttactatgaccgctctcagcattattttgtttttagtcttgattggcgggctttgttaccgcaaagtcagcctggctgccagcagcctgctacttgttgcctatacactcgtcatgggcataacgggtctttggagttactggctactattaccacttgccattattctgttcccccttattttcacaccaacgcgtatatctctattttctgcacccggcttaaaagcattccgtaaagtcatgccaagcatgtctacaacagagaaagaagccattgatgcaggaacaacctggtgggaaggtgagctgttccgtggtaatcctgattggaaaaaactgcataactatccgaagccacagttaacggctgaagagcaggcatttattgatggccctgtggaagaagcctgccgcatggcaaatgatttccaaattagccatgaattagctgatctctctccagaactctggacatacctgaaagaaaatcgcttctttgccatgatcatcaagaaagaatatggtggcctggacttttcagcttatgcccaatcacaagtactgcaaaagctgtctggtgtctctggtattctggcgattactgtcggtgttccaaactcactggggccaggtgaattattacagcactatggtacagatgagcagaaaaaacattaccttcccggccttgcccgtggcgaagagattccctgttttgccttgactagcccggaagcaggctcagatgccggagcgattcccgatactggcgtcgtctgtatgggtgaatggcaaggcgagcaagtgctcggtatgcgtctgaactggaataagcgctatatcacccttgctcctatcgcgactgttttgggattagcattcaaattgtatgatcctgaacatttgatcgggaataccgaatcactgggtataacctgtgccttaatccccactagtaccccgggggttgaaatcggcaaccgccatttcccactgaatgttccattccagaatgggccaacccgcggtaaggatattttcgttcctatcgattacatcattggtggaccgaaaatggcaggccaaggctggcgtatgctggttgaatgtctatcggtcggccgtggtattaccctgccatccaacgcaacaggtggattgaaaagtgcagctatggcaatcggtgcttactcctatattcgtcgccaattcaaactcccgattggcaaaatggaaggtatcgaagagccactggcccgtattgcaggtaatacttacctgatggatgccgcggcaacgatgattacaggcggcattatgctaggtgaaaaacctgcggttctgtctgctattgtgaaataccactgtacccacagagggcagcgctcgattattgatgcaatggatatcgctggcggtaaaggcatctgtcttggcccatccaacttccttgcccgtgtctatcagggcgcacccattgctattaccgtagaaggcgcaaatatcctgactcgtagcatgatcatctttggtcagggtgcgatccgctgccatccttatgtactggctgaaatagccgcagcagaaaataacaatgtcaaagcctttgataaagccctgtttggccacttgggccatgttgccagcaataccctgcgcagcctgtggcttggcatcactaatggcagaaccagccgtacgccagtcagcgatgcaactcgccgttactaccagcacatcaaccgtctaagtgctaaccttgccctgctctctgatgtttcaatgggcgtattgggtggcagtctgaaacgccgtgaacgcatttcagctcgtcttggggatattctgagtcaaatcttcctggctacagcagccctgaaacgctatgaagacgaaggccgtcagaaagaagatctgccattgttacaatgggcggtagaagatagcctgtatcaggcagagcaggccctgaacgatttactgcgcaatttccctaaccgtttggttgctggtttaatgcgagtgatggtgttcccattgggccgttcacatactgcaccgtctgataaactggatcataaactggcacagatattacaaaccccttccgcaacacgtagccggattggtcgtgggcagtatctgacaccaagcgagcataatcctcacgggttattggaagaagctctgcacgatatcattgccgcagaacccattcatgcacgcttgagccgcgaagcaggaaaaaacctaagcttcacacgtctggatcagttagctgaacgtgcattggcggatcacaagattacccaagaagaagcagatatcctgaaacgtgcagaaaatagccggctgcgttcaatcaatgttgatgagtttgagccggatgcatttgctgtacctcattcagcaaaaaagcctgaaagtcagcatcagactaaagccgcttga

SEQ ID NO: 5077 - DNA, 153 bp, Xenorhabdus bovienii
  Coding DNA location: Contig name=SeqID_16904; Position on contig =19834..19986bp; Strand=+
atgaggaaaacgtatttatcaatatatttacatcttaattacaatgtagctcacaaagtcattgcagtttgcggtgtgataatttcacggagatgtgatggcatcttctttcgagagagggaatccgttacactgatcggcagattttattaa

SEQ ID NO: 5078 - DNA, 591 bp, Xenorhabdus bovienii
  Coding DNA location: Contig name=SeqID_16904; Position on contig =20008..20598bp; Strand=+
atgagtcccatgtatcaagatctgatccgcagtgagttgtctgaagccgcagatacgctggctaaattccttaatgatgatgcaaatattgacgctatccaacaagcagccgttttgctggctgattcattcaaagcagggggaaaagtactttcctgtgggaatggcggttcacattgtgatgccatgcattttgcggaagaactgactggtcgttaccgcgaaaatcgtccgggctatccgggtatcgcgatttccgatccgagtcatttatcctgtgtgagcaatgattttggttacgactatgtattttctcgttatcttgaagcggtagggcagaaaggcgatgtactgctgggtatttcgacttcgggtaactccagcaacattatcaaggcgattgaagcagcccgtgcgaaaggcatgaaagtcattacgctgacaggcaaggatggcggaaagatggcaggaacggcggatgttgaaattcgtgtaccgcatttcggttatgcagatcgcattcaggagatccacatcaaagtgattcatatcttgattcaactgattgagaaagaaatggtaacagcctga

SEQ ID NO: 5079 - DNA, 768 bp, Xenorhabdus bovienii
  Coding DNA location: Contig name=SeqID_16904; Position on contig =20622..21389bp; Strand=+
atgtgcgaattacttggcatgagtgccaatgtgccaacagatatcgttttcagtctgagtgggctcattcagcgtggagggtatactggcccccacaaggatggttgggggatcaccttctatgaagggttgggataccggacattcaaggatcaccaatccagttatcattcacctgttgctcgctttgttcagagctatccgattaagtcagaagttattgtcgctcatatccgtcaggcgaaccgaggcaatgtctctctggtcaatacccatccgtttacccgtgaactatggggaaaatattggacttatgctcacaatgggcaattgcagggataccgtaacctgaaaacaggcaattaccggccggtcggtgagacagacagtgaatgggcattttgctggatactgcaacagttatcgatcaagtatcctaagcggccttccaattggcctgcggtatttcgcttcattgcctcgctggcaggtgagctgaggaaaaaaggggttttcaatatgctgctgtcagatgggcagtttgtcatggcctattgctcgacccaattgcattggatcacccgtagggcaccttttggcatggcgaaattgcttgatcaggatgttgaaattgattttcagcaacatactcatcctgatgatgtggtgtcaatgattgctacccagcctttaactggtaatgaagattggcaacgtattgaaccggggtgctatgagttatttcaccttggtgaacgcatagtttga

SEQ ID NO: 5080 - DNA, 741 bp, Xenorhabdus bovienii
  Coding DNA location: Contig name=SeqID_16904; Position on contig =21365..22105bp; Strand=-
atgaaaaaaacggcgttttatctttcactatttctgttattccatatgccctgttctgctctggcgcaaagcactccatcgtggctccagtcacccaatgaacgactccggctgaaacaacttggtgccgagattttcattcaaatattcaaggaagaaaaagtgcttgaactttatacgaaagacaacacaggccattaccaattggctcaaagttaccctatctgtaattactctggagggcttggccctaagacactgacaggtgatttcaaaagtcccgaaggtttttaccatgttagccttaaacagttaaagcccaatagccgctattatcgagcgattaatctgggctttcccaatgaatttgataaattccgaggctattctggtaataacttaatgattcatggagggtgtaaatccattggctgctatgccatgaccgatcgctatatggatgaaatctaccgatatgcagaaagtgcaatatcttacggacaggatgaaatcaaaataaatatttatcctttcaggatgacgcaacagaatatacagcgttatcgtaataacgataattattcgttttgggttcaattacagcccgcctatgaatactttgccaaaaatggcaaacttaccactatcagcataataaacgggcaatatattgttagtgtgaaacccgaaagttcgtcattcttcagtaaatcaactcaaactatgcgttcaccaaggtga

SEQ ID NO: 5081 - DNA, 111 bp, Xenorhabdus bovienii
  Coding DNA location: Contig name=SeqID_16904; Position on contig =22157..22267bp; Strand=+
ttgccatgtattgacaatgagctgaatacaaatatagcagcgatgtttggcatctgtgaaatggtggagcggccaataaatgctctgttatcgggaaagatgaagctttag

SEQ ID NO: 5082 - DNA, 120 bp, Xenorhabdus bovienii
  Coding DNA location: Contig name=SeqID_16904; Position on contig =22388..22507bp; Strand=-
atgctacagattaccctgaggtattccttgggtaatatagcgacttcagtaataaaaaacgccttgagctgcatatatctcaagttattcactccgataatcgttacaattttctcttaa

SEQ ID NO: 5083 - DNA, 1344 bp, Xenorhabdus bovienii
  Coding DNA location: Contig name=SeqID_16904; Position on contig =22539..23882bp; Strand=+
atgattaaaattaaaaaaggactcaacctcccaatagcaggagcgcctgcccaagttatagaagatggtccgacaattcgccatgttgccttattaggcgaagaatatgttggaatgcgtccttctatgctggttaaggaaggtgagcatgtcaaaaaagggcaaattctttttgaagataaaaagaatccaggggttatttttacgagtcccgctagcgggaaaattattaccatcgggcgtggtgaacgccgtgtacttcaatctgttgtgattgaggtgagtggtgatgaacaagtcatgtttgatcgctatgatcgcgcagaacttgctggcctgactcgtgaacaggtggaaacgaacctgctcgtatccgggctgtggacagcattgcgtacacgtcctttcagtcattctcctgttcccggttccacaccaaaggcaatcttcgttactgcaatggatactcagccattggctgccgatccattagtcgttattgcgacgcaggaagaggcttttgttgatggcctgaatattctgtcaacattgacagagggaaaagtccacgtctgtcatggcgctggaaatattccaaatgcaggaaacaacactcaaattacttacaatcaatttgcgggcccacatccggcaggtctggttggaactcacattcatttcattgaaccggtcagcgtgaagaaaagcgtgtggcacttggggtatcaggatgttattgccattggtaagttattcacaaccggtgagctttatactgatcgcgtcgtatctctggcgggcccgcaagttaaatcaccacgcttagtacgtagccgtctgggggctgatttgcaggaattgacgcaagatcagctgaaagaaggtgaaaaccgtattgtttctggttctgtactgtgtggtacaaaatcagatgaagttcgtcattatcttggtcgtttccataccttggtctctgttcttgctgaaggccgtgagaaagaactgtttggctggattgcaccaggagttaataagttctcgattacccgtaccacgattggtcatttcctgaaaaataaacgttttgccttctcaaccagcacgaatggcggggaacgctctatggtgccaatcggcaactatgagcgggtgatgccactggacatcatggcaacgcatttgttgcgcgacttgcttgcaggcgatagcgacagtgcccaggcattgggttgcctggaactggatgaagaagatttggcattgtgtacttatgtttgccctggcaaatatgagtacggtccggtactgcgtgacgtgctgactaagattgagcaggaagggtaa

SEQ ID NO: 5084 - DNA, 1239 bp, Xenorhabdus bovienii
  Coding DNA location: Contig name=SeqID_16904; Position on contig =23886..25124bp; Strand=+
atgggcctgaaaaatttatttgaaaaagtagagcatcactttgaggccggcggcaaactggaaaaatattatcctctgtatgaggcagtttccaccgtcttttatactccgggaacagtaacgcgaggacgtgcccacgtccgtgatgccatcgatctcaaacgcatgatgattttggtatggctatctgtttttccggcaatgttctggggaatgtataacgtcggtaatcaggcgatacccgccctgactcatttatacagcggagaagcattacagcagattctggcttctgactggcattacgtggttgctcagtatcttggtgcatcactgacgccggatgctggctggggcagtaaaatgttgctgggtgcaacctatttcctgccaatttatgccgttgtgttcgcggttggtggcttctgggaagttctgtttgccatgatccgcaggcatgaaatcaacgaaggtttctttgtcagttccattctgtttgcgctgattgttcctccgacattgccattatggcaggctgctctggggattactttcggtgtagtgattgcgaaagaaatctttggtggtacgggtcgtaacttccttaacccggcgttggctggccgtgccttcctgttcttcgcttaccctgctcagatttcaggaaatatggtttggactgcggctgatggcttttccggtgcgacaccattgtcccagtgggcaaatgagggtagccacggcttaatgaataccattaccggccagccggtcacatggatggatgctttcattggtaacatcccaggatcaattggtgaagtctccactctgatgattttcatcggtggtgccatcattctgtttgcccgcattgcctcatggcgcattgttgccggcgtgatggtcgggatgatagcgatgtctagcctgttcaacgcaattggttccagcactaacccaatgttcgctatggagtggtactggcacatggtgctgggtggctttgctttcggcatgatctttatggcgactgatcctgtatctgctgcattcacggataaagggaagtgggcatacggcattctgattggtgtcatgtgtattcttatcagagtcgtaaacccagcatatccggaagggatgatgttggcgatcctgttcgctaacctgttcgcgccactgttcgattatctggtcgtgcaggccaatatcaagcggagaaaagcccgtggctaa

SEQ ID NO: 5085 - DNA, 795 bp, Xenorhabdus bovienii
  Coding DNA location: Contig name=SeqID_16904; Position on contig =25117..25911bp; Strand=+
gtggctaatgagaaaccaaaaaataatgacagcgttggtagaacgttcctcgttgtttttgtgctgtgccttatatgttcgattgtggttgcagggtcagccgtaggcttgaaagcgcagcaacaggaacagaagctactggataagcagcgcaatattctggatgtggcgggtttactgaaacccaatatgactacagcggagatgaaagaaacctatagcagccgcattcaacctgaattgcttgatttgaagacggcaacgcttgaaaaaggcgatggtaaatttgacctgaaaaatgccctgcgtagtgatgaaaccagtatgactctgtcatcggaacaggatctggcgagaatccaccgccgcgctgatatggcagaaatctatctggtgaaagatgatcaaggcaaaaccaccgagctggtgctgccagtatatggttctggcctgtggtcaatgatgtatgcatttatttctattgatgtggatggcgtaacctctcgcggcattacttactactctcatggtgaaacaccgggcttaggtggcgaagtggataacccgcaatggcgcaggcaatgggtgggtaaaaaactctacaactcgcaaggtgttccggcgattaaaattgttcgcggtggtgctggcgataacccttacggtgtagatggcttgtctggagcgactctgacctccaacggtgttcagcatatgtttgatttctggctgggtgataacggttttggcccattcctgaaaaaagtacgtgagggagccttgaaagatggctga

SEQ ID NO: 5086 - DNA, 630 bp, Xenorhabdus bovienii
  Coding DNA location: Contig name=SeqID_16904; Position on contig =25904..26533bp; Strand=+
atggctgatagtaaagaggtaaaacgcgtccttcttgggccgctgtttgataataatccaattgcattgcaggttctgggagtgtgttcggcactggctgtcaccaccaagctggaaactgcgctggtgatgacgattgctgtgacattggtgacagcattttctagctttttcatttcattgattcgtaattacattcccggcagtgtgcgaatcattgtacagatggcgatcattgcatcgctggttatcgtggtagaccagattttgcaggcctatgcctacgaaatctccaaacagttatctgtgtttgtgggtctgatcatcaccaattgtattgtgatgggacgcgctgaagcctatgccatgaaatatccacccgttgaaagttttatggatggtatcggcaacggcttgggatacggtgtcattctgttgttggtgggttttttacgtgaactgtttggttcaggaaaactgctcggcatgacggtgctggaatctgtcaagaatgatggctggtatcagccgaacggtctgtttctgctggcaccgagcgcattcttcatcattggtatgctgatttggggtctgcggactctgaaacctgcgcaggttgagaaggagtaa

SEQ ID NO: 5087 - DNA, 597 bp, Xenorhabdus bovienii
  Coding DNA location: Contig name=SeqID_16904; Position on contig =26542..27138bp; Strand=+
atggaacattatattagtttgtttgtccgcgccgtctttattgagaatatggcgttagctttctttctcggtatgtgtacgtttctggcggtgtcaaaaaatgtgaagacagcttttggcctgggcgttgctgtaactgttgtgttggggatttctgttcctgccaacaaccttgtctacaatctggtactccgcgatggcgccttgatggatggggttgacctgagcttcctgaacttcatcacctttatcggggtgattgctgcactggtacagattctggaaatgatcctcgatcgttatgtgcctgcactgtataacgcgctggggattttcctgccgttgattaccgtgaactgtgcgattttcggtggtgtttctttcatggcacagcgtgactataacttcagcgaatccgttgtatatggtttcggttcaggtatgggctggatgctggcaattgttctgatggccgcgatccgtgaaaagatgaaatatgcggatgttccagcaggtctgaaaggattggggatcacctttgtcaccaccggattgatggcattgggctttatgtccttctccggcgtgcagctctaa

SEQ ID NO: 5088 - DNA, 1227 bp, Xenorhabdus bovienii
  Coding DNA location: Contig name=SeqID_16904; Position on contig =27154..28380bp; Strand=+
atggatataatcattctaggcgtagtaatgtttaccctgattgtgttggcgctgacggctatgattttgttcgcaaaatcaaagttggtgaacaccggggatattaaaattgaagtcaatggcgatgaggagaaaagctttacggctcctgctggcgacaaattgttgaacatgctttccagtcagggggttttcgtttcctctgcttgtggcggcggtggctcctgtggtcagtgtcgtgtgaaaattaaggaaggcggtggtgacatcctgccaactgagctttctcacatcaataaacgtgaagcaaaagagggttgtcgtctggcatgtcaggttaacgttaagcaagacctgaaaattgaattgccagaagaaatcttcggcgtcaaaaaatgggaatgtgaagttatctctaacgataacaaggcaacattcattaaagaattgaagctgaaaattcctgacggagaagtagtgccattccgtgcaggtggtttcattcagattgaatgtcctccgcacgtagcccgctatgcggattatgatgtcccagaggaatatcgtgaagattgggataaatttaatctgttccgttatgtttctgaggtaaaagaaccgactgtccgtgcgtattcaatggcgaactacccagaagagcacggcatcatcatgctgaacgtgcgtatcgccacgccgccgccaagaaatccagacgtgacaccgggtattatgtcctcttacatctggtcattgaaagccggtgataaagtgacaatttccggtccatttggtgaattctttgcaaaagataccgaagcggagatggtcttcatcggtgggggcgcaggtatggcaccaatgcgttctcatatctttgatcagctcaatcgtctgaattccaaacgtaagatcagcttctggtatggtgcgcgttccaaacgtgaaatgttctataccgaagatttcgaccagcttgcggcagagaacgaaaactttaactggcatgtggccctgtctgacgccttaccggaagataactgggatggttacaccggctttattcataatgtcctgtttgagaactatctgaaagatcatcctgccccagaagattgtgagttctacatgtgtgggcctccggtcatgaacgctgcggtcattaagatgttgaaagaccttggcgtggaagacgaaaacatcatgctggatgatttcggtggttga

SEQ ID NO: 5089 - DNA, 1032 bp, Xenorhabdus bovienii
  Coding DNA location: Contig name=SeqID_16904; Position on contig =28453..29484bp; Strand=+
atgctgagtaaaaaaattatccattggggtgtgctgatgtttgcggttttgctgctgtcagcctgtggtggccccgaacagcaaaatctgagcgggcaaacgatggggacttattactccgtcaaatatgttgctgactcatcgataccttcccctgaaaacctgcaaaaagagattgatcggctgctggaagaagtaaatgaccagatgtccacttatcggccaaattctgaattaagtcgttttaatcaaagccgtgaagtcaacacaccttttctggtatccgccgctacggccaaagtggtcaaggaagccattcggatcaatcaactgacggatggtgctttggatgtgacagtggggccattggtgaatctgtgggggtttgggccggaagggcgaattaccaaggcgccgacggatgaagaactggtcatgcgtcgtgcgtggacgggtatcgataaattgtctgttgaaggcaatagcctgattaaatctatccctgaactttatgtcgatctttcctccatcgccaaaggctatggggttgatgttgtggctgaatatctagcctcccagaacatcaaaaattatatggttgatattggcggagaagtacgcacactgggtaataatggcaaaggcgctccgtggcggattgccatcgaaaaaccatcggatagtggcattgaacagaaggctcaagaaattattgaaccgggtagtatgtctattgcaacatcgggtgattaccgcaattatttcgaacagaatggagtgcgttattctcacaccattaatcccaaaacgagcaggcctatcacccataatctggtttcaattaccgttattgccccgacatccatgagtgcagatggcttttctacggggttggatgtcttggggccagataagggaatggaagtggctgagacgctgaatatccctgtctttatgattgtcaaaacccaagatggctttgaagagcgctatagttcagcctttaagccatacatacaacagaagaaatga

SEQ ID NO: 5090 - DNA, 420 bp, Xenorhabdus bovienii
  Coding DNA location: Contig name=SeqID_16904; Position on contig =29426..29845bp; Strand=+
atggctttgaagagcgctatagttcagcctttaagccatacatacaacagaagaaatgaggaggaaaggttatggaagtctttattgcagcctttatctttttcttgttggcttttgcaggaatggcactgggctacatttttaagcgtaaaagtattcagggaagttgtggtggtttggggagtattggtgtggagaaagtttgtgattgcccagaaccctgcgatacccgtaaaaaacgcctggcaagggaagctgctcgtcatgagaagctggaaaaaaaccgaattctttgagggtgtttttgcggtcaaacaattttcagctaaaaaatgcaacccgctgtcagatacacagcgggtttttgttggctgttcagatgatgttgagagagtgacatttgctgtgagcctgctgtaa

SEQ ID NO: 5091 - DNA, 516 bp, Xenorhabdus bovienii
  Coding DNA location: Contig name=SeqID_16904; Position on contig =29801..30316bp; Strand=-
atggcggtaccaaaaagcacatgcggacacaatgacatagcccagaaattctatttcgaataccaccattggttatgcaactggatcaggcagaatagtgtctgccccagccatgcagaagatctcacccatgatactttcatcaaattgatgcagtcggcagatcttgaaaatatccgccatcccagagcttttttaattacgatagctcgtagaactctcgccaattactatcggcggaaaaagctcgaagacaattatcgagaatatgtcaatacgatgccgaaaacgacaacaaactcgtcagagtttcggcttgtactgctagaacagttggaaagaatagataagacgcttgatgagctgccaaaaaaagccagacgggcatttcttctcacgcaacttcaaggtatgcgctataaagaagtggcaaagaatttggatgtttccatgagctccgtgaaaaattacttacagcaggctcacagcaaatgtcactctctcaacatcatctga

SEQ ID NO: 5092 - DNA, 93 bp, Xenorhabdus bovienii
  Coding DNA location: Contig name=SeqID_16904; Position on contig =30277..30369bp; Strand=-
atgaaaataataatcattatcgtatttatcctaccccttcaggcagtatcatcatggcggtaccaaaaagcacatgcggacacaatgacatag

SEQ ID NO: 5093 - DNA, 2352 bp, Xenorhabdus bovienii
  Coding DNA location: Contig name=SeqID_16904; Position on contig =30507..32858bp; Strand=-
atgcaatatttcattcagttatgtttcaggaaatttatggcaaataatagtcaaaatttaggaaaacgcccaattatggccatcattcgaaaaattttaagaagtacattctcaggtacattagtgttgggtagtgcattttccagccaagttttagccgctgaaaatccatctgaccagaaatctgaaaagcaaaatgaggtggttaaattaccatcgctttcagttgtaggtagtttacacaacagcatcagtgccggtagttccgtgctaaagaaaactgatattgaacgcactcaggcagataatgttgctcagttgctggatcaactacctggggtttctatgtctggttctccacgtcccggtggacaaactttgaatatttggggcatgggtgagtcagaagatatcaaaatcacgctggacgacgccccaaaaggatttgagaaatatctccagggttccatctttattgagcctgaattaatcaagcgtatagatgttgataaaggcccgcacaatttgttgaatggcaatggtggatttggtggctccgttaagattgtcaccaaagatgccggcgatttattacgtcccgatgaaaattttggaggtttgatcaaacagagctatcacaccaatgatagacaatggattaatagtggcaccatattcggcagagatcccaatggttttgtcgatgggcttttatatgtcagtaaacgcgatggtcacaatattaagcgtcctgatggaacacattttgaatactcacaaaataaccagacctcctatttatggaaaacgaatgtttatcccaatgatactcatacattgagtttttcagccatgcgttctgagtcagatggctggcaaccgtgggctgccaagcgggatggcataagtgctccatccgccagtgatatagaaagatatggttggaatgaggcatggaaaagaaaactagtttttcgtgatcagatcgaccagaactactccgccaaatggaatattgcgccagaagataatccatggctcaatctgacactcacgtctgcctattccataaccaagcaaaacgatcgtcgccttgataacaaagatataaaacctacttcagcggggcttatgggacaaaaaagttgggttaaatatatcgatacgatggtcgatatcaacaacaaaagcgtgttttcaacaggcagtatagaacacaaattattagtaggaactcgctggcataagaacgatcgtgatgtcttaatgttcgataaaaatacagttaatgaccaagaatttaattacggttattaccaacctaactatatgccagccggagaacaacaaatttacagcatatatatgcaggactctttgaaactgggaagtgtaaccgtaactccgagcgtccgttacgatcatataaagaatattggtgaagaaaataaagcacccaggtataacaacacatcacctaaaataaaccatgattatagtggtgtaacttatgctggctggtctcctcatttgggtattatgtggcggacaaacaaaaatctttcgctctttgctgatatcagccgtacttggcgggcaccagtagtcgatgagcaatatgaagttcagtcatataaaaccagccttccgggttccagccgcaatcttgaagtagaaaaaatgactggcatacgcctgggtgccattctcgatttcgataacctgatgcttgagaatgacagcctgcaaattcgcactaccctgttccgtaaccgtggcaaagatgaaattttcaaaactcgtggtgtttactgtaaagctcaggctgacggtgcatcacccacctcatgtgaaaaaccgatagcaaatcatcgtaatctgccgggatataccattgagggactggaaatagaaacgttctacgatagcaataagttattcggaaaactttctttctccaccatgcgcggtcagcgtgatgcttctatgcgtgatccgtggatagggcacaaaacctgggttgctgaaatcccacccacttctgcacatgcaatgttaggatttaagatcccacaatggcagatgtccatgggctggaaaggtgattttatccgcaaacaggatcgttcccctgtagatggggatccaaaagcgggttcttggtctctgccagccagcaagggatatgccctgcacgggttgtttgccagctggcgcccaccttatatgaaaggctttgaagcgagggttactatcgataatctgttcaatcgtgattactacccttatttaggggaagcgacttcaggcatcggccgtaatttcaaattcagcatttcacagcagttttaa

SEQ ID NO: 5094 - DNA, 123 bp, Xenorhabdus bovienii
  Coding DNA location: Contig name=SeqID_16904; Position on contig =32853..32975bp; Strand=+
ttgcattgttataagtcacctaagaaatcaaatcgggtaaataaaaatgagaattatttttataagcatgttttgagaagtgttatggagatgaaatgcactgtgatagatcatgttgtctga

SEQ ID NO: 5095 - DNA, 279 bp, Xenorhabdus bovienii
  Coding DNA location: Contig name=SeqID_16904; Position on contig =32948..33226bp; Strand=+
atgcactgtgatagatcatgttgtctgacatttttacgggtttactgctggatgattgaaatgattatccgtgtcgttatgctttctcaattgctgactgcgttggcagtgagatcaaagtgcttatgggatgttgtggcaccaaacggtcagaacactcattggcgaggtcatttctgtaagtgcaatttccttaagtacaaggggttagtcaatgaagaaaaagattctcagttctctgatttttgcaggtatcgtagcattgcttgctggttgtga

SEQ ID NO: 5096 - DNA, 522 bp, Xenorhabdus bovienii
  Coding DNA location: Contig name=SeqID_16904; Position on contig =33162..33683bp; Strand=+
atgaagaaaaagattctcagttctctgatttttgcaggtatcgtagcattgcttgctggttgtgatgatggttcccaaaaagtggaagactctacccaacaagctgaagaaagtactacccagatgaaaaatgacgctgaacagaaaaccactggaatagtggatagtgctaaggaaaaatcacaggaagtgaaagaaggtgccatgcgtgaaggtcatagtctggtagataagtctaaggaagtacaaaatcagataagtcattctgccaatcacctggccgatcaggtgaaatctaaagcggcagatgtgcaaaatgaagtcacgaagtctgtgaatgatacgctggataaggtgaaaaccaaaacggatgatatacagcatcaagccaccgataaggctaaccagcttaaagatgatgtgaaatcaaaggcggaagaaataaaatctgatgtcaataagcaggctgatgattttatcaatagcttcaaaaatgacggcgataaaacagaggaaagttaa

SEQ ID NO: 5097 - DNA, 165 bp, Xenorhabdus bovienii
  Coding DNA location: Contig name=SeqID_16904; Position on contig =33613..33777bp; Strand=+
atgtcaataagcaggctgatgattttatcaatagcttcaaaaatgacggcgataaaacagaggaaagttaattctacgattcaatatcctgtcagtaaaaataaattaatactgaagggcgacctgaaaaaggttgcccttatttttcctctgttatcaacttga

SEQ ID NO: 5098 - DNA, 438 bp, Xenorhabdus bovienii
  Coding DNA location: Contig name=SeqID_16904; Position on contig =33840..34277bp; Strand=+
atggaaatcaaatacagcgtaggaagagaaaatcccgaattaattcagcaggcttttgccattcgcaaacaagtatttactgatgagcaaggatttgacgcagaaattgatatcgatgaatatgatgatattgctctgcatgtactgatatttgatggtgaaaaacccattggagtattacgcgcagttccaatggacaataatatgctcaaagtcgggcgtgtcgcggtattgaaggagtatcgaggtaaaggcattggtcgtaaggtcatggagtttattgaagattatggacgtaaaaatggcgttgtagctatcggtttatcctcgcaatgccatgcccagccattttatgaaagtttaggctatcaagcgcgtggggaaatctatttggaagaaggtgcagaacatatttttatgacattggatttagcataa

SEQ ID NO: 5099 - DNA, 264 bp, Xenorhabdus bovienii
  Coding DNA location: Contig name=SeqID_16904; Position on contig =34278..34541bp; Strand=-
gtgtcgtactccactaccacgcagtcaggcaaaatattatgttgccaatggcgcaccagctcgcaaatcggcacagaatacgccatcagtgaattaattttcgccaatataaaatcaacgaccagtacgggaaaattggatatatgcaatactgtttgcacaaccatatttctcgtattggtatttaaaacaagccagatattgatggatacctattttcaataccaagacatttttcttaaaaaggaagcaacgaaaaaatga

SEQ ID NO: 5100 - DNA, 1716 bp, Xenorhabdus bovienii
  Coding DNA location: Contig name=SeqID_16904; Position on contig =34445..36160bp; Strand=-
atgactgaaacagaggagataacaatggtatttgattacattattatcggagctggttcagcaggtaatgtgcttgcaacccgtttaacggaagatcgcgatgtcactgtcctgctgctcgaagctggcgggcctgattaccgattcgacttccgtacccaaatgccagctgcgctggcatatcccttgcagggaacccgttataactgggcgtatgaaaccgactctgaaccacatatgaacaaccgacgtatggaatgcggccgtggcaaagggcttggtggttcttcactgatcaacggcatgtgctatatccgcggcaatgcgctggattttgacaactgggcaacactatcaggtttggaagactgggcttatctcgactgcctaccctacttccgcaaagcggagacacgagacattggggcaaatgactatcacggcggtgatgggccagtcagcgtcactacgcccaaaccggacaacaatgaactttttcatgtgatggtagaagccggtatccaagccggatatccacgcactgacgatctgaatggctaccagcaagaaggttttggcccaatggatcgtaccgtcactcctgaaggccgacgtgccagcactgcccgtggttatctggatcaagcacgggcgcgctcaaacctcactatcattactcacgccttgacagatactctcgaatttgagggaaaaatggccgtcggcgttaatttttatcaaggtaatgattcaactttaacgcaggcaagagcacgtaaagaagtattactttgtgctggcgcgatcgcttccccacagattttgcaacgctctggcattggccctgaagaagtactaaacgagtttggcattccggcggtacagatattaccgggagttgggcaaaatctacaggatcatcttgagatgtatttgcagtatgaatgcctcaaacctgtttctctctatccagccctgaaatggtacaaccagccaaagattggcgctgaatggttattcaaaggcacaggtattggagcgagcaatcaatttgaagcaggtggatttatccgtaccagtgaaaaatttgcatggccgaatattcagtttcattttttgcctgttgccatcaattacaacggcagcaatgcagtcaatgaacatggctttcaagctcatgtcggctcgatgcgttctccaagccgtggtcgagtcaagatcacttcgcgtgatccacgccaacaccccagcattttgttcaactatatgtcaaccgcgcaggactggcaggaattccgtgatgccatccgcattacacgtgaaataatgacacagcctgcactggctccttactgtggtcgagaaatcagccctggtactgacatccagacagatgaacaattaaatacctttattcgtgaacgtgccgaaaccgcctttcatccatcctgtagctgtaagatgggtactgatgaagtggccgttgtggatggtcagggacgtgtgcatggtgttaaaaacttgcgtgtgattgatgcttcgatcatgccggaaattattaccggtaatttgaatgccacaacgattatgatcgcagaaaaaatcgccgataaaattcggtgtcgtactccactaccacgcagtcaggcaaaatattatgttgccaatggcgcaccagctcgcaaatcggcacagaatacgccatcagtgaattaa

SEQ ID NO: 5101 - DNA, 1479 bp, Xenorhabdus bovienii
  Coding DNA location: Contig name=SeqID_16904; Position on contig =36164..37642bp; Strand=-
atgactcgttttggcttacaaaagctttatatccacggcacttacgttaatagcgttaatcccgataaaaatacttttgatgcgatcaatccagctaatggtgaggtcatcgctcaattacaatctgcaacagagcaggatgttgagctggccgtcaaaagtgctcagaaagggcagaaaatctgggcaacgatgactgccatagaacgttcacggatcttactcaaagcggttaatatcctgcgcgaacgcaatgatgaactggctgagttagaaacactggataccggcaagccactgtctgaaactcaatatgttgatattgtcactggtgcggatgtgctggaatattacgctggcttgatccattctctcgaaggtcagcaaattccattgcgcgaatcttccttcgtctatacgcgccgtgagccactcggtgtcgttgccggtatcggggcctggaactatccaattcaaattgccctctggaaatcagcgccagcattggcggccggtaatgctatgattttcaaacccagtgaagtcacgtcactcaccgccctgaaattagccgaaatttatactgaagcaggtgtgccagatggggtgtttaacgttctgactggcgcgggtcatgaagtgggtcacactctgacagtacatccgaaaatcgccaaaatgtcgtttacgggtggcattgtcacaggcaaaaaagtcatggcgaatgcatcaggatcaaacttgaaagaagtcacgatggagctgggtggaaaatccccgctgatcatctttgatgatgccgatctggatcgtgctgccgatatcgccatgatggcaaactttttcagctccggtcaggtctgcaccaatgggacacgagtttttgtcccgaaaggactggctccccaatttgaagccaaaattgttgagcgtgttaaacgcattcgcattggctctcccctcgatccaaataccaactttggccctctggtgagctttccacatatggaatctgtattgcgttacatcgaaagtggtaagtctacccatgcacgactactgtgtggcggtgagcgtctgctggaaggtgaattggcgaaaggcgcattcgttgcaccaacggtatttagcgactgcacagatgatatgctgattgcgcaggaagaaattttcggccctgtcatgtgtatcctgacctatgaaacggaagatgaagtaatcaaccgcgccaataacaccgattatggcctcgcagcaggattagtgacacaagatctatcccgtgcacatcgcgtgatccatcaactggaagcagggatctgctggatcaacacatggggagaatctcaagccgccatgcccgtcggtggctacaaacattctgggattggccgtgaaaatgggctcgtcacactgcaaaattacacacaaaccaaatcaatacaggtggaactgggtaattttgaatccctattttaa

SEQ ID NO: 5102 - DNA, 597 bp, Xenorhabdus bovienii
  Coding DNA location: Contig name=SeqID_16904; Position on contig =37663..38259bp; Strand=-
atgccaaaaattggaatgcagtcgataagaaaacagcaactcattgatgcaacattagccgtagtcaatgaggttggaatgcaggatgctagtattgcgcaaatagcccgaaaagcaggcgtttccaacggtattatcagccattatttcaaggataagaatgggttattggaatccaccatgcgttacttattgcaccaactcggagtagctgtagcacggcggttacgactgctcgataatgcaaccccagcccagaggctgaaagccattgttgaagggaattttgatgccagtcaaatcagcaacgcagcaatgaaaacctggttagctttctgggcaagcagcatacaccaacccaatctataccgactacaacaggtgaacgaacgtcgtttgtattccaatatttgtgtcgaattcaggcgtgttttaccaaaaacagaagctcggctggcagcacaagggctggctgccctgattgacggcatctggctgagaagtgcattaagcagcaagccttttgacataaaaagcgcgtttactatcaccatcgattacatcgaacagaaactcggaacaccttacacagcctga

SEQ ID NO: 5103 - DNA, 171 bp, Xenorhabdus bovienii
  Coding DNA location: Contig name=SeqID_16904; Position on contig =38221..38391bp; Strand=+
ttgctgttttcttatcgactgcattccaatttttggcatgtttttatgctcagaaaatcaatcattcggcagttattaaacttttttttaattgaatgttcaatcaaaattaaatatgttttattacaatattttcacaatggcaggttaaatttattcgatatagcataa

SEQ ID NO: 5104 - DNA, 2043 bp, Xenorhabdus bovienii
  Coding DNA location: Contig name=SeqID_16904; Position on contig =38469..40511bp; Strand=+
atgaacataccagacagtccaaaaaacactcagaaggatactctgaactctgtcgtttttttcacctcagcagggctgattatcgtttttactttattcacgatttttttcactgatgcgacaagtatctggataaaaaatacgctgaattgggtgtccaaaacattcggttggtattatttgctggccgcaacgctttacattgtatttgttatttttgttgccgcctctcgttttggttctatcaaattggggccggaacaatctaagccggaattcagtttactcagttgggctgcaatgctgtttgccgcagggataggtattgatttgatgtttttctcggtggctgagccagtcacacaatacatgcggccgccaacgggtgaaggagaaactattgaagcagcccgtcaggcgatggtgtggacactgttccactatggcctgacgggctggtcaatgtacgccttgatggggatcgcgctgggatatttcagctatcgttataacctgccattgaccattcgttctgcactttatcctatctttggcaatcgaataaaaggtcccattggtcatgccgtagatattgcggcagtgataggtacgattttcggtattgcaaccacgctgggcattggggtggtgcaattgaattatggtctgaaagtgctatttggattgcctcaaggtttgggggttcagggcgggctgatactgttgtcggttgtgatggccattgtttctgtcacctctggcgtgaacaaaggtattaggttcctgtccgagctgaatgtgctgttggcactgggcttgatcctgtttattctgtgtgtagggaatactgaatttctacttaatggattagtgcagaatgtgggggattacatcagccgtttcatgggaatgacactcaatagttttgcatttgagcgcccgaccgaatggatgaataactggacgctgtttttctgggcatggtgggttgcctggtcaccgtttgttggattattccttgcgcgtatttcccgtggcagaaccattcgccagtttgtgatgggaacgctgatcattccgtttgtctttacgttgttatggttatcaatttttggtaacagtgtattgtatgaaatcctgcatggtaatcgtcaattggccgaaacggtattggagcacccagagcaaggtttttatggcttgctggcactttatccggccttcacgtttagcgcctctgttgctacgatcacgggattgctgttttatgtcacatcggcagattcagggtcgttggttctggggaatttcacctcaaatctcagcgatatcaataatgatgctcctaactggctacgtgtcttttggtcagtggcgattggtgtattaacactgggtatattaatgacggatggcatttctgctttgcaaaatatgacggtaatcatgggcttgccttttagctttgtgattttttttgtcatggcaggattgtacaaatctttgcgtgtggaggatttccgcaaagccagttcattgcagaatacctcgccaacattggtacatgacaatggttcgttgaactggaagcaacgtctgagccgcatgatgaattttccgggcacgaaaagtacccaacgaatgctggatgtggtttgtcgtcctgccatgcaggaagtggcaaaagagctggaattacgtggtgcgaaagtacagtttaatgcgctgccatcagaaggggacgaacgactgagcccgcttgagttaattgtcgatctgggggatgaacaaaactttgtgtaccaagtctggccgcagcgttattccgtgcctggatttacctatcgtgccagatcgggtaaatcttactattaccgattggaaactttcttgatggaagggactcagggcaatgacttgatggattacaccaaagaacaaattatcagcgatattctcgatcactacgaaaagcatctgaactttattcatctgaatcgcgaagcaccgggtcagacgttgattttcccgaacgggggataa

SEQ ID NO: 5105 - DNA, 150 bp, Xenorhabdus bovienii
  Coding DNA location: Contig name=SeqID_16904; Position on contig =40481..40630bp; Strand=-
atgattgatattggtaggctcgaattcgttaacttaattagcaattacagacaaggtaaaaaacaaaaaaactgccaacaactcaatatattgcaggcagcttccgttataaatctatattatcccccgttcgggaaaatcaacgtctga

SEQ ID NO: 5106 - DNA, 102 bp, Xenorhabdus bovienii
  Coding DNA location: Contig name=SeqID_16904; Position on contig =40587..40688bp; Strand=+
ttgctaattaagttaacgaattcgagcctaccaatatcaatcatattcaagaatatcaatcatattcaagaatatcaacataagtctccattctatatttaa

SEQ ID NO: 5107 - DNA, 99 bp, Xenorhabdus bovienii
  Coding DNA location: Contig name=SeqID_16904; Position on contig =40709..40807bp; Strand=-
ttggattgcatagcattcgaaatagacatggatgagctcccagagccttcattaaggcgagatgactataaattaccgattaaagtacaacaccattaa

SEQ ID NO: 5108 - DNA, 1194 bp, Xenorhabdus bovienii
  Coding DNA location: Contig name=SeqID_16904; Position on contig =40779..41972bp; Strand=+
atgtctatttcgaatgctatgcaatccaaaattcctattgctgtgtatctactgggtttaagtttgtttgcgatgggaagttcagagtttttaatcgcaggtgtgctgccaaaaattgctgaggatctgcaagtctcgttaccctctgcggggatgttaatttctgcatttgccgttggtgttctgttcggagcgccctcgttggctgtagcaacattgcgttggcccagacgagcaacattattgttgagtcaggctctgtttgttgccgctaccgccattggaatgctgtcgcccgattattggccgttattgattgcccgagttgtcagtggtatcgcttacgctgggttttgggcagttgctgcgacgacggcagttaatttagtgacccaggatcgcacggcaagggcattggccgtggttgtcagcggattgagtctggcgatggtagtgggtgggccattaggaacggtgattagtgatatagcggggtggcgtgccggtttctgggcggttgccgcagcaacatcagtcatggcgatagcattgtggtttatgttgccggagatacaaccgaatcaggtagaggttccggtattagatactgaattgaaaaccatggcacaaccgaaattatgggtagcttataccactactatgctgacaaccgccgcttatatggcgacattcggctatttgggggcattattgattgatatcagcaagctggcggtggtttgggttcctgcggtgcttgcactgtttggtatcggcgcttttatcggattgactataggtgggcggacagcagacaaatacccattcaagacgctgatgattggcactattggtatcattgtgtcttctattgcgttgacttttttagctgaaaacgtgatagccacaacttgtctggtatttctgctcggagtgtctggtttcgttgttaaccctgccgtcatgaaccgggtctataccattgctgctaatgcgccgacactggcaggtgcaactaatgtatccgctttccagctcgggatcacattagcccccttgctggctggctttgcaatcggggcaggctacggcttatcttctgtggctggagtgggagcattactggcaattattgcacttgtcccaatactgattgacgcgcgtttacatcataaaaattgtcacaacgattaa

SEQ ID NO: 5109 - DNA, 111 bp, Xenorhabdus bovienii
  Coding DNA location: Contig name=SeqID_16904; Position on contig =41932..42042bp; Strand=+
ttgacgcgcgtttacatcataaaaattgtcacaacgattaaaaatttcgtcccatcaaggataaatataaacaaaacttcatacagagcgctaacttgtagcaggaattag

SEQ ID NO: 5110 - DNA, 108 bp, Xenorhabdus bovienii
  Coding DNA location: Contig name=SeqID_16904; Position on contig =42039..42146bp; Strand=-
atgaataattttgcgcatttcacctctccatgcctcttttcacaccaaaataactgtataaatatacagcctcatgtcattgagcgctacttgttttttaagaactaa

SEQ ID NO: 5111 - DNA, 1056 bp, Xenorhabdus bovienii
  Coding DNA location: Contig name=SeqID_16904; Position on contig =42129..43184bp; Strand=+
atgcgcaaaattattcatattgatatggactgcttttttgctgccattgaaatgcgggataatccatcactccgcgatattcccatggcggttggtggcagcgcagacaggcgtggagtgatcagcacagcaagttattccgctcgccgttttggtgtacacagtgccatgtctacagcaatggcattgaaactctgtcctcaattgaaagtcataccggggcgaatggcatcctacaaagaagtttctcagcatattcgccagattttttcccgttacactgaactgattgaaccgctttcactggatgaagcctatttggatgtgacagactgtcaacattgccacggctcggcgacgttaattgctcagcaaatccgtcaggtgatttttgatgaattgcaactgaccgcttcagcaggtgttgccccagtcagatttctggcaaaaattgcgtctgatatcaataaacctaacgggcaatatgttatttcccctgaacaggttgaggtattcgtcaagtcattgccattacgcaaaattccaggagtgggaaaagtcacatccaagcgtctatctgatatagggttggaaacctgtgctgatgtacaaaactacgacaaggttgcgttgattaaaaaactggggaaatttgggctggcactttgggagcgcagtcatggtattgatgagcggcaaattagtcccgatcgcttacgtaagtctgttggcgtagaaaaaacgttggcacaggatattcatgaatggcgtgattgtgttgaactcatcgaaaaactttacccagaattggaaaaacgtttaggtaaggtaaaacccgatctccgcattgcccgtcagggcatcaagttaaaatttgatgattttcaattgacgacacaggaacatcttcacccattattggataaatcggatctaattcaggtggcaaaacaggcttgggaaatgcgcagagaaggaaggggggtgcggttggttgggctgcatgtgacgttacagaatccacaattggaacggcaattattactggaatggtaa

SEQ ID NO: 5112 - DNA, 1575 bp, Xenorhabdus bovienii
  Coding DNA location: Contig name=SeqID_16904; Position on contig =43247..44821bp; Strand=-
atgatatcctcgggcatggcatgggcattgggacagctcaagatgacaaaagctcccaatgcgtcagacattactatttccatctcatcaagatgcagttacaggagattcgccgtgtccgagttatcaacattatcccctcaaccattatgggatatttttgcccagatttgttccatcccacatccgtcctatcacgaggaagcactcgcgtcccatatcattaaatgggccaagagcaaaaattttcatgtagaacgggatgaagtcggtaatattctgatcagaaaaccagccacaaaaggtatggaaaatcgccagtcagtcgtgcttcaggctcaccttgatatggtgcctcagaaaaacaatgatacacaacacgacttcacaaaagatcctattcgtacttatattgatggtgactgggtaactgctgaaggtacaacactgggcgctgataacggcatcggcatggcttctgctcttgcagtactggcagatgaatccgtcaagcacggcccactggaagttttactgactatgactgaagaatccggcatggatggcgcattcggactgcaatcaggctggttacaggctgatgttctgatcaataccgattcagaagaagaaggcgagatttacatgggttgcgctggtggcattaattttgtctcaaccctgccactttcccgcgaaacattgcctgcgggttaccaaactttgcaactgactattaagggattaaaaggtggccattctggtggtgatattcatctgggattgggcaacgccaacaaattgctggcacgtttcctcgccgcacattcagatgaattgaatctaaaattgattgatttccaagggggaaccctgcgcaatgctattcctcgcgaaggttctaccgtcattgccgttccggcaactcagctcgaaaaactgtaccaattgaaagatgactacctgaatacgttgaaaaacgaatatgcggtcgttgaagcaaatttgatcatcctattggatgaaatcgaaacttcctcacaggcactcactacagattgccagactcgctttctatccatgctaaataccatgcctaatggtgtgatccgtatgagtgatgttgctgaaggcgtggttgaaacttccctgaacgtaggcgttgtcactatggaagaagataaagtcgagattatctgcctgatccgttcattgatcgacagtggcaaggcttacgttgttgatatgctaaattctctggccaaactggcagatgcagaaacagcagcaagtggcaactatccaggctggcagccagatgccaactcgccagtcatgcatttagttcgtgaaacctatcagcaattattcgacaagatccccaatattatggtgatccacgcaggtctggaatgtggtctgttcaaaaaaccgtatccggatatggacatggtttccattggcccaaccattcgtggcgcccactcgcctgatgaaaaagttcacatcaagagcgttggtcaatactggcagttgttaaccgctatcttaaaagcgatcccagttaaagagtaa

SEQ ID NO: 5113 - DNA, 228 bp, Xenorhabdus bovienii
  Coding DNA location: Contig name=SeqID_16904; Position on contig =44794..45021bp; Strand=+
atgcccatgccatgcccgaggatatcattttcttgtttgagatgtgcagtcaggatcaggatttcccttgttttttactggtttttgccgatccaaatcactataatcccgcgcaacctttttttccgcaaaaaactcttttctgagatattcttagtttccaggatcaaatcatatgagcgaaaaatatgttgtaacgtgggatatgttgcaaatgcatgcccgtaa

SEQ ID NO: 5114 - DNA, 462 bp, Xenorhabdus bovienii
  Coding DNA location: Contig name=SeqID_16904; Position on contig =44969..45430bp; Strand=+
atgagcgaaaaatatgttgtaacgtgggatatgttgcaaatgcatgcccgtaaattagcacaacgtttacttcctgtagaacaatggaaaggcattattgccgttagtcgtggtgggcttgtaccgggtgcattgctggcacgtgaactgggaatccgtcatgtcgataccgtttgtatttccagctatgatcacaacaatcagcgtgaattaacggtagtgaaaaaagcggaaggcgatggagaaggtttcatcgttgtcgatgatttggttgataccggaggtacagcgcaggcaatccgtaacatgtatcctaaagcgcatttcgtgactattttcgctaaacctgctggccgtcctttagtggatgattatgtgattgatatcccgcaagatacatggatcgaacagccatgggatatgggtgtggtattcgttccgcctatttgtaataaaccgtaa

SEQ ID NO: 5115 - DNA, 1248 bp, Xenorhabdus bovienii
  Coding DNA location: Contig name=SeqID_16904; Position on contig =45446..46693bp; Strand=+
atgactaaacaaaacctttcagaatcgttgttcaagcctcggcttaaacagcaggaaacgtctacactggtaaaatatatccgtccacagtccacagcggccagtgataggatacttagtggagagcgccgcgagcactggtatcggatgattgattggcttgcttggatctggaggggaatcaatccactggaaattcaggatgttctcagcaggattgcagcgatagatgccgaacgcagtgatgaccatttattggatactgtgatcggctatcgtaagggaaactgggcatttgaatggacgcagcaggctatgtactggcaacaggaggcgctgcgtgcggagcagacatctgaagccggaacatcttggctaaaggctgcgatgttatatagcattgcggcttatcctcatttacgcggtgatgaactggctgaacaggctgctgcgttggccagtaaagcctatgaaaatgcggctcactgttctgactatgaattgaaaaagctggaatttcagttagaagagggcaaaagtgtcacaggcttattgcatcttcctcctaacgttcaagagccatgtccaacaatattggtctgtaccagccttgacaatgtacagagtgacttctggcgactgtttcgtgatcatcttgctccactcggttttgccatgttgacagtagatatgcctgctgttggttactctgccaaattcaaattgacgcaggatacgtgcatactccatcagcaggttcttcagcagttgaatcaaattccgtggattgatcatactcgcgtaggcgttatgggatttcgtttcggcgcaaatattgcagtacgtcttgcttatctggagcctcaacttattaagggtgtggccgttattggcccgatagttcatacattgctgaatgacgagaaacgacagcagaatataccgtcaatgtacattgatgtgcttgctaatcgtttggggctctatcacgtcgatgaagccgccttacgtttagaattgagctgttattcactgaaaaaccaaggattgctggggcgtcgctgttctgtgccaatgctttccgtttattggaaagatgatgttttcagcccaagggaagactcaaaacttattgcaatgtcatcaatggatggttcgttattggcaattccttctacgccagtctatagtggttttaataaggcgttacatgaaacaagtgtatggttgaaagataaagcttcttaa

SEQ ID NO: 5116 - DNA, 402 bp, Xenorhabdus bovienii
  Coding DNA location: Contig name=SeqID_16904; Position on contig =46767..47168bp; Strand=+
atgactttacctgtaaattattctagaaataagttgttgaagagcttttctgcattaggaccgtatatacgtgaattaaaatgccaaaatggctattttttctttgattgcctagctgtttgtgtcagtgcaaaggtggttccggaaaaaagggagttttggggatggtggctggaattggaagaagacgaaaaagggtttgtttataactatcagataggtctatttgataaaaatggtgaatggcagccgatgggtatcaaaaaaattgctgatcttgagcatcttgaatcaactttgcaggcatttcacaaacgtctgactgattcttttaatactttcaaacttacgttgatcccgtccaaaaacaccatcgctcttcagactcaagttatggcatga

SEQ ID NO: 5117 - DNA, 417 bp, Xenorhabdus bovienii
  Coding DNA location: Contig name=SeqID_16904; Position on contig =47058..47474bp; Strand=-
atgttcccgtcctgctgcaatcgcacccgaggtcacaatgataatacggtggcctttttcatgctgttgagcacattgccgaaccagttccacaatatgagcacgattcaaacgacgagagccaccagtcagtacactcgttcccagtttcacaaccaatgtttggctgccattcatcatatttctgccattacagtaagtttgaaaaaaacaagtttgaaaaaacaatgctcagttttaacaggagaggagcgttatgccaaccgacataacgcaaaattaaaaaaaagcgggcttagaacaaactcatgccataacttgagtctgaagagcgatggtgtttttggacgggatcaacgtaagtttgaaagtattaaaagaatcagtcagacgtttgtgaaatgcctgcaaagttga

SEQ ID NO: 5118 - DNA, 1107 bp, Xenorhabdus bovienii
  Coding DNA location: Contig name=SeqID_16904; Position on contig =47295..48401bp; Strand=+
atgatgaatggcagccaaacattggttgtgaaactgggaacgagtgtactgactggtggctctcgtcgtttgaatcgtgctcatattgtggaactggttcggcaatgtgctcaacagcatgaaaaaggccaccgtattatcattgtgacctcgggtgcgattgcagcaggacgggaacatctgggatatccagacttgcctgctacgattgcttcaaagcaattgctggcagctgttgggcaaagtcggttgattcaattgtgggaacagcttttttccatttatggtattcatgttggtcaaatgttgctgacccgtgcggatctggaagatcgtgaacgctttctgaatgcaagggatacgcttcaggcattacttgataaccacattatccccatcattaatgagaacgatgccgttgcaacagcagagatcaaggtcggcgacaacgataacctttctgcgctggctgcgattctgggcagtgcagataaattgttgctcttgactgatatcgaagggctttatactgccgatccgcgtaataaccctgaagcgaagcttatacctgaagtgcatgatatcagtgatgagttaaaaatgatggcaggggatagcgtttcaggtctgggtacaggcggaatggccacaaaacttcaggctgcgggaattgcggggcgtgcggggatcgatgtcatcattgctgcgggtaataaaccggacgttgttgcagatgtcatcgaaggcaaatcagttggcactcgttttcatggtcaggccagcccgatggaaaatcgtaaacgctggatctttggtgcgcctcccgcaggggaaatcatcgttgatcacggagcagaagccgccatccttgaaaaaggtagttccttactgccaaaagggatgaaaaacgtcaaaggtaatttttcccgtggtgaagtgatccgtatccgcagcttgtccggcaaggagctagcccgcggtgtatgtcgttacaatagcgacgctttacgtctgattgcaggccatcattcacagcaaatcagccagatactgggttatgagtatggcgcggttgctgtgcaccgtgatgatatgatcgtaagttag

SEQ ID NO: 5119 - DNA, 1254 bp, Xenorhabdus bovienii
  Coding DNA location: Contig name=SeqID_16904; Position on contig =48431..49684bp; Strand=+
atgctagagcagatgggaaaagcagctaaagcagcatcatggcagctggctcaattgagtaccagccagaaaaatcaggctctgagtcacattgctgacttgcttgaaaaagaaacagaagtgattcttgccgctaatcagcaagatatggaacaggctcgtgaacaaaacatgagtgaagcgctacttgatcgattattgctgacacctgaacgattgcgtgccatcgctgatgatgtgcgtcaggtttgtcgcttggctgatccggttgggcaggtgatagatgggcaatcattggataatggtctgcaacttagtcgtcgtcgtgttcctttgggcgttattggcgtgatttatgaagctcgtccaaatgtcacgattgatgtcgcctcactgtgcttgaaaaccggaaatgcggttatcttgcgtggtggcaaggaaactcatcataccaatcaggctatggttaaagttattcagcaggcgttggagcaaagtggtttacctgccactgcggttcaagccatcagtaaacccgatcgtgagttagttgctgaattgctgaaaatggatagctatgttgatatgttgatcccgcgtggtggtgctggtttacataagctttgtcgtgaacaatctactatcccggtgatcaccggggggattggtatctgtcacacattcgtggatgaaagtgtcgatgttgaaaaggcactggatgtgatcactaatgcaaaagttcagcgaccaagtgcttgtaattccttggaaactttgctggtgcatgaaaaaatagcgtctgattttctgccagcattgagtaccagaatgaaagagcagggcgtgacactgcacgcaggagtatctgcgatggccctgttaaaagatggcccggcagaagtcgttgaagtaatagaagaagattactgcgatgaatggttgtcgctggatatgaatgttgagattgtcagtggtatcaatcaggctattagccatatccgcacttatggtactgctcattcagatgctatcctgacagaaagtctgcaacaggctgattattttgttagtcatgtggattcatcggctgtgtacgtgaatgcaagtactcgctttactgatggcggccagtttggcctaggggcagaagttgctgtcagtacccaaaagttacactccagaggcccgatggggctggatgcgttgacgacttataagtggattggttatggcgattatctatcccgtcgttaa

SEQ ID NO: 5120 - DNA, 525 bp, Xenorhabdus bovienii
  Coding DNA location: Contig name=SeqID_16904; Position on contig =49850..50374bp; Strand=+
atgaaacagactctatttatcgtaggcgcacgaggtgctgggaagacgacaataggtaagttgttggctgaagcactatcgtatacatttattgatactgatgaaagtattcaagcctcctgtggaatgaccattgctgaccttgttgaacaatatggttggacacatttcagggaattagaaagccaaatactaaaaactgtcagtcagaataagtgcgttatttcaacgggaggcggaatgatactgtcgtctgaaaaccgccagtatatgcaacaaaatggcattgtgatttatttacaggctccagcagaagttttaatcaaacgactatcgctcaacccagaaaacacacagcgccccagtctgacaggtaaatcgatcacagaagaaatcgaaagtatcttgactgaaagagagcagttataccgtgaatgtgcaaatttcattgtggatgctaattcttcgacagaaaatatttcatctttaattaatggctatattttaaaccaagaaatagggtaa

SEQ ID NO: 5121 - DNA, 144 bp, Xenorhabdus bovienii
  Coding DNA location: Contig name=SeqID_16904; Position on contig =50376..50519bp; Strand=+
ttgatatatccaaatatctttgtgcttatttttttatatagccgtaaaattttatatctcagactgcttataccaattatagtatcattttacttactcactttaattttatttaattatattgagatatggatatgttcgtaa

SEQ ID NO: 5122 - DNA, 2154 bp, Xenorhabdus bovienii
  Coding DNA location: Contig name=SeqID_16904; Position on contig =50504..52657bp; Strand=+
atggatatgttcgtaaaatttatacgattagttgttcgtgtgctctttagagtcacggtagaaggtgatgataagcagttcaaccatcccaaatgtattattacacccaatcatatttcttttctagatggtcttctgattgggctttttctgccggtaaagccggtattcgccgtttattcccatcttgcgacccccgcttttctcagattgattaagccttatgcggatgttgtccccttagatccgaacaatcctatggcagtcaggacgttggttaaagaggttgataacgggcgccctatcgttatttttccagaaggacggatcacgataacgggctccttcatgaagatctatgacggtgctgcttttgtcgcggctaaatcaggcgcaaaagtggttccagtccgtattgatggcgcagagcaaagtatttttgggcgcctgaaagagattatgaaattgcattggtttccgaaaatcaccatcaaggttttgcctgcggtcgatttccctatgccggatgcaccaaattcttcaactcgtcgtcgtttggcgggggaacatcttcacgccatcatgatggatgtgaggatgcagacccgtccaaaagagacgttatttagcgcttatcttgctgcacaaaaacgttttggccgcttcaaaccctgtattgaagacgtaacttttaaggaggatagctatcacgcattgctgaaaaaaatattgggtgtcagtcggattttagaacggtttactcaaaaaaatgagcgggttggactcctgttacctaatgctacagtgatggccgctgccatatacggcgcttcgctgaaaggacgggtgcctgctctgctgaactacactgcgggaacgaatggtattaaaaatgccatgaaagcggcaacaatcaaaaccatcgtgacatctcgtcaatttttggaaaaagggcaattaacccacctgccagaacaggtgacggaagccaattgggtatatcttgaagacctgaaagatacgattacgcgggaagataagctttggatactatggcacctgatttttcctgctaaggccattacgccttcccagaagcctgatgatgatgctctgatcctgtttacctcaggctctgaaggtgcgccgaaaggtgttgtgcacagtcatgccagtttattggcgaacgttgagcaaattaaaacgattgctgattttactcctcaggatcgttttatgtcctctttaccgctgttccatgcttttggtctgacagttggtttatttaccccgttgatgacaggtagccgtgtattcctgtatccaagcccattgcactaccgtatcgtgcctgaactggtctatgatcgcaattgtaccgtcttgtttgggacttcaacgttcttgggtaattatgcccgttttgcccatccttatgattttgcccgcttgcgctatgtggttgctggggcagaaaaactgtcagaaaacactaagcgtgtttggctggataaattcggtattcgcattctggaaggctacggtgtgacagagtgtgctcctgttgtggcaattaatgtacccatggcagctaaaatgggaactgtcggacggatcttaccggggatggaagctcgccttcttcctgtacagggcattgagggcggcggtcgtttacaattgcgtgggccgaatgtcatgaaggggtatctgcgtgttgaagcgcctgagcgtctggaaccaccaaccgcagaagatgccgaaggtaatactcatatcggttggtatgatacaggcgatatcgtttctgttgatgacgagggtttttgtacgatcaaagggcgagtaaagcgttttgcaaaattggcaggcgaaatggtttctctcgaagctgtagagcaaattgcagcgcgagtctctcctgacgcattacatgcagctacagctaagagtgatcttagcaaaggtgaagcgctggtactctttacaaccgatgctaatctgaatagaaatacgatgtcgggggttgcccgagaaatgggaatgcctgaactggcggttccacgcgatattcgttatgtgaagcaattaccgttgcttggcagcggaaaaccggattttgtcacattaagaaaaatggcagaacaggagtaa

SEQ ID NO: 5123 - DNA, 1197 bp, Xenorhabdus bovienii
  Coding DNA location: Contig name=SeqID_16904; Position on contig =52662..53858bp; Strand=+
atgaatggcactgtagagacacaaccactgttaaataaaggaatgaaagcagtattactgtctcaatttctcactgcttttgctgacaatgcgctgttctttgccattttagctcaattgaaggctgaagcttaccctggatggagtctgccagccctgcaaattgttttcgtgctgacctatattgtgcttgcccccttcgtggggcaaattgctgatcggttttcgaaaggccgggttatgcttttcgccaatggcatcaaattacttggtgccatcagtatctgcatcgatatgaaccctttcctcggatataccctcgtagggattggcgcagctgcttattctccggctaaatacggaatattgggtgaattaaccgatggtggtcgtttggtcaaagctaatggtgtgatggaagcttcgacaatcgccgctattttaattggttcagtggctggcggtttcctgtctgatatcagtctcgcactggcattaggtctttgtgctttgatgtatagtgcggctgtggtggctaatttctatattccccggcttgctgctgcgcgccagggtaagggatggaatcccaaaaaaatgctggtggattttatggctgtctgttctgtgctttggcgtaatcaggaaacacgattttcgctagtaggaaccagtctgttctggggagctggggtaacgctgcgcttcctattagtagcgtgggttcccgtcgtgttggggattgagggtaatacgacacctacgctgatgaacgcaatggttgccgttggcatcattgtgggagccgggctggctgcacggtttatcaccttgaaaacagttcgtcgttgtatgcccgcaggtattctgattggcattatggtgattgtttttgctgttcagcaatcgatatggtcttcctacttgatcctaactgtccttggtgtatttggcggcctctttgttgttccattgaatgccttattgcaggagcatggaaaacgcgagatgggcgcaggtaacgctgtcgctgtgcagaattttggtgaaaacagcgcgatgctggtgatgttgggtctgtacctaatttccatcatgctgggcgcctcggtcgttgccgtcggtattggttttggtatcttgttctcgctgacaatggggggagtatggatttgggatctgcttcggaaaaattaa

SEQ ID NO: 5124 - DNA, 504 bp, Xenorhabdus bovienii
  Coding DNA location: Contig name=SeqID_16904; Position on contig =53884..54387bp; Strand=+
atggatgaaaaaatcctgaatcagcttagtattgaacttggaaagaaactccaacggaaaaaattatccttaacctgtgcagaatcctgcacagggggctggattgccaaagtgatcacagatattgcgggaagttcggcctattttaatcgcggtttcgtgacctatggcaatgattctaaaaatgaaatgctgggtgtatcacaggcatcactggtgcagtttggtgcggtgagtgaacaggtcgttaaagaaatggcagtaggggcattaaaggcggccagagcggattttgctgtttctgtcagtggcatcgcaggtccggatggcggcagtgaagaaaaaccgacgggaacggtctactttgggtttacctaccgtaatggtgaggatgtacataccgtgacatatcgccagcattttacgggtgatcgcaatgcagtacggctccaggctgtcattttttctttaaaaacactgctggaagaaatcataaaaaattag

SEQ ID NO: 5125 - DNA, 1077 bp, Xenorhabdus bovienii
  Coding DNA location: Contig name=SeqID_16904; Position on contig =54493..55569bp; Strand=+
atggctaacgatgaaaacaaacaaaaagcactagcagcggcgctgggtcaaattgaaaaacaatttggtaaaggttctatcatgcgtctgggcgaaaaccgctcaatggatgttgaaactatctctactggctcactgtcactggatatagcattaggtgcgggtggtttgccaatgggtcgtattgttgaaatatacgggcctgaatcttcgggtaagacaacattgacactgcaagttattgcttctgcccagcgtgaaggcaaaacctgtgcttttattgatgccgaacatgcccttgatccggtttatgccaaaaagttgggcgtagatattgataacctgctgtgctcccagcctgataccggtgaacaggcactggaaatctgtgatgccttgtcacgctctggggcggttgacgtcatcgttgttgactccgttgctgcattgaccccgaaagcggaaatcgaaggtgagatcggcgattcccatatgggcttagcagctcgtatgatgagtcaggccatgcgtaagttggcaggcaacctgaaaaactcgaatactctgctaatctttatcaaccagatccgtatgaaaattggtgtgatgtttggtaacccagaaaccacaacaggtggtaacgcactgaaattctacgcatctgtccgtttggatattcgccgtactggttccgtaaaaaatggtgatgaagttgttggcagcgaaactcgcgtgaaagtagtcaaaaacaaaattgcggcaccgttcaaacaagctgaattccagatcttgtatggtgaaggtattaacacctttggcgaattggtcgacttgggcgttaagcacaaaatggtcgaaaaagcaggtgcatggtacagctataacggagataaaatcgggcagggtaaagctaatgccacgatttacctgaaagagcacccagaagtctctgctgagctggataaaaaactgcgtgaattgctgttgaataatacaggtggattcagtagtgcagtctctgattatgtagccgattatgaagataacggtgaagaagtgaaaaacgaagagttctaa

SEQ ID NO: 5126 - DNA, 198 bp, Xenorhabdus bovienii
  Coding DNA location: Contig name=SeqID_16904; Position on contig =55496..55693bp; Strand=-
ttgtcaagccagtttcagtatccctgtatcaatgatgttgattactcctataaaaacaaaaaccacatcccgacaggatgtggttcttcagaaaacagtttgtcacaacagagtgaacgagtaattagaactcttcgtttttcacttcttcaccgttatcttcataatcggctacataatcagagactgcactactga

SEQ ID NO: 5127 - DNA, 2664 bp, Xenorhabdus bovienii
  Coding DNA location: Contig name=SeqID_16904; Position on contig =55848..58511bp; Strand=+
atgaatctgttttttcagcttgatttcgggacaattatgagcaaaagcaccgctgagatccgtcaggcgtttcttgacttttttcacactaaagggcaccagatagtaccaagcagttcactggtgccaaataatgatccaaccttgttgttcactaatgcagggatgaaccagtttaaagatgtttttcttgggttggataaaaggccttattctcgagcaacaacggctcagcgctgtgttcgtgctggcggtaagcataacgatttagaaaatgttggttatacagcccgtcatcacactttcttcgaaatgttgggtaatttcagttttggcgattattttaaacaagatgcgattaaatacgcatgggaactgctgacaggcaaagaatggttcaatctgccaaaagaaaaactgtgggttactgtctatgagacagacgatgaagcctatgatatctggcacaaagaagttggcgttcccgcagaaaaaattattcgaatcggtgataacaaaggcgttccttatgcatcagataacttctggcaaatgggagataccggtccttgcggtccttgcacagaaattttctatgatcatggcgagcacatttggggtgggactccaggtagcccagaagaagatggtgacaggtatattgaaatctggaacatcgttttcatgcagtttaaccgccatgcagatggcacaatggagccattaccaaaaccttctgttgataccggaatgggcttggaacgtctcaccgcagtgttacagcacgttaattccaactacgatatcgatttattcagcgatctaattgcttctgtggcagaagtgactggcacaaccgatcttaccaacaaatctctgcgtgttattgcagaccatatccgctcatgcgccttcttgatttgtgatggggttatcccgtcgaatgagaaccgtggttatgtgttacgccgtatcattcgccgtgcaattcgccatggcaacatgctgggcgcaaaagaaaccttcttctataaactggttgctccactgatcaaaattatgggtgcggcaggcgatgagctaaaacaccagcagtcgttggttgaacaggtattgaaaactgaagaagagcaatttgcccgtacgctggaacgaggcctgcaattgctggatgaagagctggcaaaactgtctggggacattcttgatggcgaaactgcttttcgcctctatgatacctatggtttcccggttgacctgacggcggatgtttgccgtgagcgtaatatcaaagtcgatgaagctggttttgatgttgcgatggaaaaccagcgtcgccgggcacgtgaatccagtggttttggcacagattataacgaacagatcaaagttgacgggcgcagtgatttttcaggttacgaacacaactcacagcaagcgacggtgatagcgattttccgtcatggtgaagcggttgaccagattcattcaggtgaagaagcgatcgtgatacttgataagactgcgttctatgctgaatctggtggacaggttggtgatacaggcaagttgtccaatggcaacggggtatttgaggttgcggatacacaaaaatacggtcaggcaattggtcacattggtaaattgataaatggcactttgagtgtaaattgtacagccaatgccgagattaatatagtacgccgagattcgattcgtttgaatcactccgcaacccatttactacatgcggcattgcgtcagattctgggggaacatgtttctcagaagggttctttagtaaatgataaatatctgcgttttgacttctctcattttgaagcaatgaagccagaacagatccgtcaggtagaaaatctggtgaatgaagaaatccgcaaaaattcatcaattgttacagaattgatggaattggaagaagcaaaaaccaaaggtgccatggcactgtttggtgaaaagtatgatgaacaggtacgtgtattgagcatgggaggcttttctactgagctatgtggtggaactcatgctagccgtactggtgatattgggttatttcgtatttccagtgaatcaggtacagctgcagggattcgtcgtatagaagctatcacggggcaaactgcactgaattctgtttatcagcagacggatttactgcaagatattgctcatcttgtgaaaggtgatataagtagcctgaatgagaaagtgaagacgacactggatagaacaaaacagttggaaaaagagttgcaacagttgaagtctcagcaagcagctcaggaaagctcctctttggcgaatcaaactaaagagatccagggagttcgtctactggtgacacaattgggtgatactgaaccaaaaatgctcagaacgatggttgatgatctgaaaaaccaactgggatcagcaattattgtgctttctactgtgactggtgataaagtcaccctaattgttggtataacgaaggatttgactgctagaataaaagcaggcgatttaatctcttttgttgcccagcaagttggaggtaaaggaggaggacgtcctgatctggcacaggctggcgggactgatgcagcagctcttccttccgcattggctagtgtagaagagtgggtaacattgcggttatag

SEQ ID NO: 5128 - DNA, 99 bp, Xenorhabdus bovienii
  Coding DNA location: Contig name=SeqID_16904; Position on contig =58506..58604bp; Strand=-
atgcgcccaacatttcaacaatttcacaacaaaaaaacatccggcaccataaaaaacactttcatggtgccgtggctgtcacggcaataccaactataa

SEQ ID NO: 5129 - DNA, 159 bp, Xenorhabdus bovienii
  Coding DNA location: Contig name=SeqID_16904; Position on contig =58565..58723bp; Strand=+
atgtttttttgttgtgaaattgttgaaatgttgggcgcatacttatattttagctatcctatagatataggaaatgtgttcaaaactgcttatactttaagtagatatcattgctttacgttttcacggtgtttgatggataatagcggggaaacctag

SEQ ID NO: 5130 - DNA, 243 bp, Xenorhabdus bovienii
  Coding DNA location: Contig name=SeqID_16904; Position on contig =58720..58962bp; Strand=-
gtggacgccattcttgaattaaaaagttgtaggctgagatttctctgcctgaatccgttgataaatttcttcacggtgaacagaaacttccttgggcgcattcacaccaatgcgaacttggttgcctttaactcccagtactgtgactgttacctcatcgcctatcatgagcgtttcaccaactcgacgagtcagaataagcattctttgctccttgaaaatttaaaagagtcgggtctctag

SEQ ID NO: 5131 - DNA, 120 bp, Xenorhabdus bovienii
  Coding DNA location: Contig name=SeqID_16904; Position on contig =58976..59095bp; Strand=+
ttgggcgctactctgcttccccgctactctgcttccccctctttccaaattgaagtgattcacgcttcgttactaccttattttttattctctcacgtctttttattttctatctgttga

SEQ ID NO: 5132 - DNA, 93 bp, Xenorhabdus bovienii
  Coding DNA location: Contig name=SeqID_16904; Position on contig =59115..59207bp; Strand=-
atgcttagtttaacggctaaggggatgttttatcaacagcacaatcccttaaatctcgctaaaatttatgaaaatgattattcaccgctataa

SEQ ID NO: 5133 - DNA, 1560 bp, Xenorhabdus bovienii
  Coding DNA location: Contig name=SeqID_16905; Position on contig =869..2428bp; Strand=+
ttgatcccggacgtatcaaaagcattgtcatggctagaggcaaatcctaccgtgttgaacggtatttgtcgcggtattgagcgtgaaacattgcgtgttactccagacggtcatttagctatgacagggcatccagaaccacttggtgcttctttaacgcataaatggattacaactgattttgctgaatctctattagagtttattacccccgttgatagtgacatagaaagaacggtcgcttttcttaaagatttacatcgttacactgcccagaacttgggcaatgaaaaaatgtggcctttgagtatgccatgctttattgacaaagaggaaaacatcactctggcacaatatggcacgtccaatgtggggcggtttaagaccttataccgtgagggattgaaaaaccgttacggtgcattgatgcagaccatttctggcgtacattataacttctcgttgccaataagtttctggcaggcatggttaggcatcaaagatgcagaaagtggcaaagaacaaatttcagatggatattttcgtctgatccgtaattattatcgttttggatgggtgatcccttatttatttggtgcatcacccgcgatttgttcttcgttcttacgtgggcgagagacagcactcccttttgaggaaactgaaaaagggacttgttacctgccttatgcaacctcgttgagaatgagtgatttggggtataccaacaaatcacaaagtgatctgaatattacctttaacaatctccattcgtatgtagaaggtcttaaaaaagccattcataaaccatctacagagtttgcggctttggggaacaaaaaagatggtaaatatctgcagcttaacaccaatgttcttcaaattgagaatgagctgtatgcaccgattcgtcccaaacgtgtcactcaagagagcgaatcgccctctgatgccttgctgcgtggcggtgtagagtatatcgaagttcgttctctggatattaatcctttcacggcgattggcgtcaatgaaattcagatccgctttcttgatctatttttgatatggtgtgctttggctgatgctcctgaaatgagtagcaaggaacttgactgttgtcgtcaaaactggaataaggtcattttagaagggcgtaaaccagggctgaatatcggtattggttatggtattgagcagcagccacttaaaacagttggtcaagaattattcaaagatttagaacgtgtagctgaagtcttggatacctgttctggaacacaatatcaatcagcctgcaaagagttggttggtatgtttgaagatccatcattgacattttcagcccgggtactgggcaatatgaaagctcaagggattgttggttttggattggaattggcaaccaagtatcatcgtgaactgcttgaggagccgtattcaatcctgagtgaagaatgtttttctgttgagcgtcacgcttcgatagaacggcaaaatagcttagagcagcaaaacagcatggattttgaagactatctaaaactacatgctgggtattaa

SEQ ID NO: 5134 - DNA, 516 bp, Xenorhabdus bovienii
  Coding DNA location: Contig name=SeqID_16905; Position on contig =2592..3107bp; Strand=+
atgcctttattagatagttttacagttgaccatactcgtatggaggcacctgctgttagagttgccaaaacgatgaaaacacctcatggtgataccatcacagtatttgatttacgtttttgtgttccgaacaaagaagtgatgccagaaaaagggattcatactctggaacatctgtttgcgggctttatgcgtaaccatttgaatggtgatggtgttgaaattatcgatatttctccaatgggatgtcgcactggtttttatatgagcttgattggtgaacccgctgaattgagggtagccgagtcttggaaagcagctatggctgatgtactgaaggttaaagatcagaatcagatcccagaattgaacatttatcaatgtggtacttctgagatgcattctctgcaagaagcgcaggacatcgctcgccatattcttgatgcagatgttcgagttaacctcaatgatgagctggcgctacctgaagagatattagttgaacttcaagtgtag

SEQ ID NO: 5135 - DNA, 429 bp, Xenorhabdus bovienii
  Coding DNA location: Contig name=SeqID_16905; Position on contig =3285..3713bp; Strand=-
ttggttatcaatgattgtggtgaacttttagcggttaagctgacctcaggaaataaagatgatcgtcatcccgtcaaagcacgggtacaagggttaacagggtgtttgtatggcgataaagggtatttgtcacaggccttgtgcgatgaactggaagcagaaggaataacgttaatcactcatgtccgtagtaacatgaaggcaaaagcgttatctctctgggataagctgatgttaagaaagcgatttttgatagaaacggtcgtggatcagctcaaaaatatttctcagatagcgcattcaagacaccgtagtcagctcggttttttattggaaatcgtcgctggcttaatagcttatacattccaacctaaaaaaccgagcttgaatttacgggattgtgatatcgctatttttaaacgaagctga

SEQ ID NO: 5136 - DNA, 381 bp, Xenorhabdus bovienii
  Coding DNA location: Contig name=SeqID_16905; Position on contig =3683..4063bp; Strand=-
atggcctatacacaactgaccgaaatagaaagatatcagatttccagtttaaaggaagccggttttacacaacgttttattgcaacgtcgctcaatcgaaatccatcaacaattagccgggaattgaaaagaaatcaggcggtacagaaatactgccctcaacaggctcagcttaaggcgtcagaacgtcgccattctgccctaaaagcagtcaaggtgacgccagagatattgattcaaccaaaattgctgtttgtcacaacctccgtattccccgtcatcgcgtatttgagggcgtcgcacagcgagggaaaacgagtacaggctggttttatggctttaaacttcatttggttatcaatgattgtggtgaacttttag

SEQ ID NO: 5137 - DNA, 987 bp, Xenorhabdus bovienii
  Coding DNA location: Contig name=SeqID_16905; Position on contig =4339..5325bp; Strand=+
atgcattatgtcggaatagatgtcagcaagaataaactggatatttgcttgttatatgatggagttaaaggtaaacgcaaaacaaaatcccttctgaataatgaacattcagcctgtatgttaatagcgtggttagctaaatatattcctgccctgcaacaagtcaatatcgttatggaagccaccggagtctatcatgaacggttggcttattcccttcatcaggctgggggaaggattgcaatagccaaccctttacgcgtgcgtgattttgctaaaggtatggggatactgactaaaacagacaaagtagatgcctatattttagcctgttacagtgccttaaaacaacccgatgtctggcaacctcctcctatagaaattcgcgaattgaaggctctcctatgccgtcgggatgcgttattagaagatatccagcgtgaacgtaaccgatatgaaaaaagcggctcaacccataccccaaaaagggttattgagtccatagaggcaatgatgcatcacatgaaaaatgagttatccgagcttgaggctcttattgccgagcatataaaccagcaccctaatttaaaaaaagattttgaacttttaacctcaataaagggggttggaactcagattggtcttaacatgctgattatcttacgtacgaatacctttactcgtgcaacgcaagtcgctgcatatcttggtgttattcctattgcaaagcagtcaggtacatcggtgcatggtcgagtgcgcttatctaaaacggggcctactaaaatccgtgctaagttgtttatgtctgcactcacagcagttcgttttaacccccacataaatgatttatataatcgattggttaataaagggaaggcaaaaatgttggctttaggcgctgcgatgcgtaagttagttcatttgtgctacggagtattaaatacgcagcaatcatatgatgaaaactatgctattagaacttga

SEQ ID NO: 5138 - DNA, 1284 bp, Xenorhabdus bovienii
  Coding DNA location: Contig name=SeqID_16905; Position on contig =5518..6801bp; Strand=-
ttggagaatgtatcaacaagcacattaatcattattcttgtcatcatggtcatcatttctgcctacttttctgcctcagaaactagcatgatgacaataaaccgttatcgattacgccatctggcaagacaaggtagccatcctgcacgaagggtagaatcactactgcatcgtcctgacaggctgatcagtcttatccttatcggtaacaacctcatcaatattctggcctcttcgcttgccactattgtggggatgcgtctttatcaagatgcaggcgttgccatcgccactggcatattgactttcgtgattctagtttttgctgaagtaatgcctaaaaccatcgctgcgctttacccagaaaaagtggcatttccaagtagtttactactacggccactggaaaaaatcatgtttcctcttgtctgggcatttaataaaatcagcttactgcttatgcgctgtctaggcataaaaacctctgacattcgcaatgatgctgtcagcaaagatgaactgcgcacaattgtgaatgagtcaaacaccaatctctcacgccgtaatcaagatatgcttatttcaatactagatcttgagaaagtgactgttggcgacatcatggtgccccgtaatgaaattgtcggcattgatattaatgatgactggaagtcagtaatacgacaattgactcattcaccacatggcagaattgtgctttaccgcgattctcttgatgatgccattggcatgttacgtgtacgtgaagcctatcgcctcatgatggaaaaaaaagcgtttacgaaaagaaatctgatcaaggcggcagataagatttattttattcctgtcagcaccccgctgaacactcagttggttaattttcaacgcaataagcaaaaagcaggcctaatcgttgacgaatacggcgatattcaggggcttgtgactgtcgaagatattttagaagaaatcgtcggtgattttactacttctatgtcccctactttagcagaagaagtgctgccacagagtgatggtactgttctagttgatggtacagccaatatccgcgaattaaacaaagccttcggctgggcattgccttcggatgggccaagaacaatgaatggcatgattctggaagaattaggtgaaattcccgaattgaacgctcaggtacagattaataaatataattttgaaattctgtcagtgcacggtaatgttatcaaacaggtgagagttactcctattaatcaagcagcaaaaatttctgaataa

SEQ ID NO: 5139 - DNA, 558 bp, Xenorhabdus bovienii
  Coding DNA location: Contig name=SeqID_16905; Position on contig =6856..7413bp; Strand=-
atgactgtcgtggctttccgtggtcgggcatggtttctgcaacccatcgtttacagtttcgccatgataaatttaatgctggccagtatggtgccaggggcattcattacccatctggaagacagtattgagttattcattcatattgggttagcgctccttgggtatgccaccttacttatcgctgcactttatgcactacaacttggctggttggatcatctgcttaaaaagaaaaaattctctttttcttctggcatgccccctctgatgaccattgaacgcaaaatgtttcacattacccaagtcggtgtcattttactcacattgacgttatgtgcaggcatcatgtacatggataatattttcggtaaagagaatattcacaaatccgttttatctatcattgcatggtttgtctacgttatcttactctggggtcactatcatgaaggatggcgcggcaaacgtgtcatttggttcaatctgattggcgcgtttatcctgacactcgccttttttggcggcaggctattacaggaaattatggtttattaa

SEQ ID NO: 5140 - DNA, 189 bp, Xenorhabdus bovienii; identical to SEQ ID NO: 1648
  Coding DNA location: Contig name=SeqID_16906; Position on contig =1755..1943bp; Strand=-

SEQ ID NO: 5141 - DNA, 111 bp, Xenorhabdus bovienii
  Coding DNA location: Contig name=SeqID_16906; Position on contig =2200..2310bp; Strand=+
gtgaacatctttgcttctcttataaaaataactttgcctggagatagccgtctatcaccgcaaaaattcaacagtaccgcttcgcccataataccgactacatcatcgtag

SEQ ID NO: 5142 - DNA, 750 bp, Xenorhabdus bovienii
  Coding DNA location: Contig name=SeqID_16906; Position on contig =2399..3148bp; Strand=+
atgtggatcaaacagttaatttggcaagatttaagtcctgaacaaacagtcggttatctcaaaagtgaaaatataatatctttgcatcatgaaacagtttatcgattgatttataaggataaacttaatgggggtgatttatggcaacatattaggattgcgaaaaaaccgtatcgtaaacgctatggaagttatgagcgcagaggaaaaattaaaaacagagtcagtattgataagcgccccaaacttgttgataaaaagcagcgtattggtgattgggaaggcgatactatcgttggtaaagatcataaaagtgcattattgacattagttgaacgaaaatcgttatttactatcataattaaactggaagataaaacagcagaaggggtcgcaaaagcggccacaagacatttatcactgataaaacataaaattaaaacaatgacctttgataacggcctcgaatttgccgaacacgaactgatcagtgaaaatttagagacaaaaatttattttgctcacccgtattccccctgggaaagagggataaatgagaacacgaatggattaatcagagattacttcccaaaaggaactgattttaataaggtatcagagttggagattaaccttgtggcaaaccgattaaataatcgccctcgtaaaacacgagattacaaaacaccgaatgagttatttaaaggaatacccactcatttacttcgttcattacggtgttgcgcttaa

SEQ ID NO: 5143 - DNA, 150 bp, Xenorhabdus bovienii
  Coding DNA location: Contig name=SeqID_16906; Position on contig =3362..3511bp; Strand=-
ttgggcagagtttttcttagcgtgcctccttcttgcatagcttctaaccaagttaacccccgtcacatatcaacaacctattcatctaatatgacatgtcaattattgatttcaatctattacgtacaaaaacccaatatatcggcataa

SEQ ID NO: 5144 - DNA, 846 bp, Xenorhabdus bovienii
  Coding DNA location: Contig name=SeqID_16906; Position on contig =3446..4291bp; Strand=+
gtgacgggggttaacttggttagaagctatgcaagaaggaggcacgctaagaaaaactctgcccaaaaaaactatgcaatgcggtatgttgcagaccagcccgtagagctagttttacccacctctaaacgattacttgaagacaactcattaccacatgggcaaccgttaccagcccgcaatcatgaactttgcgttgccatctggaatatttacaaacagcagcgtccatcatggcaagaggttttgggttctttgattgagagcagccagcttattttattgcaggaagcgcaaacgacgcctgatttactgaaattcgttacagccagtggtttagttgcagatcaagtcccggcattttccatccctcagcatccatctggcgtaatgaccttagcatcttcttctcccgtctattgttacccattacgtgaaaaagagccgatactgcgactctcaaaatcttcactgattacgatttatccattaccagatgatcgtcaattgatggtgataaacgtgcatgcgatcaattttagccttggtgttgacgtttacagtcggcaattgaataacattggtattcatatcaatttgcatcatggacccgtgatttttgctggggattttaatgcgtggagccgtcggcggttgagagtattggtgcgttttgctcagcgtatgcaattgaaagaagtctattttaatgatgatcacagaacgattgtttttggcaaaccattagattttgttttttatcgtgaattgaaagtgttaaatgcggcagtcttaactacaatggcttctgatcacaatccattaattgtcaatttttctttataa

SEQ ID NO: 5145 - DNA, 1389 bp, Xenorhabdus bovienii
  Coding DNA location: Contig name=SeqID_16906; Position on contig =4359..5747bp; Strand=-
atgcaacataatgaaaatcagcttaaacagggcctgagcgtgcggcatattcgctttatggctttaggctctgcaataggcactgggctgttttatggctcggcagcggcgattcagcatgctggccctgctgtattgctggcctatttaatcggcggtgctgccgtatttatggtgatgagagcacttggcgaaatggccgttcaccatcccgtttccggttctttttcacaatatgccagccattatctgggaccattggccggctttctgaccggttggatttatgttcttgaaatgctgtttgtttgtctggctgatatcaccgcattcggcatgtatatgaggctatggttcccacacgttgatcaatggatttgggtgctgggtattgtatgttttatcggtgccctgaatctgtgccatgtaaaaatcttcggtgaaatggaattctggctttctatcgtcaaagttaccgccatcattgctatgatcattggcggcatcataattatgatctacggttttggtcaatcaactgaacatgctaccggtatttccaatttatgggagcatggcggcttcatgccaaatggtatcagtggagtgattgcctcatttgcgattgttatgttcgcttttggtggcatagaagtgatcggtatcactgccagtgaagcgaaaaacccagaaaaaacaattcctaaagcaatcaatgccgttccattccgtattttgatcttctatgtcctgacgctgtgtattctgatgtgcatctatccatggaatcagattgatcagaatgcaagcccatttgtacagattttttccaatctgggaattaattcagcagcgaatattttaaatgtcgtcgtgattactgccgctatttcagccatcaacagcgatatttttggtgcaggtagaatgatgtacggcatggctcaggaaagacaagctcctgaagcattcaagaaactgacccgtaatggtgtaccatggatgaccgtgcttgtcatgactatggttctattacttggcgtatggctgaatttcttgatccctaatgatatttttatccttatcgcgtctgttgcaacatttgcaaccgtctgggtatggctgatgattttaatttctcacgttgccatgcgccgccaaatgagtgcagaagacatcaagtcattgaaatttcccgttccaatgtggccaattgcgcctgcaattacgatcgttttcatggtcggtgtcatcgtattgctcggttattttgagcaaacaagggatgctctatatgttgggataggttgggtgttagtcctcacactggcttattccttctgtgtgaagaagaaattatcaacagatcatcgctctactaaccaataa

SEQ ID NO: 5146 - DNA, 180 bp, Xenorhabdus bovienii
  Coding DNA location: Contig name=SeqID_16906; Position on contig =5700..5879bp; Strand=+
atgccgcacgctcaggccctgtttaagctgattttcattatgttgcattcgttattcccatctatctttcatgccaaagagtatttcaggcatacaatgctctgtctggcgtcaaataccagcaaaagcaaccccgtacaataccataaagatggatgttcgcgggatagatatctgtaa

SEQ ID NO: 5147 - DNA, 672 bp, Xenorhabdus bovienii
  Coding DNA location: Contig name=SeqID_16906; Position on contig =5916..6587bp; Strand=+
atgatttacccaataaatgaaatttttcaaactttgcagggagaaggcgtgtttaccggtgtgccttcggtttttatccgcttacagggatgtccggtagggtgcagttggtgtgataccaaacatacgtgggaaaaagaggctgataaacaacagcctatggaaaacatcctagtgaaatcgcaggatagtgatacatggggagcagccactgcaagacaaattattaacttattcatccgtcagggttatacggcgcgccatatcgtcgttaccgggggtgaaccgtgtctgtatgatctgcgtcctttgaccgaaacattggaaagtgaaggctatcagtgtcagatagaaaccagtggtacacatgcgatccagtgttctgaaaaaacgtgggtcacagtttcaccgaaagtgaaaatgcgtggcggatatcaggtattacctgaagccatgaaccgtgcgaatgaaatcaagcacccagttggaagggagcgcgatattgaagcattggatgaactgctgacgatgctcgatgaaaaggcagatccggttattgccttacagcccatcagtcagaaagaagaagcaacccgcctgtgtattgaaacttgtattgcccgtaactggcgtttttcgatgcagacacacaaatacttaaatatcgcctga

SEQ ID NO: 5148 - DNA, 363 bp, Xenorhabdus bovienii
  Coding DNA location: Contig name=SeqID_16906; Position on contig =6624..6986bp; Strand=-
atgagcactaccatctttaaagattttcaatttgaagcggcgcatcgcctgccacatgttcctgaaggacataaatgtggacgtctgcatggacactcattcatggtacgtctggaaattaccggagaggttgatcctcttagcggatggatcatggattttgccgatgtaaaatccgcatttaagccgatttgggaacggctcgatcacaattatctcaatgaaattcctgggctggaaaatccaaccagcgaagttttagctaagtggatctgggaaaagttaaaaccaactctgccccaactcagtgccgtcatggtaaaagagacttgtagcgcaggttgtatctatcgtgacgaatag

SEQ ID NO: 5149 - DNA, 1836 bp, Xenorhabdus bovienii
  Coding DNA location: Contig name=SeqID_16906; Position on contig =7212..9047bp; Strand=+
atggatattggctatagcaaagggcacgggatcatgaccacaaaaccaccttcaactgtattattaccggtttctcctgaacaattatcacgtctgcaatctgcaatcggtgatttttctccatatcaactggcgtggttatcgggctatttctggggaatggtaaatcaaaagccacaaactgaagttgttacaccagctgcccctatatcggaaactgtcacactgatctctgcctcacaaacaggaaatgcccgtcgtttagccgagcaactcagagactcgttgttggcggaaaagctaaatgtgaacttggttaatgcgggcgattataaattcaagcaaatcgcacaagaacgggtattgattattattgcttcgacacaaggtgaaggtgaacctgccgaagaagcggtggcactgtataaatatttgaattccaaaaaagcgccatcaatgaaagagacggcttatgccgtatttggtctgggggatacctcttatgaaaacttctgtcaggctggtaaagactttgaccatcgcctgaatgaactgggtgcacaacgattactggagcgtattgatgccgatgtggaatatcaagagcaggcagcacagtggcgtcaacaaataacggaagttttaaaacagcgcctgccagcccagacacaagctggcatcactgtcaatcaagtgggttctgtcagtgaaatcattttcagcccttataccaaagacgcaccactgaccgcttcgttattgaccaaccaaagaataacaggacgcggttcagacaaagatgttcgccatattgaaattgatctggggaattccggcctgcattatcagcccggagatgcgctgggtgtctggtttgaaaatgatccggcactggtggatgaattgattgaattgctttggctgacaggatctgagctggttaatgtgcacggaaaatcactgccactgcgtcaggcgctgatcagccatgttgagctgacccagaatacggggttaattgttgagaaatatgcggtattggcgaaagatcaaaaacttctcgctttaattgctgacaaacaggcattacaacagtacgcacaaaaaacgcctattgtggatatggtcagacaagcggccttacatccagaagcccagcaatttatcgacttactgcgttccttgacaccgcgtctctattccatctcctcctcacaggctgaagttgaaaatgaagtacatgttacggttggggtggtccgctatgaaatagaagggcgtgcccgtacgggtggcgcatcgggttatctggcagatcgattgcaggaagacgacaacatccgcatctttatcgaacataacgataacttccgcttacccgctaatcctcagacacctgtcattatgattgggccgggtacgggcgttgcaccgtttcgagcatttctgcaacagcgtgacaatcagggggctgaaggcaaaaactggttgttctttggtaatccacatttcgttgaagattttctctatcaggttgaattccagcgctatgccaaagatggcttgctgacccgcattgacttggcatggtcacgggatcaacaacataaaatctatgtacaggacaaactgcgtgagcaggggaaagaaatctggcgctggattcagaatggtgcacatttgtatgtctgtggtgacgccaaccgtatggccaaagatgtggagcaggcattgctggatatcatttcacaacagggtgacatggatgctgaacaggctgatgaattcttgagtgaactgcgccttgagcgccgttatcagagggatgtttactaa

SEQ ID NO: 5150 - DNA, 1731 bp, Xenorhabdus bovienii
  Coding DNA location: Contig name=SeqID_16906; Position on contig =9049..10779bp; Strand=+
atgaataatgaaaaaaaaggtcttttgaaggttgaaggtaaactcgctgacagtgaacgcatgaaatcagatagcgactatttgcggggaacgatcagcgaagatttaaacaatgggctgacaggcggatttgagggggataactttctcctgatccgtttccacggcatgtatcaacaggatgatcgtgacatcagagcggagcgggcggaacaaaaacttgaaccacgtcacgccatgatgctgcgttgtcgcttgccgggaggcatcatcacccccagtcaatggctgggtattgatcagtttgcgacagaagacaccctatacggcagcatccggttgactaaccgacaaacgttccagtttcatggcattttgaaaaacaacctcaaacccgcgcatcagttgctggcaaaaatggggctggattcattggcaacggctaacgacgtcaaccgtaacgtactttgcacatcaaatccggtgcagtcggctttgcaccagcaggcttatgaatgggcgaaaaaaatatcggaacacttactgccacgcacgagcgcttatgccgaaatctggctggataaagaaaaagtagcgactaccgatgaagagcctattcttgggtcaacttatctgcctagaaaattcaaaacatcagtggttatcccgccacaaaatgatgtcgatctccatgccaatgacctgaattttatcgccattgcagagaatgaccaattgatcggctttaacgtgctggtgggtggcggattagccatgacccacggtgataagaacacttttcctcgtctggcgagtgagtttggctttattccactggaacacacattgtcgattgcggaagccgtggtgacaacacagcgtgattggggcaaccggactgaacgaaaaaatgccaagaccaaatatacccttgaacgagtgggtgtcgaaaccttcaaacaggaagtggaaaaacgggcaggagtgcactttgaggccattcgtccgtatgaatttacggggcgcggcgatcaaattggctggttgaaaggcattgatgatcaatggcacctgactttgtttattgagaatggtcgtctgttggattaccccaacaaaccgataaaaacggggatcgcggaaattgcgaaaatccacaaaggtgatttccgtctgacggccaatcaaaacctgattgtggcgggagtacccgaaagcgaaaaagcacgcattgaagaaatcgcccgcacacacggtctgatagacaatagcgtgacattcctgcgtcaccattccatggcatgcgtttcatttccgacttgcccgctggcaatggcggaagctgaacgttttttgccggcatttgtcgatcatgtcgatgcattaatggaaaaacacggtgtttctgacgaacatatcgttctgcgtgtgacgggctgtccgaatggatgcggcagagcgatgctggcagaaatagggctggtaggtaaagctcaggatcgctataaccttcacctcggtggaaaccgggttggcagccgaattcctcgcatgtacagggagaatatcacttcagcagagatcctggtgatattggatgaattgattggtcgttggtcagcggaacgtaatacccatgaatgctttggggatttcctggttcgtaccgacatcatcaaacctgtcctgaactcagcccttgatttttacgactggcaggaggcgttatga

SEQ ID NO: 5151 - DNA, 735 bp, Xenorhabdus bovienii
  Coding DNA location: Contig name=SeqID_16906; Position on contig =10776..11510bp; Strand=+
atgagccagcttcatttagcagaattgctggcattgaaccacgggcagcgcgccgaagcattggctgacatcaatcaacaactggaattgctagatgcccgccagcgcgttagctgggcattggaacacttatctggcgaattcgtgctttcttccagttttggtattcaggctgccgtctgcctgcatttggtgacacgggaatatcaggatattcccgtgatcctcactgataccggttatttgttccccgaaacttaccaatttattgataagctgactgacaaactgaaactgaacttgacagttttccgggcagaacattctcctgcctggcaggaatcgcgttatggcaaattgtgggaacagggaatagaaggcattgagcggtataaccagatcaacaaagttgatccgatgaaccgtgcattgaaattactgcatgcacaaagctggtttgcagggttacgccgccagcaatcggaaagccgcgctaatttacctgtgctggcagttcagcgcgatgttttcaaaatcctgcctattgttgattgggataatcgccgagtgcatcaatatttggcgcagcagggtcttgaataccatccgctgtgggagcagggctacctctcggtaggggatacccatacaactcaaaagtggcagacgggcatgagcgaagagcaaacccgcttttttggcttaaaacgtgagtgtggtttgcacgaaagttaa

SEQ ID NO: 5152 - DNA, 1461 bp, Xenorhabdus bovienii
  Coding DNA location: Contig name=SeqID_16906; Position on contig =11762..13222bp; Strand=+
gtggactatttacccttatttgttgagttaaaatcccgacccgtattgctggtcggaggtggagaggtggcttctcgtaaggcaagcctgttgctgcgtgcgggtgctgcgttaacgatagtcgcccctgaattgcattttgagctgcaacaacgctatcaaaaagcggaatttgcatgggagcagggcgggtttcggacagaatatctcgatggcgtatttttagtgattgccgcgacggatgaccacgatttgaaccagcacatttttactgaggccaatgcccgcgctattttagtcaatgtggtggatgatcaaccgctttgttctgctattttcccctcaattattgatcgttccccgattatggtagcgatttcatccgcaggaaaatccccagtgctgacgaaattgctgcgagaaaaactggaatctctactgccttttcatcttggcatcatggccgagattgcagggcgctggcgtgagcgcgtgaaacagcgcctgacctccatacgccagcggcgccacttttgggaaaaagccttgaatgggcgttttgccacattggtagccaatgggcaattacagcaggcagaagcacaactcgatgaacaattgatcgatgaacaacgggtcaatgaacaactcgcatcagccggcaaacagggtgaattggctttagtaggggctgggccgggcgatccggggttattgaccttaaaaggtttacaagtgattcagcaggctgacgttgtgctttatgaccatctggtcagtgcagagattctggaattggtacgccgcgatgcagatcaaatctgtgttggcaaaagggcagggaatcactcagtggctcaggaagagactaatgcattaatcattaaactgtcgcgtcagggtaaaaaagtggttcgtttgaaagggggcgatccattcattttcggtcgcggtggagaggaattgcaggctgccgctgaagcggggattacctttcaggtagtacccggtattaccgcggcggtgggcgctgctgcttatgccggtattccactgacacacagagagcactcccaaagtgtcacctttattacagggcactgccgtgaaaatggcgatgaactggattggcctgcattggcgcggggcaatcaaacactggcaatttacatgggtatcataaaagccgcccttatcagccagaaattgatttcacatggacgagatgccaataccccagtagctgtgatcggctgcggaactcgtccagaacagcaggtgctgaccggaaccttgtccgagctggaacggttagcacagaaagcaccatcgcctgcattgctggtggtgggagaggtggctcaactccaccaccagatagcatggttcgggcaacagtctgttgatcaaaaacaatctgttgctcaaataagtcgccctgctgttattgatctcgtataa

SEQ ID NO: 5153 - DNA, 909 bp, Xenorhabdus bovienii
  Coding DNA location: Contig name=SeqID_16906; Position on contig =13233..14141bp; Strand=+
atggacgaaaaaaaactgacacacttgcagcaactcgaagctgaaagcatccatattattcgcgaagtggctgccgaatttgccaatcccgtcatgctttattctattggtaaagattcctcggtgatgctgcatctcgcgcgcaaggcgttttatcccgggaaactgccctttcccttgctgcacgttgatacgggatggaaattccgtgaaatgtatgacttccgtgatcatacagcggaaaaatacggctttgaattgctggtttatcgtaacccacaaggtgaagcactgggaattaacccctttatccatggcagtgcaaaacacaccgacatcatgaaaacggaagggctgaaacaggctctggataaatatcgatttgatgcggcatttggtggggcaaggcgtgatgaagaaaaatcccgggccaaagagcgcatctactcattccgtgatcgttcccatcgttgggaccccaagaaccagcgtccagaactctggcgtaactataacggccagatcaacaaaggggaaagcatccgcgtattcccgttatccaactggactgaattggatatctggcaatacatctatctggagcagatagacatcgtccccctttacttcgccaaaccccgtccggtcattcagcgtgatggtgcattgattatggttgacgacgctcgtatcgatctgaaatcaggtgaagtcatcagccagcgaaaagttcgcttcagaacacttggctgttggccactgactggcgctgtggaatcagaagccgaaacgctgccggaaatcatagaagaaatgttgatatcgacaaccagtgagcggcagggacggcttatcgacagtgatcagtccggttcgatggagttgaaaaaacgtcagggttatttttga

SEQ ID NO: 5154 - DNA, 1443 bp, Xenorhabdus bovienii
  Coding DNA location: Contig name=SeqID_16906; Position on contig =14153..15595bp; Strand=+
atgcccgcacttgcacacaatgaaaccatcgccagccagatcaaacagcagggtggggtggaagcctacctgcggatacagcaggaaaagggactactgcgttttttgacctgcggtagcgtagatgatggcaaaagcacattaattggccgcctactgcacgatacccgccaaatttatgaagatcagcttgcgacattacaaaacgacagcaaacggctgggaacacaaggtgagaaactggatctggcgttattggtggatggtcttgccgccgagcgggaacaaggtatcaccattgacgtggcataccgttatttctccacggaaaaacgcaaattcatcatcgcggatacaccggggcatgagcagtatacccgtaatatggcaacgggagcttcaaccagcgatctttccattttactgatcgatgcgcgaaaaggcgtgcaggagcagacacgtcgacacagttttatcagtaccctgttgggcattcgtcacttggtcgtggcggtgaataaaatggatctggtggattatcgacaggatatttatgaacagatcaaacaggattattgggattttgccggccaattaccgactgacctgcacatttatttcgtacctatctcggcgctggagggggacaatatcgtcagtcgcagcgaaaaaatggcatggcatacaggggaaactttactggatactcttgaaaccgttgatgtgaagaaaaaagcaatggatcagcccctgcgttttccggtgcaatatgtcaatcgccctgatctcgattttcgcgggtacagtggcacactgtcatcgggtattttacgtcaaggccagcaaatcaaagtcatgccctcaggtgtgatttccaccatagaacggattgtaacttttgacggagatctgccattttctgtacctggtgaggcgatcaccgtcgtgttgaaagatgaaattgatatcagccgtggtgacctgctgattgccgttgaagatcacatgaccgtagcacgtcatgcattggtggatgtcgtatggatgtctgagcagccgctgatccaggggcaaagcctggatatcaaggttgctggcaaaaaaagccgtgggaaagtcgataatgttcaatatcaggtggatatcaccaacttgacgcaaaaagtggcggttgaattgcccctgaatgccattgggctggtggaattctcatttgatgagccactgctgatcgatagttacccgcaaaacgccgacaccggcggcatcatcctgattgatcgtctgaccaatgtgactgtcggtgcgggtctggtacgtgaaattcaaaccgaagtttacgaagagccgaaggagtacagcgagtttgaactggaattcaatcgattggttcgccgtcattttccacactggggtgcgcgtgatttactgggaggtaaataa

SEQ ID NO: 5155 - DNA, 618 bp, Xenorhabdus bovienii
  Coding DNA location: Contig name=SeqID_16906; Position on contig =15596..16213bp; Strand=+
gtgtctcagatcaaggaacacacgtcttccaatgttgtttggcattcacatacgttggacagaaagcaaagggaagcggtgaatggccatcctgctttagtcatctggttcaccggattgtctggttcagggaaatctacgattgcaggcgcactggaacaggcactgttttcgcggggaatcagaacctatttattggatggggataatctgcgtcatggcttgtgcagcgatttgggattttctgaaactgaacgacgagagaatatccggcgtatcggagaagtctcaaaattgatggttgatgctgggctagtagtcttaacggcgtttatttctcctcatagagctgaacggcaaaaactacgtgaattgatgggggaagatcgatttattgaagtctttgtggatacgccgttggcgatatgtgaagcccgtgatccgaaaggcttgtataaaaaagcgcgagcaggggagctgattaacttcacgggcattgattcagcttacgaggtgccagaacagcccgacatctatttagatggctcactgcctgttgaatcattgatagaaaaattgcttgctgcgctgcacaaccacggctttctgcctatttga

SEQ ID NO: 5156 - DNA, 321 bp, Xenorhabdus bovienii
  Coding DNA location: Contig name=SeqID_16906; Position on contig =16369..16689bp; Strand=+
atgggcaaactaacgctactattattggttttactcggctggttacagtactcgctgtggttcggcaaaaatggtattcacgattatgtgtgggttaaagatgaggttgccaggcggaatagcgctgatattacccttagggcgcgcaacaaccagctatttgctgaaattaaagatctgaaaaaaggtcaagaagcgattgaagaacgtgctcgtaatgaattgggtatgattaagccgggagaatctttttaccgtctggtgcctgatacctctaaacacaatgcgcaacaatctttgaaagaaaatagtaaacaataa

SEQ ID NO: 5157 - DNA, 780 bp, Xenorhabdus bovienii
  Coding DNA location: Contig name=SeqID_16906; Position on contig =16695..17474bp; Strand=+
atgaataacccaatatttcattctcctgctgatacttctcttgctgatattgtcgcattgatccctgctgcggggatcggtagccggatgaaatcagattgcccaaaacaatacctcccgcttgctggtaaaaccattattgaacatacattgacagcattacttgaacatccccgcatacagcgagtcattgttgcgctgaactctgctgataatcaattcgggcggcttgcgattgcctctgacccacgaataaccacagtggtgggaggatcggagcgggctgattcggtactggcagggctggattatctggcgagcctttcgacagacagttcagtttgggttttggtacatgatgctgcccgcccttgcttacatcgtgatgatctcgataatctgctacagctcatcaatagaagtgcaccgtctccggctgtctgtggcgggcttctggctgctcctgtcagggacaccatgaagcgcatggtgatgccatccgaggaagaaccatccaccattgattataccgttgatcgcagaggcctctggcatgctctgaccccgcagttatttcccttacagctattacgtgactgcctggcaaaagcgcttgcagaacaagcgtgtatcacggacgaatcttcggcactggaatattgtggctatcaccctgtgctggtacatggacgggcagacaatataaaagtcactcagccggaagatctggcattggcggagttttacctctcccgaaaatcaaaggaacatatcgtatga

SEQ ID NO: 5158 - DNA, 474 bp, Xenorhabdus bovienii
  Coding DNA location: Contig name=SeqID_16906; Position on contig =17471..17944bp; Strand=+
atgagaattggacacggttttgatgtgcataaatttggcggagaagggcctctggtcatcggtggtgttagcattccttatgaacaagggctgatcgcccattccgacggtgatgtggccctgcatgcggctacggatgctttattgggtgcggcggcactgggagatatcggtaaactgtttccagataccgatccggcctttaaaggtgcggatagccgtgaactgctgaaggaagcctatcgccgtatccgtaaaaaaggctatcggattggtaatcttgacatcaccattattgctcaagcgccgaaaatgctgccgcatattcctcagatgcgggtcaatctggcagaagatcttgaatgccatatggatgatattaacgttaaggcaacaacgactgaaaaactgggatttgttggccgtaaagaaggtattgcctgcgaagccgtggctttgctggtgaaggaataa

SEQ ID NO: 5159 - DNA, 1050 bp, Xenorhabdus bovienii
  Coding DNA location: Contig name=SeqID_16906; Position on contig =17947..18996bp; Strand=+
atgacattaagtgaattacactggctttatgggcagccagaagcgactggcgtagttaaagcctcaccagaagattttattgttcgtgaagatttaggattttctcctgatggagaaggcgaacatttaatgatacatatccgcaagataggatgtaacacccagtttgttgctgattaccttgctcgttttgccaaaataccggcgcgctctgtcagttacgcgggattaaaagaccgtaacgcagtcacagaacagtggttttgcgtgcatctgccaggaaaacaagatccggatttaactgcgttccagctggaaggatgtgaagttttgaccacttctcgccaaaaacgcaaactacggattggtgccttgaagggtaatgatttcactcttgtattgaggcaaatttctgacaggcaatctgtggaaaaacgcttgcagcagattgcacagacaggtgtgccgaattattttggcgaacaacgttttgggcgggatgggcaaaatcttgttcaggcacagcgctgggcggataatgaaatccaagtcaaggaacgcagccgccgcagtttttacctttctgccagccgtagtgccatgtttaataccattgccagtctgcggatcgctcaggatacgcaccagcaggtattgaacggggatgccttacagctaacgggacgcggtagctggtttgttgcagatgaacttgaactgcctgtattacagcaacgaatcatggatggtgaattgcagataacagcacctttgcctggcgacaaagcgctgggtactcagcatcaagcattggatttcgaacagcattgcctgttagattacgcatcactatggtcattggtcaaacgtgaacgcgtggaaagtgtgcgtagggcaatcttggtgcaaccactcaacctgaactgggaatggttggatgagcaaactgtcaccctccatttctcactgccatcaggcagttttgcaaccagtgtcgtcagagaacttatcaatcaggatcaaaataatgctgcggatattgctcagtaa

SEQ ID NO: 5160 - DNA, 1203 bp, Xenorhabdus bovienii
  Coding DNA location: Contig name=SeqID_16906; Position on contig =19161..20363bp; Strand=+
atgccattaactgataccaaaatcaaaaatgccaaaccaaaagataagccctataacttgcctgatggcaatgggctatatcttgagattagacctactggcgctaagttctggagatatcgtttttggttaacgccaactaaagacagtcgatacactattggggagtatccgtatattggtctggctgatgccagaaaagagcgcgattgggcaaaagagcaggtaaaaaagggattcaacccaacagaggttaggaagcaagaaaagtacttggttgaaattgagagggagaatactttcaggtctatcgctttggagtggataagtaaaaaagcccctaactgggaaagcggaacgcttgaacaggtaaaaatgttcttggataaaaattgctatccagcatttggtgataaacccatcaaagaagttagcgcccatgacatcttgaaagtcttgaaatcaatggaggcgagaggatcggcttcatcagcgttaaaaattagacaatggtgttccgccattttctgttatgcagtgtcaacactcagggctgaatatgatccggccgcagccttgaaaggtgcaattattcgccccaagacacagcattcacgctgtcttcctaacgaggaaattaagctctatttcgacaggctggaaaaagctagggtctattctcaaacaaaactagcgctaggattgttgccgtttgtatttgttcgccaaactgagttaaggcaagcaacttgggatgagattgacttcgataaccagatatgggttataaaagctgaacgaatgaaaatgaaacgagctcatagcgtcccgttgactgatcggatgttggaatgctttagaaggctcgaagttctgtttggtgataatgagcagggattgattttccccggcattaatactcccagtaagcccattggagagagtacattaaacagggctattgaatacatgggttttggttctaagtacataacatgccatgactttcgcgcaactgcatcaacaaccctttatgaaatgggattcaggcgcgaagtcatagaaaagcagttagcgcatgctgaacaaaatagatccgttgctgcatataaccatgccgagtatctaaatgaaaggcgggaaatgatggaagcatgggagaggcacttgttaagcattacaagtggcatcattctttcgtga

SEQ ID NO: 5161 - DNA, 249 bp, Xenorhabdus bovienii
  Coding DNA location: Contig name=SeqID_16906; Position on contig =20331..20579bp; Strand=-
atgtgcggattattcggaaggagattaagaatggataatttattaaacagaaagcaagtttgtaatgttctgtcactcagcagggcaaccctatacagaaaaattaaaaatggattaataccaaagccgctcaaggatggccgcagttcaaaatggaaagagagtgacttacagccttatatcaactctcttgatcgtggatttagcgccaagatatcacgaaagaatgatgccacttgtaatgcttaa

SEQ ID NO: 5162 - DNA, 219 bp, Xenorhabdus bovienii
  Coding DNA location: Contig name=SeqID_16906; Position on contig =20542..20760bp; Strand=-
atgaatacacagaacgaattcgagaacggaagacgacaggtggcaaaggagtgcctgaaagaactcaacaacctaccccaatatgacgacaaagcagtagccgcaattctcgataagtacacacccaaattcaaaccactcaaccacatgaggttcagcgctaaatcagtgctgggatattatgtgcggattattcggaaggagattaagaatggataa

SEQ ID NO: 5163 - DNA, 186 bp, Xenorhabdus bovienii; identical to SEQ ID NO: 1440
  Coding DNA location: Contig name=SeqID_16906; Position on contig =20845..21030bp; Strand=-

SEQ ID NO: 5164 - DNA, 582 bp, Xenorhabdus bovienii; identical to SEQ ID NO: 1446
  Coding DNA location: Contig name=SeqID_16906; Position on contig =21027..21608bp; Strand=-

SEQ ID NO: 5165 - DNA, 225 bp, Xenorhabdus bovienii
  Coding DNA location: Contig name=SeqID_16906; Position on contig =21611..21835bp; Strand=-
atgaagaataaattggaagatttgaataaccatttgttcgctcaattagagcgactatctgacgaaaatattctgaatgaacaattggaaaaagaatttcgccgttcaaaatctatttcagacattgccatccagatagttaacaatgggaaactggcacttgatgttaaaaaagccatcggtaatcaagacgtagattctctacctaaatttctaggtgggtaa

SEQ ID NO: 5166 - DNA, 540 bp, Xenorhabdus bovienii
  Coding DNA location: Contig name=SeqID_16906; Position on contig =21832..22371bp; Strand=-
atgaaaactgattacggaggcagtaacacacccaaagaactgaaagacctctggcaaactccactcccgttatttctggcactcgatttagaattcaaattcaaactagatgccgctgccgatgctcaaaataccctgtgcgcccactatctcacggaacgagataacgcattggaatctgattgggagagttacggctctattttctgtaatccaccctattccaagattacgccgtggataaagaaagcaaccatcgaatgtaggaagcaatgccagtctattgtgatgctcgtccccaatgatacctcagtaggctggtttaaattggcaatggagagtgtagatgagactagattaataacgggtggcaggattcagtttgtgccagcaggagtgagaggaaagaatagcagcaatccgaaaggctccatgcttttaatttggcggccatttattaccccacgcaaaacaataaccacggtagataaagaatatctattcgatattggcaatgaaaaattgaggaaaatagcatga

SEQ ID NO: 5167 - DNA, 381 bp, Xenorhabdus bovienii
  Coding DNA location: Contig name=SeqID_16906; Position on contig =22361..22741bp; Strand=-
atgagcgggagaataggaaaaatggactatagcgaattatcagatttcgaaattaataaattggtagctgaaaaatatttatcatgtgaatatagatttaatgacgagctgcaatatattgaattgcttttcgattatcctcatcgcgaattcagaaaaggaatagaaatgcgaaaggaggtacttggcatttacgacccatgcaataaatcatctcaggcaatgccaattattatcaaatatggaataagtcttctatttcgggatagaaaatttcactatgcaagtaatgatggtgaaatggagtgctttctcgataatccatataaggcagcgatggttatatttttgcacatgaaggacaaggagaatgaaaactga

SEQ ID NO: 5168 - DNA, 195 bp, Xenorhabdus bovienii
  Coding DNA location: Contig name=SeqID_16906; Position on contig =22710..22904bp; Strand=-
atggatattatcgacacagctaacgatgccgttgagttgacggtatctcatgcgctccagaaccggaaaccaccattaaccagcatcaacgggatgtgccgatggtgtgagactgagccagcaaaatacggtgcattctgtagtcgggagtgcggggaggattatgagcgggagaataggaaaaatggactatag

SEQ ID NO: 5169 - DNA, 255 bp, Xenorhabdus bovienii
  Coding DNA location: Contig name=SeqID_16906; Position on contig =22914..23168bp; Strand=-
atgagcaataacttgattgagaaaataaacacaacattggaatcagccgagaaactcaaatcggaaggtgccagtataataacattagatttggatgtctatattacaatattaaaacgtctggccgaatatgaaaatatggagccaattgccatatataatttagctgatggtgagatttataaaagcattaatgatataggcgatggtaaaagcgtattcgcagtaaatctatacccccaccccaacaaatag

SEQ ID NO: 5170 - DNA, 432 bp, Xenorhabdus bovienii
  Coding DNA location: Contig name=SeqID_16906; Position on contig =23165..23596bp; Strand=-
atgcagttcaccccatggaaccccaatcctaaagcagcacagagggtcaatgacccgctccccgttcccacccaatgccgacattgccgcagtcacgtaaagatagcccatcacacggaggtgcttgggaagacccggcatgacgacaaatggccgtggttctatgtctgctggtcatgtgatgcacgtgtcggtatgcatccagaaaccaatattccattgggatatctggctgatgaaccgacacggatggcgaggcggaatggcaagcaggaatttgagcagatgcgaaagagagggaattttgaacgcacggaggcgtaccgatggctggcatggaggctggggattagtttcaggaaatgtcatttcggttggtttaatgccgagatgtgccaacgggcaaccaatatatgcagggggtttaaatga

SEQ ID NO: 5171 - DNA, 489 bp, Xenorhabdus bovienii
  Coding DNA location: Contig name=SeqID_16906; Position on contig =23699..24187bp; Strand=-
atggcacaacgcggagttaacaaggtcattctgatcggcaacttaggccaagaccccgaagtaagatacctgcctaatggcggcgcagtcgccaatatcaccctagccacatcggaacagtggcgggataaacaatcgggtgagatgagagagaaaaccgaatggcacagggttgtgatattcgggaagctggcagaagttgcgggtgaatacctgcgcaaaggctctcaggtctatatcgaaggtgctttacagactcgcaaatggcaggatcaacaaggacaggacagatacacaacggaagtgtcggtaaatgttggcggaaccatgcagatgttaaatagtagacagggaagtcagcaaggacagcaaccccagcagcattcaggacagcaacaatctcaattttggggagcgccacagcaaccaccgggacagcagcaacaatcaccgccgccaatagattttgacgatgacgtgccattctag

SEQ ID NO: 5172 - DNA, 882 bp, Xenorhabdus bovienii
  Coding DNA location: Contig name=SeqID_16906; Position on contig =24188..25069bp; Strand=-
atgaaatttgctaaggccatgagaaagcaagctaaattaagactggcgctaactggccccagcggttcagggaaaacctatggggcattaactatcgctaaaggactgggcggaacaacagcggtcattgatacagagaaaggaagtgcttctctctactcagatagatttaattttgacgtactggagttagacccaccttttacaccggaacgattcattgaagccatcaccgcagcacaggcagccggatacgataatctcatcatcgatagtattactcatgaatggaatggcacaggcggttgtctggagatgctggatggagtggctaaggcaaaatatcacgggaatacgtggtcagcatggagcgacatcacgccgcgtcataataaatttctggatgcgatattgcgttcagacgtgaacattattgccaccatgcgcagtaaaacggaaacggcacaggtcgataagggcaacgggaaaaagcgcgttgataagctgggaatgaaatccgagcagcgtgacggtgttgaatatgagttcacgacggttctggacttgaatcatgagactcacaccgcgacagccagcaaggacaggacaggattgttcagtaatgccgatttcaccgtcattgatgagggtacaggtaaacgattaatggattggttgaatgatggaaggagcaaagcggagattgatctaactcactttacagagagcgcaggaaaagcacagaacatggatgaacttaaagccgccttcgctgaggcttataaatcccttaggggcacgccagagcaaggggaagcgcaggaaaaatatgaactcaggaaatcagagtttgaaccaattgaaccaaaggaggtggcataa

SEQ ID NO: 5173 - DNA, 342 bp, Xenorhabdus bovienii
  Coding DNA location: Contig name=SeqID_16906; Position on contig =25072..25413bp; Strand=-
atgaccagcaatcactggcgctcatatggctgtttcgtgccgaaagacccgatagagaagaagcgatacctcaaggaattggtcttcgcaacaatgataaataacaccccacaccccgcaagtaaaaaattgtcggaacgagttcgtgaagagcgggcgggacaagccaaccacgaagccgcattaaatcaccccccgctaccccggcacatggcagagcaacgcgctaaattagagcgtcaggcgtggcgggattattacgcaactcatcacatagaatatgaccattataagggtcattcaccgacccgccgtcatggtggtatctggacaggagattaa

SEQ ID NO: 5174 - DNA, 207 bp, Xenorhabdus bovienii
  Coding DNA location: Contig name=SeqID_16906; Position on contig =25389..25595bp; Strand=+
atgagcgccagtgattgctggtcatgtgaaatcccccgcgaaatcctgagcactgacggacaatccctccatacccaacacctcccgcttatattccagttcctcgtgctcggctatttgttcatccgtgtatttccgtttatgttgctcatcctgagcgtcataggggctgtagtcgtatctcatacgacctcccgttcatcctga

SEQ ID NO: 5175 - DNA, 207 bp, Xenorhabdus bovienii
  Coding DNA location: Contig name=SeqID_16906; Position on contig =25571..25777bp; Strand=-
atggcagcaaaattttatatcaatgatggccgattcaaaactgagcctgacggacgaggcggaaccgtaatcatcgttgatgattataccaaatggcaagtagagggcgaaggcaaggaaatcatgcgcaattccattggcttagagcgcgaggatattatttcgattctcaatgaccattatcaggatgaacgggaggtcgtatga

SEQ ID NO: 5176 - DNA, 123 bp, Xenorhabdus bovienii
  Coding DNA location: Contig name=SeqID_16906; Position on contig =25780..25902bp; Strand=-
atgcaaatcaacaaacgtcttctatgtcaggcgcaagaactggcactggaagctgttcgcctgcgctctagagacgtttggcggtcggctatgaaaatactcaaacgcagttatgggaggtaa

SEQ ID NO: 5177 - DNA, 942 bp, Xenorhabdus bovienii
  Coding DNA location: Contig name=SeqID_16906; Position on contig =25934..26875bp; Strand=-
atggcaaatgaattagtcattatcgaacccgcaacggcgctggatttattcacggcacctgacaaggttcaggtgcttatatccggcatcaaagataaggcgtatgcagagcaatccgaactcgataccgatttatcaaaagcaaagaaccgagacgcaatcaaatcactggcctacaaggtaacgcagacaaaaacctacatcgacaaagcggggaaagctgtcgttgatgaattgaaatccctgccgaaaaaagtggatgccaaccgcaagcaatttcgcgatgaactcgacgtgctgagcgatgaaatccgcaagccggtcactgagtgggaagatgcggaaaaggcgcgtgtagcagcagaggaattagcccggcaaatcgaacgtgatcacgacgaagcgttgcagatgaacgagctgtatgacctccgcaaagccgaagaagaacgcaagcgcatcgagcacgaaaacgaaatcaagcgtcaggcagctgaacaggcgcgaatcgaagctgaacaaaaagcacagcgcgaacgtgaagccgcagaactgaaagccaaacaggaacgtgaggcagcagagttaaaagcgcgacaggaagtcgaggctgcgactaagcgtgaacgagaagccagagaagcacaggaacgtgcagaacgcgaaaaacaggaagctatcgcgaaagctgaacgtgaaaaactggcagcgattgaagcggaacgtcgtaaggctgaggaagctgaaaaagcacggctggcagaaattgagcgccagaagcaggaagcagccaatcgtcaggcagatacattgcatcggtcagcagtcaataatcaggccatgcaggatttaatcatcgcgggtatccctgaagaatgcgccaaggcttgcgtaatcgctatcgctaaaggatcagtgacaaacatcaaaatcacatactaa

SEQ ID NO: 5178 - DNA, 399 bp, Xenorhabdus bovienii
  Coding DNA location: Contig name=SeqID_16906; Position on contig =26962..27360bp; Strand=-
atgtctaaaccacatgtacacgctgatttaatgatgaaagcggttggaatagcacaggaaaatgagaaatggtgggaatatttcgaggtgttgcatgacgatgctgatagatggctgtcgctggctggcgaattctattttgatcctgataaagaataccgcctaaaacccagaactgtaaaaataggttcggtcgatgtaccggaacccgtgagggagccgttggaagaaggacaggactattattttctggatttgggtggtgaaagttattatgacgaaaccttttggttgggggatctggatgatgtcgataggttaaatcgctgcctaatccacctcgaccgcgaatccgccgaaatacatgccaaagccctcatcagtctgacccagaaataa

SEQ ID NO: 5179 - DNA, 216 bp, Xenorhabdus bovienii
  Coding DNA location: Contig name=SeqID_16906; Position on contig =27360..27575bp; Strand=-
atgtctgaaataacgctgacaattaagcaaatacaggatgtttgtgatatggctggtatatcatatgaaaaggttgaagaaagtagattaagtgaagaattcactatatgtgaaaatctaccaatggaagatatacacgggaggccttacaaaggaaaaggtgtttactgcactgattatccagaagatggtgcaatgtcattggaggatagataa

SEQ ID NO: 5180 - DNA, 225 bp, Xenorhabdus bovienii
  Coding DNA location: Contig name=SeqID_16906; Position on contig =27472..27696bp; Strand=+
gtgaattcttcacttaatctactttcttcaaccttttcatatgatataccagccatatcacaaacatcctgtatttgcttaattgtcagcgttatttcagacatcgttattctcctgtcggtggttgaggcatcggcatccagtgggttacgtattcatgaaataacttccaatgatcgccacttccgttatgaaagaaataatcatcacctactctattattaa

SEQ ID NO: 5181 - DNA, 279 bp, Xenorhabdus bovienii
  Coding DNA location: Contig name=SeqID_16906; Position on contig =27775..28053bp; Strand=-
atgcggggctttttattacctgaatataggaaaatgaaaatgagtgagaaaataaaaattcatgtagatgcattcgctaaagttcattacagccaagaattagaaattcttaaaacagagtttgaccgtatgctggaaatagaaaactccgatatgagaaatcatgaaattgatagggctttagaagatatcattcatagaaatggattttttcgtgaaaaagcttgggttgatgaagatagcttagaagatattgaatttacggctctggatgaataa

SEQ ID NO: 5182 - DNA, 207 bp, Xenorhabdus bovienii
  Coding DNA location: Contig name=SeqID_16906; Position on contig =28069..28275bp; Strand=-
atggcggcaataatctcctatcttttttggggttatattgcagtattcggtctggtatttggatatatcacctttcctatagggctgctttttacattcatggcatataaaaaaacaagaagcaaaattttatattcaattttgtctgcattatttttaatcccaccaatagcagcagccattatagttaagcaattgcattcttaa

SEQ ID NO: 5183 - DNA, 240 bp, Xenorhabdus bovienii
  Coding DNA location: Contig name=SeqID_16906; Position on contig =28376..28615bp; Strand=-
atgaatgcaattactatcgaccaagtaaaatcaatttttgaagctgctggtgctatgaaatcctatgagtatttagaagaaatcactgttcattgcaataaagaagctgaatatgatttaaattattctggtaactttcctagagtgaaaaaaactgctgaacaatatgccattgagcatgcgaaagaagtggctgagtggcaacaatctaacaaaattcgccatatttattcttattag

SEQ ID NO: 5184 - DNA, 123 bp, Xenorhabdus bovienii
  Coding DNA location: Contig name=SeqID_16906; Position on contig =28678..28800bp; Strand=-
atgaaacgcgatcgtcagtctgctattcgttttcgtcatgattcatttttgcgtaaacactgtgttcaggcagcgttaaataaacgtcgttctattcgcgaattaatggctatctatggttga

SEQ ID NO: 5185 - DNA, 336 bp, Xenorhabdus bovienii
  Coding DNA location: Contig name=SeqID_16906; Position on contig =28895..29230bp; Strand=-
atgaaactcactgaattacaaaaacaaattcaccagcaaaatgttgaagccggttggtgggataaaccccgtgagcgcggaaccttactatgcctaattcattctgaaattagcgaagcaatggagggagaacgcaaaaatttgatggatgatcacctaccgcatcgacctatggcagaagcagaattagctgatgctgtcatccgtattttggattatgcagaggcatttgggtatgacatcgagggcgcgattgctgagaaattagcatacaacaggcatcgggcagaccataaacgagaaaaccgcgccaaatctggcggtaaggcattttaa

SEQ ID NO: 5186 - DNA, 276 bp, Xenorhabdus bovienii
  Coding DNA location: Contig name=SeqID_16906; Position on contig =29302..29577bp; Strand=-
atgaactcacgacaacgttataaattgagacggaagcaaaaccgcatggaagctcgggctgctgctcccagaacgactggggaaatctgggacagtattttcggtcagccggtcgatgaaattgacgcactagcaaatctgtttgcgcaactcaagacagacacgagtgacaacaacggcggatcttgctgcatgagtgacgtagctctttactcaaccaagcaaagagctagcaatcggatactggagtcaggcggggttacggcgaggggttag

SEQ ID NO: 5187 - DNA, 339 bp, Xenorhabdus bovienii
  Coding DNA location: Contig name=SeqID_16906; Position on contig =29442..29780bp; Strand=+
ttgctagtgcgtcaatttcatcgaccggctgaccgaaaatactgtcccagatttccccagtcgttctgggagcagcagcccgagcttccatgcggttttgcttccgtctcaatttataacgttgtcgtgagttcatatgtcctccgcaaattgattttggtggtgtggtggtcggtttttacttcgacaatagccacgctcaaaccccctaggattaaaatcggagtcgaaccggttgccgcagccctgttcctgagatggtctagcccatcatgtcaccacaccccaaaaccaacttgttttggcctcccagtttcaaggaggaagttaaattgttaa

SEQ ID NO: 5188 - DNA, 726 bp, Xenorhabdus bovienii
  Coding DNA location: Contig name=SeqID_16906; Position on contig =30014..30739bp; Strand=-
atgactttgaaagacagactaaaaattattctttgccaagaaaatttaaaacaaaaacaactggcggaagcattgagcgttagtgctcaaacagtaaataactggttgagcaggaacgctatcagtagagatgccgcacaaagcatcagtgaacaatttggatactcactagactggttattaaatgggatgggagatcaaaagctggaaagtgcagtaaaacaccactacgctaaatctgatgttcctccagaaaacgaatgggtaggcgtttccacatgggatagctataccccattagatgataacgaagtggaagtaccgtttttgaaagatatcgaatttgcatgcggcaatggcagtgtgattagtgttgattataacggatataagctcagattttccaaagcaacattacggcggataggcgctccaacagacggttcaacaattatctgcttccctgctaagggtgacagtatggaaccagtaataccagatggcgcggctgtagctattgatatagccaataaacacattgctgatgggaaaatttacgccattgaacaagatggacttaagaggttgaaagtcctttatcgccgtccagcgggaaaaattcttatcagaagttacaatcgcgatgagtatgaagatgaaatagccgatgaagaaaaagtgaatattatcggtaaattgttctggcactcagtcttgcattattaa

SEQ ID NO: 5189 - DNA, 117 bp, Xenorhabdus bovienii
  Coding DNA location: Contig name=SeqID_16906; Position on contig =30794..30910bp; Strand=+
atgttgattttttttattcttaagattaacattatgttgattttatacacatggagttactcatatggatttctcgcaaacaccattgcagatagctgtgaatgctgttggtggtaa

SEQ ID NO: 5190 - DNA, 207 bp, Xenorhabdus bovienii
  Coding DNA location: Contig name=SeqID_16906; Position on contig =30858..31064bp; Strand=+
atggatttctcgcaaacaccattgcagatagctgtgaatgctgttggtggtaaacagaaaacactagctaagttagtcggactgacaccgcaggcaatcagcaatctaaagaaacgaggcggtaatttaccaagaacaaaaattaccgaattccgcaaggcaacagggttgccacttgagattctttatccagagatagcggaataa

SEQ ID NO: 5191 - DNA, 348 bp, Xenorhabdus bovienii
  Coding DNA location: Contig name=SeqID_16906; Position on contig =31190..31537bp; Strand=+
atgaaacacgcaagttaccgcaaattattcagagacaaggaaagtgaattgcttaacaagatcgcgctgacaggttcacggaacgtagccaaaataattgattttcatgaatcacaaatcacgcgctggcagcgtccgcaaaaactggatgacattagcttcattgcgaaaatggctcgcgttttggttgccattgaatatgacgcgccagacacgaacgtagtgataaatcgggaggatgcgaaggcattaatagaagcacttgagtatatccgatacccaaaaagaaaaacctcgaaggcggctaccgacgaggtcttagaaatgcaacttgagataggaatttag

SEQ ID NO: 5192 - DNA, 159 bp, Xenorhabdus bovienii
  Coding DNA location: Contig name=SeqID_16906; Position on contig =31592..31750bp; Strand=-
atgcaacgttactcatggcgtttccctccggtcagttcttcgcgatgctccagccgtaatttggcatcctccagagcatcacgcagtttttcacatccctgttcggtgacagaacgagtctcccgttcgcgcgtgagatttttatgcacagcgctgtga

SEQ ID NO: 5193 - DNA, 984 bp, Xenorhabdus bovienii
  Coding DNA location: Contig name=SeqID_16906; Position on contig =31735..32718bp; Strand=+
atgagtaacgttgcatacgctgattttggtgcgaacgcgtcttcaaggagcgcacggatggaaaaccaaaaacaggggcactttgcactgttcaggagtcttctgtccagtggatgggcggatgataccgccaaattagcattatgggttaggttattggggatggctcaatacaaacccagacgcattgaatttggtggtgttgattgggatctggatacagggcaattagtaacaaaaccccggttattagccagaaagttacgagatgccaaagggaatgagaagacccctaagcaggtcagggatatgctcgaattcttttcttcggagggaatgttaacgtttagcggtaatcgacatggaacggtgatcaccatttcaaattataccgattatcagcttgatgttgaggtaacaaacaaacccaataactataagggttcaacgcaatacgaggtaacaaaacaggtagatgattttgaggtaacaaagcaggtaactaatcaggtaacaaacaaacccagtcatgacgcggatttcagcgatggtcaggtaacaaagcaggtaacaaagcaggtcaaacagagtaagaagttattagaacaagaattaaatacaccccttacccctcacgaggggaatgacggtgaggttgctaaacctaaaaagcgaaaacccactcccaaaatcaactacgacgaatacctcaatgcctacaatgaggcggttggtgacaggttgccccatgctgtagagatcaatactccgcgccagaaagcgttaaagaaattaattcccaagctgttaacgccaaatgttgacggattcggagcctatgttcgggcattcgttggtcaggctaggccgtttttctttggtgggagtgatagcggatggacggcagactttgattatttgctgagagaaaaaacattaaccggcgttcgtgaagggaaatttgcggagaaagaccatgaataa

SEQ ID NO: 5194 - DNA, 1374 bp, Xenorhabdus bovienii
  Coding DNA location: Contig name=SeqID_16906; Position on contig =32711..34084bp; Strand=+
atgaataattacgattttgaatccagtgtgattggcggattgttgattagcggtctaacacctgatgccagtgatgtattggcaacgctggagccagaggcgtttgctaccccgttctaccgagaagcattcaaaaccattcgttcacaggccaaaaccagagggttaattgattctctgatggtggctgatgcgatgggtgagaatcatttcgccaatgtcatgatgactgccaagaactgccccagtgccgctaaccttactggctatgcgaacacagtttcagccaactatgaacgcagactcatgattgagttaatggacgaggctaaggaacgcattctaagtggcacggttgagaacgcggcggagtctatggactggtttatttcccaagttgcagaggtgcgtaagccacgcgatgagatccgcccgctgcatgtttctgagttactggatgattacaccgaggttttggagaaacgtctcaaaaatggcgagcaatcagacacgttgaagacaggcattgaagagctggatgagatcaccggtggtataaacccagtcgatttggtgattgtggctgctcgccccggcatgggtaaaacagagtttgcgctgaaagtcgctgagggagtcgcaaaccagacaatcacaggaaccaaacagaaacgcggcgtactgatcttctcaatggaaatggattcccagcagattatcgaacgtcagttggctggagccgctaacctgccagtatcagttttacgaaatcctgcccgattggatgatgaaggttgggattgggttactgttggcttggggcgattacaagacttggatgtatggatcattgatgccagtaaattgacggtggagcagattgcttcaatttcacggcgtcacaagaaagtacacccggcattatctctcatcatggttgattatctggggctgattgataagccaaaggcagagcgtaatgatctggccgtggcgcatatttcttccagcttaaaacgactggcgaaagacctcaaaacgcctgttatagccctgagccaattatcccgcaatgttgaaacgcgtcccaataaacgccctgtaaacgctgacttaagagattccggtagtgttgagcaagatgcggacagcatcatcatgttgtatcgcgatgcggtgtacaatgagaattcccccgcagcgccatatgctgaaattatcgtaacaaaaaacagattcgggcaattgggtacggtttaccagcgattccgcaatgggcattttacgccgactgatcaggaagaggccgtaagagtttgccagaacaatgataacaaatcccataaacgctttgctaaaggagcaaatgtatga

SEQ ID NO: 5195 - DNA, 252 bp, Xenorhabdus bovienii
  Coding DNA location: Contig name=SeqID_16906; Position on contig =34081..34332bp; Strand=+
atgattaaggattacacagaccatctagaacggcttgataaattggtatgggttgatgaaacccacataattttaaataccgacttgggaggaacaaacaacgagtatgaaataccgctgcacgactgtgatacatcagaaaagatactgtggtggacttttcatttgtccgaaaagaattgggtaacaacagacatgttacgcagattcatcagattagcgacggtgaaagcaaaaataaaaattgactaa

SEQ ID NO: 5196 - DNA, 363 bp, Xenorhabdus bovienii
  Coding DNA location: Contig name=SeqID_16906; Position on contig =34375..34737bp; Strand=+
atgaaaatcaaaacgagtgagctgacaggtcgggcgttggactgggctgtggcactggctgatggtaggggcgttaaaattaacgagctgggttatgtttttgtcaatgataaccgctctattggtgtttattctccctcaaccgactgggcgaagtgtggggagttgattgagaagcatcatgttgaattgaattttaattcagtcagcaaagaatggccggcatacatatttagtttcgaagagcttgaatatgtacttgaagacggcgagtctcccactatcgccatctgccgcgctgtagtggctgcacagttgggcgacgagattgacatccctgatgagctggtggagggggtatga

SEQ ID NO: 5197 - DNA, 219 bp, Xenorhabdus bovienii
  Coding DNA location: Contig name=SeqID_16906; Position on contig =34749..34967bp; Strand=+
atggaaattaaaccaatttttatcaacggcgctccactgctggatggtgatttcaatccggtgcgtgtaacgaaaaatcaggcaaggaaaaaggcggggcaaatgcaatcagctatgcgtaaaaaatcatgggggaaaagcgctgtcggtattgtctgtgatgctggcgctcacttcaatgtgtcagtgggatttcctgaacctaacaaggtggtttga

SEQ ID NO: 5198 - DNA, 243 bp, Xenorhabdus bovienii
  Coding DNA location: Contig name=SeqID_16906; Position on contig =34909..35151bp; Strand=+
atgctggcgctcacttcaatgtgtcagtgggatttcctgaacctaacaaggtggtttgaaatgacagagaaaacacaggagttactgagttgcccgttttgtggtagcgacgttttgtcgataaatgggatccgtccctgtaattttgtggagtgctacggatgcggtcattcagtttatggagctgacgaacacgctgtaattcaggtgtggaaccagagggcaaataacgatgacagataa

SEQ ID NO: 5199 - DNA, 375 bp, Xenorhabdus bovienii
  Coding DNA location: Contig name=SeqID_16906; Position on contig =35141..35515bp; Strand=+
atgacagataacatcatcactctcaaatttggcgatgatagcaaacccagcattagcacctcagtgactcctaaaaccccagaacaatcccgctgcaagcacggcgcaataacagtcgatgaacaatatcgcatcatcacatgcgaccaatgcggctgcaatgtcgatgcatttgatcacttgctggaaagtgcacgtcaagccgagtgtgtggtacgagagattcaagaactataccagcggcgggatgaattgagagcagcctgtgacaatttgctaaaggaagaaaaaaacacaaaagtgaggctcaggggggcgaaaacacaactgcaatttctggaaaacgatatcaagaaggtgaataacggaggttag

SEQ ID NO: 5200 - DNA, 492 bp, Xenorhabdus bovienii
  Coding DNA location: Contig name=SeqID_16906; Position on contig =35516..36007bp; Strand=+
atgacagtcaaaacatactatctcagtaataaatccatccagcaaaacgctatcgaagccatcaagactctcccgctagaccccaagaagccctacgaaattaaactctctgaacctaagcgcactaacgctcagaatcgcaagatgtgggcgacgttgggtgatatcgcaggacaggttcaatgggatagcgagtggtacgacagcgaagactggaaagatttaattactgtgctgaacaaacaaaccaaaggcgaagcgcagcggtcagccagagggctaggcggtggcatcgtatttttcgggatgcgtaccagcaaaatgaaggtgggtgaaatagccgaggtcattgaatgtgctcactggtttggcactgataagggcgtggtattcagtgataaggctaagcaggaactggaatgggcgcagcggttcggcgataaactcaagaaggaaatggagaatgaaaaaacaggtacggcgaaaatgtaa

SEQ ID NO: 5201 - DNA, 597 bp, Xenorhabdus bovienii
  Coding DNA location: Contig name=SeqID_16906; Position on contig =35979..36575bp; Strand=+
atgaaaaaacaggtacggcgaaaatgtaaaatctgtcggggctggttccatcccaaacatgaccatgtatggtggtgtagcccggaacatggcgcagaattaggaatgcgacggcaagataagaaatacgaaaaagccagacagaagttagaacgagaacgacgacaaaaagaagtagaagcccgcgataagctcaaaaccagacgcctagcagtaaaaccccgcagttattggattcaacaagctcagcacgcagtaaacgcctacatcagagaacgagacagagacctgccgtgtgtctcctgtggcacgtacacatcgtctcagtgggatgcaggtcattaccggacgacagcagcagcgccacaactgagattcgacgagcgcaatattcaacggcagtgcattgtctgcaaccagcacaaatccggcaatctggttccgtacagggtggagctaatccggcgtattggtctggaaccggttgaggctatcgaatcgaatcatgatcgccatcgttggacgattgaggaatgtaaagccatcagggatgagtaccggcagaagctcagggagttgagacaggaggcagcatga

SEQ ID NO: 5202 - DNA, 354 bp, Xenorhabdus bovienii
  Coding DNA location: Contig name=SeqID_16906; Position on contig =36572..36925bp; Strand=+
atgacattcgacaacttcaacgaggcgatttcctatgccagaaggcggcgacgggatgagaggaagcatttcgctgttcggcaacgcaaagaccgcctttatgtcactaggttgacagactgcaagcgccctgcatggtcaacattggatgatctgcgatttgagcattacggcgtaaaaccatacccagtcgttaaattagagctgtccgataccccgctcatcatcggtttactggccgctggtctgtcacagcgtagcgtggccaataaatttgatgttacacgtggggcagtacggcgattagtcaacagagtaaaacgacaacacacagtattgccggaggtgagatag

SEQ ID NO: 5203 - DNA, 837 bp, Xenorhabdus bovienii
  Coding DNA location: Contig name=SeqID_16906; Position on contig =36927..37763bp; Strand=+
atgaatttagaatcactaccgaaatatttttcacccaaaacagctatgtttagtgactctccagccgcaaccgctactgattcatattcaattaccgatgtcatggcctcgctaggattggcgtccgctcaggcgaggatgggtattgaactgtttttggcgaaacaggggatcaataaaccagatgaatcggtggagagcctgtatcactatgcactaacgcaggttcacaaacaccctgcaatcgcaaaactcgatgaggatattaaacaaagcattctgcaaatactcgcaaattacgcatttcaggattatgcgaggagtgcagccagtaagaagccatgttcagaactgcattgtgaagatgggtttatcgaagcagaggtatttacaaccaagtggagtaaacccgcgtttctggatattccagactgggctaaagaggcacgagctataacgccggaggagtggtacagaaagcgtcaggtgcgggaggtggtgagagtggcatgtaaagcctgtagcggaaaaggtgaagtcagtcattcatgccgttgcaatgggcgcggggaggtgctggataaaaaacaaaccaaattgattggtattccagtttttaaaacctgccctaaatgctcaggccgtggatactccagactgccagccgaagatgttagacgcgctatttgtggtgaggtgatggagatgcctgagactacgtggagacgaaatttcaaaccattctatgaagcattgatagaagaatgttttaaagaagaatcacgggctgatagtgttctatcaaaactaacgaaaagagaaactatttctatataa

SEQ ID NO: 5204 - DNA, 336 bp, Xenorhabdus bovienii
  Coding DNA location: Contig name=SeqID_16906; Position on contig =38020..38355bp; Strand=+
atgaagatgaaagaaaatcctgatttctggatgcatcttggtgactggctcatatcggtaagagagcaaggcatctgggcaacccttgcagggacgatggcattttttcgcggtcgctataacggtggcggctgggtaaaggtttcaatcgacgcttttatgtgtgccatgttcgcctggttcatacgtgatgttttaaatttcatgggtctgaatcctgacttggcctacatcggcagtgtggtgattggttacttgggtacagacttcatcggtcaattgctgcgtaaggcggcagataaaagagcgggggtatcttctgatgaaaatcagtaa

SEQ ID NO: 5205 - DNA, 435 bp, Xenorhabdus bovienii
  Coding DNA location: Contig name=SeqID_16906; Position on contig =38342..38776bp; Strand=+
atgaaaatcagtaaaaacggactggaattcattcagcaatgggaaggcctgaaactgaaagcctatcctgaccctgctacgggtggtatcccgtggacgattggttatggccatacgaaagatgttaagcccgggcaagtcattaccgagcagcaggccgaagcctttttgcatgaagatttgcagcccatttacatcactctggaaacagcggttaaggtgccactgacacaaggtcagtttgatgccttatgttcgtttatcttcaattgtggcgcgggtaattttgttcgttctaccttgttcaagaaaatcaatgccggtgattacgcaggtgcagcggcagagtttccccgatggaataaagcggcgggtaaggtgatgaacggtctgactcggcgtagggcatctgagcaacagatgtttttgtcatga

SEQ ID NO: 5206 - DNA, 462 bp, Xenorhabdus bovienii
  Coding DNA location: Contig name=SeqID_16906; Position on contig =38773..39234bp; Strand=+
atgagattctacgttatctgcggtatgggaatagctctagggatcgcgctgtatattggtggttattaccgcactgagtataagaagcagctcagtatcaacggcgaccagataaccgaaattcagcaactgaccgacaccctcaactaccagaacacgcacattgatatgctgcatgagatggacaccaaacacattcgggaactcgacaatgccaaatctgaaattgacactcttcggtctgatgttgccgctggtcgtcgcaagctgcgcatccaagccgtctgtcccgtgcgtgaagccactccctccggcagcatgggcgacgcaggaaccccacaacttacagaagcagctcgacaagattattacgatctcctccgaatgatggcggagaacgaacggcagactaagtatttgcaggattacgttaatattgaatgttataaggtgaagaaatga

SEQ ID NO: 5207 - DNA, 228 bp, Xenorhabdus bovienii
  Coding DNA location: Contig name=SeqID_16906; Position on contig =39231..39458bp; Strand=+
atgagcaagctagcattaccgccgcatcaacaacgtgttattgatgaaaagaaagagttgcaggaaagaattgaaaaattatccaatttcattggtgatgcaatctattacaagctagaagaagttgaccaaattcttttggatactcagttatcagccatgaagatgtatagtgaaatactatatgagcgcgttaaacgattccgattaccacctcagagcaagtga

SEQ ID NO: 5208 - DNA, 528 bp, Xenorhabdus bovienii
  Coding DNA location: Contig name=SeqID_16906; Position on contig =39480..40007bp; Strand=-
atgtcaattgcaactattcactatagaaatttggtgattaaaaaagctggggactcagccagaaaaggaattatcttagctcatggtggttacaccccagaaagaggttttttccagccaggctctggccgtacttatgtccccttgcggattacattagtttgtaattgtcttcatggtaaagtatcaataggtcaaaaaatggcagatgccattttatatcctactcctacaaatcaaacgaattacattccggaggatatcttaggtggcagcataatccaaaattactccttaacatataacagtaaatttgaaggttatgaacccagtaaatttgtcgatgtagtgacgataaaacccaatagcaaagcacatatttcagatgtttttagtgctgtaacggcattaaatttacattatgagcgcatatacaatgtagcgtgtagaataaataagatagaccgaaattctctatcaatatccgctatcaatatgattattcaagtctcaccaatgctgccctaa

SEQ ID NO: 5209 - DNA, 585 bp, Xenorhabdus bovienii
  Coding DNA location: Contig name=SeqID_16906; Position on contig =40330..40914bp; Strand=+
atgaacacagcattaactttcaaagagcatgagatcactccgtttgataatagtgataacaagatttggttcactggtgagcatctggctgaattgctgggttacaaagacagcaagaaagtagcaaatctttatagcagacataaagatgagtttaccgagagcatgagtaccgttgccaaagtgaggacttcgaaagaatcaatggcttacgggtgtttgttatcagaggttcgcttgtattctttacgtggcgcttatcttatcggaatgttctctcggacaaaggtagccaaagaacttcgcatttggttactggatcttgctgagaaagaatccaacattgatatcggtacactggatatgactgcaataacgcagttaacagggcaaaagatgcacgatttgatagatgtttttaataaggcttctttcaaacaccgtggtcagaaaggaagcggcttaatggctcagcgcaaacaggatataaaaagaataaaggaagcgacaaaactagcattacagctcacccagttttctatccctgacctcggtgattttcccgatgaaggcgaacccgcatga

SEQ ID NO: 5210 - DNA, 216 bp, Xenorhabdus bovienii
  Coding DNA location: Contig name=SeqID_16906; Position on contig =40911..41126bp; Strand=+
atgaacaatgaacaatttatcgagaagaacgtacaggccgagttaaccaagctcggcttttcttcatctatagcaggaatggcaagtgacagagcagtagagcattaccgccgttctggttcagcgagcagaaagggtaagaagtttgaggattgcctgagtgttgctaaggcatgggcgagtaggtattcagtcgagaagcccaagaaaaaatga

SEQ ID NO: 5211 - DNA, 144 bp, Xenorhabdus bovienii
  Coding DNA location: Contig name=SeqID_16906; Position on contig =41074..41217bp; Strand=+
ttgctaaggcatgggcgagtaggtattcagtcgagaagcccaagaaaaaatgattatacaaaattctgtaaagcatccacattcgggtgcttgatagattattatttaaaaatgttcgtaaaatatgcagcatttagtatataa

SEQ ID NO: 5212 - DNA, 453 bp, Xenorhabdus bovienii
  Coding DNA location: Contig name=SeqID_16906; Position on contig =41290..41742bp; Strand=+
atgaaaaagattattgctgcgataattttctttggggtaatttttggaaacgctaatgcggccgaatttacttgtcagttaaaaaacaataaatatgtgaatgtatcagtggagcaaggaaagacacctgtttatagatatggaacattatctaaaactgaaattactttgccggtaaaattgaatgatagtaaaaatgtattttacggttatcagctacttataggtgggtcatcaacttatgtcagatttaaaaatggtgattacagctatgtcgtctatgcagggggaagtaaatattgggatttttcagggcttgttgtttataaaggcgataaaattatcaataaaaagtcctgcaaagattctgaatcgttaggtcttatagatataggtgaatatcatattcaagaagacccaatgattgaaaagtatagttcagctccaaattga

SEQ ID NO: 5213 - DNA, 525 bp, Xenorhabdus bovienii
  Coding DNA location: Contig name=SeqID_16906; Position on contig =41803..42327bp; Strand=+
atggctaaaccagattgggaggccatcgagtcggcttaccgtgaagcaggaatgcctgagttgctatatagccattttaagaaaagcggagaggcgtttctttctggcgtaattaaagttttccttgctagctctaatgcgcacataaagctatttgatggacaagtggcgccaataattcgagtagagtctgagtttccagtgccgagaggaagagttgatttcttcttagtgcatgatgatggttctgctagcgtctgtgagctgaaagatgggcgtaacggccttcaaagcgttctggctggcatcggtcaggtgatctgctattcggtgcaggttggtatgtccaattctggactgaggcatatccgtaaggttctgatgttctcacgaactaattcaatttctgatgacgctctaatcgttgaggcctgcttaaaggctggagtaatgcctgtccctattggcagtgaagatgaacacaaagaggcggcatctgccttcattgatatacacaggaaataa

SEQ ID NO: 5214 - DNA, 513 bp, Xenorhabdus bovienii
  Coding DNA location: Contig name=SeqID_16906; Position on contig =42330..42842bp; Strand=+
atggcactcactgacaaacaagaaatgttttgtcgcgagtacctcgttgatttgaacgccacacaagcggccattcgtgcggggtacagcgaaaggactgctaaccgcactgcgtctgaaaacctgtcaaaacctgatatccagtctcgaattgcagaactgaaagccgatcgcaatgaagaggttggtattaatgctacctacgtattaaagcggttggttgaaattgaccagatggatgttctcgacattctcactgatggcggtgaactgaaaccggtaaaagactggcctaaagtatggcgtacaacgctatccggtatggaagtggttgaaatgggttcacaagataccacagcgttactcaagaaaattaagtggccggataaagtgaagaacctagagctgttaggcaagcacatcagcgttcaggcattccgtgatcaggtcaagaatgaacatgatgttgtcggaacgctatccgatatgatggacgatcttgccaaggggtag

SEQ ID NO: 5215 - DNA, 1473 bp, Xenorhabdus bovienii
  Coding DNA location: Contig name=SeqID_16906; Position on contig =42845..44317bp; Strand=+
atgaagccggaacatttagcattactgcgcaacaaactctggcggctgaatcatctctattggattacggacaaagaagggaagactatccggtttaagatgacaccggaacagttagagtacttcgaaggcatgcacacccgtaacatcatccttaaagctcgccagcttgggtttactactgaggagtgcattattcagttagatacggcgctatttgaggcaggaaagtgcgcgttaattgcccatacgctgcctgatgcaaagcggttttttagagaaaaaataaagttcgcatacgataagttacccgatgaaatcaaagctgcaaacccagcaagaaacgatgcggcaggggagttggtttttgaaaaagggggatcgcttactgtatcgacatcattcaggggcggaaccttaaagaggttacatatttctgagttcggaaagatatgtgccaagaatcctgataaggcaagagagattgttacaggggctcttgaggccgttcctactgatggttgtgcaacatttgaaagtacggcggaagggcgagcgggatacttctttgattactgccagacggcagagaaagcccagctacagggcaagcagctatccaacctcgactggaagttctttttcttctcctggtggagaaatccactttatgcgattgatcctgtagagccaataccgccacgcttggttgactacttcgctgaattatcaggcaagcacggcattcagttaaatgaacgccaacaagcatggtatctcgccaaagagaagacgctcggcgatgacatgaagcgggaatacccgtcgatccccgctgaggcattccagcaatcagtcgaaggcgcgtattacgccaagcagttccgctggctgtatgaaaacaaacgcattggcaaattgccggacaactcacatctgcccgtacacaccttctgggatatcggggtgggtgactctacggctatttggttcgtgcgtgaagtcggagaagagttccacatcatcgactactacgagaactctggtgagggtttacggcattacatgaaggtgttgaaggacaaaggctatacctacggtgatcattgggggccacatgatatcgataaccgtgagtttggcgctgatgctaagtctcgacgagagctggcgcgtgaagggtacgaaatcgacggtcagaaatactcaatgatattcaaggttgtgccaaaggttggtgtggatactggcatagaatcggtgcgtgaaatcctgtccaattgcgtatttgatgaagagaagtgcagcgagggtatctctcatctggaaagctatcgcaaagaatgggatgacaagcgcggttgctggaaagataagccacttcatgacttcacatcacatggtgctgatggcttccgttattttgctgttgccaagaacaaccgtaaggctgtgggcgcatttttcttttaa

SEQ ID NO: 5216 - DNA, 1368 bp, Xenorhabdus bovienii
  Coding DNA location: Contig name=SeqID_16906; Position on contig =44384..45751bp; Strand=+
atgatctatgcggctggtggcattagcggcaatacaaaacgaaccaatatttattctgagttcggttatcccgaacagctcagatttagagagtactataacgtctatgagcgtaatgccgtagctcatgccgccgtgcatcgtttgctggatgggtgttggcaggataatccgacaattattgatggtgaagagaaaaaagaatcagacgtaaccagcgcatgggaaacgaaagttacaaagctattaaagccgttctgggcgaaaatcaaagacgctgatcgccgcaatatgattggtaactattcagcgttgctgattcaggttagggacagcaaaaactggagtgagcctgttgatgttactgtggtatcacgactaaaagttgatgcagtagttaacctgatccccgtctgggagcctcaattgactgttgctgagtgggatcaggatattcattcagatacctatgggcagccaaagatgttcaattttgatgaacgtcctgtgggtcaggttgagatgcaaggcccagcaaaacaacttcttattcatccatcacgggtgattactttgtgcgaaggtgccgaaagtggtgatattttctccggcacgccgttgctcagggcggggtataacaaattgctggatatcgaaaaggtatctggtggtagttccgagggttttttgaaaaacgcctctcgtcagatcggggtggagtttgataaagaaactgatatgaatagtatcaccacggcggcaattcaagctggctacgaagacctcggcgcggcactggaagataaaatcagcaaactcaacagagggactgactcagcggcagtgatgcaagcggggcggttgaatgtcctgtccgttgctccgggagacccaacacctacatgggaagtgaccgctcgtgaattctgcgcatctgtgcaagtgccatttactgtgttgttcggcactcagaccggaaagttagccggtgataaagatgatgctacatggaaagttcggttgaatgggcgtcgatggggttttctgactcaatatgtaatcagattgataacgcggttgtgggaaatcggcattatcgaaccaccttcttccggtgaggtcactattgcatggtctgacatgctcgcagccagtgagaaggagaagatcgacaatatgattaagatggctgaggctgcacttaagacacaacaggcatttgggacacccgcatttactcctaatgaagtccgtactgtaggcgagctggagccactgaaagaagaaccagagccacagggtgcaacaggagatccgttgactgatgaaacagacccaaatcggaaccccgataatacccagaaataa

SEQ ID NO: 5217 - DNA, 972 bp, Xenorhabdus bovienii
  Coding DNA location: Contig name=SeqID_16906; Position on contig =45708..46679bp; Strand=+
atgaaacagacccaaatcggaaccccgataatacccagaaataagcgcgaccctactcagtcatatcgtccagtaaataaaatgtttcgtgatattgagcggcgatattacgacatcaagaaagcattgcgtgaactatttgaccagcgactaactggcagggtgagagaaaacaacgcccaattgtcgtatatcatgcacggagaaacactgtatcaggttaacgctgacacttttatctacgatatgacggcgcaacaattggctgcattattagagcgtgtgcagaccattttggatgattatttgctggagggcataggtcaaaatatttgggcgctccagtacgtctcagaggaatatcagcgtggtacgttgaatgcgtacactaatctgtcggttcaatcatcggtgtatgagatgcagacgacgctatcagcattactgtcgtctgctgcttaccagaaccagatagcagccgcctacgtatcaacgtacagcgactggaaaggcatcagtgataaagcccgtgctgatcttgctaatgtgattgctgatgctattggtcgtggtgttaacccgcgtgaaacggcgcggattatcagtaagcggctcgatgtgtcaatggctcaggccaagaacatagcccagactgagcaggttggcgcattgcgcgaggctaattggaatgaaactgaatgggctagtgagcggttaggcttgaatacccaactgctttggctctctgccctaaaacccacaaccagacaatggcatgctgtgaggcatgggaagatctacaccaaacaagaagttgaagaattttattctagaaatgggaatcgctatcgctgctactgtgcgcaacagccgattgtcttggatgatgacgggaaattatataacaaaggtctgactgagcgcttaacggaagaacgtaaagcgtggcagaaaccggaacaaatcgagtaa

SEQ ID NO: 5218 - DNA, 1392 bp, Xenorhabdus bovienii
  Coding DNA location: Contig name=SeqID_16906; Position on contig =46700..48091bp; Strand=+
atgaagctatccagcgttcatgttaaatcactggccttaaactcctccaatatctcaactgaaactatcgatggtgatgcacatattgtcattcgtggcgttgtgcccgttgttgatgatgttgtgatgaacggcggtctttatccggctggtgaaattaacaagagctacaaatcaatagaaggcaagcagatgcctttgggacaccccagcattgacggccagtatgtctctgcggatgttccccgtgcggtcaatcagtttcatgttggtgcatgggctgagaatgtacgaaaagacggtgatcgggttgtcatggatatgaagattaatcgtcggtatgcggagtctacggaaaaggggcaggttttattacagcgtctggatgacatgatcgctaacaaggaagctgagcctatacacatttccactgggctattgctacagcgtgagcagaacggcgggaagtcaaaggggaaaaagtatacatggattgcacgaaacatgcagttcgaccatgtggctattctctctcctgatgagccgggagccgcaacaccaaaagagggcgtggggatttttgttaattctgacgggcagaaagtagaggttgaagcagtcaatctttctgatgcgtccgattgcacaaacgaggggctgattgataaagcgaaatttttcttttccaacgcctctaatttttcatttgatgatattcattcagcgcttagggcaaagctcaggactgtatatcccgatgatgactggccttaccctgaagccgtctggcctgacaaatttatctactacctatccggtaaaacctaccagcaaaaatatctcatgaacgatgacggcacagccgaactcgttggggagtctgttgaagttgtgcgtaagccaactgaatacgaagtaaaaaccaataaggaacacgatccgatgaaagaaattatcatcaatgcattgaaggcaaaaggcaaagatgttgaaggtaaatccgatgccgaactgctggatgcatacagccagatgaacgctgacgaagcaaaagtcaaagaaacgccggaagaaaaagccgcgcgtgagaaaaaagagaaagaggccgcaacaaatactgatgcgatcaccacagcaataaatgcagccatgaaaccactgacggacaaaatcaccacgctggaatctcagttgaccgccaacgcagacaaggagaaatctgacaagcgcgctgccgtgaaaaccaagtttggtctggatgacacggcggttaatgcgctggatggcgcagcacttgatggtttttatgcccagtgccagacctcggcagggctgaattcatcattcacaaacaacaattcttctgaatcattcacatctatgccggagtaa

SEQ ID NO: 5219 - DNA, 426 bp, Xenorhabdus bovienii
  Coding DNA location: Contig name=SeqID_16906; Position on contig =48097..48522bp; Strand=+
atggctaaaggaaaacatgtaattcatgcgggtggtgtatttactaaccccatgctgaaccgagagggtgcagcggcggtggatacgaagcccggcacgattggttattttgagaaaggaatatttaaggcctccgtggatggcaaagaacccgccattttgtatgttgccaatatcgactatctccgctgtcagacagtggatgactctatcacggcgggttcagtggtcgtcagtattcaccctatggcggggatattcctaaacgttcgtgccactgagggaacgtataaaaagggtcagcctgtgacggctgctaacggtcagattgcggctgctggtgatggtgttgctgcatttgcctatgtcgaagaagacagtatcacagcaaaagcgggtgatctggttcgcgtggtttttaagtaa

SEQ ID NO: 5220 - DNA, 1077 bp, Xenorhabdus bovienii
  Coding DNA location: Contig name=SeqID_16906; Position on contig =48533..49609bp; Strand=+
atgttttatttttcaactaaaaaggcaaccgaaaccggaaaccttgaggctaatcaggctcagtttggcgagctgacgttagcacgtaattcatctgcgcaggcggtagcggattttatttctcgctctcgctttcgtggtgaagatgctccgcgcctcgatgcggttaatgctatcgatgatatcaagcgcctgtatcgtgcgtatgaccagactgtgctggcagagtttgagcctaacactgaattcactctgttaaatgatctggcgggattatctcgctcagtgcgtttagaggaatcagtgtatgaatatgctcgtactggcggcacgggttgggcgcatacatcaatgtctggtcagattggtgctgcactggatgcgcgttcgtacagcttcgacggcacgatggttcctattcatgacactggctttaagttcaactggcgtgaccctgtatttaacaaaggctctgctctggcttcattgtctgatgcacaggccgactctgtaaaagttgttcgtcgtaagtatctcgactttatctggaatggcttccgcgacagtgaaggcaatttcattaagtttgatgacaagacttggaaaggcttccgcgctgatgagcgtgtcgcacaagtaacactgaacgtcgatcacactacaagcacagatggccaagcaatgcgtagcgaagtaatgaaagtgcgtgacgtgctgaaattacaaaactaccagtacggcgcacagacttggtatgtatcaggtgaagtcctgtctaactgggaaaaactgtactacgacgttaaccagacccgcactgttcttgaggaaattaagaaaatcacaggcatttctggcatcaaagaagactttgagctgaaaggcaatgaaatgatgatcattccactgggcgcaggtgttatcgcaccgattgttggacaggctttcggcacggttgctgacccacgccagttctacaactccgactatgtatggcgcacatggggggctgctggtctgatggttaagcaggatattaacgagcacttctcagtcatccacgccaaaggcaagtaa

SEQ ID NO: 5221 - DNA, 390 bp, Xenorhabdus bovienii
  Coding DNA location: Contig name=SeqID_16906; Position on contig =49619..50008bp; Strand=+
atggcactcgtgaaaattttggtaacaaatctttttgccggtgccagccttcagaagttggaggttggtcatacctatgagattgatgacaatattgctgttaagtggattgacgctggcaaagcagaagcttctaaagataaaaagggagagaaattagtatttgaagtagcgacacctgcaaccatgaattttcctgagaattcagaactacaagctgaactggatgatgctaacgctaagatgctagccatgactgatgctgccaaggcaaaagaaactgaactcacagaagcattggcggctgaaaaaaaacgagctgatgatgcagagaaagctcttgcggaagcggccagaaaggcgaaaaaagatggcgataacgctgaatga

SEQ ID NO: 5222 - DNA, 477 bp, Xenorhabdus bovienii
  Coding DNA location: Contig name=SeqID_16906; Position on contig =49878..50354bp; Strand=+
atgctgccaaggcaaaagaaactgaactcacagaagcattggcggctgaaaaaaaacgagctgatgatgcagagaaagctcttgcggaagcggccagaaaggcgaaaaaagatggcgataacgctgaatgatattaagccaatgatcgccgaacttggattcacattacctgattcagtgcttgagttgttattgaatcaggtgaatgacaaatctgagtgcatggtagctcatggctatgacgagagtttgcagaagcttttgcttatctattcaaccgtccgtttagcctccctgtccggtgcaagaaaaattgcctcgcagggttccccttccggtggttcccgttccttcgcttatgattccgctggcactgattatctgctcaaacaaatcagagtatgggataaacgcggttgcttatctggcttgccactggaaagcaaaacagtcggcttctttgatgtggtggggtga

SEQ ID NO: 5223 - DNA, 348 bp, Xenorhabdus bovienii
  Coding DNA location: Contig name=SeqID_16906; Position on contig =50357..50704bp; Strand=+
atgagcagtgtggctaattgggcgtataccgcgccatgcaccttctggaagcggctaggaaatgatgagtatggcaagccgcttggttatgaaacgccccgtactatcctgtgtgattatcaaggtggattgtccagcaaaatatctggggttggtgctgaactggttgtcaaaaacacattttggactgagtttgctgatgcctctataggggattatatcctgattggcgagtcatctaatctgaatcctatcgtggcaggggctgacgaaatcaaacacatcgtgcgctatgccgacaccttcgagcgcacggcggacgattacgccttaatcacaggggtatga

SEQ ID NO: 5224 - DNA, 372 bp, Xenorhabdus bovienii
  Coding DNA location: Contig name=SeqID_16906; Position on contig =50706..51077bp; Strand=+
atgggcgtaaaagtcacaggcattcgtgaagcgaaaaccaagctcaatgcattaatcggtgatattcggggtcggaaagtggttcgtgccatgtacaaggcgctgtatatcggcagcgctcaggctgctctttatacgccgattgatactgccactctcattaactctcagttccgtgatgttcgctttgatggggtgaggctgacggggcgagtgggctactcggcaaactacgccgtttatgttcatgaccccaaggttaagcaaaacttccgcagggcaaccgcaaaaaaagagttcttgaagcgcggatttaatgaagtgcgggcgcagatcgataaggctgtcatggaggaattgaaatcgctatga

SEQ ID NO: 5225 - DNA, 387 bp, Xenorhabdus bovienii
  Coding DNA location: Contig name=SeqID_16906; Position on contig =50951..51337bp; Strand=-
atgagaggcaacataattaaggatttcctgcgctcgctggataacaggctgtgggtcgttctgtccactgaccagaattacctgcacattgtcatccgcactgagatcatccagccgccccgttccacccgatggctgaaaaaccatgtattgcgctttcccgccatcgcctttctgttcaatccaagtgaccatctgtaccgtgaaaccatcaatcagccctgccgttgccagataatgccggaattgttcaaatgtactcatagcgatttcaattcctccatgacagccttatcgatctgcgcccgcacttcattaaatccgcgcttcaagaactctttttttgcggttgccctgcggaagttttgcttaaccttggggtcatga

SEQ ID NO: 5226 - DNA, 126 bp, Xenorhabdus bovienii
  Coding DNA location: Contig name=SeqID_16906; Position on contig =51334..51459bp; Strand=-
atgcgacctgattatgatgtacagcggaatagtaaccggatgatatatcggttctcttgtgtggggatgggggtcggcataccaccgagattgaaaacagcattcaggcaatcatcatcaggatga

SEQ ID NO: 5227 - DNA, 753 bp, Xenorhabdus bovienii
  Coding DNA location: Contig name=SeqID_16906; Position on contig =51500..52252bp; Strand=+
atggcaaattgcccagtagaaaccaataaacttattggccgtaatgccattatccgtattgcgcacggctgtcctgatgcagcgccagagcaatcagtattttttcgcattggtgcattgactactaaatcatttgatctgtcacctaacacactgacctcagaggcagatgattcaaaagggctggtggaaagtgtcgtcaccagcatgaacttaactatcagttttgatggtgagtatcgtaagcgggacaagaaagatgatttcggcccattgcgattgttacaggaaataccgagagaagttcaggcgggtcgtcagccctcgtattgggtacagatggattttacaggcgaaaatgccttcgttctgcaaggttatatggtcttcacgtcttggtcatctaagttcggtgctaacgaagtggccacctattccggtgagctaaaaatatccgatgccgatacggttgaatggttgatcgaagaagtcgcggtacagtcagtcactgctaatccttcgtcattgactgtacccgtaggaaaaaccggttcttttgtggttaatttcactcctgctgatgcgaccaataaaaactatactgtgacatctgataaaaccagcattgctacagtaagcaagattggtagtgtggtgacagtgaaaggggttgcagagggttcggcaaatgtcactgttacctctgaggatggcagtaaaaccgctaaatgcgcgattaccgtgactgcttaa

SEQ ID NO: 5228 - DNA, 690 bp, Xenorhabdus bovienii
  Coding DNA location: Contig name=SeqID_16906; Position on contig =52302..52991bp; Strand=+
atgacacctatttttgaaattggtgagatggttatcgccactgataaagtggactttttatttcgaccttcgttctctgcaatgacgagaattggaacgcctcagcagattgttgaagcgtacacattgctcaatggtgcagagacgcaggaattaattaatcgagctgtgatagcttacggcagtcttcctgactggctgattaagttgatgcgtaagcccatatttggccggaatatcttatcaaccgcgatgatggttatacaggcttgctgtgaagatgatgcagaagaattgatcggtgagtggaaaccggggcgaagaggtgtggtatatcgaccgggcaagatgtcaattaatgacattatcgtgctggctactgagataataacgcatggagtcattggtaaggtcaaaatcaggaagctccagcgcaatgaaggcagggaagagtattcagggcagtttgtcgcgattgagtacatcaatgcagctcgcgcccacttcggtatgtcacgcgaggaagcggcgcagctaaccatgactgagtttcagatgatgctgaaagctaagtttcctgatgacaagggctttacccgtgaagagtatgatgcggttatcgatgctgatgataagcgcaccaatgagctgatgagcggcaagcgcagattggtgagtatgaagaagtga

SEQ ID NO: 5229 - DNA, 144 bp, Xenorhabdus bovienii
  Coding DNA location: Contig name=SeqID_16906; Position on contig =53100..53243bp; Strand=+
atgagtctttttgagttgtttggatctgtttcgtggtgtactctgtatatacagattaaccataggttaaagacgccgatacatgaagctcttgatttcatcaaacatcagattgaagttggcagacaaaaacccgcctgttaa

SEQ ID NO: 5230 - DNA, 303 bp, Xenorhabdus bovienii
  Coding DNA location: Contig name=SeqID_16906; Position on contig =53182..53484bp; Strand=+
atgaagctcttgatttcatcaaacatcagattgaagttggcagacaaaaacccgcctgttaatgaagaagatatactccagtgtttttcgaatcgggttggatacttccttgaagacacaagggaagataacagaactgacccgccgactaagtggtttatatctgaaactgattatggtgttaagttaaagatagtctttatttattacccagaaaaaggggttgctataaggacggcttatgcacctaacgaagatgaattaagaatttacaaaaaatacggcctaggaacagagaaatga

SEQ ID NO: 5231 - DNA, 354 bp, Xenorhabdus bovienii
  Coding DNA location: Contig name=SeqID_16906; Position on contig =53481..53834bp; Strand=+
atgagcaaacaaactgataagcgaacacacctgatagcttccactaatgacgcgtgggataacggtgagcttggatgcagtgaagctcacgttaaagtatctgatgacataacagaagatctgattaatgaagcgttggacttacagccaatttcaatcagattaaataaatctctgatagaagatttgaaaatgatagccgaccttagtggtttaggctatcagccattaatcagacaagttttaaatcgctttgccaatagtgagaaaaaacggatactcgccgaagctcacagtagggcgatgaagaatgaaaaaagaaagccgcctaataaacgtcacaaagcggcttaa

SEQ ID NO: 5232 - DNA, 414 bp, Xenorhabdus bovienii
  Coding DNA location: Contig name=SeqID_16906; Position on contig =53859..54272bp; Strand=+
atggtgcattatgagtttggtgttaacagtataaatgagctaaccaatgaccagtttccctctgcaatagagtatctggcgactaaagcgattgaaggtgagttcttgggtaaagaaaccttaccgactccagaggttaagcagcagatatctgatgaagatttgcaaactctttgttgggggtggagattcctagcgagaagcattgaacatatggctaatgtttaccctgtattaaagtcagcagagcacgagctagcccctatttactgcgaaataccaagagaaggcgcagagatagagaagatggtgaggaagattcttgaaaatgtgacttcacatatagaagtcacgccgactcaagacaataactggaatatactaaataagctcagaactccgaactatcactaa

SEQ ID NO: 5233 - DNA, 144 bp, Xenorhabdus bovienii
  Coding DNA location: Contig name=SeqID_16906; Position on contig =54316..54459bp; Strand=+
atgccacttaaatgtggctttttgcgttcttttgcgctaattggttggtattgtaagcaaaatttgatgatggggatgtgtgatgaaaataataccaataattactttggtaggttttatatattctatgccatcgtttgctga

SEQ ID NO: 5234 - DNA, 342 bp, Xenorhabdus bovienii
  Coding DNA location: Contig name=SeqID_16906; Position on contig =54398..54739bp; Strand=+
atgaaaataataccaataattactttggtaggttttatatattctatgccatcgtttgctgatgattgcattggcgatggaatatatcaagtatgcactaagtcaagccaaaatacgcaaggagatgatgttattgagtcatatgactcagaaggtaattcatactctataacatcgggattaagggagagtagtgacggctcatccgaggttttttctgttgatagtgagggaaatcaattttcaattaaaagctggtgtgatgatgcaggttgtcacagtagagatagcgatggtaacacctgtaccgtaaccatgtctggcgaaatgattggctgctga

SEQ ID NO: 5235 - DNA, 381 bp, Xenorhabdus bovienii
  Coding DNA location: Contig name=SeqID_16906; Position on contig =54750..55130bp; Strand=+
atgataaagaaattattggcggtggtggtattggtttctgtgagtttttttgctaaatcagcaataactgataggcctttaactcaacaggaaataagtttggttgagtctgaagtaaaagtgagccttaaagatcctgacagtgcaaaattcaaacatgtcaatcttatacaaggtagtgaaaattcgatagatatatactgtggtaaggttaatgcaaaaaactcatatggtggatatgtcggctttaaaccgttcatggtaatactattgacgaatcaaaaaaacgaaagaaaggctatggtactaccagaaggagaggaatcttcagcaataaaggaaaaagccatcatgaagcagtgtgctaatcatggttactag

SEQ ID NO: 5236 - DNA, 3282 bp, Xenorhabdus bovienii
  Coding DNA location: Contig name=SeqID_16906; Position on contig =55197..58478bp; Strand=+
atggcagatcatcaggtaggcaatattgtttatcaagtatcaatggatgtcgcgcaattactgaccgcacaaagacaattagattcgcgcatgggacaggtagagcaacgttttaatcaaacagggcgctcagtgcagggggcagagaaagcattactaagtctgtcaagggctgccactgcggtaacagcggcattgtccatcgagaaaatagccagctatgcggatgcatgggttgtggttaataacaaattggttaatgccgttaaaacaaatgaaacgctggcagaagtgactgagcgtgtattcaatatagcccagaactcccgtgcgggtttggatgccactgctgcactgtatggtcgccttgaaagagctacccgtagttatggaatgtcggctaatgatgtggcaaagctaactgaaactgtggcaaaagggctggttgtttcaggtgcaaccgctacggaagcatcgagtaccatgattcagttttcacaggctatggcttccggtgttcttcgtggagaagaatttaactccatgtctgagaacgggagccgtttaattgcagcgttgagtgaccatcttggtgtgaatattggtcagctaagaaagatggcggcagaaggtaaattaactgccgagattgttgccaaagctcttctggctcaggccggaactatcactaaggaatttgacagaacatcagcgacaatgagccagtcaatggaaatggcggcgaataatatgaccaaattctttgggcaatcaaccacggcgcagacagcactgaaagcgtttaatagtactctggtgacagtcagcgaaaatatggatcttgttgcgggcgctgcaactgctttagccgttgttatgggttcgcggatggttggtgcgatgacattagctgcgagcaaaaaaataacaaatgtcagggcatctatagcgctcgcacaagctaataaagtggaagcagaaagagcattgtatgccgccaatatgacattgcgtaaggcagaaatggataaaattgctgcgattgaggcgttacgccacgctcaggctgaatacgcagtagtaaaagggactgatgcggccacagcagcacttgccagactaaccgctgctcgtgccacagcaacgacagcaacagccacatacggagccgcacaaaatgcagttactgtcgctcaagcggggttcacagcagccgcaagagccgcgactattgcagtgaatggactcaaagcagctatgtcatttttaggcgggccacttggcgtagttatgctggcagcagcagcgctttattatttccatcagcaagcggaagacgcgaaaaatgaggccaaagatttatctaatacggttgaaagtttgactggcaatctaaaggaactgagtaaagttcagctcgaggcaaataaagttaagttagaaaggaagttagctgatcagagtgagcaggtaaaaaaacaagaagtaaaagtaagtggtatccaatgggaagttgataacaatggcggctttatatactcaaaaaaatccaaggaggaaatggataagctcagggaagatttagccttagccgaaggtgagcttgaaaatgtgcaaacggtcgaaagtaattacaaaaaggccattgatctaaccagtaaagccattgctgaaaacacaaagctgaccaatgagaacacggatgccaataagaatagaaatggggaagttgatcaggcatctgacaaagcggcggattttatcaccaagctcaaaaatgaaaatgagttactcaagactcaaaagggattaaagcgagacttaaaagccgcagagttcaaggctaatgagctaggggcaagctctgggcaaaaagaagttatagcaaaggaaatcaaagaaaacaaccaactcaaggcagctgaaaaggaaagagaggacgcggcgagagaagcggaaagtgcagctaaaaaggctgcggatgatgctaaaagacgtgccgacgatattactgaggcgctttctaggcaacgggaagggatagatagactcaaaactggttatgaagaagccagcctcgaaatggctaaatacgatgctgctaaagccatgccggaaggttctagcgaggaacagattgaaaaagctagaagaaatgccgcagaaagatacgagcttgaaaaagatgctgatgccagaaagtgggatcttgaacaagactctttagcgaaatccaagaaggcaatggatgaagaacttgagcacttaaggcgtgtcaaagctcagggattgctcgaagaagaagacttcaataaacgcaagcaagagataagagagcgttataagaataagcaaacggaagatgaaattaacaaaaaagttgattcatcagtgggctttaatgatgggttgctaggcaaagcagatcctatccaacaactccagaatgaatacgctcaaaaaatggcattgctggatgcttataatacacatgatatcggcgaacatgaacgaatcctgcaactcaaatctgatttaacccgtaaattcaatgatgatatgactaccgcccaatgggagcaatggaaaggccagaatgagatgtatcaatttctgggtgatgccatggaatcattggggcaacgctctgccaattccataacagggctgctaaccggcactcaaagcgccaacgatgccatgcgaaaccttgcattaactatcacaaatgaggctgtttctgctttggttcaaatggggatgcagcaaatcaagaacatggtgattggtaaaacattagcgacagcatcgacagcaacaactatggttcaggcggctgcggctcaagcggcatgggcacctgctgctcttagcgcatccattgcaacattgggagcggcggcggctacaggcaccaccgcttacatgtcttctttggttgcaagtaaggcgtttgcaattgctggtgctcgcaaaaatggtgggccagtcagtccgaacggtgcttatcgaattggtgaagacaataagcctgaaatattcaaagcgaataatggtcatcaatacatgataccgggtgacaggggtcaggtgattagtaatagggatatggggaaagggggtggtggagtttctgtcggcgatatcaatatttcgtttagtgtgcagacgcaaggtaacttttctgaacaggatgcgcgattaatgtcgggaatggtgaaaaaatccatttatgatgtgctgatagatgagcgccgaccgggtggaatgttaaatgaatga

SEQ ID NO: 5237 - DNA, 336 bp, Xenorhabdus bovienii
  Coding DNA location: Contig name=SeqID_16906; Position on contig =58513..58848bp; Strand=+
atgacaaaaacagaattcaaatggcgacctcaagataattatgaggtttcccatgagccgcgcgttagagtcgtgaaattcggtgatggctatgagcagagagtcaaggacggtatcaataatcagttgaagcgctatcaactcagttttgttgagaaagtggatacagggcgagccattgacgagtttctgcgagtcagaggtgcagtcgaatcattcacatggcgaaccagtgacgataaccaactgcgtacttttgtttgtcgttcttggacggtaaacaggcagcgggtgatctggtctatcagttgcacctttgaggaggtagtagcgtga

SEQ ID NO: 5238 - DNA, 705 bp, Xenorhabdus bovienii
  Coding DNA location: Contig name=SeqID_16906; Position on contig =58845..59549bp; Strand=+
gtgagagacattccaaaagagatgcggattgaagttactgagctgagtcagaacgccattcttaatctctatgaaattgatttaacggccttcggtggggatatttatcgctttcatgatggcctgaatgggaagctggagcctgtcgcctggcagggaatgcgctatgaggcttaccctgttgaagcgtcgggttttgagatgaatagtaaagggccaagcgccagacccaaaatgatattcgccaacgtcaatgggttcattactgcaataaaccaagacttcaatgatgctttgggcgcggttgtgacacgtcatcaggtgccggaaatttatcttgatgcggtcaatttccctaatggtaatccacaggcagacccaaccagagaagccgtgagcaagtacctgatagagcaaaagcaagattccaacgctgacttcgtaacttatgtgctcgcattacctagtgaaaccgatggcgctttaattccggcgagagtgattcaagcagatatttgtagctggcaataccgttcagcggattgtggttatgatggcccacctgtggccgatgagaaagatcagccaaccactgacccactgaaagatcgatgttccaaaaaacccgctggctgcataaaaagatacccccgtcctcaacccatgccctttggcggctttttgggtgctaacaagctaggataa

SEQ ID NO: 5239 - DNA, 714 bp, Xenorhabdus bovienii
  Coding DNA location: Contig name=SeqID_16906; Position on contig =59553..60266bp; Strand=+
atgattgaaacagacattatcgcccacgcgaaagcggaaggggtgagggaatcgtgcggcctgatttcaggtaatcgttattttccatgccgaaatatttcgcccgatcctgagcactactttgaaattaatcctgatgactggataacggccgagtgctttgcagatattgataccattgttcacagtcatccaaacggaaagccccgcctgagtacaggagacagagagcagcaagttaaaactgggttgccatggtggttagcttgcggtgatcgggtgcataagtttaaacctgttccccgattgctaggccgagagttcattcacggtaaacaagattgctattccctcatccaagatgcctatcatcttgctggcgttgagctggacgatttcagccgtgacgatgaatggtggaatactgggcaaaatctttatctcgataatatcgccagtcaggggctggagcaggttgatgagatacaggaaggcgatgtcattcttatctgcttaggtagtcagacaccttgtcacggggctatctatatcggcaatcaacaaattctacaccatcggccagatcgcatcagtaaacgcgatatctatgacggttattggctcaagtacacacattcaatatggagacataaacaatggtcaagctacagcttggaggccatcttagaagatttggccgtcgctacgaattag

SEQ ID NO: 5240 - DNA, 594 bp, Xenorhabdus bovienii
  Coding DNA location: Contig name=SeqID_16906; Position on contig =60209..60802bp; Strand=+
atggtcaagctacagcttggaggccatcttagaagatttggccgtcgctacgaattagaggttcgcgatgcagcggaagccgtcaggtgcttgtgctaccagttgaaaggtttccagcaagcgatttctgatggtcatatccgcgttcgtattgctggacgcgacatgacagaaaaaagcgttcctgctggtatgaaccatccgcttaatgatggtgacatcgttactatcgttccggttgtggggggtgcgggtggtaatggcgttggcatggctattctgggtgtggtggctgttgctgcggcattctggacgggtgggggatcattagctgcatgggcaagtgcgtctggtgcagcagctacagctgctacaggcttagcaattgcgggtgttgccctgatcagtgcagggttggcctccatgttaaccaaaatgcctaaaggccctgaaatgggttcgagtaaaacggacggaaaccagtatttcaactcactggaaaatcgcatcgggcagggctatccggttccgattgcatacggtgagatggttgtgggttctaatgttatttctcaaggtctggagacggaataa

SEQ ID NO: 5241 - DNA, 3534 bp, Xenorhabdus bovienii
  Coding DNA location: Contig name=SeqID_16906; Position on contig =60802..64335bp; Strand=+
atgggtaagggcggaggcggaggcaacacgccaacattggttgatgacaatctaaaaaataaacagtacctgagaattgtcgatctgattggtgaggggcaaatagaagggcctgtgggcggtctgcatgggttcagggttaatgggactcctgtcgttgataaaaatggcaatcccaatattaatggtgtcactgtacagtggcgcgcgggtactcaatcccaagagccattaagcgattatccatttgttgaaagtgagatccctgtcagtgttgaagtaaaaaatgccactccaattctcaggatggtttcaaataaagatgtagacagagtcagattcactttgggcgttagtcaattagttcagacagatagccaaggcaaccaaagtaatagcacggtacaaatggctattgcggtgaatgatggaggaggatgggtacatgcaaagaccgttcagataggccccggcaaaatcagtggacagtatttagaatctcataccatcgatgcacccaagaaaaaaccgttccaaatccgcgtctcccgcttaaccgatgacagcaaaacagaccagctccgcaatggcactgtgtgggccagctataccgaaattaccgacaccctgatgagttatcccaatagcgctgtggtcggtatgcgtattgatcggtcattgtttgcagatacacccaaacgaacctaccacatcaaagggatagttgttcaggttccagataactatgatcctgagacccgtaattacaagggcgtatggacagggcgatttaaacctgcatacacgaataatcctgcgtggattttctatgacttagtgactaatacacgctatggcattggtaaattgatggggtcatttggctgtgacaagttcgcgctgtatgccattgctcaatattgtgatcagccagtccctgatggatttggtggaactgaaccgcgcttcacctgtaatgcgtacatagcgactcaacgtaaggcgcgggacgttctggatgacttggcttctgtctttcgggggatgcaggtatggaatggattacagcttacaacttttcaggataggccatctgatccggtatggacgttcactaatgctaacgtggttgaggggaaatttaacgttagttcttctgcaaagaaggcacgacatactgcaattgaaatcacttgggttaaccctgagaacggctggaaagatgagagggaattaattcaagacgatgaactggttgctcgcctaggtatcaatgtcaaaaaggtcatcgcatttggttgcaccagtcgcggacaggctcaccgagttggtcggtggataattgagactgaaaagctggaaaccgattcaataacattcagtaccggtcgggagggtatcaactgcataccgggtgatattgtcgagatagccgataacagtttcgctgctgcgcgtgttggtggacggatcctttcattctcaggcaaagaggttcgccttgatgcgcctgttgagtttgccaagggggaatcgggctatttctcttacatggggagtgagggaaaatttgttagggtcgatattgatactgttaatggtgatgttgtcaccttgaaagaagtacctgcgggattgcggcagtggggcattttttccatttccaaaaaatcactggtgactcgcctattcagggtgatgagcattgcagaagacaacaagacgggcaattacaatttcacctgcattcaacacgagccacagaaagaagcgattgttgataacggcgttgattttcaggggagtccagccacacagaatgttattcgtattcccaatattgagcgattaagtgtcgcttatattcaagacagttctcaggtgcaggctcgcgctatgtgggcgaccaccacaatcaaccgaaatatcacctttgatgtggccgtatatcgtgacaataaagtggtatctcgcggcaatactaaggaactggaatattattttaacggtctggatgctggcgtgtatatggttggtgttcgcgcccgtgacgacaatggaatgctgggggatgaatctaaagtgcagatggtaattggcgctcctgccgcaccttctgttgtcaatattgaacccggattttttgagttgaaagccattcctcatattagcgctccaaagactttagatactcaatttgaattttggttttccgagagccgtatttccaatatcaatgaaattgaagcaaaagccgattttctaggcattgcaaaattttggataaagggccaattgaaggcggacacgccatattggttttatgttcgcagtatcaatgaatttggtaagtctcattttgtcgaagcggaaggaaaaccaaatgataatgctaaggatattttagaggttgttggcgaacaatttctttccaacaaagccggccagcgtttgcagtctcaaatggactttaactccgaagccatcatggagattgccgcggtggaaggggcaattgttcagcgacagttgaaagtgaatggtgagcttaaggccgagatactgcacgttcagaccacgcaggttacggacagagaagcctttgctgaggacatgaagaaggtacaggccgaagtcggggagaatgcggcggcggtgcagacgaaggcgacggcggtctttgatattaagggagatgggtatgctctctatgacgtgggtgtcggattaaagtacaaagaccagttccataaagccgggatggtgatgggatctgaggtgaagaacggacaggtcactacctccatcggatttagtgccgagaatttcggttggtttaatccggccagcggcaaaatggagccgtttatgatggcgaaaaatggacagttgcttgtgagggatggatttatagaagatggcagtattactaatgccaaaattggcaattacatccaatccagaaattatattactggccgggcgggatggaaaattgataaagggggtggggcagaattcaaccatgttactgttcgtggggagatacatgcaaccagcgggacgttctcagggacaatcaatggcgctgatggccgtttttccggcgcagtatatgcgaccaaaattgtaggtgacgtggtgtctgtcacgttggggaatgtatcattaggcaaccgtgacagcattttctttcataaaaggctaacggaatccatgccgtttgatcgggtttttatttatggaccgataatgactcagctttacgtcggatctttgggtggttcagggggagcattcgtttcggtatacgttaataatgcgtttgtagctgaccagtattttagcatggagtcttctgatcgcggcccgcagtgtatttccggcacgttgtttacaccccctataaccatccccgccaatacaacgccgaccattaaagttgttctcacaacccacggcgcgggcactacatactctactcccggtattggtatgctgtttaaggtcagtagtcagtggtctaacatgtag

SEQ ID NO: 5242 - DNA, 1449 bp, Xenorhabdus bovienii
  Coding DNA location: Contig name=SeqID_16906; Position on contig =64407..65855bp; Strand=+
atgatctactcagacggcacaacgaatctcgtgtcaggctcggctattgtccggggaacgggcaccaaatggaaaagtaatattaacggcattgccgcaggccagattatctccattcaatccggcaatacggtgattcagaatgttatccagtcggtgaattcagacaccgaactggtactggcctttgcgccctcagtcagtcttaacaatgcgaaatatgttatctcaaccactgtcccggataccgtttccgatggtgtccggcatatatgcgccattaacgcctatatcatcctgttcctgcaaaacatggacaggtggatgagtgaaaacggtaaggttgaagtggagatgccgaacggccagaaagtcacgctggactccatccgggcattgcaggcagctatggatgggaagctggttaaggagcagaacggggcagacattccgaacaaaccggcgtttgtagaaaacctgggtttatcgggaacggtggagttggcgaaaaatgcgctgccgaaagcggggggatggattgatggtgatgtcgctgtacgtagtcgcgatgctgcgttgcgattatgggctgacggtgactccggtttatatatgacctatcaccaaaatagtaagcgttctgcgtggatgggttatggcagtgatggttcaaaaacatttaccattagcaacgaaaaagccggttcaacgatttctctggataaaaatcatgccgctatttatggtgcacaaagcttcattatcagttcaggatatgaatatagtggcataaatataacgaaaccatcagggacgttttttagattggagacagataccgatcagtctgtctccatcgttaattttgtagacagaaaccccgacaactcaaatcgcagtgtacaatccctacctaaaggaaacggcacgttattatctttaggagctaactgctggagtgataacactggctatatacggccatcctcacccatcatccaaatctaccccgatggcaccttcatcaccaacgacgaatccgaaggtgcgacagtcaccaggctcggccttggacactatcagatatccggtatccttggctataacgctgacggtgcatggggtgttcatggcggtatcagtgtcccccgtgacgtcaatggcaatgagttagtgtatgtcgaggataaagtgctgccggatggggctatcgaaattaaggtgactcaccgacagagcgcgcatatgcccgcccgattgcagaacaggcgcattaagtcacaggatgagcagacccattacacggatgatgaaccctgtgatttacccgctggcacccggttagacgtccgtgtccagatgccggaggattctatctggaaccagaaacaggtattggcatctgatcctcagcaggagcatagtgccacgtcagccgtcaataaatag

SEQ ID NO: 5243 - DNA, 153 bp, Xenorhabdus bovienii
  Coding DNA location: Contig name=SeqID_16906; Position on contig =65816..65968bp; Strand=-
gtgagacgcaatcataagcgccatagattaccatccaaccaccccacccgccagtttaccagcctcacatcccacaccaatccacccaactacccgctaatctcacctattggctatttattgacggctgacgtggcactatgctcctgctga

SEQ ID NO: 5244 - DNA, 165 bp, Xenorhabdus bovienii
  Coding DNA location: Contig name=SeqID_16906; Position on contig =65954..66118bp; Strand=+
atgattgcgtctcacttcgttagattctttcctttatataggcaagcatcctctgctaagatcaatcgatttcttaacagccaaacattgtctgattattggtcactccaatcaaataggacaacatacaggacaatatatagtatccacttatgctactcttaa

SEQ ID NO: 5245 - DNA, 765 bp, Xenorhabdus bovienii
  Coding DNA location: Contig name=SeqID_16906; Position on contig =66140..66904bp; Strand=+
atgctgcggatattgctcagtaatgatgatggtgtcaccgcaccgggtattcaaaccttagcggctagattgcgggaacactatcatgttcaggtgatcgcacctgatcgtaatcgcagcggagcatcgaatgccttaacgctggatcgtcccttacgtatcaatacgctgaataatggtgatattgccgttcaggaaggtacgccgacggactgtgtctatctgggcgttaatcgcctggttcttcctcgtccggatattgtggtttcaggaatcaactgtggtcccaaccttggtgatgacgtgatttattccggcacagtggctgccgcgatggaagggcgtcatttaggattaccggcgctggcggtgtcactcaatggtgataaacattatgaaacagccgcagaagttacaatgcgcctattgaacctgctgcaaaaattccccttaagggcaggcaatattctgaacatcaatgtgcctgacgttcctattgagcagatcaaaggttttcgggtaacacgatgcggcagtcggtgtgctgctaaagaagtttacgccttggaagatcccaaaggtaacatgctttactggatagggcctcctggcgagaaacatgacgcagggccagaaacagattttgcagcgatagaagacgggtttgtctccattactcccttacaggtggacttaaccgcttataaggcgcaggaattaatcaacgattggttggtaaaagtcggggatatgggagaatgctaa

SEQ ID NO: 5246 - DNA, 627 bp, Xenorhabdus bovienii
  Coding DNA location: Contig name=SeqID_16906; Position on contig =66898..67524bp; Strand=+
atgctaagtcggtcaatgaaaaatttgctgactcaattacgccagcaaggaatacaggacgagcacttgctggaaattatcgccagagttcctcgggaatgttttgttgatgaagctttggcgcataaagcttatgaaaatacggcactgcctattggacatgggcagaccatatcccagccttacactgttgcccgcatgacagaactgttgagcttaactcctgaagccaatgtgctggaaattggaacggggtctggttaccagacggcgatactcgcccatctggccagacacgtcttctccgtggagcgtattaaaggtttgcagtggcaggctaaacgcaggttgaagcagcttgatttacacaacatatcaacccgccacggtgatggctggaatggatggccgtcaaaagggccatttgatgccattattgtcacggcagcgccgcccgaaattccacaggctctgttgtatcaacttgcagataacggagtgatggttttgcccgtgggggagcgctctcagtcgcttaaagtggtacatcgttatggcagtgattttcacagcgaagtgatcgaatctgtccgttttgtacccctaattcaaggcgaactagcataa

SEQ ID NO: 5247 - DNA, 1059 bp, Xenorhabdus bovienii
  Coding DNA location: Contig name=SeqID_16906; Position on contig =67676..68734bp; Strand=+
atgaatttaggaaactcagtgaaaaaaataaagtggataagctctgttatgggagtggtgctggcaggctgtagcaatacatcggatcgtccagcgccgatagtgagtattgataagcaggaacaaaatagagggatcccttccagaacctcgtccatctcgacacccatgtcatcttccccttcaaccatttcagtaaatcgttcatcagagcatcgtgcttcggaaaatcgttatttagtgaatcgtgctgttgaaaatggctcacatcagggacggatcgtctataaccgcaattatgggaatattcctaaaggaagctatagcggcagcacctatacggtcaaaagtggcgatactttgttctatgttgcatggattacaggcattgattttcgtgatctatctcacaaaaataacatttcagagccttataacctcaatgttggccaagtcctgagaatgggtaatgtaaactccagtaacggtgtattactagcatcaaatagcacccaatctaaaattgagcaggttgattttcaaaaaagtaatgcgtatcctgcaaacattgatagacagagttccgaaaagatgttgccaagaaaagcaatttctgttagcgaaaattccgctctgaaatcatctccggcaacagacataagtcctagcagcaccatcagcagtaatagcagtagttggggatggcctgcggaagggaaagtgtttgaaggcttctcggattctaagggtgggaataaaggcattgatattgcgggtagtcgtggccagcccgtttttgcaactgccagtgggaaagtagtttatgccggaaacgcattacgtggatatggaaatctcataattataaaacataacgatgactacctgagtgcctatgctcataacgataccatgctggttcgtgattcgcaggatgtccaggcggggcaaaaaattgccactatgggtagtactggaacaagtttagtcaaattacattttgagattcgttacaagggaaaatccgtaaacccgctgcgtcatcttccgcagcgataa

SEQ ID NO: 5248 - DNA, 996 bp, Xenorhabdus bovienii
  Coding DNA location: Contig name=SeqID_16906; Position on contig =68788..69783bp; Strand=+
atgagccaaagtacgcttaaagttaatgagttgtatgatgaggcggatttagacgaacatggcatggaagccgatgactttgatgaagcgttgctgaaagacggggatgatttaaccaatgttgatgaagatttggatttgttgcaaggggttaaccaacgggttctcgatgcaacacaactttatctcggagagattggtttctcacctctgctgacagcagaggaagaagttcttttcgcaagacgggcacttcggggagatattgctgctcgccaacgtatgattgagagtaatttgcggttggtagttaaaatatctcgtcgatatagtaaccgagggttggcacttttggatctcattgaagaaggtaaccttggtcttattcgtgcggtggaaaaatttgatcctgaaagaggttttcgtttttctacgtatgcaacatggtggatccgccagacaattgagcgggctattatgaatcagacacgtacgatccgtctgcctattcatattgtcaaagaattaaatgtttatttacgtactgcaagagagttagcccataaattggatcatgaacccagtgtcgaagaaattgcggaaaaactggatagaccggttgatgatgtgagccgtatgatgcggcttaacgaacgcattacttctgttgatacaccaataagtggggattcagataaagccttactggatattttatctgatgaaaatgactcagggccagaaacaaccattcaggatgatgatatgaagcaaagcattgtgaagtggttgtttgaactgaatgcaaaacagcgtgaagtcttggctcgccgttttgggttgcttgggtacgaagcagaaacattagaagatgttggccgagaaatcggtttgacaagggaaagagtccgtcagattcaagttgagggtttgcgccgtctcagagatatactgcatactcaaggcttgaatattgaatcattattccgcacttaa

SEQ ID NO: 5249 - DNA, 2628 bp, Xenorhabdus bovienii
  Coding DNA location: Contig name=SeqID_16906; Position on contig =69950..72577bp; Strand=-
atgggttggctgagcgtcgatggcccaactgagtcaacaggaatagtaaaattgaatgcgatcaatatgaaagaatcaccagcaaaggatttagacagtcatactcccatgatgcagcagtatctgcgcctgaaagctcagcatcctgacattttgctgctttatcggatgggggatttttatgaactgttctttgacgatgccaaaaaagccgctaagttactggatatttctctgaccaaacgcgggcaatccgcaggccagcccattccgatggcgggggttccttatcacgcaatcgaaaactatctggcaaaactagtacagctcggtgaatcagcggcgctctgcgaacaaataggtgatcctgccaccagcaaaggcccggttgaacgtaaagttgtgcgcattgtcactcccggtacggtaaccgatgaagccctgctgcacgaacgtcaggataatctgctggccgctatctggcatgatagccaagggtttggatatgccacgctggatatcacctccggccgcttccgcgtctctgaaatggcagacgaagataccattgccgccgagcttcagcgtacccaccctgcagagttgctctatcccgaaagctttggccccatggcactgattgaacgctgtaatggcctgcgtcgtcgccagatgtgggaatttgaactcgatacagcaaggcagcaactgaatttgcaattcggtacacgtgacctgatcggttttggggtggaaaaatccacgttagcactgcgcgcggctggctgcctgctgcaatatgtgaaagatacccagcgtaccgccctgccccatatccgcaatattacggtagaacgccagcaagaaacggtcattatggatgctgcaacccgccgcaatctggaattgacccaaaatctggcgggtggcactgaaaacacactggcttctgtactcgatcaatgtgtgacacccatgggcagccgcatgctgaaacgctggctgcataccccaattcgcgacagaaaagtgctggaaaaccgccaacaggccatttcagctttacaagagattggctttaaattacagccgtttttacgtcaggttggtgatttagagcgtgtacttggccgtcttgctcttcgctccgcccgtcctcgtgatctggccagaatgcgccatgctttccagcaattgcccgatattcatcagatcatggcatcatctgattcaccttatattcaggcactgcaacagcgtgtcggtcattttgatgaattacagacgctgctggagaaagccgttgtcgaaacaccccctgttctggtacgtgacggcggtgtcattgccccgggttaccatgccgaactggatgagtggcgtgcattagccgatggcgccagtgattatctggacagactggagatccgcgaacgtgacaaactcggcattgatacgctgaaagtcggcttcaatgcggttcatggttactatattcaggtcagccgtgggcaaagccatttagtcccgattcattatgtacgccgtcaaacgctgaagaatgcagaacgctatatcattcctgaattgaaggaatatgaagataaggtgctgacttccaaaggcaaggctctcgccatcgaaaaagcgttatatgaagagctattcgatctgctgcttcctcatctggctgaactgcaaactagcgcagaagcattgtcagagctggatgtgctggcaaaccttgctgaacgcgctgagacgctaaactacacctgcccgacactgagcgataaaaccggtattcaaatcacgggtggacgccatcctgtcgttgaacaagtcttgagtgaaccctttatctcaaacccattaacgctttcgtcacagcgtcgtctgctgatcatcacggggccgaatatggggggtaaaagtacctatatgcgtcaggccgccttgattacgctgctagcgtatatcggcagttttgttcctgccgagaaagtgctgattgggcctgtagaccgcatttttacccgcgtgggcgcttccgatgatctggcatcaggacgttctacctttatggtggaaatgaccgaaaccgccaatattctgcataatgcgacagagcatagcctggtcttgatggatgagatcgggcgcggtacgtccacttatgatggtctgtctcttgcatgggcctgtgcggaaagtctggccaatcgcatcaaggcgatgacgttatttgccactcactattttgagctgacgacgctgcctgaaaaactggaaggtgtggttaatatccatctggatgctgtcgagcatggcgataccattgccttcatgcacagtgtacaagaaggggcggcaagtaagagttatggactggccgtcgcctctctggcaggagttccccgtgatgtcattaaacgagcgcgccagaaattaaaggagctggaatctctctccaacaatgcgacagcaggccacgtcgatacgccgcagttgacactgctgacggaagaagcatctccggcagttgaagcgttggaaaatctgaatccagatacattgacaccacgtcaggcactggagtggatttatcgtctgaaagatatggtgtaa

SEQ ID NO: 5250 - DNA, 102 bp, Xenorhabdus bovienii
  Coding DNA location: Contig name=SeqID_16906; Position on contig =72624..72725bp; Strand=+
atgaacctcatcctaggcgaaaacgttatcttatcactgataatcggtgtgatcattaaggcttcaaaccagccagcagtgaccaagtatggcaaaacgtga

SEQ ID NO: 5251 - DNA, 135 bp, Xenorhabdus bovienii
  Coding DNA location: Contig name=SeqID_16906; Position on contig =72712..72846bp; Strand=+
atggcaaaacgtgacagggaaagtttaggtggtaggctatcaggattgcaattgagaatgtataggattttttggctattgatgaggattgggaagcgactcgattttatttttactcctaaaaattcatcatga

SEQ ID NO: 5252 - DNA, 321 bp, Xenorhabdus bovienii
  Coding DNA location: Contig name=SeqID_16906; Position on contig =72891..73211bp; Strand=-
atgaaaaagcaagataaacaaactcttgcttccttaaaacaacttgataatcgtgccgtattaggtttttttgccatcgccttgatactcggcatgataggcggtaaaaagctggccagaagcgtccttgtcctttggcctctctatagcgttatctatatagtgatgttccgaaagctatcccaacgccttcacgatagcggtcttcgcggcctggtcaactttggcaactcataccctttctatcagttctgctgggtagttattatctttgcgatgttctttctctttttgtttctcattcatttaattatgctgtaa

SEQ ID NO: 5253 - DNA, 165 bp, Xenorhabdus bovienii
  Coding DNA location: Contig name=SeqID_16906; Position on contig =73270..73434bp; Strand=-
atgggccttttcattatattttggcatagcactgctttaactcatcactttactaataatggtgagcagtcaaagatagcaaagcctgttagtaatttcttccacgtaatcttcaaaaattcatgctaccaatcatcaatgaaaatgggtttttggattggatag

SEQ ID NO: 5254 - DNA, 471 bp, Xenorhabdus bovienii
  Coding DNA location: Contig name=SeqID_16906; Position on contig =73453..73923bp; Strand=-
atgaccggatatcaagctgaatcagcgtcggccagaaatttttatctgactgggaccaaagagttacgcgaggggatcaaagccacagtaaccccgaaaacagtatcacctgatatgatcaagggcatgacgcttccaatgttcttcgatttcttagccattcatttgaatggacccaaagtaggcgaccaccattacgccttcaacttgattttcccagatgtcggtgagaaatatactttaactgtgaaaaacggtgtcatgaattacctgcctggaaccgctgaaaaagttgacagcacgatcatacttgatcgtaaaacgctggttaaagtggcgctgggagaacttacgctggatgaattgcttgaaagcggacaagctcaaatcgatggacaaaaaggaaagttcaaagaaatgttatcttatatggataatttttatttctggttccctatttccgaaccgtaa

SEQ ID NO: 5255 - DNA, 312 bp, Xenorhabdus bovienii
  Coding DNA location: Contig name=SeqID_16906; Position on contig =73948..74259bp; Strand=-
ttgggaaccccggctgaagcgaatactagcccatgtttcgatcgcagtagaaaaacgttagacaagctccttgccctcttatcgccctttgatattcggttttattgcacggatgattatgttgtttatgacagccttcccgagaaagagcgcctgactggaaagacgtttactcagcgtatagagagaacgaacttaacgcatcgtacccgaatcaaaaggttgaatagaaaaaccatcggttattcaaagtcggcggaaatgcacgataaagtgataggaacttttattgaacgtgaacattatttttaa

SEQ ID NO: 5256 - DNA, 135 bp, Xenorhabdus bovienii
  Coding DNA location: Contig name=SeqID_16906; Position on contig =74195..74329bp; Strand=+
ttgtctaacgtttttctactgcgatcgaaacatgggctagtattcgcttcagccggggttcccaagcataccaaagccagcgttgatttttcttgttccccacaaacgacccttgctcgtctatttcgcagataa

SEQ ID NO: 5257 - DNA, 276 bp, Xenorhabdus bovienii
  Coding DNA location: Contig name=SeqID_16906; Position on contig =74363..74638bp; Strand=-
atggctaaagttgacgtctattgccgttattgtcaccaatcagaatcggtcaaaggacatggaaaaggaaatggcggacatcctcgttatcgctgctatatctgctgtaaggtctttcagttagaatacacctaccaagcctgcaaacccggtgttaaaaagcagattatcgatatcgcgatgaataacggaggaattcgtgacaccgcccgcctcctgaaagtcgctacagcaaccgtcatgaaaacattaaaaaactcagaccccgaaatgtaa

SEQ ID NO: 5258 - DNA, 189 bp, Xenorhabdus bovienii
  Coding DNA location: Contig name=SeqID_16906; Position on contig =74680..74868bp; Strand=-
atgagccagaaagaatataaaggtggatgtttatgtggcaatatcaagttcattgctaccggaatccccgactttcctcacacctgctcgtgtactatgtgccaaagacattctggcgcattgacactctgctgggttgaatttccaaaagaggcggttcaatggattggcgggtcatgtattaaatag

SEQ ID NO: 5259 - DNA, 117 bp, Xenorhabdus bovienii
  Coding DNA location: Contig name=SeqID_16906; Position on contig =74816..74932bp; Strand=+
atgaacttgatattgccacataaacatccacctttatattctttctggctcatcattactccttacgcgatgttgtacttctgcttgtattatttttattcagacaaagaaaaatag

SEQ ID NO: 5260 - DNA, 159 bp, Xenorhabdus bovienii
  Coding DNA location: Contig name=SeqID_16906; Position on contig =75244..75402bp; Strand=-
atgaatgttaccaatcagaaactatctgaattgtacagttgcttgagggaaaataagaagcccaaaagagcaaatctaatcatagtgaaaaacattagaccaacaactagtttccaaccaacccccccgctgtcaagtcatcctgagaaacgtgaatag

SEQ ID NO: 5261 - DNA, 243 bp, Xenorhabdus bovienii
  Coding DNA location: Contig name=SeqID_16906; Position on contig =75570..75812bp; Strand=+
atggagaattccactttttgcccctcgtctaaggttttaaaatcgttaccttggatcgctgagaaatgtacgaatacatctttgctgccatcctccggagaaataaaaccaaaacctttaccagcatcaaaccattttactaaaccagtcattttattagacatagatatttcctttaattttgagccactttatgtggcgaacatggcctgttttgcagagatttacttattgggcacttag

SEQ ID NO: 5262 - DNA, 141 bp, Xenorhabdus bovienii
  Coding DNA location: Contig name=SeqID_16906; Position on contig =75745..75885bp; Strand=-
atgaaagcagttttagtaaagcagtcctcagttcaagcgttatccatagatatccttcttcatgagcctcctcctaagtgcccaataagtaaatctctgcaaaacaggccatgttcgccacataaagtggctcaaaattaa

SEQ ID NO: 5263 - DNA, 147 bp, Xenorhabdus bovienii; identical to SEQ ID NO: 349
  Coding DNA location: Contig name=SeqID_16906; Position on contig =75965..76111bp; Strand=+

SEQ ID NO: 5264 - DNA, 147 bp, Xenorhabdus bovienii
  Coding DNA location: Contig name=SeqID_16906; Position on contig =76094..76240bp; Strand=-
atgatattcaatctgaaataccgtgtggctgtcatatatgtaatccatattgcacctctcgtgcaacgcagtatcgcagctaaagctgaccgactaaagtcggtggttttaacctttcatatggaaaacttaactaccacctactga

SEQ ID NO: 5265 - DNA, 429 bp, Xenorhabdus bovienii
  Coding DNA location: Contig name=SeqID_16906; Position on contig =76193..76621bp; Strand=+
atggattacatatatgacagccacacggtatttcagattgaatatcattttgtgtgggtaactaagtacagatacaaagtgttgacaggtgaagttgctctacgcgtgcgagagttagttcgtcagacatgtgaagcatttgaaatcaggatattagaaggtgtagtgagtcaagatcacgttcatatactggtgagtagtcccccaaccttggcgccctcagaaatcatgaggagattgaagggaaggacagcgaataagttgtttgaagagttttcgcatctgaaaaagcgctactggggtcgacatttttggggcagaggctatttttgtaccacggtgggccagttaacggaagaaatgataaagggttatctggcacatcattttgaaccgaatccggatgataagttcagaatggacaattga

SEQ ID NO: 5266 - DNA, 774 bp, Xenorhabdus bovienii
  Coding DNA location: Contig name=SeqID_16906; Position on contig =76949..77722bp; Strand=+
atgtcatcaaaattaaactggcttttgcaaaatactgcgccgggctctctggtgttgcaatcctggctgacaaaacacggtatcagtccctcgctagcgaataagtacatgcatagtaactggttacaaaaattacgaaccggggtgtacgtgcgggctgggcgtgatcctgagtggtgggatgtggtgttgtgcttgcaaaaccagcttggtttcccagtacatctggcggggcttaccagcttgggatatcaggggcgctctcattatcttcagttcaagcaacaagccatttggctctatgtgcaagataaagctgcgttgccaaagtggttcaaagaattccccaatatcgagtggcttttactttctaatcagaagctcgctaaacatgatgaaaaatacctgacagaggtagaaatcaagggggaacagctaagaacgagtgtgcctgagttggcagcttatgagattgccaatgctgtaccagggatactttcgtttgaacacgccgccgaactttttcaagggctagtgaatctgagcccccgtaaagtagaagcgctgttgcaatctagccgagcggtgcaaactaatcgtctttatctgtttctggctgattattatgctcatgcatgggctaagcgtttagatcaaaccaacattgatttaggagcagggaagcggcagattgtgtctggtggtaagttagataggaaataccaaatcaccgttcctgaaaaatttgtgagccatgggttattacatggataa

SEQ ID NO: 5267 - DNA, 930 bp, Xenorhabdus bovienii
  Coding DNA location: Contig name=SeqID_16906; Position on contig =77703..78632bp; Strand=+
atgggttattacatggataaatattcgccgtactaccgacaagttgcattactcataagcgcactccttgtggtggcatcggagcgctgttttgcgctaaagggtgggacggcaattaatctgtttgtgcgtgattttcctcgtttgtcggttgacattgatttggtctatgtaccactggaaagcagggacgtagctttggctaatgttcgggctgctttaacccgtatcactgggttgctccaacaacaagtgggtgtttcggcaatactgcaaacgaataaccatgatgagatgcgcattattgtctcttctcaagaggcacaaataaagattgaggtttcacccgtggcgcgtggaacgctatatccttcccaggatcttgatgttgctgaggcggtagaagacgagtttggttttgccactattcaggttgtctcaatggctgatctttatggtggcaaactgtgtgctgcattagaccgtcagcatccacgcgatctttatgacgttaaaatgttactcgaaacgcaagggatagatcgccacatatttaatggatttatcacctatctactgagtcatccccgaccgttgtccgaagtattgaatccccgttggaaagatatctcagagctttatgctcatgagtttagcggaatgacatttgataacgtatcgctggaagaactcaatgttgtacctgaatttatgatttctgccctcaagtcgcaattcactcagcaggattttgatttcctaatatccttcaaaagcggtgagccggattggcaacttgtccctgagagccaaattcagcatttacccgcagtaaaatggaagttacacaacattggccgtatacctgaagagaaacatattcaggcgctggagaaacttgagagagtactgaacgattggatgggatag

SEQ ID NO: 5268 - DNA, 1038 bp, Xenorhabdus bovienii; identical to SEQ ID NO: 1787
  Coding DNA location: Contig name=SeqID_16906; Position on contig =78749..79786bp; Strand=-

SEQ ID NO: 5269 - DNA, 606 bp, Xenorhabdus bovienii
  Coding DNA location: Contig name=SeqID_16906; Position on contig =79973..80578bp; Strand=-
atggaaaagttctatcagttaaaaattacgcttactgaaaccgagccggttatatggcgtcgctttgttgttccatccaatatttcattggatcgtttgcacgatgtgatacaagctgtgatgggttgggaagacagtcacttacatgagttcatttttagcgccaaacgctttaccgaaatgccagatggaatgagtgattgtcaggaagaaggaagattcaaactggattcgctcatcaaacgcaaaggaagcaagtttgcttatctttatgattttggtgatgattgggagcatgagattgtactggaaaacagtaactattctcccgaaaagttgccgatgcctattttctgccttgaaggtgaacaagcctgcccaccagaagattccggtggggtatatggctatatggaactacttagtattcttaaagatcccactcatgaagactatcaagacatgtttgaatgggttaatggcgaagctgatatttcccctaataacgttttttcccctgagaaatttgatgtagaagaaattaataatagactggccttatattatcgctggtcaagggatcgttacttatcgatgtttgagtga

SEQ ID NO: 5270 - DNA, 1569 bp, Xenorhabdus bovienii
  Coding DNA location: Contig name=SeqID_16906; Position on contig =81072..82640bp; Strand=+
atgtctttttttgataaaaacaagaaggcatcttgttttgttgcgctattttttcttatttttcttatacatcaatgctttgggtatcaattgaagctgatatatgtcttcagtgcctttgccttattcttattgctggcggcggtcagtaagcgtgtatatctctttttgattacttttttttcccttgtggcaatactgtacgcgccggttggcctgaattacggttttccagatattaatgcggtaggctcactgctttacacaaaccagaatgaaacgttggaatatatcagtggatttcctgtttcaacttacttaaccgtgatgggtatttttgccttgatgatgttctcattcaggctaaatgtaaacttatcaggaaaaaataaaaaatggttattttttctgttcttcattcctgcattttggtcgccagccaaaggatatattaaatctggttttgaaaacggtacggagcttttgaataccagtttacctgaagtccgctttttcagtgatgcttaccagagttacactaaagtgatgtctgaaaatagccgtttcgccaaaattatcaaacttcaggatgattggcagcccgtagtcaaagaagaaaaatacgacacttatattatggtgattggtgaaagtgtccgaaaagattttttgggcgcttatggtttccccgataaaaatacaccgtggctggataatgcgaatgcaaccctgttaacccactatatttctgccgcaccatcaacccagctatcactgacgaattctctggcgatccgtcagtcgaatgggattaatttgaataacagtgttgtcacgctggcaaataaagcggggtttgaaacttactggctttctaatcaagggatgaagggagggtttgattctcctgtggcaatgatcggccaacaggctaaacattcgatgttcttgaaagaaggtagctccgatgacaggagctatatgccggatgaaaatttattaccttatatccgcaacgcactgaagaatgatcaacatgataaaaagaaaaaactggttgtcatccatttgatgggttcgcatccgcagccctgtgccagaaccaataaccagtacggtactgatttccattccaaaaatatctcatgctatgtacagagtatctataataccgatagcctgctggctgaaatagaaaacattgccaatcaaaaccagttgaactggacaatgctttattttgccgatcatggattgtcctttgtgcataaaggaacggataacgagaacttgactcatggcgatgaaaatcaacagaattatcaagttccttttattattacctctcatgactattctgctagaaataaaatagatgcccagcgcagcggcctgcatcttttgcccatgttatctctatggttaggaattgaagagcctcggctggtctcagagtgtgattggttttccaatcaaaaatgccagaatcaacatactgtcatttcatttgatggtaaacatatggactttaatcgcctgaataacgacgccattcattttggtttatga

SEQ ID NO: 5271 - DNA, 2154 bp, Xenorhabdus bovienii
  Coding DNA location: Contig name=SeqID_16906; Position on contig =82895..85048bp; Strand=+
atgaacaataataaatttttaaaacatatcccctggatgatattggggataattggcgcattctgccttggggtcgttgcgctgcgtcggggagaacatgttagtgccttatggataatcgttgcttccgtggcggtttatcttgtggcttatcgatattacagcctttatatcgccactaaggtgatgaagctggatgcgacacgggcaacacctgcggtcgtcaataatgatggattgaactacgtaccgactaacaaaaatgtcctgtttggccatcactttgcggctattgcgggagcggggccattggtggggccggtattggcggcacaggtcggttatctgccggggacgttgtggctgctggcaggggttgtgcttgctggggcagtacaagattttatggtgctgttcatctcttcccgccgcaatggggcatcactgggtgaaatcattaaagaagaaatgggacaggttccggggacgattgccctgtttggttgcttcttgatcatgattatcattctggcggtgctggctctgatcgtcgtgaaagcactggcggaaagtccgtggggcgtatttaccgtttgctccactgtaccgattgcacttttcatggggatctacatgcgatatatccgtccggggcgtgtgggtgaagtctccgtgatcggggttctcatgctggttgctgtaatctggtttgggggggttgttgcggctgatccttactgggggcctgcactgacctttaaagataccaccatcacttacacactgattggatatgcgtttgtttccgcattactgccagtctggctgattttggctccacgtgattatctggctactttcctgaaaatcggggtgatcgtcggtcttgcgattgggatcgtgatcctgaatcctgatctgaaaatgccggccgtgacgcaattcgttgatggtaccggaccagtctggaaaggcacgctgttcccattcctgttcattaccattgcttgtggtgcggtatctggcttccatgcactgatcgcttccggtactacccctaaattgctggcaaacgaaaaagatgcccgttttattggttatggtgcgatgttgatggaatcgtttgttgcgatcatggcgctggttgctgcatccattatcgagccgggtttgtattttgccatgaatacgcctccggcggctttgggcattactatgcctgatctgcataatctgggaacggcagaagcgccgatgatcatggcatcactgcaagaggtgacagcccatgcagccgcgactgtaagctcatggggctttgttatttcacccgagcaaattctgcaaacggcgaaagacattggtgagccatctgtgttgaaccgtgccgggggagcaccaacattggcggtgggaattgcttacgtattccaccagattattccagcggcaaacatgggattctggtatcacttcggcattctgtttgaagcattgttcattctgactgcactggatgcaggtacgcgctccggtcgttttatgttgcaggatttactggggaactttgttccattcctgaaaaaaaccgattctctggttgccggcatcatcggtacagcgggctgtgtcggcttatggggctatctgctgtatcaaggtgtggttgatccattgggtggcgttaagagcctgtggccgctgtttgggatttcgaaccagatgctggcagcggctgcgctggtactgggaactgttgtgctgatcaaaatgaaacgcgccaagtacatctgggtgactgttattcctgcaatctggttgctgatctgtacgacatgggcactggggctgaaattattcagcgacgacccacgactggaaggtttcttcttcctggcgaaagaatataaacagcgtatcgctgaaggcggggcagaactgacagcccagcaaatcagtaatatgaatcacattgtcgtgaataactataccaatgcgggcttaagtatcctgttccttgtggtggtctatagcatcattatctatggcatcaaaaccgcgataaaagcgagcaaaaacccagcgcgtacagataacgaaacgccttatgttcctgttcctgaaggtggggtaaaagtttcttctacgcactga

SEQ ID NO: 5272 - DNA, 360 bp, Xenorhabdus bovienii
  Coding DNA location: Contig name=SeqID_16906; Position on contig =85084..85443bp; Strand=-
atgggtttcattttcgtttcctatttcactgacaacgattttctttcttttgatcttttgctcactaaaacactaacagcagcgcatgccgcctttgccatcaccaccatagcgcgcattctgacgctcacggaaaaactcttcataggtcatgtaaggtttatctgggtgattctccttcatgtgctggacataagtgtcatagtcaggaacgcccaccaacatgcgggcagcctgccccaaatatttacccgccttgccaagattaccaaacatactgttctccaaagaaaaataccccacataatacaaaggcgattatgcggggtatcgctattacagtatagccgttaccgatga

SEQ ID NO: 5273 - DNA, 954 bp, Xenorhabdus bovienii
  Coding DNA location: Contig name=SeqID_16906; Position on contig =85433..86386bp; Strand=+
atgaaacccatatcagtcacaattctggcaggttttttgggatcgggcaaaacgacgttattgcgtcacatcctcaatgccgaacatggttataaaattgccgtcatcgaaaatgagtttggtgaagtgcccattgaccatgaattaattggggatagggcaacccagattaagacattaagtaacggctgcatctgttgtagtcgctcaagtgagcttgaagatgccttgctggatttactggacggaattgacaaagggcagatcgatttcgaccgtctgattattgaatgtacaggtatggcagatcctggccctattacgcaaaccttcttttcccatgaaattctgtgccagcgttttttgctggatgggattatcacactggtggatgcaatgcatgctgatcagcagcttaatcgcttttctattgcgcagtcacaggtgggttatgccgatagaattttgctgacgaaaacagatgttgcccctgagcatgatgctctgcttgaacgtttacagcgaattaatgccaaggctcccatttataaagtggttcacggtgaggttgacttaagtttgctgtttgatatcgaaggtttcatgctaaatgataagctgacggtttcgaacccggtatttcggtttattcccaaacaacaaaacaccatccagtcgattgtcgttaacttgaagcattcggttgggttggccgaggtttctgacttaatggaagagttactgctgagttttgctgacaatctgctgcgttacaaaggtattcttgctattaaagaagagccacgccgattactgtttcagggagtacaacgcctatatagcgcagactgggatagagcttggcacgataatgaggaacgcctcagcgtgctggtttttatcggcatggatttacctgaacagaaaatccgtgaaaagtttgcggaattgtag

SEQ ID NO: 5274 - DNA, 552 bp, Xenorhabdus bovienii
  Coding DNA location: Contig name=SeqID_16906; Position on contig =86713..87264bp; Strand=-
atgaagcaacgtaaatttttaacccgatacgaaatagacgcaattttggaacaaacaaaacaaggacgtcatgcagaacgggattactgcatgctattaatgtgttttattcacgggtttagggttagtgaattgtgtaatttatgtttatccgacctcgatttaaattcagcaattattcatatcaggcggttaaaaggtgggctatcaacaacacaccctctgattccaaaagaaattgaagcacttaaaaaatggcttgatgtccgccagaaatggcgggatgccgatgcgccgtgggtgtttctttcccaaaaatccggccctatttcacgccagcaagtttatgggttactaaagcgctatgggaaacaggcatctgtcagtgtttctccacatccgcatatgttaagacatgcctgcggctacgcactggcggatcttggccgtgatacacgtctgattcaagattatctcgggcatcgtaatatttcacatacggtgatttacaccgccagtaatgtgaaacgtttttccagaatttgggagtag

SEQ ID NO: 5275 - DNA, 168 bp, Xenorhabdus bovienii
  Coding DNA location: Contig name=SeqID_16906; Position on contig =88094..88261bp; Strand=+
gtgtttgcttattcaggcaacccttgccttatacaccataatttcgataatttgtgtatccgtttgttgcatcgcgtggtgagcgagtggacaaaactgatcgtaattcacctttctcacgttaagaaaaggctagaaaaggagaaatacataacaaaatcccggtga

SEQ ID NO: 5276 - DNA, 1326 bp, Xenorhabdus bovienii
  Coding DNA location: Contig name=SeqID_16906; Position on contig =88215..89540bp; Strand=-
atgaaaacagcaacaaaaaacaatgaggtcacgacccatacctctccggcagccaagcgcgccaatatgactgaagttgaatggaaaaaagccataaaattcgacagtaccgacacaggttggaccatcatgagtattggtatggcaatcggtgccggaattgttttcctgcctgttcaggtcggtttgatgggattgtgggttttcctgttatcttccatcattggctatcccgccatgtatctttttcagcgattattcatcaataccctcgcggaatcaccagaatgtaaagattatcccagcgtgatcagtggctatctcggcaaaaactggggcattttgttaggtattctctactttatcatgctggtgatctggatgtttgtgtactcgactgccattaccaacgatagcgcctcttatctgcacacatttgggattaccagtgagctattatccaaaaatccgttttatggactgatcttaatttgtattctggtggcgatttcctcccgtggagaacagtggctgttcaaaatctccagcctgatggtgctgacaaaattatttgttgtcgccgccttgggtctttcaatgattgggatgtggcatctgtacaatatcggcgtgctgccacctttcgccatactgatcaaaaaagccattatcacgttaccctttacactcacttccatcctgtttatccagacgctaagtccaatggtgatttcttaccgtaaccgccagcaaaatcgtgaagttgcgcgctataaagcgctccgagccatgaatatggcgtttggcgtcctgttttgtacagtatttttctatgccatctcctttactttagcaatgggtcacgatgaagccatcaaagcctatgaacagaatatttctgcgctggctatcgctgcacaattcttccctgacggctgggtagttacggtcagtgttattctcaatatttttgcggtaatgactgccttctttggtgtttatctcgggtttcgcgaagccagccagggaattgccatgaatattctcgggcgcctgatgcccactgaaaagatcaatgaaaaatgggtgcaaaaaggcattatgatttttgccatcttattggcatggggtgccattatcctgaatgctccagtcttaagtttcacttctatctgtagcccaatatttggtatcgtcggttgcctgatcccctcttatctggtctacaaagtacccagcctccatcattacaaaggcgcctcgctaatcctaattatcttcaccgggattttgttatgtatttctccttttctagccttttcttaa

SEQ ID NO: 5277 - DNA, 159 bp, Xenorhabdus bovienii
  Coding DNA location: Contig name=SeqID_16906; Position on contig =90180..90338bp; Strand=-
atgacacaaatttcatctgtgaaattacatttaattaaaaatctcataaatcaaaaaaataaatttatttataatacaatgcaatcataccttatggagttaattttaaaatgtgacagttctaacaaagttctatttacagtgaaacacaacctataa

SEQ ID NO: 5278 - DNA, 1047 bp, Xenorhabdus bovienii
  Coding DNA location: Contig name=SeqID_16906; Position on contig =90379..91425bp; Strand=+
atgaaaattatcggaatttcaggtttattaccgtcacgatgcgtaactaatagtgatgtacttgatttaatagaacagaattcaaaagaaactttccagggtgatttgcccaaaacattaagaacgattcaaaggttactggataaaacaggacttgaaagcagatattggctgggtgaaggtgaaaaaccgatgcgtctgatgaaagaagcttttgaacaggctttgaaacaggcgaatatcagaaaatccgaaattgatctattgatttatcctaacgtcactcgtggtttcactgagcctgcaaacagtacttttattgcaaaggcgttaggattgaattgccggaattatgatgttcttgatgcctgtaatggttgggtaacggcaatggatatcattaatagtaaaatgaaggcgggtgaaatacgttatgcggctattattaatatggaatttggcatgtctgaaggcggtccattcagaaagaatttttctttgaattctgcttctgaattggcctataaatatcctagctttacaataggtgaagcggcttccgtaaccatattgagcaatgaagatacagataattttaaatttgattatatcagcagacccgatttaagtgacatatgtaatatctctttacctaattgggaattgttttgcaatgatagtgatgttgagcttatttcccctctgggaggtaaatatcagttcaactcatatgccgcagcactccatgaatatgcaggagaagaagtacccaaggtattcaaacagcataatatcgccagtagtgatatccataagattttcattcatacaggtgcaccaaatatgtgggatggctttggtaaagccgtcgatgccgctgacaaaatgcacaatatcggccagaaaaccggtaacattattaccgcttctattccttttggtatcgctgatgctcttgagaaagatcgggtcgaaagagataaactctgcatgggatgggcaggcagtggtggaatggtgttttccgcgatgtcgtttaaattataa

SEQ ID NO: 5279 - DNA, 672 bp, Xenorhabdus bovienii
  Coding DNA location: Contig name=SeqID_16906; Position on contig =91747..92418bp; Strand=+
atgaaaagtaaattcactctggcttcactttgtttggcttctcttatgctgacaggatgtgcgacagaatcctcttcaactctccaggttcaaaaagtctcttcgtataacactatttatcaaggtatccgcagtcctatcgctgtgggtaaatttgaaaatcgctcaagctatcagaatggcattttctctgacggcattgatcgtttaggcaatcaatcaaaaacaacgctggtgacgcatttacagcagaccggccgcttcaatgtgttggagcgtaccaacatggcagaattgcaagcggaagcgggtttgcagggtaaagcccagaagctgaaaggggctaactatgtcattacgggtgctgtgaccgaatttggccgtaaggaagtgggtgaccatcaattatggggcattttgggacgtggtaaatcacaggttgcctatgcaaaagtgatgcttaatgttgttaatgttgaaacgtctgaagtcgtcttctcctcagcaggggcaggggaatataaattatccagccgtgaaattattggatttggcggtgcatccggttacgactcaactctgaatggcaaagtattggatttggcgattcgtgaagcagtcaacgaccttgtggcaggtattgaaaatggcgcatggaagccagttaactaa

SEQ ID NO: 5280 - DNA, 348 bp, Xenorhabdus bovienii
  Coding DNA location: Contig name=SeqID_16906; Position on contig =92449..92796bp; Strand=+
atgaaaaagaccttgatattgttaggggtattattgttggcgggatgtgtcaaagcgctgaagaccatttacgaatggggtgattaccagccaacagtttatcaatactatcagcaggacaaaatggggctacaggagcagattcaggcgttgcagaaggtgattgaattagccaaagcgaaagataagtctgttcctcctggcctgcatgctcaaatggggttgctttatagtcaaacaggcaaaattgatgaggcctttcagcagtttgccatagagaaaaatttattccctgaagcggcaccttatatggattttctgttgagcaaaagtaagggagtgaaataa

SEQ ID NO: 5281 - DNA, 270 bp, Xenorhabdus bovienii
  Coding DNA location: Contig name=SeqID_16906; Position on contig =92796..93065bp; Strand=+
atgaaccgtttttggggcgctattgccgctttattattgctgacactgacaggatgtgttcaacaaaagccttatgattatacggctctaagggaaagtcagcctaaatccattctagtgctacccgcagtgaacaaatccgtggaaatacaagctggtggcagcctgatttctcaggtgacttacccactggctgaatctggatattacgttttcccggttgcggtggttgaagagacattccgacagaatggtgtgacagaagcgtag

SEQ ID NO: 5282 - DNA, 159 bp, Xenorhabdus bovienii
  Coding DNA location: Contig name=SeqID_16906; Position on contig =93297..93455bp; Strand=+
atgttagtctctgcggctatttctcaaatcgcgaatacgatcactgacagaggccatgatattgcaggtattaccagtaatcgcctgttaagcgcgggtcaatatggccgattactgtatgggccgcgttcggaacactacggtaaagaaaaattataa

SEQ ID NO: 5283 - DNA, 1341 bp, Xenorhabdus bovienii
  Coding DNA location: Contig name=SeqID_16906; Position on contig =93534..94874bp; Strand=-
atgcatcaatctgatgttgttgatcgttcgcttttctcactgagctggccgatcttcattgatatttttcttcacatggcgacgttattaatcaatacctatatggtcagccatatttcttcggcttacctggctgccatggggggaggcaatcttgttttcgatctctgcattacgattttcaatttcatcagtgtgggttgcagtgttgtaatcgcgcaatatcttggttcaggaaaacgggataaagccagccaagccattcatatctccattgctttcaatttcgtactgggtcttggttgtgcgctggtcacggttttcttcggttataagatcctgcacatcatgaatttgcccgaaaacctgatggaagatgggggcgcttatctgcgtgttctgggtatctgtctgattccagaagctatgtcgattattctcgctgcctgtctgcgggtttatggtaagtcgaaagcagccatgtatgtcactctgattgccaacctgctcaccattgtcggcaatatgattgttctgtatgggttctttggattgcctaaatatgggctggaaggcgtggcgtggtctaccgtgtttggccgtactgtcgcgattattttactcggcgggctactgttttatggcttgaagattaagttcaaccccagattgctcatacactggtcgaaaaatatgctgggcaaaattctgcatatcggtttgcctgctgccggtgaaaatctggtgtggatactgcaatatatggccgcacaggcatttatcggtctgatgggtgaaacgtctctggctgcacaaactatgtatttccagttatcgctgttcattatgttgttcggtatttccatcagtattggcaatgaaattatggttgggtaccttgtaggcgcaaaacgcttcgaagatgcctatatccgcggattaaatagcctgaaaatcggagttatcgtaacgtctggtgtcgtactggttttctggatgctccgggaaccactcctcaacatgatgacggaagataaaaagattattgagcttctactgcctctgttcctgttatcggtatttctggagccagggcgcaccttcaatattgtgatggtcaatgccctgcgcgcttccggtgatgcccgcttcccgctctacactgcactgattttcatgtggtgtatctccattcctgtcggctattttctggggatcgtgatgaatatgggcattctggggatctggattggcttcttctgcgatgaatggatgcgaggacttgtgaacgcttggcgctggaagtccaaaagatggcaatccaagcgattggatatttga

SEQ ID NO: 5284 - DNA, 198 bp, Xenorhabdus bovienii
  Coding DNA location: Contig name=SeqID_16906; Position on contig =94869..95066bp; Strand=+
atgcattgtaaaacctatcgattgaagtggaatgaatggtctttttacggtgtgacatacctagaaagtgtaggtaattctacaaggtttattggtcatttggtaggcgggttacgcgattggtacagatggcattgcgcttccatgacttgctcgcgaatttctacttttggccgcccctgcattttcagcccataa

SEQ ID NO: 5285 - DNA, 642 bp, Xenorhabdus bovienii
  Coding DNA location: Contig name=SeqID_16906; Position on contig =95147..95788bp; Strand=-
atgctggatgtgaactggatactttttctcgtaacggctcttactattaatgctattcctggtgcggatgtgatatatgttacgagtaattatcatcgaatcggctggaaagcggctgcgtcatcagctatagggctggcaattggctattacttctatgtttttattacttgggctgggataacctccatactgatgtctcttccggctctgtataccataatacagacagcaggcgcgctttatctaatttggatgggatataatatctatcgctctaagccatctgaaattactgcatcgtcagaaaaaaatgaccgtaacataaacagaaaaaaatccagttcctatctccttaacgggttattgatcagtatcctcaatcctaaagtaggcatattttttgtctctttttttcctcaatttgttcatcaaaacagccccgattatctcttacttgttctcggcaccatattctgtataggcgccactttttttaatattttatattgccttatcacagcccaactcaaacggatatccccagagaaaaccaattttattctcgggcgtattcccggtcttattctcattatccttggggtaatgatgatattagaatcaataaaatcaatcatataa

SEQ ID NO: 5286 - DNA, 801 bp, Xenorhabdus bovienii
  Coding DNA location: Contig name=SeqID_16906; Position on contig =95792..96592bp; Strand=-
atgtttactgttataactgaaactttttttcacactagttttctccataaaaaactgagtcatttccagctaaattggatgatcagaaatgccagaaaactagatatatcaacactcaacaatatacattatgaactttcaaaaaaggataaaataacagatggggatattaacaagttagaaatatcttataaaggcctcagtgaaccagaaaaatatctcgcaaaaaattatggcgtcccagaaactcatgctttatcttccgctaatatcattgatacagaaaaactgggaataaatttttttcaagattatctgaataatgaatgtagtaaatataatgatggtgctcttattttccttgatgttatcttggctccattctggcttaatcactttgaaaaaaagatcgttaacgctcattctgccgttcttccctatgccagaggcatgtacgcaatagaacaactgactgcaacaggaaataaagatgcagtcgagcgtgcagccggtgcaacactacactatgttgacacagggatagacacgggggctattatagagcggaaaaaactactttcactctggtcgttagaaacaatatgggcagtaaaaggggaatcttacctactcgcatttgagctgatgaaagactacttggaaagaagcaaaccatttaattttattgatactctatcggttgaatatggcactgacagccctctctttactagcaaaacttttacggataaagtaaagcgtcaatcagaatattgttttctcaaaatgaaaggaatttaa

SEQ ID NO: 5287 - DNA, 183 bp, Xenorhabdus bovienii
  Coding DNA location: Contig name=SeqID_16906; Position on contig =96631..96813bp; Strand=+
atggaggaggtttacaatggttttatttttagtcagactatagtttatttttgttatgaaataaagttgactatttatagttttaaacctatttccttattgttatgtgttattttttattggggttttttatctgtatttaatgatttaattactatttttagtcatgataaaggagattaa

SEQ ID NO: 5288 - DNA, 936 bp, Xenorhabdus bovienii
  Coding DNA location: Contig name=SeqID_16906; Position on contig =96815..97750bp; Strand=+
atgctcttcgatgacatatcatctttaattaatgacagatgttttataaatattaatggttggattcctgattccgctgtttcattaaaagtggaggggatttctgttacaggatcaataaaaataaagcctgcgctatatatgatttcagcgcttgaggatagtggggtactaagaacaggaaaaaaattgattgagagttcgtcaggaaatctagggttagcattgagtatgatttgtgcctggaaaggttatccatttatttgtgttagtgatccgaatatagctcctctgactgagaggacgatccgggcatatggaacaaaccttattatagcgaaaagtaaagataataatggaggttatttgggagaaaggataagaataattgaatctatgctaaaagaggatcagaatttaatatggattaatcagtatgaaaataaaaataatgttctttctcattatagtatgacaggaaaaagtatattggagaaatatccatatcctgattatgtatttattggcgcgggaacgacaggaactcttggcggtgtgtcaaactatatacgtaaatactctccttcaacgaaaattattgctgttgatacaaagggatctgtcacttttggtggtgaaccaagtaaaaggaggatccctggcttgggaaccagtaaggcaccagaaattaaaaaatattcacaattcgatgagattatttacatagatgaaaaagaaaccgtattcacttgcagagaattggcttcaatgggcctccttttaggaggatcaacagggacggttttagctgctgtccggcattatgaaagcatcattgggaaaaacaaaattgttgtggctatttctcctgacatgggagagaaatatatagacactatatataatgatgattgggttaataaattttataattaa

SEQ ID NO: 5289 - DNA, 1008 bp, Xenorhabdus bovienii
  Coding DNA location: Contig name=SeqID_16906; Position on contig =97760..98767bp; Strand=+
atgactgataataaattcactattatttctggtaatgatgttgaagtctggataaaagagaataaggaaaagattatcgaaataattaaaaaaacttattgtttatttagcgatggaatggtaactaatcctgatagtcatttcttgagatttcctgatagtgacaaaaataggataattgctctacctgcatctatagagcatggtaataaagtagccggaatcaaatgggtcagtagttttccagataatatacagcatggattaaaccgagcttctgctgttgttattcttaatgatcgtaatactggctaccctatcgcttgtattgaaggtagtcaaattagctcagcaagaaccgctacatccgctatcattggtgcggagtatcttcatcaggaaaagagatgtgatcaattggctgtcatagggacagggttgatctctttttctatcgttgaatatttatatagcacaggctggaaaatcgagaatattgttgttagtgatttatctgaaactaatgctgccaaatttatctcatactgtaaacagaagttaggtattgaggctaaatatttggatacgactgatgcgattagtcaatcagatttgattatctttgctacttcggctgttagcccccatatcgttgatcccgcgctgttctcccataatccaaccgttttacatatttctctacgtgatctttctactgatatcatattaaaagcagaaaactatgttgatgatatttctcatgcagttaaagctcatacttctctgcaccttacagcagaagagactcgtgatacaaaatttataaaaggaagtatatctgatcttattcggggtaaagttaaacccgacaaaactaagttaagaatatattctccttttggaatgggaatgctggatattgccgtagctgaaaatatatattctgatttgaaggatatatcaggcattacaatttcagactttcatcctttacccgtcatgagataa

SEQ ID NO: 5290 - DNA, 540 bp, Xenorhabdus bovienii
  Coding DNA location: Contig name=SeqID_16906; Position on contig =98937..99476bp; Strand=+
atgaaagcacttatcgtaatcgacatgctgaatgattttgtaaccggtgtcctcgccaatgaagaaagtgcgatgaaaattactccgcctattcagcgaatgatcaaacatgccagaaataaccctgattggttggtggtctatgtcaatgatgcccatcatgcggatgatcgggaaatggatatctggggaaaacatgcaatggtcggtacatggggtgcggatgtgattgatgaattggctccaatcggcatggagcgtgaaatcgtttttcccaagcgattttataatgcgtttgacgggacggatctggaaaatgttttcgcacaatatggcgtgactgaagtggtgctggtaggtcagcatactcattgctgtgtccgccatactgcttacggtgcgtttactcgtggttatgctattacggtattgtccgatgctgtttgtgtttcccccggtatcgatcagcaagctgcccttgattatctgaaaaccatctatggggctgaaattacgaccagcaaagcattcggagtatga

SEQ ID NO: 5291 - DNA, 348 bp, Xenorhabdus bovienii
  Coding DNA location: Contig name=SeqID_16906; Position on contig =99550..99897bp; Strand=-
atgcaaaagattgctttactcacttacattctggttctgttcagtttcgcgcaacccgcaaaagctctgtctgaggaagaggctgaaagtcttgctgatatgacagccgtctacatttatttgaaatatgattgtggctatagccaaatcccagatcgtgagatcaggcgtgcagttatttattttgctcaacgcaacaaatgggatctcaataactacaacagtcagttaatggaagaactgaatcagtcaggctacaacgatctgaagggaatcaatctgccccaaaaggcaaaatgccaggcgcttgcccgaccctctctcagcctgctagcttatgtaaaataa

SEQ ID NO: 5292 - DNA, 276 bp, Xenorhabdus bovienii
  Coding DNA location: Contig name=SeqID_16906; Position on contig =99990..100265bp; Strand=+
ttgccattttttctgtggcgtactgacgctgcgaacacatgggttaaggggaaagtgactcttgttattgacgatcatcataacggtaacgggcattgccaccagtgtgatgaaccaagatatggtgatggtttggatttagtggcaagaactaaagtgatctccatcactgaggcggcaaaagtcgttgctgatgtgctggcgttgcctttgccagaacccaagtcaaccagacaaaccagagaagacaagcatatcgcgtcagcatggttttaa

SEQ ID NO: 5293 - DNA, 171 bp, Xenorhabdus bovienii
  Coding DNA location: Contig name=SeqID_16906; Position on contig =100156..100326bp; Strand=-
atgtcatttttcaatcaaaatcagattattacctattttaaatttcacgtaatacaacagattaaaaccatgctgacgcgatatgcttgtcttctctggtttgtctggttgacttgggttctggcaaaggcaacgccagcacatcagcaacgacttttgccgcctcagtga

SEQ ID NO: 5294 - DNA, 168 bp, Xenorhabdus bovienii
  Coding DNA location: Contig name=SeqID_16906; Position on contig =100356..100523bp; Strand=-
atgttactggttcctgtaaggattattcctccacagcttgttttatcccctacagtcaagaaatgtcctataaccatattcctttctccctatgctgatacaattttactgatagaacaatttatgagcgccatgctataccagaaaaatttaataattccactatga

SEQ ID NO: 5295 - DNA, 1248 bp, Xenorhabdus bovienii
  Coding DNA location: Contig name=SeqID_16906; Position on contig =100447..101694bp; Strand=+
atggttataggacatttcttgactgtaggggataaaacaagctgtggaggaataatccttacaggaaccagtaacattacattttatgggagggatgctgcgatagaaggctcttttgttacctgtggaaaacattcaggcaacttttcgatcgtgggcggtgtgaattgcttttttgatatggaagctaaattggctgggacgttggatagtcagagcacttgtccttgtagggcaaatcttattaactccattcctgatagttatcaaaatgaagcacacttttctaattttacttctcaagatgttactaaagatacagaatcaacaactgctcagagcagtcacaatacaacaaataaatctagttctgattcatatgcacaatcagaacaaaaaattaagccggaaccattaccactacctgctgtaatctttaaaacaaaaaggaaaatggatgattatgatgctgaagacatgatatatgctgatttatcagaagaacagcttaaacataaagttgggctaactgatgttggcgtgccttgtcataattattcattgattgattttattgcacaagcagaacttcctaaagaaaatattatgcaatggtgtaacccatatacaatggaagatcgggataccagtgccagaatgttatttgataaattcagagaactatctgatttatattcatttgtaggtgaatatcagggggtaatgagaaaaatgatttctcatatgcaaggaaatactggggaaaagttcactgatccattacttgataaggcaatgtcagagcgtattttggaagatacatcagatcagagttctctacttgtaattaaaagaacacttattaaaaatattgattgggataatggttattatccattagataaaaaaggaaaactttatgaagcaataattggctctgtattaccaaagtttgacaatatagaggatagagttaatgggctgggaatcaccgttcatgacacgtgggcaacacatattactttgcagtctttggaagtaaatggtaatgctttcaaagctactatccattatcatatacaggatcactttggattagataaaagtgatgttacacattatttctacaaaaaatttcgtatattcaggatatggtttttacttcagcattggaaccaatatggctataaaccatttattaccgaaatgaatgtaacacaggtaatagaagggagttgcaatgaataa

SEQ ID NO: 5296 - DNA, 465 bp, Xenorhabdus bovienii
  Coding DNA location: Contig name=SeqID_16906; Position on contig =101687..102151bp; Strand=+
atgaataagtataaattatttttatcactaatagtcatttttgttgtttatggagtatggtggctattacaacctgtagaaattattggtgttcatcatagatctagtggttacaatgatgttcttgttaaacattttccaataacagatcgggggaagattgattggtgggaaaaaaataaatcaatgcttaaaaataaatatggtatccctgttacagataaagacggtaattttgatataagtatttgggatataggtgatggatataaagaaatgcctaacactgaccaaaactcagatttactttgttttgatgatatgaaagttaaagcgaattgtattgaaaaaaatagagttctggaagtgtcgcgttttgacggtggaaagataagctttgtaatgagacatagtgcatatctacaacgcaaagaaggcggagaaattaatccatatcaatggtga

SEQ ID NO: 5297 - DNA, 372 bp, Xenorhabdus bovienii
  Coding DNA location: Contig name=SeqID_16906; Position on contig =102202..102573bp; Strand=+
ttgggcaatatactgacagatatagatttgtgtgaagcgttatcctatgtctttgtagataatgaagttgattatgaatatatcgcttctgtagccaaacatttcccgcttgagcatgtggaaatggtcttcttcgagtgggtggctccgatatgttataccaatgggcttatccttgtgcctcctgtatggactttttttgatcgtgaacaactttgggaagatgttcacgagctaaggcgaaaacaaataacaggaggtaagatagaaaaaataaaagaaaatatcaggcgatgttttttgcgtaagtaccttgaaaaagagtggcaacgtttgaagaaaaaattaactgacgatattttttggagataa

SEQ ID NO: 5298 - DNA, 171 bp, Xenorhabdus bovienii
  Coding DNA location: Contig name=SeqID_16906; Position on contig =102615..102785bp; Strand=-
atgctcaatcttgtgaattttattcatttcacaattaaatttcataacatagaacccgctttaatcacactaggaaaaatggcaaaattccgcctacaaaaagaaataaataatataaattatcttctacaaaaacatgaagaaacagatgatagttttttatgggaatga

SEQ ID NO: 5299 - DNA, 171 bp, Xenorhabdus bovienii
  Coding DNA location: Contig name=SeqID_16906; Position on contig =102748..102918bp; Strand=-
atggctgagactttttcttttgaccatttaagatatcaagaacatttagcatctttagaattaatccagaatagatcaataaaaatcattcattatctaaaaagtgattggtggcgtggtgtcttatgcctttatgctcaatcttgtgaattttattcatttcacaattaa

SEQ ID NO: 5300 - DNA, 513 bp, Xenorhabdus bovienii
  Coding DNA location: Contig name=SeqID_16906; Position on contig =102985..103497bp; Strand=+
atgcagaatgaaatgtccgcgctgcgtaatattttccgcatggcaggctgggagaaattggaaacctctccgcgtttgagcaatcaggtattgggattgagtggagccagtcgcgccggaatgaaacaggcgatccctgatgcaacgtctcaggttgtatatcagaaggcacttgaacgtgatgcaggatttgcagtcacactgaaacttgcccgtttgatgggctacgttctcaagaagcggtgcagtgcttcgttaaaaagctggcggaaacagctagagcaaccagagccaaaacttcatgttgttttcggcacaaaaggcggtagaccaaggcaaactcgtgtactggatgttgctgcggtgaaagaagctgtagagcaggcaattgccattgcagagcagcgaggcggcaagttgattgataagtcggatctcaagcaagccatgacctactggcgagtacataccacaaggattggtttaaatggaaggggtagcaggaatgattga

SEQ ID NO: 5301 - DNA, 282 bp, Xenorhabdus bovienii
  Coding DNA location: Contig name=SeqID_16906; Position on contig =103472..103753bp; Strand=+
atggaaggggtagcaggaatgattgacgttagaaatgactggcattctgccgatattatcgctgcattacgtaagcgtggtacgaccttggcggctatctcccgtgacgcgggattcaactcatctacattagcgaatacgctgtcatgcccgtggcctaagggtgaatggattattgctaattatctcgacactcacctgtctgaaatctggtctagccgttattttgatatgaacggtaatcttatcgaacgcaaaattcgcgataaatcatcaaaataa

SEQ ID NO: 5302 - DNA, 102 bp, Xenorhabdus bovienii
  Coding DNA location: Contig name=SeqID_16906; Position on contig =103824..103925bp; Strand=+
atgagatggcacaattggttatccgtcaccgcaatctttaataccttccgacgaaatgcgtcgcaacctcctatcacaaggccagaacgtttagtgtactga

SEQ ID NO: 5303 - DNA, 144 bp, Xenorhabdus bovienii
  Coding DNA location: Contig name=SeqID_16906; Position on contig =103957..104100bp; Strand=-
atgtgtctttttacgaaaagtgatacaccgattgatataccgttcaccacacaaagacgcacacacaaaaaacatgagaacaaaatattttgcaaagcatatcagaattcaccgcctacagtaaaagaagggttgaatctatga

SEQ ID NO: 5304 - DNA, 546 bp, Xenorhabdus bovienii
  Coding DNA location: Contig name=SeqID_16906; Position on contig =104137..104682bp; Strand=+
atgagtaaaccaaaacatattgtagaagtgatgatctccgaacaagagattaaacaacgtattgctgaattggggcaacagattacagaacactatcgcaatagcggccgtgaactggtgctggttggtttgttgagggggtcatttatattcatggcagacctgtgccgtgaagttcaggttccccacgaagtggattttatgactgcgtccagctatggcaatgagatgaactctacccgcgatgtgaaaatccttaaggatttggatgaagatattcgtggcaaagatgtgttgatcgttgaagatattatcgactcaggcaatacactgaataagatccgtgagatttttgcgctccgtgaaccgaactctctggcgatctgtacgttgctgaataaaccctcccgccgtgaagtcgatgtgccggttgagtggattggctattcgattgaagataaattcgtggttggttatggcattgattatgcccagcattaccgccacttgccttacattgggcatgttactctgctggaagagtaa

SEQ ID NO: 5305 - DNA, 654 bp, Xenorhabdus bovienii
  Coding DNA location: Contig name=SeqID_16906; Position on contig =104759..105412bp; Strand=-
atgatgagaaaaattgaagaattgtttgccaggaacaagcagtggtcacaatccgtaaacgaagaaaatcctcacttcttcaaagaattgtcaaaagtacaaaaaccccattttctgtggataggttgttctgatagccgcgtgcctgctgaaaaactgattgacgctgcaccgggcgatctttttgttcaccggaacgtcgctaatctggttatccatactgatttaaactgtttatctgttgttcagtacgccgttgatgtgctacaggttgagcacattatcatctgtggtcactacggctgcggaggcatagaagctgccgtagatggcactgaattaggcttaatcaataactggctgctccacattcgggatttgtggtacaaacacagctccatgctcggcgagttgccgcctaacgatcgactgaatcgtttatgtgagttgaatgtcattgagcaggtttataatctcggccactcgactattatgcaagcagcgtggaaacgtgggcagaaagtcatgatccatggctgggtatatggcttgaaagatggcgaactacatgacctggatgttaccgctgacagccgtgaaaaactggaacttaattaccgtcaggccatttccaagctggcgcataagaaataa

SEQ ID NO: 5306 - DNA, 927 bp, Xenorhabdus bovienii
  Coding DNA location: Contig name=SeqID_16906; Position on contig =105594..106520bp; Strand=+
atggcttatgcattggagttgacgcagcttacgaaaacctatgcaggtggaatgaaggcgttgcgtgggattgatttacgtgtcgaagaaggcgatttttacgcattgttgggacccaatggtgcagggaaatcgaccactattggtatcattagttctttagttaataagagtagcggtaaggtcaaggtgtttggttacgatatcgacacggatctcgtcaatgccaaacggcaactggggcttgttccgcaggagtttaatttcaacccatttgaaaccgtgattcagattgtactgaatcaggcgggatattacggcgtaccccgcaatgtggcatataacagagcagaaacctatctgacccaactggatctatggggaaaacgtaacgaacgggcaaatcggctgtcaggagggatgaagcgtcgtctgatgattgtccgtgctctgatgcaccagccgaagttgctgatccttgatgagccgacggcgggagtcgatattgaactgcgtcgctccatgtgggagtttctgaaggccttaaatgcgcagggaaccaccatcatcttgaccactcactatctggaagaggctgaaatgctttgccgtaacatcggcattattcagcatggtgagttggtggaaaataccagtatgaaagatctactcagccaattagaatgtgaaacatttttgttcgacttcatgcccagaggtgcgatgcctgtcgttgaaggttatgactatcgtctggtcgatgcggcaacgctggaagtggatgtcaagcgtggtcggggattgaatgatattttttcccaactgagtatgcagggtattcaaatcagcagtatgcgtaacaaagcgaatcgtctggaagagctgtttgttgggttgaccaataataatcaaggagctagtcaatga

SEQ ID NO: 5307 - DNA, 771 bp, Xenorhabdus bovienii
  Coding DNA location: Contig name=SeqID_16906; Position on contig =106517..107287bp; Strand=+
atgattcaattgtactgggtagcgctaaaaaccctctggatgaaagaaataacccgctttggtcgtatttgggtacagaccttactgccaccggtgattacgatgtccctctatttcgtcatattcggcaatctggttggttcccgtattggtgagatgggagggttcagttacatgcaattcattgttccagggctgattatgatgtctgtgatcaccaactcatatgctaacgtttcctcctccttctttggcgctaaatttcaggggagcattgaagaagtgctggtcgctcccgtgccaactcatatcattattgctggatttgttggcggtggggttacccgtggagtgtgcgttggtattttggtgacactggtttcccaattattcgtacctgtgcagatccattcatggagtatggtggtgatcaccttgctggcaacatccatattgttttcgttggcagggttattgaatgccatttatgcgaaaacgttcgatgacatcagcatcatcccgacttttgttctgacgcctttgacttatttgggcggcgtattctattccctgaccctgctgcctgaattctggcagatagtatccaagctcaacccgatcgtttacatgatcagcggcttccgctacggttttcttggtattactgatgtttctctgacgatgacgttaggtatgctgggtatgtttatctttgttttttatctgttggcttggtatttgatcgagtcagggcgagggctgagaacctaa

SEQ ID NO: 5308 - DNA, 135 bp, Xenorhabdus bovienii
  Coding DNA location: Contig name=SeqID_16906; Position on contig =107248..107382bp; Strand=+
ttggtatttgatcgagtcagggcgagggctgagaacctaaaaacaagaatttgtaaatataacgctccgccgttgtttacggcggagtggcgcaatagtgagtcggtcattggtgggaacggttatgcaacctga

SEQ ID NO: 5309 - DNA, 381 bp, Xenorhabdus bovienii
  Coding DNA location: Contig name=SeqID_16906; Position on contig =107370..107750bp; Strand=-
atgttacgcaccatgctacaggggaaactacatcgagtaaaagtgacgcaggccgatcttcattacgaaggttcctgtgccatcgatcaggattttatggatgcagccggcattctggaatatgaagcgattgatatttataacgttgataatggagaacgattctcaacttatgcaattgccgctgaacgtggttccagaatcatctccgtcaacggtgctgctgcacgtcgtgcggcggtaggcgataagctgattatttgttcatatgtccaaattgctgatgagctgactagatttcatagacccaaagtagcttattttgacggtgataatgtgatgagtcggctggcaaaagcggttcccgttcaggttgcataa

SEQ ID NO: 5310 - DNA, 111 bp, Xenorhabdus bovienii
  Coding DNA location: Contig name=SeqID_16906; Position on contig =108244..108354bp; Strand=+
atgatatttgcgcctaaatcagggatatgtgcatcacgttacgactccactaacacacacatcccatcactaaaatcagccaaccaaatcgacttgttgattgtcaattaa

SEQ ID NO: 5311 - DNA, 858 bp, Xenorhabdus bovienii
  Coding DNA location: Contig name=SeqID_16906; Position on contig =108319..109176bp; Strand=-
atgctgattatagaaacgatccccattttacgccgtgaaatccgccgctggcatcaggcaggcaaacgtattgcctttgtgccaactatgggtaatctgcatgatggccatatgtcattggtggacaccgccaaagcacaggctgacgtagttatcgtcagtatttttgtcaatcccatgcagtttgagcatgaagatgatttggtcaattatccgcgaaccctacaggaagactgcgaaaaactgagccatcgcaaggtcgaactggtctttgctcccaacgcaaatgaaatgtatccgaatggctctaacagcagccagactttcgtcgaagtaccagagctttcttatctgcttgaaggtgctaaccgtccggggcatttccgtggtgtcaccaccgttgtcagcaaactgttcaatctgattcaacccgatctcgtttatttcggagaaaaagatttccagcaagtgcagattatccgcaagatgattgctgatatggcttacgatattactttggtttccgtccccatcgtccgtgaaaaaagtgggttggcactgagttcccgcaataatctcttatcggctgaagagaaaaaaattgctccggtattgcatcagatcatgcagtgtattgcagaaaagctgacgcatggagaacgagcgaccgaacaactgctcgaactggcatcgacacatttgcgtgaagaaggctttatgccggatgaattatttatccgtgatgcagaaaacttgttacctctgacatcgcaaagtaaaaaagccgtgatcctaatggcagcctggttaggacgagtacgcttaattgacaatcaacaagtcgatttggttggctga

SEQ ID NO: 5312 - DNA, 825 bp, Xenorhabdus bovienii
  Coding DNA location: Contig name=SeqID_16906; Position on contig =109216..110040bp; Strand=-
atgggacaggccctaactattcaggagataacaatgaaaccaacaaccctggctgatctgagtcagttaaaaaaagagaagcgcaagttcgctacaatcacagcttacgatgccagttttgctcaccttttcgccgaacaaggcatcaacgtcatgcttatcggcgattcactcggcatgactttacaaggatttgactcgaccttacctgtcacggttgaagatattgcttaccacacccgctgcgtccgtgctggcgcgccccactcttttctgatctcagacatgcctttcatgagttacgccactccagagcagagttttagcagtgctgcgacattgatgcgttccggggctaacatgataaaaattgaaggcggaagctggctgtgtgagacggtaaaaatgctgaccgaacgtgccgtgccagtgtgtggtcatttggggctgacgccgcaatcggtcaatattttcggtggctataaagtgcagggtcgtgatgaaacctccgcccaacaattgcttaacgatgcgatggctttggaaaaggcaggtatacagctactggtgctggagtgtgtgccgacagcattaggccagcgagtgagcgaagcgctggaaattccggtcattggcattggcgcgggcaatctcactgacggtcagattctggtcatgcacgatgccttaggcatcaccgccagaccacctaaatttgccaaagatttcctcaaagaaaccggcaacatacgggatgccatccgcctgtatatcgagcaggtagaaagtggtgcctatcccggccaagcacactcattcaaataa

SEQ ID NO: 5313 - DNA, 483 bp, Xenorhabdus bovienii
  Coding DNA location: Contig name=SeqID_16906; Position on contig =110171..110653bp; Strand=-
atggcacgggtttacatcgccattggcagtaatctggctgatcccttgcagcaagtcgataatgcacttgctgccctgcatgtgatccctgacacaagctttgtaatgcgatcctctttttatcgcagcaaaccgatggggccacaagatcagcctgattacctcaaccttgctgttgcactggaaaccaagctgcaaccagaagcgttgctcgatcacactcaagctattgagctggcacaagggcgtatccgaaaagatgagcgctgggggccgagaacactcgatctggatatcatgctgtttggtgattgcattattaagactgaacgcctgaccgttccccattacggcttaaaacagcgcgagtttatgctttatccgcttgcagaaattgcgccgaatcttgtattcccagatggagaaacactggcagcacgattaaaacatgttccagaaaatggcctgacgttttggttgtag

SEQ ID NO: 5314 - DNA, 1512 bp, Xenorhabdus bovienii
  Coding DNA location: Contig name=SeqID_16906; Position on contig =110655..112166bp; Strand=-
atgatccgcgaaaacaaaacaaaacgcgacacacaggcagccagtgaaaggccagtcaccatatctgaccatactgctcaaatagagagcagcactctgcctaaacatcgcagagaacatcactcatcttcatcaaatgctgataacgccacaatgaagaaaaaatccgcaaaggccaagccttcggaccccccgatcacggtgctccctcgggatcagcacccaatttcacgtaaagacatcagtgacaatgccctgaaggttttgtatcgcctgaataaatcaggttttcaagcctatctggtcggtggtggtgttcgtgatttattgctgcacaaaaaacccaaagatttcgacatcgcaacgaatgccacaccagaacaggtacgcaaactcttccgtaactgtcggcttgtgggtcgccgtttccgccttgcccatattatgtttgggccagatgtgattgaagtcgccactttccgtgggtcacacgagcaagttgaatccaatgaccggaatcagtcacaaaaagcacaaagcggaatgttactgcgcgataatatcttcggttcggtcgaagaagatgccgttcgccgcgatttcaccatcaatagcctctattatggcattgaagatttcgccttgcgggattacgtcggcggaatggctgacctgcaagcagggatcattcgcctgattggtgatccagaaacccgttaccgtgaagatcctgtccgtatgctgcgcgcagtccgttttgccagcaaacttgacatgaccatcgagaaaaccactgccgaaccgatcccgcagcttgcctttctgttgaaggatattccctccgcacgcttgttcgaagaatccctgaaactattacagtcggggcatggttacagcacctataaactgctgcgcgagtacaatctgttccaactgctattcccgatgatgcagcgcggtttcactccaaacaatgactcaccgctggaaaaactgctggaacaggtgctgaaaaataccgattatcggctccagaacgacaaacgtgtcaatccggccttcttattcgcggccatgttgtggtatccgttgattgaacatgcagagaaactgtctcaggaaggtggtttaccgtattacgatgcctttgctctcgcgatgaatgacattcttgatgagcagtgcggttctattgccattccgaagcgtcataccacgactatgcgtgacatttggttattgcagcttcgtctgccacgccgtcagggaaaacgcgcgaataagctgatggagcatccgaagttccgtgctgcgtatgatttattggaattacgcgccaacgttgaaccacggcatgaactgaaagagctggtactgtggtggtcagaattccaacaggcgacagcacctcaacagcgtggcatgatatcagaactgggcaccgaccccgttcgtcgcagaacacgtccccgccgtagcagccggcctcgtcagttcaaggacaacgggtga

SEQ ID NO: 5315 - DNA, 897 bp, Xenorhabdus bovienii
  Coding DNA location: Contig name=SeqID_16906; Position on contig =112308..113204bp; Strand=-
atgactcaatctgaacattccgcattatatatcgggcgtttcgctccgtccccttccggggatctccacttcggttccctagtaactgcactgggcagttacctacaggcgcatgcctgccatggcaaatggctgatgcgcattgatgacatagatcccccaagagaagttcccggagccgccagccggatattgcaatcccttgagcattatggtctttgctgggatggcgaggtgctgtatcaatcccagcgccatgaagcctatcgtgcaatactcgctcagttgcaacaacagggaagcagctattactgcacctgtacccgccagcgcattcaacaattgggcgggttttatgacgatcattgccggcattcatatttgcctgctgacaatgccgccgttcgcttgaaacaacgccatccaatttataggtttcacgataaattgcagggttacatcactgttcctgctaaaatggcggaagaagacttcaccatttatcgcaaagacggtttattcgcttataatctcgtcgttgttgttgatgataaccatcaaggcgtgactgaaattgtcagaggagcggatttgattgaacccacggttcgccagctatcactgtaccagcacctgaattttgcgatcccagattatgtgcatttacccctcgttctcaatcaagagggaaataagctctctaagcaaaaccatgcccagccgatcccactggatgatccacggccattgcttattgatgcgttatcatttttaaaccaacccaccattgcaggctggcaagatctcacgacagatcaggtgctgcggcaagctatcgtcggttggaatataaaccctgttccgcagaaaaacataacctatcgccaattcaaataa

SEQ ID NO: 5316 - DNA, 456 bp, Xenorhabdus bovienii
  Coding DNA location: Contig name=SeqID_16906; Position on contig =113264..113719bp; Strand=-
atgcaagaagggcaaaaacgcaaaacctcgtccttaagcattctcgccatcgctggggtagaagcttaccaagaaaagccaggcgaagaatacatgaacgatgcccagttaacgcatttcaagctgattctggaagcatggcgcaatcaactcagggatgaagtagaccgtactgtatctcatatgcaagatgaggcagcgaacttccctgatccagttgaccgtgcggcgcaagaagaagaattcagtcttgaactacgtaatcgggatcgtgaacgtaagttgatcaaaaagatcgaaaaaacgctgaaaaaagtcgaagatgacgatttcggctattgtgaatcctgtggggttgaaatcggcatccgccgtttagaagctcgcccgacagctgacttatgcattgactgtaaaacgttggccgaaattcgcgaaaagcaaatggctggctga

SEQ ID NO: 5317 - DNA, 126 bp, Xenorhabdus bovienii
  Coding DNA location: Contig name=SeqID_16906; Position on contig =113670..113795bp; Strand=+
atggcgagaatgcttaaggacgaggttttgcgtttttgcccttcttgcataatgcttctccttacacacgcactatcaaacgacccccccaacaatggggggaaaaaaataggccgctataaatag

SEQ ID NO: 5318 - DNA, 711 bp, Xenorhabdus bovienii
  Coding DNA location: Contig name=SeqID_16906; Position on contig =113916..114626bp; Strand=-
atggaattttcgcctcccctgaagtcagcgaccctaatccgtcgctataagcgctttcttgccgatgtcctcaccccagaaggtgaaacgctgaccatacactgtgctaataccggagcaatgacaggatgcgcgatgccgggagataccgtgtggtattccacatcagacaatcccaaacgtaaatatccgaatagctgggaactgactcagacccaaaacgggcatttgatttgtgtcaatacactcagagccaacgaattggtctatcaatccattgaaaaaaatgcaatttcagaattatctgactatgagcaaatccgccgtgaagtggtctatggaaaagagaagagtcggatagatttattgttacagtcaaaacagagagttaactgctatattgaagtcaaatcggtaacattgttgcaggaaaataagggttattttccggacacagtgacaattcgagggcaaaaacatttacgtgagctatcattgatagcacaacaggggcagcgtgctgttctgttctttgctgttttacattctgggattagtcaggttgcggcagcaaaacatattgaccatgattatgcatgtcttttggaacaagcctgtaattcaggggtcgaagtaatctgttacggggccagcataacagaagacaggatggttctaagtcacaaattaccttttgtatcaataggataa

SEQ ID NO: 5319 - DNA, 2466 bp, Xenorhabdus bovienii
  Coding DNA location: Contig name=SeqID_16906; Position on contig =114730..117195bp; Strand=+
ttgttattaccaatttatgacgttttggactctgttataactaagttgaaaacgtcgaaacaggtattgttgcatgcacccacaggggcagggaaatcgacaggattgccattggcgatcctgaataaagctcaactgacagagcgcattattatgctggaacctcggcgccttgcagcgcgcagtgtagcagagcgtcttgccgaacaattgaatgagcctgttggcgtgacggtaggttatcggatgagggcggaaaccaaagtcagtgcctctacacgccttgaagttgtcactgagggtattttgacccgaatgctacaacaagatcctgaattaagcgatgtttctctggttattctcgatgaattccatgagcggagtttacaggctgatctcgcgttggcgctgctgctggatgtacaggaaggtctgcgtgaagatctgcgtattctggtgatgtccgcgacactagacaatcagcgtctttcttctttattacctgatgcgcccgtgattgtttcagaaggtcgtagctatccggtagcacgatcttatcatccgctgccgattcatcagcattttgaacaatccgtagcttcggcagtgttgcgcttattgcagcaggaaacgggatcattgttactgtttctgcccggtgtgggtgaaatccagcgtgtgttggctcaacttgaacaaaaaatcaatgacgataccttattgtgtccactgtacggtgcgttgtcgttatccgatcaacggaaggcgatagctcccgtgccagcaggaatgcgcaaggtcgtgctggccaccaatattgcggaaaccagcctgacgattgaaggtatccggttggtggtggatagcggccttgaacgtaccagccgctttgagccgaagagtggcctgacccgattgatgacccaacgcatcagccaagcgtcaatggtacaacgggctgggcgggcaggaaggctggaagaaggtgtctgctggcatttattcagtcgcgagcaggcggaacgagctacggaatacagtgagccggaaattctgcattcagatctgagcagcctgctactttcgttattacagtggggatgtcgtgacagtaatcagttgaactggctggacaatccaccacagcccgcgcttgcagtggctcaatcgctgctgctgcgattgggggcgctggatgataatcagcaattgactgcccgtggctggcaaatggcggaggcaggtagtgaaccgcgtctggcggccatgttgtgcgcaggcaaagagcggggtgatgaggcgctggcaacggcagcaaaactggtagcgatcttggaagaacctccccgcagtgggctgccggatctcactcattggataaattcaaaccaacctcattggcagcagcgcgctaatcagcttatcaggaatcttgcgagcaagactgcaaaaataggatctaaaaaaatcagcacagaaaagattaatgctgcgcttgtacctgaactattagtacagggatttcctgatcggattgctaaaaaccgtgataatcttggccgttttcagttagccaatggtttgggtgtagcactggaacatgacgatccgttgtcgggagagcagtggctgatagcgcctacattgcagcaaaacagtaaaaaccccgatgccagagtcttgctcgcttgcccgctgaacatcgaacacactattcatcaatatccgagcctgtttacagaacaggcagccgtggagtgggataataataaaggcactctgcgagcatggaaacgtctgcagtgcgggcgtttgactgtcagagcgcagcttttagcaaaaccttctcaggcggaattacaggaagccctgctgaactgggttcggcaggaagggttggcggcgttgaattggtcgtcggaagcattgcagttgcgcatccggctgcaaagggcaacagaatggctgcctgaaattgagtggcctgcggtggatgatgacagtctgctggattccctcgagcagtggcttctgcctatgttggagggagtgggggatttgaagggattacgccagattgagctgtcgtgtgctcttctgggtctgcttgattggcagcaacggcaaatactggataatgaattgcctactaattacactgtgccgaccggaagtaggattaccatccaatatttccacgataaaccgcccgtgctgtcagtcagaatgcaagaaatgtatggagagcagcagaatccggtattggcgaaggggcgggttcctgtggtcgttgaactgttatctccggcgcatcgtccattacagattacgcaagatctcgctgcattctggcagggggcttatcgtgaggtgcaaaaagagatgaagggacgttatcccaaacatttatggccagatgatccggccaacacaacgccgacaaggcgtgtgaaaaaatatatgtga

SEQ ID NO: 5320 - DNA, 2463 bp, Xenorhabdus bovienii
  Coding DNA location: Contig name=SeqID_16906; Position on contig =117249..119711bp; Strand=+
atgtctgatgatgatcgtcagccaatcggacgcaaaggtaaaaaaccagaacttcgtcgtgggcgtccagcaaaaaaacgccatcggcaggatgactatgaaaatgatgaaaataatgattttgatgacgacgatgaggaagaggtcatgacgaaaaaagggaaaaaaccccgtccgccaaggagtcgatggctaggattctggttgctgctgttgaaagtatttattgtgctggcagtgctcatggctatttacggtttttatctggataacaaaattcgccatcgcattgatgggaaagtatgggatttacctgctgcggtgtacgggcgtatggtcaaccttgaaccgggcatgaattacagcaagaacgaaatgattcggttgctggaaggcatgcagtatcggaaggtgaccaaaatcactcgtgccggtgagtttgttgttaggggcaacaatattgaaatgctgcgccgtccgtttgatttccctgacggtaaagaaggacaaattcaggctcggctggtcttcagtgataaccatattgccagcatcgaaaacatggagaaccagcgtcagtttggtttcttccgtctcgatccgaaactgattacgatgatgcaatcgccgaatggcgaacagcgtttggttgtcccacgttcaggttttccggatttactggttcagactctgctggaaaccgaagatcgttatttctatgaacacgatggggtcaggccgctttccattgcccgtgctgtgttggcgaacctgatcgccgggcgtacggttcagggaggcagtacactgacacagcagttggtcaaaaacctgttcctctccaatgaacgtaccttcagccgtaaagcgaatgaagcttacatggcgttactgatggatgcccgctatagcaaggatcgcattcttgaactgtacctgaacgaagtttatctggggcagagcggcgatgaacagatccgcggcttcccattggccagtctgtattatttcgggcgtccgattgatgaactgagtctggatcagcaggcgctgttagtgggaatggtcaagggagcgtcgatgtataacccgtggcgtaatcctaaactggcactggaacgccgcaacgtggtattgaaaatcctcctgaacaggcaaattatcgatcaggaactctatgatctgttgagcgcccgcccgctgggtgtgaaacccaaaagtggggtgattaccccacagcctgctttcatgcaattggtacgtcaggaattacaggaaaatctaggtgataagattaacgacctgtcgggcgtgaaaatctttacaacactggacccggtatcacaggatgcggcggaaaaatccgtggaagagggcgttgccgatctgcggaaaacccgcaaggtagatgatctggaaggcgcgatggttgttgttgaccgtttcagtggcgaagttcgtgcgatggttgggggttctcaaccagaatatgcaggttttaaccgggccttaaatgcacgtcgtctgattggttctcttgccaaacctgcgacttatttgacggcactgagtcagccggataaataccgcatgaatacttggctggcggatgagcctatttcgatacctctgtcgggcggaaaatcttggcaaccgaggaatttcagccgtaattttagtggacgtgtcatgctggtggatgcgttggctcgttcgattaatattccgacagtgaatctggggctgggtgttgggctggatcgcattaccagtaccttgatctcactcggcattccggctaaagaaatccaacaggttccttccatgctgctgggtgcaatcaacctgacgccgatggaaatggctcaagagttccagaccattgccagcggcggcaatcgggcgaaactttcggcattgcgttcaatccttgcggaagatggtacagtgatttaccagagttatccgcaggcagagcgggcagtgcctccagaggcggcttatctgacactgtatggtatgcaacaggtggtggctcgtggtacaggtagttcactgacgaaaaaatacggtaaatacaatttggcaggtaagacgggaaccaccaatgatctgcgcgacagttggtttacgggtattgatggtaaggaagtggcgatcgtctggacagggcgtgataataatggcctaaccaatctgacgggagcaacgggggcattgaagatctacctccgctatctggaaaatgaaacgccattagtactgaataatcgtccaccggaaggcattgtggatatgtccgtcaatgaagatggcagtttcaactgtactggcaatggcatcaggatgttgccggtctggacagatgatccgcagagtttatgccagcaatctacgccgcagccggttgaggataacaaagaagaagcgccgggctggctacaagagatgtttgatcagtaa

SEQ ID NO: 5321 - DNA, 210 bp, Xenorhabdus bovienii
  Coding DNA location: Contig name=SeqID_16906; Position on contig =119807..120016bp; Strand=-
ttgtcgtgttatattttaaataaattagccgcattaataaacaatgtaaaaagtctgaaagtaaaaatcactcatttaaaaagcatcaaaatatttaattatttcatggtgtgtttttttattaaatatactcataataaattacattcaaaagtaaattatatttacttaaaaaaattattttcagctacgaatccggcactctattaa

SEQ ID NO: 5322 - DNA, 1059 bp, Xenorhabdus bovienii
  Coding DNA location: Contig name=SeqID_16906; Position on contig =120089..121147bp; Strand=+
atgtataaatacagtaatgatatgggtgaaataaaaaatgatcgcttattggatctctataataaacaacataaatttaaattagatgaaccagagttactcattaaaattgaaagcgccttatctctttccaatgctgattttgatttacctatcattgtattgcgtgagggcgtgttagttgccttttgtcttgcccatttatcttatcgggaaaatataaatggactgggttgtctgaatttttcaaatgttatatcttctggtgatgttgaagcattaagattcatgttcaggcagatattttttgtagcagaaattaaaatgctcattcagggtaaagatagtattctctatggccctattcataattctatattaattgatagaggatgccggactttcgctggcgaaccttttacgtataaaatgcctgataataaccttgagctatgtgacatgcttgataagataaggtgtcaaaaagaaaaagatcttatagaaattatttatgactatgactcccgagataagttacttatttctctcgatgatgacttactaatgagaacacccaaagttgattattattctgtcgatggaaaagaaatatttaaattaagaaaggaactggctgaattttataatagttcatggcaagagaattgggggtatagtcctattacagatgttgaaatgggtattgctgctgagaatatcaataatattatgggaatgattgccagaaagaatggtaagattatcggctgtacgatgatgcagtttatcgtagaatcatcaaataaagttggacgggcttttttgtctggcgtattacctgaatatagaggaacagggttatcaattgtattgacatctaaattgtcaaaaattgcgatagaaaataatattaaaagattcagtctatcttggatgttagaagataataaaataattatcggaacgatgcaacgatttatgcagtatggaaacagcaataccagacattatagaatctattcgttgtcacaagggatgtttgaaggaaacttgctatga

SEQ ID NO: 5323 - DNA, 1170 bp, Xenorhabdus bovienii
  Coding DNA location: Contig name=SeqID_16906; Position on contig =121144..122313bp; Strand=+
atgaacctgtatgaaatagttcattcagataataaagctcagacactgaattattttcctcaagtaagatcggcttgtgagcgcgttttaactttggccgatggtacgacaaaattaaatttttcttcttgtgattatcttggcatggctaataatgccttaatgaagaatgctgcgataaacgctattcaagaatatggaacaaatatcagtgggccgatgatattctgtggctatactcgctatcatgaagaattagaaaagcgttatgctgaactttttcaggtgaatcatgcgctgatgtatacgacatcataccaagctaatataggcgctttaccggttattgccgaagatattgagcttattatcatggacaaactttgtcatgtatctttatatgatgcagtaaaattgagtggaaagccatttcgtgtctatcagcataataatatgaaaaaattggctgatattataaaaaataatatgggtaaaagaattctgattgtttctgatggtgttttctccgcagatggcgatttttgtaatatcccggaactctgtaaactaaaatcgatttactctgatattatgctttacattgatgatgcacatggtgttggcactttaggcgaaaatggctgtggtttggttgaagtatcggggtgtcttggtgaagtagatattatcattggtacgatgagtaaatcttttggttcaacaggcggtttttgtatcatcagagatgatattttggcacaaaaagtaaaatataaaagttcgacatataatgcctcccgttcagtttcacctggcgtggctgccgcatcttgcacagcattacagattaatcaatgggaaggtaaagcccgacgagctaaactggttgaattagtgacttatgcccatcagcgtctggaaggtacgcgtgtgaataaacagttatctgtttctgccgttattccagtgatttttgagactgtagaacaggctatcgcggtaaatagttatttgcttagacataatattatggtatcgcttttcgtaccgccttatgttgaaaaaaataaatctcgattaaggataacgataatttatcatcataccaaagaagatatagatacactggttactgtattggataacgccatagagaaagtcatctgctga

SEQ ID NO: 5324 - DNA, 741 bp, Xenorhabdus bovienii
  Coding DNA location: Contig name=SeqID_16906; Position on contig =122331..123071bp; Strand=+
atgctgatacacataattttttccatcgttatattggtctgtagttattggttattgtgtgccattttaggcactttagctaaacaacataatattaaaattaactataccagaaagattggacatttctcgatgtttatatttcctggcatcgtgtatgcttttttcaatattattgaaacagccgataatctggttattgcgtcactctcgagtattattttttttatcagtctttctcagatgtttaggcgtagatttaaataccttgcatcatcatttcatgctattgacaggccagaggacagaccctatacattaatatggattttttctcagaccattgtcggttttctgattttagctgtattcagtgtgttttggggtattctgggaattccctatgaattaatgtacatgactatcctgacgacaacgattggtgacgggctagccgaacctattggcgtaagattcggcaagcataaatatgcagttaaaggttttttgatagacaaagtattttaccgtagttatgaaggcagttttactgtatttattactgcactaatattgggattggtttttatgtatcgttttagtccattgggggcggcactgatgattctgtgtttcccattaggaatggcgttaacggaagctaaatcaccacacacatgggatacaccatttctattttttgtcggaaatttaattataacggtggcttatttattatga

SEQ ID NO: 5325 - DNA, 618 bp, Xenorhabdus bovienii
  Coding DNA location: Contig name=SeqID_16906; Position on contig =123008..123625bp; Strand=+
atgggatacaccatttctattttttgtcggaaatttaattataacggtggcttatttattatgataatacttattcgtcatgcaacgcctaaaatcgattattctacctgtaattctaaattggcccagcagcgactgctttcatacaatgaaacgagggatatcgatgaaagtgaaatggacgggtttatggcatcctcattatatcaaaaaattaaagatgccaaccctgtcgtatatagttcaccggttggccgtgccgaacgaacttgtcaggttttatttcagcaaccgaataattattttatcaaaggtgagctgaaggaggttgatctggaaatatgccatttaccctttataaaaatgaaagtcagaagttggtttttcttttctcgtctggtttggattttgggaataggtaaagaaaaagaaaaaatgaaacatgcagcaatacgtgctaatcgggtatttaaattgttagatgaaaataaaaatatcgttattgtatcacatggttatcttatccattatgtgaagaaagaacttaaaaaacaccattataataatattgagaaatataaaaaaggatgttttactgtggagttatatgataaatga

SEQ ID NO: 5326 - DNA, 894 bp, Xenorhabdus bovienii
  Coding DNA location: Contig name=SeqID_16906; Position on contig =123622..124515bp; Strand=+
atgagaaaaatccttatcattggtgcttctgggtttattggtaaaaaagttgcagattatttaagccatagtggagattttgatgttattcgctattcccgttttcagcaggaaggttatttttcttgtcttatcggcgatagcgattgggtaaatatgattgatagttgtgaggcaatcatcaattgttcaggcgtggggctggctaaacttaaaaaaaatcaaagagctaatgaagatattgcaaaacagattgtcagatctattcctgattcatcagacaggaaatataagatcctacatttaagttctgtgaaagcctataatgctaataattataaggatatatactctattgataagtgccgatcagaagcggtatttttccgtgggaagcataaactctttggtgaattgttacgtattccggctgtattcgggcaagacgataaaaatctgcaacctcttgtccgtttagcgagaaaggggcaactgccgggtatcaatagtcatatttctgattggcactgcataacgaataatgatgtcgcatattatatatattgctggctaaataaagataatttatcaacgttaaatattagttatttattaagtgaaaaacgatatagtatcaatgatctggttgaatctattaatcactctgttcatggtaatggatatcaggccagaaaaaaaagtttaatgtacattaaattaatttattctctattagccgtaaaaagttacatttcttccgggtttaaatcgagtaatttcccatatgcgcgatatcaggatctttttgagcgggactggaaaatagatgactcagatggaatagatatccataccattgatgtgaatctggctgatatatggaatagtctatga

SEQ ID NO: 5327 - DNA, 612 bp, Xenorhabdus bovienii
  Coding DNA location: Contig name=SeqID_16906; Position on contig =124512..125123bp; Strand=+
atgaggaaattccgctattctctttttattatcttcctgataccaataataatttcatggtggagttcttatgtatcagggtatcggaatactgttccatactttgttgcttctattgcggttttaaatgaattgttttttctgaatgaagtttcaaatgtaaaatcaaaagatcaaggtattgtcagtgcacttgtagtttcggcaatgatgtcattgttgctctatttttctgctggcagagcagtcatgtatttacatctgttactcagtacggttttgattcttataggcagtggaatgcgtactttgtcgaagataacattggggatatatttttcacatacactgcgcattattaataatcataagctaattaatcatggtgtgttcagattaattcggcatccggcttatagtgtgacaattataattatgtccggttttggtttttttgttagtattagtatggggctagtatgtttttttatttttttcattctttctatgcgtagaattgaaagtgaggaaaatatgatgatggaaaaatttggttcagaatatttagattatagaaaaaatacctggaaattatttccgtttattatttga

SEQ ID NO: 5328 - DNA, 264 bp, Xenorhabdus bovienii
  Coding DNA location: Contig name=SeqID_16906; Position on contig =125145..125408bp; Strand=+
atgagttttaattctgttaatgaaaaaataaaaaaaattgttgctgaaattcttgaaatgaatagttgtgaattatctgacaatgccatctttacaaaagaatatggggcggattctattacagctattgaaattctggcggctatagagtcagaattcgaaattaagctgcccgaaaattttgctgataaaatgattagtctcaattctatttatactgtgatgcaggaaatttcaatttcttatcctgaggaaaacagttaa

SEQ ID NO: 5329 - DNA, 1215 bp, Xenorhabdus bovienii
  Coding DNA location: Contig name=SeqID_16906; Position on contig =125408..126622bp; Strand=+
atgaataatgttgagcgagaaaggattgtggtgacaggattaggacctgttcatgctttgggggttggaaaaagcgcattttttagtgcgctgtctaaaggcatcaatggagcgaaagagacccgttccattgatgtgcaaaactataaatatcattattcttgcgaagtggagaatattgatcccctgctctacggtgtttctgaattacccgctgggataggtaaagcgagcctttatgctattgttggttcccaattggcgattgaggatgccggcctgtcactggcggatttagaaaataagctagtgggatgttttttgggcaccactgatggcgagtctcaattgattgatgggatcgttaaagggattcaaggtggggatgcagttcccgcgggaacatttgacaatgcactgcattcacgtatcagccgtaatgtcagttcatatctaaaatcaaggggacccgcttatacgataggcaatgcttgttcagcgagtaatgcgtcaattatttctgccgttgagtatctgcaagacagcgacgctgagtttgccatttgtggtggcagtgatgtggtctgtcggaaaacattctctatttttcatcgtttgtctgcaataagcgagaagctttgtacgccgtttgatgttcagcgcaagggaattattcccgcagaaggagccagcatattgttactggaaaagctctcttcagcccgtgcccgtggtgttcatatttatggggagattgttggctatggtatgagctgtgatgcaacccatatgactaacctcaatccggataagatcagagattgcctgaatacatgccttgagagtgcgggtctgtctacttttgacgttgattatatttctatgcatggaactggaacgatggccaatgacttcaatgaataccaggcgctgcaaaaggtttttactgataatatcccgatatgtggttcgattaagtcgatgattgggcatgcgatgggagcggcggctgggtttggcgcaattgcttgtatgttttcatttcaccatggtattccgcctacgattaatgtgtctgagcaagatccagaaattaacatcaccatcactgataaacttttacctaaagacgttaagatcgcgatcaataatgcttttgcttttggcgggaataattccatcattgcttttaaaaaggtaaatgataatgagtga

SEQ ID NO: 5330 - DNA, 957 bp, Xenorhabdus bovienii
  Coding DNA location: Contig name=SeqID_16906; Position on contig =126615..127571bp; Strand=+
atgagtgaattttctttaacgattagaaattggtgtagcctcaaagatggaattcaaacaggcaacagcccggctttaacatcagatgattgtgcacagatagatgaaaaagttgttttggcgggtaaaaaactgcgtaatattgatactcagacaacaaaagttctttgctgttttgacgcgataaaaagagcaggaaattatgatccccatgccgctattattagcgcaacatcaatgggagcatttgacagtgtttgtaaattattggaagaatcttatcagaatgccttaccctatcagatatcgccgggtaatattcctaatactgttattaactctacggcaggttttgccgcgattcattatgaagttgacgggccaaatattagtttgtgtgccagtgaactttccttttatgaagcgttgaccaaagcttttgccataggtaaacgtcgtccggctaataaaatttttgtcagtgcagttgaatcttgggggggattatatggtcgtgctttgaatgaaatacgtcaagatgagcatttccccgttgattattacgcggcactctttatgttgtctccggctgcatggaatgttgttgatgatattgcaggggataaaatattggctgtaactaccggccgattaggtgctgaagaggatattactgccaaagcggtcgattttattaattccgtggggatcaggcctgaattggttcacacattgaatatctgggcagtctcacagaataatttgtcatcatttaaccgctacttcccacatacttctataacacagctctcttcgtcggcgaaggtactaatgtctggtttaggtgcatggcaactggagcatcttttgacaaagacagccgcgaataaatatggcgttcagatagccgttgatgatgaaggattctatggattatctattattgaaaaattatga

SEQ ID NO: 5331 - DNA, 327 bp, Xenorhabdus bovienii
  Coding DNA location: Contig name=SeqID_16906; Position on contig =127595..127921bp; Strand=+
atgttaaaaaacaaattaaataaaacgtgtttttatggacaccatcatcaggcgtttctggggcattttcccggaaactcattgttacccggagtgtattatttacgtgaagttttggcgttattaccggaggaaattactcgattttcttatatagttaaatatgcgaaatttattaagatggtaacgccgaatatttatcttaattatactattttgatagacgaaaataactcaggtgaacatattgatatatcttctactattcaggaagttgatggggacattgtcgcaaaaataaaaattactttcaaaataagtgaataa

SEQ ID NO: 5332 - DNA, 447 bp, Xenorhabdus bovienii
  Coding DNA location: Contig name=SeqID_16906; Position on contig =127923..128369bp; Strand=+
atggactgtgatacaaaaagtaatattgaaattgttgggaagaatctacacagatatcccatggtattgatagataaagtcatacagcagggagagattgttattacggaaaaatatatttctcttaatgattttgtattcagaaatagtgattttaatcagcataacgattttatttatccaagttacctgatcattgaatcattttttcaatcggccggcctattcatttgtgaatgtgatattttaccttatgtcatcctgtgcaaaaatgtagaagtgaaacggcagatttatgcaggagaaataatccgtcatcatgtcaccctcagtagcagaaaaggcagtcttattattgtcagtggtgaaagcagaagtcagggtgaatcggtaatatattatgagcaggtgtatattgggtttcagagacagggcattaagagttaa

SEQ ID NO: 5333 - DNA, 108 bp, Xenorhabdus bovienii
  Coding DNA location: Contig name=SeqID_16906; Position on contig =128376..128483bp; Strand=-
atgacgccacaatcctgtggcgtcttatattcttcatctttcaacttattaccagttgttggcttagctcacttaccgccgctctgcggcttgaaatctatcaggtaa

SEQ ID NO: 5334 - DNA, 1284 bp, Xenorhabdus bovienii
  Coding DNA location: Contig name=SeqID_16906; Position on contig =128499..129782bp; Strand=-
atgagccagtccgaaatactttactctcaggcaaaacaggtgatccccggcggtgtcaattcaccggtacgcgcctttaatggtgtcggtggcacacctgtctttatccaacgcgccgatggtgcttacctttacgatgttgatggcaatgcctatatcgattatgtcggctcatgggggccaatggtactggggcacaatcatcctgccattcgcaacgccgtgattgaagccgccgagcgggggctgagttttggtgcgccgaccgcggccgaagtggaaatggcaaaattagtgacaaagctggtgccttccatggatatggttcgcatggtgaactcaggaacagaagccaccatgagcgccattcgtctggcacggggttataccggacgcgataagatcatcaaatttgaaggctgctatcacggccacgctgactgtctgctggtgaaagcgggttccggcgccttgaccatcggccagcccaattctcccggcgttcctgccgattttgccaaacatactctgacctgcgtctataatgacctgaattccgtgcgtgaagccttcgaaaaatacccagaagagatcgcctgtatcatcgtagaacccgtcgccggtaacatgaactgcattcccccacgaccagaatttctaccaggtctgcgtaagctgtgtgatgaattcggcgctttactgatcattgatgaagtcatgaccgggttccgtgtcgctttgggcggcgcacaagagtattacggcgttgagccagatctgacgtccctcggcaaaatcatcggtggcggtatgccagtgggcgcatttggcggccgtcaggacatcatggaaaaactggcacccactggcccggtttatcaggcgggaaccctctccggtaaccctatcgctatggctgcgggtctggcttgcctgaatgaagtcgcccaacccggcgttcaccagcgtttgagcgaactgacagaccaattagcttctggcctgaaaaaagcagcatcagcggcgggtattccactggtggttaaccacgttggcgggatgttcggtattttctttaccgacgcagaaagcgtgacttgctatcaggatgtcatggcgtgtgatgttgaacgcttcaagcaattcttccacttgatgctggatgaaggcgtctatctggctccttctgcgtttgaagcaggctttatgtccatcgcccattcagatgaagatattcagcgtaccgttgatgccgccgctcgctgctttgccagactgaattaa

SEQ ID NO: 5335 - DNA, 345 bp, Xenorhabdus bovienii
  Coding DNA location: Contig name=SeqID_16906; Position on contig =130004..130348bp; Strand=+
atgagcgatgatgctgcattgcctttgcagtttactgatgccgcagccaataaagttaaagtactggttgctgatgaagataacccgaacctgcgtctgcgggtttatattacaggtggtggctgtagcggtttccagtatggtttcactttcgatgatcaaatgaacgaaggtgatctgacgattcagaaacaaggtgctgagttagtggttgacccgatgagcctgcaatatctggtgggtggctgtgtcgattatacggaaggactggaaggttcccgttttatcgtcactaacccgaatgcaaaaaccacctgtggttgtggttcttctttcagcgtctga

SEQ ID NO: 5336 - DNA, 849 bp, Xenorhabdus bovienii
  Coding DNA location: Contig name=SeqID_16906; Position on contig =130421..131269bp; Strand=-
atgaaactctggatgaaaataatctcacttagatcaatctggttgtcattctcattcctgctctttagttttctgtatagtgtcagtgcgccacttcacgccgcagcctctcgtgttatcagcctcgctccctcgacgaccgaactcgcgtatgcggctggactaggcgatcggcttgttgcaatcagtgcttactccgattatcccgaagccgccaaaaaactagagcaagtcgctgattggcaaggcatcaatgttgaacggatcattgccctgaaacccgatctgattctggcctggcgcggcggtaatccccagcgtccgttagaacagctcgcggcattaggtatcccgattttttattctgatgtgaaaaaagtggaagatgtcgcaaccgatctggaacgactggctgtctatagcccacgccccgatatcgccaaaaaatcagccgctgatatccgccagacattcagccgattaaaacaaacccatgccacccccaatcccaagcttgtgtttttacaatttggtatgaatccgatttttacttcatccggtcacaccattcaaagtgaaatcgtatccgcatgtggtggtaaaaacatctttgccgacagcactgtaccgtggccgcaagtcaatcgtgagcaagtacttacacgcaaacctgaagtgattgtgctgggaggaactgaagatcaaaaacagcgcgtggcggatttttggcagccacagttgaatgtcaagatcatcaccctgaatgacgattggttcagccgtgcagggccacgaattattctggcgacagagcagctttgccgggagcttaatctttctggcggctag

SEQ ID NO: 5337 - DNA, 675 bp, Xenorhabdus bovienii
  Coding DNA location: Contig name=SeqID_16906; Position on contig =131301..131975bp; Strand=-
atggaacaagaagtaacactactgcgtgaccagattgaaggtctgcaaactgtgtcgcggggcggatgtgaaatctacaccggcaagctgaatggcgttgacatcgcgttgctgaaatccggcatcggtaaagtctcggccgctcttggcactaccctgttgattgaacattgccagccagacatcgtaattaacaccggatcagccggcggccttgaccctaaactgaatgtgggagatatcgtggtttccggagaagtccgctatcacgatgccgatctcactgcctttggttatgagccgggtcaaatggcacaatgtccacctgcttttatcgccgacagccaattaattacactggccgaaaaatgcattaaatcccttgacctgaatgcagttcgtgggctgatttgtagcggtgatgcttttatcaatggcgcagaacctctggcgcgtatccgtgctactttcccgcaagtcgcggcggttgaaatggaagcggcagctatcggccatgtttgccaccagtatcaaattccattcgtggtggttcgtgccatttctgatgttgccgatcagaaatctcatatcagctttgatgaattcttagttatcgctgcccgtgaatcaacacggatggtcaacgccatgttgagcgaactcagccaacattaa

SEQ ID NO: 5338 - DNA, 1551 bp, Xenorhabdus bovienii
  Coding DNA location: Contig name=SeqID_16906; Position on contig =132126..133676bp; Strand=+
atggggggattaatgactaaaattgatttcaagcagaagttgaattaccagcgtaagtacagcaactcttccatacatcctgacgatgaagatcaggtgaatcgtcaattcgaaagtgaccgtgggcggatcatcaattcagccgctatccggcgcttgcagcagaaaacgcaggtttttccgctggaacgcaacgccgccgtgcgcagccggttgactcactcgctggaagtgcagcaaatcggtcgctatatttcaaaaacgattattgcagaactgacaaagcaaaatctgctggaaaaatatgggctgagtgatcgcttacttgcttttgaaagcctgattgaaatggcctgcctgatgcacgatatcggtaatccgccgtttggccattttggtgaggctgcgattagagattggttctcgcgtcgattagatcctgattatttttcagattgcgcttctgaaagcacagctcggcaagatggctgtaaagtggcggcattgagctacaatggtgaagccaaaaaagatctgttccggcgccagttacgtaaggatttatgtgagtttgagggcaatgcccaagcgatccggctggcacataatctgcttaaactgaatctgacttatgcccaaatcggctgtatcctgaaatatacttgcccggcttaccgtcttgaaggatctcccgaagaattcagttacctgatgaagaaaaaaggctattactggtcggaagacagttttatccatgaattaagaaaagagctgcaattgggagatttctgccgttttccgctgacgtatattatggaagccgcagacgatatctcttattgcattgctgatttggatgatgcggttgaaaagggcattttcaatgttgaacagttggtggaatacctgaaaaaagagtggcaggaaaatgggggacacaggaaaggggatttatttgaattcacggtgatgcaggctcataagaaaacggccagcaatgaggctcgtcgcagtattcatgagcagtttttcatgtatctgcgggtatttatcaccggaaaattggtgccctataccgctaaacgttttattgagaatttgcctgaaatttatgcaggtacattcaatcatgctttgttggaagagaatggcgatgagcatcgtctattgcagattttgaaaagtgtcacgcggaaatgggtatttaaccaccctgaagtcgaagagctggaattgcagggctatcggattattaccggattgctggatgtttatagcccattattggagctatctcggcaggattttatggcgctgcaccgagataattttcacaaaaaatactttattgaaacgcgcctgctgcacaaattatctaccaaacaccggctggcctatgaagaggcggtagaaaacattgtcgccactgatgaagctgaaaaagatgtgctcgaattttattatcgggcgcgtttgattcaggactatatcagtggcatgactgaccattatgcttacgaagaatatcgtaaatttatggtatcgaagtga

SEQ ID NO: 5339 - DNA, 2364 bp, Xenorhabdus bovienii
  Coding DNA location: Contig name=SeqID_16906; Position on contig =133660..136023bp; Strand=-
atgaccaaatatagcctacgcacccgtatgatgagcctgatattggttcctgttttactggtcggaacgctggtgagtatatcatttatctcataccgttattacgagttgaagaacctgatagtccgcagtgggatcagcattattgaaccgttgtctatcgccagcgaggtgggcatcaatctggataatcatcgacgggtcgaagtattagtcaatagcctgcatcgccgtaactccgagattgtcaaagccattgcgatttttgataaaaatcataagcttttcgacatttctaatgataaatatgatgcgaaccagttgcggcttcctgctggtgagccaatcccaaagatcctactgagtcaatcaggacacgataataatatcattttgatgatgccgctgattgcagaaaacacccaagaaaacgaatggcgcaataccaccagcaaagccaatcccatcggctatatcgccattgatctggatttgagaacggcccaaatccagcaatataaagaaattacgacgtcaatcatcctgctgatcctctgtcttggcggcactgccctgtttgcccacattttggtgcgcaaagtgacacagccactgggtgacatggtgagagtcgtagaacggatacggcagggacaattgaacattcgtgtcactggcgcgatgccgggagaactggccgcactccagaatggcatcaataccgtcgcggaatcgctgtcgaaatataaagatgagatgcagttgcatattgatcaggccacatctgacttacaaatcaccatggaacaattagaaatccaaaacgttgaactgactctagccaaaaaacgcgcacaggaagcggttaagatcaaaacagaatttctggcaaatatgtcccatgaattacgcacgccgcttaatggcgttattggctttacccgtcagatgctcaaaacacccattacttctcagcaagccgaatatctttatgtgattgagcgttctgccaataatctgctgaaaatcatcaatgacattctggatttttcacggctggaatcgaataaactggtgctggatcaagttccttttctactgcgagatacggtcaatgaagtcatcgaattgctcactcccgcggccagcgagaaaaacctccccctgcatcatcgcatagatgacaaattgcctaacctgatgatcggcgatcccattcgcttgcagcaaatactcactaacctgattggcaacgcgattaaattcacagataaaggcagcgtgatactggaggtcaaattgcgtcagcagcagcaccatctcgtgcagattgatttcaccataaccgatactggcatcggcattaaaccagaatatcgtccgattctgttccaggcattcaatcaggccgatgccagcattacccgccactacgggggaaccgggctgggtttgagtatcaccaaaaggctggtcaatgaaatgaagggagagatcgatttcatcagcgaacccgcaaaaggaaccgtattttattttgatctctggctggaaaaagaagcgtttttattgggttcattacctgaacgcctgcccattccctcggtttttccacgtttgcccataaccgtgatggcggtggatgataatccggccaatctgaaattaattggtactttgctggacgaacaaatcgagaataccctgctgtgcagcagtggtctggaagcgctgactacggcacaacaacacgcactggatctgattctgatggatattcagatggcagatatggatggtattcaaacctctgaacagatccatcaattaccacagcataaagagacacccattgtggccgtgacggcttttccctgtaatgaaacccaaaatgggggacgttccccgtttgttggctgcctgtcaaaaccattggatgaacgtcgcctgaaaacgtggctgaatcaatacagccaaaagaaaaaatcacagttcatcgattgggatatggctttgaaacaaacggccggaaaagaatctctggcgcgggaagttctggagatgctagtacaatcgctgccagaaatgaaagcgatgattgaacagatcttggcagcagatagcgacattgatcacaaacagtttcagcatcatgtccaccaattacatggcagttgctgttacaatggcgtccccaaactgcaagcgatttgtgaattcatcgaaaaacaactgaaacaagctattcctctggcggatctggagccagaattactggaattcatcgatgagatcaatcacgtcattgccgcggctcctgatgtacttagagcgaccgccgggcctctcacttcgataccataa

SEQ ID NO: 5340 - DNA, 1353 bp, Xenorhabdus bovienii
  Coding DNA location: Contig name=SeqID_16906; Position on contig =136077..137429bp; Strand=+
atggtgcaattttactccccaaaccgccgctccgtaaaccgaggcattatttccgttaccgcagataaccttgatgcacaagggcaaggtattgcccgtcatcagggaaaaacgatctttattcagggattattgccgggtgaacaggcccaaatccaactgacagaagaaaaacgccagtttgccaaggccaaaatagtaaaacggctatcagacagcccgtctcgtgttgtaccgcgctgcccacatttcaatgtgtgtggcggttgtcagcagcagcacgttgcgattgagctgcaagccaaaactaaggccagcgtgctggaacaccttatccagcgagaaactggcaccagtatcagtgctcatcccattattcacagcccggaatatggctatcggcgtcgggcacggcttggcctgcaatacgatgttaagaaaaacccggccaggcagcaaaaattattgatgggatttcgccagagccagaccaacgatttggtggccgttgcacattgtccggtaatgcgccctgaattggaacagttattgcaaccgttatcccagtgcctgaatagcctgagtgcggttaaacggctgggacacgttgaattggtgctggcggataatgggccgttaatggtgttgcgtcatcttgatccactgaagtgcgaagatagggaaaaattgtgcactttttcggtgcagcataaaacggcagtctatctggccggcgatgaaaaatcccttgagcctttgatagaagggcagtctgctccgtggtatcaggtggatggcttgaaattggaattcagcccgcgggattttattcaaattaatgatgaagttaaccagcaaatggtggcacaggcgttggcctggctggatttgcagccgacggatcgggtattggatctattttgcggcatggggaactttaccttgccaatggcgcctaaagtacaggccgtagtgggtgtagaaggggttgccgccttggtcgcgaatgggcaatataatgcccagctcaatgaacttaataacgtcgattttttccacgaaaatctggaatcggatattcaccagcagccttgggcggtgctggggttcaataaagtgctgctggacccagcccgtgcaggtgcggcgggcgtcatgtcacatattgtaaaactggcccctgagagagtggtgtacgtttcctgtaaccccacaacgctggcgcgggacagcaaagttctgctggaggctggttatcatcttgtcagtgtgcggatgctggatatgtttccgcacactagccatctggaatccatggctttgttcagccgtgagccagtggctatcgagtag

SEQ ID NO: 5341 - DNA, 2238 bp, Xenorhabdus bovienii
  Coding DNA location: Contig name=SeqID_16906; Position on contig =137439..139676bp; Strand=+
atggttgcggtaagaagtgcacatctcacaccggcaggtgaatttgcggtcgataagtggatcacgagtttaaatatcacgaatccacaatccagtgagaaattagccgaaacatggcattactgtcacgaaaaagtccaggatcaccctgatgcggcgctgttgctgtggcgcggtgtggaaatggtggaaatcctgtccacattgagtatggataatgacagtatgcgcgctgcgctgctctttcccatccttgatgccaaactgctcgataatgaaacagtgacagaaacatttggcacggccattaccaatctggtgcatggcgtgatggaaatggatgccattcgccagttaaaagccacccacacggattccaccagctcagtgcaggtcgataatgtgcgtcggatgctgctgtcgatggtggaagatttccgctgtgtgatcatcaagctggcggaacggattgcccatttacgggaagtgaaggatgccagcgaagatgagcgagtactggcggcaaaagagtgctccaacatctatgcgcctcttgccaatcggctgggtatcggtcagctaaaatgggaactggaagatttctgtttccgctatctgcatcctgatgaatacaaaaagattgccaaactcctgcatgagcgccggatcgaccgcgaacagtacatcggaaagtttgttacgaccatacgcaaatacatgctcaaagaagggatctcggtcgaaatttatgggcgtcccaagcatatttacagcatttggcgcaagatgcagaaaaaatccctcgcctttgatgaactgtttgatgtgcgggcagtgcgtattgtcgttgagcgtttacaggactgctatgcggctttaggaatagtgcatactcactatcgtcatctgccggatgaatttgatgattatgtcgctaacgccaaaccgaatggttatcagtccattcataccgtcgtgctggggccgaatgggaaaacgcttgaaattcagatccgcacccgccagatgcatgatgatgctgaacttggagttgccgcccattggaaatacaaagaaggcaccgccattggcggcggtaaatcgggcagttatgaaagccgtattgcatggctgcgtaagctgatcgcatggcaggaggagatggcggatactggcgaaatgctggatgaagttcgcagccaagtgtttgatgatcgcgtttatgtctttacgccaaaaggcgatgtgattgacttgccggcaggctctacgccgttggattttgcctatcatattcacagtgatgtcgggcatcgctgcatcggggcgaaaattagtggacgcattgtgccgttcagctatcagcttcagatgggggatcaaattgaaatcatcacccagaagcatccgaatccaagtcgtgactggctgaatccgaaccttggctatgtaaccaccagccggggacgagcaaagatccacaactggttccgcaagcaggatcgtgacaagaacatcattgccggccgccagatgctggacaatgaactgacccatttggggatcaccgtcaaggaagccgagaaagaacttattgcccgttataacgttcattcgctggaagaagtgttggcggggattggtgttggtgacatccgtattcaccaattgatgaatttcctgcaaagcaagttcaacaaaacgacggcggaagaagctgatcgtaaggcgctgcgcaatctagaaaataaaacctacactccgcgcaatgtaaaacaagacaatggacgcatcgtcgtggaaggtgtcggcaatctgatgcaccatgttgctcgttgctgtcagccgatccccggtgatgaaattgtcgggttcattacgcgcggacgcggaatttccatccacagtgctgattgtgagcagttggccgaattggaaattagcgcaccagagcgcattgtggatgcggtatggggagaaaattattccagcggctactcccttgtggtgcgggtgcttgctaatgatcgcagcggattactgcgtgatatcaccacgattcttgccaatgaaaaggtaaatgtactgggggtgagcagccgaagcgacgtgaagcagcaattggcgactatcgatatgaatattgagatttataatctacaggtattgggacgggtactggcgaagctcaaccagctatctgatgtgattgaagccagacgtttgcacggtaattaa

SEQ ID NO: 5342 - DNA, 801 bp, Xenorhabdus bovienii
  Coding DNA location: Contig name=SeqID_16906; Position on contig =139683..140483bp; Strand=+
atggataagataaaaaccacttcgattgaacgacttaaggggattatgacgcagttgcgccatccccagcagggttgcccgtgggacaaagtgcagacttcggccaccattgcgccttacacgctggaagaaacctatgaagtcattgatgccattgagcgcaacgacgcaaatgccctgaaagaagagctgggggatttgctgtttcatatcgtgttttatgcccagatgggccaagaacagcagttgtttgattttgacgatatctgcgacgcggtttgtgacaaattagagcgcaggcatccccatatttttgatcaacaggcaggcatcagtagcgaagaagcgatagggagctgggaacagcgtaaaacagcagagagggcggaaaaagaccagcattctgtgctggatgatattcccgccagtctgccagcattgatgaaagcctataaaatccagaagcgctgcgcttcggttggttttgattgggatacacttggcccggtgctgggcaaggtgtatgaagaaatcgatgaagtgatggatgaggcccggcaggcggttgttgatgaagcccggctggaagaagagctaggggatttgttgttttctgtcgtcaatttgtcccgtcatttagggcataaaccagaaatggcattgcagaaagcctgcggtaaatttgaaaagcgtttccgaagcgtcgaaaagcgtgtcctcgaccaaggtctgtcattggaaacggcgacactggaggaaatggaacagatgtggcagcaagtcaaaaaacagcagtcatag

SEQ ID NO: 5343 - DNA, 165 bp, Xenorhabdus bovienii
  Coding DNA location: Contig name=SeqID_16906; Position on contig =140562..140726bp; Strand=+
atgaatttaaagagaaagacatcggctggtttcgcgctgtccctaataagtcggcactttatcctgcctagatggtttgtagcgcatttaaggttagggtatactgctttcccgtcctgttatattcatcatccttttaaacctaaactctcaggttcagcatga

SEQ ID NO: 5344 - DNA, 1638 bp, Xenorhabdus bovienii
  Coding DNA location: Contig name=SeqID_16906; Position on contig =140723..142360bp; Strand=+
atgaaaactaattatatttttgtgaccggcggggtcgtatcctctctgggtaaaggcattgctgctgcctctttggcggctatactcgaagcccgtggactcaaagtcaccattatgaaactggacccgtacatcaacgtcgatccgggtacaatgagcccaacccaacacggggaagttttcgttaccgaagacggcgctgaaactgatctggatttaggccattacgaacgtttcattcgtaccaaaatgacacgccgcaataacttcacgaccggtcgtgtctactctgaagtgctgcgtaaagaacgccgtggcgattatctgggtgcaaccattcaggttatcccccacattaccaatgaaatcaaagatcgtatcatccgtggtgcagaaggctatgatgtggtgctggtggaaatcggcggcactgtcggtgatattgaatctctgccattccttgaagctatccgtcagatggctgtggaagtaggccgtgaacataccctgtatatgcatctgacgctggtgccatatctggcggcggctggtgaagtcaaaactaagcctactcagcattctgtgaaagaactgctctccattggtattcagccggatgttttgatctgccgctcagatcgtattattcccgccaatgagcgtgcaaaaatcgcgctgttctgtaacgttccagagaaagccgttatctctttaaaagatgttgattccatttataaaatcccgggtctcttgaaatctcagggcttagatgattatatttgtaaacgatttagcctcggataccctgaagctgatctgtccgaatgggaacaggtcgtttatgaagaagctaatccatcgggtgaagtcaccattggaatggtgggcaaatatgttgaactgccggatgcttataagtcagtgattgaagcactgaaacacggcgggttgaaaaaacgcctgaccgtcaacatcaaactgatcgattctcaggatgttgaaacccgtggtgttgatgtattgaaaggtctggatgccattctggtgccgggcggcttcggtggccgtggtatcgaaggcaagattatgactgcacgttatgcccgtgaaaacaaagtcccttacttggggatctgtctgggtatgcaggttgccctgattgagttttcacgtaatgtggcgggcatgaaagaggccaactccacagagtttgagccagagtgtaaattaccggttgtaggtctgatcacggaatggcgtgatgagaacggcaacttagaagtacgtagcgaagagagtgatctcggcggaacgatgcgcgttggcggccagttatgccgtctgtctgaaggcagtctggtacgtaaactttatggtcaggacgacattattgaacgtcatcgccatcgttatgaagtgaacaatttgttgctgaaacgcattgaagaagcaggcctgcgtattgctggccgttcaatcgataacagattggtggaaatcattgagaacccggcacatccgtggtttgtggcgtgccagttccacccggaattcacttcaacgcctcgcgatggtcatccgttatttgcaggctttgttgaagccgcaggcaaatatcagaaaggccagttgaaataa

SEQ ID NO: 5345 - DNA, 1302 bp, Xenorhabdus bovienii
  Coding DNA location: Contig name=SeqID_16906; Position on contig =142462..143763bp; Strand=+
atgtccaaaatcgttaaagtacttggccgtgaaatcatcgattcccgtggtaacccaacggtagaagcagaagtacatctggaaggtggctttgttggtctggctgctgcgccatcaggtgcatcaacaggttctcgcgaagcactggaactgcgtgatggtgacaaatctcgcttcatgggtaaaggtgtactgaaagcgctctctgcggttaatggcccaatcgctcaggctctggttggtcaggatgcgaaagatcaggctaacatcgacaaaatcatgatcgagctggatggtactgaaaacaaatctaacttcggtgctaatgcgattctggctgtttcccttgcgaacgctaaagcggcagcagcggcaaaaggcatgcctctgtacgagcacattgctgagttgaacggtacgccaggcagattctccatgcctctgccaatgatgaacatcatcaacgggggtgagcacgctgacaacaacgtggatattcaggaattcatgatccagccaattggtgccagcacgctgaaagaagcggtacgcatcggttcagaagttttccaccatctggcaaaagtgctgaaagcaaaaggcatgagtacggcggttggggatgaagggggttatgcgccaaatctggaatctaacgcagcagcgctggccgcgatcaaagaagccgttgaacaagcgggttatgtgctgggtaaagatattactctggcgatggattgcgcagcttctgaattctataacaaagaaacgggcaactatgaactgaaaggcgaaggcaggacgttcacgtctcaggaatttacccactatctggaagacctgaccaaagaatatccaatcgtttctatcgaagatggtttggatgaatctgattgggatggttttgcttatcagactaaagttatgggcgacaaaatccagttggttggtgacgatctgttcgtaactaataccaagatcctgaaagaaggtatcgaaaaaggcatcgcaaactccatcctgatcaaattcaaccagattggttcactgactgaaactctggctgcaatcaagatggcaaaagatgcgggctacactgcggtgatttctcaccgttctggtgaaaccgaagatgcgactattgctgacttagctgtgggtactgcggcaggtcaaattaagaccggttctatgagccgttctgaccgtgttgctaaatataaccagctgatccgtatcgaagaagcactgggtaaccgtgcgactttcaatggtctgaaagaagtgaaaggtcaggcataa

SEQ ID NO: 5346 - DNA, 105 bp, Xenorhabdus bovienii
  Coding DNA location: Contig name=SeqID_16906; Position on contig =143800..143904bp; Strand=+
atgttttggcgaaagagtatatgctctttcgccatctcaacaaaagataattttatccatataagtgattatatacacgatgatgaaatgaaaagtatgaaataa

SEQ ID NO: 5347 - DNA, 105 bp, Xenorhabdus bovienii
  Coding DNA location: Contig name=SeqID_16906; Position on contig =143942..144046bp; Strand=-
atgttaaagaattacattacatgtgaaataataaggagtattaacaaggaagaaaatacaacgtgtatgattttgggatctatcacgtggggtttgttcaattaa

SEQ ID NO: 5348 - DNA, 1386 bp, Xenorhabdus bovienii
  Coding DNA location: Contig name=SeqID_16906; Position on contig =144117..145502bp; Strand=+
atggacgcttctgaatctttaaccccagcgattgggccaaatccctcaaataaaagaggcttaattattctcgcgctggatattatcttgcttgtcgctttgcttaagtttttgccgtatggcgaaaaaaccaatgcgggtctggcattgatggcatttgttggtgtgctatggctgactgaagctatacacgtcacaattacggctctgtgtattccaattctggctgttggtatgggattaatgaatacgggtgatgcgctgcaatcttttgcaaacccgatcatctttctgttctttggcggttttgcactggcaacggcattgcatattcaaggtctggatcggctgatcgccaaccgtcttctgatgattgcccgtgggcgtttatcggtggctgtattgctgatatttggtattacagccgtgctttccatgtggatcagtaacaccgcgactgctgcgatgatgctgccgctgatactgggtattctggctaatctggatgtgcgcactgaacgcaatacgtttgtttttgtgttgctgggggtggcatacagcgccagtatcggtggtttgggaacactggtggggagccccccgaatgccattgcagcggcgcaactgggtatggacttcttcacatggatgaagtatggcgtgccgatggtcatcattttgttgccagtcatggtggccgtgatgtatatcatgctgcgtccaaacctaaagcataaatttgatctgaaattggaacatctggagtggaacagtaagcgtattatcactatggctatcttcttgctgacggtgtttagctggattttcagttcaatcatcagtgatgcttttggcggtatcaaagatctggatacgattattgcagtgagcgcagccatcctgattggcatcactggcgtgtcaacttggtcacagattcagaataacaccgaatggggcgtattgatgctgttcggtggcggcctgacgctgagtgctgtcctgaaaaactccggagccagcgaagttatggcgaatggcatggcggcaaccttcggtgccagtcactggtttgtgatcatccttgctgttactgcgttcattatcttcctgacggaatttaccagtaataccgccagtgctgccctgctggtgccaattttcgctacggttgcagaagccttggggatgcctgtcatggtgctgactatgattatcggtatcggtgcatcctgtgcatttatgctgcctgtggcaacgcctcctaacgcaattgtttatggctctggctatatcaagcaaattgagatggtgagagtgggcatggtgctgaacgtggtatgtatcgccattatctctgtggttgcctggttcttctggttgtaa

SEQ ID NO: 5349 - DNA, 138 bp, Xenorhabdus bovienii
  Coding DNA location: Contig name=SeqID_16906; Position on contig =145457..145594bp; Strand=+
atgtatcgccattatctctgtggttgcctggttcttctggttgtaattcatatcaataaaaaattgatcataaaaatcgccacccggaagggtggcgattgtcttggaacctataactattctttcgtactaatatag

SEQ ID NO: 5350 - DNA, 1482 bp, Xenorhabdus bovienii
  Coding DNA location: Contig name=SeqID_16906; Position on contig =145573..147054bp; Strand=-
atgaaaaaactacatgatatcgcaaaagaaatgttacctgctaaatcatataacatgttgattaatggagaatgggtagatagcgtttcaaaagaaacccgtaaaagttataacccggcaaccggtgagttactcacagaatatgctgctggcaatgcccaagatgttgaactggcagtcaaagccgcccaaaaagccttacctgcatggagtaaaaaatcagcagccgaaaaacaatctctgctactgaaaatcgctgacctgctggaagctgaatcagaacgtttcattactcttgaagccttagacgccggtaagacactaaatctatgtcggacgtttgacattccttttgccgttgatcactttcgctacttcgctggcgtcattcgcgcccattccgatgaagccgatgtgattgatgccgatactctcagcctagtgatcagagaacccattggggttgtaggacagattatcccgtggaacttcccactgctgatggcggcatggaaactagctcctgctctcgccgccggtaataccatcgtgatcaaccccgccagcctgacttcaatcagtttgctcgaattaggtcgtatcttgaatcaagttctgccagcgggcgttgtcaatatcgttacaggtcgcgggtctagtgttggtcaagcgatcctcgatcatgaaggcattgacaaggtagcctttacaggttcaacagaagtcggttacaacgttgccgcagcggcagccaaacggatcatccctgccacattagaactcggcggtaaatctgccaacattattttccctgatgccaatatgaaaaaggctgtcaaatatgctgctgacggcattttgttaaatcaggggcaagcctgtgaatctggcgctcgcctgttcctgcataaagatattcatgacgagttcctgaaatcgctgaaagcggcatttgaatccgttcgggtgggcgatcccatgatggccgaaaccgagatggcttgtcagatcagtcaggagcaaatggactttattctgggctatattgaccttgcgaagcaggaaggtgcaactgtgctaactggtggaaaccgcataacaggcgcgggatacgatgatggtttctttgttcagccaaccattattaccaatgtgaccaataaaatgcgggttgcacaggaagaaatcttcgggccagtgctgtgtgtcattccatttagcagtgaagaagaagtcgtggaaatggccaatgattctgaatacggtctgggaggcgctgtctggacgcaggatatcaaccgtgctctgcgcgtggcaaaagcggttcagacaggccgcatgtgggtcaatacctatcatgccctgcccgcccattccccatttggcggttacaaaaaatccggtcttggcagagaaacccataaaatgagtctggatgcctatactcaggtgaaaaacatctatattagtacgaaagaatag

SEQ ID NO: 5351 - DNA, 153 bp, Xenorhabdus bovienii
  Coding DNA location: Contig name=SeqID_16906; Position on contig =147030..147182bp; Strand=+
ttgcgatatcatgtagttttttcattatattctccgagtactttggtttttcctatgctaggacatctatcccgaatgttttatgggattaactcttatttttctgtcagaattgtatttaaatataaaggacctgtatcaataaataagtag

SEQ ID NO: 5352 - DNA, 1341 bp, Xenorhabdus bovienii
  Coding DNA location: Contig name=SeqID_16906; Position on contig =147634..148974bp; Strand=-
atggataacacttccaagaaaaaacctttataccaggtcctttacattcaagtcatatttgccatcttactgggtatagcgctgggtcatttttatccagacattggtgaatcactcaaacccttaggtgatgctttcatcaaaattgtgaaaatgattattgcccctgttatctttttgactgttgtaacagggatagccggtatgaataatatgaaatcagttggaagtgtcgtaggaaaatcgatgttgtatttcttgacgttttcaactcttgctttaattattggtttggttgctgccaatatcattcgccccggagatggcttaaatatttcaccggaatcgttagacagtagcaaagtcatcggttatgtggagaaagcacatgaatcatccatcgtcggctttctcatgaatattataccggaaacggttgttagcccacttgtgaatgggaatattctgcaagtcctctttattgctgttattttcggtatcgctttagcgtcaacaggaaaaaagggggaacctatattggtgtttttgcaaaacttctcagagcctgttttcaagatggtaggcatattgatgaagctggcaccgattggcgcatttggggcaatggcatttaccatcggtaaatatggcatttcatccattggaaatttaatgatgttaattgtcactttttacatgacatcattactctttatttttgttgtattgggggctgttgctaagtataacggattctccatcattaaattaattaaatacattaaagatgaactgtggttggttttgggaacatcatcctctgaagcggctttacctagcctgatgagaaaaatggaaaatgcaggctgtgagaaatcggttgtcggattagttattccaacaggttattcatttaatcttgatggtactaatatttatatgacgatggctgcattatttatcgctcaagcaacaggaattgagttgagtttcacggagcaaatatctttattattagtcgcaatgatcagctcaaaaggtgccgctggagtaacgggtgcaggctttattacgctagccgctactttatctgttgttcccagtttacccgtagccggtatggctctcattttgggcattgatagatttatgtctgaatgccgcgcattgaccaatttagttggaaatgcttgtgccagcattgttgtcgctcgctgggaaaatgctttagataaagataaaatgcatcaagctttaaatggtaatagacaaaatccagtagaagatatatcaatttccctatcaagtaaaaaaaatatgtcccctccagagaataaataa

SEQ ID NO: 5353 - DNA, 114 bp, Xenorhabdus bovienii
  Coding DNA location: Contig name=SeqID_16906; Position on contig =148967..149080bp; Strand=-
atgattctttatgcagcaaaaatcaaacatttttgccatgaaacaataaagcgttgtaaaaagtcaccaataaaaacaaataattatattaaccacaggatcctttatggataa

SEQ ID NO: 5354 - DNA, 162 bp, Xenorhabdus bovienii
  Coding DNA location: Contig name=SeqID_16906; Position on contig =149079..149240bp; Strand=+
atgttgaccaatataaaaattactcctaacgcctgtcagaaacaagccctcggatctatagaaaaacccacaggaaaaacctgtaggttcagattaagacggtactatttggtcgttacccagaatacaccgctaccgtccaatgccgtaaatgttttatga

SEQ ID NO: 5355 - DNA, 1137 bp, Xenorhabdus bovienii
  Coding DNA location: Contig name=SeqID_16906; Position on contig =149183..150319bp; Strand=-
atgtctgtcattcattactccataaaatattttatatcggtattatttgtgttattaccgatatattcacaggcagaaaatattactgtcacagatattgctggacgagaagtcacagttaatgctccggctcaacgggtcatgctgacagatagccggatcattattgcgttgaatatcctgcaccccaacgatccattgaaaggtattgtggcatgggataatgcactggagaaaaaagcacctgaccttgccgcagcctatgagaaaaaatttcctcaattaagggaaatccctattttcccgaacccctataccagtgatttcagtgtcgaaaaagctatgacctataaacctgatctggttattttcgatattggcctgaagcctaaactggataacagcaatacggttaaattactggaaaaatcggggatttctgtcattttcatcgattttcgccaatatccgctgtccaataccatacccagtatggagcttcttggtaaggtttttaaaaaagaagaaaatgccggtaaatacattgcgttttatgaaagccgtctgtctttgatcaataagcgtatcggcacactgtaccaagagcagatccccagtgttttcatcgagtatcatgccggtatgctgggagcagaagattgctgcgataccattggtgacaatagcttcggagagtttgtcacaaccgcagggggagataacgtcggcagtaagtggttctcaggcatgggaggcaaagttaacgaggagcaattgctggtcagcaatcccgatacttacctgatgacagtagcagattgggatcaggttcgcgcagggagccagtcggttcctttaggttataccggcaatttggaaaaatccgaaaagcgtttgcaaaacttgctctcccgcccaaatctgaaagtactcagatcgtaccgtgaaaaacgcgtgatggcgatttaccaccaatattacgattcaccattcaatatcattgccgtagaagccattgctaaatggctgcatcctgagttgttcaaagatattgatccccatgcagacagtatttatgttcataaaacatttacggcattggacggtagcggtgtattctgggtaacgaccaaatag

SEQ ID NO: 5356 - DNA, 165 bp, Xenorhabdus bovienii
  Coding DNA location: Contig name=SeqID_16906; Position on contig =150425..150589bp; Strand=-
atgaaggaagatgaattatggaaaaacatggcctgtgaaacaaaaaatatttttgataatcataaaacattaatttcaaaagaacactggaaaactgaattcagtgtattactacaagtaacagtgaaccataaagtctttattaaaaatgcgatcatccaataa

SEQ ID NO: 5357 - DNA, 138 bp, Xenorhabdus bovienii
  Coding DNA location: Contig name=SeqID_16906; Position on contig =150940..151077bp; Strand=+
atggcatttgtctcattccgtattgtactcaggaattttgtctggcttgaacaggtttcaaaattaataatcatggtgcagaaatacatttcgttttttgcagtaacgataaaattattaggaggatggctggcataa

SEQ ID NO: 5358 - DNA, 348 bp, Xenorhabdus bovienii
  Coding DNA location: Contig name=SeqID_16906; Position on contig =151292..151639bp; Strand=+
atgaaaaatttgttggcagtgtgtttattgggctttgtattaacgggatgtgataatcacctgaaaattgatggtacaaatgaaatagctgtaaaaacatccatcgaaaaaatcagagatacgttaccggaagataaaaaattaaaatttgatgattcattgaatattgccatgaccaatagcattgattttgatgatctgtttaaagagagcgcgaatggaaatattaaacatggggatatagaaaaattggaacagaaattttttcgatcactgcacggaaaaacggcagatcaacttattgcagaagcggaaaaaattaaagcagcgaactttaccagccaatga

SEQ ID NO: 5359 - DNA, 138 bp, Xenorhabdus bovienii
  Coding DNA location: Contig name=SeqID_16906; Position on contig =151593..151730bp; Strand=+
ttgcagaagcggaaaaaattaaagcagcgaactttaccagccaatgaacttacatccaatagatttcaagttgcagcgcatactatgttagccatatctgccagcattgaaccggatttcttaggcaaaattctctga

SEQ ID NO: 5360 - DNA, 573 bp, Xenorhabdus bovienii
  Coding DNA location: Contig name=SeqID_16906; Position on contig =151713..152285bp; Strand=-
atgagtgaaattaccataccgtatactgccgttatgaaattggttagagtccccctcgcactacagcaagccgtcatgcgcactctacggcaaaaattagcacaggcgagtgattaccttgaaacaacatttcctgaaccctgtgtgacctatcgacagagagggacaattgccggcagcgcccgcctgcaaggttgggaaattcgcctgaatcccgttctactgatcgaaaatcagcagtcattcattgatgaagtgatcccccatgaactggcacatttattgacttaccatcagtttggcaaggtggcccctcatggaaaagaatggcgctttgttatggaaacggtgcttaaagtatctgcctgccggacacatcagttctcagtggattctgtccgcagcaaaatatttatttattattgccgctgccagcaacatgagttgaccatacggcagcacaataaagtcctcagaggaaaaagttgctatctttgccagcaatgcaaggaaagattaaaactattggagcaagataaatccaataccccacagtcagagaattttgcctaa

SEQ ID NO: 5361 - DNA, 1155 bp, Xenorhabdus bovienii
  Coding DNA location: Contig name=SeqID_16906; Position on contig =152354..153508bp; Strand=-
atgactacacatctttttacttctgagtccgtttcagaaggacatccagacaaaattgccgaccaaatttccgatgccgttcttgatgcaatcttagaacaagatcctaaggctcgtgttgcctgcgaaacttatgttaaaactggcatggtcatggttggtggtgaaatcactaccagcgcttgggttgatattgaagaaattacccgccgtactgtccgtgaaatcggctataccagctcagacatgggctttgatgcaaattcatgtgcggtgattagtgcaattggtaaacagtctcctgatatcaatcagggtgttgaccgtgcagatcccctggagcaaggtgcgggtgatcaggggttaatgtttggttatgcgaccaacgaaaccgatgtgctgatgccggcacctatcacgtatgcgcaccgtctggttgagcgtcaagctcaagtccgcaaaaacggtatcctgccgtggctgcgcccggacgcaaaaagtcaggttacctttcagtatgacaacggcaaaattgtcggcattgatgccgtagtgctttctactcaacactctgaagatatccagcagaaagaactgcaagaagccgtaatggatgaaatcatcaagcctgtactgccggctgagtggcttactccaatgaccaaatatttcatcaacccaacgggacgctttgtgatcggtggcccaatgggtgactgtggtctgactggccgtaaaatcatcgtggatacctacggtggtatggcgcgtcacgggggcggagcattctccggtaaagatccctccaaggttgaccgttctgcagcttatgcggcacgctacgtcgccaaaaacatggttgcggcaggtttggctgatcgctgtgaaattcaggtgtcttacgctatcggtgttgctgaacccacttctatcatggtagaaacgttcggtactgaaaaagtgccaacttcaaccctgatccaattagtccgtgaattctttgatctgcgtccttatggtctgatcaaaatgttggatctgctacacccaatctatcgtgatactgcggcatacggtcattttggtcgtgaacatttcccgtgggaagcaacagacaaggcagaaattctgcgttctgcggcaggattgaaataa

SEQ ID NO: 5362 - DNA, 114 bp, Xenorhabdus bovienii
  Coding DNA location: Contig name=SeqID_16906; Position on contig =153783..153896bp; Strand=-
atgtggctgttggccgttaacaatcagcagataatggtgcataaccccattcacccccacatggcttatcagaacgcaagccgtttctcaattgagaagcagaacacgcagtga

SEQ ID NO: 5363 - DNA, 162 bp, Xenorhabdus bovienii
  Coding DNA location: Contig name=SeqID_16906; Position on contig =153855..154016bp; Strand=+
atgcaccattatctgctgattgttaacggccaacagccacattatgctattgatgtattcacatctagttcctttcttttcagtatgaactcatcccgatgttaccgaaagcattcaaacaggctggtaatatcgagtcggcaccatattgtcacaccgtaa

SEQ ID NO: 5364 - DNA, 153 bp, Xenorhabdus bovienii
  Coding DNA location: Contig name=SeqID_16906; Position on contig =153953..154105bp; Strand=+
atgttaccgaaagcattcaaacaggctggtaatatcgagtcggcaccatattgtcacaccgtaaataattgtttagttccctctaaacgtttctataatttaagggcatgctgttccctggcattttttaatgcgcaagatacgcactattag

SEQ ID NO: 5365 - DNA, 1905 bp, Xenorhabdus bovienii
  Coding DNA location: Contig name=SeqID_16906; Position on contig =154178..156082bp; Strand=+
atgaatgataatatcgctcgtaaaatgcgacaaacctacaatatcgcatactggggtggcggctattactatgtcaatgatctgggtaatgtcagtgtttgtccaaaccctgatttaccgggcgctcaagttgaacttactgagctggtgaagaaagttcaggaagaaaaaaaacagttgcgtttgccctcattattttgttttcctcagattctgcaacatcgtctgcgttctattaatgccgcgtttaaacgtgcacgtgaatcttatggttataagggcgattacttcctggtttatcccatcaaggtcaatcagcagcgtcgtgtgattgaatcattggcaaatgcgggtgagcccatcgggctggaagcgggctccaaggctgaattgatggctgtgttggctcatgctggcatgacacgcacggtcattgtctgtaatggctataaagatcgcgaatacattcgtctggcactgatcggtgaaaaactgggacacaaagtgtatctggttatcgagaaaatgtctgaaattgcgatggtgctggaagaagcagaacgcctcagtgtgatccctcgtcttggtgtgcgggcgcgtctggcctcgcagggggcgggcaaatggcagtccagtggtggtgaaaaatctaagtttggtcttgcggcggcacaagtactgcaattggttgaaactctgcgctcagcagggaagctggatagtttgcagctgctgcatttccatctgggttctcagcttgccaatatccgtgatgtggcaaccggcgtgcgtgaatctgcccgtttttatgtcgaactgcataaactgggtgtcaacatccaatgctttgatgttggtggtggattgggcgtcgattatgaaggcactcgctctcagtcagaatgttcagttaactacggcctgaatgaatacgcgaataacgtcatttggggaatcggtgatgcgtgtgaagagcatggtttgccgcatccaaccgtgattactgaatctggccgggcgttgactgctcatcatacggtcttgatctctaatgtcattggggtagagcataacgaatttactgaaacaacaccgccagcagaagatgcttcacgtcctctgacaagtttgtgggatacgtggcaggaaatgcaggatggcggttattctcgctccctgcgtgagtggctgcatgacagccagtttgaccttcaggatgtccatacccaatatgcacacgggatgttgaacctgtctgagcgggcttgggcagaagaactctatttaaatatctgtcgccgtattcagcgggatcttgacccaagcaaccgtgctcatcgtccgttcattgacgaattgcaggaacgtatggcggataaattctatgtgaatttctcgctgttccagtcgatgccggatgcgtgggggattgatcaggtgttccctgttctgccgattgaagggctggataagccactggatcgccgtgcagttttgttggatatcacttgtgattctgatggtatcattgaccattatgtcgatggtgatggtatagcagcaacgatgccaatgccggcttatgatccagagaatcccccattgatcggtttctttatggtcggggcgtatcaggaaattctgggtaatatgcataacctgtttggtgatacggctgccgttgatgtttacgtttcagaacacggcgaagtgacctaccagcagagcgaagagggtgattctgtagctaatatgctccaatatgtaaaactggagccgttggtactgatgagccgtttccgtgatcaggtgaaagcggctgatctggatgaaaatttgcaggagcagttcctgcaagaattcgaaaccggcctgtatggttacacctatttggaagatgagtaa

SEQ ID NO: 5366 - DNA, 927 bp, Xenorhabdus bovienii
  Coding DNA location: Contig name=SeqID_16906; Position on contig =156149..157075bp; Strand=+
atgagtattagctccttagggaaccaaattgataactctttggtttcaaatgccttcggtttcctgcgctttccgctgaatttccagccttattccagcgatgcagaatgggtgattaccggtgtgccttttgatatggcaacatctggacgtgccggcagccgtcatgggccagccgctattcgtcaggtatcgactaatctggcgtgggaaagctgtcgctggccgtgggacttcagtttgcgcaagcgcctgaatgtagtggattgcggtgatctggtctttaacttcggtgatgctcaggacatgagcgacaaattgcaggcacatgctgaaaaagtgctggcatcgggtaagaaaatgctgtctttcggcggtgatcattttgtcactttgccattactgcgcgcccatgcgaaacatttcggcaaaatggcgatgattcattttgatgcccatacggacacctacccgaatggcagtaagtttgatcatggtacgatgttttaccatgcgccaaacgaagggctgatagatcctcatcgctcggtgcaaatcggtattcgcaccgaacacgatactgacaatggttttactgtattggatgcggcacaggtcaacgatcgtagtgttgatgatgttgttgaacagatcaaaaatgttgtcggcgatctgccaatttacctgacattcgatattgattgccttgatcctgcttttgcgcccggtacagggacgccggtgattggcgggctgacgtccgatcgcgcactgaaaatcctgcgtggtctgcaacccctgaatatcgttggcatggatgtggtggaagtggctcctgcctatgatcagtctgaaatcaccgctctggcagcagcgacgattggattggaactgctgtatttgcaggcgtcgaagaaagcagtttag

SEQ ID NO: 5367 - DNA, 486 bp, Xenorhabdus bovienii
  Coding DNA location: Contig name=SeqID_16906; Position on contig =157264..157749bp; Strand=+
atgataatcagctcacctgaatttaagcataatgattttttgcataaatatcatgaattcaatgggtttggtgttaatggtgataaccgttcccctgagctttcttggcagaatgcacccgctgagaccaaaagtttcgctatcactgtttatgatcctgatgcgcctactggcagcggcttctggcactgggttgcttttgatatccccgctgaaacacacgctttgtcagccaatgtgggtcaggcggatggctctggtcttcctgccggcactatccaaagcagaaatgattatggtcagactggttttggtggcccttgcccgcctgaaggtgataaggcacatcgctatattttcaccatacatgctttatcggtagaaaaactggggattgatgccgaaacaacaaacgctgttgcacgttttatgattcaggctaacaccctgacgacagccactctgacaggttactatcaacgttaa

SEQ ID NO: 5368 - DNA, 780 bp, Xenorhabdus bovienii
  Coding DNA location: Contig name=SeqID_16906; Position on contig =157805..158584bp; Strand=+
atgagcaataaaaaaattgaatggaataatggattacagcaggaagcggtagagatcctttccaacgagggtggaatgatcgtctgcccgaccaaagtgggctacattattatgacttctgacgcgcaaggtctggagcgtaaattcgaagccaagcagcgtaatcgcaacaaacccggcgttgtgttatgtggatctctcgaacagttgaaagaattggctcagcttaacccggaaatcgaagaactgtatcaaaaacattgggatgcagatgtgttgctgggctgcatcctgccgtggaaagaagacgctgtcgcccgtattcctgatgatggttctaaagaactgatgatggatggccgtggcaccagttgtttcgtgattaaattcggtaaaccgggcgaaattctggcaaaagcactgtgggaaaactacgggaaattctcctttgccagctcggctaacccatctggtaaaggtaaccgtggtttggtggaatgtatcggtgaacgcattgaagagcgcgctgacttgattattgatgctaatgactatgttaaatctatccagccaaatgaaacggatcagacccgctatgagcagggtgtgatgatttcaatggtggatgacaacgggacactggtgccgatgcagaatggtcagcgcgatatcaccccgtgcccagtattgattcgtaaggggctggatgtgcataagatcatggtgataatgtctgatatcttcacaacttgggattaccgtcacggtaactattattga

SEQ ID NO: 5369 - DNA, 921 bp, Xenorhabdus bovienii
  Coding DNA location: Contig name=SeqID_16906; Position on contig =158647..159567bp; Strand=-
atgaataatattgaaaatcttacttcgatggtgatttttgcccgcgtagtagagacactgagctttactgaagcggcgaaatcgttaaggctatctaaatcttctgtcagccgcgagatcgcacagctagaagtaagattgggcactcagctactcaatcgcaccacgcgcaaaattcaagtgacggaagtcggactgagctattaccaatactgttcccgtattcttaatgaagccaaaagcgccgagcgttttatccgaaattttcatgacgaaccgatgggaagcctgcgcctgattgctccggtatcctttggtagtcagtgtatcgtccccgctctgaataactttatcgccagaaacattcatgtcagcgttgatctggaactaaccgacagaaccatcgatatgacagatgataactacgatattgcgatcattgtgggacgagaaataccggatcatccacttgtcatgcccctgattgatatcacttgggggctttacgctacaccagattatatgagtcagtttccgccgatagaaaaacccgaagatctgccccgctacgattacctgctgtttcgtggccctgcccatacgatttccctgccgttccgtaaggagaggcaaaagctcgatattgaagttcgcagccgttttcgcatcaataacagcgtggcgttgatgagctcggcgctgtccggtgcaggcattgcttacctgccagattacatagcccatgaatctgtagcagaaggcaaacttgtccggctattgccgggatggaatatggatatttaccaagcctggatgatgtttaaatcagaaaacacgctttcttcacgtgtgcagctatttgccgacgctttgcagcagaaactgcggggtgatcttggggatatcaaaaggaaagaatag

SEQ ID NO: 5370 - DNA, 102 bp, Xenorhabdus bovienii
  Coding DNA location: Contig name=SeqID_16906; Position on contig =159579..159680bp; Strand=+
atgatttacttgggggaatctccgcctaacataccacagatgttatggagaaaggccaatattcctctatcagatgaaggtgatattttaaccaaagattaa

SEQ ID NO: 5371 - DNA, 168 bp, Xenorhabdus bovienii
  Coding DNA location: Contig name=SeqID_16906; Position on contig =159604..159771bp; Strand=-
ttgttggacgcactgtttctctattggaacagttgttcttcagaggggaaattcctgcactcttattctgacaccatttttgcagcgcagtttaatctttggttaaaatatcaccttcatctgatagaggaatattggcctttctccataacatctgtggtatgttag

SEQ ID NO: 5372 - DNA, 1299 bp, Xenorhabdus bovienii
  Coding DNA location: Contig name=SeqID_16906; Position on contig =159857..161155bp; Strand=+
atgagccaaactatgacacaaaagattctcgcacgagctagtggccgtgagcaggtcacaccgggtgaagtggtttgggcgaaagtggatatcctgatgtctcacgatccctgtacaccgggagtagccagtgtatttaaaaaagagttcggtcaagatgccaaaatatgggacccggctcgctttattctgatccccgaccattttgtctattctgctgacccgcaggccaatcaaaatattcgtgtcatgcgcgaatttgctgccgagcagaacattaaatatttctatgatgtgggaacaccaaactataaaggggtttgtcatatcggtttggcggaaggagggcatactcgccccggtgaagtcctgttggggacagattctcataccgtcacggcgggggctttcggcgcgttcgccattggactgggcattaccgatgccgcctatgcgttaggtacaggggaaatccccctcaaagttccgacttctatcaaagtgaattttaccggaaccaagccctcgcatgtgttggccaaggatatgattctggcggtattgtcagaattaacggttgatggtgcaacttatgaagccattgagtttagcggtaatgtcattgatgaattatcggtagaagaacgcatgacgatttgcaatatggtcgttgagtgcggagccaagaatggcattatggtgcctaatcaggccacctttgattatctggctgagagaaaccaccttccctttgagattgtttatcctgacgaagatgcggaatatagccgggtgttaaacattgatgtttccgatatgcagccgatgattgccaaacctcattctccggataatgtcgttccgattgagaaagtgaccaacgttgctatttctcaggcttatatcggctcctgtaccggcggtaaactggaagattttattgcggccgctcgtgtcatcaagggcaataaagtctccattcctacttatgccgtccctgctaccaaagaagtttttcataagacaataaccacccagattgatggtgtttctgtttatcagatcttaactgacgccggagtgacactttcctcggaatcaggatgtgcggcttgctgtggtggcccgccagatacctttggccgcgtgaatgacccgatatcggtcatctctacaaccaatcgtaattttgtcgggcgaatggggcataaacgtgccaatatctatctggcatcaccttactcggtagctgccgccgccattacagggcgtattaccaatccgggggagtttttatga

SEQ ID NO: 5373 - DNA, 552 bp, Xenorhabdus bovienii
  Coding DNA location: Contig name=SeqID_16906; Position on contig =161152..161703bp; Strand=+
atgagtatattgcaggaaaacatcatcagaggcacagtttatgtcttgactgacaatatcgataccgatcagatcctgacggctgaatatctcaaggtaaacccctcaacgccggaaggatacgctcaactggcttcattagcgatgtgtggattaccggaaggctcgctgccctttattgatgaagaacagggcaaagcaaagtacccgattattgtggcagggcagaactttggttgtggttcttcgcgtgaacatgcagttgctgcactaggggcttctggtgtgaaggctgtcttagcacagtcttatgcgcgtatctttttccgtaattgcgtttcgaccggagagttgttgcctgttgctgcacaggaacgcttgtgtgacaaattagtcactggcgaccgtattgagattgatattgaaaaccagacagtgactttgctggcaaacagtgaaaaatatcccaccgatccggttggcgaactggcgaatattgtcgcggcgggtgggttattctcttatgctcggatgacaggcaggataaaataa

SEQ ID NO: 5374 - DNA, 471 bp, Xenorhabdus bovienii
  Coding DNA location: Contig name=SeqID_16906; Position on contig =161751..162221bp; Strand=-
atgagacaagcattactcgtttatgaagaaattgatgggatcatcaagaaattaccgcaaatgatgcagtcagtatctgatcaactcagccctcttgcccttttattttccgcctgccttgaacccgtagagaacgaagaagatcttaaagctcggatggtcataattgatgaattgtattcatatgccgatgatactgagcatgtagcagccaaattcgccgattttgtcacagatcgcatttatgaatatgaaaccaaaaaccggaatgtatctaacgtcagcccgcgtgaagcactggctttttttatgaaagaacggaggatcaggcaagctgatctgtgtgatattgccactcaaagtgtgatatcagagatccttcacggaaagcgttcaatgacaattcaacaagtgaaagggtttgctaaattttttggggttcccgttgaaacgtttatgggaacgctataa

SEQ ID NO: 5375 - DNA, 372 bp, Xenorhabdus bovienii
  Coding DNA location: Contig name=SeqID_16906; Position on contig =162225..162596bp; Strand=-
atgcgagttatcactgcacgagtcatcattgaagcaatgaggaaacatgctcaatggaaagttgggttaaagctatggctggatgtttttgataaagcagctttgcggtttgaatcttatgcccagatacgtgatctctggcttcaaacatctgcatggaacgttgatcgtatacctcatgagctattggaggcagggaatcagaaggggccgcttgatatttatatatttgatattcataaaaataaatgcaggataattgcatggcttaaccccaaatccggtactttttatattaaagatgtttgctcccatgctaaatacgatagatggtggcgtgaacaaaccaaatcaaacaggccaaaaaggtaa

SEQ ID NO: 5376 - DNA, 108 bp, Xenorhabdus bovienii
  Coding DNA location: Contig name=SeqID_16906; Position on contig =162682..162789bp; Strand=-
atgaagctgctgcaaacattacctgataaatatcaagctggctcgcaattttatgacaatttgacactgatactacagcaacgagtgttgacgtatattatcgagtga

SEQ ID NO: 5377 - DNA, 93 bp, Xenorhabdus bovienii
  Coding DNA location: Contig name=SeqID_16906; Position on contig =162919..163011bp; Strand=+
atgtcgaaactggatgataagattaaccaagtagctaaatcaaatctaattatagaagtcaggcatagaggcagtattagcctgccagattaa

SEQ ID NO: 5378 - DNA, 741 bp, Xenorhabdus bovienii
  Coding DNA location: Contig name=SeqID_16906; Position on contig =163063..163803bp; Strand=-
atgaaagaaattacttttaccccagttaaaaccactgccatcgatgatcccttcttcaccgtcattcagagaggcaacttacccaaataccctgatattcaggtaatgcaaacttattatgatcaggcttgctatcaggatattttatttgataagtacggtattacctatccagcaaggctacagaacgcagtaaacaagcggaaagctgaatatctggcggctcgctactgcactcaacagatcttaaatagcatggactatcctgaatttcaggtcataaatgcgccagatcgctctcctgtctggcctgataagatttgcggctccctgtcgcactccgccaactgcgccattgtttttgccgcttcccgcgagaaatatcagataattggggtggatatcgaacaagaaattaaacaggatactatcgatagtgtttcacgcactgtcattaatgaaaccgaagccgaattgctgaaagaatgtacactctctttcgctcaagcattcacccttaccttttccatcaaagagagccttttcaaagcgctctatccccatgtaaaacgcttttttgattttcatgccgctgaaattacagccattgattgcagtcatcacacattgagcatcaaactgctgaaaacgttatctgatgaatatcaggctggctcgcaatttcatgggaattttgtgttgatgccacagcggcaggtgctgacgtatttgattggttaa

SEQ ID NO: 5379 - DNA, 114 bp, Xenorhabdus bovienii
  Coding DNA location: Contig name=SeqID_16906; Position on contig =163873..163986bp; Strand=-
atgcaaagattcgataaacacgatatcacattcttccacgtgccagtttctgttagtgtcactgtttcacacaataaaaatgataacaagaaagagtataaaaagagtcagtaa

SEQ ID NO: 5380 - DNA, 993 bp, Xenorhabdus bovienii
  Coding DNA location: Contig name=SeqID_16906; Position on contig =164040..165032bp; Strand=+
atgggatatatcggcagtcatacttgtgttcagatgatggaagcgggaatgacgccgatcattatcgataacctgtgcaatgccaatcgcgaagtattggcgcgcattgcgacattgacgggtgtgatacccctgttttatgaaggggatattcgtgatgaatcattcctcgatactattttttcccgccatcaaattcagtcggtgattcattttgcaggtttgaaggcggttggggaatccgtcgctaaacctattgaatactatgataacaatgtcaatggcacgctggtgctgatgcgcagcatgcataaagcgggcgtaaaaagcattattttcagttcatcagcaacggtgtatggcgatccggagatcgttccaattacagagcaatccgccgtagggaataccactaacccttatggcaccagcaagtatatggttgagcgctgtctgtctgatcttcatcacgccgaaagtgattggtcggtagtattgttacgttactttaatccggttggtgcacatccttctggcactatgggcgaagatccgcagggcattcctaataatttgctgccatacattgctcaagtggcagtaggccgcagagaaaagctgtccgtttatggcagtgattactcaacgcatgacggtacaggcgttcgcgattatatccatgttatggatttggctgatgggcatattgcggcactgaatgccgttggcaagaaatcaggtctgcacatctacaatctgggaaccggaaaagggactagcgtattggaaatggtcacggcatttagccacgcttgtggcaaacctgttccttatgaaatttgtccgcgtcgtccgggtgatattgccgaatgttggtcaagcccagaaaaagcggaacgtgagctgggctggaaagccagccgcactcttgttgaaatgacggctgatgcatggcgctggcaatctcaaaaccctaatggttatacccaatag

SEQ ID NO: 5381 - DNA, 162 bp, Xenorhabdus bovienii
  Coding DNA location: Contig name=SeqID_16906; Position on contig =165013..165174bp; Strand=-
atgaccatactcctcttattgcgatggataacaacagtcggtaaagaaataggtaataatgcagaaattcacagtatctgtttaaccatcctcccccaccttcacgctgacgtgactcaggagagggattcccttttgaagcctattgggtataaccattag

SEQ ID NO: 5382 - DNA, 693 bp, Xenorhabdus bovienii
  Coding DNA location: Contig name=SeqID_16906; Position on contig =165173..165865bp; Strand=+
atgagttctaacccgcagcaagaaactaacccgcagcagtggactgccgttgatcattatctcaaaaaaagtttattaaaatcggcaccgcatctcgaaaagacactcgaatataatgtcagccaagaattgcctgccattgatgtttccccgcttatggggcagtttttaaggatgatggtgcagatcagcggagcaaaacgtattctcgaaatcggcacgttgggcggttacagttcccaatgtatggctaaggaattaccggatgacgggctacttgtcacattggaaaaagaacccagaatggctcaagttgcgcagcataatatcgaccaggcgcagcttgcacacaaaataaagattattgtgggagatgctcgtgaaaccttgccgacgctggtcactgagccattttttgatctgatttttattgatgcggataagcaaagcagtgaattgtatctcgattgggccattaagctgggacatccgggaagtattatcatcatggacaatgttgttcgtgccggggctattttgcatcagcagcgtgatgagcaggttgaaggtatgcgtaagtcgttggataccatgcttaaccgtcctgaaatcacagtaacggctttacagacagtcggtgaaaaaggttgggatggctttgcgttattacggataaacacggaaaatcattaa

SEQ ID NO: 5383 - DNA, 459 bp, Xenorhabdus bovienii
  Coding DNA location: Contig name=SeqID_16906; Position on contig =166059..166517bp; Strand=-
atgaaatggcgtagttacacatacggtgcgatgttactggcgggtagcctgtttagctctgccttatgggcgaaaggcgaagcacacctgttgttccacatggggttgggagccaatggcaaattctttgtagggggcacgctggaaaataaaggcgataaacctgtagcaggaggctatctggcggttttacctctgaataccaaatgtgaacctcaggctccgacagtacaatcatttgaatcactggcgccgggagagaaaaaagaattccgcattcccgtaaatacccaactaagtggctatcgcctgattggttttggtgcttatgatgatatgggtttttccctccctaccgtggatgaaacagcaaaagtgattaaagaccgagagcctgatgaacgtaaagcctgtcagttagcccgtaaatctgaaaaaactgcggtcaaaaaacaataa

SEQ ID NO: 5384 - DNA, 906 bp, Xenorhabdus bovienii
  Coding DNA location: Contig name=SeqID_16906; Position on contig =166618..167523bp; Strand=-
atgtatacgcacactgaagcagcaaaattggcatcattaatcatgtacgcatatgatatgaatgaaaaatattacaataatcccactccccctgctgatccacgtatcaaagaggatggatggaatcttatcgcttatatttccggagatgacacctctttctcagtagaaaaaaaaatgttgttcacattgccgaagagtatctgttacggatatattgcagagaagaaggacgcaccgggaaagtatgtcattatattccgaggaacggatgacacaaaccttctggaggatctccatgatatcattgccatttttacatcgccttggtctagtgccccagaacggaaagtaagccgcggtttttatagcgtttacgactcactgaaactcattgcgtttaattctgaatgtgattgcgattatagccaactaaaactggccgatgcgattactcaaatcataggcataaacggccaattcacaatactcgctcatagtcttggagccgccatcgcttcttatttgatgtgtgatatcgcttttttagcacccaatcattctgcctgtttgtttgcttgcccgagacccggaaataatgaatttgttgaatatgttgataataattttagccactatgaagtattcaactatgcaaaagatatcgttcccaatttaccgcctgattttcagggacttgatatttctcagcaatgggactacgaatataaatcactacctaagatcaccctccttaattctccggaagccctgagcatagctgacagcataggttgcaaccactatttaaccagctacattgctatattagatccagatgaattcacacgagttacaacaggtaatggcgcagctagtcgtcattgtgtaaatatgaataaataa

SEQ ID NO: 5385 - DNA, 1371 bp, Xenorhabdus bovienii
  Coding DNA location: Contig name=SeqID_16906; Position on contig =167836..169206bp; Strand=+
atggctgtaccacgttcggttcttgaactgattgggaatactccgctactggagctgacccatctggatactggcctatgccagttgtttatcaagttggagaaccaaaatccgggtggctctattaaagaccgagtagctctttcaatgattgaaaaggctgaaaagcagggattgttgcagccaggtggaaccatcattgaagcgacagccggtaataccggtatcgggctggcgctggtcgctgctatgaaaggctataaactgattctggttgtgcctgataagatgagccgagaaaaaatttatcacttgcgggcattgggaacggatgtgcgtctgacccgttctgatgttggcaaggggcatcctgagtattatcaggactacgcgctgcgtttgtcgaagcaaatcagtggcgcctattatatcgatcagttcaacaattcctcgaattcactggctcatgcgacgacgacaggccccgaaatctggcaacagatggagcataacgtggatgctgtggtggttggtgtgggttctggcggtacgcttggcggtttgagccaatacttcagggaagtctcccccgatacggaatttgttctcgctgatccgaaagggtcaattctggcagattatgttgagcacggccgttacgatgaagccggaagttggtttgttgaaggtattggcgaagattttatcccgccgctcggggatttttctcaagttcagaatgcctatcggattactgattcagaagccttttccagcgccagagatttgctcctgcaagagggcattctggcgggttcatcttcaggaactttactggccgccgctctacgttattgccgcgcccagaagacgccaaaacgggtggtgacgttagcctgtgacagcggtaacaaatatctgtcgaagatgtttaatgattactggttattggagcaagggttacgttcacagccacaagagaacgatttgagtgattacgtcacttatcgttatcgggatggtgcaaccgtttcagtttcgccgcaggatactctgcaaatcgctcatggccgaatgcgcctgtatgacatttcgcagttacctgtgctcgaaaatgaacaggttgtgggcatcattgatgaatgggatttaatgcatgccattcactcagattctaataatttctctttgccagtcagcaaggcaatgacgggtcaggttaataccctcaataaaaaggctccactggagcagttgactgcaacttttgatgcgggtcatgtggctttgattgtggatgataacaatcgttttctgggtctggttacccgtactgacgtgctgaatgcatggcgccaacaactcaattga

SEQ ID NO: 5386 - DNA, 1161 bp, Xenorhabdus bovienii
  Coding DNA location: Contig name=SeqID_16906; Position on contig =169225..170385bp; Strand=+
atgactacaactaagtttgatacaaaaagcgttcatgcaggctatgtccccgatcataccggcgccgtcatgcccgctatttatgccacttccacttatgcacaacctgctcccggccagcatacaggctatgagtactctcgcagtggtaacccaacccgcgatgctctggaacgtgcaattgctgaattggagaacggtactcgtggctatgcttttggttcagggctggccgccagttctaccattttggagctactggataaagacagtcacattattgccgtagatgatctgtatggcgggacttaccgattattggaaaaagtccgtcgccggacggctggcctgcgtgttacgtatgttgaagcggggaataccgcagcgctggaagccgccattgagcctgatacaaaaatgatttgggtggagacaccaaccaatccactgctgaaactggctgatctggctgccattgcccagatcgcccagcgccataagattatcagcgtggcggataatacttttgcatctccctatatccagcgtcctcttgatttaggttttgacattgttgttcattcagcaaccaaatacctgaatggtcattccgatgttgtcgcgggtcttgccgtggtggggaacaatgctgaactggcggaacaggttgcttttctgcaaaattccattggtggcattctcgatcctttcagcagtttccttgtcctgcgtggaatacggacgctggcgctgcgtatggagcggcatatcgataatgcagagaagatggcacattggctggagcagcaacctcaaatagagaaagtgttttatccgggtctggcttcccatcctcagcatgaattggcgaaacgtcagatgcagggttttggtggcatgatttccgtggtgttgaaaggcgatgatgactatatacgccgagtgattaaggaactgaaattatttacgttggcagaaagtctgggtggagtagaaagtttgattggccagccatttacgatgacccatgcctcgattccactggaaaagcgtctggcatcaggtatcacaccccaattgatccgtatttcagtcggtattgaaaattcagaagatttgattgctgattttgctcaggcgttagaaaaagccagcctgtaa

SEQ ID NO: 5387 - DNA, 507 bp, Xenorhabdus bovienii
  Coding DNA location: Contig name=SeqID_16906; Position on contig =170584..171090bp; Strand=+
atggcaattttaaatatactcacgatccctgatgaaagattgagacaaaaatgtgttgatgtcacgcatgttgatgaaatacaaacattgattgatgacatgctggatacaatgtatgacacagataatggcattggtttggctgcaccgcaggttggccgaaaagaagcggttctgatcattgatatctcacccaatcgggatcagccgatggtgttagtcaatcccaagattgttgaaaaagagcgtcgggtcgtgaatcaagaaggatgtctgtctataccgggatattacgcggatgtagaaagatttgaaaaagtgaaagtggaagcactggatcgtcatggcaagtctattacggtggaaagtgaagattttctatcgattgttatgcaacatgaaattgatcatttgaatggcattatttttattgattatttgtcacccttgaaaaggcagatggcgctgaaaaaagtaaagaaatttttgagtaataaggcaagttag

SEQ ID NO: 5388 - DNA, 486 bp, Xenorhabdus bovienii
  Coding DNA location: Contig name=SeqID_16906; Position on contig =171289..171774bp; Strand=+
atgtttatctacctgaattttaataaaattatagttaatgatataaaagagggaatgattgtggctggaaaaaatgatattacattttatcaacaatccaattttactatcagcttgagtttgatagatacaactgatgctaagattggcgcctatttgatgatacttgatgctgaaggaatcaataacgcgcaggttttctcgattaaaagtggaagtgaaatggaatatgttcacattccatcaacagccagcagtaaccaacttacatgctccatttatatcaaaaaagtggacaatggcagttatccgctggttggcactttctatcttcgctatcatccagcatctgggattgttgatattaccgaagtgaaaatatcgccgggagccctgttgaatttggaagtagacaaagtcgataacactaaatttcactttaaactgcaagcgaagcaatgcaatcaggctattacgtcaatataa

SEQ ID NO: 5389 - DNA, 681 bp, Xenorhabdus bovienii
  Coding DNA location: Contig name=SeqID_16906; Position on contig =171831..172511bp; Strand=-
atgtactttacaccgcccagtccacctgaaaatgaacaacaactactcgaacgagctaattctctggcgggtttgtcaatgggtgagctagctgcgcaggccaatctgcccattcctcccgatctaaaacgggataaaggttgggttggcatgttgcttgagtattatttgggcgcaagtgcaggcagtaaaccagaacaagatttcgaacatattggcattgaactaaaaaccatccctgtagataagaaaggttcaccactggaaacaacctttgtctgcgttgcacctttaacgggcaatagtggcattagatgggaaaattgccacgtcaagcgtaaattatcgcgtgtcctgtggatacctgttgaaggggaaagggaaatcccacttgccgaacgccgtgtcggttcaccactgctctggagccccgatccgattgaagaagagctattgcgacgtgattgggaagaattaatggatttgatcgtattgggcaaagttgagaatatcaccgcacgtcacggagaagtgttgcaattacgtccaaaagccgccaatagccgagcgttgacagaagcgattggagaatttggtcaacccatcatgacacttccccgcggtttttatttgaaaaaaaacttcacagcccccttgctggctcgttattttttcttatga

SEQ ID NO: 5390 - DNA, 210 bp, Xenorhabdus bovienii
  Coding DNA location: Contig name=SeqID_16906; Position on contig =172981..173190bp; Strand=+
atgaaagaaaaatatacccgtcttacccctgtctttttcacatacatatccacagaaaaagtgaataaaatagtggccgtcagactaaaaatgtttataactttagctttttctgtgaattatccttgcggcggtgtaaaccacgcagatttaaagtcaaaccatccgaacgtgttcatttttactcccctcatgctacgctgcacctga

SEQ ID NO: 5391 - DNA, 108 bp, Xenorhabdus bovienii
  Coding DNA location: Contig name=SeqID_16906; Position on contig =173283..173390bp; Strand=+
atgcaggttgatgctgtaatgcctgtccgatgttatcgaatctatttaccatgcagtggcgcaaagtgttggcgccttaaatttcttctgcaatataacgtgcaatga

SEQ ID NO: 5392 - DNA, 441 bp, Xenorhabdus bovienii
  Coding DNA location: Contig name=SeqID_16906; Position on contig =173359..173799bp; Strand=-
atgttgaaatccagcacatgtatatcgacaacgcccaccatgcaattgatcaaaaatccggctcagttcgatgttctgctatgctccaatatttttggtgatattttatccgacgaatgcgccatgatcacgggttcaatggggatgctaccttccgccagcctgaatgaaaaagggtttggcttatatgagccagcgggaggatcagcacctgacattgcaggcaaaaacattgccaaccccatcgctcagattttatctatcgcgctgttactgcgttacagttttgagcgtgatgatgccgcagacgccattgagcaagccattaaccatgcactggagcaaggttatcgcacaacagatttagcaggtaatgacaaagcagtcagtaccgatgaaatgggcgatatcattgcacgttatattgcagaagaaatttaa

SEQ ID NO: 5393 - DNA, 783 bp, Xenorhabdus bovienii
  Coding DNA location: Contig name=SeqID_16906; Position on contig =173699..174481bp; Strand=-
atgtcaaaccaccctactacacacaaacaaaagtctggcagttatcacattgcggttttgcctggtgacggtattggccccgaagtcatgaaacaagcctataaagtgttggatgcaatccgccggcgctttaacctccacattacaaccagcgaatatgacatagggggcattgcgattgatcatcatggttgcccgttgcctgaaacaaccatcgccggttgcgaaaaagccgacgcacttctatttggttccgttggcggccccaaatgggaacatttgccccccgcagaacagccggagcgtggtgcgttgctgccactgcgcaagcacttcaaactgttcagcaatttacgcccggcgcgcttatatgcgggtttggaatctttttgcccacttcgccaagatatcgcggagagaggttttgacattttatgtgttcgtgaactgacgggtggcatctattttggtcaacccaagggacgggaaggaaaaggaaaatatgagcgggcttttgataccgaaatctaccatcgtttcgagatagaacggatcgcccgtatcgcttttgaatccgcccgcaaacgtcgtcataaagttacatccattgataaagcgaacgttttgcagagttctgtactgtggcgtgaagtcgtcagcgaagtcgcgaaagcttaccctgatgttgaaatccagcacatgtatatcgacaacgcccaccatgcaattgatcaaaaatccggctcagttcgatgttctgctatgctccaatatttttggtga

SEQ ID NO: 5394 - DNA, 1593 bp, Xenorhabdus bovienii
  Coding DNA location: Contig name=SeqID_16906; Position on contig =174484..176076bp; Strand=-
atgagccagcaagttattatcttcgataccacactgcgcgatggcgagcaggcattacaggccagcctgagtgtaaaagaaaagctgcaaatcgcttatgcactggaaagactcggggtggatattattgaggcggggttccccgtttcttccccaggagattttgagtcggttcaaaccatcgcccgtgagatcaagaacagccgtatctgtgcattatcccgttgtgttgataatgatattgatgttgccgccgaagccctgaaagtcgcggaagccttccgcctgcacctgtttttggcgacctccagcctgcacgtcgaacataaattgaaaaaagaatttgacgatgttgtcgaaatggccgttcgttccatcaagcgtgctcgcaagtacaccgacgatattgaattttcctgcgaagatgccggccgttcgaatatcgacaacttatgtcacattgttgaacaggcaatcaaagcgggcgcaaccacaattaatattcccgataccgttggctataccacgccttatcaatttggcggcattatccaaaatttatttgatcgagtacccaatattgataaagcgattatttctgtccattgccatgatgatttgggcatgtccgtggcgaactcgattacagcggttcaggccggagcccgtcagattgaaggcaccatcaacggcttaggagaacgcgcggggaactgttcgctggaagaagtgatcatggcaatcaaaactcgccaacaaatattaggtgttcacactaatatcaaccacaaagaaatttaccgcaccagccaattggtcagccaaatctgtaataccccgattccggccaataaagcgattgtcggcagtaatgcctttgctcactcatcaggcattcatcaggatggcgtcctgaaaaaccgcgaaacctacgaaatcatgacgccggaatccatcgggctgaaagatacccaattgaacctgacttcccgctctggccgtgccgccgtaaaacaccggatgtctgaaatgggctatcaggagcaggattataatctggataccctgtataaagctttcctgcgtctggcagacaaaaaaggccaggtgtttgattacgatctggaagcactggtgttcatcaatcaacaacaacaagagaatgaacattaccgtctggattatttcagcacccagtccggcaccaacatcgttccaacggcgaccgtgcgtctggcctgcggggatgaaatcaaatctgaagccgctacaggcaatgggactgttgatgcgatctatcaagccatcaaccgcattaccggatattcactcgaacttatctcctaccagttgactggcaaaggacatgggaaagatgctctcggtcaggtcaatattatcgtggaacattctgggcgccgtttccacggcatgggattggaaacagatatcattgaatcctccgccaaagccatgatccccattctgaatagcatctggcaggcagaacaagtcgaaaaagaaaaacagcgcatacaaagcaatacctcccaaaacaatttccccaataacaatacaaaggaaactgcataa

SEQ ID NO: 5395 - DNA, 120 bp, Xenorhabdus bovienii
  Coding DNA location: Contig name=SeqID_16906; Position on contig =176749..176868bp; Strand=-
atgcattcttatttatacgacgataatattcttataagcatgaatattaatactttatgtatgaatagaaataactcgaattacattagtcacttacgcgtaaaaatgcgcaaccaataa

SEQ ID NO: 5396 - DNA, 129 bp, Xenorhabdus bovienii
  Coding DNA location: Contig name=SeqID_16906; Position on contig =176960..177088bp; Strand=-
atgattcttttcttcttgtcgttactgaattatatccagtcattatttcactccactaaatttattgcagcgacctcattaaataacggaatattggcagtgtcccaatgcaacattttgacacagtaa

SEQ ID NO: 5397 - DNA, 948 bp, Xenorhabdus bovienii
  Coding DNA location: Contig name=SeqID_16906; Position on contig =177046..177993bp; Strand=+
atgactggatataattcagtaacgacaagaagaaaagaatcatgtgaagtgcaattgcgcagtgtggatctcaatttgcttactgtgtttgatgctgtaatgcaaatgcagaacattacacgtgcggctcaggcactgggaatgtcacaaccggctgtcagtaatgcggtagctcgcttaaaaactatgtttgatgatgagttgtttgtgcgctatggccgtggcattcaaccaacggcaagagcaaaacagctctttgggccactcagacaggcacttcaaattgtccataatgagttgcctggcgtggggtttgagcccgataatagtgcgagggtatttaacctctctatttgcagcccgcttgatattcgtttagctgcccaaattgttggggaaataaaaaaacattcgccaaatattgaagttgtcattaaaacacaaatcaatggcaatattgagaaacaattaaaatatcaggaaatagaattcgttatcagttatatacaattagatcagcctgattttcataattctccattgtttaatgatgaattggttttggccgtttccaaaacgcatcctcgaatcggtaaacgcattaatcagcagcaattgcaggaagagaggcatgcaattgtggcattggataatgtggattcattcagtaaaccttactatgaaagtaatgaattgttgcgttctgtttcttatcagggtacggatttaaatagtgttctcaatatcgtgtctcagacgtatttagtcgctattgcaccgaaatggatggttgagcattattctgaacagttaaatatacgtgcgatacctttgcccaacggtcgaatctcccgcccctgctatttgatatggcacggttcgacaaacagagataaaggtcatcagtggatgaaatcgttactgagcaatcttggtgaacaggaatag

SEQ ID NO: 5398 - DNA, 1836 bp, Xenorhabdus bovienii
  Coding DNA location: Contig name=SeqID_16906; Position on contig =178316..180151bp; Strand=+
atgataaacctaagacttatacaggaatatatcgtgataacagattccctgcattcctatcacctgatcaaccggttgcagcagcaaaccattgaatatcccgaaaaaattgcattcaggcaatggtcaccatcagagcagcttgaaatgagttggcaagacgttacttatagaacggaatccatcgcaaaagctttgttgtcactgggtatagaaattcaggagaaagtcgctatttttgcgcataactgtattgcatggtcattggctgatttggccgttcttcagttacgtgcggttacagtccctctttatgcgaccagcagccgtgatcaggctaccttcattcttaaggatgccggtgtgcgggtactgtttgttggtgagcaagaacaatataatgttgcgatgacattgctggaattgtgccctcaactcaatcatcttattgtgctggacgagtccgttgacttaaagggctgtccgcaggcgcagcatttatctgccttcattgccaatgaccatacacaatatcagccagagcttgataaccgcattgcagggcaggatttaaatgatcttttcaccttgatctacacctccggtacaacgggagagccaaaaggagtgatgttggattaccgcaatatcgcttcgcagctttacttgcatgatcagcgtctgacactgaccagagaggatgtatcacttagttttttaccgttgtcccatatcttcgagcgcgcatggagttactatgtcatgcatacaggagcgcttaatgtctatttaactgacaccaattctgtgcgtgaggcgatggctgaagtacgtccaacggttatgtgcgctgttccccgtttttatgaaaaagtgcatagtgcaattcttgagaaagtttcccgtgcgccatttttgcgccggatgattttccgctgggcgataaagcgaggagaaagccgctggatgcgtcagctacagaataaaaaagcgtgtctcttctctctctgtagtgatcaactggccgacaaactggtgttgagcaagttccgtaacatattgggaggacgagtgcgtttcttacccgtggcaggagcacgccttgacgattctattgcccggtttttcctgtccgccggcattaatatcaaatatggttacggcatgacagaaacttgtgccacggtgtcttgctgggaagagaaaaactatcttccaggctcgattggtacaccattgccgagcattgatgtgcgcatcagtgccgaagatgaaattcaggtacgtggccctattgtgatgaaaggctatttcaaccggccggaagaaacggttcatgcttttaccgaagatggctggctacgtacaggggatgcaggggggttggatgaaacaggcaatttgttcatcactgagcgcctgaaagatttgatgaaaacctcgacgggaaaatacattgctccgcaaatgcttgaggggactttgggacaggatcgtttcattgaatatattgcggttattgccgattcccgtaattttgtttctgcgttgattgtccccagttatgacgcattagaagattacgcaaaatctatccatcttcattatcgtgaccgtgttgagttgctgaacaatcgtcagatcatcgaactgtttgaacaacgtttggtggaactgcaaaaaaatattgccaaataccatcaggtaaaacgctttatcctgctgccagaagccttctccatggaaaaaggcgaattgactcctacactgaaactgcgccgtaaggtgatttcgcaacattatcacgatgaaatcgaatccatgtatcgagattaa

SEQ ID NO: 5399 - DNA, 1728 bp, Xenorhabdus bovienii
  Coding DNA location: Contig name=SeqID_16906; Position on contig =180345..182072bp; Strand=+
atggagatgttgtcaggagccgaaatggtcgtcagatcgttaatcgatcaaggcgttaaacatgtattcggttatccgggtggggcagtattggatatttacgatgccctgcatacggtgggaggaattgaacatattctcgttcgtcatgaacagggtgctgttcatatggcggatgggtattcccgttcaacgggaaaagccggggttgttctggtgacatccgggccaggagcaaccaatgctatcacgggaattgcaacggcttacatggattcaatcccaatggtggtgttgtctggccaagttgccagctctttgataggtaatgacgcgtttcaggaatgcgatatggtgggaatttcccgtcctatcgttaaacatagttttctggtgaaaaaagcagaagatattccaaatacgattaagaaagccttctatttggcgacaactggccgtcctggtccggttgttatcgattttcccaaagataccgtcaatccggcactgaagtttccgtatgtttatccggaaaaaatcagcatgcgttcttacaaccccaccgttcaggggcataaagggcagattaaacgggcgttgaaaactctgctggatgcgaaaaagccggtgatctacgtaggtggcggcgccatcaattcggcatgctcatcagagttgctgaaattggctgaacgtttgcacattccggtcgtcagttcgttgatggggctgggcgcttttcctgccacccatcgtcaaagtctgggaatgctgggaatgcatggcacgttcgaagccaataaagcgatgcacaattctgatttgatttttgcagtgggtgtgcgttttgatgatcgcacaaccaataatctggaaaaatattgtccagaagccattgtactgcacattgatatcgatccggcctctatttcaaaaactgtgtcggcggatattcccatcgttggggatgccaaacagatactcggccaaatgctggaattgatgaatactctggaagacactcaggacccggatgcattgaaagactggtggctttccatcgaacaatggcgtagccgcaaatgccttggttacgatcgcaccaccgcgaaaatcaagccacaggccgtgattgaaacgctttaccgtctgactgaaggcaaggcgtatctctcgtcagatgtaggccagcatcagatgtttgccgcactgtattatccctttgatgagccgaggcgttggatcaactctggtggtttgggtacgatgggatttggcttgccagccgcgcttggggtgaagctggcaaaacctgatgcgacagtcgtgtgcgtgacaggagatggcagtatccagatgaatattcaggaattatccactgcattgcagtatggcttgcctgttctggtgctgaatttgaacaaccgttttctgggtatggtgaaacagtggcaggacatgatttacgcgggtcgtcattctcaatcctatatggaatcgctgcctgattttgtcaaattggcagaggcttatggtcatattggtgtttctatccaaacctacgaagagctggaaaataaactggctcaggctctgcatgaagtcactgaaaaccagcggctggttttcgttgatgtcaccgttgatgaaacagaacacgtttatccaatgcaaatcaggggtggagcaatggatgaaatgtggttaagcaaaacagagaggacctga

SEQ ID NO: 5400 - DNA, 492 bp, Xenorhabdus bovienii
  Coding DNA location: Contig name=SeqID_16906; Position on contig =182075..182566bp; Strand=+
atgcgccggattttgtctgtattacttgaaaacgaatcgggagcgttatcccgcgtagttggcctgttttctcaacgtggctataacattgaaagcctgaccgtcgcccctacggaagatccaacgctgtcacgcatgactatccagaccaagggtgatgctaaggtattagagcaaattgagaaacaactgcataagctggtggatgttctgcgggtcagtgaattgaccgcaggtgctcatgttgaacgtgagatcatgctggtgaaattgcaggccagtggctatggtcgggaagaaatcaagcgcagtacggatatattccgtgggcagatcgttgatgtgacgtcaacactttacaccgtccaattggcaggaacgagtgaaaaactggatgcgtttcttgatgccgtgcgcgatgtggctgagatcctggaagtagcacgatcaggtattgttggcatcgctcgtggggataaaattatgcgatga

SEQ ID NO: 5401 - DNA, 1008 bp, Xenorhabdus bovienii
  Coding DNA location: Contig name=SeqID_16906; Position on contig =182655..183662bp; Strand=+
gtgaaactggatgagatcgcccgcttagcaggggtttcacgtactacggccagttatgtgatcaatggtaaagccaagcagtatcgggtcagcgataaaacagtagaaaaagtgatggcggtggtcaaagagcacaattaccatcctaatgctgttgccgccggtcttcgggcggggcgtactcgttcaattggcttagtgataccggatttggaaaacacgagctatacccgaattgctaactatcttgagcgtcaggcacggcaacgtggataccagctattgatcgcatgttctgaagatcagccagataacgaaatgcgctgtgttgagcatcttctgcaacggcaggttgatgccattattgtttccactgctttgcctcctgaacatcctttctatcagcgttggacaaaccgttcactgccaattattgcgcttgatcgtgcattggacagcgaacactttatcagcgttgtgggggatgacttcgaagatgcgaaaatgctggcacaggagctgcgtcaatttccgtcagaatctgttctttatctgggagcattgcctgaattatcggttagtttcttacgtgaacaggggtttcgtgaagcatgggaaagtgatcagcgtgaagtgaactacctgtatgcgaacagttatgaacgtgacgcagcggctgaagtctttgcttcatggctggaaaaccatcctgtacctcaagtactctacacaacctcatttgccttgctgcaaggcgtcatggataccctccttaagcgcagtggccggttacctgagcagttggtcattgccacgtttggtgatcatgaattacttgatttccttgaatgtccggtgctgtccgtcgcacaacgccaccgtgacgtggctgaatgtgcccttgaactggtattggctagtttggatgaaaaaaagaggccagagccaggaataactcgaatgcgtcgtcatttatgccgtcgtggaagtctgagtagaaaagcttga

SEQ ID NO: 5402 - DNA, 150 bp, Xenorhabdus bovienii
  Coding DNA location: Contig name=SeqID_16906; Position on contig =183777..183926bp; Strand=-
atgactattgggaataaaaagtcattaaatatcaaatcaataaaaaaatctctccgtcacagaagtaaacgatgtaaatcgtctgactttacgtgtagatcattcaccttgccatttttagtaacaagttatcggattttcaggtcataa

SEQ ID NO: 5403 - DNA, 108 bp, Xenorhabdus bovienii
  Coding DNA location: Contig name=SeqID_16906; Position on contig =184128..184235bp; Strand=-
atgaaaaccttgtcaagccagagcccatgtgctttagctagatttacagaaagatttcagagagaagaagagagatttttcagatttggcaatattaataatagataa

SEQ ID NO: 5404 - DNA, 495 bp, Xenorhabdus bovienii
  Coding DNA location: Contig name=SeqID_16906; Position on contig =184275..184769bp; Strand=+
atgtggagatttttaccatcaaggggtaacctgagtatgtttcgtggagcaacactggttaatctcgatagtaaagggcgactcactgtacctgcccgatatagggaaatgctgaatgaggaatctaaaggtcaaatggtttgtaccattgatctccatcagctgtgcctgttgctttacacattacccgaatgggaaatcatcgaagaaaagttatctcgcctatccagcatgaatctagccgaacgtcgcgttcaacgtttgttattggggcacgccagtgaatgccaaatagacagtgcagggcgccttttgttagccaatacactgcggcagcacgcagggttaacaaaagaggtcatgctggttgggcaatttaataaatttgaattgtgggatgagcaagcctggtatcagcaagtacagaatgatattgaggctgaacaatccacacaagaacctttatcagcaaggctacaggatttatcactataa

SEQ ID NO: 5405 - DNA, 945 bp, Xenorhabdus bovienii
  Coding DNA location: Contig name=SeqID_16906; Position on contig =184772..185716bp; Strand=+
atggcaaatagtcattataagcataccagtgtattactggacgaagctgtcaatggactgaatatccgagaaaatggaatttatattgacggaacattcgggcgaggagggcattctcgcctgattttgtctcaattaggggcagatgggcgtttaattgcgattgatcgcgatccgcaggcaattgaagcgtcgaaagccattactgacccgcgtttttccattactcatgggccattttccgaattggctacctatatagaagaagcgggactggttggaaaaattgatggtgtgttgctggatttaggggtttcctccccacaactggatgatcctgaacgtggtttttcatttatgcgtgacgggccgctggatatgcgaatggatcctacccgagggcaatcggccgcagagtggctgatgaaggccgaagccgatgatattgcatgggtactgaaaacctttggtgaagaacgttttgccaaacgtatcgcgagagccatcgtagctcgcaatcaggaaggatcaatcacgcgaaccagagaactggcggaattgattgctcaggcaagcccagttaaggaaaagcacaagcatccggcgacgcgcagttttcaggctatcaggatctacattaacagtgaactggaagaaatagaacgcgcattgaatggtgcattgcaggttctggcaccgcaggggcgattatcagtcatcagtttccactcgttggaagatcgcatcgtgaagcgttttatccggcagcatagccgggggccacaggttccagccggtttacctctcactgaagtgcagttaaaagctcaggggggacgcagtctgaaatcaattggtaaactgaagccttcagaggacgaagtggcaataaacccaagagcgagaagctctgtgttgcgatttgctgaaaaggcaggtgagtaa

SEQ ID NO: 5406 - DNA, 318 bp, Xenorhabdus bovienii
  Coding DNA location: Contig name=SeqID_16906; Position on contig =185717..186034bp; Strand=+
atggcaggtgagcgtcatggattagtgggggtcattggcagggatttaatccgcaatgccaagatcccactggttttgctggtagcggtaatcatttcagccgtcagcgttgtgacggttgcccataaaacccgcttattgatagcggaaaaagagcgctcggcgattgattttgattctctggatattgagtggcgtaacctgctccttgaagagaatgccctaggtgatcacagtcgtgttgaaaatatagcgactgaaacattgcatatgcaacatgttgatccagcgcaagaaaatattgtgataactcaataa

SEQ ID NO: 5407 - DNA, 1776 bp, Xenorhabdus bovienii
  Coding DNA location: Contig name=SeqID_16906; Position on contig =186062..187837bp; Strand=+
atgaaagctgcacgctctttaaagttgaaaaagcaagaagataaagccagttttgtaagctggcgctttgctttgctgtgtgggggcatttcgtttgctttgttcgggcttttgattcgtgttgcttacttgcagattatcaatcctgaccgtttgctaaaagaaggtgactcccgttccttacgcgtccagtccatcccgaccactcgtggtatgataaccgatcggaatgggcgccctttggctgtcagcgtaccggttgatgcagtttgggctgaccctaaagaagtctttgaaaaaggtggcataacggatgatacgcgctggcaagcgttggctgacacgctctccataccacttaatcaactgacccgtaaaattcaggattatccacaggggcgttttgtctatcttgcccgtcaggtcaatacctccattggtgattatgtcgaaaaattaagattgcctggcatctatttgcgccaagagtcccgccgttattatccggcagggcaggtgaccgcacacattattggcgtgaccaatattgacgacaaaggcattgagggagtggaaaagagcttcgacaactggctgacgggtaagccggggagccgaattgtccgcaaggatcgcaatggacgggtcattgaagatgtttcgttcactgacagtcaggctgctcacaatctggctctcagcattgatgagcgtctccagactttggtctaccgtgaactgaccaaggcagtgatacttaataaggctgaatctggtacggccatattgattgacgtaaaaaccggcgaagttctggcgatggcaaacaacccatcctataacccgaataatctggcaggaacgccgcaagatacgatgcgtaaccgtgccatcacggatatttttgaacccggttctaccgtaaaaccgctagtggtgatgagtgcgttgaatcttggcattgttaaagaaaattcggtgctggataccaaaccttatcgattgtcgtatggcgcacgttcgcatcaaatcaaagacgttgccccgcgtgctgaattaaccatcactgggattttacagaagtcgagtaacgtgggtgtttctaaactggcgttagcgatgcctgcctcggagctggtaaatgtttattcccgctttgggatgggaaaaccgaccaatttggggctggtcggagaaagtagtggcatatatccaaaaagagaacggtggtcagatcttgagagggccaccttttctttcggctacgggctgatggtaacaccgttacagttagcgcgagtctatgcaacgataggcagctttggtatctatcgcccgctgtcaattaccaaagtagaccctcctataccgggaacccgcgtgtttcctgaacccattatgcgtaccgttgttcacatgatggagagcgtggcactacccggcggcggcggggtgcgcgccgcgataaaaggttatcgtatcgcaatcaaaacgggaacagcgaaaaaggtggggccggatggaaaatacgttaataaatatatttcctataccgcagggattgcccctgcaagtaatccacggtttgcattggttgtgatcatcaatgatccacaagccggtaaatattatggcggtgcggtttcagcgcccatctttggcaccatcatgagtggtgttttacgtacgatgaacgttgaacccgatgcactgcctgcggatgataaaaaagaatttgtgattgataataaagaggataaaagtggcagatcgtaa

SEQ ID NO: 5408 - DNA, 1488 bp, Xenorhabdus bovienii
  Coding DNA location: Contig name=SeqID_16906; Position on contig =187824..189311bp; Strand=+
gtggcagatcgtaatttacgcgatttactggctccatggggtgttgatacaccggagcttccgctgcgcgaaatgacattagacagccgtaaggcggctgccggagatttgtttgttgcagttaaagggcaccagacagatggccgaaaatatattcctcaagccatcgctcaaggtgttgccgcggtgattgcagaagcgaagggaaaaacggataacggcaccattcaagcaatgcacggtgttccagttatttatctggatgatctcaataataaactgtcaaaattggcaggcgaattttaccagcatccgggtaataaactgaaactcgtcggagtcactggaaccaatggcaaaaccacgacgacacaattgctggcacaatggagtcagggtcttggggaaatcagtgccgtaatgggaacggtaggaaatggcctgctgggaatgatagttccaagtgaaaataccacgggttccgccgttgatatccagctcgatttacagcagctcgttaatcaaaaagccacttttgccgcgatggaagtttcttcacacggtctagtgcagggacgagtggcagccctgccatttcaagccgccgtttttaccaatttaagccgtgatcatcttgattatcatggtgatatggaaaattacgaagaggccaaatggttgttgttcagcagccatgatgtaaaacagaaaatcattaatgccgatgatgacgtggggcaaaaatggcttgcccgtttaccagaagcggtggccgtcacgatggaaaatcgcctgccggaaaattggtcagggcgctggttatccgccagtgacacccactatcacgacaaaggtgcatccattacgtttacctcctcttgggggcagggaactctccatagtcccctgatgggcgcgttcaatgtcagtaatctgctgctggcactcgctaccttactgtcactggaatatccactgcaaaaactattggaaaccgcttcctgtctggagcctgtctgtgggcgcatggaagtttttgctgcgcgaggtcgtccgacggtcgtggtggattatgcccatacacctgatgctctggaaaaagccctgtctgcggcacgattgcactgcaaaggccaactttggtgtgtattcggctgtggtggtgatcgcgataaaggtaagcgttcattgatgggcggtatcgccgagcagggagctgatcgggtggtagtgactgatgacaatccccgcagtgaagaaccccattctattgttgaagatattttgaccggtttcatcgatccgggtcgggcgatggcgattcacgggcgtgttgaggcggtgaccagtgccattatgcaggctgctgaagaggatgtcgtactggtggcgggtaaaggtcatgaagattatcaattagtaggcaaccgccgtttggattattcagatcgtctgactgttgcgcgtctgctgggggtaattgcatga

SEQ ID NO: 5409 - DNA, 1383 bp, Xenorhabdus bovienii
  Coding DNA location: Contig name=SeqID_16906; Position on contig =189308..190690bp; Strand=+
atgatcccgctgacactcaagcaattgacacagctgacaggcggcgtgctatatcacatttccgaacagcaggcggctacttgccaaatcaataccgtggaaactgatagccgaaaaatggtgcgtggagggctattcattgccttaaaaggggaaaagttcgacgctcatgatttcgtggcggatgtcgcgaaactgggagccggtgctttgttggtcaaccgccgccttgaaattgactgccctcaggtggtagtggaagacacccgtttggcgatgggcaaactggcggcttgggttcgccagcaaagtaaagcacggatagtggcactgactggttcatcgggcaaaacgtcggtcaaagagatgacggcggcgattctgcgtcaacgcggtcataccctttataccgcaggcaactttaataacgacattggcgtgccattgacactgttcaggctgactgaagaacatcaatttgccgtgattgagctaggtgccaatcacattggcgaaatcgcctataccgctgaaatgacccgtcctgaaagtgcgctggtgaataacctgtttgccgctcatctggaaggcttcggctctttggcgggggttgccaaggcaaaaggcgaaatttttgcggggctttcatcagcaggaaccgccatcatcaatctcgatagcaatgattgggcacattggcagcaggggatcagcgaaccgcagactgtatggcggtttgctgtttcacctgtgccagaagctgacttttacgccactgacattcaggagcaaccgctggcaacgagcttctgtctgcatacaccgattggaaatatcgaagtaacactgccactgccggggaaacacaatattgccaatgcattggccgccagtgcgctggtgatctctgtgggtgcttctctcagtgatattcgtgccggattattagaactgaaggctgtttcaggacgcttattcccgattcaacttgcagagggaaaaatcgtgctggacgacacgtataacgccaatatcggttccatgattgcggccgctgataccttgtcacagatgcccggttatcacgtgatggtcgtcggcgacatgggggaattgggagatcagactgttgagtgtcaccgtcaggttggtgaagccgtggcatcgacaaaaatagacaaaataatgagcgtcggtgagttcagttctcatatcagtgagacaagcggccgggggcagcatttcgcaaacaaggcggaattagttgcagcgctgtttcctttactggaacaacacgaaatgatttccatattaattaaaggttcacgcagtgccgcaatggaagaggtagtgaacatactgaaggggaacttccaatgttag

SEQ ID NO: 5410 - DNA, 1083 bp, Xenorhabdus bovienii
  Coding DNA location: Contig name=SeqID_16906; Position on contig =190684..191766bp; Strand=+
atgttagtttggttagctgattacttggttaaatatcacacagtctttcacgtcttctcctatctgacgttcagggccatcgtcggcttactgactgcattatttatcgcattgtgggtggggccaactttaatcggctatctgcaaaaattgcagattggtcaagttgtgcgtgacaacggcccagaatcccatttcagtaagcgcggtacaccgacaatgggtgggttgctgattctattctctatcaccatgtccatattactgtggacgcgtctggataacccttatgtctggtgtgtgctggccgttctgctgggttacggcgtggtgggatttgtcgatgattatcgcaaagttgtccgtaaagataccaaagggctgattgctcgctggaaatatttctggcagtcagtcatagcattgggtgtggcgtttgccatgtacagtatgggtaaagatactgccgcgacacaactgatcgtaccatttttcaaagaagttatgccacaactggggctgctttacatcctgctggcgtatttcgtgattgtgggaaccagtaatgccgttaatctgaccgatgggcttgatggtctggctatcatgccaactgtgtttgtcgcagcgggtttcgccatcgtggcatgggcgatgagtaacgtgaagtttgccctttatttgcacatccctcatttagtccatgcgagtgagctggtgattgtttgtaccgcgattgttggggctggattgggcttcctgtggttcaacacctatccggcgcaagttttcatgggtgatgtcggttcactggctttgggcggcgcgttgggaactattgcggttttgctgcgtcaggaattcctgctgatcatcatgggcggggtatttgtcgtagaaacactatccgtcattttgcaggtgggatcgttcaagcttcgggggcagcgtattttccgcatggctccgattcaccatcactatgaattgaaaggctggccggagccacgcgttattgtgcggttctggattatttccctggtgctggtactgattggtctggcaacgttgaaggtacgttaa

SEQ ID NO: 5411 - DNA, 1311 bp, Xenorhabdus bovienii
  Coding DNA location: Contig name=SeqID_16906; Position on contig =191769..193079bp; Strand=+
atggctgaatatttgggtaaaaaagtcgttattgttggattggggctgacgggtctctcctgcgttgactttttcatagcacatggtgtgactccgcgtgtgatggatacccgcctagtgccaccgggcagcgataagctgcctgatgacgttgagtgtcacacgggtagcctgaatacacaatggttgatggacgcagatttaatcgttgccagtccgggtattgcactggcaacacctgagttacaggcagcggccgacgccggcattgaaattgtcggtgatattgaattgttttgtcgtgaggcgacggcaccgattgtcgccattacgggttcaaatggtaaaagcaccgtcacgactcttgtcggggagatggcaaaagaagccggatggcaggttggtgtgggaggaaatattggtgttcctgcactggaactgctgaaacagccttgccagttgtatgtattggaactttccagctttcagcttgaaactacttatagtctgaaagctgccgcagcgactgttttgaatgtcactgaagaccatatggttcgttatccggacgggttgtcgcaatatcgtgcagcaaaactgcgtatctatgatcaggcaaaagtgtgcgtggtgaatgaacaggatgcattgacattgccggaagcaggtaaagatagccgctgtatcagttttggtgtggatagtggtgtttatcagcttgagagtggacgtcaacaactggtggttaaccatcaatctttattggaaacccgtcagattcggttgacagggcaacataactatatcaacggcttggcagcattggcgttggctgatgccgtaggtatccctcgcgaagccagtcttcaggcattgcagacttatccggggttggcacaccgttttcaagtcgtgcatatgagacatggcgttcgttgggtaaatgattccaaggcaacaaacgtcggcagtacccaggcagcactcagtggactgacattggaaggtacgctctatcttttactcggcggggatggaaaagccgctgactttactccactgcaaccttatgtatcgggaaataacattcgcctttattgttttggttgtgatggaaatcagctggcgcaattgcgtcctgaaatttccacgttgacagaaacgatggaacaggcaatgagagaaattgcaccgaagctgatgactggcgacatggtgctgctgtcacccgcttgtgcgagctttgaccagttcaatggttttgaacatcgcggccatgaatttgcccgtttggcagaggagttaggctaa

SEQ ID NO: 5412 - DNA, 1194 bp, Xenorhabdus bovienii
  Coding DNA location: Contig name=SeqID_16906; Position on contig =193079..194272bp; Strand=+
atgactattccaggcctcggtaaatttaaaaattggctgacggggaacgtggagaccgatgccacggatatcgtcatgtatgatcgtaccctggtctggatgatattgggattggctgtgataggttttgtgatggtgacatcggcctcaatgccagtgggtcagcgtctcgcacaagatccgtttatttttgcgcagcgtgatgcaatttacttggtgctggcgtttatattatcactcatcaccttgcgcatcccaatggagttttggcagcgttacagcaacattatattgctgggcacgatcatcatgcttgttgtggtgctgctggttggcagctctgtcaatggtgcatctcgctgggtggcgattggcccattgcgtattcagccagcggaattatcgaagttgtcacttttctgttacctatcgagctacctggtgagaaaagtagaggaagtgagaaacaacttttggggtttctgcaagcctatgggcgtaatgattgcgctggctattctgctattggcgcagcccgatttgggaaccgttattgttttgtttgtgacaacgctggcactgttgtttctggccggtgccaaattgtggcagttcctagccatcattggctgtggaatatttgccgtctgcgtgttgattgtcgctgaaccttatcgtatgcgtcgagtaacctctttccttaatccgtgggatgatcccttcggcagcggttaccagttaacacaatcgctgatggcatttggtcgtggggactttttcgggcagggattaggaaattcaatccagaaaatggaatacctgcccgaagcgcatactgactttattttctccattctggccgaagaattaggttatttgggtgtggttttagtgttgtcaatggtattcttcgtcgcctttcgcgcaatgatgattggtcgccgagcattacagcttaatcagcgctttgctggttttttggcttgtgcaatcggcatctggttcagctttcaggcattcatcaatgtcggtgcagcgtcaggtatgttgccaacgaaaggtttgacattacctcttgtgagttacggtggttcgagtttgatcgtgatgtcaacggctatcgtcttattattgcgaattgattatgaagtgcgtctggcaaaagcacaggcgtttgtaaggagccccaaatga

SEQ ID NO: 5413 - DNA, 1086 bp, Xenorhabdus bovienii
  Coding DNA location: Contig name=SeqID_16906; Position on contig =194269..195354bp; Strand=+
atgagcggcagaaaccggcgtttaatggtaatggcaggcggtacgggaggccatgtttttccgggactggcggttgcccaacatttaaaagaacaaggctgggaaattcgctggttgggaaccgctgatcgtatggaagcagatttggttcctaaacagggtattgatattgaatttatccaaatttcaggattgcgtggcaaaggaataaaagcactctttgcggctcctgtcagaatttttaaggcgatccggcaggcaaaaacgatcatgcgccgctatcagccggacgttgttctgggtatgggcggctatgtctcagggcctggcggaattgctgcatggctgtgtggcattccggttgttctgcatgaacagaatggtattgccggattgaccaaccgctggctggccaaaattgcgaaaacggtcttgcaggcatttcccggcgcattttctgatgcacctgttgtcggcaatcctgtgcgtgaagatgtactggcgctgccagtgcctgcacagcgtctggcaggaagagaaggatctatccgtgtactagtcgttggaggtagtcagggtgcaagaattctgaatcaaatcatgccagaagtggctgaccgtatgggtgatcacatcactgtatggcatcaggcaggaaaaggcgcgcaggaagaaacacacaaaaaatatgaaaattcagctaaatctgaattcaaagtgactgaatttattgatgatatggcgcaggtttatgcgtgggctgatatcgtggtgtgtcgttcgggtgcattgacggtcagcgaagtttctgcggcaggattacctgcgatctttgtgccatttcaacataaagatcgccagcaatattggaatgctttgccgctggaaaacgcgggggcggcaaaaatacttgaacagcctcaatttacggccgaggccgtagtggatctgctcacgcagtggcagcgtccacaattgctggaaatggcagaaaaggcgcgctccgttgccatcgtcaatgcaacggagcgtgtggcagcagcgttgatcgatgctgttaaaaatcattcaggccgttctaagtag

SEQ ID NO: 5414 - DNA, 1431 bp, Xenorhabdus bovienii
  Coding DNA location: Contig name=SeqID_16906; Position on contig =195436..196866bp; Strand=+
atgagaaaagtcaggcatatccactttgtcggcattggtggtgctggcatgggtggtatcgccgaggtgttggctaatgaaggttatcagataagtggttctgatttggcacccaatcccgtcacacaacagctgatcgcactgggtgcaaccatttatttcaatcaccgttcggaaaacgtacgagatgccagtgtggtcgttgcatccacggcaatctctgcggacaacccagaaattattgctgcccgtgaagcacgtattccggttattcgccgggcggaaatgctggcagagctgatgcgttatcggcatggcatcgccatcgcgggaacgcatggaaaaacgacgacgacagcgatgattgctggcatttatgctcaggctggccttgaccctacattcgtcaatggggggctggttaaggccgcaggcacacatgcccgtcttggaaccagccgttacctgattgctgaagcggatgaaagcgatgcttctttcctgcacttgcagcctatgatggcggttgtcaccaatattgaagctgaccacatggatacctatcagggggatttcgaaaatctgaaacagacattcgttaatttcttgcataacttgccgttttatggtcgtgccgtgatgtgcattgatgatcctgtcgtgaaagagttaattccccgtattgggcgttatatcacgacctatggtttcagcgaagaagcagacatccgcattacgcattacgagcagaagggagcgcagggttttttcaccatcagccgtgatgacttgccagaactgcatgttgtattgaatgcaccggggcgtcataacgcgctgaatgcgacggccgctgtcgctgtagcgacagaagaagggatcaatgatgctgctattctggcttcactggctgaatttcagggaacggggcgccgctttgattttctgggtgaattctccctcaaacatattaatggcaaagaaggtagcgtgatgctggtggatgattatggccatcatccaaccgaagtcgatgccacgattaaggctgcgagggcgggttggccagataagtgtattgtgatgctgttccagccgcaccgctatacgagaactcgtgatttatatgatgattttgccaatattctgagtcaggtggatgttctgttgatgctggatgtgtattcggcaggtgaaaccccaattccgggtgctgatagccgctctttgtgccgtaccattcgtagtcgtgggaaattggacccgatttttgtgtcagatccagagcaaatttcagccatgctgtcacaggtaatggaaaacaatgatttagtgttgattcagggtgccggtaatatcggtaaaatagcgcgcaatctggctgaaacaaaattacagccgtcttttaatgagggagagcatcatggttga

SEQ ID NO: 5415 - DNA, 921 bp, Xenorhabdus bovienii
  Coding DNA location: Contig name=SeqID_16906; Position on contig =196859..197779bp; Strand=+
atggttgagaaggtcgctgttctattgggcggaacatccgctgagcgggaagtttcactgcaatcaggacaatctgttgtggctgggctgaaagaagcaggcattaatgcgtattcagtcgatacaaaagactttgatgtgactaaactcaaaggagaagggttcagcaaagccttcatcgctctgcatgggcgtggtggtgaagatggtacgctgcaaggggtactggagtttttgcagatcccttataccggcagtggtgttatggcatcagctttgtcaatggacaaattgcgtacaaaacagttatggcagggagcaaagttgccggtttctccgtatgccgtaattaatgctcaaaaatttgaacaagttaatgattttcaactccaagaatatgttcgagaattagagcttccattaatggtgaagccgaatctggaaggctccagtgttggcatgactaaagtgaatgattattccgaactgcgcggggcattggaactggcgttccagtacgacacggatgtgctggttgaaaaatggttgtttggtcctgaatataccgtggcattcttgggcgatgagattttaccctctatccgtatccaagcgccggaagtgttttatgattacgatgcgaaatatctttccaatgaaacgaaatatttctgcccaagtggcttgagcgcggaaaaagaacaggaactggcagagattgcatcaagagcgtataaggcgctggggtgcagtggctggggtcgggttgatatcatggatgatggcaatggtaatttctatctgctggaagtgaatacatctccaggtatgaccagccatagtctagtaccgatggccgcacgtcagtccggactcagtttttcacaactcgtggtgaaaattctggagttggccgattga

SEQ ID NO: 5416 - DNA, 825 bp, Xenorhabdus bovienii
  Coding DNA location: Contig name=SeqID_16906; Position on contig =197781..198605bp; Strand=+
atgtcacaggcagcccggaatacccgggagcgagaaagtgaaacacaaagctcccgccccagtaatggctatcatctagcagggattgttttcttcctgatggtgattggcaccatcgtatggggaggctggatgacattggactggatgaaggattcaaacagattagcgctctcaaaactggtgttgactggtgaacgccattacaccacgaatgatgatgtcaggcgagcaataatggcatttggcgcgatcgggacatttatgacacaggatgtcaatattattcaggggcagatagaacggctaccgtggattcggcaagtcactgtgcgtaaacaatggcctgatgaactaaaaattcatctggtagaatacgtgccttatgtgcgttggaatgatacgcacatgctggatgtagaaggaaatgtatttagtttgccgatagagcgtagtgtcaaaaggcattacgccatgctttctggccctgaaggtaaagagaaagaggtattggcagaatataacaaagtagcgcccttgtttactgaacataaaatgaaattgaaaacggtgatcatgacggagcgtaatgcttggcaattaattctggataacgacattcggctggaactgggaaataaaaatgatgtgaagcggattaaacgttttattgaactttatcctgtgttgcagaaaaacacggagaaacgcgtggcttatgtagacttacgttatgacagcggcgctgcggtaggttgggctcctttattaattgatgcgccggtttcaatcaacgggcagaaaaataacagtgactggcaataa

SEQ ID NO: 5417 - DNA, 1257 bp, Xenorhabdus bovienii
  Coding DNA location: Contig name=SeqID_16906; Position on contig =198628..199884bp; Strand=+
atgatcaaatcaacggacagaaaattggtagttggccttgaaatcgggacagcaaaggtatctgccctggttggtgaaattctgcccgatggtatggttaatattatcggagtgggaagttgtccatcccgcggtatggataaaggtggtgtcaacgaccttgaatcggtcgttaaatgcgtacagcgtgcgattgatcaggctgaattaatggcggactgccagatatcttcagtttatctgggactttccggtaagcatatcagttgccagaacgaaattggcatggtgccgatttcggaagaagaagtgacacaggacgatgtggacagtgttgtccacacggccaaatcggttcgtgttcgtgatgaacaccgtattttgcatgtgatcccacaggaatacgctatcgattatcaggaagggatcaaaaatccggtcgggctttctggcgtgcgtatgcaggcaaaagtccacttgattacctgccataacgacatggcaaaaaatattgtaaaagctgttgaacgttgtggactgaaagttgatcaacttatttttgcgggtctggcggcaagttatgctgttctgaccgaggatgaacgtgaattgggcgtttgtgtcgttgatatcggcggcggcacaatggatatcgctgtatacactggcggcgcattgcgccataccaaggtgatcccttatgcaggaaatgtcgtcaccagtgatatcgcctatgcgtttggaacgcctccaagtgatgctgaaaccatcaaggttcggcacggttgcgcattgggttcgatagtcagcaaggatgaaagtgtagaggttccaagcgtgggaggacgtcctccccgtagcctgcaacgccagacgctggctgaggtgatcgaacctcgttataccgaactgctgaatttagtgaatgatgaaattctgcgattgcaggaacaattacgtcagcagggagtaaaacaccatctggcagcagggattgtcttgaccgggggaggagctcaaatagatggcgtggctgaatgtgctcagcgggtattccatacccaagtacgtattggccgtcccctgaacattactggtctgacggattatgtgcaggagccttgctactcaacggcagtcgggcttctgcattacggcaaagaatctcaccttggtggcgattctgatgccgataaaagaacgtcagtgagcggctggttcaaaaaagtcagcagctggctgagaaaagaattttga

SEQ ID NO: 5418 - DNA, 1164 bp, Xenorhabdus bovienii
  unsure (1)..(1164): unsure at all n locations
  Coding DNA location: Contig name=SeqID_16906; Position on contig =199951..201114bp; Strand=+
atgtttgaaccactggaattaaccaacgacgcggtgattaaagtcatcggcgtcggcggcggcggcggtaatgctgttgagcacatggtgcgtgaacgtattgaaggtgtagacttctttgcgattaacaccgatgctcaggcgctgcgcaaaacagctgtcggtcagactatccagattggcaacggcattacaaaaggattgggcgctggtgcaaaccctgaagtcggccgtactgcggcagaagaagatcgcgaagcattgcgtactgccctggaaggtgccgacatggtattcatcgctgccggcatgggcggtggtacgggaactggcgcagcccccgttgtggctgaaattgccaaagagcttggtattctgaccgttgctgtcgttaccaagccattcaatttcgaaggcaagaagcgaatggccttcgcggaacagggtatcactgaactgtccaaacatgtggactcactgatcactattccaaatgacaaattattgaaagtgctgggtcgcggcatttccctgctggatgcattcggtgcagccaatgacgtcctaaaaggggcggttcaaggtatcgctgaactgattactcgcccaggactgatgaacgttgacttcgctgacgttcgtaccgtgatgtctgaaatgggatacgctatgatgggatcaggtatttcacaaggtgaagaccgtgcagaagaagcggctgaaatggctatttccagcccgttactggaagatattgatctttctggtgcacgtggcgtgctggttaacattactgccggctttgatttgcgtctggatgagtttgaaacggtgggtaacacaattcgtgcatttgcctctgacaatgcgacggtggttatcggtacgtcactggatccagacatgaacgatgagctgcgtgtaacggttgtggcaacgggtattgggatggacaagcgtcctgaaattacgctagtgaccaacaacaaagtatctcagtcaaatacactggatcgccgttacccgcagatgtctggtggaatcccgtcattgtctgaagagaaaaaaaccgctgcaaaagtggtcaatgatcaaaatgcgcagacaagcaaagagcctgattatctagatattccagcgtttttgcgcaaacaggnnnnnnnn

SEQ ID NO: 5419 - DNA, 1143 bp, Xenorhabdus bovienii
  unsure (1)..(1143): unsure at all n locations
  Coding DNA location: Contig name=SeqID_16907; Position on contig =42..1184bp; Strand=-
atgattgatgctattttgcctaaatatgcagagcatacggtttctcatggcgaggctcttttagcgatgatcctcaatgggttgggtttccacagtcgaacgctccatatgtgccctgatttttttaagcacaaacccgttgaacgcctgattggggtgggaattatggctgaacacctcaatgatgatgtgctcggccgcacgctggacgctttgtttgactgcggtgtctctgaaatttatcaggttatcgctgagcgggttattgataaattggcattaaaatccgattccgttcaccttgatatcacgagttttcacgtggatggtgagtacaaactccccgatgatgacgagacaaaacgcctcgttttggtgcgtggttacagtcgtgatcaccgtcctgacctgaatcaggttgtgctgcaacttatctgtgaaaatcaggcggggatccccgtatacatgcaggcgatgagcggaaacaccaacgacaccaaagcgtttgcagagacgacgaaacatcacattggctgcctgaaagcggcccaaaacagccgttatctgattgccgatgccgcgctttatacccaagagacactggcctcacttcatcaacaaaatcaaaaatttattacccgggttccgttaaccattaaagaggcgaaacagcacctgctgacggttaataccgaccagttacaaccggttacagaaggttatgccggtcattggattgaatcttgctacgggggcgttccacagcgctggttactggtcaacagtgaagcggcgatgcagtgtgaacatcagactttcaggaaaaatacgcggatttcgacggaaaaagaactgaaacagttcgaaaaactcagcaagaagtcgtttccctgtgatgaagatgctttgcaggcattgtgtgacttcgaagcagaatgccagtttatcggcattgaggccccaaagttcaaaaaatcgaggtgcataaggggcgaggncgccccggctaaaggtcacatcccgatagtggtcattatcagctttctgccctcgtctacagccaactggnngaaagtggcnntatgtccgctcaaagtcggcatggtcattctggcgacgaatgaaatggacgataggcgctga

SEQ ID NO: 5420 - DNA, 1500 bp, Xenorhabdus bovienii
  unsure (1)..(1500): unsure at all n locations
  Coding DNA location: Contig name=SeqID_16908; Position on contig =17..1516bp; Strand=-
atgcctgtaattactcttcctgacggtagtcaacgtcaatttgagcatgccgtttctgtaatggatgtggctcgcgatatcggtgcgggcttggcaaaagcgtgtattgctggccgtgttaatggcgaattggtggatgcatgtgaattaattgaaaccgatgctaaccttgcaattattaccagcaaggatgaaaacggtctggaaattattcgccactcatgtgcacatttattaggtcatgcagtcaagcagctatggcctgatacgaaaatggcaatcggtcctgtgattgacaatggtttctactacgatgttgatttagatcgctctttgacgcaggaagatatcgagctgcttgaaaaacgcatgctggagcttgccaagacagattatgacgtcatcaagaaaaaagtcagttggcaggaagcgcgtgatgcattcgcagctcgtggcgaagaatacaagatccagattctggatgagaatattagccgtgatgaccatccgggtctatattaccatgaagaatatatggatatgtgccgtgggccacacgtccctaatatgcgtttttgccatcacttcaaattgcagaaaatagcgggcgcatactggcgtggcaatagcgacaacaaaatgttgcagcgtatttacggtactgcatgggcagacaaaaaacaactcaatgcctacttgcaacgcttagaagaagcttcaaaacgtgatcaccgtaaaatcggcaaacagctcgatctgtaccacatgcaggaagaggcgccgggcatggcattctggcataatgatggttggacaattttccgtgaactggaaacatttgcccgcgtcaagctgaaagagtaccattatcaggaagtgaaaggcccattcatgatggatcgtatcctgtgggaaaaaacaggtcactgggaaaactacaaagaacatatgttcaccacatcatcggaaaaccgtgaatactgcgtgaagccgatgaactgcccaggacatgtccagattttcaatcagggtctgaaatcttatcgtgacctgccgttgcgtatggctgaatttggtagctgtcatcgtaatgaaccgtcaggggcattgcatggattgatgcgtgtacgcggctttactcaggatgatgcacatatcttctgtactgaagaccaaattcatcaagaagtcagcagctgcatcaaaatgatttatgacgtgtataatacgtttggtttcgagaagattgttgtcaaattatcgactcgtccagaaaaacgtattggcactgacaaacagtgggatgaagcggaagctgatcttgctgaagcactgaaacaaagcggtattgaatttgaatatcagccgggtgaaggtgctttttatggccctaagatcgaatttactctatatgattgtttggatcgtgcgtggcaatgtggtactgtgcagctcgatttttcattgccagcgcgtttgaatgcgtcatnnnnnnnnnnn

SEQ ID NO: 5421 - DNA, 108 bp, Xenorhabdus bovienii
  Coding DNA location: Contig name=SeqID_16908; Position on contig =1469..1576bp; Strand=+
atgctcaaattgacgttgactaccgtcaggaagagtaattacaggcatttaaaatccttatctacagtggtgacccacacgaaagatcacttgtatgaaatattttaa

SEQ ID NO: 5422 - DNA, 132 bp, Xenorhabdus bovienii
  Coding DNA location: Contig name=SeqID_16908; Position on contig =1726..1857bp; Strand=+
gtgatattcagccatcttgaactacctaaaatatctaataattattacggtagaaaattaagtaaaatgctgttgaaatatacgccatctggattcaacctgatatctaatacacaacgttttctcttataa

SEQ ID NO: 5423 - DNA, 144 bp, Xenorhabdus bovienii
  Coding DNA location: Contig name=SeqID_16908; Position on contig =1852..1995bp; Strand=-
ttgtatgttttcactcaatcatttgcgcagggaaattcccaagatttagttaatgaaaaagatcacgatatagaacgtggaatgtatggtaagaaaagtttaaaaaatcatccaatatcaatgcagatatcatcagacttataa

SEQ ID NO: 5424 - DNA, 684 bp, Xenorhabdus bovienii
  Coding DNA location: Contig name=SeqID_16908; Position on contig =2032..2715bp; Strand=-
gtgaaattaagactcggctatattgtgctggcaatgctattgacaggatgtgcagaccaagaaattcatcagtcaggagttggtaagcaactaacagcaaaacgcctgctcggtaacaataacgttgtttctagtccccgtaaatttatggctagatctgaatcaacaccatttgatcgttttattgagcaggctgcaaggcgttatggtgttgatgaaacgcttattaaagcgattattcgggtggaatctggttttcgtccagaagtcgtcagtaaatccaatgctgttggtctaatgcaaatcaaggcatctacagcagggcgagatgcttatcgaataaaaggaaaatcggggcagccaactatgcgtgagttgaaagatccagaaaccaacattgatcttggaaccgcctacattagcatcctgaaaaagcagcatctggaaggtatcactaatcctgaaacgatgtactatgcgatgatagtcgcttatgttaatggtgcaggagcactattgcgtacatttgattcaaacagaactttggcaatcaataaaattaatcgaatgacgccaaatgagttttatcaatatgttcagaataatcatcccgcaccacaggctcctcgttatttatggaaagtaaaaaatgcctaccgcgatttggatatcattgataattga

SEQ ID NO: 5425 - DNA, 147 bp, Xenorhabdus bovienii
  Coding DNA location: Contig name=SeqID_16908; Position on contig =2712..2858bp; Strand=-
gtgaacaaaaaattagcctattgtctaggcttacgtaatataaatggctcaatttattttgataagttgtataaaagtattttgggcttattagtaaagttatatatgatttataaagttaattttggtttggggaagacagcgtga

SEQ ID NO: 5426 - DNA, 135 bp, Xenorhabdus bovienii
  Coding DNA location: Contig name=SeqID_16908; Position on contig =2895..3029bp; Strand=-
ttgaacgccttttgttcattttggcaaaccttacttgttatacatgtaattattgataatgattatcaatatcatttatttaaagtcaaggcgatattacacaaaattaatgatagtttgatagacattccttaa

SEQ ID NO: 5427 - DNA, 915 bp, Xenorhabdus bovienii
  Coding DNA location: Contig name=SeqID_16908; Position on contig =3011..3925bp; Strand=+
atgaacaaaaggcgttcaatttctgctttcccgatattcagtatgattatcgcattattcacgctcactctattcagccagcaagcctatgcagataaaaaattcagggttgtaactacctttaccattattcaggatatggcccaaaatatcgcaggtgatgcagccatcgttgaatccatcacaaaaccaggtgcagagattcacgattaccagcctacgccaaaagacatcattaaagcacagcgtgcagatcttatcctctggaatggcttgaatcttgaacgctggtttgaacgtttctttgaaaacatgaaagacatccctacggctgtcattactgagggtataatcccgctgccgattcgtgaaggaccttacaataaaaatcccaatcctcatgcttggatgtctcccaaaaacgccctcatttatattgaaaatatccgcaagtctttcgttaaatatgatcctgcgaatgcagaagtttataatcgcaatgcgaaaatttacgcagaaaaaatggccaaactggatgcaccactcagggaacgcctttcccgtattccagaaaatcaacgctggctggtaaccagtgaaggggctttcagctatctcacacaagattatggtttcaaggaagtgtacttatggccaatcaatgctgaagaacaaggttctccgcaacaggttcgccgtgttattgataccataaggacacaaaaaatccctgtagtcttcagtgaaagtaccgtttcggataaaccagcaaaacaagtcagcaaagaaaccggggctcactacggtggaatcctatatgtcgattctctttctaccccaaaaggtccagtgcctacttatattgacctgctgaacaccactgtggacaccatcgcgaaaggatttaatcaatga

SEQ ID NO: 5428 - DNA, 912 bp, Xenorhabdus bovienii
  Coding DNA location: Contig name=SeqID_16908; Position on contig =3922..4833bp; Strand=+
atgagtcattcatcgttaaaccatcaatcattatttgagcatccccatttaattgttgatgatgctaccgtcacttacaacaatgggcacaccgccatatatgacgccagtttcgatattaccggcggcacaatttgtgcgctggtaggtatgaatggcagcggaaaatccacattattcaaaacaatcatgggattagttactccctcccacggaaaagtcaccctcaatgcacaaaccatcaagactgcgttaaaacaaaatatcattgcatatgttccacagactgaggatgtagactggaattttccagttttagtttccgatgttgtgatgatgggccgctatggaaaaatgggatttttgcgcagacccagtaaacgtgaccatcaaatcgtggataaagcgcttgaacgcgtcgggctgaatgaactgcgaaatcgacaaatcggtgagctttccggtgggcagaaaaaacggacatttttagcacgtgcactagcacaggaaggaaaagtgctactgttagatgagccttttactggtgtagacgttaaaacagaaaatgccattgtcgatttactccgtgacttacgtgatgaagggcatctagttttggtatcaacgcataacctcggcagtgtgcctgaattttgtgaccatgttatcttgatcaatcgcactgttctggctagtggcccaactgaaaccactttcacccaaaaaaatctggagacaacattcggtggtgtcttacgccatatcaacctttctggctcagagcttcatgatgatgatgatccgcgctcactgactgtcattaccgatgatgaacgggctgctgtcttctatggctatgaccgtcatgtcccaccacgacaaagccaaaagcagaaggaaaaccagccatga

SEQ ID NO: 5429 - DNA, 876 bp, Xenorhabdus bovienii
  Coding DNA location: Contig name=SeqID_16908; Position on contig =4830..5705bp; Strand=+
atgatggagttgctgatacaaccattcaattacaactatatggtgaaagccatgtgggtaagtgccatcgtaggtgcagtctgtgcttttttatctgcctatctgatgctgaaaggttggtcgctgatgggagacgccctttcccattctgttgtaccgggcgtagcaggcgcatatgctctcggtttgccttatgcaggtggagccttttttactggtatgctcgcggcattatcaatgactctggttcgtcatatcacgcggttacgtgaagatgcggtgatcggttttatattctccacttttttcgctgtcgggttattaattgtttccttaaaccccacttccgttaatgtgcaaaccattattctcggcaatatcttaggcatttctgatgaagatgttttgcaagtcgaaatcattattgctgtctcctttattatcttaatgctgatctggaaagatcttttagttgttttcttcgatgaaacccatgcacgttctatcggtttatcacctctgcggttaaaaatcattttcttcaccttactcagtgcctgtactgttgccgcattgcaaacagtcggcgccattctggtcatcgcaatggtagttactcctggtgccacagcctatttattgacagatcggtttaagcacctgcttatcattgctgtcaccatcggatcattaacgagtgctatcggtgcttacttgagttacttcctcaatggtgcaacagggggagtgattgtcacgctacaaactgtgattttcctactggctttcttctttgcccccaaacatggcatgttagcgtcccgcagacgagcgaaaaaagaatctttagcattaactcaaggaggacgctcatga

SEQ ID NO: 5430 - DNA, 876 bp, Xenorhabdus bovienii
  Coding DNA location: Contig name=SeqID_16908; Position on contig =5702..6577bp; Strand=+
atgagtacattgattgaattcattactgaacccttcatgcatgattttatgcagagagctattttcgcttctgtcatggtgggggcagtctgcgcggtactttcctgctatctagtattaaagggttggtcactgatgggggatgccatttcccatgcggtcttacctggtatcgtattagcatttgtcgctggaataccactcgcaataggtgcttttctttcagggatattttgcgcattcgctaccggatatctgaaagaacacagtcgaatcaaagaggatacagtcatgggtattgtattctccggcatgtttgcattgggtttagtcctgtttactcgcatagataccgatcagcatctgacgcatattctatttggtagcatacttggcattacccagcatgaattgatccagacactatgtattgctagcgtaacactggcaattgtgttgctgaaacgcaaagattttatgctctactgtttcgatcccaatcaggcacgcgttgtcggtctccccgtgaaacttatccattatggcttattgtccctgctggccttaactattgtcgcatcgctgcaagccgttggcattattctggttattgccatgctgatatctcccggcattattgcatttatgctctgccggagttttgatcgcatgcttattgttgcaatgattgcttctgtgtcatccagtgtgctcggtacaataatcagctttcacatcgatggtgaaacagggccttgtatcgtcattattcaagctattttcttcataacagcacttatttatgaccaaataaaattagctagaaagaaaatgagcaagaagcgtaccaaagatatcccatctccatcatcataa

SEQ ID NO: 5431 - DNA, 129 bp, Xenorhabdus bovienii
  Coding DNA location: Contig name=SeqID_16908; Position on contig =6656..6784bp; Strand=-
atgtcagcgccaccaaaatgctcacttaatagacggttcactgcttgccacatgattcacctcattaagttgacaattgctatgctcatattacagacagatgcaacaattgaacaggttaaaaagtga

SEQ ID NO: 5432 - DNA, 864 bp, Xenorhabdus bovienii
  Coding DNA location: Contig name=SeqID_16908; Position on contig =6732..7595bp; Strand=+
atgtggcaagcagtgaaccgtctattaagtgagcattttggtggcgctgacattcacaataaaacagaattagcgggaggggatattcaccgttcttggtgcgttgagtacggcgaacagcatatttttatcaaatccaacttgaaagaaatgttgcctgtttttaaaacagaagcagaacaactggaattgctggcccacagcaaaactatccatgtccctcaagtttacggcgttgggtacgatcgcgaccacagttttcttttgctggagtatttacctataaagccatttaatgcctatagtgcatactactttggtcaacaactcgcgaaactgcaccaatggagtgaacaacctaaatttggttttgattttgataacatgctcgcgaccaccatacagcctaatggatggcaaaagcgctggaatcaattttacgcagaaaaacggattggctggcaattacaactcgcggcagataggggaatggtgtttggcaacatcgagcttattgtccaaataatcagtgacaagctacaatctcaccaacctcagccttctctcctgcatggcgatttatggccaacaaattgtgcatcattaaatagcaactctgccgcagcatttgatcccgcctgctattggggagatcgtgaatgtgaccttgccatgctgcccctttatccagagctacccctacaaatttttgatggttaccaaagtatttggccattgccacaaggttttattgagcgacaacctctttatcaactttactacttactgaatcgctgtaacctttttggaggggaaaacttcatcatagtgcaaaatatgatcgataatatattatctgaatag

SEQ ID NO: 5433 - DNA, 93 bp, Xenorhabdus bovienii
  Coding DNA location: Contig name=SeqID_16908; Position on contig =7653..7745bp; Strand=-
atgtatttagtgtgtcgtgaattttgttttatcgtcattgttaatttgcttaatataaagataattaactccgatttttggcaatggtgttag

SEQ ID NO: 5434 - DNA, 129 bp, Xenorhabdus bovienii
  Coding DNA location: Contig name=SeqID_16908; Position on contig =7853..7981bp; Strand=+
atgccgattaaactactgaatatcttaataagctgcgaagagaagataaatgcttccgcagctgttatttttattttttacattaccaacccaatagttttgagaaaaaataagcaatcgcaccaataa

SEQ ID NO: 5435 - DNA, 540 bp, Xenorhabdus bovienii
  Coding DNA location: Contig name=SeqID_16908; Position on contig =7935..8474bp; Strand=-
atgacgtatcaacaagctggatatattgctattgcgaaacggatcttgggctgggttatttttgtacccgcttttttgtcaacttttgtctcagtgatcaatctggcatggcaacatggtgtgaaaggaagtggaatttatgcagtattgaatgattttttaagaatgatgacagagatgatcaaattcaatacatcatttttggattttttctggaagcattcaccaatacctgatcgtatggtgatgattacaggtacaaatgttagtttccttgtgatctattttcttatgttcgttgggttggcaatgagtgcatcaggcttaagaatgtatcgccaatttaaattcatcaaggaacatatcgaagatcaaatgatccttgaaaatgctaaggaaagcggaataaccaaggagcagttggaagctaagattaaatttcctcctcattcgttattcagtcaaatttttatcctttatatatcaccaataattattggtgcgattgcttattttttctcaaaactattgggttggtaa

SEQ ID NO: 5436 - DNA, 114 bp, Xenorhabdus bovienii
  Coding DNA location: Contig name=SeqID_16908; Position on contig =8914..9027bp; Strand=+
atgatcgctacgactttgcactaccgacgaaattcgtcgccagccatttcagttgcatacggaaagatccctcatgtacaaaaacatcaactgcaaaaaacttttcagttgtga

SEQ ID NO: 5437 - DNA, 147 bp, Xenorhabdus bovienii
  Coding DNA location: Contig name=SeqID_16908; Position on contig =9024..9170bp; Strand=+
gtgaaaatctcacatgagcaaaaggtgttgaggaaatctcaatacctacaaaagcaaaaggtatggtggaaatcaccatacccaaggtgtgatattacaccttgcggcaaccgtggtgatttccaccctagttgcttaactcattga

SEQ ID NO: 5438 - DNA, 168 bp, Xenorhabdus bovienii
  Coding DNA location: Contig name=SeqID_16908; Position on contig =9190..9357bp; Strand=+
ttgaccacccgagacatctcttccgtaaattcgtctttatttcaactgttgggaaatcccaatggttactttatgtgctggacaaaaggaataaatgcattgtatttcaatgtgttaattgtgcgcaaggggctgggcaagcagacgccaaatctgtcgtctgattaa

SEQ ID NO: 5439 - DNA, 294 bp, Xenorhabdus bovienii
  Coding DNA location: Contig name=SeqID_16908; Position on contig =9296..9589bp; Strand=-
atggtgccggcacgcttccgtttcaaacggagatgtgaaattaactacaaggattccttgagcttaaggaatcatcaatctcagaggctcaactacgaaaatttcgtagtttatattttcgccaataaggagtcctcgtctcaatcggacaaatttttggctgatcgcgccaattgggatttgaaagcccatttaagtgggaatgcccatttaagtgataactcattgatatttaatcagacgacagatttggcgtctgcttgcccagccccttgcgcacaattaacacattga

SEQ ID NO: 5440 - DNA, 843 bp, Xenorhabdus bovienii
  Coding DNA location: Contig name=SeqID_16908; Position on contig =9897..10739bp; Strand=+
atgagtattcaaaataataatcctgatacaccatgcccttgtgactgtgatcttttcgtggtacccagtcgtaattatgtaaaagaatctattgaagaacatgcccaaagccgcaatcaccccaatgcaacattgcaagataaaggatttgtgaccctgagtaatgatgctgacagtaataacgaaactagtgcagcaacaccaaaagcggtgaaaacagcgcatgacttagcaaacttagcaaatcaaaatgctaataatgcaaatataaatgctaataatcgcttagctaaagatcagaacggcgcggacattcctgacaagaaagcattcattaaaaacctcggtttagtgagcaattcaactttacctgtcggagtccccgttccttggccagcagaaaccccaccagaaggctggttgatatgtaacggtgactcatttgataaagcaacatatccgaaactggctcttgcctatccctctggaaacctacctgatttgagaggggaatttattcgcggttgggataatgggcgaggagcggacgttggtcgatctctactttctaatcaagtggcagatattgctccacatagtcacaggattggccgcatgtggtccagctcaaacggtggagtcgagggtttgggtacagggaaccgcattttcaatagtgtccaccaagacattaactacggaattgatcctcgcggactaggcattgctataggaatgggatctggtggtgtcggttatatggataatgcggttgctgcttcaacgggaacagaaacacgtccccgcaacgtagcatttaactacatagtgaaagcagattaa

SEQ ID NO: 5441 - DNA, 171 bp, Xenorhabdus bovienii
  Coding DNA location: Contig name=SeqID_16908; Position on contig =10736..10906bp; Strand=-
gtgggcgggtgttggggggcttggtgtgaggctggggatggtagaagaatgaagccagtcttaacccgcggaaagttgcgggttaaggattattcgtccgaccattccatcgctgggattagaatattttctaggtatagcgcggtcttccttacctgtggaatcaattaa

SEQ ID NO: 5442 - DNA, 435 bp, Xenorhabdus bovienii
  Coding DNA location: Contig name=SeqID_16908; Position on contig =10991..11425bp; Strand=-
atgaattattactattatagcccctcgcaaaatgcattctatccgtatgccatgaaacgggattatgtcaatgccggttcatggcccgatgctggaatcgatgtagaggaggctgtttttgaaaaatacacggcaacgccgccaatgggtaaaatgcgcgtcgccggcgctgatggtttgcccgcgtggggagatattccgccagcaccgcccccaacacccgaggagcgacagcaacaggcagaatcccaaaaatggagtctgatacagccgatccgagggaaaattgaacctttgcaggatgcggtctatctggatattgcaaccgaagaagaaaaaatcgcgttgactgaatggcatcgctaccgactggcactttatcgggtggattgcactaccgcacccgatgtcaaatggccggagcagccgaagtga

SEQ ID NO: 5443 - DNA, 894 bp, Xenorhabdus bovienii
  Coding DNA location: Contig name=SeqID_16908; Position on contig =11436..12329bp; Strand=-
atgatctactcagacggcacaacgaatctcgtgtcaggctcggctattgtccggggaacgggcacccaatggaaaagtaatattaacggcattgcagccggccagattatctccattcaatccggcaatacggtgattcagaatgttatccagtcggtgaattcagacacggaactggtactggcctttgcgccctcagtcagtcttaacaatgcgaaatatgttatttcaaccaccgttcccgataccgtttccgatggtgtccggcatatgtgtgccattaacgccgctatcatcctgttcctgcaaaacatggcccgatggatgagtgaaaacggcaaggttgaagtggagatgccgaacggccagaaagtcacgctggactccatccgggcattgcaggcagctataaacgggaaacaagacaggggtgattatgctactaattcggcgcttaacactgtcaacgacaacgccaacatccgcctggagaaaaaccagaacggagcagacattccgaacaagccggagtttgtgaacaatctgggtttatccgaattagtttaccgaaccatcggcaacgggcctaatcaaatccccgacatgtcgtttttctccgctgggggcggacacatgaaattccccaacggtaaaatgattcagtacggctatgcgcaatcagatccgagtgaacctaaaataataaattttccaacgccattcccaaaacagtgctacggcgttactagctctggaaccgatcctgacgctgctaacataagcggctgtggcgttattgatagatttggattttatttatcggcctggcatgttggctcaaaaactaccaacagaactgcaacacatatcagctggattgctgtaggaatatag

SEQ ID NO: 5444 - DNA, 1071 bp, Xenorhabdus bovienii
  Coding DNA location: Contig name=SeqID_16908; Position on contig =12401..13471bp; Strand=-
atggactttaactccgaagccatcatggagatcgccgcggtggaaggagcaattgttcagcgacagttgaaagtgaatggtgagcttaaggccgagatactgcacgttcagaccacgcaggttacggacaggcaagcctttgccgaggacatgaagaaggtacaggccgaagtgggggagaatgcggcagcggtgcagacgaaggccacggcggtctttgatattaagggagatgggtatgctctctatgacgtgggtgtcggattaaagtacaaagaccagttccataaagccgggatggtgatggggtctgaggtgaagaacggacaggtcactacctccatcggatttagtgccaataacttcggctggtttaatccggccagcggcaaaatggagccgtttatgatggcgaaaaatggacagttatttaccagagaagaatttatagaagatggcagtattaccaatgccaaaattggcaattacatccaatccagaaattatattactggccgggcgggatggaaaattgataaagggggtggggcagaattcaaccatgttactgttcgtggggagatacatgcaaccagcgggacgttttcagggacaatcaatggcgctgatggccgtttttccggcgcggtatatgcgaccaaaattgtaggtgacgtggtgtctgtcacattggggaatgtatcattaggcaaccgtgagagcattttctttcataaaaggctaacggaatctatgccgtttgatcgggtttttatttatggaccgataatgactcaacgttacgtcggatctttgggtggttcgggggaagcctcagtttctatatatgttaataatgcgcatgtggctggacagtattttagcatggagtcttttgatcgcggcccgcagtgtatttccggcacgttgtttacaccccctataaccatccccgccaatacaacaccgaccattaaagttgttctcacaacccacggcgcgggcattacataccctacttccggtattggtatgctgtttaaggtcagtagtcagtggtctgacatgtag

SEQ ID NO: 5445 - DNA, 279 bp, Xenorhabdus bovienii
  Coding DNA location: Contig name=SeqID_16908; Position on contig =13337..13615bp; Strand=+
ttgcctgtccgtaacctgcgtggtctgaacgtgcagtatctcggccttaagctcaccattcactttcaactgtcgctgaacaattgctccttccaccgcggcgatctccatgatggcttcggagttaaagtccatctgagactgcaaacgctggccggctttgttggaaagaaattcctcaccggccgcatcaatgatccagttcgtatccgaagaagactccccacgaatgaacgccgggggctttcaccgccgcccttgttgccccgaattaattga

SEQ ID NO: 5446 - DNA, 576 bp, Xenorhabdus bovienii
  Coding DNA location: Contig name=SeqID_16908; Position on contig =13676..14251bp; Strand=-
atgaatacgttacgcacaatacggttgtccggcgtgctgataccccaattcgggcggcagtataagctggcagtctcatcccccatagaggctatcagggcgctgtctgtccttattgacggctttgaaaagttcctgttaaccgcgaaagagcgcgggctgacttttgccgtattcatcggaaaacgcaatatcaaccgtgacgaactggaattatccggtgaaggcgacattcggattgtaccggtgatcattggtagcaaaaaagcaggcatcttccagactattctcggcgcggtgatggtagtggccggggcgtttttgtgggcaaccccgtatggcgttccattggtgatgtccggtgcttctatgatgctggggggcgtggtgcagatgctgtcaccgatgccgggtgggctggcacgacgggaagatcccgacaataaacccagctatgcgtttggggggccagtcaactccatcgcgcaggggaatccggttccgattggatacggcaagcgtcgtatcgggggtgccattatctcggcgggtatctatgccgaagatcagcaataa

SEQ ID NO: 5447 - DNA, 141 bp, Xenorhabdus bovienii
  Coding DNA location: Contig name=SeqID_16908; Position on contig =14248..14388bp; Strand=-
atgacatatttcacgtacaggcatagcagtgaccttattgacttggtggaacaatcagtagatcacacaacgctatgcctgtctattttctggggattcctcagccctaacgggggttttttttatggagtaaattcatga

SEQ ID NO: 5448 - DNA, 339 bp, Xenorhabdus bovienii; identical to SEQ ID NO: 2540
  Coding DNA location: Contig name=SeqID_16908; Position on contig =14365..14703bp; Strand=+

SEQ ID NO: 5449 - DNA, 216 bp, Xenorhabdus bovienii; identical to SEQ ID NO: 2539
  Coding DNA location: Contig name=SeqID_16908; Position on contig =14728..14943bp; Strand=+

SEQ ID NO: 5450 - DNA, 201 bp, Xenorhabdus bovienii; identical to SEQ ID NO: 2903
  Coding DNA location: Contig name=SeqID_16908; Position on contig =15005..15205bp; Strand=+

SEQ ID NO: 5451 - DNA, 453 bp, Xenorhabdus bovienii; identical to SEQ ID NO: 2538
  Coding DNA location: Contig name=SeqID_16908; Position on contig =15106..15558bp; Strand=+

SEQ ID NO: 5452 - DNA, 132 bp, Xenorhabdus bovienii
  Coding DNA location: Contig name=SeqID_16908; Position on contig =15617..15748bp; Strand=-
atgaatagttctataaaatccggtgttcgtcctgatgccttaaaatcaggtgttcgccccgatgccttgaaaacaggtgttcgtccagacgctctaaaaacaggtgttcgtcctgatgctattattgactaa

SEQ ID NO: 5453 - DNA, 123 bp, Xenorhabdus bovienii
  Coding DNA location: Contig name=SeqID_16908; Position on contig =16272..16394bp; Strand=-
atgaaagagacaatttcatttccattcattggcttaaaaaacttgaatacccgattccatcggataataaactaccataccagctttaatactttaactatcctaaatattaactttccatga

SEQ ID NO: 5454 - DNA, 150 bp, Xenorhabdus bovienii
  Coding DNA location: Contig name=SeqID_16908; Position on contig =16366..16515bp; Strand=+
atgaatggaaatgaaattgtctctttcatatatcaccattgtcagtgggggcagtttttagagcgcttattaagaaccactttcaatgatatgaataaattatatattgatatgaaaatcattactccggtaacatctttcctaatttag

SEQ ID NO: 5455 - DNA, 831 bp, Xenorhabdus bovienii
  Coding DNA location: Contig name=SeqID_16908; Position on contig =16553..17383bp; Strand=+
atggttgttacaaacgatgagattcaacaccatgatattcagacccgttatgccaatatttcagttctcgataccggtggaaacgggctgccagtgctcctgatacatggtaattcaagctgcaaagaaatctttcgtcatcaaattgagtatttaaaaggggactatcgggttctggcattggatttacccggccacggtaaatcttctaacgccagcgatccacgtgaagcatactcaatgtccggttatgcccgcaccatcattgaagtgctggaaaagatgggcattgataaagtcgtggtctttggctggtcactaggggggcatattgggttagaaatgctggcattgaaccctaaaatgatcgggttgatgatttgtggcacgccgccagtggccgcagggagagagaatgtagcccgtggttttcgtcaaagtgaactgaggcttaccggtaaagcggaatttactgacgaggatgtcaaaaactttgcccgtgagacaaacggagtgaatgcacctcatgaaccgtttatgatagaagccgtggcaagaacagacgggttagctcggcagtatatgtttgaagcttctgtttcccctcaggcgacagatcagaaattattggctgaaaccagtgaagttcctttggctattgtcaatggtgctggggatcctttcatcaatcacgattatattaatggattaaattataaaaacctttggaaaggccaagtgtttaatctggccggcgtcgatcatgcgccattctgggaggctccaaatatttttaacccgattttagctgagtttctaaaaggtttttaa

SEQ ID NO: 5456 - DNA, 102 bp, Xenorhabdus bovienii; identical to SEQ ID NO: 2214
  Coding DNA location: Contig name=SeqID_16908; Position on contig =17572..17673bp; Strand=-

SEQ ID NO: 5457 - DNA, 1407 bp, Xenorhabdus bovienii
  Coding DNA location: Contig name=SeqID_16908; Position on contig =17635..19041bp; Strand=+
atgtctctctctgaacctgccatcaaacgtctcgatcacctcggccttgtcgccgctttttgccatgagatcggtttaccccgcatgattgatgctattttgcctaaatatgcagagcatacggtttctcatggcgaggctcttttagcgatgatcctcaatgggttgggtttccacagtcgaacgctccatatgtgccctgatttttttaagcacaaacccgttgaacgcctgattggggtgggaattatggctgaacacctcaatgatgatgtgctcggccgcacgctggacgccttgtttgactgcggtgtctctgaaatttatcaggttatcgctgagcgggttattgataaattggcattaaaatccgattccgttcaccttgatatcacgagttttcacgtggatggtgagtacaaactccccgatgatgacgagacaaaacgcctcgttttggtgcgtggttacagtcgtgatcaccgtcctgacctgaatcaggttgtgctgcaacttatctgtgaaaatcaggcggggatccccgtatacatgcaggcgatgagcggaaacaccaacgacaccaaagcgtttgcagagacgacgaaacatcacattggctgcctgaaagcggcccaaaacagccgttatctgattgccgatgccgcgctttatacccaagagacactggcctcacttcatcaacaaaatcaaaaatttattacccgggttccgttaaccattaaagaggcgaaacagcacctgctgacggttaataccgaccagttacaaccggttacagaaggttatgccggtcattggattgaatcttgctacgggggcgttccacagcgctggttactggtcaacagtgaagcggcgatgcagtgtgaacatcagactttcaggaaaaatacgcggatttcgacggaaaaagaactgaaacagttcgaaaaactcagcaaaaagtcgtttccctgtggtgaagatgctttgcaggcattgtgtgacttcgaagcagaatgccagtttatcggcattgaggcccccaaagttcaaaaaatcgaggtgcataaggggcgaggccgcccggctaaaggtcaacatcccgatagtgttcattatcagctttctgcctcggtctacagccaactggggaaagtggcttatgtccgcctcaaagtcggcatgttcattctggcgacgaatgaaatggacgataaggcgctgaatatggaaactctgctggctaattacaaagcgcaacaaaaagtcgagcggggtttccgtttcctgaaaagtccggagtttctgacttcagcgatttatttgaaaaagccagaacgcatcgaaggcgttattaatgataatgacatgcagtttaatggtttatgctgcactggagcataa

SEQ ID NO: 5458 - DNA, 258 bp, Xenorhabdus bovienii
  Coding DNA location: Contig name=SeqID_16908; Position on contig =18995..19252bp; Strand=+
atgataatgacatgcagtttaatggtttatgctgcactggagcataaaatccgcaccggactgaagcaaaatgccccgttctatcccgatatgaaaggtaaacccacccaatctcccacggcgcgttgggtgtttttgaccttcgaagggattagtactttcgagtttcaggaacaccgtatggtgacgggaatacaggtgtatcaaaatgaactgctgaaaatattggggcaaccctatgaatcattttattcctga

SEQ ID NO: 5459 - DNA, 105 bp, Xenorhabdus bovienii
  Coding DNA location: Contig name=SeqID_16908; Position on contig =19450..19554bp; Strand=-
gtggattttttattaataacaaaaaggcttcattatgctaaaagcggctgttttaagtgcattgttttccataggctcgtagagactcctttaattttcaattaa

SEQ ID NO: 5460 - DNA, 1287 bp, Xenorhabdus bovienii
  Coding DNA location: Contig name=SeqID_16908; Position on contig =19670..20956bp; Strand=-
gtgatctactattttgaattcttatttagagcacaagaaaagaaatcaactggtattggttataacgctgtggcaactggcgaattttcgactgcattaggtgctgatagcattgcttccggttgggaaagtacagcattaggagaaaaggctaatgctacgggaagagcatctactgctgtaggtaatcacgcacatgcaacaggagataactctatcagtatgggctttactgcaaaagccaaagcaaataactcgatggcatttggtaatgaatctgtagccgacagagaaaacacagtctcttttggtaatagtaataatcaaaaacaaattgttaatgttgccgacggaacacaaaaaaatgatgctgttaataaaggtcagatggatgttgtagacggcaaagccacggaagcaaaaaacactgcgaatcaagctaataatacagctaacaatgcaaatgctacagctaataatgcagtaacaaaagctgatagtgcttttcaacgcgcagagcaagccgaaaaaaacgctaacaattacactgattcaaacatcactgaaaataacaaggtgattaatcagaatattaataatgcgaaaaatgaagcgttccaaaaatggcaagaaaccgccaatgctgctgaaaagaacgcgaatgcctatacagatagcaaagccaaagaaactctgaattttgcaaataattatactgataacaaaatcaccggaaataataaggtgattaatcataatatcgacaatgccaaaaatgaagccattacgaccagtaataagtatacggatttgaaaattactgataggaaaactgagttaaatcagaatatcgataactcgaagaaagaggcgattacaacgagtaataattacactgatagccgaattacggatatcattatcaatgaaaatattgataatgcaaaaaatgaagcgatttcaacaagcaatgattataccgattattggtttaatcagttagacggcaaaacagattcacgttttaatcaagtggataagcgtattgatcgtttagaaaataaagtcaacgcaggtttagcaggtgttaccgcaatttcttcaattccgtatgtacaagaagaacgtttttctttcgggatgggattagataattataaaaacggtaatgctattgctgcgggtgctaaatataaacccactggaaatacgaatgtccgtttaaatttctcttgggataatgagagtaattctgcggtcggggttggttttgctattggctggtaa

SEQ ID NO: 5461 - DNA, 957 bp, Xenorhabdus bovienii
  Coding DNA location: Contig name=SeqID_16908; Position on contig =21029..21985bp; Strand=+
atgcctatcatagcacccatacctcgaaatgaacgacagaaaatgaaaaagcttatccagaaaacccaaaataaggattatgctcgccggatgatggcattattaatgttacacaagggggatacggtttctcacgttgccaaaaccctttgtgcctcacgttcttcggtcaatcgctgggtaaattggtttacattatatggactggacggattaaaaagcttaccgccgggcaggccggccatctggaatttagagccacttctcgctgtggtttctttcttattaaaacactccccacaacatttcggttatctccgctcacgctggagtcttgagcttatcacacataaaatcaatgtattactggatatatcactctctcaaagtacactttatcgctacttttatcgggcggggatcgtctggcgaagagccgcacccacgttaagattgtctgatcctgaacatgatgaaaaaagggcaaaaatcaccggggccttatccaatgcctcagagcaacatcctgttttttatgaggatgaggtggatattgaccttaacccaaaaatcggggcagattggtgtttcaagggacaacaaaagcgtgttgtgacccccggaaagaaccagaaacactatcttgcgggttgcctcaacgcgaaaacgaaagaaataacttatgtcgggggcttaagaaagaactcggatttatttattaagttgttagatgtacttaataatcaatatgttaatgcaaagacgatcaccttgattttagataactatggcattcataaaagtcagaaagtcatcgcgtggctggcaaaaaatcctaaatttaatctcttgtttttaccggtctattccccttggttgaataaaattgaacgcctgtggcaatccctgcatgaaaccgtgacacgaaaccattgctgccaatttatggggcagtga

SEQ ID NO: 5462 - DNA, 177 bp, Xenorhabdus bovienii
  Coding DNA location: Contig name=SeqID_16908; Position on contig =22077..22253bp; Strand=-
atgttaactaacaaaattagtatagcacaaaaaaatgaatccaaccttaagaataaatctgaaaaatactgtaatggttttaagctaaaacttattgttttggttttatcttcaactttaggaattggcggggcttatgcttcatataatactatttatggtgatcaggctaaataa

SEQ ID NO: 5463 - DNA, 702 bp, Xenorhabdus bovienii
  Coding DNA location: Contig name=SeqID_16908; Position on contig =22318..23019bp; Strand=-
ttggatcaaacaatcagcggctatgctggtgaagaaaaaccgctgaatatttcggtttctgccaaatatggccttgaacgcattgattggaaacttgctgaattaacggccaatggtggcaagattgaaaatgacggcggttattaccgtattttgctgccagattatcaatacagtcacaccgaccctacctctgtggctgcgactggtgatcataaggtcaagaatacctattctgtttctgccgttgccattgataaaaaaggcaatcgttctaatcctgtgcatatgcaggttattgtttcatccgctgcaatcaatacggttaatagcttattttcaccagaaaaaagtgaattggcggcagagggcaaaagtacgcagaaactgacattaactatcaaagataaaatgaatcaaccggttgatgttaatgtcgaggaatttagagtgaagatgaatgaacgggcaaaacgcgcagaaattaaagtccttgctacagaattaatgaaaatcgatcccgacttaaccggattggatgaacaactgtaccaagggcataccaaaaatattaaatggataagcttagttttgccattaagcactcatttatggctagaggagagagtgaaaggtagtaatcgaacaaaagccgaagaattgaaactgttgtgtttttggatgcaacaaaaagaaagttag

SEQ ID NO: 5464 - DNA, 390 bp, Xenorhabdus bovienii
  Coding DNA location: Contig name=SeqID_16908; Position on contig =23093..23482bp; Strand=-
atgttgaccgctgggcaagctcatgaaagtcaatccgccatccctttgttcgacggcattggtatacaacgcaaaaatggtttcatgaaacgacgtggcaaagcggtgctggcagataaaggctattcgggcggaaaactccgcggttatctgcgtaaattgaggatcaaaagcgttattccttataaaatcaatgaaaaaggcagtgctgatggtcgcacacaatttgatgaacaggcttatcgtgaccgcaatgttgtcgaacgctgtttcggttttctgaaaggaaatcggcgtatcgcaacccgttacgaaaaaaccgcacgaaactatttgtccagggtgaaattaggctgtattcgactcttttacaggcggttatctaattaa

SEQ ID NO: 5465 - DNA, 456 bp, Xenorhabdus bovienii
  Coding DNA location: Contig name=SeqID_16908; Position on contig =23482..23937bp; Strand=-
atgatggcacgctacgacattcctgatgacgcatggatagtgatagaaccttgtttgcccccgatccattcagagcgagcaggacgtccacatgttgaacaccgccgtgtgatgaatgggatgttctgggtcttgtgctccggggcaccgtggcgtgatttacctgaacgctatggttcttggaaaacggtctataaccgatttaatcgcgggtcaaaatcgggcattatcaacaagatatttaatcggttactgtccattctggatgaaaaaggcttgattgactgggctgaaatttgcctggatggcagcaatattcgcgcgagtaaagatgccgcaggcgcgaaaaaaaacatcccgatatcactgacgatcatgcgctgggtcgctcacgcggtggttatggcaccaaaatccacctggcaaccgacggaaagggttttcccctcaacctga

SEQ ID NO: 5466 - DNA, 234 bp, Xenorhabdus bovienii; identical to SEQ ID NO: 3573
  Coding DNA location: Contig name=SeqID_16908; Position on contig =24007..24240bp; Strand=-

SEQ ID NO: 5467 - DNA, 1170 bp, Xenorhabdus bovienii
  Coding DNA location: Contig name=SeqID_16908; Position on contig =24158..25327bp; Strand=-
atgccatcccctgccaaaatctgggaacaggcgctacaggcattacatacccgtctggttcccttatttcactctaccggctcacgacaacgcagcctcgcctatcttcggggattgctcagtgatgttgaacgtaagaatagctggcaactggctgaatggatgggggaaagtacccccgatgggattcaatatttgctggaacgcgctgattgggatgtcgatatgtcccgcgatatcctgcgggattatgtcactgaacatttgggcgatgaacagggtgttctcatcattgatgaaaccggttttatcaaaaaagggacacattctgccggggtacagcgtcagtatagtgggaccgctggacgggtagaaaacagccagataggcgtatttctttgttacgccggcaacggagggcatgcctttgttgaccgggcattatacctgcctcgccagtggacagatgcccgttcccgctgtgaagctgcgggtatccctgccggcgtcacttttgcaacgaaaccccagttagcccggcagaggctggaacgaacatgggatgctggcgttccctgtcgctgggtgaccgcggatgaagtttatggccgtgaccgtcgtctaagagtctggctggagtcccgataccagcccttcgtgttagccatcccctgcaatactcccttatggtggcaaggaccagagtatatccgtgctgaccggattgccgataccctgaccgccgctgactggaaaacacggtcagcgggaacggggacaaaaggtgagcgtgagtatgactgggctgtcgtgccgttatggcgtttacagctcagtgaagaggatcgacattatggtcattatttgttagttcggcgcagccgggatagcagacaggaacgggcttactatgtggtgtatgccctgagagaacaggcggatcttaatacgctggttcaggttgcgggttgtcgctgggaaatcgaaagtggctttgaggaaaccaaaggggaatgtgggctggatcactacgaagtgcggcgatggcagagctggcaccggcatattaccttgtcgttactggcccatgcagtcctggcggttttgcgggtacaggagaaaaaaaacaccggtaggccgggttccgctcagtgtagcggaactccgtaa

SEQ ID NO: 5468 - DNA, 234 bp, Xenorhabdus bovienii
  Coding DNA location: Contig name=SeqID_16908; Position on contig =25376..25609bp; Strand=+
atggattacggctgtagtactagctcttgtttatggcttttccattcgctgagcaattccggtggtatattgtcgcgcgtggtccgatatttcagctggttattgacaacaaacagcgtgattccatgttctaaagcttcattgacgatttgtacggcagttttcatatatcaccttctaatagtccttgtgtcgtttcttgttctatctggaaatgttttcatttttctttga

SEQ ID NO: 5469 - DNA, 183 bp, Xenorhabdus bovienii
  Coding DNA location: Contig name=SeqID_16908; Position on contig =25850..26032bp; Strand=+
atggccataaatataatattaaaatcattaacattcatactaacatattattgttattcgtcgtcatatacttttttttatttatgtatcaaaaaacaattaaataaaaatatttttattaataccctcagatataatctattacccttttattttatgaaacatcatcttatgtcatggtaa

SEQ ID NO: 5470 - DNA, 117 bp, Xenorhabdus bovienii
  Coding DNA location: Contig name=SeqID_16908; Position on contig =26026..26142bp; Strand=+
atggtaataaaaaaagagcttcatgtatcatgtaataacacgaagctcttggtgattaagatgatgctattcgttataaggctcgaaggattgggtctacgctatcttgctgaataa

SEQ ID NO: 5471 - DNA, 852 bp, Xenorhabdus bovienii
  Coding DNA location: Contig name=SeqID_16908; Position on contig =26167..27018bp; Strand=-
atgtcaaaacttaaaatagctgtggttggtggcggaaatattggttctagccttgctttcgattgtgcgttgcaggggcatgatgttgttgttatcgaaaaagacgctctttcttgcgaacagagcagggaacgcatcatggaaacggcgggttacgcgcctttgttcagtccgctcgccaaaggaaaaacccctgaggagatgctgctcaacatcgtctggtcgcaggatttgcaagccgtgtcggattgtgcgtttatagtggaaaatatcacggaaaatatcgagcttaaacaggcgttatatgcccgtatgtctgagtttgtggcccctcacgcggtgctggcggcgaacacttcctgcattcccatcacgaaactgggttcgtttcataaaacgtcttctcaagtgattggtgtgcattttatgaatccggtttatctgaagcatactgtcgaagtaattgtcggtctgaatacttccgaacaaactaaagaacgatgtctggaaatcttgagggtgttaggtaaaaacgccgtggtagtgaaagatggccccggcttcgtctctaatcggatttctcatttatttatgaatgaagccgctttcaccatacaggacgggattgcccaacctgcggatgtggacactatctttaaacaatgcttcggtcataaaatggggccgctcgaaacagcggatctgattggtattgacacggtggtcaattcccttgatgtgctctaccagatgtttcaggattcaaaatatcgggtttgtccgctgatgcggacaatggttgatgcgggttatttgggacgaaaatccggccggggtttttacacttattaa

SEQ ID NO: 5472 - DNA, 729 bp, Xenorhabdus bovienii
  Coding DNA location: Contig name=SeqID_16908; Position on contig =27089..27817bp; Strand=-
atgcctttattttcacaaacaataactgatttttggcaggctccatttttgaacggagacgttctctatagcgatgcagtctttactgttaccgtcaaccctgatctgaacgaagatcgccgggtcatggtgctggaaacctccgacggtcgagtgatggcggttctgacacccgcgctggctgataaggccggtctttatcagcaacaagatctgtctgagccggttttccgccagaaattgaatgaagccggcgtcacgctgcatggcgcagattatatcttttatttttcagaagcggataagaacgccttgctgcaagagaatctggcaggtgttttgcgtcagttaacagagcaagataaggcggttttctccgaattcgaatcttccgcctcagaacaagatttggatgacgcttatgtggaattagatcactgggcggtgttcggctcttttgaacagcatcgtctggtcagcgcggccagtatgtatccgtgggagaatgcgcaaattgcggatcttggcgtattaacgctggcaccctttagaggaaaaggccacgccagcaaagtggtgcgttcaatcagtaaatatgcctgtcatcagggctatgaaccccagtatcgctgccagctcgataactatgcgtctacgtcattggctaaagcggcaggattgacgctgtttggtaaatgggaagtgatttctcctgattcgactgaatga

SEQ ID NO: 5473 - DNA, 189 bp, Xenorhabdus bovienii
  Coding DNA location: Contig name=SeqID_16908; Position on contig =27772..27960bp; Strand=+
atggagcctgccaaaaatcagttattgtttgtgaaaataaaggcatacttcttactcgctttggttggaatcagcgagcgcacgatggcgctcagtcaaataaccctaggaaagacaagcggaagtttgagctacccactcccttgctcgctcttcaatctatggtatcacttcatcacgtgtaaatag

SEQ ID NO: 5474 - DNA, 1185 bp, Xenorhabdus bovienii
  Coding DNA location: Contig name=SeqID_16908; Position on contig =28020..29204bp; Strand=-
gtgagcctacgccggaaacgttcgctcagacgagcgaccagaatgtggattcagagtttaatttttaggggaggtcgaaagatgagtcttttcagtaatacatggaatgcattcggggatgtcgcgatgtgggcgttcgaagaaatgagcatttatcggtgccggcagggcacgcagcgagaagttggcaataacgataacgatgcactagcgcgccttgaggcggctgaatatcgcaaggtggagaaagtttcggacatttcaatcgctgagttcagtgaacgctacttaatgaaaaaagagccggttattatcgctgatggtctgagaggctggcgagcgaagcaaatatggaactttgattacttttgtcaggagttcggggatatgtccgtgcaattgcaggatgcgggattcaagccgaaagaccatgttgagctgcgcacctacctgcgggaaatcatgtcattgcctgccgtcgaactgggcgaaatggggaataatcttagctatctgcgatacacctacgattcattttttaagcacctgctgttcacttggggatttggtcacagggtgaaaaccaactcgttcagttttctggcgtttcaacgcattcaggagcattggcgcagaccttattttctgccggatggcggttataagatcccttgggttcaggtagggtccctgcatccgaacaagcggatgtgtcaggattggggtctctatttttctgcgccgggcgcttgtacccgtttacatgtcgatggtatgcgcaccaatgcggtgttgtgtcaggtcgcgggcagaaaagcgggctggatcttttccgcttcgcttgaagatgtggtcagagatacggctgagggtcgtgctgctttatcatccgtcgcatcacccgccgctaatggaaaaagtgaggcaaattcaccacacagcaaagatcgtatatggcaattcgatttgctaccgggtgagattatgctgatccccaaagggttagcccatgaagtgcataccttatcgccgagtatttctttgacttataactttgtcactaattcggagtatcgtgattacttcaatttcaaacgcgagcgcggccacggctggatagcgaatgcaccgattgcggctgttccagaattcgcccttattcaccaacgtaaccaaaggctttag

SEQ ID NO: 5475 - DNA, 5010 bp, Xenorhabdus bovienii
  Coding DNA location: Contig name=SeqID_16908; Position on contig =29137..34146bp; Strand=-
atgcgtacagaaataagagaagatttagatatcgctgtcatcggtttgtcaggtcgatttccgggagcggggaattgcagtgagttttggcgaaatttgttgatgggcgtggacgggatttcctgctttacggcagaagaattgcttaaggcagggcatgatgccggcaagatacgcaataaagatttcgtgccggttaacggagtactggaaggcgcacagtatttcgatgcggagtttttcggctacagtcaggcagaagcggcgcttttggatccgcaaacccgtttgatgatggagtgcgtttggcatgccttggagaacgctggcgtcgatcctgacaaacggagtcgcaatatcggactgtttctgggggcgcgcagttcggtgcagtggacgatgcaggcgatgttgtctgaacaggttgagaatgtaggcggttttcttgcctcccaattgtccaataaagatgcgatgagtacgctaatctcctggaagttaggactggaaggccccagttttaccttgcagaccgcctgctcaaccagtttggtcagtgtgcatcaggctgtgcagagcttgttgagtggtgagtgtgatttcgccgttgccggcggaatcagtctgttgttgccgcagcaaaacgggcatacctatcaagacggaatgttattttcaaaagacggcaaaaccagagcgtttgatgcggaggctaccggtagcgtgttcggtagcggactcggtgcggtagtattgcggcgggcgggagatgctattgctgataacgatcctatctgggcgatcctcaaaggctctgccattaataacgatggtgcccgcaaggtcggctacaccgcgcctagcgttaaagggcagacggaagtgattcgctctgctttgcagatggcagagatcgacgcggcggatctggatttcattgagtgtcatggcacggcaacttctttgggtgacagcatcgaatttatggcgttgcgtgaagttttcaacgaaagaggatcttctgccagtgcagaggagacactcaatcaatgtgcactgggtgccgttaaaaccaacatcggtcatctggattccgccgccggtatcgcgggtttcattaagatggtgttggctctcagacacggcatgatcccgcctacgctgcatttccaacggccgaatcctcaattggaatttgaacactccccgttttatgttaatacccgtgctgaaccgtggccgtcaaaacaagggaaattgagaaccggtggcgtcagcagttttggtattggcggaaccaatgcgcatatggtgttacagcaatatgtgctccctccgcaggccatgaagacaagcggcgtcgataaagtacccgaagtctgtttttttccgttttcagcgaaaaacagtgcttctctggtgctgcaattagaatcagtgtcccagtggttggtatcgcaaactgatccgaatttatctgcgctgtcccgtaccttgggcaagcggcacagttttccgtatcgagctgtgtttgcagcagattcgaagtttgctctgatgcggcaaattgaacgctatctggcacctgatgaacagatggagagtctggcgctggttcggcaagttctggaaacgacatcgccggataacctctcagaacattttgctgctatcaccgactgggtatctggtaagacgaaagagcttgagaaatgtcttttccgctcctgtgacggacaactgttgatggatgttcccggatacgcttttattcgtgaggaacacggaacagaacatattacagataaaatctggtcgcaaatcgccagtgttatcgcggcacctgatggcaaaaatctgtctaaaaatgcggcggggctgttattgccattctggaaacctctacgcttgccggcacaaccgatgtcggaggtgaagccggatgccgtgctgctggttgaccagacgttagcgtctcttgcgagcgggttggcagacaaaagtcagattgaggttgtcagtctggatatgctgtgtccagtacaggtgcgaagtgctctggcaaaactgtctattggttcgcaattaacaggtttgcaaaagaatccttctctggtgttgtcgctggcgttcccgacagagggtttttcttttgcgccagcgtcgctccaaatcttatctgaattaggccggtcgctcgcggagactgatttctccgcgtttacttccgtgcatatttatttgatcgcgcccgcttgctccatgaccggcgatagcggatctctggctgaatctgtattgacggctgcggctcttaaagcgttagcgttagtgatgcctcaggaaattcccggtgtcaattgtgcgtttctgggcattcagaatcccagtgcagattggacgcctgccgcgctgaccagactgctgcagactccgttgcatgggcctctgaaacttaatgacgaggggctgtttgttgaagattttcgttgtccggatgcggaagaaaatgatgtgttggatgcgtcgtatttcaccgggaaaacttacgtcatcacgggcgctggcggcaggatggccaaggcgatggcaggggtgatagcacgacgttttcaagggcggttggcactaatcagtcgccagcctgcggactctcccgcgatgaagcgcttacaggaagagttgaaggacgcgggcgctgaaacggtggagatttttccgtatgctctggaatcggaagccgacgcattggcgttgtttgagtccattcgccatcgtttgggagagatcagtgtggttcttcacgcggccggcgttactgatggcaattctttttctcctctggttcaactcaatgctgatcattattgcgcgcaactcgcgccaaaagctaaggtggcggcagtactcgccaacgtattcgaaagcattcctgttgagtattgcttcgtgatgtcttctatgtcggcgtttttcgggggcattgcccatgcgccatacgctgcggccaatctgtttctggatggttgggggcagatgcaaaacagacggttgacagggacgcgttgggttgccgtgaactgggaaacggtacattttgacgaagatcgtcgggctgatgcacttgtctggggtgctaatgaagttgctctctctggcgctgagtttcctgctctgtttgaacgcagtttgcgtgaatacgatcacgaaaaccagaaaattttctctgctggccagtttatggataggttgtatgcctggggaggaagacgtgctgccaatggcgatcacagaccgcaggccgaggggaacgtcaaattgaagtccagaccgaaaacgctgacttccgtttatcaatcgcctgccaatgagatgcagaaggaaatcgccgctatatggagcagtattctcggtattgacggtatcggcattgatgaccgatttatggaactgggtggcgacagtctgaagactattgtgatggcggaaaaagtgtataaaaaactcggtaagcgagtttccattcaggacttttttgcgcaacccaccttacgggagattgaacggcagttgctcaacgaccagaacgcgctccatccgatcttgccggccatcgacccatctgagccaatcgttgccagcgccgatcaagaattgttgtatatacatcaaaccacgtttaccgacgccagttataacatgccaatggcttttcaatgcccggcggcgatcagtgcgatcgccatcgctacagcgatagaacaggttgcagaccgacatccggtcttgaaatgtctgtttaaaaggcagggggctaatttgatgatgctgcctcagcttgacgctaaagtcagcttagccatatttgaggctgaacccgcacaggagggaaatctggctcgcctcgaacagtttgctaaggcgccttttgacctgcataccgaactgccaatgcgcgccatgatgataaaaggtacggatgccggccagtttcatcaggtgttgatcgtcgtccatcacatcgtatgcgatgctgtttctctgggcatactcgcccatgattttcagaataggcttaaggagcgcccgttacctgcgccggagtacagtttcgctgcctatcggcgctataggctggagtttgagagtgaagatcagatacggaaaaataaagcttattggctcgccaatctattacctttgccggcaccgctggcattacctgtggtagatgattatgacggacatatcgatgccgacagccatcggggggtaacgcgagttaaaagtttttctgcgcaaaccagtgaagaaatcaggtgtttttgcagtgatctggggctccctgtatttacctttttccttggggcgttcggggtgctgatgacgaaaatcgcccgcgccgaatcctttcttctcggtgttcccgtcaccggacgcacacagccggaagaactggcgctggtgggctatcttgtcaacatgctggctctgaaaattgagccggatgcggactttgccatgacggactatcttctggagctgaatgcacagtggtctgaaagcgtcccttatcagacttatccgatgagcgcgctgctggacgatttgagtactgagcatgacttccaaagccgtcaaggcaaacatccgttgttcgacgtggttttcgggtatctgccactgagtctgaacggtgctgatgaagccgcgtggcgccccggattttcccgactggaactgacgtcagatacggccaaatttgatttggtgatggaaatatccgaaacccaagagacatttgactgcacgatacaatttcgtgcacgcatgtttaacgaagccaccattatggcgctgtttgagtactttttcgctttgatagaggaagtgctcaccgatcctgatgtagaaatacaggaattactcaagaaccttagcggtgagcctacgccggaaacgttcgctcagacgagcgaccagaatgtggattcagagtttaatttttag

SEQ ID NO: 5476 - DNA, 6537 bp, Xenorhabdus bovienii
  Coding DNA location: Contig name=SeqID_16908; Position on contig =34131..40667bp; Strand=-
atgaaaataaaacaggaagttgcggaaatgcacactaatgatcccattgtgatgaatgcaaggaaacaggcattcaaagattatgttcgccaacaactggataccgactatcagggatgtcccttttttgtgacacggctggcgacatcggggacagacacggaggtggtcacgacgtcattcacgtttgccgaaccactgaacagcagaattttcactatggcggcgtctccgctgcatcgtctatcgctgttttccgcctgcatcaagtatctcgcttttttgcactgccgggagccggaagggagcctgaattgggcgatcggggcgcaagatatagcggggaacggaacaccggcggttttatccgatgaccgttccgcaggtgtttatcttgtccccgctaaatggcatctgacggaaacggaactgacacaacccgtaaaacggctgttcggtgaggagcttgcgcaatggaagcaagttgctgcgttgacatctggcatacctctgcaatcggcatcttccgtgatgtctcaatcgccgcaaattctggcgggttactctgaaactcagccaccttttgaggggacagagacggcgtgttattcactgagtctctggctccaggccagtcccgaaaagacctgtctgcatatgcggttcgattcgcagagggtggatgcagaattgacatcacttctgatagatcgcttgaccttgttgttgaacagcatggtattcgaaccaaactccccgctcgcgtcaatgccctggatgccggatcaagagcgggagcgtgttgctgcactttctgcccccgtacccgcgcagccactgagatacaaaaatgtggcacaggctatgaccgcctccatgcgcggcagagctgaaacccggtttctcgaggccagtgatcagaccgttaactttaaactgttggagcggtacacggataatttgttgactgatcctgatttgccacaatgggaatcgttaggcgactgtgtgcttattgtcggcgccaagggcgtggaaaccacacttgccgcaatggcatgtatacgcatcggtaagccgttctgcctgcaatcctatagcgcgccagaaaggcagttagtggacatcatcgagctgcatagcaccaaggtggttctgctacaggaaagttgcggtgagatggcagagtttttccgcactcagggctgtcaggttgtcatgctgccttattatgtaccggatgcgccggccaagtcgacgcatcggacggagatgtctgctctggcggcgttgttgcgtaaaggtgaggcagtcaatcccgacgacccattgtgtgtggtgatgacctccggcagtgagggtaaaccgaaaggttgtatcaatactcatcaagcattacttaatctcagtgctgaaaaacaaaccctgtatcgaacggcaggctccagagtcgcctccgtagcgaaccatacttttgactatttcgtactggaatgtgtgcagtgtctgactcaggacatcgtgttggtcatgccgccggaagaggtacgtacagacgctgaaaagtgcgtcagatttctgcgggaaagccgcatcgatttattgtttaccacgaccgtgctggcggaatacatcatggagctgggggatattccgaacttgcggcaactgtattttggcggcgaaagcctgagaacgtttcaaaagaataattacgagctgtttaatgtatacggccccagcgaaaccggcgttatcacaacctatttatccttagtacgcaataaccagaaaatcactatcggtaagccgttaggcggctgccagtgtgtcgtggtatttcccgatagcttagaaccctgtcctatcggtgtagcgggtgagctgttgataggaggaactggcgttggagtgggctacataaatcgccctgatctcaccgcaaaggtgttcgtagacctggatacggaatggttgaagggaaagtattatcgcagcggtgatctctgttactggaatgttcagggtgaaattgaaattgagggaaggcgtgatcgccaactgaaagtaaacggtttccgcgtcgaattggatgccattgaaaaaaacattctggatctgccgacagtggctcaagcggcagtgattggcatagaagaccagcggggacacgctcatcttggcgtctttatcgttacgacggacagtggggtcacggagcaaaacatcagagaggcgttattaagccggatgcccgcttatatggtgccgagtcaggttattttggtcgtggaattatcgctgacacgcaacggcaaactggatcgacaagggctaaaacaggcgttcagcaaggcgatgagcggtaaaatcgttcggcctgacggtgcaactcaagaatggctggcagcctgttgggcacgctatttggagttggaggttgacgcgttgtcggtggacaaaagctttttctcccttggcggtcattcgttacgggcggcaagagttctggcggaaattcaacatgaattcgggcaggttgtctctttgttggaattctttcaaaacgatacgatcgagtcgctggcgaaaacaatcgatgcccgacggaccggcggtgacagcatggcggtggaggatttctcaagtctgctggaagccgcacctcagcttgcggttggcgggcgtggcccgttatcggcacaagaaattcggctctatgcacaatatcgtctgcatccagaatcattggcttatattttggcgctggagatcccgttatctcatgacctctctactgatgtagtgaaacaaacactacaggttctaatcgaccgccacgatattttgcgtacccgatatcgcatcgatagtgaaggtattccctatgctgagatattaccgtcgctctcggttgacagggtactgatcgatgatcggagtcagtggttgcagaggcggacgcaggctttcgagttaggagaagcccctctgctgagaggctgtctacaggaaatgaacacggagcacgccggcttgcagttgcagatccaccatattttagtggacaaaccttcgttggagatcctacagcgtgagtttcagcaattgctggcgcacgaatcgttggctcccgttgcgctgagttacaggcactatgcgctggcattggctgatgcccgtcaacacccggtctggacacaggctgagacattctgggcaaatcatcttgaagggcttgagttcgatccgttcggccatggtgcggtgaatgcaggcggcaaggtaaaaaccctatcctggcatctatcggctgcggatatggcagcagtgaaacgtctttgcggagccgtcaacgtgactccggccatgcttttcctgtcggtgtgggggcttaccgtggcgcacgaagggagtagcgatgctttttccatttcagtggcgaatgcatttcgcccaaaaaatgcgctggagacagtgggcatgttcgtctcgttatccccttgcgcgtttcgttttgatcagccggcagaaacctttgaccgatttattaagaaattggcggatgagcagtggcgcgcggttgatcagctctttttcccggttgaagaggcctttgcattgctcagtcgtgaccctaggatgtttggccgtaatccactgcttaatgtcgcctattcctatcttgacgcaggggagaatgaggcactggatgcagaggatttattgctggaagcgcatgggccgctcaatcttactgtcagccatcgtacgcaaggtatacaaaatacacaaagttgccgattgacgctggaatatcagatcgcggctttcacagattcacagatagaagcgatcgtaaccggctatcaggaaattttgcggcagatattgcgtcacgttccttccaccttgcagattgatgatctgatagtgtctgccgacatagttaaaaaggcctttcggccagttcaacgacgcgcgtcgtatcgccaaattgatgccatgctgattaatgggtttctgacattgaccgaccgtcccgcggtgatggatgaaaaaggcgtcgtgacttggggagaattcgccgcattaaccgctgcgtatacgcaggttctaaaccaagggacgattcggcgggcactcattttgggacgtcaggggcgtcagctacaggcatttctggcggcgtgtttcctgacgcacacgacctatctggcactggaaacggggacaccggaggaacgtattaacgaggtgatccgccatgcagagccggatctcgtgatcaagtgcggttcggaaattggcgcacaattgcaggacgatagtctgattgaacctgtttccattaattggcgcggctttcacagcatgaaatccgctgacgataatcctatcggatgggtactgtacagctccgggactaccggcaaacccaaaggcatctgcgttgccgcgcatacagcggcgcagtatgtggattcactcgtcaataaactgggattaaagcaacaattgcaggcaacgcagcagggattgcggatcgtgcagcaattctcgcccagttttgacggttatctcgaagaagttctgctctcttgggcattgcaaggaacgagtgtggtcgttgaccgttacagtttactggatgaacgcaaagcgagagcgtttttacttcactatcgccctgatgtcatttctgcggctccggctcttttttccgcttggaaccgtatgccggcgttggcacccttgcccaagatctgtattagtggcggtgatttcctcactgccggagatatcagccaattacttgaacgcacacaaatttggaacagttatggccccacggagacctgtattgccgtatcgatggtgaactgcgcgcagttggcgtcaggcacggcactttccatcggagaacccttcgatcatgccgcttttgccgtgatcaatcaggatggcggccggctccgggtcggtcaatggggagaactggtgatctatggggattttgaacgtcatggttatctgaatgatccggcgctgactgcgcgtaaatttggtcgggacgctcagggaacgtttttccgtaccggcgatttagcgatggcggacaaaaacggtctgttttacctcaaagggcgaatggatgatagttgtaaagtgcggggcaatttcatcggtttgggtgaattagaaaaccgagccggacagtaccctgacgtgattgcggcgggtgccgcagtggcgttcgccggcacaccggaagcttgtttggtactggcgattgaaggaaaagagaatatgcagtcggatctgcaacagtatctggcgcgacattatccccgctcccacctgccgtcggcgatatttccgctggcgtctttgccccgaaccgaaacaggcaagctggatcggcagcggatcgtggcgctgtttctggaatggcgtgaaaacacgcatcaaacacaggaggagcaggcagcaacaatgagcgagggagtgcagaagttaatcgcctgctggaggaaatgcttaggatataaaggggcgttgacacaggattctgatttctttctggtatccggatcatccctgagtgccgtgcgactggctaaccagctggaaactctgttcggcgtgacattcagccccgtcgatgtgttccgcaatgccacgctcggcgagcaatggtcgctgatcaacgcacggcagggagcggatgacacaatgccagtgaagttgttacaagagcgttttctgaacgtcgatgagccgggcactgccaaactgatactgctgccgccggcgctagggggattgattgaattgcagacgctggcggacaaattagccggtcgcgtcaccgtgtctgttttaacaacggagccccgcgcggttgaaaacctgtcagtgcaggaatttaaacaggcgttgctaaatgctctgacattgcacattaaagcgcaggacatacacccgtcacgatcactgtggctgggcggctattcccttggggctgagatgctggtggcattgctggcacaacaatcggagtcatcgccgcatttttctcaatacatagacaaactagtgtttctcgatcctaacctgcgtaccaacgtttttgagggagatgagctgtatgcagagttcgttgcgttctttcgcgacgttaatcggttggcttttgattgtgcaggtattgatgccgatatggatgttgaaacattgcggcggcaatttccttcgctccatcaggagtggcgctattaccaattacagcatcagatccttgaaaacaagacattccatgagcggatcttggctctgccatcagaaaacctccccgtcacgatgttcttttccgacgacgcagacgaagcaggtattgatggacttacgcaaaaaatgaaagggtgctgcaccgtccggcgtaaaagcggtgatcacgttgaattcgttaagcaattaacttccgatgactttatcgatctggaacagggtaagacattatgcgtacagaaataa

SEQ ID NO: 5477 - DNA, 6540 bp, Xenorhabdus bovienii
  Coding DNA location: Contig name=SeqID_16908; Position on contig =40669..47208bp; Strand=-
atgcttaatcagttgctgtcagaaaatcattctgatcattccaatcagagccgggcgccagaggacactatcctgaattgttgcattcatgaactgtttgagcggcaggtagaaaaaacaccggatgcggttgccgttcgattcggggagcagtcactctcttatgcagaattaaaccgtagggcgaacaggctggcccgattcctcagagacgatttgcacgttggcccggatactttggtaggcgtgtgcgtagagcgcagcatggaaatggtggttgcgctgctggcggtactgaaagccggaggagcctacgtacctcttgaccctcactatcctgctgaaaggctcgactacatgctgcatgactctgctccccgtgctttgttgtctcacggtgcggtgccggctgtcgttcgcgcgctgctggatcaatacgcgatgagcacaaatgtcagcgtgatcgatttggaggccgatgtctcgcagtggtccgggcaaaacagtgatgatttgcatccggcagataacgggctgacttcttcccatctggcgtatgttatctatacttctggctcaaccgggcggccaaagggcgtgatgaaccagcacgttggcgtcgtcaatcgtttggtatggatgcaaaaggtgtatcggttgaatgcgaatgatgtcgttctgcaaaaaacacccttcagtttcgatgtgtccgtctgggagtttttctggcccctgatgtacggcgcccgtctggtggtggcaaaacccgaaggacataaagatccggcttatctgagcgctttaatccaagcgcaccggataactaccctgcattttgtaccgtcaatgttatccgcctttttggatcaggtgccgccagaagtgggcgattgcctgcaacgcgtgttttgcagcggtgaagcactgccggcgcgcagtgtgcatcggtttcgggagcgttttgccaaggttgaattacataacctgtacgggccgaccgaagcggccattgacgtcaccgcctggaattgctgccttgatgaaacggatggcttgatcccggaaaatgtgatcccgataggtaagccgattgataacattcagctttatatcctcgacgcttacggccagccgtgcccggtcggtgtggcgggtgagcttcacatcgccggggtgggcgtggcgcgcggctatctgaatcagcccgaactgacagcggaaaaattcatcaaaaatccctttagtccggcattaaatggcgtgatgtaccgaacgggggatctggctcggtatttacccggcggcgacattgaatatctgggacgtaatgactttcaggtcaagttacgtggcttccgtattgagctgggtgaaattgaagcacgtctgatgaagcatccggccgtacgtgatgccgttgtgctggcgcagggcgagagtgcggaagataaacgtctagttggatttgttattgccgcggaacgcgccttacagcgccagtccagggagagcgtgaaagagagtattcaacggcttatcaacgatgcggtgcccgattacatgaggctggccgctatcgtcatcgtcagcggttttcctttatccgccagcggtaaaattgaccgcaagtccttcccggtggtcacttttgatgaattcacggcacaagacgttgaaccgccgaaaaatgcgttggagcaaaccttggttgaggtgtggagtgagttgctcggcgttaaaaacatcggcagaaactcacacttttttaacctgggcggccattcgctgctgaccctgaaaatggtgctggcgctgcgtcgtcgtggactctttgtagatggctacacgctgtatcagtatcccgtattgtccgaactggcgacacagttgcaggtgtccgatccacaggaaacccgctctgacatggcggaacgctctatggtggaagcgtccgcctgggcgcaactcagccaaaaagaaatcgacgctctgattaccgctatccccggaggtctcgccaatatccaagatatttatcctttgggggcgttgcagcaggggatgatctatcactatctgacgaatttggcgggagatccctatgtgctttggcaggtcgtccgtttccgtaatgcagacttgctgcacgcttatgttgacgccctgcgcggcacaattgcccgtcacgatgcgtttcgggtcagcgtccatcatgaaggacttagccagccggtgcaggtggtttggcgggacgctgaattgacggtggaagagctgaaacctacgatggattgcgatgatccgttggtcatcttgaaacagcattgcgatcccgccatgctgcgttttgatatcactaaagcacctttgcagcgttgtctttattgctatgacccgaaacgggacgaatgggtattgctgcatttgatccatcatatgacggtggatcacacgacggtagaaaagatgcagcaggaaatagaagcgcaactgcattcagaaccgtctgctccgattgcgcccatatcgttcaggcaggtgaacgcaggtcttttctgcgcaactggcgcggaagagcaaaaagcattttttgacgctatgttacgggattatgaaccgactccagcaccgtttggtgccggtgaatatttagggggcaacgcggtggtggtagaagcttggcgaccgctgcaagaacggttgtgcagccagatacgccaacaagccaaagcacacggtgtcagtgctgccgcagtttttcatctggcttgggcgaaagtgatcgcctgcctgaccggatgcaacgatgtcgtcttcggtactgtcttactggggcgcatgtttgcaggtgaaaacgctgaaaacatcatggggccgtttatcaatacgctgccgatccgggtacgtctggataatcttgctgtttttgagtgtctctggaatgctcaggatactctgacgcagttggtcaggcatgaacaggcgtcattggcgctggcacagaaatcagtacagacatcgggaacagcgcctctgttcacttcattgctgaattatcgtcacagtgaaatgcgcaacattccttcggcagatccttttcaggcaatgaatccttcctccgtcaatggagtcagttattccggcagtatggagagaacccattatccggtttccgtcaatattgatgatttcaccaacgattttgttattaatgcacaggtcgaacaggggcttgatcctgaacttctctgtgactacttgcagacagcgttacaggaaattgtcaccgcgctggaaagcgcaccagagagaagaatgggtcggattcatgtcttgccggtgcaggaaaaagataaattgctgtggcaatggaatcagaccgaatctgattttccgcgacaggcttgcctccataccttaattgaggagcaggcgcgtcggacgccggacgccattgcggtggtgtttgaagaccaagtgctgagttatgcgcaattgaaccagaaagcgaaccaactggcccgattcctcagagacgatttgcacgttggcccggatactttggtaggcgtgtgcgtagagcgcagcatggaaatggtggttgcgctgctggcggtactgaaagccggaggagcctacatacctcttgaccctcactatcctgctgaaaggctcgactacatgctgcatgacgctgctccccgtgctttgttgtctcacggtgcggtgccggctgtcgttcgcgcgctgctggatcaatacgcgatgagcacaaatgtcagcgtgatcgatttggaggccgatgtctcgcagtggtccgggcaaaacagtgatgatttgcatccggcggataatggtctgacttcttcccatctggcgtatgttatctatacttctggctcaaccgggcggccaaagggcgtgatgaaccagcacgttggcgtcgtcaatcgtttggtatggatgcaaaaggtgtatcggttgaatgcaaatgataccgttctgcaaaaaacaccctttagtttcgatgtatccgtttgggagttcttctggcccctgatgtacggcgcccgtctggtggtggcaaagcccgaaggacataaagatccggcttatctgagcgccttaatccaagcgcaccggataactaccctgcattttgtaccgtcaatgttatccgcctttttggatcaggctccgtcagaagtgggcgattgcctgcaacgcgtgttttgcagcggtgaagcactgccggcgcgcagtgtgcatcggtttcgggagcgttttgccaaagtcgaattacataacctgtatgggccgaccgaagcggccattgacgtcaccgcctggaattgctgccttgatgaaacggatggcttgatcccggaaaatgtgatcccgataggtaagccgattgataacattcagctttatatcctcgatgcttacggccagccgtgtccggtcggtgtggcgggtgaacttcacatcgccggtgtgggcgtggcacgcggctatctgaatcagcccgaactgacagcggaaaaattcatcagagatccctttagcccggcgttaaatggcgtgatgtaccgaacgggggatctggctcggtatttacccggcggcgacattgaatatctgggacgtaatgactttcaggtcaagttacgtggtttccgtattgagttgggtgaagtggaagcggcgttgttatcgcacgacagcgtgaaagagtgtgtggtgctggtgcgtgaggatgtgccgggcgatgctcgtctggttgcttatgtcacccctgcttccggctacgccgatcaggttcaggaggaacggaatcagacgctgagagcgcacttacagacgaatctgcctccatttatgatgccgtccaacttgctttggctggatgcgtttcctctcaccacgaatggaaaattggatcgcaaagcgttgccatctcctgctgatgcaccgatggggcaaacaataacggcacaacctccgcaggaaggaacggaaacccgattggctcaattgtgggccgagttactcaatctcaatactaatgcgatcggacgtcaatctcacttttttgaagccggagggcattcattactggctgttgcactcatggcgcggatacagcaagcgttcagtgtgtcattgctgctgagtgcgatagtggaacacttggatttggcttcgcaggccgagcttatcgagactgaaatagaaaaaggaaacgcagcaagggaaaatggggatcgggcgcccttaacagagcagaacgaaccgacgcctgtcgagcagattcgggcgttgccaacgcaaaaagccatctacaaggcagtaaaacttaatcctcaagacttaagcaataacagtttcctcgctttgtcgttcgacgacgatgcgcagccggatcttaaacaactgcgtaatctattgcagtcggtattttcccgtcatgaaagcctcagggcgcaattcattcttacaggcgatgaactctctttgcgtcctgccaagcgttttttattccgattggagaaacgtcaaactcttggttctctggaagaggatctgcgcgattttatccgcccgttttcgctggaagatggcatgaatgttcgcggtcggtgggttgttgatgggcggcatccgcttttgctgttggatttttcccatgcctgtattgatggttcaggtctgatgcaaatactcagcgagttagccgctgaaaatgaccccgctccttcgggaacccgtctggcgacttattctgagcttttctacagccgtgaatttgcggctctgcgacaagaacatgcggacttctggcggacgcagttacaggagtggtcgccccttgtgcatgcgcaggacactgagtcagtcacgcacacttgcctgattacgctcgacgacgggcttaaagggcagattgaaacgctcacgtcacgattgaaaatcagtgttcctgaattcttcatggccgcatttttgctgtttaaagcccgtctggattatcagcccgctcaattcaacccgcacgatcaactaacgtccatgatctttcatggtcgggacaggttggatcagcagacggtcatcgcgccattgatgtcggttctgcccgtgcgggtaaggttgcggggcgagacgatggaaccggagatgctccatgaagtgagcacagccgtgcgcgcggcctgtcgtcattacctgtttgatgtcgaagaattgacagtacggtatccggcgctggctaaacaggcgttgtcacccacgtcctttttcggttacttccagaaagagggctttgacggccgcatcgcaggcaggctctgtcggcaattggaaacgcccaatgttgcaggtgggcaatcgcactggaatctgacctgcgaaattgccgagcataccacgggctttgacgttcatctggaagcgctctcgttcagaacgagaagcgacgtagggaattgggaagcgctgtttaagtcgattttgcaaagtgcgctgagtgttgagtga

SEQ ID NO: 5478 - DNA, 3324 bp, Xenorhabdus bovienii
  Coding DNA location: Contig name=SeqID_16908; Position on contig =47201..50524bp; Strand=-
ttgcagaagaaccgcagatgccgcaacaagggctgggagataaacggcgcacgttgcaggctcgtcgcaaattacgcggcgttgtgtccggtgaggatatgcccggtcaggggagtgaagacaatgagtaactctggattgatccggataggcatttttttagtcgctatctatctcgcgctggtgggcagcgtgttcgctgacacgatcgatcagaaacaggttatcagccagaagcaagatcctgatctggagcagatagtcggtgagctgagtcgtcgttgggatgttgcgcaagttcccactggcggactgagtgtcatcgtcggcgataaagttcgtacatggcgactgggcaaggaggaggcaggtacattcgaactcgcttccacctctaaagcctttactgggttgctgattgcgctgctggagcaggaaggtgtactcaatcggcaggatgcgattacgcaatggatacccgagctggcggagcgtccggaaatgggctactccgccgtgctacttaaaaacctgttgttccataccagcggtatttcaggcgacacgatcgacttgctgcgaccttatgatgcgtctgatgctttagtaaaattgccggtattgctgaaggagatcccgctggtttatcccgtcggtgccaaagaggagtatgccacgctgaattacagcctgttgggtttggcggctgaacgtgcgacgggaaaatcgtttgcaaccctgatgcgggaaaaaatctttctgcctttgggaatgaaaaatacaacggtggagggcgatttgccggcagaggggagtactgctgtatctgcgcgcattccggggtataagatcagctttacccacgcccggccgtatgatgcgccccgttatctgcaaaatacacctgcaggttatgtgctcagtactccgcaggatatggctatttggttgaagttcttactgcatcagcaacccttggctagcgacaagggtaatggcgatgaaaagcggtctgcgttatacgcggcgttggagcaggcaaagcgcccttacggtggcaatggcgacgtggggtacgcttatggttgggatgtgaaaaccgacgtaaccacaagctggagccatccgggtcagaatcccaatgccacagcttatgtcgcgtttgacccgaaggctggtgtgggtgtttccctgttaggtaacagcaacagccctcaggtgattcaattggggcaggcgatattcgaacacctgcgtggtgcttctccggcaggtttgccggaaaatttccccactgatgatcaggactggctctccacggtagtggctgtgattttctggctcggtggggcgctgcttttagtggcggtcatgtataaaagggggaacaaggataaaggcgatcgagatgagtcggttcccgatggagcaagtgttctagagagccgagtggagacggcgataatacaagagagttttgttcgaaccgcagaaagcactgcgggaaaaccggtctggcgctcttttctcagtcggcttctcgtgcagaatgtcgttcttgtgtccgtgctggcgattacaccgctgctattgtcgggtttaagctgggcaaatctgctggtttgggggccgttaagcctgcccgttgctgtcgtagggttgttgttcttcgtcaacgctatcagtctgttcttttttctggtgacccagcgcagcgacagatataccagtaagactttttcctcgttgatgattgctaaaatcgtcggtctgacggtcatttccggactgctcaattccgcattggttttattcatcattcaggctatcgatagcccatctacgtatttgctgtacagcgctgtgctgctgtttagctgtatctacttctacatttccacccgtaaagcagctgaacaacagatcatgcgctttgggcattcttttgtgcagggctggcggatggagattatcaggaagctgctggcgtcggattacaaaaacatcgaacagctatcttcgggaaaaatacagtccgtcgttggggaaaattcgcaagaattagcgaaaagcgttctggctttcgtgcctttcttcgccaatttgttgacgattatctttttattcacctacttgatggtgttcaagtcgcctgtagccacttctgtcctgttggcctgcgctttgcccatgatcgtgctctattactgcatttctgaacgagccactcgcattatgcctcaagcattaagcatccgtagcgagtttatggataccgtggaagatttgcagaaaggctataaaggactacggcgtgaagcggtaaaacacagcttctatcgtcatgcgcaggctgtgtcggatcgttttaaagcgttgaggattcagtacgatctcggctttttaaatgcattctttatcggcgagtcattgctcaccattttactggttgcggtggcgttgatgtttccgctcctgatcccccattttgacggtaatgtgtcgaaagaatatctgatcattctgctgtacctcatcgggccgcttaacgcggtgatgtcggccatgcctgaactcatcaggctgaaaagcctgatgaacagtatggtgatgttcagtcagtcgattcagaccgactctcctgccgggacaatgccgggaattcaggacgtgaagacgcttgaactgtctgcggtgcattttcactatccggccacgggaggagaatgcttcggtgtagggccaatttcattgaaagcggaaagtgggaaaagctatttcctgaccggtggcaatggctcgggtaaaagtacgctggctatgattctagcaggcttgtatgtccccgcccaaggcacgataaggataaatggtgaagaggcttcccagtatcaactattggaacacacgcgggcaatcttcagcgataactggttattcaaacgggtttatgaccctgcgttattgccgttgcgggaggctgtcaaccagaacatcgcgttgttgggattgacgcaaaaagccacgcttctgagtgatggtgcctttgacaacatcaaattatcaacaggtcagcgcaagcgtctttcgttggccatgctgttggccgatcccagccctctggtcgttctggacgaatgggcggcggatcaggaccctcgttctaaggcccgattttacaaggaatggcttcctatgttgaaagcccagaatcgtatcgtgtttgtcgtgacccatgatgacgaatatttttcggaagcagatgtcctgatcacaatgaaaaacggtcagctcattgagttaaaggaagagagttatgcttaa

SEQ ID NO: 5479 - DNA, 6498 bp, Xenorhabdus bovienii
  Coding DNA location: Contig name=SeqID_16908; Position on contig =50394..56891bp; Strand=-
atgaagcgtgaatatacgggtagtgaagtcgctattattggcatttcttgcagatttccccaaagttccgattggcggaatttctggaacaatctactggccggacgcgagctggtgtcatttttctctcgggaagaactcttagctgtcggcgtgccgtctgagatcatcgatcttcccaactacgttccggctaaagcctcgcttgaggatgctgagtgttttgattatgaatttttcggctactcacagcgggaagcgcggaaaatggacccgcaactgcgggtgttgcacgaagtcagtttcaacgcctttctcgacgcgggtttacccgttggtgaggcgatattaaaggcaggggtgtttattggttccacgctgaatctggcacgactggagcaatttgcgggagccagtcaggatatttcagaaatgttcgatgttggcaactataacgatccggcttcgttcgcagcgcaaatcgcttatcgtatgaaattgaatggcccggcggtgcacgtacaatccgcctgttcgacgtcattatccgctgtccatctggcttgcaaggcgcttttagcgggtgagtgcgaaatggcgctggcgggtggcgcatgtatcactgatccggtggcaggcggttatttacatcaggatgggatgatcctgtcgccggacggccactgcaaaacgttctctgatgacgggaaagggacggtgaacggcaacggcgtggcagtcgtgttgttaaaattgctggaagacgcgctcgcggacggtgaccccattcatgctgttatcatcgaatccggcatgaacaatgacggcgatagaaaagtgagctttgaggctcccagtgtgcagggacaggcggaagttatctcacaggtctatcggctggcggatattccgttttcgagtctgggcatgatcgaagcacacggcaccgctaccgtccttggcgatccgatagaaattcaggcgttgaataatgttgcgcgggaactgctctcgccggatgaactccagcaattcagctgtgccgtggggagtgtcaaatccaacatggggcatctggatgccgccgccggtattgccggactgataaaagccgctttgagcgtccgttttggtaagattccgccttcgttacatttcaataaacccaatccacatctggatctggacaagacgcccttctgggtgcctacccaagccaccgactggccggcaaagcaggcgattcgacgcgctggcgtcagctcattcggtatcggtggaaccaatgttcacgttttgcttgaacagccgccggaaaccgtaggtaaagacgcttctcaccggaaatccgcgcaaatactgccgctctcagccaaatctcccagtgcgctggcacgattagcagcgtcttattccatccacctcagcctgattaatcagggattagccgaagaagaaacatcaaaccttgaagtgatcgcccggcagctacaggaaaaccgaaccgaatatccttgtcgcgccgcttttattgccaaccatcgcgatgactggcaacagcagcttgataactggacgctgatggagggcgcttatgcaccgatggcagagttagtctggttgtttccggggcaaggttcgcaatcgccggaaatgggcctgcgtttggcggctgaatatccggagttcggtgacatttatctggggctgctggataaagccgcggcactgttatccgttcaaaaagcggcattgattgatcaacagacattaattgacagtattaggcgacctgaacaactgtcaaccctttatctccagcccattttatatgcggttcaggcagcgttgggtgtttggctacagaaactaggctgtaaacctacggccttgttagggtttagtctgggagaattcgctgcggcagctatcgccggtgtgttcagcatcgaagaaggaatggagctggtggttgcacgggcagggctgatggattccatgccaaaaggcgcggtctttgctgccagtcgcaagagcaaaaatagcaaggaaaactttgacggtgattttccggcgatgcttgggtgcatatcagaactcagcccgggaacgtggacactggcgacagaggagggattggtcgcagacgcagagaactggctgacgcagcacggctttgctttcaagcgggtggcggtttctcacgccttccatacaccgatgattgagccagcggcgaaagcgtttggtgacctgctgaaaagttatgatctgcaacccgcgcagtgtgctatctattcaaccgctttggggcggaaaattgaggcggatgagatgtgcgacccgcaatattggatcaatcaaatgctgtcccctgtgcaattgggtgctgctttaaagcaggtggctcaggagcatcccgagtcactcttcgcgcaaataggggttggcatggatttgttgcagcacacgcgtaaatggctgcatctgaatggggagagatgggttccgactttaggcacgggcggcgcggatcacgagataaattcaacgttgcaattcattgccaaggtctggatacagggcggtggcattgattggagcagaattcatccgcagacatccatcgaacgtaccataacgaaaacgcacctgcccggtcacgcttttgaacgtcgggtttgtctgccacaagcgagtacaaaagcggctcagacaatttcatctctgtttttcggttcgcattattacgggctggagtgggaaaaaatcaactcatccacgccggagaacgccgcccaatcaggggacacgccgacaacttggataatttgcccacaggttcaggaaagagaacgtcgtctggctgaggcgctggaactgaataaccgtcaactgacgtttattgagagtgcgaactggcggggcagcgacgccaacctttatgctgagctggaaggctggctgttgcagcaagggctggcagtgtccgccgcgatggatattattgttaccggattgctggatgatctggatgcacggcaggcggagttctgggcgttctggctgccgactgttctggcgagatggagcacaactcagcatttttcaccgaaaatacgactgttctttccttcgactgaaatggcggcatggaagggttcggagacgctgaatgcagaaaaaaaccagcttctggggccgctgctgatcctgccggaagaataccccaacattactgccctctgcgtggatctggaaaattcggaggtagagaacgttgcccgtggattacaaccttggataaatcaggactggcatggcggtcaattctattgtttccgccagaacgatttttggcaacggcgggtaacgtcgcaagtgcaaaaacaagctttgacgcacccactgccggacatcagccgagatagttgggtgcttgttactggcgccaatggcggcatgggcgcggctatcgccgaacatttagcgcaggtttatcattgtaatctcttattgttggtgcggaaatccctgccgaaaaagcggggttggccgatggagattgaaagcaacggttcccacgcgaaatttctgcgctgggtgctgaaccttgaagccaagggaagccgggtagagttattgcaggcggatttgggcgatgacgaatctctggcgcaagcttttgcccccgtattccaattggctgcgcggggagaggggatcgattacgtgttccataccgccgggcgcggagagggcgcgatgttgcagatgcgttctgaggcggaatcgattgcaacgctggcgcccaaggtggcgggaacccgcttcctcagcgataacctgagtagacttggcaatccggcgctgttgctgttctccagtctgggcaatttgctgcccaaggaaaagatcggtcaaatcgcttatgttgccgctaacgcctgtctggaagcctacgcagatcagatccgccacaaaggcggcaaagcgctggctattgcctgggatgattgggctgaatcaggcatggcgacccgctccgcgcaacaattggatcgtgcgcttaaaaatccggcacaggacacggcgcccgacgccccaatttggctacgtcggctgtgcgccaaggacgactggtggcttgacgagcaccgtatcgatgcagcgactgctgtgatgcccgccatgggaatggtagttctggtacatcgcgcgttgattgagtggcaagcggtggcggcagaggcattctcattacaggagatcgccattgagaggccgttggtggtggctaacgacgcggagcttgatgtcgcagtgatctttgcggacgacttgaacgcctttgagttattttccggcaatggcaagttttcccctgaaacctggcttaaacatgccagcggtaaaattaaataccgtgacggtcatactgcactttctggcgaaaccgtttccttaaaaacccttccttcccagccgccgctcctgaacctgtttagcgccaaagataacatcggcgtcagcccgaaaggggcgctgacattcggtccccgctggcaaaatgtgatcgcggttgatcagaccggaatcaatgaagtgttgaatctgttacagcttcccattacctatcggggtgaagcagaagcctccggtcttcacgtcgcgttgttggacacggcgaccctcattgcctctccggagcatgaagatggacagtttgcccccatctcaataggggctttcactcaattcgcgcccatgtgcgacagagtgaaaagccacgtccaaattcaggatctgggtgccaacaagttattgcaggtgaatatttattctgaggaagacaatctgttagtggcaatcagtgatttgttgctggttgatgcatccgctgctttgcaacacaccgtcatgcgcttgaatgccagagacgcaggaagcgtcgatttttcttttagctcacaatctgaaacacgcaaagagcctggcccgctggatgtggaaattcaggttaaggcggcgggactgaattttaaggacgtgttgattgcgctcggcgtattgccggcccctgccgacccgaccatgacttttggccaggaggcggcaggtattgtcacccgcgttgggcggcaggttaacggtattcgcgttggtgatcgcgtgatgtgtgcgggacatagctgcctggctgaacacgttattatgccgcagcgcgttgtcgcacctattccacggacacttggctttcaacaggccgcgggggttccggtagctttcaccaccgcttggattgccttgaagcacgctgccaatctgaaaaagggtgaacgtatcctgatccattccgcggcggggggtgtcggcatggcggcgatgcagattgccctgtatttaggcgcggaagtttgggtgacagtgggcagcgaagaaaaacgccgattgctcagagaaatgggtgcacaaggcgcagcaaattccagaacgcgagagttcggtgatattttccgccgtgagctgggagatcggccttttgatgtgatcctcaatgcgctggcaggagaattgctggaagaaagtctctctttattggcgccgcaaggccgatttctggagcttggcttacgggatatcctgcaaaactggcaactgggactgtctatttttgcggaaggcggcagcttccacgccgtgcaggcgggtgccgaacatcccgcttatcaggaggcttgggctgaggttgccgcactgttggaggacgaggtacttaagcctttgccgacaaaagtttatcccgccaaagagatcactgaggcatttcagttcatggctcaggggcgacatatcggcaagattgtcatcgcgatggaagaacgcggcaaagcacttagcttcgtagaaaagctgaaagcagagggattatccaatttagaaggaacgcagatagccgtggcgatggcggcgcttgtcggtcaaaccaaattgccttatgtcgctgtttctaaacttcccatcggctcagttttagaaaagcaacggcatactcagcagatgttattcagttctggctcaacgcggaatgcgccagccgtcgtcgatggagacgcagacggatcgcttaagggcgcaaatgcggacgatttattgcaggctatgcgcactattctggaaggatttctcggtgttgacggtctggacgtgggcgccagtttcttctccttgggggcaacttcgctggatcttattcaattcgccaaaagactggagcaacggctggagcgggatataccggtagcgctgctgtttaaggccgcctctttgcgggaattgagcaaagagctggcaccggagcaatccgttgcagaagaaccgcagatgccgcaacaagggctgggagataaacggcgcacgttgcaggctcgtcgcaaattacgcggcgttgtgtccggtgaggatatgcccggtcaggggagtgaagacaatgagtaa

SEQ ID NO: 5480 - DNA, 3330 bp, Xenorhabdus bovienii
  Coding DNA location: Contig name=SeqID_16908; Position on contig =56888..60217bp; Strand=-
atgatgcagccctattattccgacaaacccaattatattgaagaattactacaggtgacgccgcaagcgaacggcctgctgtttcacgcgttgaaagatggcaacagtgcctatcatattggcgtggcatttagtctgaaagcggacgtcagtgaagaagtgattcttgatatctggtatcagatacagcagtcacaacccgctctgagggcggtttttacctgggaaggcattcgtgttccccatcaggcgatatacgcattaccacggataccgcttgaatatatccacgttgactcaactaccccgcaaccgtcgctcgattggctggcacaatcgaaagcgacgccgtttgagttggatacggaggtgtttcggatcatttgtttccacgatattaacgcggggatcttaagagtcgctttctcttttcaccatattctgatggatggttggagtagctcgctgctgatttctctctggctacagggattgcgtcagcaaaaaatcgttcctctggctgcacggctttattcgcagcaactctggaaagggctaagccaagaagaactgaggctcagtcgtgaatactggcagcgtgttttccaatacctgccagacggagaaacttcggcgacgacaaaactgctggccgaaccgctgttccgttctgccgaacataccgcgattaagcataaggcgggagaaaaaataacagatgaaaaaatcaccgcgaactgcatatgggataaagaacgtaaagcggcgatagagttgatttgccgccgtgcaggtgtcaccccggcaagttttgtctatctgtgctgggcgctggtgctggccaagttgacctttcaaaaaaccgtcactttcggttgtacattttccggcaggggagcggcgttgacacaaaacgtcgaccgccaacctttgggactgtttacgaatacggtgccgctgatcctgacgctcgacggaaaatggcgtctggaggtggcattacgcaccgtttttcaagcgctgcaacagactcatcaacatgaaaaaacgcccccgctgttgataagagaagagacgaagatacgtgacgaactctatgactctattgtcgttttcgataactacccgatcgatgccgagttacaggacgccggttgtggtgcgtttctgacggacctgcacagtgaagagacgacgcactttggtttgactctgacggtttccggtgtggatcaatggaaagttgagttgagcgcgggggaaacttttgagggtgatcctgatgcggtgaatagggtgttttacgcgttcgaatctttggtggcagatttggttaaagggtctgcggatgtacgggttgaagatctggtgttaaaactcaacccagacggcgctgaagaagccgctttggtcatgggagaacacaatgcgcaaacgccggatatcaatgctttgctgctgcgcatttatcagcgccttaatcagtcaccccaagcaataagcctgatcgaagaccggcatcagatcagtaatcgcgagctgctacggggcgtttctgtcttgcaggaacggttacggggatcgggattcgttcccggcgatagagtggcagtccatctcgaaaagggactgttatccacccaagcgatactggcgatattgttcagtggcggcagttacttctatgtaaacccgaaagatccaccgcaacgcaaaaaaaatctgttggcgttggcgaattgcggcattgtcttatgtgatgcttccttgaacggggaacttgatactgacatcgggcgttacttgctgctgaatatcgaaacagagacaacatggctggagtccactggcgaaccgacgttatggcgcaatcggcagcctgaagatgagttttacttcattttcacgtcaggaacgaccggagcgcctaaaggcatctctatccgtaatgaatcagtggcgaacctgctggattggtttgtccgggaaactcacctgacgcctgcggatcgggtacttgggctgaccgatctgaattttgatcccagcgtcgaagatctgtttggcagccttgttgccggagctacgctgatctatccatcgcccaatgtattgttggagcggcaggcgtttatcgatttgctgcgggatgagtccatcacgctgattaactttattccgggtgccattgcccagctcattcaaggtgctcccttcttccctgctatgcgattgtggatcttcggtggggaagaattacctcaatggctcagggatgatttgctgcagcagggctacgccgtcagcaatcattatggccccagtgagacgacggtggactgcctgactgccagacaatctctcgctgcggaagtttccatcggctggccaattcaaaatgtcatcgcctgctgcgcggacgtcttcggtaagccactgcctgcggatatacggggcgagctttggattggagggcaggcggtggctcacggttacgccaccaatccggttgagtccgataaatactttgtcaaatacagtgagcaggctttttatcgcacaggtgacgcggtcactttttctcatgggtcaggttttaagtatctgggacgaattgacgatcaagtgaaagtgaacggtgttcgcattgaaccgcgtgaactggaacgtgctgttgaggcattggaggaagttaaggcttgttgtctgttatccgcgacggggcgggaaggaaagcggcaatggtgtcttttcgtcgatggccgcgaacagcctgccattctggagccccgtgtgcgggaacatatccgtcagcattttccagcgtcgtggctccctgcccttattgtggtggtagacggttttaaacgcaccatcaccggtaagatcgatcgtcagcgactgctggagtgcgagactcagcgacggcaaacgcaaactgccacggatcatgtgccgttgaccgattctgtagaagcgaaaatacaggctatctggagcgcggttctggaaaacccggtggctgatgcaaacgtgaatttcttcgatgcaggtggtgactcaataaaaataatcgcgctgcaatcccaaatgcagcaggcgttcaaccagaaaatcggcgtcgccgtcttattcgaacacccaaccatcaccgcctttgcaaattggatcaaacagagcaacgtatctcctgaaaatacggaagccgaagtgatgctatctgattctggtaagcaactatcccaagaaaatactctgtcgtcggctcgctcaggtaaaaacagactggcggacaggcggcgtaaagtgaaaggaagttcagtatcatga

SEQ ID NO: 5481 - DNA, 1239 bp, Xenorhabdus bovienii
  Coding DNA location: Contig name=SeqID_16908; Position on contig =60220..61458bp; Strand=-
atgagaactgctatcgactcagcgaagacggtatttttattccccggtgtgggcgcacagcaacccgatatgtttgccgaattcagagcctatcccgaataccgagcctgtttggaagaagtatcggatctgtctcaggttgatttatacggtgctatccatggcgagcggcgcgacactttaaaacaagtgcgcattgcccaactggcgctcacggcgactacggtcgccatcgcgggcatattacgtaagtactgtgggcttgttcctgagtttatgatgggacacagtctggggcagtatccggctctgtgctctgcgggttaccttgatttggcgacgctgaccaaagtggtgaacctccgctcggaagtggtggaaacctgctcccgtcattacgagcagggcgacatgtgttgggtgttgcaccttcctgccgacgttgtggtgcaggaagtggataaagccagaaaagacgatggcatagaattgtacgtatctgccattgatgcgtttgatcaggtgacggtttctggcgtcatggctgacattcgacgctttgcgccgcgtatggaagcgctgggcgggttgctttatccattgaaaatcggcggcccgtttcattcgcctttaatgatggaagccaaagagaaactggcggaatggcttgacttcctgcctggcacagacaagcaggggacgctgatctccagactggtctgcaacgtcagtggcgcggagttaccggctgaggatctcaagccatcaattttacagcatctgacttctcccgtgcagtggctgcggagtttgcagtatgccgcgcaaaacggcgtcacccgttatttggagatttccccgaaaaccgtattgagttacctgaatcagcgcgccggattgcccatgctgcccttgtgcgaacccgctgaaattttcactttcactgaggcattaagtactgcagagagccggctggaacggtttttcagttactgtcatttccatctttatagttccagattgcctgacataaatgatgcgacagcgatcgtacaactgcgtcaaatcagggatgcagtaacacaaaagataaaaggctcacatctgacccgtgaggaatgcggcttcctccatcagcacacacagcaatggctgaaaattatcgaagaaaaaggggatacctctttactggtagaaaagatgaaattgcaaagcctttttaatgcagtggggcgttga

SEQ ID NO: 5482 - DNA, 4653 bp, Xenorhabdus bovienii
  Coding DNA location: Contig name=SeqID_16908; Position on contig =61455..66107bp; Strand=-
atgagtaaaccgacttttgagctatcgcggtcacaacaggccgttttcaaaatggaagcgtttcatctgtccggttactcattttatttgggcggtgtggcgcgcttgagtggaaatgtgtcgctggatcaactggtatgggcggccgaaactgtcaggaataagcaggatgtgtgccatatcggattcgtcaacgatcctttagaaacggttcatccagaagttgttgattgggaaatattatggcggggaattcggcacaacacgcctcaggccgatgtggagcgagtggacttcagcaggcatccagaccccagacaggcctttgaaagttgggtggagcgtcaactgctggtggaagaggacttatcactcacgccgatacggatttttgcggtgcgtttccgacaggaacaatcgggatggtttgtgaaagcgcatcatgctgcggtggatggtgcggcgttggcgatattactagaacgtctggccgatgcgttggcgcaggaatcggggaaggtgaattcccctttgtactctattcacgccgagagagagcgggattacgagaattcccggcgtatggtaagggatgcggcgtattggcggacggtttttggtgaacagaatgcgtatggcgacacggcgtcagcccgtgccaccaaaatctcctgccgctacccaataggggattatcgtggattgaagccgcacgcgatgcgtgtacggatcgctttgagcgaagcgcaaaacgacatgctgcacaaattcagtaatcgcggcggttcagtctttcggctgtttttcgccgcagttgcctatacacaaatggtgattgaagacggcaatggcgctttattgcaggcacctatgctgaaccgttggagcgaagccgaaaaacagtcaatagccatgtcagtggctcccgtcctgatcccggtatttcgtgaggtaggggaaaccgtcgcggattgctaccgcaccctcaaaaaaagtctgcaaaaagccattgtgcactcacgctatgctccgggcgcccgttggggggatttcgcatcgcaggaatggagacagattgtgccggctttcggcgtttcctatcaaacaggcgtgtttcagaaaaccgtctcaggtgctgaagtggagattgaccatattcaggttgtggaggcgttgtttgccaccgtgcacatccacgatcgctttgagggtggtgacttcaagattgaagccgattttcgcaaaatctggtctttcgaccaatgtcatgcattcctgcaaaccgtcattgattatgcactggaagctgccgctgaagtgatggggcaacaagaaacgacaaggcaaacaaaagaaatcaacgtacggactgattgcctcgcagagccgatcggcattcatttatgtgacgcttttcagcgttatgccgataactggctgttcaaacaggaagctggtgatctgacctaccgtcaaggatggcagtggattcgcaagtttggtacgcaattgcgtgacaggcgggatcgacgtttcgaacaccgtccggtggtgattctgggaaggcgctcgcctgaaatgacgctcgcctatttgacctgtcttattgaaaatgtgaccgtggttcctgtttgtcctaccacgccgttggcgagattatcgactatcgtccgtaattcgggcgcgtctctctgcatttataccggagttgatcaaaaccttgcggcggcgctgaatttgcctctgttacgcgcttcgctggataaagatttatgtgacgcgggcttgcatccggaaatccagtcagaattcatacatcccgaacaagcccggtcacaacaaacagacagcaatcctgcttatattctgtatacatcagggtcaaccggagaacccaaaggcgttgtcatttcccctgttgcactggcgaactatgcgctggcagccaaaggggaatacgcttctgaggcgtcgtttaatgcacctttgtttacttcctttgggttcgatttgacgcagacagcgattctgatcccggttttgtcggggggatttatacaagcccacgaacaggatattcgcgataacccagaactactgcaaacccttctctccgatgaggcattgacgggagttaaatgtacaccatcccatctctcattattgattgaacatagcgcccagagacggaatccgctgacctttattgttggtggcgaaaacttgtccgtcgctttggtaaacagagcgcttggcttctttccttcgggcagcagagtgatcaatgaatatggaccgacagaggcgacggtagggtgctgtatttatttgatgaacgaaagtttgatgagcgaatctgatgagaacgacaaaacgagtgccgtgattgcgcctatcggtaaagcactggggcaagcggagatgtcgataagagatgcttgggggcaaaatatgccccgtggatttaaaggagaaatagggatcggcggttcagtgctggcggatggatatatcaacaaccgcgcgcagacggaggcaaagtttgtgtgtggcgccgatgggcgacatcgttggtatcgcactggcgatctgggcttgcaggatgaacagggaatattttattgccttgggcgcattgacgatgaattcaaagtgcgtggtcatcggattcatcctgcggaaattgagaaagccgtggcagaagtactggcggatcttggacgcgacggcgatgaccgtcgggagttgaaagcgttaaaactggccattgatggatatgaaacggtcgctttatgcagcagccaatctgtgccatacgacaactctgcattccagaaaaacctgaaaaacaaaatccctgacggttggctgccgagtctttactgtaccgtgcagccttggccgatgaatgccaatggcaaggtcgatatggcggcgctcaccgctgctgctaaagcaacgctggcggcagccgatcctgctcagtttcgtgcaaccgacaggcaaggtcagacagagccggaagcctactcactcccggcatggctggatgccgaatttttaaggccgatttggccggaaaccgtggatctgtccgcctcatttttggcacaggggggtgactcgatcaaagcgatccgccttgtcgccttgctcgccagacaaggtattcgaatcggtgtaagtgaactgttaacttcaaccgccttaggaaccgtgcttgaaagagtctgcgcggaaaaaccggaagttgctgtgaccgacccggccgtatcggaagaaccagaagcaaactgggtgaactatttacccagtgttcgctggtttcgggaacatcactttaaatacggtgaacgactgcaacagggcgtggtacttgagttaccgccctccatttgcgccgggcgtataaacagcgcagttgcagcggtaaaagcaagacataaaatcttcatgttgagatcgaaccggagtttgagtgagttttatttttcgtccttggaaccggaacaacataacggcgatatgttgttgcaagatcacgtattggcgccagacgaaagccttgaggacagactgcacagattgcagggagaagtttgtctggaaaaccagcccagtgtgcatgaagtggtattggctccggttgcgaacaaaaaatatctgatctgggtttgtcatcaccttatctgcgatgtccattcatggattttcttactggatgaattggatcaggtgctgaacgaatcggcggctcagcttaacgttgataaagctaatgttgataaagccagtgctgctgttgagcagggtgcattcctttgggggaaatggctgcgggatcacgtttctcatgctgaatctgcaccccatgacgatgctttttatcagccggcagccgttcccgtcacgctggcgctgtcagtttctagcgagggtttccggcttatggaacaacgctacaaagctgaacgcacgcagttgatcgccgctgctttgctggagatagtgcaggataacggcatgttaccggagcagcttgcggtgctgtttgaaaaccacgggcgtttattctccgaagcagaaacacctgctgtctggcatgcagcgatggcagattccgtcggttggtttactggcttcaatcaacagaatctccacgttcccctagaccatcaaagtggttttttacccggtttctttttacggacattgaaatcacgccagtatgcaaatagctcagactggaaagaacaactgggattgaatggcgtgcggacacggccggttatctgcatcaacgatattggcttcgggctgagcgaacgcggaacatggcgccattttaatctggttgattccctgtcgggtggtttccggtatcccgacgaaaagagtgtggctgattttgatgtgcttattcacgacgatcgcgaatccagttctgttttcgttgagttgaggttgggcattcccggagctggcgccgatgatgccaaacgctacctgatgcaattaaacgaaagactatcagtctggaacgatgcgttacatcgcgcgcaagtggaacctatgttgatcccggcggatttccccctttgtcagctctcacaatcggagctcgatctcattattaatggagcctcagcatga

SEQ ID NO: 5483 - DNA, 1671 bp, Xenorhabdus bovienii
  Coding DNA location: Contig name=SeqID_16908; Position on contig =66100..67770bp; Strand=-
atgagatttgaacaaatccagcactcagaggatgtcggcatcatggcaactggtcgatttattactgattatttcgaaagtacggcgagaaataaccagaatccggcgatacggtggggaaaagggaacgttttatcctgggcagaactatacgaaagggcgcaacgactggctcattatctggttaatgagcgcggtgtatgtcagggcgattgtgttgctattggccttgagcgcagcccggaatttctggtggcggcatatgcggtactgcttgctggtggcgtttattttcctgtggaggcgaaaacgcctgccgctcggttgacgtctatgtttgcgacggctcaatgtcgtatcgctttttgcaatgtggcacaggagagtctgtttactcaggccaaacccggattggaactgatcgggcgtgaatttctgacagaaatattcacctctcattgtctggatgaccatcggctgagttttcatcattcagaaagcgcgggcaaaaaagcgcgtcaacgacgggctaccgatccggcctacttaatcttcacttccggcacgactggcacccccaagggagtgctggtcaatcatggcgccttcattaaccgattacagtggcatcaggctcatagtgagatgacggatgcggacattatcttacaaagaacggcgttgacgtttgatgtgtctttatgggaactctttttacctgccctgaatggcgcgagtaattatctgctgcaaccgggattggaagcattccccagaggtatagtcgctgcattgataagcgaaaatattacggttgtccacttcgttcccagtttgctgaagcccgtactgcaagaactacaagagcttcaggatgatagtgctgaaacgccatcgttatcggcgctgcgcagggtgtatgtgagtggagagtcgttgccagccagtctggtgactcaatttcagaaaatatttgcttcgcgctgcctgttgaccaatttatacggccccacggaagctgccattgatgtcagcttttatgactgcgtggaaaccgtgtcggacgccattcccattgggcagcctctcactggatgccagttatatatcttggaacccgacagtctgacgttaaaagcggattcgaaagaaggcgaaatcgccatcggtgggatatgtttggcagagggctactacaaccgaaaagatctgacggataaggtattcatcttccatccagaacttcagcagcgactatacctgaccggtgatcttggttggcatgagaaaagacggggctttttctgtcagggacggaaggatacgcaagtcaaattacgcggattgcggattgagttgggagaaatagagcaccatctgctcaattacccttctattaccgaggccgttgcttgcgtggttgaggatgaagatcaggaacagtggctggtcgcggcgattgttgcaggcaaaagggggcttaatgagcaggatattcgccaatttctcgctgtgcaggtgccggcttacatgttacccactcgttattggcaagcccgaaatctgccgaggtctggctcaggaaaacttgacagaaaaacgatagcccaaaatatgcgggatctgtttttcaccgatcatcacggagttggaaaccttatccatgagtaa

SEQ ID NO: 5484 - DNA, 1164 bp, Xenorhabdus bovienii
  Coding DNA location: Contig name=SeqID_16908; Position on contig =67866..69029bp; Strand=-
atgcttaatcgttttttgtcacctttgcaaaacgagtggttacagacatttgagcaattttcagcgactgaaatcgcgccttatgctgacgaatgggatttagcagaagcgattcctgcaacggttgtgcaaaaacttgcacataacggttggctggggggactggcaaaacccgagagtggtggtctggggtttgacgtcacgactttcggattgctgaacatggccatcggcgcagggagcggttcgctcacgggtttgctgaatgtgcattctatggtgttgaaaaccattgaagattggggttctcaagatcaaaaacaacgctttttggcaccgctggtaaagggtgaaataattggtgcattcgcgcaaacggaagtttccgctggcggagattccaaaaatctgtcaactcagtttgaagaagacggggattatctcagtgttaatgggcaaaaggcttggattactttcgcccagattgcggatttatttctggtattcggtaaatatcagggactggataccgcagtgctggttcctaaagatactccggggctaaaagtgaccgccaaaaaaaatatgctgggcttcaagagcgcatatttggcggtgttggatttcactgattgtcgggttcctaagaccaatatcgtcggaaagcccggattcggacaaaacctaatttctaacaatgccttggactatggccgcatcagcgtggcctgggcggcgcttggaatacagcaggccgcattggcggcatccgctcgcagggctaactcccgcgccacctttgatacgttgcttgcggatcaaggtatcattcgcggctatctggcggaaatgtccagtagcctgctggcctctcaactcatttgcttatcagcgacaaaagccaaagaaacaagggatgaagacgctcttgagcagatccttcaagccaaacttttctcatcgcatgaagctggcaccgcagcagcgaaagcggtacagattcacggtggtcacggttgcgatgaaagcaacggcatcagtcggctctatagggatgcgaaaatattgcaagttgttgaaggcagcaatgaacttcaaaaaatgctgatcggcaaagcagtatgcaatcggtacagccataacgtcgcgcagactattccataa

SEQ ID NO: 5485 - DNA, 252 bp, Xenorhabdus bovienii
  Coding DNA location: Contig name=SeqID_16908; Position on contig =69022..69273bp; Strand=-
atggacgtatctgcgcgtaaaaaattagtgtctgaatacctgtgcaaacttgctggcaaacaggatttagacgattcggtcaacatcttcgaaacaggcttggttaactctttggccgctatccagctaatctcctttctcgaaaaaaacttcaaaatcaaagtcgaaattgatgaccttgataatgccaatttttccagtattcaggctgtctgccactttttggacagaaaggtggcggtaaatgcttaa

SEQ ID NO: 5486 - DNA, 108 bp, Xenorhabdus bovienii
  Coding DNA location: Contig name=SeqID_16908; Position on contig =69554..69661bp; Strand=-
atgcggctttcactcttcaggataatatattgtcttaatttcttgatataccgacgtaacctgtgctacagcctaattcaattctatttatacccccacaaaaaatga

SEQ ID NO: 5487 - DNA, 162 bp, Xenorhabdus bovienii
  Coding DNA location: Contig name=SeqID_16908; Position on contig =69678..69839bp; Strand=-
atgttaatttattgtcaagccatggtattattatggcattggcatatctacggaatcgagatgtattttaaggtgcataagggtcttcttctaaattttctatgtattatggcagaattaaatgtttcgttattacgtttaattctggctcatagcaaatag

SEQ ID NO: 5488 - DNA, 1239 bp, Xenorhabdus bovienii
  Coding DNA location: Contig name=SeqID_16908; Position on contig =70050..71288bp; Strand=+
gtgagaattatctgttcagacaacagtaaactaggatttagttcccctgattgctttcatcaagatggagaaccttttacatttgcgcatttagtaaaaagaagtcctaatgctttaggaggtgataattatattgctaatgtagcatctaggaataaaaagttggaagaggtaaattcatctgatataatttcaaaattcaaactgcaaaattttctagaaagctttgcagtttgtgatgaaaaagtgagccattatgtttctcatttaactctagaagagaagactggcgaatcctataggtgcatgatattaattgacttttcttttaaaaaaacagagcatagaatgaaagattccttatcggtaatcgtaattatcgtctcattgctaataattggatttttccttggaaaaggaataaaaactaatactagagattatctagtaagtttaatatcaaaaatagttattatccttttattatgtatgggcattgaacttggagaggtttttaataatacaaatgctggtgtgtcaatagttaaaaaatctataattttggcttcattaatctctttatctactttttttctattcataaaatacagagaaaagaataaatctggttataataaaccaaacttcaagaagcctattattagctgtgcagttgccatgctttctttcattttaggtgtcttattttattcatatactaaaatatcactgcatagcataagcttatctagtaactatgtactctatttacttatagttcttgttggaatggatttagtaaactttaaacttagcggaataaaatttgacgcaataaaaataccatttataacaattttaggaactgttattgctgcagcaatattttctaaaatatataactactctttaatagagtccatgttagtatccagtggttttggctggttctctctttcagggccgatgataaatactctggcaacccctgagctaggagctctagctttcatgactgactttttcagagaaataataagtattacttttctttattttatgggaaggtcacaaccacaaggtggaataggtatttctggagctgctgctttagattccgctcttccatttatcaaagaaaactgtaaaccagataatataaaatatgcaatagttagtggttttatattaactttactagcacctttactaatctctttattagcaagcttattatag

SEQ ID NO: 5489 - DNA, 228 bp, Xenorhabdus bovienii
  Coding DNA location: Contig name=SeqID_16908; Position on contig =71352..71579bp; Strand=+
atgatatatcacaatataccaataaaatttctctattcagagagaaggaatcgataccattttgaattatatttaaggaatagaatgcttcaagaagaaattgtaactccaaagtcccaaaaaacacaaacgacacaaacgacacaaacgacacaaactttacgtcgtgagctaaaatcacgacatctcactatgatttgtttttcaaccatcagtaacggcttgtaa

SEQ ID NO: 5490 - DNA, 180 bp, Xenorhabdus bovienii
  Coding DNA location: Contig name=SeqID_16908; Position on contig =71701..71880bp; Strand=+
atgctatctgctggcgctaatccgtcatttattgcaacacagatggggcatgtttcatcacaaatggttcataacgtttatggcgcatggatgaatgaaaatagtgatgaccaaattaagctgttaaataaaaagctcacgattgccccatgtatgtcccaagtaattaatgaaaattaa

SEQ ID NO: 5491 - DNA, 312 bp, Xenorhabdus bovienii
  Coding DNA location: Contig name=SeqID_16908; Position on contig =71911..72222bp; Strand=-
atgtcaattcaggcaattgaaggtgtactgcaacagatgaaggcacaggcattacaggcaacgaacattgccaaacccatgccagtacagggaggttttgccagccaccttaccgccgcagtagaaaaaataaatcaaacccgtctgtcggcgactaagttgtctcaggattttacgttgggtgtgccgggtgtggaattgaatgacgtgatggttaatatgcagaaatcgagcatttcattgcagatggggattcaggtcaggaataagctggtcagtgcatatcatgagatcatgagtatgcaggtgtga

SEQ ID NO: 5492 - DNA, 111 bp, Xenorhabdus bovienii
  Coding DNA location: Contig name=SeqID_16908; Position on contig =72401..72511bp; Strand=+
atgatgggattaatagtaggaagaatcttttcgcttgcgtatggggagtctgttttgttacgccacgcttttagtattcatgttgaccagcaaggcaaggatcgtctatga

SEQ ID NO: 5493 - DNA, 1710 bp, Xenorhabdus bovienii
  Coding DNA location: Contig name=SeqID_16908; Position on contig =72508..74217bp; Strand=+
atgagtgcagcaacaaccgacgttgagaaccaaaataaaggtttcagcgctatcatcagcaagataaaaactgatccaaaagttccattattagttgctggctctgctgccatcgctatcgtagtcgcccttttcctctggatgcgcagccccgattaccgggtgctttacagcaatctgagtgataaagatggcggcgagatcgtcacgcaattaacccaaatgaatatcccttaccgttttgctgaaaacagctctgcgctcatgatacccaccgataaggtacatgaagcccggttgaaactggcacagcaagggctgcccaaagggggagcggtgggctatgagttattggataaagaaaaattcggcatcagccagttcagcgagcaggtaaattacaatcgcgcaaaggaaggtgagttaagccgtactattgagtcccttgaccccgtcgagagtgctcgtgtcattctgtccatacccaagccttctctattcgttcgtgaacaaaaatcccctacagcttccgtaacggtaagattactgcaaggccgtactctggatgagggacaagtcaacgccattgcgcaccttgtttcaagcggtgttgccggtttaccgccaagcaatgtcaagattgtggatcagtcggggcgcctgctgactcaagccgatgccaacgggcttgatttaaacaccactcagttgaaatacatccaggaagtcgaaaaacgtttccagaatcgtattgaaaccattctgacgccggtggtcggccgtggcaatgttcatgctcaggtcacagcccagcttgatttctctcgccgcgaacaaacggcagaagagtataaacctaatcagccacctaatgaggccgctattctctctaaacagagcagttccagcgaacaaagtgggggatcactggttggtggcgttccgggtgccttatcgaatcaaccgagtgcagcaccaagcgcaccgattgagaaaccaaatccagacacgaaaggcaaaggtgacgaaaaatccgaccagaatcgcaatagcacctataacaattatgagcgtctggtgaacaacagccgcaataaccgtcatgacgaactgattaactatcaagtcggtaaaaccattagccatacccaattacaggtaggcgcagtagaacgtctttccgttgccgttgtgatcaactatgccactgctcagggagaaaatggccctgaaacaaaagcactgacaccagaacagttatcccagatcgaagcactgactcgtgaagcaatgggcttctcaactaaacgtggcgatagcctgaatgtcgtcaacacaccgttcaacgatacggctgaagtgatagaactcctgccgttctggcaacaccctgtcctgctggaaaaaacgttagagttgggccgttggttactgttggcactggttgcatggctattgtggcgcaaaatgatcgtgcctcaaatcgccaagaaacgtgcggcggaaaaagcagcacttaacgcgcagaaaaatcaacagaaacagcaagcgccagaatccaacgcagaactggatgaaaaagtgcgccgtaagctggctcgccaacgagtcaatgccgagattcaaagccagcgtatccgtgaacttgcagaaaaagatcctcgcgttgtcgcgctggtgatccgccaatggatgagtaacgaacaatga

SEQ ID NO: 5494 - DNA, 993 bp, Xenorhabdus bovienii
  Coding DNA location: Contig name=SeqID_16908; Position on contig =74214..75206bp; Strand=+
atgagcctgaccggaacagaaagaagtgccgtcatgttaatgaccctgggagaagatcaggcggccgaggtgttcaagcacctgaattccagggaagtacagcaactgagtatcgcgatggcggggatgaggcaagtctccaaccagcaactggctgaagtgctggcagagtttgaagaagatgcaggacagtacgcggccctcagcatcaacgccaacgactacctgcgcagcgtcttggtgaaagcgttgggcgaagagcgtgcttccagcctacttgaagacatccttgaatcccgcgataccacaacgggcatcgagaccctcaactttatggagccacaaatggcggctgatatgatccgcgatgaacatccgcagatcattgccaccattctggttcacctgaaccggggtcaggccgccgatatccttgccctgtttgatgatcgcctgcgcaatgatgtcatgctgcgtattgcgacctttggtggcgtacagccgtccgcgctggctgaattgaccgaagtgctgaataacctgctggatggccagaaccttaaacgcagcaaaatgggcggtgtccgtactgcggctgaaatcatcaacttgatgaaaaaccagcaggaagagagcgtcattgaggcagtgcgtacctatgatggtgaactggcgcagagaatcattgatgaaatgttcctgttcgaaaacctcatcggtgtggacgctcgtagtatccagcgcttgttgcaggaaattaccaccgactccctgcttgtcgcattgaaaggctgcgatcaggcattgcgcgatcacttcctcaacaatatgtcgcagcgtgctgctgaaatcatgcgtgatgacttggcgacccgcggcccggttcgcatgtctcaagtggaagccgaacagaaatccatcctgcttgtggttcgtcgtttagcagaaaacggcgaaatgatcctgaatggtggtgatgatacctatgtctga

SEQ ID NO: 5495 - DNA, 723 bp, Xenorhabdus bovienii
  Coding DNA location: Contig name=SeqID_16908; Position on contig =75181..75903bp; Strand=+
atggtggtgatgatacctatgtctgataagtcgaataaggcaatttggcagccgtggcagccaaatgaattgactcagtgggaaacactacgggcgaaactggagcccatggacaacgagccggagcctagcgagcaggatcgtctgctggtgcaggccagaatgctggacgcgctgaaagagcaagcgcgtcagaccggccatgaacaaggctttacggcaggccaggcgcaaggttatgaacaagggatacaagaaggccgacaggcgggtctggagcaagggttgcaggaagccagacaacaacagcagattgttgttgaacagtggaaagcgttgctggaagattttagccattcactggatgggctggatacggttatcgcttcacgcctgatgcagctttccctcacagcggctcaccatattctggggcagcccgcagtgtgtgatggcactgccctactgaaccaaatccgtgaatttatccagcaggagccgatgttcagcggaaaaccacaactgcgagtccacccacagaatatcccgctggttgaacagcaactgggggaagttctggcattgcatggctggcgtctgattgcagataacaagctgcatccgggcggctgtaaagccagtgcggatgaaggcgatctggacgccagtttggcaacgcgctggcacgaaatgtgtcgtctggcggcgtcaggagaattgtga

SEQ ID NO: 5496 - DNA, 1365 bp, Xenorhabdus bovienii
  Coding DNA location: Contig name=SeqID_16908; Position on contig =75903..77267bp; Strand=+
atgactgcacgacttgggcgctggctggcaacgttagattcactggaaaaacgtctggaaaaaaccccgaaagtccgccgttacgggcgtctgacccgcgcgaccggtttagtactggaagccactggcatacagatgcctttgggcgcgacctgtctgatcgaacggcagaatggcagcacgattgaagaagtcgaaagcgaagttgttggtttcaatggcgaaaaactgttattgatgccattggaagagctggaaggcatagtaccgggtgcccgcgtctatgcccgttcttacggcgaagattcggctggcggacgtcggttgccactggggcctgaattgcttggcagagtgctggatggctctggtcgccctctcgacggctttcctacccccgatacaggttatcgtgcgctgttgaccacgccccctatcaacccactgcaacggacacccatcagcgatgttctggacgttggtgtgcgggccatcaattccctgctgaccgttgggcgtgggcaacgcatggggctatttgccggatcaggcgtcggtaaaagtgtgctcctcggcatgatggctcgctatacccaagcagacgtgattgtcgttggactgattggtgagcgtggccgcgaagtcaaagatttcatcgaaaacattttaggtgtggaagggctggcacgttcagttgtcgtggccgcgcctgccgacgtttcgccactgctgcggatgcaaggtgcttcttatgccacccgcattgccgaagatttccgcgatcgcggcaaacatgtcctgctgatcatggattccctcacccgctacagcatggctcaacgcgaaatagccttggctatcggcgagccaccggcaaccaaaggctacccgccttccgtgtttgccaagttacctgcactggtagagcgagcgggcaatggcgtcagtgatggcggttcgattactgcgttttataccgttctgacggaaggtgatgatcagcaagatccgattgccgattccgcccgtgctattctggatggtcatatcgtgctatcgcgctcactggcagaatctggccactaccctgccattgacattgaagcttccatcagccgcgccatgaccgcactgattgataacgaccattatcgatgggtacagcagttcaaacagttgctttccagctaccagcgcaatcgggatttgattaatgtcggcgcttacgccgcgggcagcgatcctttactggacagagcgattcagctttaccctcatatggctcagttcctgcaacagggcatgaatgaacgtagtgaatacgatgcggcatgtattcagcttcaacaattattgccgatataa

SEQ ID NO: 5497 - DNA, 447 bp, Xenorhabdus bovienii
  Coding DNA location: Contig name=SeqID_16908; Position on contig =77362..77808bp; Strand=+
atgcaacagcactcccctctcgtgactttacgtgaacttgctcaagatgcggcggaaaaagcggcaagtcaacttgcacagatccggcagagtcaccagcaaatggagcaacagctcacggcgttgacggattatcaggatgaatatcgtacacgtttaaatgacacactcagttgcggcatgtccagctcaacctggcaaaactatcagcagttcatgaaaacgctggaaatggcgattgaacaacacaggttacagcttacccaatggaaaaatcggcttgagcaggccatgtcacaatggcaggaaaaacagcagcgtctgaacgccttcgacacactgcaacagcgggcagagcacaatttgaagttacaccagaatcgcatggagcaaaaacaaatggatgagtacgcacaacgtggtgcacaacggagaatgaaacaatga

SEQ ID NO: 5498 - DNA, 1365 bp, Xenorhabdus bovienii
  Coding DNA location: Contig name=SeqID_16908; Position on contig =77805..79169bp; Strand=+
atgaacctcactcttttgcctactgatataaaactcacggaaaaaagtcagccgacgttgaatgatcccttggcccgtaacaattcttctgaatttgggcagcatctcgatgcagaaatagcctctgtgcggaagacggcggcccgggctgataaaaatggtctgaacaatgagaagcaccccagcgataacccaatcgaaggtgaattggcacccttactggctgtagcagacaacactgtaattaacgttggtggtaaaacgctggctgggggcaaaccattgacagaaatctccacaccggaaagcgatattgatttcgctgtgttgaaggatgaagatctcttgtctgctgaagctctggttgctgcaatgccaatccaactcgcaggattgatcaacgctcagtcgattcctgcggagggtgttgaaaacacagacgaactgctacgtggtgaaaataccggtgcggagactttactgggtcagaatgtaaaacctggcaagagtgcaaaagtcgatgctgcactgatcactacagatcgtactgaccacaccaaagatggcgaacaagataaaagtatccggtctttcgccacgcaagagactaccctgagcaacaacgcggaacaatcaaccaaaacacgtccaactctggctcccgttgccgggcaagtgaaactcgccatcaataataaagcagaacaaaactccgcttcccaaaataacggaaaagagttgaatcagttccagacagcgattcaggggatacccgcacgggtggcggccgcggctgaaacttcccagccagaatcacctgcgataccggctgcctctcccctgctttcagcgggacagcaaacaaccggtcaatttcagttaaacggcactcctgctccgctactgagtgcccatcttggcagtgaagagtggcaacagcagctcaaccaacatgtcctgttctttaatcgcaacgggctgcaacaggccgaattgcgcttacaccctcaagaattaggcgcactgcatatccgcatgaatgttgaagacaatcaggctcaactgcattttgtctctgcacaccagcatgtccgtacagcactggaagcggcgttacctgggcttcgccatgcattggcggaaaatggcatccaattagcacaaagcagtgtaggcggtgacactcagggaaactggcagcaggaacaggcgggcgattcaccgagtcattcccatcactctgccaaggctcatggacgggatccagccgccgtgacacagatgccaacgactcatgaatcagccatcaaaataacaccgcagcagctcgcttcaattcgcggaggtgttgatattttcgcctga

SEQ ID NO: 5499 - DNA, 153 bp, Xenorhabdus bovienii
  Coding DNA location: Contig name=SeqID_16908; Position on contig =79260..79412bp; Strand=-
ttggatttgtgcgtttacgctcgtagctataatcagacatggacagacaaattcctgttttccgttgcggataagttcccgcgcattccgtggcgggtcttcttatccatcaaaatcgatatcaattatcccgcgtctttgttccgccaatag

SEQ ID NO: 5500 - DNA, 477 bp, Xenorhabdus bovienii
  Coding DNA location: Contig name=SeqID_16908; Position on contig =79373..79849bp; Strand=+
atgtctgattatagctacgagcgtaaacgcacaaatccaatttggataatactgttaatactgattgctgttcttagtgccgccatcggagggtatagctggtggacaatgaagcagccaaccaagaacagcaccgaaaaagccaaagtcatcagtaccccggtatttatgacgctggagaattttaccgtcaatttgatcgacaacgaagaccatattgaccgtgttttacatgttggagtgacactgcgcctgcctgatgaaaaaacccgtcagcgcttccatgattatctgccagaagttcgtagccgtatgctgctattgttatcccgtcagaaagcgatagatctggcgaacgatgacggcaaaatgcgtttggtggcagatatcaagcagacactgcgcccaacgatgatacccggtgagccagatcaagtggtcaccgatgtgttgtttaccacgtttattttgcgataa

SEQ ID NO: 5501 - DNA, 1008 bp, Xenorhabdus bovienii
  Coding DNA location: Contig name=SeqID_16908; Position on contig =79855..80862bp; Strand=+
atgagtgacaatattctttcacaggcagagattgatgctctgctcaatggtgacagtgccactgccgatgacgtagaacccactgcgtcaggggagagtgagattcgaccttacgatcccaatacgcagcgtcgtgttgtacgcgaacgtttgcagtcactggaaatcatcaatgaacgttttgcccgtcaattcaggatggggctgtttaatatgctgcgccgcagcccggatattacggtcggcgcgattaaaatccagccttatcacgaattcgcccgcaacctggccgtgccaaccaacctcaatctggttcatctgaaacccttgaggggaaccgcattattcgcttttgaacccagtctggtttatatcgccgttgataacctgtttggcggtgatggccgttttccgaccaaagtcgaaggccgtgaattcacctataccgaacagagagtcatcaaccggatgctgaaactggcactggatgcctaccgtgacgcatgggattccatcttcaaaattgaagtggaatacgtccgttccgaaatgcaggtgaagttcaccaatatcaccacctcaccgaacgatatcgtggtcacgacgccgtttcaggtggaaattggtgcactgtgcggagaattcaacatttgtattcctttcgccatgattgaacctctgcgcgaacgtctgaccaatcctcctgtagaaaatgcacgtcaggaagacggccagtggcgtgaaagtctggtgaagcaggttcagcattcagaattggaactcgttgctaactttgttgatattcccctgcgactgtcaaaaattctccaactgaaacgcggcgatgttttaccgattgagagaccggaacgccttatcgctcacgttgatggtgtgcccgtgctcaccagccaatatggaacactgaacgggcagtatgccctgcgtgttgaacacctgattaaccctgttttaaatgctctggatgaggaaaagcccaatgagtga

SEQ ID NO: 5502 - DNA, 432 bp, Xenorhabdus bovienii
  Coding DNA location: Contig name=SeqID_16908; Position on contig =80831..81262bp; Strand=+
atgctctggatgaggaaaagcccaatgagtgatgctaaacaacccgcagaagccagactgactgaagatatgtgggcagaagcactggaacaacaggccgcacagcaaacctctgacagcggcgcgtcaatatttgagaacctggagccgcaggacgcgctcgcccagctttctgatattgacctgatcatggatattcccgttaagctctctgttgagctgggacgcactaaaatgaccatcaaacaactcctgagactgtcccaaggctcagtggttcctcttgatggtcttgccggtgaaccactggatattctgatcaacggctatctgattgcacaaggggaagtggttgtcgtatccgataaatacggtatccgtatcacggatatcatcacgccttctgaacgcatgcgtcgtttgagtcgttga

SEQ ID NO: 5503 - DNA, 498 bp, Xenorhabdus bovienii
  Coding DNA location: Contig name=SeqID_16908; Position on contig =81265..81762bp; Strand=+
atgatggcgaaccagccttccctttatgcttcttttcaacatggtgcagcatctgatgctgcaccggttaacgcaaaagctaataccctatctgcgaacacggtgaaacccgcagccagtccagaacccctccccgccagtcagacactaatgcaggtcagcagtgcactaggtggcatcctggtgctgatttttgtcatgacatggctgattcgccgtctgggtcttgcccctgccaagaacaaaaatcaccggctgctcaatgtgaaagcgagttgctctcttgggccaaaagaacgggttgttgtgctggagatcgaagacagttggctcgtattaggcgttacaccccaacagattaatgtcttgcatcagatgcctgtgccacctgataacgcggaaaaggaaactgcactcaagacgttaccctttagtcaaatgttaaaaaatacgctccagcgaaaaagcaagaacgacaaggatgacgatgaaaaatag

SEQ ID NO: 5504 - DNA, 810 bp, Xenorhabdus bovienii
  Coding DNA location: Contig name=SeqID_16908; Position on contig =81752..82561bp; Strand=+
atgaaaaatagcgttttctttatgacaggcactccaatgactggcaagaaatttgtttctctactccggcctgtgcatttagcaaccctgctgatggcgcttttgttgccgctatttcccatgaatgccgcggccgcattgcctggcattatcagccagccgatggcaaatggtgggcaaagctggtcactgccggttcaaaccctagttttcatcacggcactgggttttatccctgccgctttgctgatgatgaccagctttacccgcatcatcatcgtgcttggtttactgcgtaacgcactgggaacaccttctgccccacccaatcaaatcatgattggcttggcactgttcatgacttttttcattatgtcgcccgtattcgataaggtttatcaagatgcttacttgcctttcagtgaagacaagataagtctggaagctgcactggacaaaggtgcccagcctctgcgtcagttcatgttgcgccagacacgacaaaccgatctggcactgtttgcccgtcttgcggatcaggatgcttttgaaacagcggattccgtccccatccgtgttctggttccggcatttattaccagtgaattgaaaaccgcattccagattggttttacgctcttcattcctttcctgatcatcgatctggtcgttgccagtgtcttgatggccttggggatgatgatggttccccctgccaccatatcgctgcccttcaaactcatgttgtttgttttggtggatggctggcaattgctgcttggttcactggcacaaagcttttatgtctag

SEQ ID NO: 5505 - DNA, 132 bp, Xenorhabdus bovienii
  Coding DNA location: Contig name=SeqID_16908; Position on contig =82512..82643bp; Strand=+
atggctggcaattgctgcttggttcactggcacaaagcttttatgtctagcgaacagtttttatgtctagcgcgaaatttgcgtgaaatcctattggaacaagatcgaaaaagcggtttaaaaaaattatga

SEQ ID NO: 5506 - DNA, 270 bp, Xenorhabdus bovienii
  Coding DNA location: Contig name=SeqID_16908; Position on contig =82640..82909bp; Strand=+
atgactccagaatcggtaatggctctcggcattgaggcaatgaaagtggcgctggcgctggccgccccgctgcttctgtctgccctgatatgtggtttggtgatcagcctgttgcaggcagcaactcagataaacgaaatgaccttatcgtttatccctaaaattctggctgtttttgtcactatcgttatcgctggcccgtggatgctgaacttactgctagattatatgcgcgtgctatttagcagtattccaaccattatcggctaa

SEQ ID NO: 5507 - DNA, 783 bp, Xenorhabdus bovienii
  Coding DNA location: Contig name=SeqID_16908; Position on contig =82912..83694bp; Strand=+
atgatcccgtttgatagcgaaatgctctctcgtcttgtcagtgattttttctggccactggtacgccttttggcgctgttcagcacagcccccattttcagtgaaaagcagacaccgataaaagtcagaattagtttggcgctggcgatcaccttcttgttggttcctaacataccctctccgcaaattccgatattttccgttgcgggggtttgggtcatgatacagcaggtgttgattggtgttgccttgggattaaccatgcagattgcttttgcagcaatacgtcatgccggagaaatactcggcttacagatggggctttcattcgccacattttttgatcctactggtgggccgaatatgccgattttggcgcgtattctgaacttgctgatgatgttaatgtttctggctttagatgggcatttatggttactgagcattattgccgggacatttgattcgattcccattcaaccaatgcaattgaaccccaaagggtttctgttgttagcccaaagtgccagtttaatcttcatcaacggtatgatgctggcaatgccgttgattaccctgctgttggtcctgaactttgccttggggatgctcaaccgcatgacgccacaactttccgtgttcgtcatcggctttccgctgacgctcaccgtggggatctttacactttccctgttgttcccgatgctggcgccctttactgaacggttaatggcagaaatattcgatcggctggcagtgattatcggggagttggtgttataa

SEQ ID NO: 5508 - DNA, 759 bp, Xenorhabdus bovienii
  Coding DNA location: Contig name=SeqID_16908; Position on contig =83723..84481bp; Strand=-
atgatgcgatttgaaaataaagtagtcgtgattaccggtgcgggaagtggtatcggtgaagccaccgcaaagcgtttttcccaagaaggcgctattgttgttttggtgggacgcaacgttgataaacttaatcgagtgtacagtgagctgtcatccagccacgcacgggtcattcaggcggatgtgtcggatcaggattccgtcaagatgatgattgatgagaccatcgaacacttcggcaggatagatattctcgtcaataatgccgggttgtatattcccagtacgatattggatacttcgctggatgatggcaaaaaagtgttggcgaccaaccttgatggcgttatttattgcagccattttgccttgcctcatttgctcaaaagcaaaggatgtattgtcaataatgcctctgtatcggggataagggctgattggggcaatgcttattactgtaccgcaaaaggggcggtggtcaatctgacccgtgctatggcattggatcatggctcacaggggattcgggtcaacgcagtgtgtcctagcctgatcatcactccaatgaccgaatatatgtccgatgaggttctgcaaaaattcgattcccgcatcccgatgaaaagagcgggaacaccggctgaagttgcatcagctattgcatttttagccagcgaagatgccagctttattaatggcgttaacctacccgtcgatggtggtgttacggcatcaaatggtcagcccaattttagttaa

SEQ ID NO: 5509 - DNA, 426 bp, Xenorhabdus bovienii
  Coding DNA location: Contig name=SeqID_16908; Position on contig =84478..84903bp; Strand=-
ttgttggcttcttttagcggtaatgtcgtcatttcaacggagattattttctcgccacagcaggattatgatcaggctgggttaatgatccgtctgtctgataaaaattggataaagttctcactggaactggagccagacaaaaccattaaattaggcacgacagtaacatcacagggggtatcggattggtctggtgaaatcattgatgacatcagtatgccgattaccctgattgctgaaatatcatcgggagcctgtttattatccatgcgatatggtgatggcctgccaaatacggtcagaataacgccatttatcgcagtcaaatccggtgacatgtgggcaggtatttatgctgcttgtccccgtcagtctgggtttgtggcgaactttgaaaatacgtcaatgagagtaataaaatga

SEQ ID NO: 5510 - DNA, 183 bp, Xenorhabdus bovienii
  Coding DNA location: Contig name=SeqID_16908; Position on contig =84887..85069bp; Strand=-
atgctgaatgatgtttttattgaattaccagtaaacagcacggttaaatggttgaacccagctccttattgggaaacagatatcggattatgcagaataaaacctgcgtctgaaaccgatttctggcgggaaacctacttcggtcatacggctcaatggacatgctttgttggcttcttttag

SEQ ID NO: 5511 - DNA, 312 bp, Xenorhabdus bovienii
  Coding DNA location: Contig name=SeqID_16908; Position on contig =85080..85391bp; Strand=-
atgattgaacatcttgtttcctataaatttaaaaataacttgctggacgacgacataaaatccgttttagataaactcgtgtctatgccgcaatccatacctgaaatacgccatgcaagctggcatctgaattccagtctggaagggcgggatcaaggatattgctatcttcttcgtctggaatttgatgatcaatttcagctagaacactatctggcatcacccgctcacacggcattgtgtgatgacattctgtttcctgcccttgaagacgggctgaattcgctgatcgtgtttgatattacacagtga

SEQ ID NO: 5512 - DNA, 969 bp, Xenorhabdus bovienii
  Coding DNA location: Contig name=SeqID_16908; Position on contig =85444..86412bp; Strand=-
atggccgcattggtattaattgagcgaaaccagtttcgttatatcgaggatatgcccgattccaatacagaatggccagcatgggaggtttatcgggtgggtatttgccggacagatgttaatttgacgcataatccagcgcgtactaatacggttcttgggcatgaagtggtttgtcgtgatgggcacggtcaatattatgcgctgaataatgagatcaattgtggcgagtgtgattattgtctcgaaggaaaaaccagccattgtcgccacatgcgagaattgggcgtgaatgaacatggcggctttgccagtaaaattcatgcgccagcaaataatctggtgccttttacctgtattgatcaccgcattggcgtgctgattgaaccgctggcctgtgctatacatggcatcaaacgtttggatacggttctcaatacccagtcagaaatcaaagtgttggttcagggatcggggatttcagggaaattaatcacttatctccttcatactttgtaccccgcactggaattgacgctctatgatgttcaggcagatgccatggcctgggctgaatcttaccccgctattcaacgaatcactgaaatcctgcaggaacatttccatgttgccattgaatgcagtgggtcacagcagggtctggcggactgtttccatgctgtccggcgtggtggaatattgatgatttatggggtaccactggctgaagcgacgttttcatttagtcctaatgagttgatgacaagggaaattaatcttgtcacctctctggccggttgtgatcgggaaactttttgccaatcgagggatactgtcgtcgcacaccagccgtttttttctactttgttaggaaaaaccatcggcctgaaggcactggaaaaagagttattacatttttcgctgatactgggaacgaaaacgctggttgatcccttatctaccatttag

SEQ ID NO: 5513 - DNA, 372 bp, Xenorhabdus bovienii
  Coding DNA location: Contig name=SeqID_16908; Position on contig =86412..86783bp; Strand=-
atggagcaggattatgaaaataccctaccggaaaaagctaaacgttatcttgctgggctgaaaaagctcaaggacaaatatgcctgcattcatcatgtcgatggtctgggcatgctatttaacatcagttttgccgatgctatgggcaagccgattgaaaatgcgggtaaatatgctgtaacgctggctcaggatgaagattatttttatgcagggcaacgtctcagaatggtgctcaatagcggtggctattggaatgaaggtcttaaattagcgccttatctggatattacctatcaggaaattgatagaacgttgtctgtactggatcaagttatcgctaatctgcataagaaattggagaataaataa

SEQ ID NO: 5514 - DNA, 105 bp, Xenorhabdus bovienii
  Coding DNA location: Contig name=SeqID_16908; Position on contig =86783..86887bp; Strand=-
atgggaggctatccccttcggtctttacacccggtcatgcccacagcaattttgccaatcatcccttgggaaccagcgcggctttcgcaacatgggattacatga

SEQ ID NO: 5515 - DNA, 120 bp, Xenorhabdus bovienii
  Coding DNA location: Contig name=SeqID_16908; Position on contig =86889..87008bp; Strand=+
atggtagcgacacgattgcgtcccgtattttgtctgacgattttcagtgcatcttcaacaaccagcgtgccactggcattaaaggagatacgcccaggggttacgcatgaaaatatttag

SEQ ID NO: 5516 - DNA, 1122 bp, Xenorhabdus bovienii; identical to SEQ ID NO: 4176
  Coding DNA location: Contig name=SeqID_16908; Position on contig =87041..88162bp; Strand=+

SEQ ID NO: 5517 - DNA, 354 bp, Xenorhabdus bovienii
  Coding DNA location: Contig name=SeqID_16908; Position on contig =88175..88528bp; Strand=-
atgcttaataatgcgagtgttgaacgtttacgtgaaattgatcagaaatatctttcttggggagatacggttcattatcaggaacgacctattatcgctgatcattgccatggcgagttaattcacgatttggaaggaaatacctatattgatacccagatgtggcattcaagctgtaattttggttatagtaaccccactatcgaacaggcatgtcgaaaacagtttgaaaaattgccacaaatcagtggggattttctccatgaagaaaaattactgctggcagaaaaagtctgtcaggctatttatgagagaacaggcattaaagggcgtatctccaggggttacgcatga

SEQ ID NO: 5518 - DNA, 114 bp, Xenorhabdus bovienii
  Coding DNA location: Contig name=SeqID_16908; Position on contig =88750..88863bp; Strand=-
gtgcatcaattcgagggcttctttttgggcatctgtcagagtaattgtcatgggcgcgatcttgatctgatacgaataaaaaatcaagcatcttcaatgacgatgggtatataa

SEQ ID NO: 5519 - DNA, 1038 bp, Xenorhabdus bovienii; identical to SEQ ID NO: 1787
  Coding DNA location: Contig name=SeqID_16908; Position on contig =88813..89850bp; Strand=+

SEQ ID NO: 5520 - DNA, 441 bp, Xenorhabdus bovienii; identical to SEQ ID NO: 2208
  Coding DNA location: Contig name=SeqID_16908; Position on contig =89897..90337bp; Strand=+

SEQ ID NO: 5521 - DNA, 537 bp, Xenorhabdus bovienii; identical to SEQ ID NO: 2180
  Coding DNA location: Contig name=SeqID_16908; Position on contig =90363..90899bp; Strand=+

SEQ ID NO: 5522 - DNA, 180 bp, Xenorhabdus bovienii
  Coding DNA location: Contig name=SeqID_16908; Position on contig =91170..91349bp; Strand=+
atgtatataaccatccccttaatctataaggaaccgattaaaagattaacaattaaattatttgcttattgttatcatagcattattggaacttgtactaatatccaattttttgtcgcattcttgccaaggcagtcccctcagaaaagcatcattacaatccctgggatcatggattaa

SEQ ID NO: 5523 - DNA, 423 bp, Xenorhabdus bovienii
  Coding DNA location: Contig name=SeqID_16908; Position on contig =91357..91779bp; Strand=-
atgatgcattttgctaatcgtaatcacacggatatcgccataatttccacaccaaaatcactgcgttttttacgaacctgttatgaccatatggcaggggagattgcggtaaaaatccataacagcctacttacgaaccattggataacccgtgattataaattgacgcagagggggaacgattttttgctttctattggcgtgtgttgtgatactgaatcctcgtcgaggcggaaatttgcctgttcttgccttgattggagtgaacggcattttcatcttggcggatttctgggtgcctcgttgtttaagacgtttttacagaaaaaatgggcgattagacaattagatagccgcgaattgatattgacggagcaaggaagaagagtgcttatgcaaaagtttggtgtggatataaattga

SEQ ID NO: 5524 - DNA, 264 bp, Xenorhabdus bovienii
  Coding DNA location: Contig name=SeqID_16908; Position on contig =91776..92039bp; Strand=-
atgaatgagcttaaccttgaggaaagtgtggtgacgattgcggcggtgcttgcagatcgcactcgtacccgtatgttgtttctgatgatggatggtcgcgcttatactgcaacggaattaagtgcggcatctgatgttgcaccttcgacagccagtgttcacttaaatcgactggcagaagggaaactggtgatctgcgttaaacagggacggcaccgttattttaaaattcacagcgaagaagtggattgctggaaagcatga

SEQ ID NO: 5525 - DNA, 330 bp, Xenorhabdus bovienii
  Coding DNA location: Contig name=SeqID_16908; Position on contig =92114..92443bp; Strand=+
atgttagctattatatttggggtcgaaattgcagaaaaccagagtgatcgttattttgacacctcagccacattaaagccgatattggaggcgatccccggttttatttccgtggaacgttttcagagcctcaataataatcataaatacctttcactttcatattggcgtgatgaagaagcagtcaaacagtggcggaatacttacccacatcgggaagcgcagaaattgggacgcaatggtgtatttacagattatcgattaaaagtagtgacggttattcgtgattacgggttgaatgcgagagaggaagtaccaaaggaagattga

SEQ ID NO: 5526 - DNA, 351 bp, Xenorhabdus bovienii
  Coding DNA location: Contig name=SeqID_16908; Position on contig =92449..92799bp; Strand=-
atgaaaattataaatatattaatatgtgttgtctttattttgttcagtgccatattggtgggatgtttttctacaattgattatgaatgggcaatcggggaagaaggaatcaatacagtctgtgatgtagtcaatgcttttgttattgatgatgacagggtattgactgcgccgttgtgttttgtttttttactgccttttatggtgacatttgttgtgaagagtattaaaggatttccggaaaataagctcaaagccatcagctatttggttactgttggcttttcagcgggatactggtattggatgttctttggtcggtttattgattgtccattggtgacgcattaa

SEQ ID NO: 5527 - DNA, 186 bp, Xenorhabdus bovienii
  Coding DNA location: Contig name=SeqID_16908; Position on contig =92747..92932bp; Strand=+
atggcactgaacaaaataaagacaacacatattaatatatttataattttcatgcttatttattcttcttgtctatataaagacaagatttcatccttgctcaaaatagctgaaatgtatcagcaagagtttatatcaaaaaaactaatgcattattctactttcctatcaaagataagatcttga

SEQ ID NO: 5528 - DNA, 96 bp, Xenorhabdus bovienii
  Coding DNA location: Contig name=SeqID_16908; Position on contig =93021..93116bp; Strand=+
atgagattgataaccgagtatgacaggcacaatagggagaaacagacaggctcttacccatttctccctattgcagagaaacagataagagcctga

SEQ ID NO: 5529 - DNA, 927 bp, Xenorhabdus bovienii
  Coding DNA location: Contig name=SeqID_16908; Position on contig =93143..94069bp; Strand=-
atggatgggattttgggtgcccaatccaaatggatgcgctatggtgagcaactgtccacggggaaacgggttattaacccgtcagatgatcccttagcggcttcacagagcatcatggtttctcagtctgaatcgaaaaatcagcagtttatgacagcgcgtatttttgccagaaactccatgtcagctcaattaagcattacctcaaatatcgtttcggttgcgaccaatgtttttgagactttggtggcggcagcggataagcagagcgatcaggatcgcgcatcctatgcgcagcagttggaaggttttaagcaacaattgctgaatcttggtaataaaacggatggtaatggccgctatatctttgggggttacaaaaccgacgttccacctttcaaagcggatgagtctgggaaagttcattataaaggtggacatgaagaaattacccagaaagtggatgataaccgctcgatgatcattgcccatacagggcagcaggtttttttatcgacaacgaccaatccgattaaagaacccgatggtggcactggtgagccagatgtttttactacccttgacttagcaatcaaggcgttgagaacgccgtacagcacagccagtgagtcggaaaagaatgatgccatggagctgataaataaagccaaccgtggtatccgcaatagtctggacaacttctcttcggtggaagcggttctcggcctccagcttcaggaactggaacaactggactcgctgggcagtgagcgcagcatatccaataaagttcgtacaggggaattagtggacgtggattgggcatcgtccatttccagctattatcagcagcaggctgccctgcaagcttcttataaagctttcactgacttaaaaggtttgtctctatttgagatgtatcgttaa

SEQ ID NO: 5530 - DNA, 1641 bp, Xenorhabdus bovienii
  Coding DNA location: Contig name=SeqID_16908; Position on contig =94142..95782bp; Strand=-
atgtctaatagtcttatgaatactgccatgagtggtattaatgctgcgcaggtagcgatgggtgtagtgggtaataacattgccaactccagaagtgagggctataaccgacagacagccgtgctgacacagaataacggaaccctgtcaccggtgggttttattggcaatggtgtggctgtcagttcgattaaccgcgaatatagtgagtttatcaaccagcaacatagctctgcacaaactaaacatgccgcactgggcgcttataaccagcaaatcaccaaaattaatgatctgctggccgataaggacaccagcctttccaattccctcgaagattttttcaaaagtctgggtgcggctgaaagcaatgcggaagacagtgcggcaagaacaacagttctgggtaaagccgaaggtttggtgagccggttcaaagaagcagatgaatttctgcgtcagatagacaacagcatcaattcccaaattgagcagaatgccagagaaatcaataaatacgccgaagaaattgccacgctgaacaacgaaattacccgtatgcgcggtactggcacgggcgaaccgctggctttgctggataaacgtgatgatgcggtcaacaaattaaatcagcttgttgaagtgagtgtcacccagcaggatgggagcgtttataacgtctcattcggtggtggcatgtcactggtatcgggtagcaaagcctatcgattggaagcgatcccatccagcactgacagcagccgtatcacgctaggctataacaacggcaccgtaggaacgaaagaaattgacgagcgctttatctcccaaggcagattgggtggtgcattgcaggtgcgcagggaagtcgtagactcaagccgcaatcaattgaaccaattggctctggtaatggccgatcagttcaatcaggtgcaaaacggcggttttgatctgaaaggtaaaccgggtgttaatttctttaactttacccagccggatgttatttccaacagcaataacaaaggaacggctgatattaaggtggaatacacagataccaccaaagtgaaaggcagtgactataccctcaaacatgaaggtggggattggaaagtacagcgcgtttctgacagggcggcaattcctgtcaccaagaatggcaatgcgctggaattcgatggactgaaagttgaaatcgatgccgctcattctcaggatcacgacacctacacactaaaaaccgtcagtaatgtagtggcaacactggaaatgaatctccaggattcctcccaattggcgactgccagcgctaaagatgccggccctagtgataaccgtaatgcgaagaaatttcttgacctacaggatcagcgcttggttgatggcaagtcttcctttgccgggggttatgcgtcactggttagtcaagtgggtagtaaggccaatgaagctaaagtcagtgttgaaacacaggggcatatcgttgacaaactccatgcgacccgcgaatcgatttctggcgtcaatatggacgaagaatatggctccctgcaacgcttgcatcagtactatctggcaaacgcccgtgtgatccagacagcgacgaccttgttcgatgctattttgggcattcgctaa

SEQ ID NO: 5531 - DNA, 183 bp, Xenorhabdus bovienii
  Coding DNA location: Contig name=SeqID_16908; Position on contig =95703..95885bp; Strand=+
atgttattacccactacacccatcgctacctgcgcagcattaataccactcatggcagtattcataagactattagacatgtgtagatccttttacgttttcgttatgcctccgtcatgggaggtaattcactgctacagttatcggcaagattccctgatccttgaacaaaaacggcgttaa

SEQ ID NO: 5532 - DNA, 966 bp, Xenorhabdus bovienii
  Coding DNA location: Contig name=SeqID_16908; Position on contig =95895..96860bp; Strand=-
atgagtgattttttaacgacgcctaccgccgcttacgatgtgaattcgctgcattcactgaaagccagattatcacaggaaccacaacaagggctacggcaggtagcccaggaacttgaaggcgttttcgttcagatgatgctgaaaagtatgcgttcctcgttgccacaggatggcatattgagcagtgatcagacgcgtttttatacctcgatgtacgatcagcagattgcccaggatctttcccaaaaagggctgggttttgccgacatgatcgttaagcaattttccaacgcgaacagcgttgccggcgaacaggccggaacggtaccgatgccgttggataaggaattcctgcaaacattgccgaagcaggcactggaacagtttatgcaccgtaccatgacggcgccgtttgctgcggcagcttccaagggttccgtacaatcgaagtcattaccggttagcagcactgactttgtttccatgctctccctgcctgcgcagatagcgagccagcaaagcggtatccctcatttattgatcattgcacaggcggcgctggaatccggctggggacagcgggaaattctgacagcggaaggcaaaccgagtcataacctgtttggcatcaaggccggcaagaattggaaaggggcggtcaccaacatcatgacaacggaatacattgagggtgaaccgaagaagatgcacgacagtttccgggtttatggctcttacagggaagcaataacggattacgtcaaactgctgacagaaaatccgcgttacgctaaggtcgcgcaatcaacgacggcagagcagggcgcatattctttacagagtgcagggtatgccaccgacccgggttacgccaaaaaattggtatcactgatccagcagttaaagagtaccggcaatcaaatggtaaaagcctataccgatgatttcgacaacctgttttaa

SEQ ID NO: 5533 - DNA, 1119 bp, Xenorhabdus bovienii
  Coding DNA location: Contig name=SeqID_16908; Position on contig =96860..97978bp; Strand=-
atggaaaaattagtcgccagcctttttacacttttactggcattgtccagcatagtcgtgtctggcaccgcttcggcagagcgcattcgtgatttggtcaccattgagggtgttagggataatgcactgattggctatggtttagtggtcgggctggatggaacgggcgaccagaccatgcaaaccccttttaccacccaaagcctgagcaatatgctatcgcagctggggattactgtgccgcccggtacgaatatgcagcttaaaaacgtagctgctgtgatggtgacagccaagctacccccttttgcgcactcagggcaaaatattgatgttgtggtttcctcattgggtaatgccaagagtctgcggggcggaacattgctgatgacgcctctgaaagggattgataatcaggtgtatgcgctggcgcagggcaatattttggtcggcggggctggtgtcagtgccggtggtaacagtatcaggattaatcagcttgcgggcggacgcatttccaatggtgcggtgattgagcgggagttgccgacccagtttggccagaaaggaacgctgaacctgcaactgaataatgatgattttagtctggccgagcaaatcagtgatgcggtcaatcgcctgcaaggaaaagggacggcaacgccgctggattcccgtactgtacagttgcgtttgccgagagaaaacagcgaacaggtaaggttcctgtctcaagttcagaacctgaatattcgcgtggatgcgggtgatgccaaagtgattttcaattcccgcacgggatcggttgtgatgaaccgcaatgttacgctggatagctgcgccattgcacatggtagtctgtctgtcactgttgagcgtcagacggcggttaatcagcccaataccccattggcggggggcaatactgtagtgacccgtaatacgggtgtcggaattcaggaacagggcggtgcattacagcaagttaatgccagtgccaatctgacacaggttgtccgtgcattgaatgttctgggcgcgacaccgacagatttaatgtccattttgcaggcgatggaaacagcgggttgtttgcgggcgaaactggagatcatttga

SEQ ID NO: 5534 - DNA, 753 bp, Xenorhabdus bovienii
  Coding DNA location: Contig name=SeqID_16908; Position on contig =97994..98746bp; Strand=-
atggatacaatgcccgttgccgagaacaacgtagcttatgactctcccagtttacggaaaaaccggggatataagtggcgcatcagcatggctctggcggtactgtcactggcgggctgtgcctatataccgcacaaaccgctggtgaaaggagcgacaaccgcaaaccccgccgaagcccctgctccaacaccaaatggttctatttttcaggtttcccagccggtttattacggttatcagccgttgtttgaagaccgccgtccccgcaatatcggtgatacgctgaccattattctgcaagaaaatgtcagtgccagcaaaaattcctcagccaacgccagtcgcagtggaaaaaccggtttcacggctgctctgaccccccgtttcttaaagggattgatgggtggtgacaaaacggatttgagcatggaaggcgatagtgactttgggggtaaagggggagccaatgccaacaataccttcaggggcacgattaccgtgactgttgatagattgctggccaatggcaacttacatgctgtgggggaaaaacagatcgccatcaatcagggaacggaattcattcgtttctctggcgttgtaaacccgcgcaccattaccggcaccaatacggtgagctccaatcaagtagcggacgcccgcattgagtatgttggcgatggttatatcaacgaggcacagacaatgggttggttgcaacgtttctttatgaatatctcaccgttttaa

SEQ ID NO: 5535 - DNA, 783 bp, Xenorhabdus bovienii
  Coding DNA location: Contig name=SeqID_16908; Position on contig =98879..99661bp; Strand=-
atgatccgatctttatggattgccaagactgggctggatgcacagcaaacaaatatggatgttattgccaacaacttggcaaacgtcagtaccaatggttttaaacgccagcgcgcggtttttgaagatttactctatcaaaccgaacgtcagcccggtgcgatgtcgtctgaacagaccaatctgccttctggcttacagattggtacgggagctcgtccggtggcgacagagcgtctgcacagtcagggcaacttggcacagaccaacaacagcaaggatgtggcaatcaaaggacagggccttttccagatccagatgcctgatggcacaaccggttatacccgtgatggttcatttcaggtggatcaaaatgggcaactggttactgcgagtggttttcaggtcgtgcctgccatcatcattccagacaatgctaccaaaatcagcattgctcgtgatgggattgtgagtatcaacgtgcaagggcaaaacgcacctcagcaggttggccaactgacgctgaccacttttatcaacgaaagtggtctggaaagcatcggtgagaacttgtatctggaaaccaacagttccggtgtccctgtagaaaacgcaccgggcatcaatggggcagggctgctctatcagggctatgttgaaacgtccaatgtcaatgtggcggaagaactggtcaatatgattcaggttcagcgagcctacgaaatcaacagtaaagccgtatcgacttctgaccagatgctgcaaaaactgacccagttataa

SEQ ID NO: 5536 - DNA, 756 bp, Xenorhabdus bovienii
  Coding DNA location: Contig name=SeqID_16908; Position on contig =99684..100439bp; Strand=-
atggatcacgtcatttataccgcgatgggtgctgcgcgccaaacgctggaacatcaggccgtcaccgccaacaatctggccaatgcgacgacgccgggcttcaaagcccagcttgccgcactgcgttctgtgcccattgaaggcgaaactctgccgacccgcacattgaccgttgcttccacccccggcatggatagccgtcaggggccaatgaattatacttcccgcccgttggacgtggctgtcggacaaggtggttttctggctgtccagctcgacgatgggacggaagcctatacccgcaacggcggtatccagatgtcaccagaaggacaactgacggtgcaggggcgtatgttgatgggcgaaaacgggccgattgatgttccgccacaggctgaacttactattgcggcagatggtgccatttctgccttgattgccagcgatcctccgacactgctggggcagattggcaagctgaaaatcgttaagctggaagcgggccaagtggtgcggggcgatgatggcctgttccatttaacgccacaggcgcgggaacagcagggcaatgaactggcagccagcactgaagtgaaaatcatgccgggtgtactggagggcagcaatgttaatccagtagaaagcatggtgaacatgattgctaatgcgcgtcgttttgagatgcagatgaaagtcatacacagttccgatgaaaatgcacagcgggctaaccaaattctcgccatgagctga

SEQ ID NO: 5537 - DNA, 1221 bp, Xenorhabdus bovienii
  Coding DNA location: Contig name=SeqID_16908; Position on contig =100461..101681bp; Strand=-
atggctttttcacaagcggtcagtggcttgaatgccgcagcaagtaacttagacgttatcggtaataatatcgcgaactcggcgacatttggttttaaatccagttcagcggcctttgcggatgtattcagtggttcagatgtggggctaggggttaaagtttctggcatggttaagaactttaaggatggttcaaccacgaccacaagccgtcagttggacatggcaatcacccagggcggttttttccgtatgctggattccaacggcagtactttctattcccgcaatggtcagttcaacatggactcagaccgtaacctgatcaatatgcagggcatgaagttgaccggttatccagcggtacaaggggcaaatgggcctgaaattcaaaagggtgcggcaccggggccaatttcgattccaagggatatgctggatgccaaggcgacgacgaacgtcactatgacggctaacctgaattcgatgaataagaaagtcgatatcgcggctaccccatttgattcatcaaaaaaagacagctttaactatagctctggtctctcggtatacgatagtttgggtaatgagcacaatatcaatgtgttctttgtcaaaacaaaagataacgagtggcaaattcatgctcaggatacttctgtagcgggttctgctgctcaaaaattgggtgatgtcaagtttgatggcaatggccgcattcaagggactaacaacgcatttgctttcaatgtgcctgcgttaaatggttccattgctgctccaatcaatatcgatttcaacaacagcaaacagcagagcatttcacaggactctatctccaaccagcagcagaacggctatgccgcagggagttttactaactaccgcgttgatagtgatggcaaaattcatggcctctactctaatcagcaaacacaggtgttaggtcaggtcgtactggcaaacttctctaacccagaaggtttggctgcacagggtgataacgtttgggtagaaacgggtgcatccggtagcccaatcgtaggaactgcgggatcaggtaacttcggtaagctgatcagcggcgcactggaagcgtcaaacgtggacatgagccaggagctggtcaatatgatcgtcgcccagcgtaactatcaatccaacgctcagaccatcaagacgcaggatcagatcctgcaaacactggtcagcatgcgttaa

SEQ ID NO: 5538 - DNA, 696 bp, Xenorhabdus bovienii
  Coding DNA location: Contig name=SeqID_16908; Position on contig =101697..102392bp; Strand=-
atggcggttagctcttcaatcaatgactcattagataattcaacggtaggcgaactcgccaccctgaacaaacaacaaccacaaaaaagtggtgatatcaaagataacttcttgaatttattggttgctcaacttaagaaccaagatcccaccaacccaatgcaaaacaatgaattgacgacacagcttgcgcagatcagcaccgttcagggtgttgaaaagctcaataaaacgctgggcgctgttgttgggcagatggaaggcaatcaggcgatgcaaacgacaatgctgattggccgaacggttatgatccctggcgataagattttagtcggtcccgatgaagaaaacggtattagcacatcgccattcggtttcgaactgacccgacccgctgataacatcaaaattactattagagataaagagggtgtcgtcgtgcgggaagtggaagctgaaaaagtgaatgtcggtgtacataaagttcagtgggatggcaaagacgcagacggtaaggaagtgataaacggtgcctataacttcactgtttccgcaagctatcaagatcaggcgttggtgacacttccgctgacctctgctgaggttagcggcgtcacacggggtgaagatggcactagattagatttagggctggcgggtacggtaaccatggaccaagtacgtcagattctttag

SEQ ID NO: 5539 - DNA, 411 bp, Xenorhabdus bovienii
  Coding DNA location: Contig name=SeqID_16908; Position on contig =102394..102804bp; Strand=+
atggaattcctgttactgacccagagtcaacgttttcagcatgatggacttggtcgtgttaagcacttcaatgtttgcctgataactgcgggaagcagagatggtattgaccatttccccgacgacatccacatttggcatacgtacataacctttttcatcggccagtggattacccggccggtattcgaggcgaaaaggggtgggatcatccacaacttcactgacacgcacgccaccgatctcctgtcctgccagagccgcaacgcggaatacaacttgtttggcacggtaaggctcgccattaggccctacaacgctatcggcattcgccatattgctggcgctgacattcagtcgctgggactgagcggaaagtgcggagctagcaatatcaaaaatactgagtaa

SEQ ID NO: 5540 - DNA, 417 bp, Xenorhabdus bovienii
  Coding DNA location: Contig name=SeqID_16908; Position on contig =102816..103232bp; Strand=-
atgctcgataaattagatgctgcctttcattttcgacaagaagcgctggcactccgcaaccagcggcaggaaattctgtctgcaaatattgccaatgcggatacccccggctatcaggcgcgtgatatcgattttgctgctcaactgaaacaagtgatggcagagggtcgtgtgacgggaaatggaatgaagctgcgtctagcttccgatcgacatatccctgctcagtctcagaatcgtttggaaatggatctgctctatcgggtgccttaccagacagcaatggatggaaataccgttgacatggatgtagaacgcagccatttcgcagataacagcctgaaatatcaggccgaacttacgatgacgaattcgcagcttaaaagcatgatgtcagttctacagtcacaaggataa

SEQ ID NO: 5541 - DNA, 672 bp, Xenorhabdus bovienii
  Coding DNA location: Contig name=SeqID_16908; Position on contig =103472..104143bp; Strand=+
atgcctgcattaaaatttatcgggtttattacctttttccttagcagttttttgcatagcgctttggcattggcgagtaatttaccgcaatcaatcaataattatttcacacagattcaccacaacgcggaccacaaagtcaccgtgaaaattaaaacgcctgagcagcaatggccggtatgtgaatttcctgaaatacagccgtcactcagcaacagaaactggggcagcctgtccattcccgtcacctgcggccaacagcgccgttttattcaggtatacgttggtgttacgggttcttatctgatgtctaaccgcaccattcagcgcaataccgtgctgacagaaaaagattttcaggtaaaaacaggggctttggataaattgccaaatgacataatccgtaacagaaaggccatacaaaatggtattgccattcgcaacattcctgccggacaattcatcactcgtaacatgatccgacgtccgtggacgattcgcgccggacaaaatgtcgtcgtcaccgtagatggacatcattttcaggtgcgctacgaaggaaaagcgattaacaacgccgcgagttttgataatatccgagtccgcctgacttctgggcaggtgattaccggagaaactcaggaaaatggcagtgtaaaaatgatgttataa

SEQ ID NO: 5542 - DNA, 300 bp, Xenorhabdus bovienii
  Coding DNA location: Contig name=SeqID_16908; Position on contig =104290..104589bp; Strand=-
atggctctttatgattttgatggcttatttatcatattccatgttttcaagggcttctctgaacagagcatcagcaattttaccgctgtccatggtcagagttcctttcgcaatggcttctttcaattgttgtactttctggatattaatatcttggctacttggctgaacaagctttttctgcgcctcgctcagcttaacttgcgtatcagcgcttttttctgcgacagctacagttctgcgagtgccctgagcaccttcattggcattgcgttgctgcacagcagcaatggccagtag

SEQ ID NO: 5543 - DNA, 441 bp, Xenorhabdus bovienii
  Coding DNA location: Contig name=SeqID_16908; Position on contig =104592..105032bp; Strand=+
atggaagaacttcaactcttgcttgagcagcaaaatgtacacttaaattcgctttcgaacactatggcagaagaacaacgcatattgagcgaaggctttattgaagcgaatcatttacatcgagtcaccgaacaaaaaacattttttctctcggcactcgatcatgttgaacgaagacgccagcaattaaatgaaacgctgaaagtgaacgcaccctattctagccatgaaatactggcggtattatgggatcaaatcagccaaactgttgaacgtatccgtaatctcaatgtacataatgggtttttactggatcaacatattgagttgaacagccaggcaattgctttcttgaaaagtcaccacagcccttctctttatggtgctgatgggcaagcccatcacaacacagcactgtctggccacaagatcagtgtttaa

SEQ ID NO: 5544 - DNA, 129 bp, Xenorhabdus bovienii
  Coding DNA location: Contig name=SeqID_16908; Position on contig =104980..105108bp; Strand=+
atgggcaagcccatcacaacacagcactgtctggccacaagatcagtgtttaattttgagtggtgcgactttacgtcgtcatatgtacagacctctttatttatcagtgaaataaggggtctgttttag

SEQ ID NO: 5545 - DNA, 1017 bp, Xenorhabdus bovienii
  Coding DNA location: Contig name=SeqID_16908; Position on contig =105181..106197bp; Strand=-
atgaaggtattcgtttatccgtggttactgttagcttcggtgtttttttcccccggtaaggtttatgccgattgttccgggggcagtggaatcatatcgactgttgcggtgtccattccgcaacatatatcgagggatgaaatataccgtagcttatattcccagtctcgggcagatatggcgataacttgcacaaatatgccagtaggagccactcacataactgtcggtataaaagcctatggggacgattcggggataacttccatctcccgtaaaatttttaaattgggtgacagtggtattgggtatgtcgttattggtgtggatgatacgcacgatgaaaaaccgataacaacaactgcggaccgtttttggggtgggaatgccagggaactatataccactgagatagggcctgatggcactatcaacctgaatgccgcactcagacttgaattttacaaaattggcccgataaagccgggtcgttattcccagtcagtagccgcagctattgtcgcaccgcgcggatccagaatacccagtgtgactcaagaattccgattcaccacgggtatgataacgattaacgccccaacctgttccgtcgataacagcacaattcctgtaacattaggccggataacgacaatgcaattaccttatgtgggttcaacggcagcggaaacactatttcatatacctttgacctgtgaacccaaggctagcgtttttatgaccttagaggcaggtcgtcaaggggcttatgacctaatgcaaggtattatcgagcttaaacgtggccttaatgagagggctagggatggtgttggtgttcagattttagatggtaaaacgaatatgcccattcaccttggtgaaaaaaaatactatacaaccaccgggacgggcgggcctgtaaacattcctttaaaagcacgctactatcggtatggtgacgttagagcaggggttgccaatgcgaccgcgacattcacaatgagttatgagtga

SEQ ID NO: 5546 - DNA, 2490 bp, Xenorhabdus bovienii
  Coding DNA location: Contig name=SeqID_16908; Position on contig =106273..108762bp; Strand=-
atgagtttgattactccttttatccgtgcgcagttaatattgctgctgttggccggatttctgcctgtcgctgggtatgccagtgactattttgatctcgatgctctggaaattcatgacccgtctgcaccgccgcctgatttgagctattttgcagaaaaaggcggtagtgcaccggggacataccatgttgatatccgtgttaatggccagaataaaggtgctcaggatatccagtttgtactggacgccgggagaaaacttcaacccgatttatcagttcaacaactggccgactggggagtcaatgttgcggctttcccagtcttgaactcaaaaatgcaggtcactgacctggctgacatcatcccttatgccagtacctcattacagcttggtcaacaaacgctaattatcagtattcctcaggcggcgatgacggctgaagcgcgcggtgcgattgattcgtcactttggcaacagggtgaatcggcgctatggatgaattacgattttaacggtgctgaaactcgcagtaaaagcggctctaaaaccaacagtatctatatgaatttgcgtagtggattaaactgggacgcctggcgcttacggaattattctacttaccaccggagccgtggcggcgagtcacgttgggaaaaccttaacacatatcttcaacgtgatgttcatctgctaaaaagccaattggtgatgggtgaaaccaatacacgtggagagctgtttagcggatttgctttccgcggtattaccctgatgtctgatgataatatgctaccggacagtcagcggggattcgctccgatagtgcggggaatagcggaaagcaatgctcagatcactattcgtcagaacggattcatgatttaccaggcttatgttccacccggggctttcgtgattgatgacctttatccggcctcctcaggaggaaatttggatgtgactattcaggaagcggacggccgtgaaaggcactttgttcagcccttttcgtcggttcctattatgttacgggaaggtgggttcaaatacagtctgacggcgggagaataccgcacttcacacgatcagactcgacagccgctctttatgcagagtgaagtttattatggcctgccacatgccacaactgtgtatggcggtacgttactgtctccgaactaccaggcctatgtcgttggtgtgggatacagtcttggccgttggggttctttatcttttgatatcacgcggtcacaggctgatattatcaatgaaggtcaacaacagggctgggtttaccggtcgcagtataccaaagacttcgagcagacggggactcgcttgtcgctggccagttaccactactcttcaccgcacttttatgattttcaggacgtcaataactgggctgcacatgatgagctgtcatatcaacgtaaacataaatttcagcttaatctcagtcaaaatttgtcggattatggcagcgtctatgtttccggttatttgcaggatgattggggaaaccgcggcacgacccggaatttaaatgtcgggtacagtgtgaattatgccgatatcaattataccctgaactacacccaaaatatgagttcaggtaactcaacagccgataaccaactggcattcaatatacaagttccgctcgaccgctggctgccgaacagttgggctacctatagtttcaatcataatcgccaaggcgatatgaaccaatcagttggactgagtggtacggcgctggatgacaatgttctgggttactctctgcaacagcgttacggtaataacggtcagaattccagtggtaatattaatctcaactataaagcccgttatggggagctgtccggtggatataactacaacaatagctcgcagcagattaactacggactcaggggaggattggtcgctcatcgccatggcataactttgtctcaatcattgggtgagacgattgtcttggtcaaaactcccggagcagcaggggttaaggttaacggctataacggggttgaaacggatggacgaggccatgcagtattgccctatgtcagtccttatcaccataaccgtatcgctctgtcaccggactcttttggcgatggcgtggaaattgagtccaatatccagactgtcattccgacacaaggagcgatggtagtggctgatttccgaacacggatcggtcaccgagtgctgtttactctgactcatctgggtaaaccgattccttttggcgcaatagctaccctgaatgaagaaaatacaatcagcttcctcactgaaaatcagagcattgttggcaatggaggagaagtctatttcggtggcgtgccggagcaggggcagttgtctgttcaatggggtaatggtcagtttgagcagtgtaaagcgcgttttattttgccaaaaagtgaagcggcggtgatttcgatgaaggcagattgtcagttatga

SEQ ID NO: 5547 - DNA, 705 bp, Xenorhabdus bovienii
  Coding DNA location: Contig name=SeqID_16908; Position on contig =108793..109497bp; Strand=-
atgttaaaacgttttttgttcggactgttactgtccctgcctgttgtcttttctgcccccacccatgccggaatagcactcagtagtacccgggtgatttatgaagcatctcaacgtgaagcaactatttccgtaatcaacgatagtaaggagaatgtttaccttattcagtcttgggtaaatacctttacaacaacgaccgaactatcggatcgcaaagcgccatttttagtgacaccgcccttattccgtctggatggtgagcaagaaaaccgtctgcgaattatcctgacagatgactctttaccacaggatcgtgaatctgtcttctggttgaacgttaaagcgattcctgcggtggaaaaaaatgatgcaaatcgcctgctgatatcggtaaagaaccggataaagctcttttatcggccggccggattgacagaaaaactggcggataatgcctatcaacaactgactttttcccgccagaatgggcaattagtggtgcagaatccaaccccttttcatatctctttccacaacattacggtcgggaataatccagtaccggaagccggtatggtcgccccgttcagccgccgtcaatggcctttacccgcaggttccggtaataccgtgacttggcgggctatcaatgattttggcggcaccactgagccacagcatcaaaccttatcatccttgtaa

SEQ ID NO: 5548 - DNA, 525 bp, Xenorhabdus bovienii
  Coding DNA location: Contig name=SeqID_16908; Position on contig =109600..110124bp; Strand=-
atgaaattattaaaattatttatcgcagcaattatttctggatctatggctgcgtcggcattggctgccgatggcagaattgactttaacggtaggattactaaggcgacatgtactgtcgatgcatcaactgctgatcctgtcaacctacctgaagtaggtgcgactgcccttgcagaaaaaggtaaaaccgggggtgacactctctttagcattaatctgaaggactgcgggatagtgggtggttcggctaatgtgcaggtgaagtttgacggtgttaaagatcgtatcgatggcaatctgctgaaaattaactctgagagtggtggagcgacgggtgttggcattggtatttatgagaaaaatggtagtacgctaattaatatgggggagcttagcaaaagtactccggtgactaaggatgtaactaaacttgaatttaaggctaaatatgtggctacaggggcaactgtcacgccaggtacagtgaaagcctctacggactttacactagactacgagtaa

SEQ ID NO: 5549 - DNA, 132 bp, Xenorhabdus bovienii
  Coding DNA location: Contig name=SeqID_16908; Position on contig =110958..111089bp; Strand=-
atgttaatttatcttatcctgttcgctgtcatatggttaataagtgatgatttaaaaaaattatatttatatgctatcaattttatggcgccgcacttcatggctaccacgaacgaagttatttgtaggtag

SEQ ID NO: 5550 - DNA, 102 bp, Xenorhabdus bovienii
  Coding DNA location: Contig name=SeqID_16908; Position on contig =111212..111313bp; Strand=-
gtgcttcgaaaaatgcaggtaaataaatggaatggtgtgacacctcaatatttgggtggcaatgcttttattccgtttttgccagtagataagagtaagtaa

SEQ ID NO: 5551 - DNA, 288 bp, Xenorhabdus bovienii
  Coding DNA location: Contig name=SeqID_16908; Position on contig =111344..111631bp; Strand=-
atggagtggtatctaaaagcatcaaagcagggcctttcaacggctcaaaataacattggtattttatatcgtaaaggccgcggtgtaccacaaaactatcaaaaagcgatggaatggtaccttaaggcggcaaaagtcggtaatgcagtaggtatgtttaatgtcggctatttataccaatctggtcttggcgttgaaaaagacgaacaaaaggcactggagtggtatcaaaaagccgcagaagcagataaaaactttaccgaagccgcatttgcagtaaaaaactga

SEQ ID NO: 5552 - DNA, 108 bp, Xenorhabdus bovienii
  Coding DNA location: Contig name=SeqID_16908; Position on contig =111592..111699bp; Strand=+
ttgaaaggccctgctttgatgcttttagataccactccatcgctttttgataatcttgtggcacaatttcacctaattcataaatcggtcatgataccaatttattga

SEQ ID NO: 5553 - DNA, 504 bp, Xenorhabdus bovienii
  Coding DNA location: Contig name=SeqID_16908; Position on contig =111693..112196bp; Strand=-
atgccgggcgacagcccgtgtgatggggattggtctgaatactgtccttcgccatttaaaaagctcagacccaaatcggtaacacaagccattgctcccggcactgaagtgattgtctgttgcgaaatggatgagcagtggtcgtacgtgaagtcaaagaatcagccccgttggctcttttatgcttacgaccggatcagacggaaagtaatcgcccacgtttttgacccaagaacaaagaaaacattgatgcgtctgatgacgctactggctcccttcaatattgtgatctctatgaccgatggcgggagaagttatgaaaaaacacgggcggggaagcggcatgtggtcagtaagcgttatacacaacgcatagagaaacataatctgaatcttcgtcaacatttagcaagactgactcgcaaaaccttgtctttttcaaaatccatagaaatacatgacagggccatagggtattatttaaacattcatcactatcaataa

SEQ ID NO: 5554 - DNA, 291 bp, Xenorhabdus bovienii
  Coding DNA location: Contig name=SeqID_16908; Position on contig =112142..112432bp; Strand=+
atggcgaaggacagtattcagaccaatccccatcacacgggctgtcgcccggcatcccattccattcatggccctatcgacgatttgcttatgtgtaccgggacgacaagcggcataagtgaattcccgttgccaagaatgacggcaggactggcaaagataacgttgatgaccagagcgagagcgcccattacggtggatccctttaactgcacaacaagatgggcaggtcacatcaatctttgccatctgaatgttttccaaatagacagactatacagggttcaataa

SEQ ID NO: 5555 - DNA, 621 bp, Xenorhabdus bovienii
  Coding DNA location: Contig name=SeqID_16908; Position on contig =112538..113158bp; Strand=-
atggaattttataaattaatgataattagaaaggataatatgttttcacataaaaataacccaattcgcgcattttacactgaagaatatatcagggtatatcaggctttttctgatacaatcgctgacagtgctattaaaaatggcactttcgtttctcctccttttagtatgactcgcatgacatggatcaaaccctcttttttatggatgatgtaccgatcaggatgggcaatgaaagacagtgggcaaacgcggatcttagccattgatatcacccacgaaggattcagggaaattgtccggcagggaattatcagtcactatgatccagaattttttgattcaatggatgcatggaaagagaaagtacaaaacagtgatgtcgttgttcaatgggatccagagagagatattttactgaataagttagaacagagaacaatacaaatcggtttacgtaataaagcggtagataattatgttaatcaatggattgttaatatcagtgacatgacacatatggcacatgaaatctatgaattggtaagaaacaataagttggatctggctcaagcgttgttaccgaaggaagaaatttatttcaagtcatcatgttag

SEQ ID NO: 5556 - DNA, 2088 bp, Xenorhabdus bovienii
  Coding DNA location: Contig name=SeqID_16908; Position on contig =113426..115513bp; Strand=-
atggctaatctggcctcattacttcgtttaccggggaatatgaaaggctcccagtggcaaatgcttgcggggcctgtactgatcctcatgatcttgtcaatgatggtgctgccgttaccaccattcctgcttgatctgctattcacttttaacattgcactttccattatggtcttgctggtggcgatgtttacccgtcggacactggattttgccgcattcccgactattctgctgttctcaacattactgcgcctgtcactgaacgttgcatctacacgtatcattctgatggaaggccatacgggttcagcggcagcgggtcaggtagtggaagctttcggacactttctggttggcggtaatttcgcgattggtatcgtggttttcgttatcctgatcctgattaactttatggtcattaccaaaggtgcggggcgtatcgcagaagtcggtgcgcgttttgtactggatggcatgcccggtaaacagatggcgattgacgctgatttgaacgccggcttgattggtgaagatgaagccaaaaaacgccgcgccgaagtgacacaggaagcagacttttacggttcaatggatggtgcgagtaaattcgtgcgcggagatgccattgccggattgatgattctggtgattaacattatcggtggactgattgtcggtgttgcccagcataatatgaatctgggagatgcagcggaagcttataccctactgaccatcggtgacgggttggtagctcagttgccagctctgattatctccacagcggcgggtgtgattgtgacccgcgtggcgacggatgaagatgttggtcagcaaatggtgactcagcttttcaacaacccacgggtgctgctgttgagtgcgggggtattaggcttgcttggtctggtgccaggaatgcctaatttcgttttcctattattcacggcggcattagcgggtttcggctactacctgctgcgcaaggacaaaaatccgcttgcggcacagcacgaagagatgaaggcggcagaggaacagcaacaaactgcggaagcctcatggtctgacgtacaactggaagatccactgggcatggaggttggttatcgtttgatcccgatggtagatttccgccagaatggtgaactgctggggcgtatcagcggtatccgcaaaaaatttgcgcaagaagtgggctatttgccgccggtggtgcatatctgcgataacctggagttggcacctgccagttaccgtattttgatgaaaggggtcgaaattggccgtggtgaagcgcacccaggacgctggctggcaattaacccaggtggcgcagttggcgagttacagggagatttgacacaagatcctgcttttggtctgtctgcggtctggattgatgattccctgcgagaacaggcgcaggtacagggttataccgttgttgcggccagtaccgttgtggcgactcacctcaaccatctgttatctcaacactccagcgaactgtttggcagacaggaagcacagcaactgtttgagcgtgtcagtcaggaaatgccgaaactgacggaagatttcatacctgacgtggtgagcttgaccaccttgcacaaagtattgcaaaacttgttggcagagcaggtgccgatcagggatatgcgtaccattatcgaaacactggctgaacatgcgccaacacaagccgatccttatgaattaaccgccacgattcgaattgcgcttggcagagccattgcccagcaatggttccccagggcggatgaaatcaaagttattgggctggatgcaggtcttgaacgtctgttgcttcaggcattgcaaagcggtggagggctggagcccggcttggcagaaagcctcgaacggcaggcggcagaagcgctggagcgtcaggaaatgttgggtgcaccgcccgtgttgctggtcaatcatgcactgcgtccgctgttgtctcgtttcctgcgccgcgtactgccccgattggttgtgctgtctaaccttgaaatcaccgataaccgccaaatcagaatgacggcaacgattggtggagcaagataa

SEQ ID NO: 5557 - DNA, 1236 bp, Xenorhabdus bovienii
  Coding DNA location: Contig name=SeqID_16908; Position on contig =115506..116741bp; Strand=-
ttgtcatgcttaacacaattttatttgctctttcccaaaagcaatttttctgcatgcaataacgaacgctcaccaaggaaagtcgtggctgaagatagcgatctcgaaaaaaccgaagaacccacgccccataaacgggaaaaagcccgcaaagacgggcagattgcgcgttcaaaggaactgacttctatcctgatgctggcgggaggggtaagcctgctctggatgagcggaaattcgatcactaatgaactttcactgatggtattcgaagggtttaacttcgaccataacatggtcagcaacgataagcagatgattcagcaggtcggtcgcttattgaaacaggcagtgtgggcattgttgccagtattcgttggtctggttctggttgccctcagtgcaccgacattgatgggggggctgatattcagttcaaaatctatcaaatttgatctagctaaactgagtccgatttctggattgaagaagatcttctccatgaacgcactggcggaactgttcaaggccatcttgaaagcctcactggtcggtggtggagcagccctgtttatctggctgaattggccggccatgttgaacttgactgcccagcccccgctgatggcgttgagtgatgccatgatgatgctgatctttgctggttacattgtcttatttatgttgataccgatggtggcgtttgatgtgctctatcaaatccgcagccacttgaaaaagctgagaatgacccgtcaggagatcaaggatgaattcaaggagcaagaaggggatccacatgtaaaggcacgcattcgtcaacaacagcgggcggcggcacgtaagcgtatgatgagcgatgtgccgaaggctgatgttattgtgaccaacccgacccactacgccgttgccttgcagtatgacagcaaaaaaatgggcgcccccaaagtattggcaaaaggggcggggcttattgccttacgcatcaaagaaattggtgcagaaaaccgaattccgttattggaagccccaccactggcaagggcgttatttcgtcatgccgaagtggggggctttattcctgcgacgctttatgctgccgtcgctgaagtgcttgcctgggtttaccaattgaaacgttggaaacgagagggcggcctgaaaccgaaaacacctgaaaatctgccggtgccatctgcactggattttgctggagaaaataatcgtcatggctaa

SEQ ID NO: 5558 - DNA, 120 bp, Xenorhabdus bovienii
  Coding DNA location: Contig name=SeqID_16908; Position on contig =116757..116876bp; Strand=+
atggcgggaatactgcaaagtttgcagaggtatttggggaatcacacgataccagagcttggaaggctccggaatcgtgagatgagtgttacttataacggttctgtcacattaaggtga

SEQ ID NO: 5559 - DNA, 135 bp, Xenorhabdus bovienii
  Coding DNA location: Contig name=SeqID_16908; Position on contig =116886..117020bp; Strand=+
atgttctgccttttactctgtgagctgagcatgtctttaatacggaaatctttcaaacgtctgcattatcctgttgacatcatggctcagtgtgttcgctggtatctggcttactcgctgagtttacgaaattga

SEQ ID NO: 5560 - DNA, 132 bp, Xenorhabdus bovienii
  Coding DNA location: Contig name=SeqID_16908; Position on contig =117009..117140bp; Strand=-
ttgttggggcggatttttaccaagcctattttgaaattaattcaacctttatttggcgtagggctttacggaaaaaatgctatacggcggcaacatccctcgttccgccctcatttcttctcaatttcgtaa

SEQ ID NO: 5561 - DNA, 927 bp, Xenorhabdus bovienii
  Coding DNA location: Contig name=SeqID_16908; Position on contig =117159..118085bp; Strand=-
atgcgggattaccgtgtcacttaccgcattcaggacctgagtgttctgcaaccggcagaggaagttcaaatcaccacgccaacgtatgacataagaggaaagggggagtccggggctcaggtgaccgtggccgcttccggtaagccgctgtgtagcgcgattgtggacgggcagcagaactgggtttgcccgcgtttcgtctcctcgccgggctggtatgagattgaggcccggcaaacgctggagggatatagctggggcaaaccggtcacccggcactatgaggtcatttacgggatgccagatatcgtcatcaacagcactgccccggcattttgtccgccgccgaacaccggccagccaacgtcggccttcgtgacggggaaagccctgccggggagctacattaccctgaatgcttccgccggtcatacctgcgggaccacccaagcatcggcgaaaggaagctggagttgccgccttgataatgtctggttagggaagtttcacctgacggcgttcccgtcactcacgcctgatggccgtccggtgggaccgacagtcgagcaggaggtgaccatcagggagaataccttcagggtgctggaacccggcaatcgtgtggtgtatgaaactcgctcaccttgggggcgtgtagcccacataacgatgtacggcgtaggaacaccgggggcagaggtggagcttgaagtcgtgagagcgtcgggatggaagaccacgagccgggtcagggtggggaatgatgggggctggaaatacgacggattccagttagatatagggtggtatacgctgcatgcctcccagcaggggtgtgacaagggttcgtcggcggatattcatttttcggtaacatcgaagccgataacgatcccctgccctccacatgtcatatgtgataactaa

SEQ ID NO: 5562 - DNA, 1767 bp, Xenorhabdus bovienii
  Coding DNA location: Contig name=SeqID_16908; Position on contig =118122..119888bp; Strand=-
atgaaagcaggtaaaatagttgctaaaaatactacttacatgacagtcaaaaagaaaaataataaggacaaggacaaatttaaaagtgattaccccaaaaataatacaaccgttgatccggatggcaccattcagctttttggctcattcggtactgtcggcggtgtcgttgcgggggctggagttgctgtcgtggggctgttaggttcgattttcggggccgtcagtggagccgtgtctttagttgccggactgcctgctaccctttggggcgtcgcgatcaatccgaataaactcggcgggggagatatctacacgctgacattacaggaaacccactacggtcagcttgtcggcgatccgatcatctggacgtttacggtgccgatgcggattactgagccggggctgaatgcccagtaccgggtagataaccccatttccattaaaggcgaaggcacgcccggccagcttatcctgattgccggctcacagtatttgctgtcgtccagattaaccgtggggcaggttccagagaacaacctgatttgtcagaccacggttaatggcgggggaacatgggcctgccccaataacccggccatgacggcaaaactggcgggcaccttcttcttgtatggggcacagtataaaaaaactgcaccgggtaacgtggatgccatgtatgaaagaacctcggcggtggtgcgccggtatgacatcacccagacccgtatcaatatcacggccccccggcagggcgccaaaatcacggtgctgccattgaccatcaccggcacgggtgagccgagagctcaggtacatctcggcagttttggcgggacaccgaagtgtaacaccgatgttgaggcatcagggatctggtcttgcgggccctatcagccggaaaagggggaatacacgctttccgctgaacagcttatcaataatcagctgcactcaacggcacaggtttcctttgacgtccagactgaccgcatcaggccgctggttatcacccaaccacatcatggtggggtataccggtatcaagagtcggttgtgccggcgggccaaagcgaaccgggcaccacaatctgtctggcagagcaggcgctggagcaggtatgccagaacggggtcacagtggataaagaggggcgctggacagagcgtgaccgcctgaacaccgcgcgcaagggggaacaaactctggtagcaaccgcctttttgggccaggctcggcaatccacggcgaaggttacctttcaggtggagggggctgacggtgaacgcctgctgacggtgaacgtccccggagaggcggcggtgataaaaaccccgtcttatacctttagtggcaccctgccggctaacggcaggtcggtgacggtgcatgcgtttggcggcaatgagggttgcactgcggagctgaacctgaccagtggtagttggacatgcgggccctacagtgcagtgcctggggattaccgtgcggtcattgaggatgataccggcagccggattgcgcggagctttaaggtgcgttatggggataacctgcagatgcgcgtgcttgaaccggcagaaggggcgcaaattgaccgcccgctttatgccattaacggaacagggcagacaggggcgcgcattacggtgactctggcgggcgagccagtttgtgagacaacggtggatgagcatcagacgtgggcctgccaggaacgccagctatcccgtcagggggattaccaactgctggcctag

SEQ ID NO: 5563 - DNA, 2526 bp, Xenorhabdus bovienii
  Coding DNA location: Contig name=SeqID_16908; Position on contig =119949..122474bp; Strand=-
atgaatatttttaggacgttctttatactgcttttattattatttttctgtgattatgctttttctaattctgcattgaaataccagccaataaaagctatcgcgggaggggagaaaagctgcgattctggtagtggtaacaaatgtaaaccttgggttgtcaatatatatgttcaatcgaatagcgatacgcaatatgcattatgtagtggttcagtaattgcacgaaagtatgttcttacagctgctcattgccaaaagaaaaatataaaaaaatatatcataaaaaattataaaaatgaggagattagcactgcattacctcatagttttattgcgagttacaacggttcagatcttgctattttaaagttggaaagtcctgttatattagttagttatggacatgttcgtcgtttttttaattatgatgaagcctatgaaaaatttagaaacagttattatgatgcttctatttatgggtattgttccttcggaattaataaaataacgggagcgcaagtaaggaattcaggagaccaatatagggctgatgtgaaaatgttcaccacagctccagactctcgtaataatcaaggattgatggtagaggaaaatttaaatgaaaatttaaaaccaggaattgcacaagaaggggattcaggtggcccacttatttgggatgatacaattattggtgttgtatcatggggatattcttattttgaaaaaaaatatcaagatagtgatagtcgctctcatttttttgttatgtcagatgttactggaaagtatattgatattggcctgagtaaaaaaaggtctatgagtagttggttttctcggactatgaataaaatttggattgagagtccagactggaatagtcgcctaagtagaagaggtaagagtgttgttgttaaggggtttgggcgtccaaacagtgatctcaaacttgattattctgttggcaataaaaaaaataaggtaattaaatgtaaagatctagataatatgaagaaagaacattcagttgataactttggaaaatggaagtgtgatattccatatgacagttatttcactgaatttgttactgaaaataaggaatataaagtggcgattaaagccagagaatctaaagaggattctcggggatggaaggaagatattatacaagccaaaatcccacctgaaaaagaagaattcagtatcgtttatccaacagataaatcaattgtacttactaaaaattttatcatacgtggatacgcagatcctaattctaatgttaaattgattctgaagtctaactccagcgataaaagctatacacaagataaaatatgtaacggccttgaagataaagaattaataaaaacaggtgaggatggggtatggtcatgtatgatagattatcaacttattattaaatctggagatataaataaacaatatgatattaaaataacagcaatgcaaaatataggaaaggtgattattcctgacgggattaatatgattttaaaaccagaagactataccgagttaaaaatcgaacagagtaatgaaagtaagaataatatatacagaaaaaatcttatatttgatgtgaattactctaaatatgcaaaggtcgtatgtgtttttaacaggaaaagcttcagttgtaaaaataatactgatggtaaaggtgatttttatttgggtaatatatcagcgggaagagataatcttaattcgcatgaaaaagcacgctttaacataagtgcaatacaaaagattgaaggagcagatccttttgacccaaaattgtggagtgatattaattatgagtctgtgggaggatattttcctccagactttaatgaagtgcatgatatctctcaccccaaaagtatcttgtctgctgaaattgaaaataatgtaattactggatttggtggtgataataaacgctatactgatatgaataatgatataatcttaccttcagaatactctatatgtatgaagaaagggggtgattcgcctttacctccaggctcttctctgtgttctgaaaaaggggataataatatttacttaaagattccattcaaagatagtagggagttttcggaacttccaataaaatatggaaatttttcgggtaggaaaaattttccaatttggagcattactcttccacctacattgaaagatggactatattatcttgaggtaacagataaatatcatccattaggattgcctaatttcaaagaaacttactactcaattctaaataaaacatattttcaaatattaactcctaatgttgaaattaaaactccttctgtgggcgacgtgaatactgtaggtacgccaagttttgtatcaggtgatgctaatgtacccggtgatgaagttgatgttaaaaagcgcaaaattacattttctttggaaagtcagggaaagaataatttaaacagtgcacaagaaactgttatttgcacgggagccatcgtcaatgataatggttag

SEQ ID NO: 5564 - DNA, 819 bp, Xenorhabdus bovienii
  Coding DNA location: Contig name=SeqID_16908; Position on contig =122641..123459bp; Strand=-
atggtaaaagaatataaaccaaacattgatattgaaacagggaaatggagtgtggaaggtttagacgcagaatgttttacttattataaagcctctatatatttccagtcagatcaagaagataatccagatatgtcagggaaaagatcggttaattatgatgtatcacattgtccggtaaaaattacaaaacctacaatgtatcaaatgatttcttcaataagtgaagattataataaaattggtgttgaaggaaaagttacacagaacactcctcttgatattagtgcgagtgattcttcaggtggcaagaatctaattcatttaaatagccgtactggaaatgattggctagctgaaattagtgacgcacctaatggttttataaaaataaaggcgaataataccggaacagatcaggttaaaatcaaaaacagtgaggatgaagttattatacttaaatcaaaagaattttctgtgaactatgaatttcccgataaagtgtttatcgatttttatggaacctctatgccgatgatttctgaaaaggaaaacgataaatcgaatggttttaaagaatctcttcaccctacaataagaatcttgcttgatggtgaaaaagcagatgaaataatacccgatgaacggggtgattggaaatcgaacaataaatattatgcgaaaagaggggtatatacctttactattcaagaaatatccgataacaaaagatataaggcacgagaagataaagtattggagtgtaaaggaggaacgagcaatatgacttgttttgaaaaaaataattatactaaatag

SEQ ID NO: 5565 - DNA, 1224 bp, Xenorhabdus bovienii
  Coding DNA location: Contig name=SeqID_16908; Position on contig =123510..124733bp; Strand=-
atgaaaataattaaaataaatttatatattgcattgttttttagcattctgttcacctttaataaagccagagcagataacttaatcagtgcagataatattataagtgaaaaaaattataaatttaaaaaaaacataattaatctagaaagacattacgctctgatatttaaaaacgaaagtaaaaatgatgatttagaaattaaagttttagattctaattgtatgaaaaacagtggtgaccaatatatccatttaagcccgggagaaattaaatatgattatactaaagatagtaatgcttggccagactgcttaagagaagcaaaaattataaaatggaaaattattacttataaaaaaggtgtagaatacaaatcatgtgattttgagattaaaaactccgtgccgtcgtttccaagtgaaggatatttagtttggagaactattattaatgcagcaaattgtgatcttgtaaccagcgctttatgtggtacatcgaactgtttaaataattctgtttatactgactcttatgatattaacataagcattaaagatgataacaattgggaaccaccaaaaattatttcccctgatagaaagcattatgctgaaaaaaattatattacagttgtagggcaaggactcatggaggacgaatcgttgcctttaattatcacaagttttgataataatatatatcaagttgataatacaggagaagctgaagataaatggagtgcgaaaatctgggcgaattgtggtatatcaggaacagttagcattaaggatattgcaaattcagatgtaactattatcggcacaccatgtggtgcaaccataacatcaatgaaagaaaatcagctcttatcttcaggaaaatataatttatccggactaattaatggttataaattagatgatatcaagaatgaactgagtgtgaagatagctaacttttctgatcctgaacataaaaaaggtgttgggatggtaaaagaatataaaccaaacattgatattgaaacagggaaatggagtgtggaaggtttagacgcagaatgttttacttattataaagcctctatatatttccagtcagatcaagaagataatccagatatgtcagggaaaagatcagttaattatgatgtatcacattgtccggtaaaaattacaaaacctacaatgtatcaaatgatttcttcaagaatgaactga

SEQ ID NO: 5566 - DNA, 141 bp, Xenorhabdus bovienii
  Coding DNA location: Contig name=SeqID_16908; Position on contig =124927..125067bp; Strand=-
atgggctatgacctattttctttttatatcaaacgtatacaaaagccaatgacgttgttttttgttaccgacaaaagatctttattcaaaaacacaagaatatcaaattaccgctttggaatcatgaccaataatttataa

SEQ ID NO: 5567 - DNA, 228 bp, Xenorhabdus bovienii
  Coding DNA location: Contig name=SeqID_16908; Position on contig =125016..125243bp; Strand=-
atgactcaatggttctggcgatacaacaaggagcggcagactattgcctatcagaattacgactcgacgattttccatataaccccctcagtcatcggttgttatgaaacgaatactaaaggggtcagtaagtcgaacaatttgcggcaggttgcatcggttcgcgaaccgaatacatgggctatgacctattttctttttatatcaaacgtatacaaaagccaatga

SEQ ID NO: 5568 - DNA, 153 bp, Xenorhabdus bovienii
  Coding DNA location: Contig name=SeqID_16908; Position on contig =125258..125410bp; Strand=-
atgcgttttctagcgcgatggataacccagcattttcaggatcagagtcagcttttccctcgtcaatcggcgacgtccacctttacggttgaaccatctgtagattattcgcttatttgggtaggtaaactgcccaactcgtcggccagataa

SEQ ID NO: 5569 - DNA, 222 bp, Xenorhabdus bovienii
  Coding DNA location: Contig name=SeqID_16908; Position on contig =125578..125799bp; Strand=-
atgtgggtaccggatgctgaccaaagaataacgatttggcggtttatggtggataaaaaccatcaaaacaagggtattgggcgtaaagcactatcactggcgcttgatgaaatcaggcgcacagttcagttggagacaatagcaatcagttatgatccgaataatctcgtggcgaaaaatctttatgccagttttggtttcgttgaggttggcatggattag

SEQ ID NO: 5570 - DNA, 174 bp, Xenorhabdus bovienii
  Coding DNA location: Contig name=SeqID_16908; Position on contig =125769..125942bp; Strand=-
atgaagctgtctgcgacctatcagtcactgatgaccaacttgactatattgcggaaaatatgtgatctcttgctcaatccaaattttaccctttataccaaacgcgtgcaatttgtctggatggggagcctgttggttttttcatgtgggtaccggatgctgaccaaagaataa

SEQ ID NO: 5571 - DNA, 141 bp, Xenorhabdus bovienii
  Coding DNA location: Contig name=SeqID_16908; Position on contig =125878..126018bp; Strand=-
ttgacggttctggcttacaatcccatattggagtggtgtatgttaattaccttaactgacgtaaacaagaacaattatgaagctgtctgcgacctatcagtcactgatgaccaacttgactatattgcggaaaatatgtga

SEQ ID NO: 5572 - DNA, 312 bp, Xenorhabdus bovienii
  Coding DNA location: Contig name=SeqID_16908; Position on contig =126032..126343bp; Strand=-
atgaaaaataagaaactcaaaagacttcagaaagaactcgatacattaggattcattgaaaaagatcctgatgtggtcggttatgcgctatttaacacgcgtaatcgtcgatttgcgacgttggatgaaaatgaatttgggatggtgatatacgccgatgatattgaagaagcctatctggcaacgtcacgattttctgccttaatggatattggctttttgccagaaccagaccaattcgatattgccgttatcccagtcattgagaacccagtatttggattaatacttaaaaaaacagttttaaattaa

SEQ ID NO: 5573 - DNA, 102 bp, Xenorhabdus bovienii
  Coding DNA location: Contig name=SeqID_16908; Position on contig =126356..126457bp; Strand=-
atggttaaccaccgttcatctttgatgagcggtttttttaatgccaaaagacccacgatttatcggactttgacacgcaacagaatggctaatgataactaa

SEQ ID NO: 5574 - DNA, 1377 bp, Xenorhabdus bovienii
  Coding DNA location: Contig name=SeqID_16908; Position on contig =126512..127888bp; Strand=-
atggaactgattacacaatggttaaatgcgataaacgggatagtatggggaatacctatgctggttggtattctgggcattggcatttttatgcaaatccgcctgtccttcttaccgatccgaaaattgggaacggggtttaagttactttttcagaaaaatgaacaacgtggtgaaggtcagatctctcctttcaatgccttgatgactgcgctgtctgcaacaataggaacaggaaatattgccggtgtggcgacggctgtcgtaatgggcgggccgggcgcattgttctggatgtggatgacggcattattgggtatggcaaccaaatattctgaagccgtgttggcggtacgctttcgtgaaacagataaaaacggcaactacgttggcggccccatgtattacatcaaaaatggcttggggaaaaaatggatttggctaggaacactgttcgccttctttggcagtatcgccggttttggtattggtaataccgtgcaggccaactctgtggctgacgtactgcacagcaattttggtattgaaaaaaccgtgaccgctggcattttggtcattctggttggtgcggtattgattggtggcatcaaacgtatttctgatgtggctggcaaattggttcccgtcatgactgtcggctattttggtgccggcatcatcgtactggcactcaatatcaccgccattccagaagcctttgtcttgatcattaaatctgcgttcactcccgttgcagcacaaggtgggtttgcaggtgcagcagtctgggcggcgatccgctttggtgttgcccgtggtgtattttccaatgaagcaggcttgggcagcgctccgatagctcatgctacggcaaaaacccaaaaccccatccgtcagggtttgattgctatgctggggacatttattgacaccatcatcgtctgttctgtcactgggctgaccatcgttatcactggcggttggttgacaggggaaacaggggcaacactgacagcctcctcattctctgcggtgattccgggaggtaattacattgttgctgttgccctggctattttcgcctttactaccatcttgggatggagcttctacggtgaaaaatgtatccaatacttactggggccaaaagccattgtgcctttccgtattgcctggatcatcgcactgccgattggtgccactcagtcgctgaactttgtctggttgctggcggatacactcaatgccatgatggcgatccccaatctgatagctcttgctctgttaagccctatcgtgtatcgcttgaccaaagatcatatccgcgacgttaacgctgatagcatcgaaatgaaaacagcaaccaaaacagattaa

SEQ ID NO: 5575 - DNA, 189 bp, Xenorhabdus bovienii
  Coding DNA location: Contig name=SeqID_16908; Position on contig =127879..128067bp; Strand=-
gtggataattgctgtctggaagatcaatacatcgttaccagagtgagtgactcaactcacaggatcaattttttcttaccaatgataaccaattgtcctcgcttattttcccaaaatgctctttatttaattgaaacaattttgttgctaatttgttatgtcagattacgggagtgtatatggaactga

SEQ ID NO: 5576 - DNA, 609 bp, Xenorhabdus bovienii
  Coding DNA location: Contig name=SeqID_16908; Position on contig =128173..128781bp; Strand=+
atggtttttttgggtattgaaggattatcagtggcaagagtcgggtatgtcagagtgtcaacaaatgaccaaaatagtgatttgcagaaaaatgcgctggtcagtattgactgcgagcgcatttttgaagacaagatcagtgggaaaaccgctaatcgtccggggctgaaacgcgctttaaagtatctgcaatccggcgatactctggtggtctggaaattggatcgtctggggcgcagtgtaaaaaatctggtgacgttgatttcagaactgcatgaccgcggaattcattttcagagcctgaccgatagcattgataccagtaccgcgatgggacgttttttctttcatgtgatgagtgcactggcggaaatggaacgagagttgattgttgaaagaaccaatgcaggattagccgcagcgcgggaacaggggcgcattggtgggcggcctgtgctgtttaccgaagaagatcggcagcaggccgccagattgctggataggggacatagcagaaaacaactttcccttatttatcatgtttctctatcaacaatttataagtatttgcctgtgggccaggtgattaatcttccattacttgattaa

SEQ ID NO: 5577 - DNA, 180 bp, Xenorhabdus bovienii
  Coding DNA location: Contig name=SeqID_16908; Position on contig =128866..129045bp; Strand=-
atggggtattcattatcaaaggcaggcaggagcaccaaatatcagagaattcttcccccctcgcgttggagtctattgaataggaacgagaacaatattgaagtaagagtctctgaaaacagctttattaaaggcacaggaacaatgagcactcgtttcccacaccatcagccgcaatag

SEQ ID NO: 5578 - DNA, 180 bp, Xenorhabdus bovienii
  Coding DNA location: Contig name=SeqID_16908; Position on contig =128963..129142bp; Strand=-
atggattatcttgattatggtttttatcaggaaaatggacagaccatgaataacataactgcctttgcctttatgcattacaaccaagaggaaaaaaatggggtattcattatcaaaggcaggcaggagcaccaaatatcagagaattcttcccccctcgcgttggagtctattgaatag

SEQ ID NO: 5579 - DNA, 126 bp, Xenorhabdus bovienii
  Coding DNA location: Contig name=SeqID_16908; Position on contig =129148..129273bp; Strand=+
ttgccagtccttccccatgttcggcagcgtctaattcatgatatttctctctctcatgaccacctgagacatgaaatacccgtaattagcgagtataaacatcgtcattggcaggcaggggaataa

SEQ ID NO: 5580 - DNA, 828 bp, Xenorhabdus bovienii
  Coding DNA location: Contig name=SeqID_16908; Position on contig =129233..130060bp; Strand=-
atgaatgtttttaatccaactttatatgcctgtacaccgactgtcaccgtcatggacaatcgagggctgtcagtgcgggatattgcttatcaccgtacaacagcaggagagcaggctgacactcgcatcacccgccatcaatacagtccccataattttttaatcgagagcattgatccacgcctttttgatttgcaatctcagagcaccataaaacctaatttcacctactgtcctgccttgaagggtgatgtcctacggacagagagtgtggatgccggacaaactgtcattttgagtgacatcgaaggtcgtccgttactgaatatcagtgcgatgggtgtcgtcaaacactggcaatatgaagataatgcactgccggggcgcttgcttgctgtcagtgaacggaagagcgaggcttcaacaccacaaattattgaacgatttatttgggcggaaaatagccaatcagaaaaagatcacaatctggcgggaaaatgtctccgtcattatgataccgccggattaaaccagcttaatgctgtgtctctgaccggcgtggatctctcacaatctcgtcaattattgcaggatcttgtctatcactatgatccggtcggtaatctcctgaatattcgcaataatgcagaggtaacccgtttctggtgtaatcagatagtagaaccagagaaccactatgcttatgacacgctttaccagctagtcagcgccagtggtcgagaaatcgccagtatcggtcagcaaggcagccgattgcctgtactgattattcccctgcctgccaatgacgatgtttatactcgctaa

SEQ ID NO: 5581 - DNA, 147 bp, Xenorhabdus bovienii
  Coding DNA location: Contig name=SeqID_16908; Position on contig =130008..130154bp; Strand=+
atgacggtgacagtcggtgtacaggcatataaagttggattaaaaacattcatcgtattttttcctaatcagcctgaatcggatgtaaaaaagatgacgttaaaatgcggtcttaaccttccccgcctgcataacagggaaggttga

SEQ ID NO: 5582 - DNA, 1608 bp, Xenorhabdus bovienii
  Coding DNA location: Contig name=SeqID_16908; Position on contig =130172..131779bp; Strand=-
atggggggctatccccggcgcaataaaccggcacagaacccctatccggattcgttaccggatactctgttcgccgatagttatgacgaccagcaaaaacagctatatctgacaaaacagcagcagagctattaccatctgatccagcaggatgattgggtgctgggtctgacggatagccgatacagcgaagtttatcattatgcgcaaactgacgctcaaagtgacattcccaaggcagggctgacattggaagacctgctggcagatgacggcctgataggtaaagacaagacgtttatctatttagggcagcagcgagtggcttacgtgggtggagatgcagaaaaaccgacacgtcaagtacgggtggcttatacagaaaccgctgcttttgatgacaatgcgctgcacgcctttgatggcgtgattgcccctgatgaactgacgcaacaattgttggcgggtggatacctgctcgtgccgcagatttctgatgtggcaggcagtagtgaaaaggtatgggtggctcggcagggatacaccgagtatggcgatgcttctcagttctaccggccactcatccagcgcaagagcttgctgaccggaaaatataccctcagttgggatactcgctattgtgtggttgtcaaaaccgaagatggcgcgggaatgaccacgcaagcgaagtacgattaccgcttcctgctcccggtacaattgaccgatattaacgacaaccagcacatcgtgacatttaatgcattggggcaggtgacttccagccgtttctggggcacagaaaatggcaaaataagcggttactcgacgccggagagtaaaccattcacagtgccggataccgtcgaaaaagcccttgccttgcaaccgacgatcccggtttcacagtgcaacatttatgtgccggatagctggatgcagcctctgtcccaacagtctctgactggccagctaaaagagggggaaactttgtggaacgcattacaccgggcgggtgtagtaacggaagacggtttgatctgtgaactggcctgccgtcgttggctcaaccgccagacaccgtcttcaatggaagccgtgacattacagcaaatcttggctcagactccacgacaacccccccatgctatgacgatcacgacagatcgttatgacagcgattctcagcagcaacttcggcagtcgatagtattgagtgatggttttggtcgcgtattgcaaagcgcccagcgtcatgaagcaggagaggcatggcagcgtgcagaagatggttctttggttgtcgataataccggtaaacccgttgttgctaataccacaacgcgctgggcagtatctggtcgcacagaatacgacggcaaagggcaggcgattagagcttacctgccttattatcttaatgattggcgctatgtcagtgatgacagcgcccgggatgacctgtacgccgatacccatttttacgatcctctggggcgtgaatatcaggtaaaaaccgcgaaaggattttggcgtgaaaacaggtttatgccgtggtttgtcgtcaatgaagatgaaaatgacacagcagcacgtttaacatcttaa

SEQ ID NO: 5583 - DNA, 684 bp, Xenorhabdus bovienii
  Coding DNA location: Contig name=SeqID_16908; Position on contig =131668..132351bp; Strand=-
ttgaagcagcgcttgtataacctgcgtcataatctcaccattgatggcctgccgctgtcattgcccatttacgccaaacctgccgatcctaaagccttgttgagtgcggcggtgaatgcttcccagggaggcacggatctgccaaacccggaaatgccacttcatcgtttccccatcatgttggataacgcgaagagtatagtcagtcaactgattcagtttggttctactttgcaggggatcattgaacgtcaggatgcagaagcgctcaacgaattgctgcaaaatcaagcgcgtgaactgacgctgatcagcattcagatgcagaataaaacgctggaagaattggatgcggaaaaagaagtactgaaacaatcccgacaaggggcgcaatcacgctttgacagctatagcaagctgtacgatgaaaatatcaacgcgggcgaaataactgctatgggtttgcgtgctactgccagcgcgataagtactgcgctggaagctgctaaattggcagaggccggtgctgatatgttcccaaatatcttcggtcttgctggtggtggcagccgatggggggctatccccggcgcaataaaccggcacagaacccctatccggattcgttaccggatactctgttcgccgatagttatgacgaccagcaaaaacagctatatctga

SEQ ID NO: 5584 - DNA, 1083 bp, Xenorhabdus bovienii
  Coding DNA location: Contig name=SeqID_16908; Position on contig =132358..133440bp; Strand=-
atggtggaacgggcagaaacgggcattgataccctgctggcaatggatacccaacagctgcctgaacctaaaatgggagatgggggatatattagtgtcaccttacccaaatatgatccagataagcatggtagtaccagaaacgccgcggtcacactttatcaggaaaaagatggtgtagactcaacaacgcattacggcttctgggacgggtcgttaacagatgcagaacaaaccatcaaactgtttattccattaactagcacgaaagaacctttctataacacgattgattttccatcttcgataagtgacgggcttcaagtttttctaaaaagcgctaaggaaggtttgctggccggaaccttaaaaacagcgtttactccatctgaggataagaaggccaatattgtcttcacggaatatacccctgtttcgggtacgccacccatgaaggttgaactgctgtccaaatattatgatcagccgatggattttaacggcgccaactccctctacttctgggaattgttctattacagcccgatgctggtagcgcagcgcttgttgcaggaacaaaattttgatgaagccaatcattggctgaaatatgtttacaaccctgagggctatatcgtcaaaggtgagattgcgccgtatcattggaattgccggccactggaagaagatacttcgtggaactctaacccgctggattccacagaccccgatgccgtcgcccaagatgatccgatgcactataaagtttctaccttcatgcggatgctcgatatgctgattgcccgtggcgacaaggcttaccgccagcttgagcgggatactttgaatgaagccaagctctggtatatacaggcactgagtctattgggggatgagcagtttgtggcgctggatagcaactggtctgaacccacgttggaaaccgcagcggataagacggtggaacaggattatcagcatgcgctgatgttaattcgcctggtacagcccgccgaatataccgctaactcactgaccaacctatttttgcctcaacaaaatgacaaactgaacggctactga

SEQ ID NO: 5585 - DNA, 4911 bp, Xenorhabdus bovienii
  Coding DNA location: Contig name=SeqID_16908; Position on contig =133260..138170bp; Strand=-
atgtacaatacagaaaatatattttttaggcttaatagggaaaaccatcggaaaccgataacattggctcatattatgccgatctcattttcagcgttcaggaaagaagtcaaagacacactgaattggggagaaagcccccatctgtatctggccgccaagaaagccgaaaaagaaaacaggatttttgaagcacgtttattatcccgcgccaatccgcagttaaggggagctgttcatctcggcattcagcaactctcgcagtggcaaagttacgatatgctatttggcggacggtcagataagtatgtattgtccggctctgtcgcctctatgttctcaccagccgcttacctgacagaactgtatcgggaatccagacatctgcacctagaatcacccatctaccatcctgataagcgtcgccttgatttgcaaagtataatgttgtcgcaggaaaaccaagatcaaaccctctccacgcttgaactatcaaatgacattctctatcctcagctcagtcaggttagtcagtcgccaaaagtgattggtttattgtccccggtcagcctattggggatatcaagtcaaatttcaccagaactgtataaaatcctgacggaagaaattacggctgagaatgcgcaagacatgtataagaaaaatttcggtgacttgccgatttctgcactgtctaatcctaactatttgatgaaatattatgatattgatgcagatactctccgtgctgtaatgggtatctatggatcaggccaaaacgatgatgaacccgcattcatcagcgatcaggccatagtgacttaccttgatgataaaaattctttcgttacttacctgattactcgcaccaaaggcgagacttatggctggcaggttaattttatcgaagctattcccacaaaagatggcaaattaaaatattggtataattttaaagctccggcttccagtgcagtttccaccaaaatttcgctgaatgggcagactatcctcgacagacctgattggctgccggagctcaataagacttattcagatatcgttgatttccccagtgatgctgatagaaaaaaatttactctgaaattcgaaagagcagcctctggcagtggaggtagttttaatacggatgcgacattctcaattgaaacggtattacctcaactctttttcctcaaattgaataaagttattcgcctttacaaaaaaaccggtatcacgctggaacaaattgaaactgctgtggattcagataatgcccaacaacaaataaccgaaacaattctgaaaaagatattttatacaacctactatattaataggtattatttgagtttcaatgatgcactggtgttatgtaataccgcaatatctcagcacagctataatgatcagccttctcattttgaccttatttttaataacccgccattgaatggaaactattaccaattgggtggggataaaattcaagttgatccagatcaggcagattatgaacaatataatcaacggcgtgaaatgctcaagcacgcgttgaaagttaatgacagtgaattattcacgctatctaagattctggatcaagaaaatacatcaggtatcgacaataaccttgctacggatttatctgcgctgtaccgcgtacgaatgcttgcctacattcaccaactttctatcaatgaattggctatcctgctaaaactctcgccatatgctgaagagtcttttaacaaaatcagtacggaaaagttaatcgaagtcattgaatatctttacagtatcacccagtggttacagacacagaaaatcagcatttataccctgtatatgatgacgaccacaacctacagtacagttttatcacccgatattaacaatctgatcgagacgctacgggcgggaatgcagaacaaaaccgtaccagacgatccacttcaacttatcaagaccttggcacccttcattgcagcggcactgaaactttcttcggcatttgtggctgagtcgatcctgatatggatcaacaagatcaaacccaatggcatggatgtcaccgccttctggaaatccattgaacctgtaaaagatccgattaagccggacagcatggtattttgtcaggtgctggggcagttggcattgatttatttagccacgcaactcacggaaaatgctctgaatctggcggtgacaactaaagttatcatcggtcactccagcaataccgatcatctgggcaaagatactgagacggtgagacagcttagccgttttgcgggatggtgtaattcactggctagcaatacagacacagtactgacagctctgcaaagtaacaacttggatagtactattctggcgagcgccatgaggatggatgagaggctgctttcaaccgccagtgaacaggccaatattaatcaccaagttgcagaaaaaaataagtatgcagactggtcagaaatagacagtgttctgcaatggctggcagtggccaatgtgatgaaaaccagcccgaataaaattaatgctcttctccaattggactatctgaaagatcagaatactacagaagtttcttacgaaacatggagccaatcggcagatatactggcggctggactgaatagtaatcagtcagatattctgaaacaagtcttagaggaagaagccagtgccgcattaagccaatattacatccgtgaagttgtggatagtgcggctgaggtgatagatagaaatgatctgtatggttacctgctaatagataaccaaatctccgcacaggtcgaaacgacacggctggctgaggccattgccagtatccagcaatatatcaaccgtgcattgaatggccgtgagagtacccctgccaccgatgtcatgacaggccagttttatcaggattgggatcgttataacaaacgctacagcacatgggcgggtgtttccacgctggtttactatcctgaaaactatatcgatccgaccatgcgtatcggtcagacccacatgatggatgaattgctgcaatccgtcagccagagtcaacttagtgttgataccgttgaagatgcgtttaaaacctatctgacccgctttgaacaaattgccaacctgactgtcgtcagtggctatcatgataatgtgaacatttcacaagggaacagttaccttgtcggtaaaggggaaacggatgccaaccaatattattggcgcaaactggatcacagcaaatcccgtcaaggcaagattgccgccaacgcgtggagtgaatgggcaaaaattgacagcccggtcaatccctatcagggcttaattaagccggttatctataaatcccgcctgtatattatctggctggaaaaacgagtgattactgtttcagaaagcgataaggagggcgtaataacatcgaaagatatcattaaatatgaaatcaaaatcgctcatatcagacatgatggcacatggaatacgcctatcacgttagatgtcagcgatattttcagcgcatataacgatacagacttggccaatctggctatgtattgctctgaatatacgggagaaagtaccttacttttattactgtatgttaaacaggctaatacggagggaaacaaagatctcacaaagaccaaaacaaagggaatgtatatttactctgacatgaccacaaaagtcatggaaaaggatgagattggcaattatcaaaacagcgtttaccgagagttcgatacattgacccaacgatggttaaataaccgttatgcggcaaattatgattatccgtcttccgttgcagtcagtagtggttacgagtggggcgattattctctgagtatggtttatgacagtaaaattgcttccattgctaccgtcggaactacttcatcagagatcaaattgaaaatcgatgccgacctgcgggtaatttataacggggttgaaggcaggcagcgtcaccaatgtgctctgatgcaaaaatttggtcagttaggtgataaatttattgtttacgaagacctgaaaattgacagagagaatcagagtgcaggcaataacaatctcttttatcccgtttatcaatacagtggcaatgtcagtaaattgtcaacagggcgtttattagtttatagagaaagttcatcatcttatgtcaaggcagatattgggccagggcacgatccgctcattaatgaaaatgctcaaaaaccttatggttatgttgaagacagcaaaaataaccccgccgcgctgaaaaataacatgacactgacggataacgcgggtatttctacgaaggtcgcatcaccaagagatatcgatactgctgtaacgccggcaaatatcacgattaaggccagtgcaggcagcagtaaacctgtagagtttaacgctggcacatctgtcataaatctgcccaacaacaacttggaagaaatgatctataacttccatgatatggaattcactatcccactgacagaatttaaggacaaccaagtcgatgtggagatagtgctgaccgggaaaacggatgatggccgggttctgggaagtgaaacctttaattttaccgttacacagaaaattctgaatgaacagtcagggttgctgacgctcaatactgctgcgtctaaagcccaatatctgcaatggggccttaccgtacccgcattaataccttatttgccagaaatatggtggaacgggcagaaacgggcattgataccctgctggcaatggatacccaacagctgcctgaacctaaaatgggagatgggggatatattagtgtcaccttacccaaatatgatccagataagcatggtagtaccagaaacgccgcggtcacactttatcaggaaaaagatggtgtag

SEQ ID NO: 5586 - DNA, 99 bp, Xenorhabdus bovienii
  Coding DNA location: Contig name=SeqID_16908; Position on contig =138622..138720bp; Strand=+
atgaattacaatatattaatggaatcagtaacttatatttttaaagaatcttttaccgcatttatatattctgttaggctttcgatttacgcggtatga

SEQ ID NO: 5587 - DNA, 111 bp, Xenorhabdus bovienii
  Coding DNA location: Contig name=SeqID_16908; Position on contig =138740..138850bp; Strand=+
gtgtgctattttgatgaacttcacacattagataactattctcaatatcgctacattttatttactccatgctttcctccagaaactggaaatgcttcaacaaactactaa

SEQ ID NO: 5588 - DNA, 138 bp, Xenorhabdus bovienii
  Coding DNA location: Contig name=SeqID_16908; Position on contig =138836..138973bp; Strand=-
ttggggattttgctcttagctaccctacctttattgttcaccgatggttacttgctgacatccttcacagtggagcagggaaagtcagccatgtcggtggtggcagtaaaggttctgttttatttagtagtttgttga

SEQ ID NO: 5589 - DNA, 222 bp, Xenorhabdus bovienii
  Coding DNA location: Contig name=SeqID_16908; Position on contig =139214..139435bp; Strand=-
ttggacgtcggcgctgctttccgaatcacccgcccgcaagtcggaaacagaggtatcgttcaagttcatattgcttccttaaatgaaagtaatgtgagaccaagaggattcaaaactagcaacctcacttttcagcgcccaggactctgccactgtggagatttccctttggcagggtgtattgttgcccctgtggcgctgaaaaactcagaattgccttaa

SEQ ID NO: 5590 - DNA, 1035 bp, Xenorhabdus bovienii
  Coding DNA location: Contig name=SeqID_16908; Position on contig =139367..140401bp; Strand=+
atgaacttgaacgatacctctgtttccgacttgcgggcgggtgattcggaaagcagcgccgacgtccaactggctccgagcaaagacaaagatctgcgcagccgcctgccacgtgaatattttgtcaaacgtccagccctattcatcagcaagattgtcttcgcctttgcgctaatcgccctaggatggtatggcgtcggatatgcgctgaacactccggtcaccatcggttccattctggtggccatcggcggcatgctgctcagtggcttgatctacccccacctggttgaactacagcacgaatgcctgcacgaccacgctttcaagtcggccaaactcaaccgtctgttcggcgtgctggtcgggctattcatgttcaactcccattcgcactaccgttacgaccatctgcgccaccacgcctatctcggtactgagcaaaatgtggagcacttcgactaccgcttcaacgatctggcttcgccaaaaggctttgctatcgcattctttgatctcaaccgctatcgccgtgtgttcaatatcctcggtgctgcctacaccggtaaatcgatctccggggtgaacaaggaacaagctcaacgcgatatcaaacaggaatatgtgttctatatgctgatgttcatcttgagtgtggtggcatcggtgtacttccaaacctggctatttgctttggcttggtggctaccgacgctggtgatcgccgaaggcgcacactttatgatcgaaatgccggaacactacgggctggacactcagagctcaccagacgtactgaaaaacacccgtactatcagcactaactggctcatcgcatggtacgtgaacggtaatcacacccacaccgcacatcatttccaccagggtgtgccgatgtgccatgtgaaaaaactcaatgaactgatcaaaccgcaactgcaagtggtagaaacctcctatttcgccttctatcgcaatgtgatcagtgggcgcatccgctcctacgtggatgtgagctgtaaagtcacggattaa

SEQ ID NO: 5591 - DNA, 153 bp, Xenorhabdus bovienii
  Coding DNA location: Contig name=SeqID_16908; Position on contig =140409..140561bp; Strand=+
ttgttaggcagaagtgttaggcggaaattggcattatcatcacgacacaaaggccgtttacccagcgctgaaaactatcgactgctatcggctggcagggctactggaaaacgccgcctccgtgctgcgcataaacaagtagtcctgcattaa

SEQ ID NO: 5592 - DNA, 111 bp, Xenorhabdus bovienii
  Coding DNA location: Contig name=SeqID_16908; Position on contig =140558..140668bp; Strand=-
atgatgaatacaaaacgtcaacagcccctaatcaaatggggaagaaactacctgcttttatcttctcatcttaatattcttatcatgttttttccttatcagcggctttaa

SEQ ID NO: 5593 - DNA, 402 bp, Xenorhabdus bovienii
  Coding DNA location: Contig name=SeqID_16908; Position on contig =140669..141070bp; Strand=-
ttgaaccaaaatccatttggctgtagacagttacggtttacctgttcatttcgaactgtctggggtcaggtcaatgatattgttcatgcggaaagtcttgtatctcagtcacctttatcagattttgtgattgctgataagggatatgatagtcagcgtttgagaagtgttatcgaagaacaaaagtcggttccggtgatcccttatcgcaaaaatagccgaaaattggatcaaaaaattgacaaatgtttatatcgttaccgacatttggtggagaatgcctttgccagaatcaaacattttcgtgcgatagcaacaagatacgacaaacttgaacggaattacgccagcatgctggcactggcgtttattattgtctggttgccaatgtgggctgaataa

SEQ ID NO: 5594 - DNA, 363 bp, Xenorhabdus bovienii
  Coding DNA location: Contig name=SeqID_16908; Position on contig =141067..141429bp; Strand=-
atgccgcgaactatgttaacagatacacaatgggataagctatctgcattcatgcaacatactggacttatttaccacaaaacaaaacatcgccaaacatttgaaggcattctttatcgtatgagaacaggcattccgtggcgcgacctgccttccgaattcgggaaagggaatagtgtctttcagcgttttaatgcctggtcaaaaaagggtattttgcatttaattttcaactggttatctggactctctgatacagaatggttgttcattgatggaagtattgttcgagcccatcagcatagtgcaggagcggcgtctgaagaggatgaggcaatgggtcaaagtcgtggaggacgttga

SEQ ID NO: 5595 - DNA, 234 bp, Xenorhabdus bovienii
  Coding DNA location: Contig name=SeqID_16908; Position on contig =141377..141610bp; Strand=+
atgaatgcagatagcttatcccattgtgtatctgttaacatagttcgcggcatgagggtgaagtctagttattttttggcgaaaacgattatacccaatcatcatgctgttcaaattcccctcacaaaacgtcaacagcccctaggcatagctttattctttaacgtcttcgatagtctactaaagacaattatcgctgtctattcatccagtcttatagggttcgatatgtga

SEQ ID NO: 5596 - DNA, 726 bp, Xenorhabdus bovienii
  Coding DNA location: Contig name=SeqID_16908; Position on contig =141623..142348bp; Strand=-
atgcgttatgccgtccagaacgacattcttgaatccagtcctgccaatgatatatctggtgctctcaccacagtaaaatccaaacatcatcccgcattaccccatgaacgtttacccgaatttttgacccgtcttgctcgctatcgtgggcgtttaattacccgtatcgctttggagttaactttacttacgtttgtccgttccagtgagttgagatttgcccgttgggaagaagtcgatcttgaaagggctatctggaagatccccgcaacaaggaagcccatcgaaggtgttaaattttctgaacgtggcatgaagatgaaaactgagcacattgtgccattgtgtcgtcaggctgtgtctcttatcgaaaccttgcgtgggttgagtggcgattgtgaagtgatgttccctaacgatcatgaccccaaaaaagtcatgagtgaaagtacagtcaataatgccttgcgtgttatgggttatgacaccaaaacagaagtctgtggacatgggtttagaacaatggcgcggggtgcgatgggtgaatctgcattgtggaacgatgatgcgatagagcgtcagttaagccacatagaaagaaaaaacgttagggctaaacatttggacgaacggcggctaatggttcagtggtgggctgattacttagacgcgaacagagaaaagcctataacaccgtatgattttgctaagaaacgccggaaatag

SEQ ID NO: 5597 - DNA, 126 bp, Xenorhabdus bovienii
  Coding DNA location: Contig name=SeqID_16908; Position on contig =142347..142472bp; Strand=+
atgatggcagtcacacgttgctgtaaccgccgggctatatcatgcttggtttctgcatcaactgctttgattggcgctaataggtggcttgttcttaaaatggaaatatcaagcctgccaatatga

SEQ ID NO: 5598 - DNA, 360 bp, Xenorhabdus bovienii
  Coding DNA location: Contig name=SeqID_16908; Position on contig =142441..142800bp; Strand=-
atgatggtgggttatatctggaggtcacttcacgcggctaaatactggcgtatgaaatatcgccgcccaacagacaaaaaggaagaccgactggcttttggtgtctatccggcggtgtctttggctgacgcccgaaccaagcgagatgaagccaagaaattacttgcgcaaggaattgaccccaagatagagaaaaaagggggctacctaagtcggcaggagcatattcctttgaacgggttgcccgtgaatggcatgccagtaataaacggtggagtgaagaccacagcaaccggattttgcgcagtcttgagcaatacattttccctcatattggcaggcttgatatttccattttaa

SEQ ID NO: 5599 - DNA, 162 bp, Xenorhabdus bovienii
  Coding DNA location: Contig name=SeqID_16908; Position on contig =142905..143066bp; Strand=-
gtgtgttgcattagtgcaaatagcttatcccagacgagatctgttaacatagttcgtagcatgatgatgaggcttaatgagtttttggcgaaattgattataccaaatcatcatgctgttcagattaccttcacaaaacgtcaacacgccctaggggcataa

SEQ ID NO: 5600 - DNA, 762 bp, Xenorhabdus bovienii
  Coding DNA location: Contig name=SeqID_16908; Position on contig =143005..143766bp; Strand=+
atgctacgaactatgttaacagatctcgtctgggataagctatttgcactaatgcaacacactgggctcgtttatcataaagccggacatcgtcttattcttgaggggatcctttatcggatgagaacaggtatcccatggcgtgacctgccgttggaatttggtcgatggaatacggtctttgtgcgttttaatgcgtggtcaaaaaagggcgttttaaatctgatattcaaagggttatctggacttgctgatagggaatggctatttattgatggcagtattgttcgagcgcatcaacacagtgccggggcagcaacaaatgaagaggaagcgataggcaaaagccgtggtggacgttcaacgaaacttcatttggccgtagacagtcagggtttacccgtccactttgaactgtcaggggggcaaacgcacgacattaagcatgcggaaagtctggtgaataactccccggcatcagattttgtgattgcagataaaggctatgatagtgacgctttcagaaatatcgtcgaacaaacaggggcaacacccgtcattccttatcgaaaaaacagccgaaaatcagaaaagcccatagacaaagggttatatcgttaccgacatttagtggagaatgcctttgccagaataaaacattttcgggctatagcaacgagatacgataaattagaacgaaattatgccagtatgttagcactggcatttactctcgtttggctaccaatgtgggctgattga

SEQ ID NO: 5601 - DNA, 657 bp, Xenorhabdus bovienii
  Coding DNA location: Contig name=SeqID_16908; Position on contig =143909..144565bp; Strand=-
atgagtgaaaatccagtcatgccgagagatgaggcggttactaccagtgaaataatcagtcgtattgggcagttaacgagaatgctgcgcgatagtctgcgtgaactggggttagatcaaaccattgctcaggcggctgaggcgatccctgatgcgcgggagcggttgaattacgttgtccagatgacggcacaggcggctgaaagggtgctgaactgcgttgaagaggcacagccccaccagaatgaattggaatcttcggcgaaatccttgacccagcgctgggatgagtggtttgcaaacccgaacaatctggaactgacagaggctcgctcactggtgacagataccagagattatctcaatctcgtacctgaacatgtctcatttaccaatactcaattgcttgagatcatgatggcacaagactttcaggatctgacggggcaggtcatcaaacggatgatggaagtcattcaggaactggaaaaacaattggtcatggtgttaatggaaaatatgccttctgaccagatggccaaagcgaaaaaagagaacgacagccttcttaacggccctcaggttaatcagaatggagctggtgttattgccaaccaagcgcaggttgatgatttattggatagtttaggtttttga

SEQ ID NO: 5602 - DNA, 411 bp, Xenorhabdus bovienii
  Coding DNA location: Contig name=SeqID_16908; Position on contig =144575..144985bp; Strand=-
atgaaattccaaggagtttttatggcaagtaaggatctgagatttctggtcgtcgatgactttgcaactatgcgtcgcattgtacgcaatttattgaaggaactgggcttcaacaacgttgatgaagcccaggatggagccgaagcactggctaagcttcgtgctgctgaatttgattttgttatttctgactggaatatgcccaatattgatggtctcgaattgctgaaaataattcgcagtgaagaaaagctggctgccttacctgtcctgatggtaacggcagaggcaaagaaagaaaacattattgcagcagcgcaggccggagccagtggttacgtcgttaaaccgtttactgcggcgattttggaagagaaactcaataaaatatttgaaaaattagggctctaa

SEQ ID NO: 5603 - DNA, 1053 bp, Xenorhabdus bovienii
  Coding DNA location: Contig name=SeqID_16908; Position on contig =145033..146085bp; Strand=-
atgaataaaataactgtactgtgtgtggatgattcggcgctgatgcgccagatcatgcgggaaataatcaatagccacccagatatggaggtggtggactgcgcgccagatccgtttgttgcccgtgatttaataaaaaaacacaaccctcaggtattaacattagatgttgagatgccacgcatggacggcattgattttcttgaaaaattaatgcgtttgcgtcccatgccggttgtgatggtttcgtctctgacggcgaaaggatcagaaattacattgaaagcactggagttgggggcggtcgattttgtaaccaagccgcaactgggccttcgcgaaggaatgctggcctatagtgagctgattgccgaaaaaatccgcgctgcggcgcaggcaaaaatcagtaccatgccgtccagtcctgtgattgccaccccattgaatttcaagccactattatccagcgaaaaactgatcgcagtcggcgcttcgacagggggaacagaggcaataaaaaacttgttgcaacctttgcctgtcaccagcccggcgttactgatcacccagcatatgccgccgggttttacacgttcatttgcagaaaggctcaataaattaagccaaatcaccgttaaagaggcggagaatggtgagcgggttctgccggggcatgcttacatcgcaccgggggatcaccacatggaactgtgccgtagcggagccaattatcaaatcatgactacccgggccccgccggtcaatcgtcatcgtccttccgttgatgtgctgttccgctccgttgccaaacatgcgggacgcaatgccgttggtgtcatcttgaccggaatgggcagtgatggtgcagccggcctgctggaaatgaaacaggcgggtgcttatacgctggcacagagtgaagcaagctgcgtagtttttggtatgccacgagcggcgatccagctgggagctattgatgacgttatggatattcaaaaaatcagtaaaacgatgctggccaaaatcagcgcagggcaatcgattcgtatttag

SEQ ID NO: 5604 - DNA, 891 bp, Xenorhabdus bovienii
  Coding DNA location: Contig name=SeqID_16908; Position on contig =146078..146968bp; Strand=-
atgaaatccaatttagcagcctcagatactgatgctatttcaccgctgaactttatgtttcagcggcatattttgtcggatgcgcaatttgagcgcatctgccagtttatctatcaacgggctggtattgtactggccaaaaataaacgtgaaatggtttacaaccgtctggtcaggcgcttgcgtgtactgggaatcaatgattttggtcaatacctgtcgattctggaacagaatattcatagcaaagaatgggaattattcatcaatgcattgaccaccaatctcacggcgtttttcagggaagctcatcattttcccattttggcggcgcatgccagcagaaaaaacggaggcacataccgcgtttggagcgcagccgcttcgacgggggaggaaccgtattctatcgccatgaccttgtgtgatgcattggggcatcggacaaatcggataaaaatcattggcagcgatattgatactcatgtgctggaaaaagcccgtcagggagtatatcgactggaagaattacagcacatgagtgatagccaaaagaaaaagtattttttcaaaggcattggcctctttgaaggatatgccagagtgcgtcccgcactggctgagctggttagctttcagcacttgaatctattggattctgactggacgctcgaaggtaagtttgatgcgatattctgtcgtaatgtcatgatttattttgacaaaaagacgcaggaaagaattttgcgtcgttttgtcaatttcttaaaaccggatggtttgctctttgcggggcattccgaaaacgtcactcaaatcagccgagagttctacttgcaaggacagaccgtttacggtgtaggtcgtcgggcagggaggggtcatgaataa

SEQ ID NO: 5605 - DNA, 1632 bp, Xenorhabdus bovienii
  Coding DNA location: Contig name=SeqID_16908; Position on contig =146975..148606bp; Strand=-
atgttaggtaggcttcgcatatcaaccagtttgtatctattactcatgatgttttgtgttatgcaaattatttcgagcggtttgtccctgggaataattcatacagaccagtcatatattgaaagaattgatttgggaactaaacgaagagatacccttggattgagctgggcagcaatgctgcaaacgcgtaacactctcaacaaaattgccattggccaaaaagtgggtcagtcgcaggatcagatcgacgcgatggaagcgttgctcaaaagctcattgaatgaagctgaaaggaatttcgcacagttcagtgccttacctcagatagaaaagaatgaccaaagtgtcgccttattggctgcggttgaacgttcttaccaagaatatattaatgcgttgaaagagctgaaaacgtatctttatgaagggaatttccaggcatttcttgatcagccaacagaaaattaccagcgccagctagaagtcgcatacaacaattacatgcagtatctcggccataacatcagcacagcggtttccgatggtgccttttactataaagtttccatcgccatgtttttcggttctatcctgatggtatttgttgtttcggcatcagcgcactggtggatgcgacgtaatctgctccggccgtttgacaatatgcgagcctgtttccaggacgtggcagaaggccgcctgaataaagaaattgctgtcacgaccagtgatgagattggcgatatcttcagaaaactgcgcgatatgcagaaatctttgatcaagtcgattgcctctgtacgagacaacaccaaccagatgtatgccggtattcaggaaattacacagggcaataccgacctgtcatcacgcactgaagaacaggctgcgtcgctggaagaaaccgctgccagcatggaagagctgactgttactgttaaacagaacgctgaaaacgcacgtcaggccagtgaactggcagtatccgcttcccagacggcttcgaaaggcggtgaattgaccgtcagcgtggtggccactatggatgaaattgccaacagttcgaagaaaatcagcgctattatcagtgtcattgatggcattgccttccaaaccaatatcctggcattaaatgcggcggttgaagcagcgcgtgccggtgagcagggacgtgggttctctgtcgtggcgggcgaagtacgtgacttggcgcaacgcagtgctgaggcggcgaaagaaatcaaaaccctgatcgatgaatctgtccatcgagttaaccaaggttctgagctagttaataacgccgggaacaccatggatgaattagtcaaatcagtaaaccaagtcactgaactgatggctgaaattgccgccgcttctgatgaacaaagccgtggtattcatcaggttgcccaagctgtcagccagatggatcaagtcacacagcaaaatgcggcattggtggaacaatctgcggcagccgctgctgcgcttgaagataaggcagacacattagtgaaaaccgttgctttatttgaactgcctgaaggcttagacaatgagtatgaccatcagacaccctctgcttcaaaaatgaccgatgagtatatcgcaagtcaaatacgctga

SEQ ID NO: 5606 - DNA, 1692 bp, Xenorhabdus bovienii
  Coding DNA location: Contig name=SeqID_16908; Position on contig =148662..150353bp; Strand=-
atgaaaatagtgacggggctaatctcagtcatcatattatttggtgctctgcaatttatctccgggggactgttctttaatggtttaaagaacgatacagaagcctttgatttattggataaaatgcggcagcagcaaaagttattggatgaaagctggatcaacctgctgcaagcccgtaataacctgaaccgcgttggcatcatctatatgatgaaagaacgcgatcttgatggtacttaccaaattgatgatgttctggctgaatctaaagtcaatctagctcgtggggaacgccgcttcgagcaatttgaacagctcaaaaaattgcccatacatgatccagaccatctccaacgtttaaaacaaactcatcatgaatatcttaacgcgctcaaagagttggatggatttctggcaaaaaaacagtataaagaattttttgcccagaaaaccaccgactatcagaacgcttttaatgtggaatacgactactatctgaaccaggatcaaaaactgtatgatgaagtggcgcgcgaagcagatatcgcttatcgcaatatcatcattagcttaatctctgtgtttgtgctgttgattttggttatggcagtaagctggattagcttgcgtaaagcattgatcaatccattgaataagttactggaaaatattaaagccttctcgaaaggtgacttgacccaaactatcaatgtgtccggtaccaatgaaatgggcatgctggcggttggcttgaggcatatgcaggacgagctgatccataccgtcagaagtgttcatcagagtacggaaaccatctataccggcaccagcgaaattgctgcgggtaacaacgatctctcttctcgtacagaacagcaggtggcttcgctggaggaaaccgctgccagcatggaacagttgactgcaacggtaaaacagaatgctgacaatgcccgtcaagcgagcaatttggctgacaatgcctccgatatcgcccgtcagggaggtaaagtggtggcgaatgtggtgcaaaccatgcatgacattgctgacagttcccgcaaaatttctgatatcaccggtgtgattgatgccattgccttccagaccaatattcttgcccttaacgctgcggtagaagctgctcgtgcaggtgagcatggccgcggttttgcggtggttgccggcgaagttcgcaatttggcacaacgcagtgcggaagcggccaaagaaatcaaatccctgattgaagactctgtggatcgtactgacaccggctctgtgctggtggaaagtgccggcgaaacgatgaacaaaattgtcgattctgtgacccgcgtgactgacatcatgggggaaattgcatcggcttctgatgaacaaagtagaggaattactcaagttggtgtcgctatttctgaaatggatagagttacacaacagaatgcgtcactggttgaacagtctgcggccgcagcagcggcactggaagagcaggccatgatcttgaccaaagcagttgcgttgttccagctaccggagcaggccgaaaggaagcagtctgaaaaaagaaaacatgaagttttatcgacgataaaatcgccgactcctccagctaataaaacgaatcctcctatgctgaagaaaggcagtaatgtggaagacccctctaattgggaaacattctaa

SEQ ID NO: 5607 - DNA, 147 bp, Xenorhabdus bovienii
  Coding DNA location: Contig name=SeqID_16908; Position on contig =150391..150537bp; Strand=+
atgccagtgttatcggcacccttaaagggaactttatgtgtaatccaaaaaattgagtttttgcactatttttttgatctaaaacaattaaggctgccgttttgctcgactgactataatgagtggcaacaatcacgacagccctga

SEQ ID NO: 5608 - DNA, 498 bp, Xenorhabdus bovienii
  Coding DNA location: Contig name=SeqID_16908; Position on contig =150542..151039bp; Strand=-
atgtcagccatagaagaattcagtaaattatcgggggaaacgaccggaaaggaatatctggttttcaccttgggtgacgaagagtatggaattgaaatactgaaagtgcaggaaatacgtggttacgaccaagttacccggattgcgaatacaccttcttttatcaaagggataaccaatctgcgtggagtgattgttcccattattgacttgaggatcaaattctctcaggaaaacatcacttataacgacaacaccgtcgtgatcgtcctgaacctgcttaatcgtgtggtggggattgtggttgatggcgtgtccgatgtgctgtctctgaaggacgatcaaatttgcccggcgccggagtttgcggttaccttgtcaactgaatatctgacagggctaggttccattgatgagcggatgctgattctggtagatatcgaaaaactccttaacagtgaagaaatggcattagtggattctgtcgccaagagctga

SEQ ID NO: 5609 - DNA, 2166 bp, Xenorhabdus bovienii
  Coding DNA location: Contig name=SeqID_16908; Position on contig =151051..153216bp; Strand=-
atggatattaccgcgttttatcagaccttctttgatgaagcagatgaattattggacgatatggagcagcatttattgctgctcgatgccgatgaacctgatcatgaacaactaaatgcaatttttcgtagcgcccactccatcaaggggggcgctgcaacttttggttttgccaagctgcaacaaaccacgcatgttttggagaatctgctagacagtgccagacgtgacgaaatacgcctgactactgacattatcaacctgtttttagaagcgaaagatattatgcagcaacaattggatgcctataaaagttctcaggagccggatgaagatacattcaattatatctgcgagacattgcgtcagcttgccttagagctacaggaagataagcaggatgagagtgctgacactgccgcaccggcaattcagcctgaacctgcattgaaagagactgtgctggaagctgaagaagaacaagcagtcgtgatcaatcagccagaagaaaaaaatcttccggcaggtaaaactgatcaagggagaatccgcgttcatctatctgggctaaaagaacgcgaagtctccttgatgaaggatgaattggggcatcttggtgatgtttacgacgttgaacagaccgcagacagccttgaagcttcattgatcacatctgcaacagaagatgacatcaccgctgtaatgtgttttgtgattgaaactgaacagataacttttctgcctgttgcggactcgcatccggcagaaactgaagcagacactcagtctgaaaaaaaaccagcggcagaaggtgtggcaatcgaaagtcgtgtggctgtaagtacgataagtactgataaaccacagtctgctgatgtgccacaaaaatcagaagtacatgaagtagggcgtccggccccgcgtccggtagcgggatcaccacgtcaacgtgtcgaatcttccagtattcgtgttgctgttgagaaggtggatcaactcatcaatctggtgggagaactggtcattacccaatctatgctggcacagcattgtgatggattggagcagacaaaacacagcgaactgctgagttgtatggctcaattgcagcgaaactcccgtgatttgcaagaatccgtcatgtcgatccgtatgatgccgatggagtacgttttcagccgatatccacgtctggtgcgggatttggcaggtaaactgaacaaaaaagtggagctgacgctgatcggcagctcaacggaactcgataagagcttgatcgagcggattattgatcccctcacgcatctagtacgcaacagcctcgatcacggtattgaaaacccggaaaaacggattgcagccggaaaatcagaaacgggtaacttgacactctcggctgaacatcagggcggcaacatctgcattgaagttatcgatgatggtgcaggcctgaaccgcgagaagatcttggcaaaagcgcggtctcaaggcctgaatatcagtgaaaacatgagtaatgaagaagttgctatgttgatttttgcgccaggattctctaccgcagaagtggtaacggatgtttctggtcgtggcgtcggaatggatgttgttaagcgcaatattcaggatatgggtggccagattcagatcagtttccaagaagggaaagggacgatcattcgcattttattgccgctgacattggcaatactggatggcatgtccgtcaaagtcaatagcgaagtcttcattctgccattgagtgctgtggtcagttcattacagccacaggaagaagatatctatcctctggcgggcgatgaaaaactgctgcaagtccgtggagaatatttaccgctactggaattgtaccggatatttgatatttcgaacggggaaacctcgccaaccaaaggtattgccgtcattgttcagagcgcggggcgccgctatgcactgctggtggataaattggtcgggcagcatcaggtagtcgttaaaaatatcgagagcaattaccgtaaagtacctggcatttcggctgccaccattatgggagacggtagtgttgccctgatcattgatattcctgctttgcagaaactcaatcatgaacagttggctacgcgtaaggcggagctggtgaataaaaaaataacacagtaa

SEQ ID NO: 5610 - DNA, 1002 bp, Xenorhabdus bovienii
  Coding DNA location: Contig name=SeqID_16908; Position on contig =153223..154224bp; Strand=-
atgagagcgaataatgttactgtcatcagagtaaaaaaacgcaaaaaacacggtgagaagcactgtggtggatcatggaagattgcatatgccgatttcatgactgcgatgatggcgttttttctggtcatgtggctgctatcgatcgccagcccacaggagttaaccagcattgcagactattttcgcactcccttgcaggtagcgataaaccaagggccacaaagcagcgatagcacaaatccgattcctgggggaggggatgaagtttttcagcaggatggagaagtttttcgcgaatctaaacttgttgaatccaatgaggaaaaacgtcgtctgaatcgactgcaccaacaacttgatcaacttattatcaccgatcctcgcctaaaagaactacgtccccatttgttgatcgacatgatggatgaaggtttgcgcattcagatcatcgatagggaaaaccgtccgatgtttatggttggtagtgcgaaggttgagagctacatgagagatattttgcaggcaattgcaccgattttgaatggaattccgaacaaagtcagcctttctggtcataccgataatttacagtatgccaatggccaaaggggttatagcaactgggaactctctacggatcgtgctaatgcctcaaggcgagaattgctgaacggtggcttggatgaggtcaaaatcttgcgggttgttggtatggcatccactgtcagtatgcagaagggaattgatcctaatgcaccggttaaccgccgtatcagcattattgtcttgaataaagatgcagaaaaacggattgagcaggaaaacagtggtggtgacgccatgaccgctaacagtagtatggatatgcaagaagtcatcagaacggattcgaataagggagcgccttctcagcaacccaccgaacaatccagtgaaatcacaatatcggtgcagactcagactgaaccgtccagtgatactaataaggtgacagagtaa

SEQ ID NO: 5611 - DNA, 882 bp, Xenorhabdus bovienii
  Coding DNA location: Contig name=SeqID_16908; Position on contig =154227..155108bp; Strand=-
gtgttagtacttttaggatatgtagtggtttttggtgcggtaattggtggctatctgcttgtcggtggccacatgggcgcactttatcagccagcggaatttttgattattgcaggtgcgggtattggcgcttttatcgtaggcaataatggcaaggcgataaaggcaacactgcgtgttttaccaaaagtattgcgcagatcaaaatacaacaaagcaatgtacatggatctcatggcgctgctgttccgcctgttatccaaatcacgccaaaatgggcttctggctttggagcgggatatcgaaaatccacaccagagcgacatcttcacacagtatccccgtttgttaaaagatccctatttgatggatttcatcactgattatatgcgtctgatcatcagcggtaacatgaatccccatgaaattgaggccctgatggatgaagaaatcgagacttatgaacaggaaagtgaagtccctgcgaccagtctggcgatggttggagattcactgccggcatttggcatcgttgccgccgtcatgggagtggttcatgcactcggatcagcggatcgtccggcaggggagctgggtgcgttaatcgcccatgcgatggtaggaacattcttagggattttattggcttacggttttgtttctcctctggcaaccttgctgcgtcaacgtagcagcgaacaggtaaaaatgatgcagtgcatcaagattacactgctttccagcctgaatggttatgctccgcagattgcggttgaattcggtcgtaaaacattattcctcacagatcgtccttcatttacggaacttgaagaacatgttcgtcgggttaaatctcctgtacaacaagaagtcgaagaataa

SEQ ID NO: 5612 - DNA, 582 bp, Xenorhabdus bovienii
  Coding DNA location: Contig name=SeqID_16908; Position on contig =155246..155827bp; Strand=-
atggttgaaaaaagtattgttcaggaagcgaaagatattcatcttgcaatggagctcatcactttaggtgcacggttgcaaatgcttgaaagtgaaacacaattaagcagagggcgattgatcaggctgtataaagagttgcggggaagccctccgcctaaagggatgcttcctttttcgacggattggtttatgacttgggaacagaatattcactcttctatgttctacaatgcttatcgtttcttgatgaaaagcgggcattgtgacggtgttgaagctgttgtaaaagcttaccgactgtaccttgagcaatgtcctccaagcagcgaaggtgggcctgttctggcactgaccagagcctggacacttgtccgtttcgttgatagcgggatgctacagccaacagagtgtcgctgctgtggtggcactttcatcacgcacgcccaccaaccggtgaacagctttgtttgtagtctttgccagccaccttcacgagcggtaaaaaaacgtaaactttccgctctgcctgccgatactaattcacaactgctggatggatttgctcagcaagctatgtga

SEQ ID NO: 5613 - DNA, 351 bp, Xenorhabdus bovienii
  Coding DNA location: Contig name=SeqID_16908; Position on contig =155830..156180bp; Strand=-
atgagtacggttgaattgctcaaacatatttatgacataaatttatcgtatttgcttttagcgcaacggctaattaaccatgagaaagcatctgcgatgttccgtttaggtattagtgaatcgatggctgatacgttggccgagctgacattgcctcagttagtaaaattagctgaaactaaccaactgatttgccattttcggttagaagaccacgaaacggtgctgcagttaacgaaggaatcgcgggtggacgatttgcaacaaattcacacaggtatcttgctgtctactcatctttttcagcagttatctgcgctggatgacatttcaatcaagaaaagagcgtga

SEQ ID NO: 5614 - DNA, 120 bp, Xenorhabdus bovienii
  Coding DNA location: Contig name=SeqID_16908; Position on contig =156435..156554bp; Strand=+
atgctaattaactttactcctgaatcatcaacttatacaacggagaatatatgccattttaaatactatgtgacatatatcacaaaactgacactttttattatgattctagctcattaa

SEQ ID NO: 5615 - DNA, 153 bp, Xenorhabdus bovienii
  Coding DNA location: Contig name=SeqID_16908; Position on contig =156608..156760bp; Strand=-
gtggaagagaggtccctacctccattatcaagaggcaaattttctaaacattttgagaatttaactaaagtatatattttttatcgccattttaaatttagaagtttaatagatcgtataaaccaaaaaacagtccttaatatttttatttag

SEQ ID NO: 5616 - DNA, 165 bp, Xenorhabdus bovienii
  Coding DNA location: Contig name=SeqID_16908; Position on contig =156891..157055bp; Strand=-
gtgacttctgtggttttgaatagtagtggcttttgttgtgttctcgaagccttgtccgctttatttactctaaggcagggatgtagatgttttttatttcaacatcatactgtattttatcttatttttgtgatctgtgtgatatttatgcgtaaagtggcttga

SEQ ID NO: 5617 - DNA, 132 bp, Xenorhabdus bovienii
  Coding DNA location: Contig name=SeqID_16908; Position on contig =157146..157277bp; Strand=+
ttgttatttctcctcattgactaccttatacccacaatcaataagataaatttatcattaaaagcgtgctcttttttcataatgttaagaataatcaatgtttatgccatttatacagaacggagtgactga

SEQ ID NO: 5618 - DNA, 207 bp, Xenorhabdus bovienii
  Coding DNA location: Contig name=SeqID_16908; Position on contig =157240..157446bp; Strand=-
ttgcattccctgtttcgtattcaaagtgttttttcttcttttaattggattttatgttataagaatttattgttaaatttgtatttgggagtgattttgtttctattttttatgttatttaaggaaattaattttctgttaatgggggatttttcttttgcgtacacagtcagtcactccgttctgtataaatggcataaacattga

SEQ ID NO: 5619 - DNA, 162 bp, Xenorhabdus bovienii
  Coding DNA location: Contig name=SeqID_16908; Position on contig =157371..157532bp; Strand=-
ttgaatcgttacttttatatgatctattgttacttatattttaaattaagtaagataatttcctttttcatatttatttattctgtttgcattccctgtttcgtattcaaagtgttttttcttcttttaattggattttatgttataagaatttattgttaa

SEQ ID NO: 5620 - DNA, 180 bp, Xenorhabdus bovienii
  Coding DNA location: Contig name=SeqID_16908; Position on contig =157837..158016bp; Strand=-
atggaaggccagttgtctcaggcactggctgtacatatgttgcgtacacaaaaagttctgtttgtccaaagtatcgccgtattacctgtgttattaacaacgtcaataattatgacactaggtatatacataccatttttaccatttgatgtactaattggattacagtcattgctttag

SEQ ID NO: 5621 - DNA, 189 bp, Xenorhabdus bovienii
  Coding DNA location: Contig name=SeqID_16908; Position on contig =158092..158280bp; Strand=+
gtgatatctaagatagaaaatgtcgtccctaacccaatcataaaatatccgatattctttacatctatttgcgagggattctcaataactctttatccattttgtcttacgacaaagacagttgtgaaatatcgtacattaggttttgtacaagcaaatagatggctaacatcagtaaaaatggaataa

SEQ ID NO: 5622 - DNA, 96 bp, Xenorhabdus bovienii
  Coding DNA location: Contig name=SeqID_16908; Position on contig =158253..158348bp; Strand=+
atggctaacatcagtaaaaatggaataaatactctggaaatcagtatcgaaaatacattcacgaaatccaactggctgtcatatttaaatacttaa

SEQ ID NO: 5623 - DNA, 312 bp, Xenorhabdus bovienii
  Coding DNA location: Contig name=SeqID_16908; Position on contig =158348..158659bp; Strand=+
atgatattcccaaacgtttccctactttttattactcgttcccctaataccatcaaatttttatcaaacaaaatgatatcctctgactcttttgcggtattggttctggtgtcaacagaaataccgatatcagcataccgcaatgtagacatatcatttattccattaccgaaaaaactaactgtgtatttactattttgcaatgactttaaaatgcgtgacttttccgtggggttaacttacaaaatgctgttcttaattccacttcttttgaaaggtcttcatcactcgcaaattcaatatcaaaattaa

SEQ ID NO: 5624 - DNA, 465 bp, Xenorhabdus bovienii
  Coding DNA location: Contig name=SeqID_16908; Position on contig =158556..159020bp; Strand=-
atgtcatcagtatgctctcatatgaggttaaaggagaaaataatttctctcactgaagaaaatcgtaacaatgtgatggggctggttaacctctataaagagcaaggtttcagagggttaatcttagtgacaggggagttaagtcttgatgaagtgaaacatccattttctgttgctgatgaaaaggagagggtactgcaaggtttattaacatttttagatttgccaaaggtgagtgtggcgatggcaatggctgcattaagagaaaatgacgtttcagctaaggtgcttaacggagatagccctgtcattaccgcagaaatttaccgtgatgtgggtttagatcctaggaatatttttattaattttgatattgaatttgcgagtgatgaagacctttcaaaagaagtggaattaagaacagcattttgtaagttaaccccacggaaaagtcacgcattttaa

SEQ ID NO: 5625 - DNA, 156 bp, Xenorhabdus bovienii
  Coding DNA location: Contig name=SeqID_16908; Position on contig =159044..159199bp; Strand=-
atggatttgatggatcaagcgattgtcaggtatgggagcgaaaaattggtattggttttctcaccagctacagaaaaattgatgagttatcttttgattttgttagacgtagcttgccaatttctgttcaaaaacagtagcaaaagtgctaattga

SEQ ID NO: 5626 - DNA, 189 bp, Xenorhabdus bovienii
  Coding DNA location: Contig name=SeqID_16908; Position on contig =159190..159378bp; Strand=-
atgcttttggcgatgatcatcttttttactgattactttttgtcgtcacgccatgaaaatgaaataaatataaccaatattattattatcttaataataatttcatttagtggtttattcttgttctggcaggtaagagacttcagtattccattgggcatagctaaacaagcggcactatggatttga

SEQ ID NO: 5627 - DNA, 612 bp, Xenorhabdus bovienii
  Coding DNA location: Contig name=SeqID_16908; Position on contig =159576..160187bp; Strand=-
atgttgttaacacctattgccattcatttactatctgcaatgttttttggggctctgattggagctgagcgccaatggcgtcagcgtattgccgcgcaaattgtattcggtattggttttcttggggctggcgtgattatgcgccaaggaatgaatattcgaggcttaaatactgctgcaacattgtggtgttcggcgggtattggcgtgttatgcggacttggtcaatattggtctgcgagcattgccacaggcattattctgtgtgcgaacattctgttgagagaggccgcacagcggattaatacccaaccttatcaacaagccttagatttagaacaacgctataagatccatattgtttgtgatattcatgatgaaatcctagtcaggacactgatcctacaggctattaatgggttaggtgtcagattgcagtcattgagtagtgctgatgctaatgccactcaacccgacaggcttgaagtctgtgcagaaatattggcaacaccgactgagcaaaaagaaatagagtcgattgtttgtcgagtgagtttggaaaaaagcgtcagttcagttaattggaaaattgctacagaattacctgcttag

SEQ ID NO: 5628 - DNA, 174 bp, Xenorhabdus bovienii
  Coding DNA location: Contig name=SeqID_16908; Position on contig =160258..160431bp; Strand=-
atgtcttatgacgacaccatctacagcccagagctgaatctgattgaaatcatctggaaacaagccaaatatcactggcgacgctttatcacttggactcaggataccgtggagtatgagctaaatactctattggaaggttatggtgctaaatttgcaattaatttttcttga

SEQ ID NO: 5629 - DNA, 354 bp, Xenorhabdus bovienii; identical to SEQ ID NO: 1741
  Coding DNA location: Contig name=SeqID_16908; Position on contig =160421..160774bp; Strand=-

SEQ ID NO: 5630 - DNA, 492 bp, Xenorhabdus bovienii
  Coding DNA location: Contig name=SeqID_16908; Position on contig =160711..161202bp; Strand=-
atggatgacttaaccatgagcacacccgtacaccgccgtcacgatatttccgatcatatttggagtttgcttgaacctcacctgccgggacgtaagggagcctgggggcgtgttgcttatgataatcgattatttattaatgccgtattctggattttacggacaggcgcaccctggcgagatttaccgcccgattatggcgactggaaaaatacgcatcgccgtttttgtcggtggcgggacaaaggcgtatgggaagaactgcttgaagaactcatctttgaacccgatttcgaatggctgatgattgacgccagtcatattaaggttcatccccacgccgcaggggcggcaggaggcaatcaggatatggggcgcacaaaagggggctcaatacaaagatacatctggccgtggatgcgcatggtatgccgatcagagcgcttattacaagcggtcccacagcggattgctcacaagctgaggccttga

SEQ ID NO: 5631 - DNA, 387 bp, Xenorhabdus bovienii
  Coding DNA location: Contig name=SeqID_16908; Position on contig =161253..161639bp; Strand=-
ttgctggataagattaaggccggtgcacgggcaggccgctaccgtctggtctattttgatgaagccggttttgccgcctctccgccggtgcaatatggatggagtccacggggtaaaccccatgaaactgagcctcaacaccatgacagacggtcagttctgggggcgttaaattacacggacaacacgctgttttaccaggcaccgtcaggcagtatcacacgagctgatgtgattgattttttagagcaggtcgccaaacaaggggacaaccgcctgacatttttagtgttggataatgcgcgtatccatcatgggatagagaaaaaaatcagaaatcgctggttacgagaacacaacctgcttttattttatcttcctgcctag

SEQ ID NO: 5632 - DNA, 441 bp, Xenorhabdus bovienii; identical to SEQ ID NO: 2208
  Coding DNA location: Contig name=SeqID_16908; Position on contig =161665..162105bp; Strand=-

SEQ ID NO: 5633 - DNA, 159 bp, Xenorhabdus bovienii
  Coding DNA location: Contig name=SeqID_16908; Position on contig =162122..162280bp; Strand=-
gtggctaaaattttcatatataacgtatgggagttatttttcaactacgggttgaaaatcatcttaagttatttagtcaatagaacctcaataaataaaactaagttaatcaatgaaattatctgcacttttgttatagtcggtaatacaatacactga

SEQ ID NO: 5634 - DNA, 153 bp, Xenorhabdus bovienii
  Coding DNA location: Contig name=SeqID_16908; Position on contig =162379..162531bp; Strand=-
atgagctgtactcacccgacaaaagattatttgatactcagaatctattgcattgaattcttaataaagtatcaacagaaactatatcggggtattcataatgtggttatatactcactccttatttcctctgggaacatacaaataatctag

SEQ ID NO: 5635 - DNA, 213 bp, Xenorhabdus bovienii
  Coding DNA location: Contig name=SeqID_16908; Position on contig =162942..163154bp; Strand=-
atgtctgacaaaatgaaaggtcaagtgaagtggttcaacgagtctaaaggctttggtttcatcactccagctgatggtagcaaagacgtattcgttcacttctctgccattcaaggtaacggtttcaaaactctggctgaaggccagaacgtagaattcaccattgaaaatggtgccaaaggcccagcagcagcaaacgtaactgctatctaa

SEQ ID NO: 5636 - DNA, 243 bp, Xenorhabdus bovienii
  Coding DNA location: Contig name=SeqID_16908; Position on contig =163041..163283bp; Strand=+
ttgaatggcagagaagtgaacgaatacgtctttgctaccatcagctggagtgatgaaaccaaagcctttagactcgttgaaccacttcacttgacctttcattttgtcagacatttgactttcctatatatcaaaaaaaactcgccacctcgggcatgtgttggccagtatcagctattacttatggaggcactaagaaggaaacggtcaacaaaggctaccagagatagcacttacacataa

SEQ ID NO: 5637 - DNA, 108 bp, Xenorhabdus bovienii
  Coding DNA location: Contig name=SeqID_16908; Position on contig =163477..163584bp; Strand=-
atgccatttttaaggctagcatgcccggagcacacacctgtatatcaattgccttattttatttataaaattgttattgtctggaaacaatatcgatatttttgctaa

SEQ ID NO: 5638 - DNA, 591 bp, Xenorhabdus bovienii
  Coding DNA location: Contig name=SeqID_16908; Position on contig =163550..164140bp; Strand=+
gtgtgctccgggcatgctagccttaaaaatggcataaccttcaattcgataacgcgtttctacaataatcgggttagtattatgaacatcatcaaacagatattgattcaggatcttaagcggattaatctcgaagaacaccgtgatggtaaagtgcatttcaatagtatctttattcgtcatcatccatacctatgcttggggatggttactgcttatgctttccttgtcatgctcatgggatattctccctattttggcacttggtcactgattttatttacagtactttttgtcgccatggcagccgttctgcttttcgatataaaaccggtgtatcattttgaagacattgatgtactggatttacgtgtctgttacaacggagaatggttcgtcaacgaaaaagtatcccataaagccatcaataaaatacttactcatcctaaagtacccagtgaaatgaaagatgagatcaaacgaatcatgaggaaaaaagacggcatttgtttttatgatgtatttatagttgccttttcagaacaatcaccctattttcacccttccgaaatggtgaataaaagtgcgtaa

SEQ ID NO: 5639 - DNA, 186 bp, Xenorhabdus bovienii
  Coding DNA location: Contig name=SeqID_16908; Position on contig =164488..164673bp; Strand=-
atgtgcaacatgatgatattttgttattttttacagcaaaatataagcattactgcaattttccataccttactcaacctcctatcacttctttgctcagttctgggtaccaccttgataaaaattcagcaaatcgatgtaaagaataaggaacaaatctaccaacgtgagaaaggagcactttga

SEQ ID NO: 5640 - DNA, 751 bp, Xenorhabdus bovienii
  Coding DNA location: Contig name=SeqID_16909; Position on contig =2..752bp; Strand=-
atggacaggattagattaattaaccagatccttcagccggagacaatcatcttcttacggcaaaggatggggctttttcaggaagaactaggccggataatgggaatgaccttgcgaccttggcaacgaaaagaagcttgcagtaaggagttaaaacagcaatatgattccagtacgctgacgctgggtgagtccaattttttattgttgattgcagataaacatccaaattatcggttaaccacgcagtttaaggaaagccgcgtaattagtgaacagccaacggcagaaaatgtgaggcagctgaggggtgctttgggtttgacgccacaggaaatggcgacgcaaatgggttacaccgtgtccgcttggagatcaaaagaacaggctagcaaacgggggatcaaactcaaacagggagaatataacctgttattggtattagccggaatgcactctaagatggaagttaccactaagttgaaggaagatccccctgaacttttgcagcaacaaaagggagtcattcaggcggaattagggcaaataatgagtttcacgccgtcagagttagctcaaataaaagacaccagtggagaagaatttacgcagtataatttcaatgcgctgatgccgggtgaatacagttttttattgttggttcttgataaacatccaaactatcggctaaccacgccgtttaatgccactcaagtcattaacgaacggccaacggtagaaaatatcgaat

SEQ ID NO: 5641 - DNA, 252 bp, Xenorhabdus bovienii
  Coding DNA location: Contig name=SeqID_16909; Position on contig =739..990bp; Strand=-
atgaaaaaggtgtattacgacgaaggttttagcggtaataacaaatatacgtttgaggtttacgagctggatgatggttcctataaggcggtcgctagacgttggaatcgaaagttgaatctggttaacgttgagactcattttgttgcaacaacacgcgctgatttgcgcgaacaaaattatccgcgtacacgtcaagttaagatattcctgaattcagatttttggagcaatcagaatggacaggattag

SEQ ID NO: 5642 - DNA, 204 bp, Xenorhabdus bovienii
  Coding DNA location: Contig name=SeqID_16909; Position on contig =1092..1295bp; Strand=-
atgaatgaattcgataccaacacgctgattaatgtttcgagtcagctgacaggcagaacgttagcgttatcaccaacgtcagctgatgtttctactgacgataagggaacgggtacgcagccaaaagaggaaacagtccagacagacccaaatgaggctgaaacaagggcaaacagcgctaaaatgttttctgatgatgattga

SEQ ID NO: 5643 - DNA, 258 bp, Xenorhabdus bovienii
  Coding DNA location: Contig name=SeqID_16909; Position on contig =1492..1749bp; Strand=-
atgacgggctacgaattgagattatggcgtaaagcgcagggctggacacaagagcgtacagcagaagaactgggcattcacatacggacatataaggggtatgagaaagtaaacagaagagtgtcgaaaataatccagctggcttcacaggtactttcactgcgttctgacttgtcaatcatgcaagcgatgagccgggaacagcttctaatttatttatataacacgctaaataaggaattagccgatgaaccataa

SEQ ID NO: 5644 - DNA, 1008 bp, Xenorhabdus bovienii
  Coding DNA location: Contig name=SeqID_16909; Position on contig =1839..2846bp; Strand=-
atgcaggggaagaacagatttattcagttgtctgtaccgtttagaatgttgaaacgtgttttggccagtgacgatagcggtcatgtattggatcgttcacagcgagaaattaaccggaatcgtgtcaatggtatttataactatttgatgaattctagagagaataactcagatatttgtttgccaccgttggtcggcaattgtgatcagaatatagattttcagtttttttgtaattcagtggtcggtatggcaagaattccaatggattctgttattacattattcgatggtcagcatcgggcagccgcaatcatgaaatttgctgataaatgcttaggtcattacagtattcctattatgatgtataaaaagctagaactgaaaactcgacagcagtttttttcagatatcaataataatgcatctaaaccaagtgcaaccatcagcatggcttataatgggcgggataaacttaccaatatggtacgggatatattgaaagagaatcctgttctttctgacgctacagattttgaacataatgtggtgaaatcaaaaagtgactattttgtcagtttcaaggcattatgcgatgcaacccgaaaatttgcggttaacggggaacagatcgcctcggcggaagaaattgatgctgtgtggtcttcttgggttaatttcagtgcactgaatgacattaaaggtgttgtagaacaagtgcaataccgtaaagaatatattcaatttcatgctgttatggttaacgcttttggttatgctgtacgtcagttagcgcaggagacggaattgaaaaaaattccggccatgattgattcattcgcagttgaaattgatgcttcgaagcgcgaagaattcttttttataaaaaactggaacggaatttgcactcgtgtagagaatgatcgttctacgattattgccagtgtgagtgcccaaaaagcgacggcggaaaaattggccgatgctattcgacgacggtcagtttaa

SEQ ID NO: 5645 - DNA, 510 bp, Xenorhabdus bovienii
  Coding DNA location: Contig name=SeqID_16909; Position on contig =2941..3450bp; Strand=-
atgaacttgaaaccaattcctcgaactttaaatgttactctccatcgtgtaacagaacgtgatcacgtcactgttcatgttgatttctctactgaagctgatcttgatacggatcaattagagttgtctctatgccgcttacagggctgcaattcgctgctatctctcgaatatgacgtgctgacggggaatggatgtttttccctgatgaataagccccctgaactgagtgtttataccgtgtgctacccgttgctaccaatcgtgagattgcacgcctctttgactttcggggtggtaacggaagaagagacgttgacgcatattgcgggtgatcgtattggtgtatttcaaacactatgcggtacggaaactgtatcccagcaagtaaattccctgtgtcctgttgatgaagttcgtgtgacgtgtgaacgttgtcaggctatctggcaacgttgtcagctgtttaccgctcaggattttgcaacaaaacaggaagaaaacgcatga

SEQ ID NO: 5646 - DNA, 897 bp, Xenorhabdus bovienii
  Coding DNA location: Contig name=SeqID_16909; Position on contig =3810..4706bp; Strand=+
atgattgtcatgaatttccgttatatcaggtattttctcgccgtcgcagaacatcatggttttacccgagcggcaacagcgctgcatgtatcgcaaccagccctgtcacagcaggtcaggcttctggaagaaagcctcggcgtacagctgtttgaccgcagcggacgcaatacccgtctgactgatgccggagaagtttatttacagtatgtttaccgtgcatttcaggaactggatgaaggtaaacgggccattcatgatgtggaggatctcagcagaggttcgttgcgtgttgctgtcacgcccacctttaccacctattttatcgggcctctggttgccgaattttatacgcgttatcctcatatcacactacaaatccaggaaatgtcccaggagaggatagaagagcggttaattaacgatgatctggatataggcattgcctttgatggcggggaatccccgggaattgcatcaagaatcctgctgactgaaaccctttctcttattgtagcctaccaccatccgcgggcacagcagcgcaaaatcgctctgaatgaactcaacgatgaaaaactcatcctgctgagcgcagggtttgctacccgtgaacagattaatcgctatttttgtgaggcaggtctgcgcccgcaagtgcagatggagttcacctccatcagcgccgttttagacgtgatccgcaggacatcactttcaaccttgctcccagcggcgattgccatgcagaataatgacttggtagcgatcccgcttgctgactggcaactggaaagaacgggggtgttgatgcagcgaaaaggggcatggcaaacaacggcagcgcgggtgtttattgaagttgcacaggcgttgggtcatgtattaaatagttag

SEQ ID NO: 5647 - DNA, 1407 bp, Xenorhabdus bovienii
  Coding DNA location: Contig name=SeqID_16909; Position on contig =4780..6186bp; Strand=-
atgcaattcacaattcaaatagcggtggccgatgaatcaggtcacagccatactgaaactctatttagggtagaaaaacagagtgatacccccaatgacattgggctttccctgtctgagtccaaattgcttttgaacgctatccagcaatcggtgatccagaaacaggcggccgaatacctgagtgaacatcgcgcttgccctcattgtcaacgaaatcgacggataaaaggtaaacagacaatcctgtatcgaaccttgtttggcattatccccgtggagggatttcgggtttaccggtgtgcttgtgaaaaacattcaacccacaccgttagcttgctcaataactggtgtgatacgcatactcacccggaactcaggtatatagaaacccgatgggcttcattgatgtcttatggattgaccgccaatctgctcaaagatattttgccggtgggtgaacgctgtaatgccgccacagtcagaaaccacctctgccagacggctaaaagacaagaggccgaattagatgggttgcctgattttctccctggcgatcccagagaatgggaaaaattacccaaaccgggaaaaccgatggcggtgggtattgatggggggtacgtcagaaaccgggacgatagaaaacaccattttgaaatcatcgccggaaaatcgttctctgcgacggttccggccaaacgctttggttttgtgcagtgtctggaaaatcaccccagaagaaaacttttggctcagttatcctcacaggggatgcaggctaatcaacaaattaccttcttatcggatggcgctgataatctcagggatctgcaatttaatttgtaccccgaatcccagcatgtactcgactggtttcatatcacaatgcgtctgacagtattaaaacaatatgccaaaggggtatcaaaaaacgcccctgaactcggtgcagaattattagacgttttaaccagcacaaaatggtctatctggcatgggaatgtcgataaggcattagaatatttggatcattgtgccttgatatgtgatgacgatacattgcattatgaaaaccataaatcgctgttaaaacatcttgatgaaatgtatacctatattgaaaataacagcatgatgatcccgaattatggtgaaatgtaccgatatggcgaaccgatctcctcgtcatttgttgaatcggcaatcaatgaagttatcgctaaacggatggtgaaaaagcagcaaatgcaatggagccaacaaggcgcacattatttactccagacacgcacagcggtacttaataatgatttaaaagcccgatttgagcattggtatccgggaataaagttaggtgaagaaaccgagcgctatttgacagaagctgaagctattgctgcataa

SEQ ID NO: 5648 - DNA, 582 bp, Xenorhabdus bovienii
  Coding DNA location: Contig name=SeqID_16909; Position on contig =6211..6792bp; Strand=-
atgcattatgcctacattcgggtcagttcggttgaccaacatgttgagcgccagaaagaggcgctgtttgcgtccggtattgaaattgacaaaatgtatgtcgaacaggccagtgcgaaaaacatcaaccggccacaacttcaggatatgcttcaacaggtcagaaccggcgacacgattgttgttcactccatcgatcggttatgccgcaatatgatggatatgtgtagcctgaccctgcgtttacgtcagcaaggtattacactgatattcctgaaggaacagctttcttttaatgctaatgagtgcacacccatgcaagagctgcaactgcatatgatgtcggccttcagtcagtttgaacgggcactcattcgagagaggcaaaccgaagggatcgcagcaaaaaaacagcgcggggaacgaacgggcaggccgcctgcggatatcagtaaattacccccaatagacgcgttgagagcaaaaggtatcaagttaaagctggcctgcgataacgtaggattaggtgtttctacgtattataaattgcgtcaccagctaaaaaatggaggaatacagtag

SEQ ID NO: 5649 - DNA, 582 bp, Xenorhabdus bovienii
  Coding DNA location: Contig name=SeqID_16909; Position on contig =6911..7492bp; Strand=-
atgcccgtatatacagtaaaagccgccattcgagatgtcagccctatgatctggcgacgttttcgcattcagagtgatatgtcactaggcgcttttcattttttactgcaatttgcttttggttgggataatgactatctccatacctttcatatctacggtaaagactatggtatcagctatgaaggtggtctcagtttttataatgatccctgggctgtttcacttgcgtcttttcatttcgaaaaccgtgataaattcacttatgagtataatttctatcggcatgggttactggatatccgcatcgaagcgattgaacctgactcaaataaaagtacgccattttgtctcagtgggcaaggtatgcctgatgtcactcaatatgatgaaatcgaagcgacattgaagctattggaagccattgtcgaaagtgatgacagtacaacgtttggcgacatccaagaattcatcgacgagttcaatcgcgtcaaatttaatcgccatcgactcaaccggttattaaaggattatgatttttatacaccaaattactcgcaaggcttagactggattctataa

SEQ ID NO: 5650 - DNA, 696 bp, Xenorhabdus bovienii
  Coding DNA location: Contig name=SeqID_16909; Position on contig =7678..8373bp; Strand=+
atgcccctgagccgaaacgcctttaaacgtctccattatcccgtcgatatcattgctcaatgtgtccgtgggtatttggcctacgccctgagtttgcgtaacttagaggaaatgatggctgaacgggggattgccgttgatcattctaccctttcccgttgggttcatcgtcgggttccgttgcttgtgaaacgttatcggcggtgcaggcctgatgttgggcatcgctggcgaatggatgaaaccgatatcaaaatcaaaggccaatggaaatatttgtatcgagctgtggactcaggcggcaagacagtggattttttgttgacggctcgtcgggataaggccgctgccttgcgtttcttcaaaaaggcgatgcgtcagcatggccaaccggacgtggtgacaatggataaaagcggtgccaataaagccgcagtggatgaattaaatcaaggaaagccaaaagaggaagccattgttatccggcaaaacaaatacctcaataatctgattgaacaggatcaccgcaacatcaaacggcgaatacatcccatgctgggatttaaacatttccggcgagctcaaacgttattgagcggtattgaattggtcagtatgttacgtaaaggacaatatccgcaagaaccagagtgttttctttcacccgccgactttttctatcaattggctgcataa

SEQ ID NO: 5651 - DNA, 144 bp, Xenorhabdus bovienii
  Coding DNA location: Contig name=SeqID_16909; Position on contig =8588..8731bp; Strand=+
atgttaggctttaaatcgtttcgccgggcccaaacgattttagcggggatagagcgcgtttcgatgctgcgtaaagggcaatactcacaatcagaagataagacattgtcaccggcagagatgttttatcgattgactgaataa

SEQ ID NO: 5652 - DNA, 147 bp, Xenorhabdus bovienii; identical to SEQ ID NO: 349
  Coding DNA location: Contig name=SeqID_16909; Position on contig =9005..9151bp; Strand=+

SEQ ID NO: 5653 - DNA, 519 bp, Xenorhabdus bovienii
  Coding DNA location: Contig name=SeqID_16909; Position on contig =9473..9991bp; Strand=+
ttggacgcatttaatactaaacgcgatcctgtaggtaaagggcgcagacttgctatgcagcaaccccatgctcaattggatgaaatctatatccttgagcgcacgcactgccaattacaaggagatggtgacgctcattattttatgaaaagtatagaaccaataacgctacatgtcccagatggtcattatctatacgttatttacactgatatgcctctgacagttatatgtggtctttatgatcctaatcggattcctactataggtcatacgtcattaataaaaggcaggattcgattgtatggcaagaataaaaatatttctcagctagatgataaagatattgactatgcaaaataccctgtattgttggcaggagagctatttttcgatgatggtcgattgactatgtggaataatcggagtggtcattattttcctaaaggggataaggttgtcttaaacgccactaattgcatattgccccaaaagttatttagacaagtctggggataa

SEQ ID NO: 5654 - DNA, 696 bp, Xenorhabdus bovienii
  Coding DNA location: Contig name=SeqID_16909; Position on contig =10454..11149bp; Strand=-
atgcccctgatccgaaaagcgttcaaacgtctgcactaccctgttgatattatcgcccagtgtgttcgttggtatcaggcctatgccctgagcttgcgtaatctcgaggaaatgcttgttgagcgggggataaccgtcgatcattccacgctctctcgctgggttcatcgcctgatcccgttgagggtcaaacgttatcggcggagcaagcccgccgttgggcgtcggtggcgaagggatgaaactgatatcaaaatcaaagggcaatggcgttacctttaccgggcggtggattcagacggcaatacggttgattttttgttgaccgcccatcgggataaggaagccgccttgcgtttctttaagaaagccatacgccagcatggacaacccgacggagtgacgatggataaaagtggtgccaataaagccgcagtggacgagttaaacaaggaaaaaacaaaggataacgacatcattatccggcagaataagtctcttaataatctgattgaacaggatcaccgccacgtcaaacggcggacacatcctatgctgggattcaaaaatttcagacgagcccagaccgtgttggcagggattgaattagtctgtatgttgcgcaaaggacaataccgacaaaaagaagggggtccgatttcaccggcagcctttttctatcaattagctgagtaa

SEQ ID NO: 5655 - DNA, 726 bp, Xenorhabdus bovienii
  Coding DNA location: Contig name=SeqID_16909; Position on contig =11103..11828bp; Strand=-
atggctgaaatgcttgcccagttggccgggacccgtggatattacgcaacgattatgccttttatgccgctgcatcaggccctcgaggttgcccgttactatccccatgctcgggtattgatgcattcagcggaagcgaccctatcggtaccggccggggggcttgattcgcaattacaacaattgtgctcccaccacagggtaagaaccaacgcggaactggccgccttttcccgcttagggaaccgagtggaatggtgccgactggacgattatctactggaggcggcggcagaacttattactaataaccggggaaaatacggtagccatcaaggtattgactggatgcagcgaatatttgatggacaaaaaaaatcctcagtcatcaacactgcggtggctgctgtagccaaacgcggtgagcagatcttgggggtaaccatcttctaccgttttggtgaaacccttcatgcccgttattacggttcgaattatcagatagacgataacgacttccgttatttcgtgctgacctattacgactcgttagattacgtggcgaaaaacgggagctgtgaatgccggctgtccatttccgcccttagagccaaaacgggttctgtcgcattaagcgatcatcaggtaagctcccctgtttttgagcgagtccagagcgatgcccctgatccgaaaagcgttcaaacgtctgcactaccctgttga

SEQ ID NO: 5656 - DNA, 543 bp, Xenorhabdus bovienii
  Coding DNA location: Contig name=SeqID_16909; Position on contig =12150..12692bp; Strand=+
atgtcgttgatacgaaaagccttcaaacggttacattaccccgttgatatcattgcccagtgtgtccgttggtacttggcctatgccctaagtctacgcaatctcgaagagaggatgaccgagcgaggagtacgtgttcattctaccttatcccgttgggttatcaggctcacaccattactgggtaaggcctttcgtcgacataaacgtcccgtggctcgtcgctggtgtatggatgaaacctatatcaaaatcaaaggtcagtggaaatacctgtatcgggcggttgatacctccggtcaaactattgattttttattgaccgccaaccgagataccgctgccgctttgcgttttttccgtaaagccctacgccaccacggggagcctgacatcatcacccttgataagagtggggccaacaccgcagccatcgccttgctgaataccgataaatcaaaggaaaaaactatcaaaatccgccagaataagtacctcaataagatcatcgaaacattaaacgtcggatacggccgatattag

SEQ ID NO: 5657 - DNA, 360 bp, Xenorhabdus bovienii
  Coding DNA location: Contig name=SeqID_16909; Position on contig =12913..13272bp; Strand=+
gtgcttaatatcttcccaagcattgataccggtgtttgtgccacatctgtccgtaaattcaaccaacttgccagcgaattggataatactgttgtattgtgcgtttcagccgatttgccttttgctcagtctcgtttttgtggctctgaaggcctgtccaatgttgtcaccctttctacgctacgtggctggaaatttcaggaagattacggggttgcaatcagcgaaggcccattggctggactgactgcacgggctgtcgttgttctggatgaaaataatcaggttatttatagccagttggtcgatgaaatcaccaacgaacctgactatgacagcgcattggcagcactgaaataa

SEQ ID NO: 5658 - DNA, 1917 bp, Xenorhabdus bovienii
  Coding DNA location: Contig name=SeqID_16909; Position on contig =13761..15677bp; Strand=+
atggaaaggatcattatagctcactcctcattaggcgatgaatccctgctgtttaagtcattgaaaggaaaagaaaaattatcaactatttatagttttgaagtggagcttttcagtgaaaagaaggatcttgacatcaaagagttacgaaacaaacccctgtcaatagagataaaaaattctacaaacatttcagaaaaatcccgctttttaagtggaattatccgtgaagccactatctgtgattattatgaccattactactatttatataaggtgattatccaacctgagttgttcattctcactttaaacaaagatttcagaatctggcagaaaaagacggtgcctgaaattatttcagacgttcttaataaatataaaataaagtttaaaaatgaactcaatgcgaaataccagccattagaatattgcacccaatataaagaaactgatttcgattttttgagtcggttaatggaacgtgaagggatttattactatttccaacacgataagaatgatcacacgcttatattggctgattccccccaatcccattcagcgttaccagagcaggcttctattgaatattatccaagccatttttcaccgagaaacaaagacaaaaattatctatacgactggattgtaagttattcaatcaatcccaagttctataccatgagtgactataacttccttaagccaaatgcacagctaaaagaaactcagcagaatccagatccgacagtaccaaaaacagaactgtttgagtggccagggaattataccgaaaatgcgcaaggacaattttatgtccgaatactacaacaatcctataccgcgcaggatctgtatataaaagcaaaaagcatagaatccggcattgcgccaggctacaccttcacattatcaaaagccctgcgggatggagacaacggcgactatcttattgtcagtgccaattatgagtttcatgaaaatccctatattctgggagacaatacggctgatgccgacaacataaataaaattatcactgagttcaccgccatccccgctaaagtcaactggcgtgctcctcgcacaacatcatggcccatagcaggtactgaacgagctaccgttgtcggggcaagcggcaaaaccatttggactgatgaacatggcagagtcaaactcaagtttcactgggacagaagcgatataaaagacgataaaagttcttgttgggtacgggtatccaacaattgggcgggatcaaagtttggggtgatgcaggtgccaagagtgggggaagaagttatcgtcaatttcattaataacaacccagacgaaccattggttgtggggcgcagtttcaaccaaaacaatatgcctccctgggaattacccgcagaagccaccaaaatggggataatgtcacggagtttagagggcggaaaagataatgccagttacttgttgattgatgatgctcaaggaaaagagtccttcgaaatacatgccgagaaagacatgacagtctcagtggaacacgatcaaaccgtttccattgatggggcgtctatcacaaagatcaaaaacaaacaacagactaccgtgaccaatggcaaggaagtcgaagtcaccagtggtggtattcaatataaaattactgacggatataaagcagatatcacgggtgataaatcagaaaaaatcagcggctcttatcagttagaggttggacgcaattttgctaacaacatcagtggaaattacaacctgaatattacggggaataagaaagagtcagtgacaggaaacgccgaaattaaagcaagcaagttgtccttggcatcgagtaccacaatagatattaacggtgcagcaaagatttccataacggcgggactcattctattgggttaa

SEQ ID NO: 5659 - DNA, 2511 bp, Xenorhabdus bovienii
  Coding DNA location: Contig name=SeqID_16909; Position on contig =15796..18306bp; Strand=+
atggctttaactgatatgggtgcctcccctcgcctgcggcctgagcctgaactttggcaacttgcagaagctgaactgaaaaccactaatggcgttgtcgatctcgccatccctaaatcttccgctgaatttcttgcaacgggctatgcctatactcatcaccagcctgataaaaccacgtgttctgcacgtatccagatagagcaattggataagacactgattgtctctggcgatcgtcattggattggcgataagccatccacgccgcaggcatttgaacagatgcggttggattggagccgtgctttcgggggaaaaaattatgaagaaaatccatatgggatcggctttacgccagaactacaggaaaatggcctcgaaactcatcgattacctaatgtagaagcccaaaacagacaacttttgtcactgcaggatacccctaatcctgcgagtttttgtcccctcgaatttgggtggccgcgccgtttcacccgtatagggaaaaaatatgacaaagagtggctggaaaatgaattccctggtttttcccgtgatatcgactggcgattgtttaatgctgctccccgcgatcaatggtgggaacactatcagacgctgccagaaaacgcagcatggcgcatttggaatatgcatcctgaaaaacccatgcaagaaggcaagctgccaccgtggcaggcgcgttgtttcatcaaacggctgcgtgctgacgaagagattttcgaagagattgccatgcgcaatacgacggtgtggtttttccctcatcgggaacagatgatcctgatttggcatggttacacacgtgttaatgaagatgatgcgactgatgttttacacatgctctccgcaatagaactcaatagcgaagcacactcagaaaatgactaccttcaagtacttaaccagcgtacagagaaagaaaaaggcgcattatatgctctgcgagaaaaagacctgatccctgaaagcattattggcccgtggatagatacagagcaatcggagcatggcagtcctttgagggagaatttgcaaaatcgcgagaaacgcctgcgtgagcaacacaaggagcgcatggcgaaatatggaaaagatatcagcacactaataactccctatattgaacaacccgctaatcccaaagcggatgaattacctgaatttgtagacaaaatagagcaagaagctgcccaaaaatatattgcagccgagcagcaacgggaaaaaattcgcacaatcgctcaagagcaaggtgttaaggtggagcaggtagcgatgcaaaacgcccccagagggccacaaaacttccaccaaatacgggatatcttgtaccaacagcaagaaagtcaaaaacaagttgagccaaaatcaatagaacttaacgataaaaaactgacacagattgaacaatctctgcataaaatgtatctggcctctgcacagacacaaccgccagccctgcgcttgaccggggatctgtcacaaattattcgcaagcaagtccagcgtattatgcgggaagggggcgatttccgtgcaatggattttaccggagcagacttatcaggaatggatctacaaggagccaatttttccggtagtttgctggaaagtgcctgtttcaataacagccaattggatggcgcagatttcagtgaagccatgttagccagagccgagatatgccatgcttccctatatggtgcaaaactggataatgccagtctggcacaggcaaaatgtgaacaaagcgatttttcagcggcaagttttaaagaaacacaattgcaggaaacgttgctcaaccattgccgatttaatcatgctatcttcacggatctctttttacaaagaaccttcatcaaacactgtcgtttccaacactcgcaatggcaaggctgcatttttattgagatgatgctacctgccctaaaatttagctatgccagcttaaataaagtttcctttatcaattgcctgctggagaacgccatttttgatcacgctgtactcgaaagctgttcatggatagaaaccgaagcagtggcaatccggtttcgatcagccaaactgctaaactgcgtgtttaccatgaaaagtgtgcttaatcaggctgatttcggttatgccacattaacggaatgtaatttacgccagacacctttagttcaggcctctttccactctgccacactgaataacagtgattttagcgaagccaactgccaattggctgatatgcagtatttaaataccacccaaagtatatttatcagaacgaattttaagaatgcattgctgaataatgccaacctgatcggcgcttttatgcagaaatgtactttttgtagcactgacttacacgaagctaatctgttccgcgctgatatgtcccagtccatcatagacgactccaccttgattcatcatgcctatacacaacgtatcaaaaccttacccaaacgtgatcaggacgtgatatga

SEQ ID NO: 5660 - DNA, 1068 bp, Xenorhabdus bovienii
  Coding DNA location: Contig name=SeqID_16909; Position on contig =18309..19376bp; Strand=+
atgctgacagctaatgagatcatggctaagatcaaacagggagacgtcattgaacaagtcaatttgcaggggatctcgctggttggacaaaacttatcaggaggcaggttctgggctgtagacttttcagatgccaacttctcccatgccattcttgaagagtcagtctttactgaatgcctgtttgaagaaacggtcttcaattccgtcaggtgtgaaaagaccttgtttgaacagtgtaatatgatacgtgccatgttcaataaggccacactgagcgccagtgtgttcgaccaatgcgtcttaaaaaaaacacagtttaaagtcacaaaacaaaacagtacccagttttcatcctgccaattgcaatatgctgattttattgaaaatgaatttgatcgcgccacctttatcaactcagtattgcattacgcaacattacgcaatagtcacttttttctggtcaccttttttcgtcaggacttaagaaaaacggatttttatgccagtcagttcatgaaaacccttttttttgaatgtgaccaccgtgatcaagattatcgaaaattgcaatttcaggcctgtcaatttacagataatcaacttgatgcagtgaattttaatcaatccaatttgacccattgcaattttaagggaagctctctgcaagacgcccagctttcgaatgtcaatgcaacccaagcgttattcatcaatgccgatttaacgcgtgcatgctgccataacagtctgtttaatggagctatttttattggcgcttgccttgagcggaccgattttcggcaaagtcaactacaacaagccatcatgcaaaaagtacgggctgtcaacgcacaatttgtgaattgtgatatgacctatgctgatctctcttatgccaacatgaataacagcgactttcgggcagcacattttatgagaacgctttttcatcgtactcaacaggttggagcattattctctgaccgtcagggcatattggaaaatgatcctgaactgtttgctgctgaagagtggagtacacaacaacgtcaacgtaagatttaa

SEQ ID NO: 5661 - DNA, 516 bp, Xenorhabdus bovienii
  Coding DNA location: Contig name=SeqID_16909; Position on contig =19538..20053bp; Strand=+
atggttaaaaatcaaaatcatgggtggcattgtcgacaagccgccagttgcctattggctcctgcaatgggtgacagggtgctacttgtagaagccgatgaacaactctggatactggcgatattagaacgggcagagcaacaagatccggctgtaatcaaggtatcaggcgatttatccattatggctcaggggaatttgaacctgagcagtaacgggttaaatatcaccgccgaaaatggaaattgccatattaatgaaatgcaatacagtggtggatccttgtctgcctgggtctccgtctcgaagataataggcaatcaatttgaatccgtttggcaaactgtaacccagttgagccatcgtctttttcgccatactacgcaaacagaacaagtgcatgcagggcaattagatatgcaggcagaaaactacatgcgactacatgcccaaaataccgtgataaccgccaaagcaatcaccaaaatagatgctgaacagatccacattggatga

SEQ ID NO: 5662 - DNA, 402 bp, Xenorhabdus bovienii
  Coding DNA location: Contig name=SeqID_16909; Position on contig =20074..20475bp; Strand=+
atgtttgccaatacccaaggcggtggcacagatctggccaccccagatatctgcctaaccccatgccctctaggtgccccagtaccgatggtgtatctcaatattgcacaaggtacgaatggcatttgtgccagcacggtcaatattctctttatgggaagtccagcccataacatggcgacaatgattgccatgacgaatggagataatccgggggtgaatttgggcgttgcgtccgggacggtgatgggaccctcccgccatacgcttggagccaatagcgtcttgattaagggatcaccggcaacccggctatcaagccctaccctacagaattcaaccaatgcggtaggatcacgtaccgtccccagccagacaaaggtcgatatttcaggggcatga

SEQ ID NO: 5663 - DNA, 207 bp, Xenorhabdus bovienii
  Coding DNA location: Contig name=SeqID_16909; Position on contig =20933..21139bp; Strand=+
ttggaaaaaaacataccagaagccaactctatcggcattcttgctgaatataagcaattggatgggaaaaaatggcgtatcgcattaccggttcccattcctgagcctcccgctttctataagttttggacatcaccgccagacacattagatatatgcattcaagtcaccgccaatggcctaaatttcatcgataaatgcaattaa

SEQ ID NO: 5664 - DNA, 1344 bp, Xenorhabdus bovienii
  Coding DNA location: Contig name=SeqID_16909; Position on contig =21166..22509bp; Strand=+
atgagcagatcagaaaaagttatctggacagaaggcatgttcttacgccctcaccactttcaacaggccgaaaactatctggagacttatgtccgcgattggggtatggctcaaaggccatattactggggctttttaacgttaaagttagatcaatcattgctcgaacagggcaaggtcatggttgcatcagccagtggaatttttcctgacggaacaccctttaatttcaccgagacgcacgcccctgttccattgcaacttgcagaaaatcaaactggagaaaatgtcgtattggcactgccgatctttcgcggaggaagggaagagatcatttttcaggaaagaaaagactctatggcacgttttgtcagcgttgatgccgaggtcaatgattttaatgccatgtcagtcggaagtaccaccgtgcaatttggccgaatgcgcctgcggttgatgttggaatcagatctgactccggaatggacgtcactaagtattgtgcatgttatcagtagaacccgtgataataaattgctccttgattcacgctttattccgcccttactcaactgccatgtacatccacaacttgtcggtttcattaatgatttacagggattgctggagcaacgccgccaacagacaagccagtgtttgttacaattggggcaacaaaatagttcggaaatcatgtattttcttttcttgtcattagtcaatcgttatagaggccaagtgagccatacccggaatattcccttactgcatccagaacggttattcagtgaatggctgcaatttgccaccgaactggcaagtttttcccaatcacggataccagaagagaaacttccgatttatgaccatgacaatttgcaagtctgtttcaaccacctcatgtttttattacgccaagggttatccattattctggaagaacacgctctccagttgcctttgactgagtattctcatgggctgaatgtggcgaccttaactgacgccaatatgctaaatacattcagctttgtattggccgtttatgccgatatgccgaaagaaacactcatctcccgttttccggcacagatgaaaattgcccctgttggccgcatacgtgaactggttcagttacagttacccggtatcccgatcagtgcaatgccatccgttcccagacaaattccctggcattccggttacctctattttgagttagaaaaagagggtgaactctggagccagatggcaaaatccggtggttttgcgttacatctggcaggtgaatttccgggtctgcacatggaattttgggctgttagaaatcagtccaagagttga

SEQ ID NO: 5665 - DNA, 1212 bp, Xenorhabdus bovienii
  Coding DNA location: Contig name=SeqID_16909; Position on contig =22553..23764bp; Strand=+
atgactccaaacactcccaacaggcatacggagctttctggcgacacttgggataatccattagtcactgccgctaaccctctattaaatagcattcctcagatccgccatgataccgagtccccggatccaaccgttctacggcaaaaactgatcgatgaaattcgccactttgaactgaaatgccaatatgccaaattgccttatgaagtcattatcggtgcacgttactgtctgtgcaccacattggatgaagcggcagcactgactccgtggggcgttcgcagtgtctggtccggcagtggattgctggtcacgtttcacaacgaaacatggggaggggaaaaatttttccagttattagcgacgttatcccaaagtccccaaaaaaatctgttgttgttagaactcattaacttttgtctccagcttgggtttgaagggcgttatcgtgtcatggataatgggcgaacccagttggaaaccttgaaacagcgcctgttccagttaattcattccgttcgtggcaattatccgcctgaattatcacctgcattgcaaaaaatcgtggcgccaaatcatccctggcaatcgtctttccctatttggtcctatatcgcggtaacctgtcttattgcatgtattctgtatatcgggctgaattggcagttggataatataaccagcccaatattgacgaaaatatatcaagtcaatttgcccaatatgtccgttgatgatcgcgtttcttctttcctgccgccggtcttaaatttacaggatatgctcagacgtgaaagtgctgcgggattattaaatgtcgcggatttggctgataaaagtatcgtcacattaaggggcgatggtttgttcaagacgggttccactcaaataaaaaataattatcttcccgttatcaaacatattgctgagaccatgaacaacatcgagggggaaattttagtaatcggctataccgatgatgttcccattaatagctccagcttttcatctaattatgccttatcactcgccagagccaaatcagtaaaaagggaattcgaaaaatatctggatcaccctgaacgggtaagaacagaaggaagaggagaaagtgatcccctatttccaaacgatacgcccagtcatcgagctaaaaacagacgggttgaaatcattctgttaatttcccctacacatcagacaacgtga

SEQ ID NO: 5666 - DNA, 3510 bp, Xenorhabdus bovienii
  Coding DNA location: Contig name=SeqID_16909; Position on contig =23777..27286bp; Strand=+
atgttgagcgccattgttgctatttttaccagccgattaatgtggagtttcctcggcatcaccgccatctcttccattatctggtttattggtcccatgacttctatcggtaataccatacctcttgaatcaagtacggtacgaataattatcattgccacattatattttgtctggctctttatccagttagcgtctcacttatatcaggtttggctgaataaaaaactttctgccccattaaacagaggcaatggcgagggtgaacaattacgaaattcacaatattcccccttatcagaacacttttctgatgccttacgactactgaaaaatgcctatttttatggttcagagatccaatataagccaaaatggaaaccttttttcgatcgtcgatatcggtatcagttaccttggtatgtcctgattggcgcccccaattcagggaaaacaacccttctggaaaattctggtttgcactttccattatccgatcatttcgaaacgctttcctcaaacgagataaaagaaaccgataattgtcactggtggttcaccaatcaggctgtcttactggatacacccggacgatataccactcaggatacacggcacgaacaagatgcccgtgaatggaaatgttttgtcaatttgctgaaaaaatatcgcacacgccagcccctaaatggcgtcattcttaccattagcgtagcggatttattaaacccctcaaagaaagtacgtgatcaacacgcttatttattacgcaggcgattgtcagaattacaggctcagttcaagatccaatttccaatctatgtcatcattaccaagattgatttactgaaaggatttggggcttattttgcccattttgacaaaacacagcgcgatcaaatctggggattcaatttcccgtggaacaaaacaggctgggatctaaaggacatttttgcacagcaatatgggttgttgcagacacgattaaatgcagggctatcccatattttattgcacctgaatgatcttcagcaatgtgctgaaagttacctatttccgcaagaatttgccgcactgcaatccttaattgctcagcatcttgaaattgcattcgctaaatcagggtttgatattccttattcaccacgtgggctttatttcactagcggcgtacaggaagagcctattcatcaagggtattttctgaaaactctgctggaaacgctctttcaggaagccgggcttgccggtcaaaatcgttggtgggtgtacagaaaccgtctattaaaagggctggggtatattattctggctgcgatcatggggttaatcatcaccttgttttttagcagttataacaacaataaaaattacctgatagaagttcaaaataaaattttccctattctgagccaaagcgcaaaattaaaaaagatcagcaacgacatcgatatttatgccttactgcctattttgaataaagtggcggatttgggaaaaagtaaatatttttctcctgatgctcccccttggttataccaaatgggcttgtatcatggtgaacagatcaatggtgccagtttgacactgtacacgaaaacattacaaaccttattgttaccgcaagtcgcacggttaataacgtctcaattgcaccaaaccaacagcgataatatagatgacacttacaatacgttgaaagcgtatcaaatgttatgtcagccccaacattatgacggtaagttcttacatcgttgggtgatgcaatatttgcaggctcatttaccccccactatttcaccggcacaattacaccaaattgaggggcatctgcgccaattattggaatatcaggtcgttactttcccttatgtttgtgataacccactgataaaacaaaaacagattttacttagcaagatcccaccagcacgactcgtttatatccatttaaaacaggaactatcggataaccccaatttatcgccagtcggcttaacaacgcttgctggcccagaagccggattggttttctcgcgcatcaacggtacaccgattacccttaatatagcggggatgtttactccggcggggtatcaaatggggataggtaacaatctcactaccctcatcgataagttatacagtcaaaatgcatggatactgggccagtatgcagaaatatcaaccccaaaagagcttgcccttttagtacgaaaattttatctccatgattatcttgaacagtgggataaatttctgttcgacatccgtctaaacaatattgacagcctggagcaacgttccaatatggcccagttgctggcttcaaatgcttctcccatgcgcaatctgctcattaatatcagtaagaatgtcaatctgaatgaagggttaagcgatagcaaatttgataaaaaaatcggtgagttggtcagccgtaaagcaggttcattgacaaaagtcgtacctaatccattcatgtcaggagataacccccccaccccggaacaagaattgagagaacattttacccaaattattgcattggcaaacaatccagacggtaaaaataagcaaattccctttgataacattctcagccaacttgccaaattacatgaatatctggattcggtacaaaaggctaccaatataggcatacccgcgccatcggatgaaattatcacccaactccaagccacggcggagcgattgccgatcccattcaagggcatcatttcctcgttggcaatgggggctaacagtgatacacaagccagtaacgtaaagaatctcaataagcaactgaatacagaagtccaaggcttttgtcatcaagcgattgccaaccgctatccgctgacgccgtgggcacttgatgatatcagaccggatgatatggcccggatgtttgcgccacaaacggggatcatggatagctttttccagaaaaatctggtgggaaaagtcgatacatctcacgaaaactggcgccttatactggggacggatagcaaagcattaccggaaaatcacaaattactcctgccattccaacaagcccagatcattcgagatactttattcagcaacggctcgcgtatcccttcatttcgggtcatcgtccgcaccgtaaatatggataaagagatattgagtatgatactggatgttgatggccagcaattgcaatatagccacggcccacaagtttcgcagtcactcaattggcctggcccaaacggctccaatcaggctcgtatccaattaaatttagatgatgggacaacagcgagtctgatcacttccggcccgtgggcattaaatcgcttaattgaccatgagcaacacgcgacaggaaaacccgccacaaataatcatacaagccagcgtgtgacatttaatatcagaggccatcatgtctcattggaatttattccaaacagtattctcagcccgtttcaacttccccttttcgtctgtcccaagctgattaattcataa

SEQ ID NO: 5667 - DNA, 1056 bp, Xenorhabdus bovienii
  Coding DNA location: Contig name=SeqID_16909; Position on contig =27444..28499bp; Strand=+
atgaacatcgaaaccttactcgaacccgtcagcatcgaatctccttgtggggaaaatctggaatacgatcctgaatttatggcattagagcaatatttgctcggaaaaacggaacagcagtttggtgatatcactattccagcggagccacctgactggatacaggccgaaaaacaagccattagcctactgaggcggaccaaagatctgcgcatcatcatggcactgacacaatcatggttgcaaatgcggggattatgtggctacgcagacggcctgaatctgctccagcagacactggaacgctattgggatgaagtttggccgaaattagcgtttgagggggaatatgatcccctatttcgcctcaacatacttgccgctattgaggacgattctcctctttcgttgcaagcgcaatattccactctgttgcggaacgcgtcaaaggagttgtcattgctggaggtttgctcattactggatggcacgataaacgaaatcagcggctataccggcgggcgaccccgattacaggaggagttaaagcagcaggccagtagccctgaagttttggccgtgatccgtattcgggatcacctcattgcaatactcgacattattcgtcaggcattctcagaaagctatgttcctgaattgtcttggttattaaaacaattaaataaagtgattgaattttgcccttccctctcaaaaacaaggcatcgcgataaggagccagaccccaaaaatatttttgactcaacaacatgttcggaacagagaacgcctgcatcgacatattcaacccatgcggtatctgcttcttggcataccattgaagccagcaaccgtgatgaagcacgcatgttactagaaaaggctaaaaactattttgtcgtcaatgaacccagtcaccctgccccacatatgattgcccgcattcagcggttgattgatcgtgacttcgttgacattgtttatgatcttgccccagatggactcaaccagctcgaaatcattttgggtcgcccagacaattttgactcgaattaa

SEQ ID NO: 5668 - DNA, 552 bp, Xenorhabdus bovienii
  Coding DNA location: Contig name=SeqID_16909; Position on contig =28690..29241bp; Strand=+
atgaaatccagtggacaaaagtttattgctcgaaatcgccctccacgcgtacaaattgaatatgatgtcgagctttatggttcagaacaaaaaattcaactgccgtttgtgatgggagtgatgagcgacttagcaggaaaaccattagaagccttaccggaagtcagtcaccgcaagttcatggaaattgacattgataactttgatgaatgcatgaaatcaacacaaccccgtgttgcttttcaggtggacaataccctaaccaatgatggaaaactgaatgtcgaattaatctttgaaaaaatggaagattttcagcctgatgccattgctaaaaaagtagaacccctggctaagctactggaagcacgaacccaactggcaaacttattatcctatatggatggcaaaagcggcgcagaacaattgatcgccgatatcctgcaaaatcctgccctgctgaaatcactggccgatgccccaaagcccaccgaaagtgttgctgatacagacagtacgaccaacacagaacaggctgaaaataaggagtaa

SEQ ID NO: 5669 - DNA, 1503 bp, Xenorhabdus bovienii
  Coding DNA location: Contig name=SeqID_16909; Position on contig =29245..30747bp; Strand=+
atgagtacgactgaacaagaaactgaatttcagcaagagcagctctcaaaagaatatacccctgatgaactgagtgtattgctgaataaagaatttcgtccgcaaagcgaccaggcacgaagcgcagttgaaagcgctgtgaccacattggcacaacaggcgctggaaaatacggtcacaatctccggtgatacctaccgaaccattcaagccctgattactgaaatcgataaaaaactatcacagcaaattaatcatattttgcatcatgatgaattccaaacgttggaaggggcttggcgggggttgcattatctcgccaataacacggaaaccgatgaaatgttaaaaatccgtgttatgtgtatttccaaaaaagagttgggcagtacgctaaaacgtttcaaaggtgtgagctgggatcaaagccctatctttaaaaaaatctatgaagcggaatatggccagtttggcggtgagccttatggttgccttatcggagattattatttcgatcacaccgcacccgatgttgaactcttacgggagatggctcagattagtgccgccgcgcattgcccatttctttcgggcgcctcaccaagtgtgatgcaaatggaatgctggcaagagttatctaatccacgggatctcaccaaagttttccaaaataccgaatatgccccttggcatagtttgcgtgaatcggaagatgttcgttatctgggattgactttaccccgttttctctcccgtctgccctatggtaataaaacaaatcctgtcgataattttaattttgaggaggataccgaaggccctacccacagtaactatacctgggccaatgcagcttatgctatggctgttaatatcaaccgctcatttaaattatatggctggtgtacttctatccgtggcgtagaatccggcggtactgtagaaaatttgccttgctatactttcccaaccgatgatggcggggttgatatgaaatgccccaccgaaattgccattagtgatcgccgtgaggctgaattggctaaaaatggttttattccactcttgcatcgtaaaaatacagatatggccgcctttatcggtgcacaatcacttcagaaaccttctgaatattacgaccaagatgccactgctaatgcaaatctttcagctcgcctaccctatttattcgcctgctgtcgtttcgctcactatttaaagtgtattgtacgcgataaaatcggcacatttcaggaacgtagtgatatggagaactggctcaataactggataatcaattatgttgacggtgatccgaccaactcttctgcaggaaccaaagcacgaaaacccttggctgccgcagaagtacaagtagaagaaatcccaagtaatccagggtattatcacgctaaattcttcctacgcccacattatcaattagaaggattaaccgtttctttacgtctggtatcaagattaccttcattaaaaagcgcttag

SEQ ID NO: 5670 - DNA, 504 bp, Xenorhabdus bovienii
  Coding DNA location: Contig name=SeqID_16909; Position on contig =30913..31416bp; Strand=+
atgtctgatttcaattccatgtataatactcattctttcgtccaattcgagggcattgagggtgaatcgcaaactaaaggttatgaaaaatggatcggtgtccaatttattagtcgtgccataattaaccctgctaatgtctcaaccgatacaggaagctggggttcaggtaaaggtgttttaaaccatttcatgcttcatattaattatgataaggcaataagcgccttagaaaaatacgctgtcacgggtaaacatattaagacaacaaaaattcatatacttcgtttcattggcgaagctgaaccggcaatatgggctaaatatgaacttaccaatacttatatttctgaaataagcagtggacaaccttccgataatgtcatcacggttggcctaaaaatgaaaaaactccaattaaattacacaccagcagattatgaaggtaaaaaacaggctgaaaccacctggacctgggatatggaaaaaaatgttatcgaataa

SEQ ID NO: 5671 - DNA, 1554 bp, Xenorhabdus bovienii
  Coding DNA location: Contig name=SeqID_16909; Position on contig =31508..33061bp; Strand=+
atgcgattcaccattgttaaaaatattggtacaaaccagccgcaacaactgagttatgattttatgccgcccggtggcacaattggccgctctccagataataactgggttttgcccgatgaagggcaggctatagctcgtttacaggccactgtatctgtttccatcgatggagaatgtcgtattagcaatcggggggctgcctctgatattttgttaaataccatccccatcgctcccgaccggaagattgaaatccgcgatggtgatacgttaaatatcggtgattaccaaatccaagtcattaatattaaccaaggttcgaataatacgaatagtgtgaacacgccaccattggcaacaattcgcaaagatattcacagtgaaatttgggatggattggagaatacgtttacgtccgatgaaagcatgcctcagactccccaacaaattgctaagacactcaatgacaataatccactcataaaatctcagcgacatcaggaacgcaatccaataaaccctctcgaacagatggaaacaataattgacctagattccctgcaattccgagccactgatccaatcacgatgtttaatgcaaacacggatagccagcaagaaaatattctcaatgacagtacgcccagtaccttattgcagcagggcaaccagcgcgataaacaagaaattgatcccttgattttattttccgataaacgtcggcgggggattttgcatgatgagccgctaaattgggtgatggaaaatgctgaacctttggtcgcacaggctaatacaggcacttctgaccctcaatatggcgccagtgatccccctttccaccgtcataacaatgaacgcttggatatcgacccagtgacatatccgcctaatccccatcaacccgatcaggtcgaagaaggtgttaaattagagggtaaactcttagccgctttattggacggtatggggcttaatcatctccaaaacctgcaatttgatgggcataccctgtataaactggggaaattacttagccagttatcacaaggcattatcgcgttaaatgcgtcacgcacgcagttgaaatatgaaactgataccggagttgcccagatcctggtggatggcaacaatccctttgcacttcttccttcgggtcaagcggtgctgatccaaatgcttggcgatcatatgccaggatttatgtcagcagaacaggcaacacgagatattttaatcgagttacaagcacatcaattaggcatgattgcaggtttacgcactattacgacagagatgttacaacgatttgatccctccgtgattaaacaaaaagcacaagaaaccggcaacctgcctcgtttggcattatcatcaacttataaagcggctttatgggattatttcatcaaacattatcagaaaaccatggaaaaaattgaacaggatcactctgtatttggtgaacactttcaacaagcctatgaatcagaaattattcgatataaacactcgcaagataaattaaaaaatagagataaaaaataa

SEQ ID NO: 5672 - DNA, 555 bp, Xenorhabdus bovienii
  Coding DNA location: Contig name=SeqID_16909; Position on contig =33118..33672bp; Strand=+
atgaaagataatatcactttattacatggcggttatcattttcgaaaacctcctgcacgcatcactgccagagataggatgcagtcttctttacttgacagacttaccgacaacgaacctgacaagaaaaaagaaaatacgaaaaattatttattatcacacagaacctttcggcaaaatatactacgggatttacaatggttactcaacagtattaataaagaatctaatccagaactttcttgtttccctgaaatacagaattctacttataactttggcatagctcccctgtcgggtaaaaacatgtccgatattgaatggagtgatatccaaaataaaattattaaagcgattcatatttttgaaccccgtattatttccagtgaactgcaagtcaattgtatttcaaatattcattcactatctctatacaatatattgtccatcgaaataaaaggatttttgtggtgtatcccctggccaatagaattcctgtttcgcagtgacatcgatctggaacacggttatttcaccatgaaagaagctggataa

SEQ ID NO: 5673 - DNA, 1875 bp, Xenorhabdus bovienii
  Coding DNA location: Contig name=SeqID_16909; Position on contig =33693..35567bp; Strand=+
atggatagcaaactgctggaatactataatcgagaattggtgtacttacgtgaaatgggtaaagagtttgccgagcgctatcccaaaattgccaatcggttaggaatgcacggcattgaaatcgccgatccctatgttgaacgcctgatagaagggtttgctttcttgacttcccgcatccagctaaaaatggatgccgaatttcagcatttttcccagcatttactggaaatgctctatcccaattatctggcgcccaccccctcaatggcaattacagaactccaacccgacatgagtaagggagatatcagccacggttttctggtgccacacggcacgattatgcgctgccaatcactggagaacgacggcattactttgcaatatgccacggctcaggatgtcatcttacaaccgctgaaactacaaaaagttgagcttggcaaaatccccgccaatattcctcttgtgggtttaaaccttcatcaatatggtgcaatcagtgcattgcgtatccgccttgcctgtaagggaaagttctttctccacgatttagatctcaataaactgacattttttctttcagggccagatattcaatcccagaaactgctggaactgattatggagcactcggttgggatggtatgccaaactttgggggcctccccacaatacctgacattgcctgacattgctccacatcatgaaggttttgatgatgagcaagccctcttacccaatgatccccgtaatttcagtggatatcgccaggttcaagaatattttgcctttccggcacgttttcgttttttcagtgtttgtggtatgcaatctttgctcaaggagacgaagaaagacgttgaattcgagcttattctgctcttaaacaaaaccgatagcagtttagagagcctgatcgacacttcctatctggcgttgaactgtactcccgtgatcaacttatttcccaaaatgaccgagcgggtaactgttgatgaaagtaccaatgaatatcatttggtcgtcgataacatccgtccattggattacgaaattttttccgtacaacgcttacttggcgtcgacgcacaacataaacaagaacgtatatttcgtcctttttggtcaaccaatagcgatgaccagggtaattacggtgcctatttctcactgcgccgggagccacgcatattgtctgaacacgcccatcattatggcacccgcactagctatatcggcacagaaacatttatctctattgtggatgaacattactccccgtggcctgatacattaagatatctgagtgccgacgtgatgtgtactaaccgagatctacccgcaatgttgcggcaaaaagatatcaatagctttgccatgctggactccatccctatcagtaaaattgagtttattaaaaggccgaccatccctcgccctgctctggctgagggggctgtatcatggaaattaatcagccagcttcaaattaattacatgaattttatggatcaaaaccaagaagaaggtacccaggcactacgacagctattaagtctctatgccgatcttgctgagccagcagtcgtacgccagattaatggcatacgacactgctcattaaaagaagtctatcgtagagtgcccgatactggccctatcgtttttgcccgtggtgtcagcattaaactcgaagtcgatgagcaggagtttgccggcgccagcccgtggcttttaggcagtgtgctggaaaaattattctcgcgtttggtcaccataaacgcctttactgaaatgacactgtatagccagcaacgtggacaagttggcttctggcctgcccgcatgggcagcaagaagttaatataa

SEQ ID NO: 5674 - DNA, 1077 bp, Xenorhabdus bovienii
  Coding DNA location: Contig name=SeqID_16909; Position on contig =35623..36699bp; Strand=+
atgaaaacagatattacggccattcatcgtgtatgccgtttgccagagtatttttggcaacaactcacccaagccccctggcaatttgatctgttccagaccctacgtcgcattgatgcccaagcgggagggtattaccgattagggacagccccattaccacgctatgaacttttgcgcttggggcaaaaagcgtcaatggcattcgcaccttccacaatttccacagtccatcagctaaaaaattcaaaactctacgaagtgcttatttacagcttcggattatttggtcccaatggcccattgcctctgcacctgactgaatatacctattcacgggaatataattatcaagatcccactttgggtgcctttaccaatctatttcaccatcggctgatactcctgttctatcgagcctgggccaatgcacaacctacctcatcattagatagacctgacaaccagaagttttgtcattatctggcttgcctgatagggatgggattgtcagcccagcagaattccaacccggtcaatcacgataacattatccgtaactctattaacaatcatgcccgttacgcgttgtccggccatctttcccgccagaggcataatgcggaagggttgaaaaaaataatgcttttttatttcaaggttcccgtaaaaattatccaaaatatcccacaatggttgcagattgaaacgcaagatcaggctcgactggcagcagggcgtcatgtgccctgtttaggtaagtccgccattttgggcattgcaatacatgatattcagcataaattccgtattgaactagggccattaactcaggcagagtacgacatgtttctgcctgaacagacgaaatctcaacaagtgcgtgagtgggtttatcaatacttaggtatcgagtatggctgggatattaggctgatacttgataaatcagacatcaccgaaatgcgcctgtcaaaaacggggaaattgggactcaatagctggctgggtaaggttaacaaatcaagccattatgatgacttaatctacaaccctaaatcctgcaagacacattaa

SEQ ID NO: 5675 - DNA, 2634 bp, Xenorhabdus bovienii
  Coding DNA location: Contig name=SeqID_16909; Position on contig =36743..39376bp; Strand=+
atgccagaaatcagccgttctgtactctttggtaaactcaatcgtgtactcttcacctcactggaaaatgcgacaactttctgcaaactacgcagtaatccttatgtcgagttagtccattggctgcaccagcttatgcagcaacaagactgtgatttacaatcggttatccgttactttgcattagatgaagccaagctggcaaaagatattattacagcactggatcgcctgccacgtggagccagtgcgatttctgatctttccgaacatattgatagtgccgtagagcgtgcctgggtatatggatcattaaaatttggtgttgacaagatccgcaccgcgcactggctgattggtatgttaaagactttcaatctgtacaataccctgaaagccatttcccgacagtttgaacaagtcaatgcagatacgttaatagataatttcaacgccatctgcggcaacagcagtgaagaaccggagaatgaatcaccctctcatcattcccaaccgacaaaaccacaatcctctgacagtgccctgcggcaatatgggcaaaatctcactgatctggctcgccatggtgatattgatcccgtatcaggacgcgatgaagaaatacgccagattgtcgatatcttgatgcgccgccgccaaaataaccccttactgaccggtgaagctggggtcggaaaaaccgccatcattgaagggctggcattgcggatcgccgcaaatgaggtgcctccaccactgcaaaatgtgcaactttggctattggatattgggatgttacaagccggggcgggtatcaagggcgaattcgaatcccgcttgcgcagagtgattgacgaagtgcaatccagcccccttccgatcattttattcattgatgaaatccatacattaattggtgcaggcgggcaacagggaacgggggatgcggccaatttacttaagcccgtactggcacgtggtcagttacgaacgcttggagcaaccacctggtctgaatacaagaaatatattgaaaaagatccggccctcacccggcgttttcaggtcgtccaaattcatgaacccgatgaagccaaggcacttttgatgctacgcagtttggtcaggacgctggaaaaacatcaccgtgttctcctactggatgaggccgttgaagctgccatacggctttcccatcgctatattcccgctcgtcagctacccgataaggctgcagctctattagatacggcatgcgccagagttgccattagccaacacgctgaaccaccacagttggaaaattgccgacataaaatcgatgccttgaagattgagctagaaattgttgaacgagaagcaaaaatggggataggcgatcagcaacggtcaaataccatcctcaatgcgctatccctattggaagaacaacgtattcaattggaaaaccactggcagcaagaactctccttgattaatagaattattcatctgcaaactcaactttatgaacccccctttcatcaacaacagcataatgatcccaatgccctgcatgcagaactgatagcattgcaacaacaattaaaaatgttgcaaggagagatcccccttatctttgcttcggtagacagcaatgttgtttccgccgttgtctcagactggacgggggttcctcttagccgcatggtaaaagacgaaattaatgcggtattgcatttggcggatacactcaaccaacgagttatcgggcagtaccatgctttggagttgatcgcaaaacgggtacgaacttcacgggcaaaattggatgatcccaataaaccggtgggggtgtttatgttatgtggcccttccggtgtcggtaagaccgaaaccgcgctggcattagcggaaacgctatatggtggcgaacagaatctgatcaccattaatatgagtgaatttcaggaagcccatacggtatccactttaaaaggggcaccaccagggtatgtgggttatggtgaagggggagtattgaccgaagccgtgcgccggcgtccctacagtgtggtcttactggatgaaattgaaaaagcccactctgatgtccatgagattttttttcaagtctttgacaagggttggatggaagatggtgaaggccgccacattgattttcgcaataccattattatcctgacatccaatattggggctgatttggtgagttcgctgtgtttacaacaggcttctcttccagatccagaaaaactgagtaccgcattgcgaaaacccttactgcacgtattccctgctgccttactcggacgtttgattgtcattccttactatccattgagtgataatgtgatgacaagtattgttcacctgcaattggcaaggatcaaaaaacgtttactggaaaaccatgacattgtagccacatttgatgaacccatgattaaatatatcgttggccgatgtacagaaatcgaatcaggtggccgtatggtagatgctatcctgaccaactccttgctgccgcagatcagccagctcttgctctctgctaacgcgaatggtcagcaatatcatcaattacaagtctctctcggacaaggtgagtttcagttccagttcatggaatga

SEQ ID NO: 5676 - DNA, 885 bp, Xenorhabdus bovienii
  Coding DNA location: Contig name=SeqID_16909; Position on contig =39406..40290bp; Strand=-
atgtctaatttagaagaactttactgctgcgtcgatgacttttgccaaaaatttatccctctctggcatcaacaactcattgaaaatggattacgtaaacggcaccgtgaggcatccctttctctcagtgaagtcatgatgatcctcattttatttcatatgagtcattatcgtgattttaaaacattttatattgaacatgtaaaacaatattttacagccgattttcccggattagtcagctatactcgtatcctcaccctgaagaaaagggcgcttattcctttatgcgcttttctttcatcacgtaaggcgcacactcaagggattgcttttattgattctaccaaaattgctgtttgtcacaatcttcgttttccccgtcatcgcgtatttgaagggatggcacaacgaggtaaaacgagtacaggctggttttatggctttaaacttcatttggttatcaatgattgcggtgaattgttagccgtgaaactcaccacaggaaaccaggatgatcgtcagccagtcagagcgctgacaaaaggactaacaggatgtttgtatggtgataaggggtatttatcccaggctttatgcgatgagttagaagcggaaggcatcacgttaatcaccaatgtccggagtaacatgaaaaccaaagcattatctctctgggataggttgatgttaagacggagatttttgatagaaacggtcgtcgaccagctcaaaaatatttctcagatagcgcattcaaggcatcgcagtcagctcggttttttgttggaagttgctgccggtcttattgcttatacattccaacctaaaaaaccgagcttgaatctacgggataatgaaatcgctatctttaaacgaagctga

SEQ ID NO: 5677 - DNA, 303 bp, Xenorhabdus bovienii
  Coding DNA location: Contig name=SeqID_16909; Position on contig =40423..40725bp; Strand=+
atgtcgttgatacgaaaagccttcaaacggttgcattatcccgttgatatcattgcccagtgtgtccgttggtatctggcctatgccctaagcctacgcaatctcgaagagatgatgaccgagcgagggatacgtgttgaccattctaccttataccgttggattatcaggctcacaccattactgggtaaagcctttcgtcgacataaacgtcccgtggctcgtcgctggcgtatggatgaaaatcaaagggcaatggcgttatctttaccgggctgtggattcagacggcaatacggttga

SEQ ID NO: 5678 - DNA, 549 bp, Xenorhabdus bovienii
  Coding DNA location: Contig name=SeqID_16909; Position on contig =40559..41107bp; Strand=+
ttgaccattctaccttataccgttggattatcaggctcacaccattactgggtaaagcctttcgtcgacataaacgtcccgtggctcgtcgctggcgtatggatgaaaatcaaagggcaatggcgttatctttaccgggctgtggattcagacggcaatacggttgattttttgttgaccgcccatcgggataaggaggccgccttgcgtttctttaagaaagcaatacgccagcatggacaacccgacggggtgacgatggataaaagtggtgccaataaagccgcagtggacgagttaaccaaggaaaaaacaaaggataacgacatcattatccggcaaaataagtatcttaataatctgattgaacaggatcatcggaatatcaaacgtcggatacggccaatgttaggttttaaatcgtttcgccgagcccaaacgattttagcggggatagagctcgtttcgatgcggcgtaaagggcaatacttacaacccgaagataagacattgtcaccggcagagatattttatcgattgactgcataa

SEQ ID NO: 5679 - DNA, 732 bp, Xenorhabdus bovienii
  Coding DNA location: Contig name=SeqID_16910; Position on contig =99..830bp; Strand=+
atggttttggccgcaaaaagctttacatgtgatgtaaatatatatcatgaagagactcctggtacattttttgatgctcttggtggccttacaccttcccaatactgccgatggttgtggcgacgtaactcgaatgagaacggtcgtcatttgtatgtccctgtaggtcaaactaaacgaaaacgcaaagttacttcttcattatcttctttctaccttcaaatcaatacagatgaagatctctacttcactcccaatacgtttttcgactggcgtaaaaaagcgctgctatcggggctttgtgcaaattatgtagagatagatacgtctattgaacggatgctgactgctaatgagtctcagcaggttcttgatgaggtattgcagcaggtagctgcttcaggtacaccagcccctaatgccatcgttgaaagcgggtcaggcggtcttcatctatattggttctatgaaatgattgatgcttttccggcacagaagctagcatgggaatctatctctaaaacgcttactgataggtttactggcggcgatctatggcatgttgataccggagcatcccatgacatgacaagatttctacggttcctggttcgaagcattctacaacggggaagtgcgttaagttttggttgtcagaccaacagtattcttccaaaatgttggccaacaagctggatgttgtttattcgccaccaatattggaatcattaa

SEQ ID NO: 5680 - DNA, 204 bp, Xenorhabdus bovienii
  Coding DNA location: Contig name=SeqID_16910; Position on contig =776..979bp; Strand=+
atgttggccaacaagctggatgttgtttattcgccaccaatattggaatcattaagagtaagtgtcgtatttatccttctccctcaccaagatttactgagcctgaaagtgataccccggctcggcatagtatcgccaattggtggagccgtatctattggcatctatccagctttatcaggagttccaagcgaattaagttag

SEQ ID NO: 5681 - DNA, 870 bp, Xenorhabdus bovienii
  Coding DNA location: Contig name=SeqID_16910; Position on contig =2272..3141bp; Strand=+
atggctaagtctgttaagagtaaaaaaactggttcgtctgttagtctgttgcacaagaaaattgttgaggcaattcgcgctgctcatccaatctttggaaattccaatgataaagggggggtaggtaaaacgacagtaactgcacatgaagcttggtatttagctagtctcggtttgaaagtgttggtaattgatttcgataaacatataacgaaaatgtttttcgaaaatgctatccctgatttatctgaatttgcatatgctagtgatctcttcagtgatgagggtataactaagccgatctatgaaatgcctaatcaccaaaacatctggttcctgcctgctgagcatgaaatgaaaggtattgattcgcgtccgatgagttctggcatagttgtatatccacgctttcatttacaatcattacgtgatgatttcgacgtaattgtaatcgataccccgccaggagaaggcaaccgtcaacaagcaggactgctggcttgtactcatgcggttttagttactgaaatgggggcgctttcaataggtggtgtaagtgacgccatttctataaccaatgaacttattgacaatattaatgctaataatccagatcaggatatgacaaagccttcttatattgtcattcccaacaaatttaactctcgtagaagccgccataaagactatctagcacagcttaaacagctagacgtgaatttaacaccgtgcatcaacgaccgtgaaactttcggcatatcgacagataccgcgatccctgtctggaaatttgatgatggtaatgctcgtctagcagctaaagaagttaagaatgtcttaaactatattttcttagaggtggcaaaatga

SEQ ID NO: 5682 - DNA, 723 bp, Xenorhabdus bovienii
  Coding DNA location: Contig name=SeqID_16910; Position on contig =3138..3860bp; Strand=+
atgaccaagaaaccttttactttaaatattccggcgcttgaatcaatttcgcgttcagcttcagccaatcaaaagaatatagctggtcaagtgttctatgttgatccagatgagtgctatgttgtagtaaacccgcgtacaaaatataatgaagcgctgattgaatcgtatgtccaagatttcttagatgagcgtcagggccagcgtgagccttgcacggtgtatcccaaggatgataaaggctatcgcatccatcatggcgctacgcgcacgttagcgggtaagaaggctaaggaaattaagtctgattggaagttaaaaataataatcgatcctagtttgcaaacacgcagcgatttcgaaaattattgggaacaaggcactaataatgtcgcccgagataatatgaacttactcgatgttgctaactggataatcaaaagcaaaacattagcaaaagctgaaggtaagactcttactcaagaatctatagcgaagagtattggtcaaacaggggcttgggtatcgaaagtgcaagctcttgctgagttaccggactacctaattgaagtgtaccaaaatggtgaaacagttgatccttggacgcttaactctttattaaaaatccataaagctaatgaaagcttgtgccgtgcttttatcgaaagtggagaagtggggccgcagcagcgcacagaaagtgttgaaagcaatgtctcttga

SEQ ID NO: 5683 - DNA, 756 bp, Xenorhabdus bovienii
  Coding DNA location: Contig name=SeqID_16910; Position on contig =3775..4530bp; Strand=+
atgaaagcttgtgccgtgcttttatcgaaagtggagaagtggggccgcagcagcgcacagaaagtgttgaaagcaatgtctcttgatgtgctgaaagcaccaactgacagcagcaaagacgcggggctacaacctgttactagtcaaagctcaacaaatgaaattacttcaaaagaaagtgttatgactagaaaccaagatgatgaagtgatttttgatcttgtgcatgcacaaaaaattgaagttatgagtggagtaacgggcgacgctttcatatatgtccagccaatagataatctatggatctctacagctgagactacttttgaacatgagtttaatgccacaccttctatttcttctaacttgaagtttgcgagtaaagaggccgcagaatttgcagccttagtttcgttaaaatctgtggctgagaatattctagtgcaacgtcgctctctgctagaagaagaaagcagagatgcggaaatgttgttatcttcgatagatataaaattaaactccaatggcacagaaaataatgcgctaacaggtagcagcaaagataagaagaataaaggggctaagaaaattgagttacaagtagctggtcgctggaatggtatcgactgtgtgattatgatgaaaaaagcggaacagccaaaccatgtagtgatcaagctattatctgatagctcgattaaagagatagcagcggaagagttcaccttaactggctactttgaatacagtcattaa

SEQ ID NO: 5684 - DNA, 744 bp, Xenorhabdus bovienii
  Coding DNA location: Contig name=SeqID_16910; Position on contig =4533..5276bp; Strand=+
atgacactatccgctaagcaagaagatcgggggagggggaacccgatctctttaccagaactgcatgcagctacatattatgcaacactgacaaataaagaccgtggaataccaatttctttattcgtgcaaacatgtgcaatgaatcaagacctatcaaaaaaggaagctggaatacgtctcggtaaactggccttcgagttaggatacaggcaattggataaaccggtttactcgaatacgttgtttagctggatgagaaataaaaccactccactgtgggctgcgaaaacagcttggaactatttagaaagccaaaaagtacaacctatgaatgctcttgattggtgttcttgggcgagaacgttcactgattcaggtcgagatatgaatcaagtaccacagttttatgatgtaaatgaagcgagtaaatggcttattgcggccaataaatatcagcaatttagggataaagtcagagaagtaaatcaagagtcatcaaaagagatttttggtaagtattcaaatccagaactggccctaagaacgtattgttttttagctgtctatgatgaccagaacggctttagcagcgtcaatatcgccatatcgattagtgcaaaaagtgcggtttctttgattaccgatgttagcgcggtgttagatgagttatttaaagatgacttgctaatttgttctgaaggggaatataaaattaagaagtctacgaattattttcaataa

SEQ ID NO: 5685 - DNA, 285 bp, Xenorhabdus bovienii
  Coding DNA location: Contig name=SeqID_16910; Position on contig =5257..5541bp; Strand=-
atgcgaactaagtcgcaagttgaaaaaaagactcaaattgagaaattaaaatatatccctatgcctattatgtgccacattgacgatagaatttttgtagctgaaaaattgagtctgcttcacgaacgttatagagaacgtatcgccggtttatatactaaaatattcttgataaatttacatgaccctaaaatatcagacttaaaaaggctaggtcatgccaggcaaaaagctaacgaatggatcttagagtttatcaatggaattattgaaaataattcgtag

SEQ ID NO: 5686 - DNA, 342 bp, Xenorhabdus bovienii
  Coding DNA location: Contig name=SeqID_16910; Position on contig =5852..6193bp; Strand=+
atgatggaatacgttcaaaccaagattggggctatgaaaatagagcaatgcttaacaaatttaggtgatgaaaatcatttaaatttaagcgagttaactcatttatctgacgctgctaaggatatctgcaagagccatagtatttgcctggatatctacgttactaggcatcgatattgcgatttttcggagactgaaattgagacagttaaccgatcaaaactgtcactaaaggagaaatcgggtaattatgtgtcaacttataaatataggcacttcaacttaattataaccacagatttaactaaaaatacaactgaaatagatgtctgtgtttcatga

SEQ ID NO: 5687 - DNA, 297 bp, Xenorhabdus bovienii
  Coding DNA location: Contig name=SeqID_16910; Position on contig =6269..6565bp; Strand=-
gtgcaggtattcctaacctgggctaaagaacattcaccatcgagtgattttgtaataaataataactatatatctattgttgacactgaattatcagtagaatactttgggttttctgttgaaaatttttgcacattgttaatcatatttaaaaataagaaatcatccttagatagtaatcataaactattgtttgaaactcttttaaaaaaatctaactatacaatttataatggtgaaattaacttagatgtagacgaaactcatgcatatagaccaataaatcagttaaaataa

SEQ ID NO: 5688 - DNA, 120 bp, Xenorhabdus bovienii
  Coding DNA location: Contig name=SeqID_16910; Position on contig =6987..7106bp; Strand=-
atgacgcacaagaagttcttagatggctggggtattgaaattttgtgtgagcttaaggcacttttaagcttagcagccaatgccgatgtcgttttccacatgagccgagccagccagtaa

SEQ ID NO: 5689 - DNA, 180 bp, Xenorhabdus bovienii
  Coding DNA location: Contig name=SeqID_16910; Position on contig =7069..7248bp; Strand=-
atgaataccgaatttacagacccttactacgaatctgctgaaggtgaatccatttcaaagaaacaagcattattagaactcaaaaagcatggtattgaagatccatctgagttttttactgagcttaaagaaaaagaaaactatgacgcacaagaagttcttagatggctggggtattga

SEQ ID NO: 5690 - DNA, 243 bp, Xenorhabdus bovienii
  Coding DNA location: Contig name=SeqID_16910; Position on contig =7782..8024bp; Strand=-
atgtggttgttcgtcgagggtaactactcgactcttcatcaaccagccgttgcgatagttgggagtagaaaagctacagaagatggactttggttaacgaaatacattgtttcagctatagctaatcaaggtcttgtttcggtaagtgggcttgctaacggaattgaccaaaaagcacatgttgaatctattcgattcaatgtgccaacaattgctgtgctaggtgtaagggctcgcgtttga

SEQ ID NO: 5691 - DNA, 291 bp, Xenorhabdus bovienii
  Coding DNA location: Contig name=SeqID_16910; Position on contig =8656..8946bp; Strand=-
ttggcaaaaagctggatcttcgcagggatgccggcatgttacttgaaactattccctgttcgtggcagcattgaagatcgcattcccaccgatccgaccatgtatcgtttctacgaaatgctgcagatttacggcaccacgttgaaagtgctggtacatgaaaagtttggcgacggcatcatcagtgccatcaatttcaaactggacgtgaaaaaggttgccgatccggaaggtggtgagcgtgcagtaatcacactcgacggcaaatatctgccgaccaaaccattttaa

SEQ ID NO: 5692 - DNA, 255 bp, Xenorhabdus bovienii
  Coding DNA location: Contig name=SeqID_16910; Position on contig =8873..9127bp; Strand=-
atgattcagtcacaagttaaccgcgaagtccgcctggcgctcgccgacaaaatctggtcagtcaaaacgaagaaagatctctcgttcgcccaaattgccgacggcactggtttatcggaagccttcgtcaccgccgcactcctaagacaacatgcactttcggcgaagggggttaaaattgttggcaaaaagctggatcttcgcagggatgccggcatgttacttgaaactattccctgttcgtggcagcattga

SEQ ID NO: 5693 - DNA, 189 bp, Xenorhabdus bovienii
  Coding DNA location: Contig name=SeqID_16910; Position on contig =9239..9427bp; Strand=-
atgaaaaaagttattgacggctttctgaaatttcagagtgatactttccctgagcgcgttgagctgttcagaagcttggctacacagcaaagcccgcgaacgttgtttatctccggttccgaacctggcgaccaacgtgaacccagcgatctgtttgtgatttgcaatgctgatgactaccgtccgtaa

SEQ ID NO: 5694 - DNA, 888 bp, Xenorhabdus bovienii
  Coding DNA location: Contig name=SeqID_16910; Position on contig =9539..10426bp; Strand=+
atgaatttccgttatatcaggtattttctcgccgtcgcagaacatcatggttttacccgagcggcaacagcgctgcatgtatcgcaaccagccctgtcacagcaggtcaggcttctggaagaaagcctcggcgtacagctgtttgaccgcagcggacgcaatacccgtctgactgatgccggagaagtttatttacagtatgtttaccgtgcatttcaggaactggatgaaggtaaacgggccattcatgatgtggaggatctcagcagaggttcgttgcgtgttgctgtcacgcccacctttaccacctattttatcgggcctctggttgccgaattttatacgcgttatcctcatatcacactacaaatccaggaaatgtcccaggagaggatagaagagcggttaattaacgatgatctggatataggcattgcctttgatggcggggaatccccgggaattgcatcaagaatcctgctgactgaaaccctttctcttattgtagcctaccaccatccgcgggcacagcagcgcaaaatcgctctgaatgaactcaacgatgaaaaactcatcctgctgagcgcagggtttgctacccgtgaacagattaatcgctatttttgtgaggcaggtctgcgcccgcaagtgcagatggagttcacctccatcagcgccgttttagacgtgatccgcaggacatcactttcaaccttgctcccagcggcgattgccatgcagaataatgacttggtagcgatcccgcttgctgactggcaactggaaagaacgggggtgttgatgcagcgaaaaggggcatggcaaacaacggcagcgcgggtgtttattgaagttgcacaggcgttgggtcatgtattaaatagttag

SEQ ID NO: 5695 - DNA, 1407 bp, Xenorhabdus bovienii; identical to SEQ ID NO: 5647
  Coding DNA location: Contig name=SeqID_16910; Position on contig =10500..11906bp; Strand=-

SEQ ID NO: 5696 - DNA, 582 bp, Xenorhabdus bovienii; identical to SEQ ID NO: 5648
  Coding DNA location: Contig name=SeqID_16910; Position on contig =11931..12512bp; Strand=-

SEQ ID NO: 5697 - DNA, 582 bp, Xenorhabdus bovienii; identical to SEQ ID NO: 5649
  Coding DNA location: Contig name=SeqID_16910; Position on contig =12631..13212bp; Strand=-

SEQ ID NO: 5698 - DNA, 402 bp, Xenorhabdus bovienii
  Coding DNA location: Contig name=SeqID_16910; Position on contig =13607..14008bp; Strand=-
ttgccactgacatcagaaacaaaacacttaggttcttggccggatattcaggccctccttgtaacggaaacgatacggcaagaacaatattctgacacagtcacctctgattttcgttattatttaatcagttgtcaggatgttcccgcctttcagttaggtgccatacgaaaacattgggctatcgaaaatagtttacactgggtactggatgtcacttttcgagaagatgattcacggatgagagagcggatcgccacaagaatatttgctcaattacgtaaaatggcgctcaatatcgttaaacgagatataaacagtaaactgagtttgagtgcccgaaggaaatcagccgggtgggataagtgttatatggaagcgctgttatttaatcaattttag

SEQ ID NO: 5699 - DNA, 687 bp, Xenorhabdus bovienii
  Coding DNA location: Contig name=SeqID_16910; Position on contig =14547..15233bp; Strand=+
atgcctttttttcaaccatttaaaacgagtcttgagccagaggatcttgtatttggtttaaatacagaaagaaacaagtatgccatagaatatcgagccttcggccatttacgcgataagaatcatttctcaataattgatagatattcaattactccagaagaaattacaacgcggaaatttcttagagcacaaatcccacctaatcaagaaagctttacacaatcgatagaaaatcatcgtaagtacaaggtattacagtctgctgcgaaagataatggaaagacgaattttgatgttgattgggataaacattgtctttcctatactaaaaaagtgacaaaaagaaaatgcaaagctggattatcttggtactctctttcactaaaccgttcatgtattcattttattttagatggaatagatatggagagtgttatttacaaacattatgagcaaaagataaagaaagggacttcatacacaggcagtgaactgagatggatatatcgaaataggaaagatccaaaagttaaatcttgcatccaattttggcgaaatggtcagccagttctcccaccttgggaagaaggaaaagatgctcatttatggcaatactaccagccgaaatttgaaaactctgaaattgaggttggggaatttgctgaaaccgttttgaacctttag

SEQ ID NO: 5700 - DNA, 294 bp, Xenorhabdus bovienii
  Coding DNA location: Contig name=SeqID_16910; Position on contig =15364..15657bp; Strand=-
atgagaaacaactcaaccccttttacatccgcaatatgctggatctcattttggttaggaacagttcttgttggcgcttcatggctttatgcaaaactacaaggaaaagaatttctagtgggattatcagaaggtttaatgaatataacctcacctgatagcacagttgcgataatgctttctataggagctatgatgatcgccattggaatgctatacgttcccttattctatactactgtctttgtacaagcattcatgaaagttctgacgagaaaaccaatcagaatctaa

SEQ ID NO: 5701 - DNA, 354 bp, Xenorhabdus bovienii
  Coding DNA location: Contig name=SeqID_16910; Position on contig =15681..16034bp; Strand=-
atgcataaatcaggacatttctacttagccttgacatgcaaatctggcaactacagtcttcctgaatcgctaaaacttcaggtattggcgttgctatatgaaaattacagtgactttggccccacactggctgctgaaaaacttagggaacgtcacgacatcatcgtctcggtggaaatgctcagaaaatggatgactgccgatggtcactggggttacttattttggtcaaatcaaagttattatccacttatcatttggtatattggcaaaatgtgtatcaacatgaaaaaatctaaactttcgcaaaaagaaatgcagttcagtactaatgtttcttttcatcatctgtaa

SEQ ID NO: 5702 - DNA, 348 bp, Xenorhabdus bovienii
  Coding DNA location: Contig name=SeqID_16910; Position on contig =16103..16450bp; Strand=+
atgaaagctatatctatagtcgcaccagcaggtgaaaatattgcgacaggaaaaaaaacgttagaaataagaaaatgggcaccaaactttgattgtaatgaggacttgttgattgttgagaaccaacattatcttttaaaagagggtgatgaggaaatggggaaagccgtcgcaatcgtcaaagttaaaaatgttaggccattttttgaaagtgatattgaagcagcttgcgcatcgtattacgaagcgggttggttagcttgggagctaacggatgtcagagctatcgaagaaccaataaaaatgatagcaaaacgtaaaatttatgaggttgagctgagagcctaa

SEQ ID NO: 5703 - DNA, 105 bp, Xenorhabdus bovienii
  Coding DNA location: Contig name=SeqID_16910; Position on contig =16542..16646bp; Strand=+
atggatttgtttattgaaaaggttacacctaacacagttggtttttgggagttgatgaaagagtattcgtttttaatacaatatgttacgcaggctgaaacataa

SEQ ID NO: 5704 - DNA, 1107 bp, Xenorhabdus bovienii
  Coding DNA location: Contig name=SeqID_16910; Position on contig =16898..18004bp; Strand=-
atgaaagaattagtggaggtcttttctgattttccagatccacgttgtcagggaaaggttaaacaccgttttattgatatcttagtgatcgcggtatgcgctgtcattgccggggctaacgcctggaccgatattgaacagtatggccagctaaaaaaggattggctgggttcatttcttctgctcaaaggcggtattccgtcacatgatactttccggcgctgttttagtttattaaatcccggcctctttgaacgtcatttttatcagtggatttctcgtgacgtctcttcagaaaagcgagcgatcattgcgattgagggtaaaagtttacgccattcgtttgataagaaaattgaacaaagcccactacatgtggtgagtgcattctcggttgagaaaggactcagcttatgtcagtgtgcagtagacggaaaatcaaacgaaattaaggccatccccgcattattatcgatgctttcattgaaaggacatctcgtgacgattgatgcgatgggctgccaacgcacgattgctcagcaattacgtgagagtgaagccgattatattttgtcgcttaaaggcaatcagggaaaaactttttcggaagctgttaattattttcaacagcaacagataacccaaaaaccttaccttaaacctgactatgatgaattcgatgatagtcatggacgtggatgggttctgccgctgacatcagaaacaaaatacctaagttcttggccaaatattcaggcccttctggtaacggaaacgatacggcaagaacactactctgacacggtgacctctgattttcgttattatttaagtagttgccatgattctcccacctttcaactaggtgccataagaaaacattgggctatagagaatagtttacattgggtactggatgtcacttttcgagaagatgactcacggatgagagagcggatcgccacaagagtatttgcccaattacgtaaaatggcactcaatattgttaaacgagataccaacagtaaactgagtttaagtgcccgaaggaaatcggccgggtgggataatggctatatggaagcgctgttatttaatcaattttag

SEQ ID NO: 5705 - DNA, 954 bp, Xenorhabdus bovienii
  Coding DNA location: Contig name=SeqID_16910; Position on contig =18030..18983bp; Strand=-
atgacttctgaaattattttatcagaagtcatatgcacactaggctttaagccctatcaattggtgcagtcgccttctgaaaatgacaaacagaatacagaaagccagcgtcgtgaaatcgaggcggctggatttgctatcagacctcagcgactgattgaagaatatgtaagcggatctgttgcggcgggtgagcgaccgggattcacacggctgcttgaccgtatggaaaacggagacgtgctgattgtcacgaaacttgaccgcttaggacgtaacgccatggatatcaggaaaacggttgagttactcgtagactcagaaatccgcgttcactgcctggcattaggaggagttgacctgacaagtcctgctggaaaaatgacgatgcaagttatctctgcagtagccgagtttgagcgtgatctgttactcgagcgtactcatgctggtattgcgcgggctaaagcatccggcgcgtcactgcaacggccagaacttttacgattgcttgatgatgctgcaccgggtgacattattcttattgagcaggttgaccgcctttcacgtctggatgaagcgggctggcagaaacttaaacaacttattcaggaaaaacacctcgtgattgtcagtcttgatctgccgacgagccatatggcgcttgcagaaaatgcgggtgatgagttcactctggccatgcttaaagcgattaacggaatgatgcttgatatgctggcagccattgcacgtaaagactatcaggatcgtcggcggcgtcaggaagagggaatattgaaagccaaagccgctggtaaattccggggacgccaagcagataaccagctgcatgagaaaatcattgaacttcgagttaaaaacaggcagagcatccgagataccgcgagattgtgtggtgtccaggggttacgcatgaaaatatttagtggataa

SEQ ID NO: 5706 - DNA, 789 bp, Xenorhabdus bovienii
  Coding DNA location: Contig name=SeqID_16910; Position on contig =19157..19945bp; Strand=-
atggatcttggaatagccgatcgttgggctgttatatgtgcagccagcgaaggtttggggttttcttgtgctgctgcactagttgcagaaggcgtaaatgttgttattaacgctcgaaggcctgaaccattgaaggcggctgcgcggcggctgcaaaatataaaccctgctgtatcgataaaatgggtacctggtgatataacagaatcacaaactcaggatactgtgttaagtgcatcacctatggtagatatccttgttacaaatgcggctggaccacctacaggtaattattccgattggaaccgtgacatatggtaccaagcaattaataccaatatgctcactcccatcagcctgattcagattgttattgatgagatggttaaccgccgttttggacgagttatcaatattacttccggtacagttaaagccccccaaagtgagttgggattatcaaatggagcacgaggagggctaactggttttatctgtggcttggcaaaaactgactctctagcgagtaataatgtcaccataaacaatttattacctggtgctttcgatactaatcgcctgaagcaaacatttgcacaaaaagcgtcgagatgcggagatttaccggagcgcatagcaatgcagcgccgccaaaaaattcccgctggacggtttggaacccccgaagaatttggagcatattgtgcttttttgtgtagtgtatatgcaggttatataacggggcaaaacatccttattgatggcggtgcctatcctggtgttttttaa

SEQ ID NO: 5707 - DNA, 1173 bp, Xenorhabdus bovienii
  Coding DNA location: Contig name=SeqID_16910; Position on contig =20014..21186bp; Strand=-
atgaagtccaaactaatcatcatcaattcgtgcgtaatactggtattaggattattttctatagatctctataatccagcactgcctataataaaatcagcactggcgattactaacaatcaggcgcaaagtcttgttgtttattatctttctggttttgctgtatctcagcttttttatggcccactttccgacaaatacgggcgtatccctataattgtattttccttattattttccgccgccggtaactacctgacttctacagctgaatcatttcacacactgtcactgttccggcttctgaccggtattggtgcaggcgggtgtccagttattagcagagctatactcagtgatactttccgtgataaaaccgaattatccaaatcactgactattttttcgatggcatcacaggtttcacctgcttttgctcctgttattggtggatatatcacagagtatctgccgtggaggtttaattttatagccctcgccataatgatgctggtaggggtatcttttgtaaaaatgacgctgccagaaacatcgccgatgaaaccaacagacagtggcaggataacaggttttcgaattctgttatctgatgttagttttgttgtatacagtgttgtatctgccgttttgtttgccattaccattggttattttactgccagtcctttcgtctttcagactcagtttgatttatcctcgtcacagaatggatatctgtttatgatttattctgctggaattgtaataggctcattactcacaaagaaatggttgtcacactctagccctgaaaaaattcttagggtttctcttccgttattacttttcttcactgcaattgcgctcatttctgttcacttcatacagatattatcaattgcatttatcgttatttatagtttttcagtcggaatggggtgtgggttttcttccccattactactcgggataagtttacatgggcatcctgaattatccggaacaggcagtgccttacaaggagcactaaaaatggccggtgccgccattgtattatattttttctcccgtgggcatacagcaactgcggcagggttaatgtggggacttttcatccttactctaatttgtgttgttttaatcgcttttactcagtacaaagcaccaaaatag

SEQ ID NO: 5708 - DNA, 1392 bp, Xenorhabdus bovienii
  Coding DNA location: Contig name=SeqID_16910; Position on contig =21200..22591bp; Strand=-
atggaaatgcacaatgtcttacaggacagtacccaatccggaattaatcagcgtgaaatttttgctccggttactcgtgcagcatttgacgttaaggcgggtcaaccactcagtcgttttctgagggaatcactccgtgcaatgaaaggcactgaaaaaggccccgtttatctggggataagtcaggaagttttaaatgaacatgatgaaaaccgtcccgacatcagtgcaagtattgctgactcttggaagaatcgcccgatagatatcaagaaaataaattcacctgaatttgcaactttcattgctaaggcccgtaattgcatcatccttgcggggctacggggcaaaatgcctgaaacagctgatacgttgttagcatttgcagaaaagtatcatttcccagtggcaacgactctaagtggtaaagggctttttcctgaatcccatcctctgtcactcggtatttacggttattcaagtaaccccagagccattgaagcatttaagaatccgaagttggaagggattattttactgggaatggacaccacccaatggagcaccatgctatggtctctggagttgcaacttcctgggggaacgattcaggtcgatactaacccggaatatctgggtaaataccttgagatcacttgtgggatcacggcaaacagtagcgcatttctggaaactcttaatgaatactaccataatcccctcatcgaaggacgcccggaacgggagaaatgggtacaacacctcagtacagttcccaagtatttcccaatcgattttagtgcaacaggtaatgaaaccagacaccccgcgtcctatatcaaaatctttcaggaacattttcctgaaaatggaatagtcagtgttgattctggtgcacatcgttcattcttcggtcattattggatcgctcacaggcctgagacgtatatatcagcaaccacacttggccctatgggatggagcatccctgctggcataggagcgagtttcgccgcccctgacagaaaatgtatggtcataaccggtgacggttgtatgctaatgcaaggaatggagttagccactgcatcaaaataccagcgcaatatactttttgttgtctttaataacacatcttatgcagcaagctactttaataataaagataacagaacagatctgactcaaatccctgattatgattggtgccaattagctaaaggattgggattaaacagcctgtgtgtgaattctcctgagcaattacaaaagcatattgccgaaattatgcaacagaacagcccgtttttgatcgagatcaaatgcgataagcaacatgccacaccaaacaaggaatacaacaagcgcataaaaactcttccactcttatga

SEQ ID NO: 5709 - DNA, 282 bp, Xenorhabdus bovienii
  Coding DNA location: Contig name=SeqID_16910; Position on contig =22660..22941bp; Strand=-
atggcgcattcagataatggatataaagaaaatggggcatcttatatactaaagcagctgcgccacttgaatgcatctcatatcttcatggtacccggcaagctcattaattcattcatgaaatgctatccaaaagatgatgactcagtgttggacatctttcctataccgataataacagcctgcgagacgggtgctgcttatatggctgaggggtccgtgtctctgacacttttggtgtatgtctcgttattggagggccgggtgttacaaataccctga

SEQ ID NO: 5710 - DNA, 780 bp, Xenorhabdus bovienii
  Coding DNA location: Contig name=SeqID_16910; Position on contig =22945..23724bp; Strand=-
atgaatattatcaaacagatgagtgaacaaggttacgttgtaatttcagaagtaataaataaaaaagaaattgacatcattagagaatattataagaaaattttagaaagaaataatttgtcaacactgcttccgacggatgtactaaaatcccccgatgtctttaacactattctaaaagataaagtagtcaccgctatcagggaactttttagtcgagatttctctttgtttcccaattttactatccgagaaagtgtctatattccctggcataatgacgcatattttctccctgatgaagtcatcaatcctgaagttccactacagtttatgcagtgtgctatctatttgcaggacaatgaccctgaactgggaggtgggataactctgatacccttctctcatcgactggatcaacccaccgtgaaaagtatgttaaatacgccacaggcatacgagaaagttatcatgagtaaggctggtgatcttattctatgggataacagaataactcacagaagcacttacccggataaagcacctgataacactaaactggctttacaatggacagtatctgcctcagaacggcataacgagtcatatctacagtatcttcaagatcgtgcgcaatgttctatgcatgtttcagattacctgcttaaaagtccaaaaccttattttgcagatatgcccaacgtccggtatccagattcatttcatcaggattcattaaacataatgaaacaatacaatatacaattcatagggttataa

SEQ ID NO: 5711 - DNA, 1179 bp, Xenorhabdus bovienii
  Coding DNA location: Contig name=SeqID_16910; Position on contig =23785..24963bp; Strand=-
atgaaggaagcctgtcgcagtattggtgcccgaattattgaggagcctgagcggttaattatttatggtatcggcggaaaaattaatccgaagaaaaaagtcattgatgctttgggttcggggttagtcttccgtgtaatgaccgctctaacctgccacagtacagctccagcggtgatctctggtgacgtcgttctcagaacccgtgccatggaacctttactgaatgctcttattcagctgggaggaaacatttccagtgtccatatgaatggaaaagcccctttcatcaattggggaggatattctggcggtatatgtgaaatcgagggaaacatcagttcccaatttatcacagcaattctgtttgcagccccccttgcgaggaaaagtaccacgattaaaatcatagaaaaaaccctatcgctatcatacattcggcaaacattagaaactctgacaatagctggcattaaatttcagcaaaatgagaatctttcccaaattactgtatttccgggtcaatataattctgctgaatatacaataacgggcgattacacctcatgttcctatcttgttgctgcggcaactctttttccatgcgatttaacactcaagaatatcaatagtaagagtttacaaggcgaacaagcgattctaacgtttgttgatgaaatgggaatggatatcattcgcaattataagcgaaacgaaattcgcctgataaataaaaaaaaacaactgactggaaattatgaatttaatgtcagcgactgccctaatattgtacctactcttgctgcgttaggtatttatgtcgcaggctgtttcagagttaccggaggctctattacccgctttcataaatcgcctagaatagaggcaatggtaaatgaattactaaaattgggtgtcaatattcgtcctctatttataaatggtgtttatgatggtttagaaatttatggagcttcatcctacgcggggaattgcatactttccagctggggggatcatcgtatctttatgtctttatttgtagcatcattacgttgccaacaagctaattatattgatggttatgaagatgttcattgttcatttcctgatttctttaaagaatttgaacaattggggatcacatttcaagaggttattcctcaacatggaaaataa

SEQ ID NO: 5712 - DNA, 549 bp, Xenorhabdus bovienii
  Coding DNA location: Contig name=SeqID_16910; Position on contig =25130..25678bp; Strand=+
atgaaaattacgctgacagatgcccaaaaagaagccctcgaattgatgcacgatacgactcgtgatgggcgcgtacgtgaccgcatcaaggccgtgcttttggcctcagaaggttggactgctcagatgattgcccaggctttgcgtattcatgaaagtacggtgagtcggcatctgaaggatgacttctctgaggaaaaactcgcccctgaaaatggcggctctgaaagccgtttgtctgccgaacaaacgacagaattagtggagtatctgacggcaaatttgatgcacactaccgcgcaaattgttgcttatgtctgggcgcactggcaggtgacttacactgtggccgggatgacaaaatggctccaccgccaagggttcagctacaagaagccgaggggaattccccataaatccgatgcggataaacagcaacactttattgagacctacaacgcgttgaaagctgaatgtggtcaaaatgcgcctattttgtttattgatgccatgcatcctacccagtccacaaaattaagttacggctga

SEQ ID NO: 5713 - DNA, 456 bp, Xenorhabdus bovienii
  Coding DNA location: Contig name=SeqID_16910; Position on contig =25706..26161bp; Strand=+
gtggtcgaaaccacaggcagccggacccgccttaacatcatgggcgccctcaatttgattgaagagaccattattcgtgaatatccgacgattaacgcgaaaaatgttgttctgtttttcggcgcaatccgggaaacctatccgctttcacaaaaaattcatctcattctggatggcgccggttaccaccgctctgaaatagttcaattttttgccgaggtcctaaatatcgagttgcactatctgcccccttacagccctaacctcaacccgattgagcgattatggaagtatgcgaatgagcaggtgcgaaacaatatctattttccggatgcaaaaacgttccgtgaaacgctgcatcacttttttcatgtcacattgccagaaaaagtgaaagaactcaccacccggttgacagataatttccagactttaagtcctgcatcttcaagttaa

SEQ ID NO: 5714 - DNA, 564 bp, Xenorhabdus bovienii
  Coding DNA location: Contig name=SeqID_16910; Position on contig =26408..26971bp; Strand=-
atgttcagatcaaaatcttttaatattaacaaccgttctgtaggatttggtcctttaactcggtctaaatcctgtacggatatgtacacaacattggttaatatgaaaacatttatcacaatcaaggaggtcagcccagaagaagcattctacgcaacggaaaagatgctaacagaaactatggctgaggattggttttattttgattttcttaagcttgataaggaacaggaaaggtggaaaatgaggtataatcaggcggttagtatacttaattgtctctcgactaatgcaaagattcaatctatgagagataaaactgacggttcaaaaaagttttttgctgttgcttatttcagaggtattcctgtcggtgccttacaattattagtgcaagataatcatgaaaatgagttacctgaagtttcttttttggccactcattgcggtattcgaggttgtggtgttttactcattgaatatgcagtaaataaatcacaacaattagggatggaaggaaagttaaaactttctcctatgatgaggcgaggcaagcatatataa

SEQ ID NO: 5715 - DNA, 477 bp, Xenorhabdus bovienii
  Coding DNA location: Contig name=SeqID_16910; Position on contig =27079..27555bp; Strand=-
atgaataatgagtggttgtgccctaattcttctggtcagcttgatgaggagcaaataaaatggaattctagatataatcaggcattgggaatatttaaatttttctatattgatattggtattcgccttaaattagaagaaattgataaaagagtgttgttttttgttgcttatttcagaggtgttcctgtcggagttttacaattattaattactgatgggttacctaaagtcgtttttttggcaactcattgtggcatccgaggttgtggtgctttactcattgaatatgcagtaaataaatcacaacaattaggaatgggaggaaagttacaactttctccatatgagggagcgagagcgacatatatggcaatgggatttactggggctggggaacacctggaattatatcctgctgatagaaatgataaatggaaatggaatgaggcaacgggtcgttatagattctgttaa

SEQ ID NO: 5716 - DNA, 1032 bp, Xenorhabdus bovienii
  Coding DNA location: Contig name=SeqID_16910; Position on contig =27827..28858bp; Strand=+
atgaaaattacgctgacagatgcccaaaaagaagccctcgaattgatgcacgatacgactcgtgatgggcgcgtacgtgaccgcatcaaggccgtgcttttggcctcagaaggttggactgctcagatgattgcccaggctttgcgtattcatgaaagtacggtgagtcggcatctgaaggatgacttctctgaggaaaaactcgcccctgaaaatggcggctctgaaagccgtttgtctgccgaacaaacgacagaattagtggagtatctgacggcaaatttgatgcacactaccgcgcaaattgttgcttatgtctgggcgcactggcaggtgacttacactgtggccgggatgacaaaatggctccaccgccaagggttcagctacaagaagccgaggggaattccccataaatccgatgcggataaacagcaacactttattgagacctacaacgcgttgaaagctgaatgtggtcaaaatgcgcctattttgtttattgatgccatgcatcctacccagtccacaaaattaagttacggctggatgaggcgcggaagggagcatgtcaacgtggtcgaaaccacaggcagccggacccgccttaacatcatgggcgccctcaatttgattgaagagaccattattcgtgaatatccgacgattaacgcgaaaaatgttgttctgtttttcggcgcaatccgagaaacctatccgctttcacaaaaaattcatctcattctggatggcgccggttaccaccgctctgaaatagttcaattttttgccgaggtcctaaatatcgagttgcactatctgccaccttacagccctaacctcaacccgattgagcgattatggaagtatgcgaatgagcaggtgcgaaacaatatctattttccggatgcaaaaacattccgtgaaacgctgcatcacttttttcatgtcacattgccagaaaaagtgaaagaactcaccacccggttgacagataatttccagactttaagtcctgcatcttcaagttaa

SEQ ID NO: 5717 - DNA, 231 bp, Xenorhabdus bovienii
  Coding DNA location: Contig name=SeqID_16910; Position on contig =28803..29033bp; Strand=-
atgaaaattatatcaggaaagaataatcatggatattcttatattatcaatgaaatatgggatgactgcattcgtgaaaaaataccacttccgcaatataattctatctctgcttcatcgatgtacgaagccagaataaaattacctgataatgctattaaaactatatacgcaattaacttgaagatgcaggacttaaagtctggaaattatctgtcaaccgggtggtga

SEQ ID NO: 5718 - DNA, 459 bp, Xenorhabdus bovienii
  Coding DNA location: Contig name=SeqID_16910; Position on contig =29272..29730bp; Strand=-
atggcacgctacgacattcctgatgacgcatggatagtgatagaaccttgtttacctccggtccattcagagcgggcaggacgtccacatgttgaacaccgccgggtgatgaatgggatgttctgggtcttgtgctctggggcaccgtggcgtgatttacctgaacgctatggtccttggaaaacggtctataaccgatttaaccgcgggtcaaaatcgggcattatcaacaagatatttaaccggttactgtccattctggatgaaaaaggcttgattgactgggctgaaatttgcctggatggcagcaatattcgcgcgagtaaagatgccgcaggcgcgaaaaaaaacatcccgatatcgctgacgatcatgcgctgggtcgctcacgcggtggttatggcaccaaaatccacctggcaaccgacagacggggttttcccctcaacctgcttttga

SEQ ID NO: 5719 - DNA, 570 bp, Xenorhabdus bovienii
  Coding DNA location: Contig name=SeqID_16910; Position on contig =29797..30366bp; Strand=-
atgcctagtgatgtgttgctgcagaaaacggttgaggtgagttttcatcaggagaagcgatttcattattttttagatacaccaaaacataaaccgggaggtcggctcaatattataggacacgcatctccagtgggcagtccaatattatttgcgggagcatgtgcgtataattttggaatgaatttgaatgttttttgtcaaacaatcaatgcattattaactgatataaaaaatagagggcaaaatatccaatgtgtcagaataatagcttgccactctggagcaaatgggcttgctcaagcattagctaatcatatcaatatgccagttaaaggctcgttaggaggcacacgagtttatccaacgatgcaatttcgttcaatgcccaatataaaccgtcattttattgataagacagatagaggtggtcactattattcagaggaggaggagagacagttgaggcatgatcccgcctatggtttgtataagtggtactatcctcaatcttcaaatccagatagtgaatttgatgagtttgctagtcaacgggttctgtcgcattag

SEQ ID NO: 5720 - DNA, 696 bp, Xenorhabdus bovienii
  Coding DNA location: Contig name=SeqID_16910; Position on contig =30577..31272bp; Strand=-
atgtccctgatccgaaaagcgttcaaacgtctgcattatcctgtcgatatcattcctcaatgtgttcgtgggtacctcgcttatgccttgagtctgcgccatctcgaagagatgatggcagagcgcggcattggggtcgaccctgccacgatacatcgctgggtgttccgtttggtgcccctgctcggcaaggctttccgacctcgcaaaaagcccgttggctcccgatggcgaatggatgaaacggacattaaagtcaaaggccagtggaaatacctttaccgggcggtcaataccgacggtcagacgattgacttcctgctgaccgctcgccgcgatgcaacggcagcccggcgttttttccgtaaagcgatacgccagcacggcagacccaccgtcgtgactatcgatgaaagtggggccaataccgccgcgctcaccctcctcaatgcggaaggtgagcctcagcaggggattgaaatccggcaaaataaatacctgaataaccgcattgagcaagaccatcgccatgtcaaacgtcggatacggccaatgttaggttttaaatcgtttcgccgggctcaaacgattttagcggggatagagcgcgtttcgatgcggcgtaaagggcaatacttacaatcagaagataagacattgtcaccggcagagatattttatcgattgactgcataa

SEQ ID NO: 5721 - DNA, 310 bp, Xenorhabdus bovienii
  Coding DNA location: Contig name=SeqID_16911; Position on contig =2..311bp; Strand=-
atgtttaacaaacaagagtcctatacaaaagaagaacttcaaacctctggacaaggtaagttattcggtgaaaatggcccaccactgccttctggcaatatgctgatgatggatcgcatcataaaaatgacagaaaccgggggtgcctacgataaaggctatgtcgaagctgagttagatattaattctgagctgtggttcttccattgccattttgtcaatgatcccgttatgccaggttgcctcggccttgatgctatgtggcagctcgttggcttcttccttggctggatcgggggtgaaggtaaag

SEQ ID NO: 5722 - DNA, 282 bp, Xenorhabdus bovienii
  Coding DNA location: Contig name=SeqID_16911; Position on contig =396..677bp; Strand=-
ttgtgtaactaccgggagctgacaggtaagcaaggcgtgattatcccaacgtccaatgtgcaacacctgtgtctgaatcaagacattattgacgcagtaaaaaatgggcaatttcatatctggacagttgaacatgtctctgaagcagcatcacttctgacgggtattccctattacgatccacaaaaagaacacttgttagccattatatacgaacgcattacacaggctaatagtcaagagcggcctaagcttccttggtttctgcgctggttaggttaa

SEQ ID NO: 5723 - DNA, 1278 bp, Xenorhabdus bovienii
  Coding DNA location: Contig name=SeqID_16912; Position on contig =37..1314bp; Strand=-
atggatgcaattcaatctaggttacacaatgggctaaccctcttttgtcaggccgatctgcgtcagccttttatgttattaaaggctgatgagagtgatatttatctgtctcatttatctgatactatctcagctttactgccggaaagccgtcccaaaatcggtggttactatcagatagaacaccaaaccattacttggcgttcttctggtgaaggctcctttgcaccaactgagcgggttgcttatcgcgaatggattgaaccggagcaattattcggcaacatctacacccatcaaggtgcgcttcagctacaacctggtcttatccatcaggtcaatggcggtgtcctgattttgcctttacgtaccctactttctcagccattaatgtgggttcgtctcaagcagatgattatccagcgccgttttgattggctatcacacaatgagaatcgctcactaccccttcctgtaccttcaatgccgttgaatttgcggctcgttctggtaggagatcgcctgagtcttgaggaattacacgctcttgagccagaattggccaacaatgcactgtatggcgaatttgagttggatatgccatttcatgaagaagatgatctagcgctatggtgccgctatgttaacagaataattcagcagcaaacattgcctccattaagtactgatgcatggcctgaactgctcaagcaagccgttcgttatactgaagaccaactcagcttacctttggatattcagtggttacaacaaaagctggaaacagccgccgcttaccaacaggaaaatcaaatcacatcgcattcgatgcaacaagcggaagacaatcgtctctggcgtcatggctatttggctgaacgtagcatagacgaaattctgaaaggtcagatactgatccgtacacaaggctcagtgattggccaaatcaatgggttatccgtgctcgaatacccagggcatccagatccgatgggcgaaccttcacgcatcagttgtgttgctcatttaggagacggtgaatttattgatgtggaacgtaaagtagagctaggcggcaatattcatgcaaaaggcatgatgatcatgcaggcttacttaatttctgaattaaaactggatcagccacaaccgttctctgcttctattgtgtttgaacaatcttatggcgaagttgatggcgacagcgcctcactggctgaattatgtgcgttaatcagcgccctgtcacaacagcctatgatcagcaaattgccgtaa

SEQ ID NO: 5724 - DNA, 243 bp, Xenorhabdus bovienii
  Coding DNA location: Contig name=SeqID_16914; Position on contig =1..243bp; Strand=+
atgaaacagacgattcgggcgcggcgtaaacgtcattttaatgcggaacatcaacattcgcgaaaaaaatccatcgatttggatttccaagtttggcagcggctttcagctctttcccgacgtcgtggcaatactttatcagaaacgatagtgcaattgctggaagatgcagaatatagagaaaaatatacccatcaaatgtcgagcctaaagcaggatttggaagctatcttggggaaataa

SEQ ID NO: 5725 - DNA, 1152 bp, Xenorhabdus bovienii
  Coding DNA location: Contig name=SeqID_16914; Position on contig =318..1469bp; Strand=-
atgataacgaggcgtaaaatgaaaaagacagctatcgcagtagcagtggcagtggcagctttcgcaactgttgctcaagcagctccaaaggataacacttggtatactggtgctaagctgggttggtctcagtaccatgacgtaaatttttacggcaatggatacgataaccaaatcggtaacggccctactcgcaaaaaccagctgggtgcaggtgcctatgtcggttatcaggcaaacccatatctaggttttgaattgggttatgactggctgggtcgcatggcatataaaggcagcgtcaacaacggtgctttccgtgctcaaggcgttcaactggcggctaaactgagctacccagttatggataatctggatgtctatactcgcctaggtggtatggtatggcgcgcagactcttccgctacttataatgttaacgcattaggtggtgcaggtgataaagatcagcgcagactgaaaaaccacgacacaggtgtttctccgctggctgccattggtgttgaatacgccctgaccaaagatctggcaacccgcctggattaccagtgggtcaacaacatcggcgatgcaaccagtgtcggtgcccgtccagataacggcatgctaagcgttggtgtttcttatcgtttcggtcaagatgacatagctcctgtcgttgtacctgctgctcccgttattccagctccaacgcctgcgccttcaccaactgttgaaaacaagagctttactctgcgctctgacgttctgttcaacttcaacaaatcaacgttgaaaacagaaggtaaacaagagttagacaacctctacacccaactggccaaaattgatccagatcaaggcagagttctggtaattggccacactgatcgcatcggtagccagcagtataacttgccattatcccagaaacgagctcaatccgttgttgattatctggtagctaaaggcatcccagtagccagcatccaagcagaaggccgtggcaaagaaggctctgtcactggctctacatgcgataacatcaaaggtcgcgctaaactcatcgactgtctggctccagaccgccgtgtagttatcaatattcagggtactaaagaaatcgttactcagccgaaagcagcacagtaa

SEQ ID NO: 5726 - DNA, 594 bp, Xenorhabdus bovienii
  Coding DNA location: Contig name=SeqID_16914; Position on contig =1807..2400bp; Strand=-
atgggcatccgatcatcttggggatatcttattgagaagaaaacggcagctaacggaacggaagaagaacaaaaaacagacagctgtccggttctcaaaatagacaaaacagcaagtatcacaacggccagtcggctatcttttgtcgaatcatcccaatatgattcacaaatggtaaaaggaatggtcagtgaactgatctactgtgagcaccagccagctatcaatcaccttctgcttcctttactccgtcaatccgggcatgaaaatcgctggttactctgggttacacccaataaaagattgagtcgtcagtggctgatgagttctggtttacctttggataaggttgttcagttaaatcaaatccgtcctgttgcatcaattgatgccatggaaaaggctctagcaagtggcaactacagtgtagtactgggttggctaccagagctatctgagtatgacgtacagaagctacaactggccgctcagaaaggtacagcattgggatttattatgcgcccacaaaactcggctcatcatttcaaaccgccagtaaacagattacaaatttcttctgtttactatcattga

SEQ ID NO: 5727 - DNA, 201 bp, Xenorhabdus bovienii
  Coding DNA location: Contig name=SeqID_16914; Position on contig =2303..2503bp; Strand=+
ttgagaaccggacagctgtctgttttttgttcttcttccgttccgttagctgccgttttcttctcaataagatatccccaagatgatcggatgcccataatgttcctcgcccataatgaactgtatatttatacagtatatcgttacttgcttaaaagcaagcctattttttttcaaagcgcttcgcaaaaatttacataa

SEQ ID NO: 5728 - DNA, 624 bp, Xenorhabdus bovienii
  Coding DNA location: Contig name=SeqID_16914; Position on contig =2642..3265bp; Strand=+
atgtttttatctggggcgcgttttgctcaattgaaacacggcgtatcttcattgggaaaacttaagaaaaaatctcaatttggtgggtttgggttgttacttgacggggtcttgtttgccattagctcagatggcgaactgtatttacgaggaaatagtcatgctgaggtattatttaaagccagaggcatggagaaatttattttttcaaaaaggggcattcccgtgactttacggtactaccgggttaatgagtcactttggcaggatcaaaagcagttgtttgaatatgtcagcttagcttatcaatatacaatggcagaaattatcgataagcaaaaaatgccccttaggctaaaagatctccctaacttgggaatgactttagaacgtcaactatggaaagtcggcatatctaaagtagaagagttgcacgtgctgggagcaaaagcgacttaccttaagttacagcaacacagaaaacagacgaatgtcagcatattgcttgcgttggctggtgcgatagaaggttgccatgttgccgtattaccagagaaaatccgtgatgatttacttctctggcacaaggaattggatcactgtagtttgggttatcattcttaa

SEQ ID NO: 5729 - DNA, 123 bp, Xenorhabdus bovienii
  Coding DNA location: Contig name=SeqID_16914; Position on contig =3605..3727bp; Strand=-
atggcctatatcattatccggaaaatgatagttatcatttatatagttttttatttattaaaaccttataaaaaatattttctccacatgaagattaataaattaaacacccagaaaaaatga

SEQ ID NO: 5730 - DNA, 102 bp, Xenorhabdus bovienii
  Coding DNA location: Contig name=SeqID_16914; Position on contig =3765..3866bp; Strand=+
atgtcagagttcggcttcagagtcatcatttttgctcaggagaataggaaaactggagaagaacgttgtgcaggtatgtctggctacataatcagcaactga

SEQ ID NO: 5731 - DNA, 1161 bp, Xenorhabdus bovienii
  Coding DNA location: Contig name=SeqID_16914; Position on contig =4045..5205bp; Strand=+
atgttcggtcaatttggctggccagaatatgaacctaatatgacatctaatggccatttaatttcatccgatttacgaaaaatattacttgagcagtgttctatttctaaaaaattgccatctgaacagtggtggaaagagaaacgaaaaaaagatttgcctttgcacttcctggttcgggattatctcaatcatccagccatccagtttaattcccgaactcttttttcatcctgcgtagagacgttagaaaatatcaaattcagtataaatgaaagaagagaaatcgatattcttctccctgtcttctgcgttattagcaattggcagaaaagacatgatattacctctttaaccatggcagaagaggtgtccttgctacatcttgcgaaaatttcaacctatcttgaggaacatacaggggtcagaatacgtttcaaaattctttcggatgccacattctatgccgggatttttggtgatcctatggctgcggcagaacaatatataaaggatctggaagagttcactcaagtaagtaaaatcaatgaaatagttaatattctcgatatatctaagatagtttcattacttcaggataattatgaccgtgcctttccagagcatctgagaaccttcacattgaatccatctttgggaattagtcatgaggaagccattcgtttcaatgcaagcgtcgggagcacggtcaatatatcagatctatctctgacatataatcaaagaaaggctatattttgtgattctatcttccctgattcggagataaagcatgagatcatgaatagagttcacactgccttcgttcattatagagctatgaaggaaacaatggctagtatccgatgggaaaatacgctatttcctaatgcaatccgagccactatccaccataagacaataccattaatgggcgtcaggatatatcctggttacaagagccattcacccaatcttccctatcatggtattgcagttattgaaaatcggaagaatgtctggcaaatgagtattgaacaagaaattcaccaacatggcaaacgactaaggattattaataatcggggagtgagtgacttttatgtagatgccgatattttggagaatatggcggttttgttgcataaattgaactcttag

SEQ ID NO: 5732 - DNA, 96 bp, Xenorhabdus bovienii
  Coding DNA location: Contig name=SeqID_16914; Position on contig =5237..5332bp; Strand=-
atggatggccctctgataagcgatatgagcacatattccacattgttaagttgttactcccatattaaggggtgttcttcaatgttgatatgttag

SEQ ID NO: 5733 - DNA, 1194 bp, Xenorhabdus bovienii
  Coding DNA location: Contig name=SeqID_16914; Position on contig =5331..6524bp; Strand=+
atgcgtaaccttatcttcattattttggggaatatcacattagaaagtgcggtaccgctactttttactgttgggggactggctggcctgcatcttgctccattggcctggcttgcgacattgcctattgcgatacaaatggctgctggaagtgtctgtgcaatccctttttcgaacttgatggcacgttacagccgcagaaccggatttattctggctagtatggcaatgatattcggtggacttgcttcagcgacggctatttattcaggcagtttcgggcttctgctcggtgggcatttcctgattggcatctcgatgattggtattaattttctacggtttgccgctgctgaaagcgttccaaaaaaccgggctgcaacagcaacctctttactgctagcttctggaataattggtgtcattattggaagcgagctctatgggagaggagatagcttgggcttcgaacttccattcatcgggatatacatgatcgtgtccgttatcggaggatgtgcagttcttgctttcgctgcacttgatggtggtcttagatgttcaattaatcgacaaacagaagctgacattagtaaggcatcaggattttcacttattgccacaaatcgccgtttgttttttggaattgtgacaatggtgttaggtcatgcaatcatgctgatagtcatgtcgactgcctcgattgcctctatagattatggtattggaaattcagaaacgggcatattaattggtgttcatcttgtagctatgttcgctcccggtgttatcaccggtatgcttatatcaagaatgggggcgaatcgtattattctcttgggggctatcttgtatcttgtcggtttcctgatagggcttataaatgaagcagtaatggttattatagcagcgccgctgatttttgctggattagggtggaactttatgttcttagggggaactcatattatcaacagtatgcctgatggtatcaataaagtccgtgtccaaggggcgagtgagacgcttctggcctcggtatcgactgtatttgcgcttgcctccggagggatttacggggcatttggttggaaaggactgatttttgttgtcacaacgatgacattgctgactatatcattactttgcattcgtgcacttttgatatcgaatgttgttgatcaatcggactga

SEQ ID NO: 5734 - DNA, 105 bp, Xenorhabdus bovienii
  Coding DNA location: Contig name=SeqID_16914; Position on contig =6502..6606bp; Strand=+
atgttgttgatcaatcggactgacttttctccggtaattcattcaatacgaaatagtttttcttatcaccactccatttttgcgttagcacacttatttcagtga

SEQ ID NO: 5735 - DNA, 96 bp, Xenorhabdus bovienii
  Coding DNA location: Contig name=SeqID_16914; Position on contig =7284..7379bp; Strand=+
gtgaagtgtagagctgaaatctactcgtttgtgtcacagagtacaagtaacttgcgaacggaatgcattcgtataatttattatgagaacatctga

SEQ ID NO: 5736 - DNA, 14061 bp, Xenorhabdus bovienii
  Coding DNA location: Contig name=SeqID_16914; Position on contig =7366..21426bp; Strand=+
atgagaacatctgaaagctcgttgaactcgaatttatataaccttcatcccgctcaagaggatgtgttttacgagcaggcactctatgaaaacaatccactacacaacctcggttggtatacgttgatagaagaagatgttgatatagtaacttttcagcaagtgtggaatttactacatcaacatattgatatgttacggttacgcatatcggttaatgcggataatgaagctatacaatatatccaagatcaaggtgtacctgaatcaattatatttcatgatgttacaatgcagcctgaacctgaaaaaaaagcacagctttggatgcagcagcaaatagataatcctataaattttttaaaggaaactccatatcaaatttcattgattcgtatgacagatgaaaaatattattttttcactatattccatcatattatgattgatggtgtaggattatttcgactccatgaatatgttaataaattgtacgaatgtattaaaaatggaacatcaatagcttggttatcagaaattccgcaatatttagatacaataattaaagcaagggaatatctaaattcttctcattacgaaacggataaaaactactggtgtgattttttaaaagaaaatgaaatataccctttaactccttgctatcaaaatacgggtagtggtgttggttcgctaacattaccttctgcgatgacatcagatttacgtattttttgtagagaaaataatactaatttgcttgctgtcttttcgagtctagtcatcatcatgatggcagaacttacggggcaaaaagaattaacatttagtactattacacacggaagaaaaagaaagttagacaagcatgtcgttggaatgcatgcaaatatttatccagtacattgtcaggtttcacactcgctaagtgtgattgaacagattaaattcatggaattatcgcaaaaaaatagttatcgctattgtaaatttccccactctcaccttattcgaatcgctaataattttggaatccctttacctaatttatttattttctacgaacgattttcagagtcagcatctgaagtaactcaaaataaacataatcatatagaaggaacttctaatatttatcctatcgtttttcgattcaaggactatagcggcactgatcaggaactaaaaataaatataaattatttgcaggcgtattttagtgatcaagatgtagggaaaatacttgaacgtctgaaaaacttatttgctgcgttgattaaaaaaccttctttattagtcagtgaattgcctattttattagaacaggaacgtcacactctactgtacacttggaaccagcccgatgcgctgtatccacaaaatcaaaccctgcaacagcagttcgaagcccgtgcagcagccatgccggataacgtggcgctggtatttgagggagcaacgctgacttaccgccagttgaatgagcgggcgaaccaactggcctttgtgatccgcgagcactatcagcaacgacacaatcaagcgatgccggcagatacgctggtggcactgtacttggatcgcggtctggagatggtcatcagtattctggcggtgctgaaagccgggggagcttatgtgccgatgtccccggaacatccgccggagcggattcagtttattttggaagacacccaatctccgtgcgtggtgactcagcagcggcacctgacgacactgagtgaatgcacacaagttctgattgaccagccggcactgatagcggcagatgaccaggtggtgacggccggctggccagtggacaatccggtaccggtgaacggagccgctgatctggcatatgtcatttacacctcaggaacgactgggcagccaaaaggcgtattacagactcatcataatgctatgcgtttatttgctaccacccaaggggattatcaatttgatcaaaatgatacttgggttctttatcatgcctatacctttgatttcagtgtctgggaattatggggagcattaatatatggtgggcgtttaattattccaacagtcgattgcacgaaggattttgtcagctttacccgcttgtgttcacaccaaaaagttactgttctgaatcaaactccaggcgcattttatgcttttattgatgcctcgttgagtattggcgctaaatttccctgtcttcgatatgtgatctttggaggagataaacttaatcctgttcagttgaagccctggtgggacagttatggagatcaatcaccaacccttgtcaatatgtatgggataacagaaacaacggtacatgttacctatcagaaattaataaaagacgacgctataacggcatcctgcattggacgaccgttaaatgacatgcatgcctatgttttgaatgactcaggtcatctcgtacctattggtgccccaggggaactgtacatcgggggcgctggactggcccgtggatatttgaaccggccggtgttgaccgccgagcgttttgtggtgaacccgtttgccacggcggaagatcaggcgcacggctacacccgcctgtataaaaccggtgatctggtgcgctggcagccggacggtaatctggaatatctggggcgcaatgattttcaggtcaagatccgcggctaccgcattgagctgggggaaattgaaagcgcgctggcctcgcacccgcaggtgaaacaggcggtggtgattgaccacgagcatgaaggccataaagcgctggcggcgtatctggtcacggacggggagctgccggatgacaccttgatgacgtacctgtccgcccgcctgccggactacatggtgccagccagcttgacccggattgagacggtgcccctgaccctgaacggcaagctggatcgccgggcgttgcctgcaccggtgtggggaaaccgggatggttatgtggcgccgcgtaatgcgctggaaacccagctgtgtgctgtctggcaggacgtattggggctggaacgggtcggcattgaggataatttcttccggatcgggggagactcacttatcgcgattaagctgacggcagccattcgccgtgttttggccgtggatgtttctttggcacaggtgtttagcttgaaaaccgttgccgggatggctgcacagatgggacagcaggcctgcacggtgatcccccacgtcgagttggcgcgttaccccctgtcatttgcccaggagcggatgcggtttatcgaacagtttgagcagggaacccatgcctatcatgttccttatctggtgcaactggatgacggcgcttgtttgtctcagctggaaaccgccattcatcgggtggttgagcgccatccggtgatgaagacggtctaccgcaccgatgaggcggggcaggcctaccagcaggtactggaaggtaatttggttctccggtcacagtcttgtgaggcgtttgacgcactcctgcaaaccgtgcgtgcggaactggccactccgttcgatctgacggcagagccggggctgcgcctgtgtcactaccgggtggccgaacatcattatttattgatgatgtggcaccatattgccattgatggctggtccatcgatatttttatggatgaactggcggaaatttattctgccctacgggaaggtcgtgacagccagctgtcgccactggaaatcacctatggggactatgccagatggcaacgtgactatttgcagggtgaggtgcgtgaacgccagctggcctactggcagcaggcgctggccggttatgaaccgctgtctttgccgacggaccggagccggccgacacaggtggattatcagggccgggatttcaattttgcgctggggagtgaactttcgcatcagttaagggcgctggcgaaaacgcaggaaaccaccctgtataccgttctgctcagtgcgttttatgtcacgctggcgaaactgtccggccagaacgacatcgtgctgggcaccccgaccgacaaccgacatcatgcgcaaacccagccgctgattgggatgtttgttaactcactggtcttgagggcgcagcttgagccggccggcagcgtggaaacgctgattaaacagacccacgcagtgattgcccaggctaaggcgaatcaggacatgccgtttgagcaattggttgatgcgctggagattgagcgcgacaccgcccgccaccctattttccaggttatgtttggggtacagaatttgggtgagggcgggcaaagcagggcaaacctgccgtttagcccggtgaaactggccggggttctatacagccccgccaagtttgacctgagcctgtttatggccgaggagcaggccaatattgccggtggcataaattacgcggtaagcctgtttgacgagtcctcaatagcgcggatggcggatagctatcagcgggtattgacggcgtttgtcgccgatcagaagcaatctctggccgggcttgacgtgttgtccgcgcaggagcgtcataccctgctgcatcgctggaaccagactgacgtgccgtatccgcagagccggacgttgcaacagcagtttgaggctcaggtggtcgccacaccggataatgtggcactggtgtttgccggggaaacgctgacttatcggcaggtcaatgagcgggcaaaccagctggcggttgtgatccgcgaacgctatcagcagcagcgccatgcgccgatgccggcagacacgccggtggccctgtatctggatcgcagcctggagatgatcatcagtattctggcggtactgaaagccgggggggcctatgtgccgatgtccccggaatatccgccggagcgggtccggtttattctggccgacaccgggtcttcgtgtgtggtgacccagcagcgtcacttgacggcgctgggggaatacacgcacaggctgtcactgatcgcggcggatgatccgtcggtgaccgcaggacggccagtggacaatccggtgccggtgaacggggctacggatctggcgtacatcatctacacttcaggaacgaccggtcagcccaaaggggtcatgctgacgcaccaaagcgtgatgaaccgcctgtgctggatgcaatcccgatatgccttaaatgcggcggataacgtgctgcaaaaaaccccttatacctttgacgtctcggtgtgggaactgctggcggctaactgggttggcgcccgtattgtgattgccccgcctgatagccatagacagccggaaaccctgcataaactgatgcaggaaaccggggtaacggtggttcactttatcccgcccatgctcagtgccttctgccagtcgctacaggccttaaggcagcggttggcggaaactgtccgttatgttttctgtagcggggaggccctgactggatcacaggtcaacgcgtttaaaaccattaatccgggcgccagtgccttaattaacctttacgggccaacggaagcggcgattgaagtcacctattttgataccgccgacgaatttaatggcaatgtgcccatcggccgggcgattgataacacccgcctgtatgtgtgtgaaggtgggggtaacctgtcccccctcggtgcgcccggtgagctttacatcgggggcgctggtgtggcccgcgggtattggaaccggccggatctgaccgcggagtattttgtggtgaatccgtttgccacggcagaagatcagacgcggggctacacccgcctgtataaaaccggcgatttggtgcgctggcggccggacggcaatctggaatacctggggcgcaatgattttcaggtcaagatccgcggctaccgcattgagctgggagaagtcgaaagcgcgctggcctcacacccgcaggtgaaacaggcggtggtgattgatcgcgagcatgagggtcataaagcgctggcggcgtacctgatcacggaggggatgctgtcggatgagaccctgatagggcatgtgtccgcccgcctgccggactacatggtgccttcaagctttacccggattgagtcggtgcccctgaccctgaatggcaaactggatcgccgggcgttaccggcgccggtgtgggtgaaccgggacgattatgtggcgccgcgtaatgcgctggaaacccagctgtgtgcggtctggcaggatgtcctggggctggagcgggtcggcattgaggataacttcttccggatcggcggcaactccctgatggctattaagctgacggcggccattcgctatgccctggtagtagaagtcccactggtacaggtatttgaactgaaaaccgttgccggtctggccgcccagatggggcagcaggcctgtacggtgatcccccaccttgaactggtgcgctaccccctgtcgtctgtgcaggaacggatactgtttatcgaacagtttgagcaggggagcagtgtctatcatgtcccctatctggtgcagctggatgatggagactgtttacccctgctggaaacggccattaatcgggtagttgagcgccatccggtgatgaaggcggtgtaccgcactgacgatgcggggcaggcctaccagcaggtgcttgagggcagcctggttctccggtcacagtcttgtgaggatattaacgcgcttttgcaaacggtgaacacggagctggccactcccttcgatctgacgtcagagccgagcctgcgcctgtgtcactatcgggtggccgagcatcattacttattgatgatgtggcaccatattgccattgatggctggtccattgatatttttatggatgagctggcggagatttaccgtgctctgctggcatcccgcgacagccagctgccgccactggatatcacctatggggactatgcaaaatggcagcgtgactatttgcagggtgaggtgcgtgaacgccagctggcttactggcagcagactctggccggttatgagccgctgtctttgccgacggacagaagccggccggcacaggtagattatcagggacggaatttcaattttgcgctggggaatacgctttcgcatcagttaagggcgctggcaaaaacgcaggaaaccaccctgtatgccgttctgctcagtgcgttttatgtcacgctggccaaactgaccggacaggatgacatcgtgctgggaacgccgaccgacagccggcatcatgcgcaaacccagccgttgattgggatgtttgtcaactcactggtcttgagggcgcagcttgagccaaccgacagcgtggaaatgctgattaaacagacccacgcggtgattgctcaggccaaggcacatcaggacatgccgtttgagcagttggttgatgcgctggagattgagcgcgacaccgcccgtcatcctattttccagatcatgtttgggttgcagaatctgggtgagagtctgccagacagggcaggtttgccgtttaatccggtgaaactggacagggttctacacagccctgctaagtttgatctgagtctgtttatgtcggaagagcagtccagtattgccggcggcataaattacgcggtgagtctgtttgacgagtccacgatagcgcggatggctgatctttatcagcgggtgttagcggcgtttgtggcggatcagaagcaatctctggccgggattgacgtgttgtccgcacaggaacgccataccctgctgcaccgctggaaccagaccgacgtaccgtacccgcaggacaaaaccctgcaacagcagttcgaggcgcgtgcggcagccacaccggataacgtggcgctggtatttgcgggggcaacgctgacctaccggcagttaaatgaacgggcgaaccaactggcggttgtgatccgtgaacgttatcagcagcagtgccatgcgttgatgccggcagacacgccggtagcgctgtatctggatcgcagtctggaaatggtcatcagcatactggcggtgttgaaggccggcggcgcctacgtgccggtctcgccggcttacccgcctgagcgtatccggtttattctggcagacaccgcagccctgtgcgtggtgacccagcagcggtatctgacggatttgggggaatacagccacgcgttgtcactgatcgcggcagatgatctgtccgtgaccgcaggccagtcagcagacaatccggcgccggtgaatatgtctacagatctggcgtatatcatctacacctcgggaacgaccggccagccgaagggggtgatggtagaacatgccagtgtcattaatttatcccggtttattgcccgaacacatttactgggggaaacggtaaaggccctgttcttttccaattatgtttttgatgcgtcggtatttgagctattcccggctctgatggccggtgcaacgatttttatcgcaccagaggccgtgacggcggacagtgaccaacttttgtcgtttatcaatacgaacgaaattaccaaggcgtttattcccaccgccttgatgaatcattttgccgacgaactggcacgctcaaccttgcaggttatccataccggtggcgaagcactgaatgcgctgagtctaccgccggacgtcatactgtttaaccagtatggacccaccgaaggcaccgtgtgcgtcactcaaaacttattgcgggacggggatcgggcgattggtaagggaattgataatacccgtctgtatgtccttgatggtgagggcaatttgtcccccatcggtgcgctgggggaactgtacatcgggggcgcggggctggcccgtggatattggaatcggccggcgttaaccgcagagcgttttgtggtgaatccgtttgccacggcggaagatcaggagcagggctacacccgcctgtataaaaccggtgattgggtacgctggcggccggacggcaatctggaatatcgggggcgcaatgattttcaggtcaagatccgtggctaccgcattgagctgggggaaatcgaaagcgcgctggcttcgcacccgcaggtgaaacaggcggtggtgattgaccgcgagcatgaaggccacaaagtactcgcagcgtatctggtcacggacggaacgctgtcggatgaaatcctgatggagcacgtgtctgcccgcttgccggactacatggtgccttcaaactttacccggattgagtcggtgcccctgaccctgaatggcaagctggatcgccgggcgttaccggcgctggtgtgggtgagccgggacggttatgtggcgccgcgcaatgcgctggaaacccaattgtgtgctatctggcaggacgtattggggctggagcgggtcggcattaaggataatttcttccgtattggtggcaactccctgatagctattaagctgacagccgccattcgccgtattttggcggtggagattccattagtacaggtgtttgagttgaagactattgccgggttggccgcacagatggggcagcaggcctgtacggtgatcccccatgtcgagctggcgcgctaccccctgtcgcttgctcaggagcggatgcggtttatcgaacagtttgaacaggggagcagtgtctatcatgtcccttatctggtgcagctggatgatggagactgcttgcccctgctggaaacggccattaatcgcgtagttgagcgccatccggtgatgaagacggtttaccgcaatgacgatgaggggaatacttaccagcaggtgcttgagggcagtctgattttccggtcacagtcttgtgaggagtttgacgcgctcctgcaaacggtacgtgctgaactggccactccgttcgatctgacgacagagccgagcctgcgcctgtgtcactaccgggtggctgaaaatcattacttattgatgatgtggcaccatattgccattgatggctggtccattaatatttttatggatgaactggcggagatttaccctgctctgctggcatcccgcgacagccaactaccggccttggatatcacctatggggactatgccagatggcagcgtgactatttgcagggtgaggtacgtgaacgccagctgtcttattggcagcagactctggccggttatgagccactgtctttgccgacggacagaagccggccggcacaggtggattatcagggacaggatttcaattttgcgctggagagtaaactttcgcatcagttaagggcgctggcaaaaacgcaggaaaccaccctgtataccgttctgctcagtgcgttttatgtcacgctggccaaactgaccggacaggatgacatcgtgctgggaaccccgaccgacaaccggcatcatgcgcaaacccagccattgattgggatgtttgtcaactcactggtcttgagggcgcagcttgagccgaccgacagcgtggaaacactgattaaacagacccacgcggtaattgctcaggctaaggcgcatcaggacatgccgtttgagcagttggttgatgcgctggagattgagcgcgacaccgcccgccaccctattttccagattatgtttgggttgcagagttttggccaagatgagccaaacagggcaggtctgccgtttagtccggtaacactggatggcgctttacacagccccgccaagtttgatctgagcctgtttatggcagaaggcgcgggcagtattgtcggtggcataaattacgcagtgagcctgtttgacgagtccacgatagcgcggatggccgatatctatcagcgggtgctgacagcgtttgtcgccgatcagaagcaacctctggccggatttgacgtattgtccgcgcaggagcgccataccctgctgcaccgctggaaccagaccgacgtgccgtacccgcagagccacaccctgcaacagcagttcgagacgcgtgcggcagccaccccggataacgtggcgctggtatttgcgggggtaacgctgacctaccggcaagttaatgagcgggcgaaccagctggcggttgtgatccgcgaacgctatcagcagcagagccatgcgccggtgccggcagacacgccaatagcgctgtatctggatcgtagcctggaaatggtcatcagcatgctggcggtactaaaagccggcggcgcctacgtgccgatctcgccggcctacccgccggaacgaacccggtttattctggccgacaccgcagccccgtgtgtggtgactcagcagcggcacttaacggcgctgggggaatattcccacgcgctgtcactgatcgcggcggatgatccgtccgtgatcgcaggccagtcagcagacaatccggcgccggtgaatacctctgcggatctggcgtacatcatctacacctcgggaacgaccggccagccgaagggggtgatggttgaacacgccagtgttattaatttatcccagtttattgcccgaacgcatttactgggggaaacggtaaaggcgttattcttttccaattacgtttttgatgcgtccgtatttgagctattcccggccctgatagctggttcgacgatttttatcgcgccggcggccgtgacaagagacagtgaccaattgctgtcgtttatcaatacgcacgaaattaccaaggcgtttattcccaccgccttgatgaatcattttgccaccgaactggcccgctcaaccttgcaggtcatccataccggcggtgaagcgctgaatgcgctgagtttaccgccggatgtcatgctgtttaaccagtacgggccgaccgaaggcaccgtgtgcgccacccaaaactggttgcaggacggggatcgggcgatcggtaagggcattgataatacccgtctgtatgtccttgatggtgagggtaatctgtccccgatcggtgcgccgggggaactgtatatcgggggcgcggggctggctcgcggatattggaaccggccggcgttaaccgccgagcgttttgtggtgaacccgtttgccacggcggaagatcaggcgcgcggctacacccgcctgtataaaaccggtgattgggtacgctggcggccggacggtaatctggaatatcgggggcgcaatgattttcaggtcaagatccgtggctaccgcattgagctgggggaaatcgaaagtgtgctggcctcgcacccgcaggtgaaacaggcggtggtgattgaccgcgaacatgaaggtcacaaagtgctggcggcgtatctggtcacggacggggagctgtcggatgaaatcctgatagggcacgtgtctgcccgcctgccggactacatggtgccggccagcttgacccggattgagacggtgcccctgaccctgaatggcaagctggatcgccaggcactgccggccccggtgtgggtgagccggggcggttatgtggcgccgcgcgatgcgctggaaacccagctgtgtgccgtctggcaggacgtcctggggctggagcaggtcggcattgaggataacttcttccgtatcgggggggattcgattgtcagtatccggctggtgtctaaacttcggcaggcgggtttttcgctacaggtcaaatcgatttttgatgccccgacggtggcgcggttggctaagttgctggcccaggcctccacggcggtcagggtgattgccgagccgggattattaagcggggagtttggcttattgccgatccagcaggccttcttcggccggagcctgccgtgtccgcaccattggaatcaggcatttatgatgcagcttcccggagaaatccggcacgctgatattgagcaggccctgatccggctggccgggcggcacgatatgctgcgtacccgttttgtcagcacggaagacggttaccgtcagtgttatcaggctgagatgccattcgggttgcccgccttacaccgcgctgatgtcagcgtgctggagaaggcggcattacatcaacagctgacgcagtggcagggcgggtttgattatgctgccgggtctttatggcaggctagtcatctgaccgggtacgcggacggcagcgcccggttattcttcgcctttcaccacctgattattgacgcggtgtcctggcgcatcattgcggaagatatgcgtttattactgcaaggcgcaaccctgccaccgaagaccagcagctaccgccagtgggtggccgcggttcatcattatgcggcgcgccatcaacaggaagtgccctactggcagcgggtgatggtcgggaaagagactgaaccggcagccggtgaagccagccagcaccggttggtgctctctgccaaactgaccgataccctgttgcgggaggccaattccggttaccacacggagataaacgacttactcctgagtgcgctcaccctggcgttgtcggccagtttttcacgcccggtgaatcacatcattctggaagggcatggccgggagcccatcgataccacgctggatgtctcagaaaccgtggggtggtttaccacggtgtatccggtgcgcctggaaatgcaggcgggggtgacggaaaccatgatccacaccaaagagatgctcagggcggtgccgaataaagggatagggtacggggccttgcatcaggctggagacttagccggtgagttgccggcgataagtttcaactatctcggccagctggggggagacgccggacagggccgtcatcaagactggtcactgactgacgacgattgtggggccatgatagctagcgataaccccaatcctttgctgctggatatcaatggggcggttcaggcaggcagcctgcaattcagtgtgaactcccgtttgtcaccggcccagactcaggtatttatcacggcacttgagcaggcactcaccaccgttatcacggccggccaaaaacaggcccggttgggcggagtaaaaacccccagtgattatggcattaaaggcgtttcaatcgagcagttaaatcaactgactcatcgtcttgatcatgtgaataacgaaaattcgtctctccatgtagaaaagaaaacaattttggatgtgtaa

SEQ ID NO: 5737 - DNA, 11835 bp, Xenorhabdus bovienii
  Coding DNA location: Contig name=SeqID_16914; Position on contig =21419..33253bp; Strand=+
atgtgtaacaatatgttgatattactgaaagaactaattaaaaatcgggtgtcagtatgggtctgtgaaaataagttaaaactggcgtttgcaggagaaacgccccctgttcaattaattgataaagtaaaagagaaaaggcaaagcgtaatagatttcctaaatgaaaaatgtattttctctgaagaggattttcaaagttttatctttaataaaaatcagtctaatttcgatataacttttgctgatcccagccaatattctggaaataaaattgaagcgatatttcccgccaccagtttgcagcagggctttgtttatcattatctggcgcaaccgcaggatgacgcctaccgagtgcagttgctgttggattatcacgacaggctggattttgcggcttatcagcaggcctggacactggcttcactgcgcttccctgccctcaggacggcctttgactgggaaggggaagtgttgcagattgtgacggagggcgccagtatcgggccggccaatttcacgatcaaagatatcagttcattacccgcagaagagtgggatcgggcgattgaagaactccagcgaaatgaccgggcccagccttttgatttaagccagccggggttaatccgcttcaccttaatcaggcagcaggcacagcaggtgacggcactgatcactcagcatcactgtattgccgatggctggagtaccccgattttattgcagaccgtgcatgagtattacaatgcgctggtgcagggacgtgtcctcccgaaaggggtggacacggcctacctggcgactcagcagtatcatcttgatcacaaagatgcctccgatgcgtattgggctgaacgcaaaacccagtttcagggggcgaatgatctttctgcgttgttaagtcacgggattgacctggcgcagataaaaacggttgaaaaaccggccgagcaggtgctgacggtagagggaaacgcctatgggcagctcaagacgatgtgcagggagcagggggtcacgctgaatgtggtgctgcaatttgcctggcataaattactgcacagttactgcggggatgagcagacccttgtcggcaccgtggtgtccggacgagatgtgccggtagacgggattgagtccagtgtcgggctgtatatcaataccctgccgttgaccgtgcagtgggagcctgccggcagtgtactggccgttttacacgcaatccagaacgatattgcggcactcaacagccacagcgcggtgtcactggccagtttgcagcccgacggggcgcgtttattccacagcctgctggtctttgaaaactacccggcaccggtgataagcgagcacggggcagggattgaaaacaaactggcattccgtcaggccatcgaaaaagtggattatccggtgttactgatggcctatgaacagggtgacagcctgaccgtgaaattgagttatggcgaagactggctggcgggtgaacaggcgcggcgtttactgcaccagcttgagggcatcctgcataccgtcgcccgcgatccacaccagccgcacccgtcggtggaatttctcagtgacgacgagcgccacaccctgctgtaccgctggaaccagaccgacgtgccgtacccgcagagccacaccctgcaacagcagttcgaggcgcgtgcggcagctatcccagataacgtggcgctggtgtttgcgggagcaacgctgacctaccgacaggtcaatgaacgggcgaaccagctggcggttgtgatccgcgaacgctatcagcagcggtgctatgcgccgatgccggcagacacgccgatagcgctgtatctggatcgtagcctggaaatggtcatcagcatgctggcggtactaaaagccggcggcgcctatgtgccagtctcgccggcctacccgccggagcgaacccggtttattctgaccgacactgcagccccgtgtgtggtgacccaacagcggcacttaacggcgctgggggaatattcccacgcgctatcactgatcgcggcggatgatccgtccgtgaccgcaggccagtcagcagacaatccggcgccggtgaatacctctgcggatctggcgtacatcatctacacctcgggaacgaccggccagccgaagggagtgatggtagaacacgccagcgttattaatttatcccagtttattgcccgaacgcatttactgggggaaacggtaaaggccctgttcttttccaattacgtttttgatgcatcggtatttgagctattcccggccctgatggccggcgcggcgatttttatcgcgccggcggccgtgacaggagacagtgaccaattgctgtcgtttatcaatacgcacgaaattaccaaggcgtttattcccaccgccttgatgaatcattttgccaccgaactggcccgctcaaccttgcaggtcatccataccggcggcgaagcgctgaatgcgctgaatctaccgccggacgtcacgctgtttaaccagtacgggccgaccgaaggcacggtgtgtgccacccagaactggttgcaggacggggaccgggcgatcggtaagggcattgataatacccgtctgtatgtccttgatggtgagggtaatctgtccccgatcggtgcgccgggggaactgtatatcgggggcgcggggctggctcgcggatattggaaccagccggcgttaaccgccgagcgttttgtggcgaacccgtttgccacggcggaagatcaggcgcggggctacacccgcctgtataaaaccggtgattgggtacgctggcggccggacggcaatctggaatatcgggggcgcaatgattttcaggtcaagatccgtggctaccgcattgagctgggagaaatcgaaagcgcgctggcctcgcacccgcaggtgaaacaggcggtggtgattgaccgcgagcatgaaggccacaaagtgctggcggcgtatctggtcacggacggggagctgtcggatgaaatcctgatagggcacgtgtctgcccgcctgccggactacatggtgccggccagcttgacccggattgagacggtgcccctgaccctgaatggcaagctggatcgccaggcactgccggccccggtgtgggtgagccggggcggttatgtggcgccgcgcgatgcgctggaaacccagctgtgtgccgtctggcaggacgtcctggggctggagcaggtcggcattgaggataacttcttccgtatcgggggggattcgattgtcagtatccggctggtgtctaaacttcggcaggcgggtttttcgctacaggtcaaatcgatttttgatgccccgacggtggcgcggttggctaagttgctggcccaggcctccacggcggtcagggtgattgccgagccgggattattaagcggggagtttggcttattgccgatccagcaggccttcttcggccggaacctgccgtgtccgcaccattggaatcaggcatttatgatgcagcttcccggagaaatccggcacgctgatattgagcaggccctgatccggctggccgggcggcacgatatgctgcgtacccactttgtcagcacggaagacggttaccgtcagtgttatcaggctgagatgccattcgggttgcccgtattacaccgcgctgatgtcagcgtgctggagaaggcggcattacatcaacagctgacgcagtggcaaagcaggtttgattatgctgccgggtctttatggcaggccggtcatctgaccgggtacgcggacggcagcgcccggttattcttcgcttttcaccacctgattattgacgcggtgtcctggcgcatcattgcggaagatatgcgtttattactgcaaggcgcaaccctgccaccgaagaccagcagctaccgccagtgggtggccgcggttcatcattatgcggcgcgccatcaacaggaagtgccctactggcagcgggtgatggccgggaaagagactgaaccggcagccggtgaagccagccagcaccggttggtgctctctgccaaactgaccgataccctgttgcgggaggccaattccggttaccacacggagataaacgacttactcctgagtgcgctcaccctggcattgtcggccagtttttcacgcccgatgaatcacatcattctggaggggcatggccgggagcccatcgataacacgctggatgtttcagaaaccgtggggtggtttaccacggtgtaccccgtgcgcctggaaatgaaggcgggggtgacggaaaccataatccacaccaaagagatgctcagggcggtgccgaataaagggatagggtacggggccttgcatcaggtcgggaatttagccggtgagttgccggcgataagtttcaactatctcggccagctggggggagacgccggacagggccgccatcaagactggtcactgaccgacgacgattgtggggccgtggtggccagcgataaccccagccctttgctgctggatatcaatggggcggttcaggcgggaagcctgcaattcagtgtgagatcccgtttgtcaccggccctgactcaggtatttatcacggcatttgagcaggcacttaccaccgtcatcacggccggccaaaaacaggcccggttgggcggagtaaaaacccccagtgattatggcattgaaggcgtttcaatcgagcggttaagtcgttttcagcagaggtatcagattgaagcgctgtatcccgccaccagtttgcagcagggtttcgtttatcattatctggctcacccgcaggatgatgcttatcgagtgcagttactgttggattatcacgacaggttggattttgcggcttaccagcaggcctgggcactggcttcactgcgcttccctgccctcaggacggcctttgactgggaaggggaggtgttgcagattgtgacggagggcaccagtatcgggccggccaatttcacgatcgaagatatcagttcattaccgccagaagagtgggatcgggcgattgaagaacttcagcaaaatgaccgggcccagccttttgatttaagccagcccgggttaatccgcttcaccttaatcaggcagcagacacagcgggcgacggtactgatcactcagcatcactgtattgctgacggctggagtaccccgattttattgcagaccgtgcatgagtattacaatacgctggtgcagggactgcgacccccgaaaggggtggacacggcctacctggcgactcagcagtatcatcttgatcacaaggaggcctccgaggcgtattgggctgaacgcaaaacccagtttcagggggcgaatgatctttctgcgttgttaagtcacgggattgacctggcgccgataaaaacggttgaaaacccggccgtgcaggggctgacggtagagggaaacgcctatgggcagctcaagacgatgtgcagggagcacggaataacgctgaatgtggtgctgcaatttgcctggcataaattactgcacagttactgcggggatgagcagacccttgtcggcaccgtggtgtccggacgagatgtgccggtagacgggattgagtccagtgtcgggctgtatatcaataccttgccgttgaccgtgcagtggaagcctgccgacagtgtactggctgttttacacgcaatccagaacgatattgcggcactcaacagccacagcgcggtgtcacttgccagtttgcagcctgacggggcgcgtttattccacagcctgctggtttttgaaaattacccggcaccggtgatgagcgagcacggggcaggcattgaaaacaagctggcattccgtcaggccatcgaaaaagtggattatccggtattactgatagcctatgaacagggtgacagcctgaccgtgaaattgagttatggcgaagactggctggcgggtgaacaggcgcggcgcttactgcaccagcttgagtacatcctgcataccgtcgcccgcgatccgcaccagccgcacccgtcggtgagattcctcagtgacgacgagctccataccctgctgtaccgctggaatgagaccgacatgccatacccgcaggacaaaaccctgcaacagcagttcgaggcgcgtgcggcagctaccccggataacgtggcgctggtatttgagggagcaacgctgacctaccggcaggttaatgaacgggcgaaccagctggcggttgtgatccgcgaacgctatcagcagcagcgccatgcgccgatgccggcagacacgccgatagcgctgtatctggatcgcagtctggacatggtcatcagcatgctggcggtactaaaagccggcggcgcctacgtgccagtctcgccggcctatccgccggagcgtatccggtttattctgaccgacaccgcagccccgtgtgtggttactcagcagcggcacttaacggcgctgggggaatattcccacgcgctgtcactgatcgcggcggatgatccgtctgtgaccgcaggccagtcagtggataatccggtgccggtgaatacctctacggatctggcgtacatcatctacacctcgggaacgaccggccagccgaagggagtgatggttgagcatacaggtgtggtgaatctgtcccagtttattgcccgaacgcatttactgggagaaacggtaaaggcgttattcttttccaattacgtttttgatgcgtccgtatttgagctattcccggccctgatagccggttcgacgatttttatcgcaccggcggccgtgacaggagacagtgaccaattgctgtcgtttatcaatacgcacgaaattaccaaggcgtttattcccaccgccttgatgaaccattttgccgccgaactggctcactcaaccttgcaggtcatccatactggcggcgaagcgctgaatgcgctgaatttaccgccggacgtcatgctgtttaaccagtatggccccaccgaaggcaccgtgtgcgccacccaaaacttattgcaggacggggatcgggcgatcggtaagggaattgataacgtccgtctgtatgtccttgatggtgagggcaacttgtctccgatgggggcaacgggggaactgtatatcgggggcgccgggctggcccgtgggtattggaatcggccggaactgaccgcggagcgttttgtggcgaacccgtttgccacggtggaagatcaggcgcggggctacacccgcctgtataaaaccggcgattgggtacgctggcggccggacggcaatttggaatatcgggggcgcaatgattttcaggtcaagatccgtggctaccgcattgagctgggggaaatcgaaagcgcgctggcctcgcacccacaggtgaaacaggcggtggtgattgaccgcgagcatgaaggccacaaagccctagcggcgtatctggtcacggacggggggctgtcggatgaaaccctgatggcgtacctgtctgcccgcctgccggactacatggtgccatccagctttacccggattgagacggtgcccctgaccctgaatggcaagctggattgccgggcgttaccggcgccggtgtgggtgaaccgggacgattatgtggtgccgcgtaatgcgctggaaacccagctgtgtgccgtctggcaggacgtattggggctggagcgggtcggcattgaggataacttcttccggatcgggggcaactccctgatagccattaagctgacagccgccattcgccgtgttctggccgtggaggttccactggcacaagtgtttgagttgaaaactattgccgggctggccgcacagatgggacagcaggcctgcacggtgatcccccacgtcgagttggcacgctacccgctgtcatttgcccaggagcggatgcggtttattgaacagtttgagcagggaacccatgcctatcatatcccttatctggtacagctcaatgatggggcctgcttatcccttctggaaacggccattcatcgggtggttgagcgccatccggtgatgaagacggtctaccgtaatgacgacgaggggcaggcctaccagcaggtactggaaggtaatctggttctccggtcacagtcttgtgaggcatttgactcactcctgcaagcggtacgtgcggaactggccactccgttcaatctgacggcagagccggggctgcgcctgtgtcactaccgggtggccgaacatcattatttattgatgatgtggcaccatattgctattgatggctggtccgtcgatatttttatggatgaactggcggaaatttactctgccctgcgggaaggtcgtgacagcctgctgccgccactggaaatcacctacggggattatgccagatggcagcgtgactatttacagggggaagtgcgtgaacgccagctggcctactggcagcaggcgctggccggttatgaaccgctgtccctgccaacggaccgaagccggccaactcaggtagattatcagggccgggatttcaattttgtgttggggagcgggctttcagatcaactgagggcgctggcgaaaacgcaggaaaccaccctgtataccgttctgctcagtgcgttttatgtcacgctggcgaaactgtccggccagaacgacatcgtgctgggcaccccgaccgacaaccgacaccatgcgcaaacccagccgctgattgggatgtttgttaactcactggtcttgagggcgcagcttgagccggccggcagcgtggaaacgctgattaaacagacccacgcagtgattgcccaggctaaggcgaatcaggacatgccgtttgagcaattggttgatgcgctggagattgagcgcgacaccgcccgccaccctattttccaggttatgtttggggtacagaatttgggtgagggcgggcaaagcagggcaaacctgccgtttagcccggtgaaactggccggggttctatacagccccgccaagtttgacctgagcctgtttatggccgaggagcaggccaatattgccggtggcataaattacgcggtaagcctgtttgacgagtcctcaatagcgcggatggcggatagctatcagcgggtattgacggcgtttgtcgccgatcagaagcaatctctggccgggcttgacgtgttgtccgcgcaggagcgtcataccctgctgtatcgctggaaccagactgacgtgccgtatccgcagagccggacgttgcagcagcagtttgaggctcaggtggtcgccacaccggataatgtggcactggtgtttgccggggaaacgctgacttatcggcaggtcaatgagcgggcaaaccagctggcggttgtgatccgcgaacgctatcagcagcagcgccatgcgccgatgccggcagacgcgccggtggccctgtacctcgatcgcagcctggagatgatcatcagtattctggcggtactgaaagccgggggggcctatgtgccgatgtccccggaatatccgccggagcggatccggtttattctggctgacaccgggtcttcgtgtgtggtgacccaacagcggcacctgacggcgctgggggaatacacgcacacgctgtcactaattgcggcggatgatccgtcggtgaccgcaggacggccaatggacaacccggtgccggtgaacggggctacggatctggcgtacatcatctacacctcagggacaaccggtcagcccaaaggggttatgctgacgcaccaaagcgtcatgaaccgcctgtgttggatgcaatcccgatatgccttaaatgcggcggataacgtgctgcaaaaaaccccttatacctttgatgtctcggtgtgggaactgttggcggctaactgggtcggcgcccgtattgtgattgccccgcctgatagccataggcagccggaaaccctgcataaactgatgcaggaaaccggggtaacggtggttcactttattccgcccatgctcagtgccttctgccagtcgctacaggccttaaggcagcggttggcggaaactgtccgttatgttttctgtagcggggaggccctgactggatcacaggtcagtgcgtttaagaccattaatccgggcgcgagtgccttaattaacctttacgggccaacggaagcggcgattgaagtcacctattttgataccgccggtgaatttaatggcaatgtgcccatcggccgggcgattgataacacccgcctgtatgtgtgtgaaggtgggggtaacctgtcccccctcggtgcgcccggtgagctttacatcgggggtgctggtgtggcccgcgggtattggaaccggccggagctgaccgcggagtattttgtggtgaacccgtttgccacggcagaagatcaggcgcggggctacacccgcctgtataaaaccggcgatttggtgcgctggtggccggacggcaatctggaatacctggggcgcaatgattttcaggtcaagatccgcggctaccgcattgagctgggagaagtcgaaagcgcgctggcctcgcacccgcaggtgaaacaggcggtggtgattgatcgcgaacatgaggggaataaagcgctggtggcgtatctgattacggagggggtgctgtcggatgaaactctgatagggcatgtgtccgcccgcctgccggactacatggtgccttcaagttttacccggattgagtcggtacccctgaccctgaatggcaaactggatcgccgggcgttaccggcgccggtgtgggtgaaccgggacgattatgtggcgccgcgtaatgcgctggaaacccggctgtgtgcggtctggcaggatgtcctggggctggagcgggtcggcattgaggataacttcttccggatcggcggcaactccctgatggccattaagctgacggtagccattcgccgtgaaatagatattgatattcctttaagcatactgtttagtcacaaatgtatttctttattaacagaatggctggaatccgggtgtttaaaatacaacttacttaatttattaactccagaatcaacagcaacgaataagttatttatgatccatgcggcgggttgcggtagtgaggtatatgatcctttagcaaaagcattgtctgatgtgtataactgtataggtatcgataattataatctctttacggataatcacatagagtcactacagaagatagctcaaatctatttggaattaattttgactgaaacttctattgataaacctattaaaattttaggatggtcattaggaggacaattagctatggagattgcatttcaattagaacagaatggtgcaaaagatattcagctattcttattagatacagtgatcaatactgttcaattaacagaaattaaaaatcaattagatatgtcatatgtacttagtgaggctgcaataaaattgcaggcaatgggagttggggatgcttatataaataaagtgttggatgcaatgccttttgaacataaaatagttaattgtaatttgagtggaaaattaatgcatacaaatattactttatttaaagcaggtcaaatgaactcagattataaaggagatattggattaacggtaaatcagttaatagcaaaaatgccggataataatatttcggcatgggtgacaaatccattagtgattaaattggttaatgatcgttctcacgctgatattcttgaatctatttctattgttagtgcagaaataatcgacaaattatcaattgagggaaatatatcaatataa

SEQ ID NO: 5738 - DNA, 2163 bp, Xenorhabdus bovienii
  Coding DNA location: Contig name=SeqID_16914; Position on contig =33314..35476bp; Strand=-
gtgctaacggttttatccagctcccgtcattttctgtataacagtcacgtcctctattatatccgtatatttattgcactgacaggaacgaccctcgtcccttggttattgggggaagagcctaaaataacgatccccctgacattaggtgttgttgctgcggcattaacggatctggatgatcgtttagttggccgcctgcgcaaccttgtgattaccctagtttctttctttgccgcttctacgtccatcacactgctttttccttacccgtggcttttcatggttgggctagcggtatctacctgtagttttattctgctcggcgcccttggacaacgctatgctaccatcgcctttggtgccttactgattgccatttacaccatgctcggtacgtcgatatttcctctttggtatcagcagcctttattattactcacgggtgcaatttggtataacttactaacgttaacggggcatttactgttccctattcgtcccttgcaagaaaatttggcacgttgttaccagcagctttctgcctatctctatgccaaaaccagcctgtttgaccctgattccgaagctgaagaatataagcaatcaatgtttgatgttgccatggcaaacagcgcattagttaccacgctcaatcaagccaaaatttctttgctgagccgtctgaaaggcgatcgtgggcaacggggcacgcgtcacacactgcattattattttgttgcccaagatattcatgagcgtgccagttcgtctcatgttcagtatcaaaaattgcgggagacttttcgacatagcgatattttgtttcgttgtcagcgattgctgtccatgcaggctcgtgcatgcgaacaggtctcgcaatcgataattctccgtaagccatatcagcataactcacgttttgagaatgcgttcaactatcttgaaagttctcttgaacgcttgaaaaatcagcaaggcgctgacacgcaaattatggcgttctacaatttgctgagaaatttacgggcgattgatgctcaactatcagggctgaattctgagcaatccccacttctccaaaacgcgtctcaaagtggtaagcaagaggatactcaattatccaatgaagccttaactggctggcgtgatgtctggttcaggataagcagtaatctgacgccaaagtctgctcttttccgccacgctatccgcatgtcggccttgctgtgtaccggttatgccattattcaattgtttgatctgcaacgtgggtattggattttactgaccagcctgtttgtctgtcagcctaactacagcgcgacccgacgtcggctggcactgcgcgtcacagggacactggctgggatcttgattggcttgccaatcctctattttgttccttccatcgaagggcaactggtgctgattatcatttcaggtgtgctgttttttgccttccgtaatattcaatatgcacatgcaacactgttcattacgctgctggtgttactgagtttcaatttattgggtgaaggatttgaagttgccttgccaagaattacagacacattaataggctgtggtattgctttgctggccgtcagttttatctggccagattggaaattccgccagttgccgagagtgattaaccggacaatgatcgccaattgccgttatcttgacgctattgtcgggcaatattaccaaggcaagaataatagcctgaattatcggatcgcccgtcgtgatgcccataattgtgatgctgaattagcatccgtaatatcaaacatggcatcagagcccaaaaattaccgtgtttctcaggaagaagcctttcgcctactctgtcttaaccatacgatgctaagttacatttctgctttgggtgcgcatcgtgaccggctcaatgatcaggtcattctggatattctgaacgatgcaatttttcaggttgaatcggcattgcagcaaggatgggttgatgatgaacgcctgcaacgcatttcagagcgtctggctgagagcatcaatctggtatcttctggtagcagcggcaaagtacaacttgtattacaacaaatagggttattggttgaacttctgcctgaatttgtttcattgataaaacaactcacacagtcggatatctga

SEQ ID NO: 5739 - DNA, 2064 bp, Xenorhabdus bovienii
  Coding DNA location: Contig name=SeqID_16914; Position on contig =35543..37606bp; Strand=+
atggaactcaaatcaacgcaaatgggccaacgccttgcccagcatccttataacagggtgcgtttacttaacgctggtattgaagtcagcggtgataagcaccagtaccttattccatttaatcagttaatgagtattcagtgtaagcgagggattatttggggggaactggaatttgagttgtatgaaggaaaagttgttcggctgcatggcacggaatggcagcaaacacagcacttttaccattacttgttgaaagaatggcaacaatggagccttgacatgagtgatgtcagtgctgatgtgctggccgctcaagtcaatgaaatcaataaaatcacacagcaggatcgctggttcaaaactgcggacttgctctcattacagcagcaaattcaggaagcatttcaggccctccctttgccattagcgcgaatcgaacaatttgagaactgtcgtgatgattatcgaatgtgtttggattggctggatgagggggggaaaacgattaaaatccttaaccagcaatgggttgatcgtatattgcagcaatatgcagaatttttccaaactatcgaaactacgccactcaatcgttttcagtgccaggcggtcgttaatggtgaaaaatctatattggttttggcaggagcgggcagcggaaagacctccgttctagttgcgcgtgcagggtggctgttattacgtcaacaagcgcttcctgagcagattttgctgctggcttttggccgccaggccgctgatgaaatgaataaacgtattcagaaacgcttgggaacaaaagagatacaggcaaaaacattccatgctttggcattgcatattattcagcagggtagcaataaagcgcccaagatgagtgaattagagacggatgcacagaagcgtcgtgattttctcatccaggaatggcaaaaacagtgcagtgaaaaaaaagtacaggcaaaaggctggcgcgaatggttgaatcaagagcttgattggcaattgcctgagggggagtattggcatgataaacaactctcgattcgattatctgaccgtttggagcgttggctggagctgatgcgaatgcacggtggcagccagaaagagatgattgaacaggcatctcctgcttatgctgacacattccaaaaacatatacggcttatggctcccttgctgaaggcttggaaattggcattaaaatctgagggtgctgtggacttttccggcttgatccatcaagccgtgaatattctggaaaaagggcgctttatcagcccatggaagcatattttggtggacgaatttcaggatatttcaccattgcgagcaaaattgttggcggtgttacgagtgcaaaataaacaaagccatctatttgccgtgggagatgattggcaggcaatttatcgctttagtggtgcagaattaacgttaacaacggcattctcaacctattttggggaaggtgcggaaagtgcggaatgtaccttggacaccacttatcgtttcaatgatcgcattggtgagattgctaaccgctttatccggcaaaatcccaatcaattgaacaaaccgctcaatagcctgataaaagggaataaaaaatcagtcgtgattttgccgcaggagcagttggaggcactgctgaataaaatgagtggttatgtcacgaagcaggaaacgattctgttgttggggcgttatcaccatctcaaacctgaatttttgaaaaaagcgtctacacgctggccgaatttgaatattgaatttatgacaatccacgcatccaaagggcagcaatcggactatgtcattatcttgggattgcagcagggacaggatggctttccagcgccggcaagggaatccgtgttggaacaggtattattgccgcagcctgaagattttcccgatgcggaagaacgtcggcttttgtatattgcactgacgcgggcgaaaaaacaggtatggttgatgcaggagccgaaaaatccgtcggtattcattcatcaattaacacaattgggcgtgccaacccaacgcaagccatag

SEQ ID NO: 5740 - DNA, 414 bp, Xenorhabdus bovienii
  Coding DNA location: Contig name=SeqID_16914; Position on contig =37626..38039bp; Strand=+
atgagtgatcaatacatagcggacattctgaaaaataccaaggccatagcattagtaggagcgagtgaaaaaactgaccgaccaagctataaggtcatggagtatttgcttaatcagggctaccacgtcattcctgtcagccctagattggcgggaaaaacagtgttaggacagcctgttgttagccaattggcggatattgaacagtcggttgatatggttgacgtgtttcgcaacgccgaggctgcgagtggtatggctgaagaagctgtcgccattggtgcaaaagtattttggctgcaaaaaggggttattaatgaagaagcgaaatcactggcagaaaatgcaggattgaatgttgtgatggatcgttgcccaaaaattgaaattcctcgtttggccatggaaaaatga

SEQ ID NO: 5741 - DNA, 321 bp, Xenorhabdus bovienii
  Coding DNA location: Contig name=SeqID_16914; Position on contig =38104..38424bp; Strand=-
atgatgatcgccagcaaattcggtatcggtcagcaagtacgacataagctgctaggttatttaggtgttattgtagatattgatgctgaatattctttagaacagccacaggaaaatgatatagcatcgaatgctaccttgcgttcagccccgtggtatcacgttgtgatggaaggtgatgatgggcagccagtccatacctatctggcagaagctcaattggcttacgaaacgtcagatgatcatccagaacaatcttctctagatgagttggctgaatccattcgcagtcaattgcaggctccacgattacgaaattaa

SEQ ID NO: 5742 - DNA, 138 bp, Xenorhabdus bovienii
  Coding DNA location: Contig name=SeqID_16914; Position on contig =38380..38517bp; Strand=+
atgtcgtacttgctgaccgataccgaatttgctggcgatcatcatatagtcacctccaaagaaaccttgcaaagattcttatataagggcagtaaggtaaatttcaagtgcacactcggtaaacggaattttttgtaa

SEQ ID NO: 5743 - DNA, 279 bp, Xenorhabdus bovienii
  Coding DNA location: Contig name=SeqID_16914; Position on contig =38647..38925bp; Strand=+
atggctacaaagggtatgactatttatgtttatgggcgggtacagggagtcggcttccgttatcaaacttattgttgggcaaagaaaaataaactagtgggatatgttcgcaatatggatgatggtagtgtcaaaattgttgcttgtagtagtgatgagcaacttaaaaagttgacacattggctggagcagggagggccaccgggggctaaggttgaacactttaaatctcagctttgtgaagtggaggagatgaccgattttagcatccgccattag

SEQ ID NO: 5744 - DNA, 330 bp, Xenorhabdus bovienii
  Coding DNA location: Contig name=SeqID_16914; Position on contig =38940..39269bp; Strand=-
atgttggtatttaaagatcgtgcgatcgaaactgatgcacaaggttatctaaaaaacagcagtgactggcaagaagatatggcgtcactacttgccgaacaggaagatatcaccttgactgaacagcattgggaagtcatacgctttgtacgtgaattctacgaagaatttaatacttctcccgctattcgtatgttagtcaaagcaatttcacaaaaatatggtgaggaaaaaggaagtagccgttatctctatcgtctgtttcctaaaggacctgcaaaacaggcaaccaaaattgcaggcctcccaaaaccggtaaaatgtatctga

SEQ ID NO: 5745 - DNA, 129 bp, Xenorhabdus bovienii
  Coding DNA location: Contig name=SeqID_16914; Position on contig =39320..39448bp; Strand=-
atgtcgtgcactataaacatcactgttctcaatgtaaagtatttatctgttcaactgccgctaaattactcacattgctattcgttggcttatttcttcagcagatttggcgatctttcttgggaataa

SEQ ID NO: 5746 - DNA, 345 bp, Xenorhabdus bovienii
  Coding DNA location: Contig name=SeqID_16914; Position on contig =39714..40058bp; Strand=+
atgaagctgacagacatggcaatcaagcgtgctaagccaaaagaaaaatcatatacgctggcggacggtaacgggctatctttgttagttgaaactaatggatctaaaggttggcgctatcgttatcagttcacaggtaaaactaaaatgatatcgttaggtatctacccagttgtaactctcactgaggcaagagctaaaagagatgaggctagaaaacaggtagctaacggcatcaatccgagtgaagccagaaaagcggagaaagtcgcatcaattagccagtctgagaatacatttaaaaatatcgctctcgaatggtacgaaggtagaaaagatagatga

SEQ ID NO: 5747 - DNA, 369 bp, Xenorhabdus bovienii
  Coding DNA location: Contig name=SeqID_16914; Position on contig =40080..40448bp; Strand=+
atgatggacgcattcgaaaaagatgtgtttccttatataggtgatcgcccgattgctgacattaaaccaatggaactactcgaagtgctttctgttatggaaaagcgcggcacaactgagaaattgaagaaagtccgccagcgttgcggtgaagtttggaagtacgccattattacgggcagggcggagtataatccagcaccagatttagctagtgcctttgttcctcataagcgtgaacactacgcacatctttcagtaagcgagttaccagaattcctttcttctatagataaatatatgggaagccagattgttagagtggctttacggattcttatattaaccggattcgaccaggcgagttaa

SEQ ID NO: 5748 - DNA, 243 bp, Xenorhabdus bovienii
  Coding DNA location: Contig name=SeqID_16914; Position on contig =40517..40759bp; Strand=+
atgcgccgccctcatatagtgccattgtctgaacaggttattgagttactgaaacagatacacccaatcagcggtagttatcaatatatttttcttagccgtactgattatagaaagcatatatctgatatggcattaaatacgatgattaggcgtatgggttatagcggtagagccacaggtcacggctttaggcacaccatgagcactatattgcacgaacaaggctataacactgcctag

SEQ ID NO: 5749 - DNA, 252 bp, Xenorhabdus bovienii
  Coding DNA location: Contig name=SeqID_16914; Position on contig =40652..40903bp; Strand=-
atgcaccacatttttgccctgttcgagtgtttccatgtagtcggcataccattgcagcatttccctgcgaccatccagatattgggcgtggttgtaagttcctcgaatactgttcttatcaacatgggcaagctgagtttcaatctaggcagtgttatagccttgttcgtgcaatatagtgctcatggtgtgcctaaagccgtgacctgtggctctaccgctataacccatacgcctaatcatcgtatttaa

SEQ ID NO: 5750 - DNA, 738 bp, Xenorhabdus bovienii
  Coding DNA location: Contig name=SeqID_16914; Position on contig =41072..41809bp; Strand=+
atggcaagagtaaaacctaaagaaataacttcatggtttgatataagtagatatgagcaattattagatttaacagtgttagaggttattgatgatttgaagaatagagtattttctttatatgattacgaagatgaagatgaagatgaagatgaagacgatgcagatgatggttctccaacacttaatattgatgaaatacgaaagtcaatattaagagggttggagaaagggttagttaattacaacagtttaattatccatgatataatttcggatttacatgatggttctgatgaaaaaaatattccggttataaaagatgaatcctttgataaaagtcaggaatgtgaatttattgtaaatggacaccccataagatgtgttgatttttttaataaagaatatgatgagcattctattgaggggaagtcttgcaatttatttaatattggcgatttagcatcctactatagaggcttattaaggcaaggtgacataatggaggaagttaataaacctgtaaaggtaattggtggtaacatattttcgagtataaacaaagttggttatttaggagatgggtttaatgatgaattggtagttaaatttaacataggagattattctgatgatgaactacttacagaatttaaaggacttttaaaaatatggagacttggaacagaaatagatgaacctaaaaaaacaataatagaattggattgtcttcattga

SEQ ID NO: 5751 - DNA, 237 bp, Xenorhabdus bovienii
  Coding DNA location: Contig name=SeqID_16914; Position on contig =41851..42087bp; Strand=+
atgctatgggaaaaaataaaccaaaagaaaatcagcaatgaattatatgctagattattatttcctctaagtgaaggaaatataatgggaggggttcaaatcaaagatactgttagaccgttcgttgaaaaaataattttcgatgattttttacgatatttatcgttctatgtaaagaaaaatgaataccttaaagatatgagattttcagatgtcatgaaactcgccgagatttga

SEQ ID NO: 5752 - DNA, 93 bp, Xenorhabdus bovienii
  Coding DNA location: Contig name=SeqID_16914; Position on contig =42065..42157bp; Strand=-
ttgtcattccattatcttgttttagatagacataatcacaaaaatgatttatctaccaaaatcatcggtctcaaatctcggcgagtttcatga

SEQ ID NO: 5753 - DNA, 174 bp, Xenorhabdus bovienii
  Coding DNA location: Contig name=SeqID_16914; Position on contig =42219..42392bp; Strand=+
atgtcaacaatcacagcatcgaaagaaaaccttatccgcttacccgaagttcagcgcagaactggctacggtaaagcgtggatctacaaactcattgcagacaataaattcccgaagcaagtcaaaatgggtactcgctcagtcgctttcgttgagtcagaaattgatgactag

SEQ ID NO: 5754 - DNA, 129 bp, Xenorhabdus bovienii
  Coding DNA location: Contig name=SeqID_16914; Position on contig =42340..42468bp; Strand=-
ttgtctactgttggcaggaatataaagcttttcattacatcacctcgccacgagattcagcaatacgctgtgatatctagtcatcaatttctgactcaacgaaagcgactgagcgagtacccattttga

SEQ ID NO: 5755 - DNA, 246 bp, Xenorhabdus bovienii
  Coding DNA location: Contig name=SeqID_16914; Position on contig =42517..42762bp; Strand=+
atggaaaaaattactgccttgattggcaacggtcaaactcaccctaaattcagccagagcgatatttcaattatccgtaaggcggttatttcgggtaactggacggcaattaacaagggcatttgcacactcactgacttgggtttacgccataacggacaggggcttgtttggcttaattctggtgtatcggttcacgatgcagatagtgatatagggctggcaggtaggtcatgctcccaatag

SEQ ID NO: 5756 - DNA, 276 bp, Xenorhabdus bovienii; identical to SEQ ID NO: 420
  Coding DNA location: Contig name=SeqID_16914; Position on contig =42808..43083bp; Strand=+

SEQ ID NO: 5757 - DNA, 252 bp, Xenorhabdus bovienii
  Coding DNA location: Contig name=SeqID_16914; Position on contig =43132..43383bp; Strand=+
atgagcaggggtcatttgtcggcaacaagaagaatcaacgcgggctctggtatgcgtgggaaccaaaccagaagcaaatcaccgcacatgtatttggcgatcgcagtaaaaaaacgctggaaaaactgttggcgcttctggcatcgtttgaaatccagtattattgtactgataattatgctgtttatgattgccttcctgagagaactcacctcagaggaaagaaatttacccaacgcatcgaaagaatga

SEQ ID NO: 5758 - DNA, 255 bp, Xenorhabdus bovienii; identical to SEQ ID NO: 422
  Coding DNA location: Contig name=SeqID_16914; Position on contig =43260..43514bp; Strand=+

SEQ ID NO: 5759 - DNA, 477 bp, Xenorhabdus bovienii
  Coding DNA location: Contig name=SeqID_16914; Position on contig =43572..44048bp; Strand=+
gtgtgcccagttaacgcattgaataatggtagctattatggatttgtccagctaaaggatatcgatagttacgcattgaatatcattacttcaatcagttctgaatataacacacgcaaaaatggtgcctccttagcgacgttcgcgttactgattgaccagaagcaacggaaacaggccgtggataactggattttataccgcaatccaaaccagccagataagtacaccattctcaataagcatcatgaactggcgaagtgctatcaggctaaaggctggatgcgtgagccattggtgtatatcgcacgggtgattagggacaatgcagaatttagccggctaatgaaacgactgggttatatcaaggttagaactaggaaaatcacaggcagccttcaagacttctgggtttatcggcacaaagagaaaagcacctccttgcgcacaaaaaaaaccttaaaaacaataagttaa

SEQ ID NO: 5760 - DNA, 93 bp, Xenorhabdus bovienii
  Coding DNA location: Contig name=SeqID_16914; Position on contig =44045..44137bp; Strand=-
gtgatcggcatagacatagagccactgaccatctacagcaatgcgatcgaaggctctcgctggtcgttttgcatactggacaaatgggattaa

SEQ ID NO: 5761 - DNA, 1110 bp, Xenorhabdus bovienii
  Coding DNA location: Contig name=SeqID_16914; Position on contig =44113..45222bp; Strand=+
gtggctctatgtctatgccgatcacattcgttttctgaccaaaaagcgccaccgtgtcgagggtgttcgggttcagggttacacagcgaaaggaatagatctgcgagaggtcatgtgatgggaattattaactatagggatgctgggaggttaaggagtcttactgttgaagtcctcactttgggtgcaacaatagctttgggtcagttccttaacgcattgatatataatcagacggcatatttgcagtctggtcataatatggtcgtatcatttagcgacgcggttaatttgcgatcctcattgagtggagctcaaaaagaaaaggatagcacggcgaatgctaccctttggcgtgactcagatttgagtcatgagttaaatcaatcagttacccgtaatccaaatctggtttacgaagaattacaacagcttaagaggctaccatctttaagagggggagtgaaccaagtaaaggatatttacttggttagttattgctcagataaccatgtgaataatgttcactcagttaaccaagtcaatcttattgccttggatagccattgtacttattgtgcgtttattaaccatcgaacttattgtcggttggttcagccttttggttcaatgcctcgagattgtagttctttgcgaagggtgcgttttatccatgtagcgagggatggatcgccatcaatttttgcttgctcttcaagttgttttctaaattcttctgtcatcctcatttggtactggggagatcttttttcttttggtgttgacatggtaattaccctaggatattgtgagttacatggtaacgaccattgtagtatcagttatcaaataaggcaacgccccacagtgctcgcaacacatgtagggcgtttaaccaaaccgttagttgaggtaacgattatggctatacaacagcataaccaaactcgccttaaatttacattcctaattgcatcgggcaatcaacgtctggtggatattcaccctgtacgcctcattactgttctggcggactgtgaaggtgaagcccgtttactggcaggcaaatctaatctggtatttgtttcccgtcagggggtggccgcatga

SEQ ID NO: 5762 - DNA, 249 bp, Xenorhabdus bovienii
  Coding DNA location: Contig name=SeqID_16914; Position on contig =45219..45467bp; Strand=+
atgagcaagcctatcactattcatcaagccgctgaaaaggcgcagcaactcgaatttattaatcagcttattgagtcataccctcatcaaatacagggcagtgaaatatccgttatgtcttcactgatggcgaagctatccggcgatattgctgtatttctgattgaagtaatcgcaggtgaggaagctattgataacacttcccactgtagcgatatgtctaccgttcagggggtgaaccatgcctaa

SEQ ID NO: 5763 - DNA, 171 bp, Xenorhabdus bovienii
  Coding DNA location: Contig name=SeqID_16914; Position on contig =45460..45630bp; Strand=+
atgcctaatcctgcccctcatgactattacacccatcagaacggggaaaccgttcaggtgttgtcggtcgcctttaatcgcgtgacgtttgtccgtgatggttatcacaccccgtgcatcatgccagtaagccgtttcactaaagaatacacctacgcagggagagcctga

SEQ ID NO: 5764 - DNA, 306 bp, Xenorhabdus bovienii
  Coding DNA location: Contig name=SeqID_16914; Position on contig =45633..45938bp; Strand=+
atgtctgatatctataaccacttagtacgcaacaactttaacgctatgagcactgaggaaattaaagatctgcgtaagcattcagatggagcacacagtgcagtgatggcggcaatgtcagcgatgggtgagttggctttctggtctgctgataatgaaaactatgcaaattgtcaggcaagggaagatttacgccgcgtgggtgaagcactgatgtatttgccgaggattgccgaagcgctgaacgacacagcacagcatgcggattttgaaattcatcaccgtgaggggttccccaaatggtaa

SEQ ID NO: 5765 - DNA, 960 bp, Xenorhabdus bovienii
  Coding DNA location: Contig name=SeqID_16914; Position on contig =45932..46891bp; Strand=+
atggtaaatcatattgatatccgttcagtgaaaatggcggctaaggatcactggcaaggattgctgccagcctgtggggtggatgttccggcgaagggtaagcatggcgcttgccccctctgcggcggcactgaccgctttcacttcatggacgatcacggtcacggtgactggcattgtcgccagtgcgatgagccgaatcacggtgatgggctggatttgctggtgagggcgaaggggatcacgattattgaggcggctaaagttgttgctgatgcactggcattgcctttgccagaacccaagccagccagaaaggaagctcccaaatcggaggctcccccgatagccgaaagaattaaaaagctggtggctcaaaccacggtggggcaatccgactatctgactaacaaggggctgcaatgcccccatcagaagctactgaaagacggttctttgttactggtcatgcaagcgttggacggaaccgtaacaggcgcccagacgatcaagccgaacggtgaaaagcgccttgtctcaggctcacagaaaaagggcagttttatctccttatccgaaattaccggaatgcctgacacgttcatcattacagaaggctacgcgacggccttaaccgtcagccagttgcatgatggcgtgatactggctgcaattgatgaagggaatttaccgactgtagccgaacaggtcagggaacggtggccaactgcgaaaatcattcttgccgctgacaacgatatgaagtccggtcataagaatgtggggaaaatttcagcagaaaaagcggctaaatctgtcaggggctgggtcacattgccgcccacggaagagaaagcggactgggacgattaccgccagcgtcacgacatcgaagcggcaaagcaggcattcagtaatgggttgtatcaggtggggaaaaagaaccaatgtcagtggtga

SEQ ID NO: 5766 - DNA, 1749 bp, Xenorhabdus bovienii
  Coding DNA location: Contig name=SeqID_16914; Position on contig =46879..48627bp; Strand=+
atgtcagtggtgattaatttagcggaacaccgtgagaaagaacgtgatcccctgataccgtttattgatgtgcgcaacaccggagttttttacgcgaccccgaaattagacaaagaaaccggggaaatcatcaaacctgaacagtggttatgttcaccgattgacgtgatcggcacgggcattgatgaaaatgatgagcaatacctgatagtccgctggaaaacgaagggtaataaagacccggtcattaaaggggtagcgtcggccgacattggagaacgcgaaggctggcgaatactcaaggcgggcggtgtgcaggtgaccacaaaaagtaatctcagggcgatcctggctgactggctgatacgaagccacacaaaggaaatctggagtatgacggcaaaatcaggctggcataaaggggcgtatatcatgccggacggttcagtgattggtgtacctcagcagcctgttttgtttaacgggggaagcgctgccgcccatgcttacacggtttcaggcacaacggcaagctggcgtgaacaggtggcgcggctggcaaataataacccgttcatgatgctgggcattgcgacggcgttagcggccccgatgatagggattgtgggggcggacgggtttggtgtccatctgtatgcgcaatcgaccgccgggaaaaccacgacagcagatattgccaccagcctatacggtaagccggatgagcaacggctgacgtggtatggcactgcgctgggtattgctaacgaagccttggcacacaatgacgggttgttatcactggatgaagtcggacagggcgcaaaccctaaacatgtccacacctcagcttataccctgtttaacggtaaggggaaaatacagggggcaaaagaaggcggtaaccgtcctttggcaagctggcgaaccgtggcgatcagtaccggtgagaaagatatccccacgttcttgatggaagccgggattaaaattaatgccgggcaattagtcagattgctgaatatcccgatggaaagggcgaaaaccttgcacggttcagaaaatggtaaggcgcatgcggatgctttaaagcgcggctgtcgtgaacattatggtgcggcagggcgggaatggatcggttatctatcgtcacaccatgaggaagccagacaggcttatattgaggcgcaatcacggtggggcaagttgataccggaaagttatggtgagcaggtacaaagggtcagcgaccgctttgccgtactggaggcggctttaatgttggggcgggtcattacgggctggaaagcgcaggattgccgcgatgtgttgcaatatatctttaatgtctgggtggcggagtttgggacaggcaataaagaatttgaacagattgtcgagcaggccgtttcctttcttaacgcccatggcatgagccgctatgcccctctgccctatgatgagcgggacttaccgattcgggatctagccggataccgggaaaagaaaggccttcatgataatgatccgatgattttctataccttacccgccactttcaagcaggagatcgcccggggttttaacgtggatatgttcgcagacacgttagtgaaaagcgacatactcaaaaagccggccagtggaaggagctatcagggcaagacaccccgccttaagcatctggggggcattcagcaacgggcttacatcatggtgttagtgcctgaatcagacgaagaagcctga

SEQ ID NO: 5767 - DNA, 93 bp, Xenorhabdus bovienii
  Coding DNA location: Contig name=SeqID_16914; Position on contig =48637..48729bp; Strand=+
gtgagggttaaaacctgttgtctcagttgtctcggttgtctcatttttatttttccatatgaaaggtttaaaaccaccgtctttagacggtga

SEQ ID NO: 5768 - DNA, 147 bp, Xenorhabdus bovienii; identical to SEQ ID NO: 349
  Coding DNA location: Contig name=SeqID_16914; Position on contig =48695..48841bp; Strand=+

SEQ ID NO: 5769 - DNA, 126 bp, Xenorhabdus bovienii
  Coding DNA location: Contig name=SeqID_16914; Position on contig =48838..48963bp; Strand=-
atgcctccaatggcctgccaaaaagaaaacttttacccgtttgatgttgtctcaaaacccttgtttgttgtctcatgttgtctcaatttaaaaactaaaataattacaattcatacagttacttaa

SEQ ID NO: 5770 - DNA, 153 bp, Xenorhabdus bovienii
  Coding DNA location: Contig name=SeqID_16914; Position on contig =48965..49117bp; Strand=+
atgagaaaattacgtaaattataccgtcagaaaatcaatggctttacgggcatgcggttggaacttcacaccttgtccgaagagcgattccatgatcatgagctgaccgacaggattatcctgaatctggtgggggagtgtgcggatgcgtga

SEQ ID NO: 5771 - DNA, 387 bp, Xenorhabdus bovienii
  Coding DNA location: Contig name=SeqID_16914; Position on contig =49102..49488bp; Strand=+
gtgtgcggatgcgtgatattcagatggtacttaactaatggggtgcatgggccagtgaagggaatagtgacgttgactgggcacctattgcagcggggtttaaagggctggttcccagtacccgaaagactcgcgctcaatgttgtgatgatgacggttttgcgattgaagaaatataacccttattatttccagctaatcgtcatgcactatattaaggcgtctgcacttcgggcaatggggacaaagctaggcatctcccataacgaagtatcaaaacgattacaggcagcagagggatttattgaaggcgttctggcggtatcaggggtcactttggagctggataaatgcgtacaaaaagaaatcatcaatagggttgcgtaa

SEQ ID NO: 5772 - DNA, 453 bp, Xenorhabdus bovienii; identical to SEQ ID NO: 2538
  Coding DNA location: Contig name=SeqID_16914; Position on contig =49592..50044bp; Strand=-

SEQ ID NO: 5773 - DNA, 201 bp, Xenorhabdus bovienii; identical to SEQ ID NO: 2903
  Coding DNA location: Contig name=SeqID_16914; Position on contig =49945..50145bp; Strand=-

SEQ ID NO: 5774 - DNA, 150 bp, Xenorhabdus bovienii
  Coding DNA location: Contig name=SeqID_16914; Position on contig =50207..50356bp; Strand=-
atgctagcgagtgctgttaaccctaaagctagagtaattattgttacggatgcaggttttcaaaatgcagggttcaaacagataaaaacgctcggttgggatttcgtcggacgcattcgaggaaatactcaactaagacttgaaaaatag

SEQ ID NO: 5775 - DNA, 144 bp, Xenorhabdus bovienii; identical to SEQ ID NO: 4180
  Coding DNA location: Contig name=SeqID_16914; Position on contig =50365..50508bp; Strand=+

SEQ ID NO: 5776 - DNA, 339 bp, Xenorhabdus bovienii; identical to SEQ ID NO: 2540
  Coding DNA location: Contig name=SeqID_16914; Position on contig =50447..50785bp; Strand=-

SEQ ID NO: 5777 - DNA, 189 bp, Xenorhabdus bovienii
  Coding DNA location: Contig name=SeqID_16914; Position on contig =50762..50950bp; Strand=+
atgacatatttcacgtacaggcatagcagtgaccttattgacttggtggaacaatcagtagatcacacaacgctatgcctgtctattttctggggattcctcagcgcccagtgcggggctttttattaccctgtattcaataaagggtatttagaatcagcagtaaacttcaaatttacaactcactga

SEQ ID NO: 5778 - DNA, 465 bp, Xenorhabdus bovienii
  Coding DNA location: Contig name=SeqID_16914; Position on contig =51121..51585bp; Strand=+
atgtctgaagttaataagccagaacttaaaggttacgtgatgtcttttgatattggattaggagttagacgactctatttaggcaaggatttgtatgctgaaagagagttggggtattcgaatgatccacatacttatggagccttggatataattacaaacactacattaattagaaatatattatttttcaattttcggggggacgacgaccttaatcttcctctgagtataggtgtgatatcttatccaaatgatgattcaggtcccatatcagcattaggtagacaagatcttgatataacggttgatggtgtgatctatcatcttggctctagtcaagaaatttatgtacaggatggtaaagttcttctttcataccaaaacgcagatgtaaagaaattatttgctatggcgatgcaagcaataggtgaaactaagcgtttttgcctcaactggcaataa

SEQ ID NO: 5779 - DNA, 150 bp, Xenorhabdus bovienii
  Coding DNA location: Contig name=SeqID_16914; Position on contig =51727..51876bp; Strand=+
atgcggcaaatagaggaaatagctgaagagatcgtttctgaactctttgcagtcagtaaaactccaatggaacaatttggtattaattggaagcaagctgaacgcttagactcactaaacgaggctcaactctccggtaattccggttag

SEQ ID NO: 5780 - DNA, 213 bp, Xenorhabdus bovienii
  Coding DNA location: Contig name=SeqID_16914; Position on contig =51884..52096bp; Strand=-
atgtcacaatttgaaaaattaccactcggagataagacacctctagcattcatctttggtgggatatttttactcgcggtatcaattttaaagtggatgacatctgatattgcagtggactggctatataattcagttgaaagtttactagccatttatcttatcactcttgggttcaggttacgtaaaaagtatcgaagtaataataagtaa

SEQ ID NO: 5781 - DNA, 129 bp, Xenorhabdus bovienii
  Coding DNA location: Contig name=SeqID_16914; Position on contig =52381..52509bp; Strand=-
atgatctatagccacttcttgttttcgtccctcaaattaggggaagaaatcggaagtactggtaacaacaaaatattcctaaaaatattccaaacattttatgattttgtttttattgaaaatatttaa

SEQ ID NO: 5782 - DNA, 315 bp, Xenorhabdus bovienii
  Coding DNA location: Contig name=SeqID_16914; Position on contig =52676..52990bp; Strand=+
atggggtggaatatgcgtatgccaaacaaagatccgattgaactctaccagtggctgatacttctgctgctttctgcatggggcggaatagtccgctacatcatcgatataaaaaccagcaacgcccgctggagctggattggggcatttgcccaaatagtcgtttcgggatttaccggactgataggcggatttatcagtctcgaagcggggctgagtttatacctgatgttcgttagtgctggcgtgtccggcgcaatggggagcatcgccctaacctatttctggaacagactgacaggtgaacaaagatga

SEQ ID NO: 5783 - DNA, 402 bp, Xenorhabdus bovienii
  Coding DNA location: Contig name=SeqID_16914; Position on contig =52987..53388bp; Strand=+
atgagcagaggcattcgcaacaacaatccaggcaacattgaccacaactcagcgaataagtggcagggtcaattgccccatgacccgagtatagaaaagcggttctgtcggtttgaatcaccagagtatggcattcgagcgctgatgaagctgttgtgcaattaccataaaaaaggctatcagacagtcgcgaagataatcgaccgctgggcacccactaacgaaaacaacacctcggcttatatcaagggtatggccaaggcattaggtgtcgatcctcatcaggtgattagtgtcgataaggtcacattgattgtgttggccaagtcgatcattcagcacgagaacggcaagcaaccgtattcagaggcaacgtttgagaaagcgtttgagcttttatga

SEQ ID NO: 5784 - DNA, 474 bp, Xenorhabdus bovienii
  Coding DNA location: Contig name=SeqID_16914; Position on contig =53385..53858bp; Strand=+
atgaagtgggaagttaaagctgttgcagtgatagtcggtatcgttctgattggctcggctgcatattccatctattcagtgtatgcggaaaatggacggctcactggtgcgaataaatcattgaccactcggctatcagaacaagtcgccatcaataccaaacagcaagcacgaatccagcatctcgcagaactggagaccaaacacattcgggaactcgacaatgccaaatctgaaattgacactcttcggtctgatgttgccgctggccgtcgcaagctgcggatcaaagccgtctgccccgtgcgtgaaaccactgcctccggcagcgtgggcgacgcaggaaccccacaacttacagaagcagctcgacaagattattacgatctcctccgaatgatggcggagaacgaacggcagacgaagtacttacaagattacgctaacactgaatgttataaggtgaagaaatga

SEQ ID NO: 5785 - DNA, 165 bp, Xenorhabdus bovienii
  Coding DNA location: Contig name=SeqID_16914; Position on contig =53870..54034bp; Strand=-
atggctcctgcaaccccagtatcatttgctctgcggtggcaatttgttatttgctctttttttggcaatatgggcatccatcagggcgaaggcttcttctttagagtagtaaacgccattccccgccctataatcctctaccgcttccttgatgattccctttaa

SEQ ID NO: 5786 - DNA, 246 bp, Xenorhabdus bovienii
  Coding DNA location: Contig name=SeqID_16914; Position on contig =54079..54324bp; Strand=-
ttgttaagtattattcgcttgttattgggggaagatgggtttattagatttaccagtttttgtgataataacgtagtaaaagatgtggagaatgattatgaaaaaatatcttcttctttgcctggtagcaggtacgactcttttagcttcgatgcagacttatgccactatctgcttaccttttgttctatcacccatagcatatacagattgtatagctgcctgtcttgtgatgaatccggatag

SEQ ID NO: 5787 - DNA, 351 bp, Xenorhabdus bovienii
  Coding DNA location: Contig name=SeqID_16914; Position on contig =54440..54790bp; Strand=+
atgccgccacgtatcccccgagcctgccgcaagcagggctgccctaagaccaccactgaccgaagcggctactgtcctgaccatcttcacaccggctgggagaatcaccagcaaggtaagagccgacatgaacgcggctatggcaggccgtgggacaagctcagagccaccatcaaggcgagagacaagcatttatgccagcaatgcttacgcaatggacgggcagtgacaggcgtgaccgttgaccacatcaagcccaaggcacacggtgggacggatgcgttaacaaatctgattctactatgctggtcttgccatagggcgaagaccgcgacggagagactacgatga

SEQ ID NO: 5788 - DNA, 168 bp, Xenorhabdus bovienii
  Coding DNA location: Contig name=SeqID_16914; Position on contig =54787..54954bp; Strand=+
atgagcgagaaacaagtcaaattatcaagactgtacaagggtggccacttcaaaggttatgccctgagtgtggatggcatgttgctatcgaaccagcagcaggtcgtgattgagactcacagcagggatattcaccccacactgaacggtaaccttcacagtcagtga

SEQ ID NO: 5789 - DNA, 495 bp, Xenorhabdus bovienii
  Coding DNA location: Contig name=SeqID_16914; Position on contig =55239..55733bp; Strand=+
atggctggaacggcgggcagatcaggtcgtcgccccaagccgacggcacgaaaagaactggcaggcaatccgggcaagcgaaaactgaaccgggatgagccggcttttacgcccctgtccggggtttccccgccggactggtttagggaaaacgaattgccgctggcggcggtgatgtgggaactgaccagtcaggaattgtgtgcacagggattgctttgcgtcaccgatcttgccgtgctggagcgctggtgtgtggcgtatcagttctggcgcaaggcggttatcaatattgcccaacagggtaacacggtaaccggcgcgaccgggggaccgattaaaaacccggaactgaccgccaaaaaagaacagcaatccgaaatggacacgaccggctccctgctggggttagatcccagcagccgtcagcgtctgattggggcggcaggtcaggccaaaaccgacaatccctttatgaggatgatctcatcatga

SEQ ID NO: 5790 - DNA, 1731 bp, Xenorhabdus bovienii
  Coding DNA location: Contig name=SeqID_16914; Position on contig =55730..57460bp; Strand=+
atgagccgcaaatcttatctgaatgtcaatgcggcgaaccaatatgcccgtgatgtcgtgcgcggcaaaattgaagtcggtcgctacgtcagagaggcctgtcagcggcatctggataacctgaatcaggaaaaggcgacatcgtttaagtaccggttcgataaagatcgggctgaacaggccgccaaatttattcaattgctgccccacaccaagggggaatgggcgtttaaacgcatgcccatcacgctggagccgtggcagctatttattgtgtgttccgtgtttggctgggtgcataagggcagccggttgcgccgctttcgggaagtctacaccgaaattccccgcaaaaatggcaagtccgcgatttcggcgggcgtggcactctattgctttacctgtgatgacgaattcggcgcggaagtctattccggtgccacgacggagaaacaggcgtgggaagtcttccggccggcgcggttgatgtgtaagcgtaccccgatgttggttgaagcattcggcattgaagtgaatgcgtcaaacttaaaccgtccggctgacggggcccggcttgagccgctgatcggcaatcccggggacgggcagtcacccagttgtgccattgtggatgagtaccacgagcatgacaccgatgacctttacaccacgatgctgacggggatgggggcacgacgtcagcccctgatgtgggcgatcaccacggcaggttacaacattgaaggcccctgttatgacaagcgccgtgaagtgttagagatgctgtccggcaatgtgcccaacgaggagctgttcggggtgatttacaccgtggacgacggggacgactggacttcgccggacgtactgcggaaagccaatccgaatatgggcgtgtcagtctatgcggatttcctgctcagtcagcagcagcgcgccctgaataatccccggctggccagcgtcttcaaaaccaagcacctgaatatctgggtgtctgcccgggaggcctatttcaatatggtgagctggaagcagtgtgaagacacgacgctcaccttagagcagtttgagggccagccctgttttctggcgtttgaccttgcccgtaagctggacatgaacagcatggcgcggctttttgtccgcgagattgacggtaagcggcattactacagtattgccccgcgtttttgggtgccgtatgacagcgtgtacagcgtagagcagaccgagaaccgccgcaccgctgaacgttttaagaagtgggtggcgatggatctgctgaccgtgacggagggggccgaagtggattaccgctacatccttgaagaagccaaactcgcctgtcacctgaacccggttaatgaggccccgattgatccctttggggcaactggcttatctcactcactggcggacgagggcattaacccggtcatcattacccagaatttcacccacatgagtgacccgatgaaagagctggaggctgctatccaatccgggcgctttcatcacgacggcaatcctatcctgtcatggtgtatcagtaatgtcgtggggaaaaccatgggcgggaatgatgacattgtgcgccccatcaaggagcaaaaggacagcaaaattgacggggcggtcgccctgattatggcgatgggccgcgccatcctgcatgaagaacccgactttctttccaacctcgatccggatgaccttttaatgttatga

SEQ ID NO: 5791 - DNA, 162 bp, Xenorhabdus bovienii
  Coding DNA location: Contig name=SeqID_16914; Position on contig =57457..57618bp; Strand=+
atgaaaaatttactgattgatggcgctgcactggccggcaccggggcggtgttggcgggctgttaccttaagtatgggctggcaaacaccctgatcatcgggggcgttttgttgattgcctatgccctgaccgtcgcccgccggaggaaatatgctgcttga

SEQ ID NO: 5792 - DNA, 1230 bp, Xenorhabdus bovienii
  Coding DNA location: Contig name=SeqID_16914; Position on contig =57608..58837bp; Strand=+
atgctgcttgatgcgctgttccgcagtgaaccgctggaaaatccccgcaccccgatcacggccgaggctgccgaccatgacggcctgttcagtgcggatgtgtatgtcagccccgaaacgtcgatgaaactggcggcggcctatgcctgtatctatgtgctgtcctcttcggtggcgcagatgccgctgcatgtcatgcgcaagaacggtaagaccgtggaaatggcgcgggatcacccggtgttttatctggtgcatgatgagccgaacgactggcagaccagttacaaatggcgggagctgaaacagcgccatgtcctcggctggggcaatggttactcgtgggtgaggcgtaaccgtcgcggggaagtgaccacgctggaagcctgtatgccgtgggaaacgaccttactgaacacgggcgggcgctacacctacggggtgtataacgaagacggcagttttgccatcagcccggacgacatgatccacatccgggcactcggtaataaccggaaaatgggactcagtcccatcctgcaacatgccgaaaccatcgggatgggcatgagcggacagaaatacaccagtgccttttttggcgggaatgcgcgtccggcggggattgtctccgttaaaggggaagtcaatgataaaggctgggagcggcttaagcaggtgtggaaaaaagccgccgccgccctgcgcagtgaggaaaataaaaccctgctgctgcccgcagaactggattatcacgccctgaccgtgtcacccgtggatgcccagctcatcgacatgctgaaactcaaccgctccatgatagcggggctgttcaatgtgccggcccacatgattaatgacttagagaaggcgacgctttccaatatttctgaacaggctatccagtttgtccgccataccgtgatgccgtgggtggtgaactgggtgcaggaactgaatcgccggttgtttacccggcaggaaagggcggcggggttttatgtccgtttcaatctggcgggactcctgcgcggcaccccgaaagagcggggtgagttttaccacttcgccattacggatggctggatgagccgcaatgaagcccgtgcctttgaggacatgaaccccgtggacggactggatgaaatgctggtgagtgtcaacgccgccaatctgcttaacaacccggatcaaccccatcccaaccaggaggacaaacccgatgagtga

SEQ ID NO: 5793 - DNA, 666 bp, Xenorhabdus bovienii
  Coding DNA location: Contig name=SeqID_16914; Position on contig =58764..59429bp; Strand=+
gtgtcaacgccgccaatctgcttaacaacccggatcaaccccatcccaaccaggaggacaaacccgatgagtgacagggaaatgcgctgttacagcggtgaggtgcgtactgaaaccccggagaaccagccgacgcgcattgtcggttacggctcggtgtttaacagccgctcagaaccgttctggggctttcgtgaaatcatcaagcccggggcctttgacgaggtactccatgatgatgtgcgcgggctctttaaccatgatcccaattttattctgggacgcagtgccgccgggacattaaccgtgtccgtggatgaacgcgggctgcaatacaccattcaggccccggacacacagaccatccgcgatctggtgctggctcccatgcagcggggggatattacccagtcttcctttgcctttcgggtcgcccgtgacggggaacactggtacgaagatgaggaaggcattgtcatccgggaaatcagtcagttctcccggctgtttgatgtgagtccggtgacgtatccggcctatcaggcggccgattcagccgtccgttccttgcaggcctggcaggaggtgcgccacagcggggcactccggcaggcgattaatcaaaaaatggcgcgtgagcgcattctgacgttactgaatatttag

SEQ ID NO: 5794 - DNA, 1230 bp, Xenorhabdus bovienii
  Coding DNA location: Contig name=SeqID_16914; Position on contig =59433..60662bp; Strand=+
atgagcatgaaattacatgaactgaaacaacgccgtaacaccattgcggcggaaatgcgtaccctgcatgacacaatcggggatgccgcgtggacggatgagcagcgcaccgaatggaacaaggccaaaaccgagctggacagcattgatgcccaaattcagcgcgaggacgaattgcgtcacctcgaccagcagctggttaatcagactgagtccgaacagcggggtcatcctgccccgcctgaaacggcgctggctgaaaaacgggcggcgtctttcgacaaatacctgcgtcacggattgggtgaaatgacccccgaagagcggcaggcattgcgtgaactgtgggcacagggcactaccccggatgaaaaaggcggctacaccgtcccggttcagatgctgaacaaggtggtcgaggccatgaaagcgtacggcggcattgccagcgtggcgcaaatcctcagcacctccaccgggcagactatcgaatgggcgacggcggacggcacgacggaagagggtgagctgctgggtgaaaacacggcggccagcgaagaagatacgctgttcggcaccgagtcactgggggcgaagaaactgtcgtccaaaatcatccgggtgtccaatgagctgttgctggactccggcattgatatggaggcctatctggcgaaacgcattgccgagcgcatcgggcgtggtgaggcccggtatctggtgaaaggcacgggcacgggcagtccgcaacaaccgaaagggctggaaacctcggtcacgggcacggtagacgcggccaccaagtttagctggaaagacatgaacgccctgaaacatgcccttgatcccgcctaccgcaatacggggacgttccgctgggccttcaatgacagcacactgaaaatcatcaccgaaatggaggatgcccagaaccgcccgctgtggttgcccgaaattgccggggtggtgccttccacagtattgggggtgccttacgtgattgatcaggcgattgccgacatgggggcgggtaacaagttcatctattgtggggactttaaccgctttattgtccgccgtgtcacttacatgaccctgagacggctggttgagcgttatgccgattatgaccagaccgcgtttctggcgttccaccgtttcgactgcattctggaagacacggcggccatcaaggcgctggtcggcaagggtacagtgtcagcggcgtaa

SEQ ID NO: 5795 - DNA, 132 bp, Xenorhabdus bovienii
  Coding DNA location: Contig name=SeqID_16914; Position on contig =60672..60803bp; Strand=+
atgacactcacgccgcgtaaagcggtttttttgtgcctgcgatcggtcagggtcgcaggtgtcaggaggcaagatgccttttcccaccgtggacaaactcagacagcaatgccgtatcgacagcaaccatga

SEQ ID NO: 5796 - DNA, 282 bp, Xenorhabdus bovienii
  Coding DNA location: Contig name=SeqID_16914; Position on contig =60745..61026bp; Strand=+
atgccttttcccaccgtggacaaactcagacagcaatgccgtatcgacagcaaccatgacgcggaagatagtttgctgaacacttacgcccgtgctgccatccggcgggcagaaaattacctgaatcgccgtctttatgaagaagtcgtgccggacactgaccccgacggattgtttgtttcggacgatgtggaactggcgatcatgctgacggtgggctactggtatgaaaaccgcgaggcgcagaccttatccacgcccctgtgggcgacactggtttaa

SEQ ID NO: 5797 - DNA, 114 bp, Xenorhabdus bovienii
  Coding DNA location: Contig name=SeqID_16914; Position on contig =60971..61084bp; Strand=+
atgaaaaccgcgaggcgcagaccttatccacgcccctgtgggcgacactggtttaacattgatgcagccatttttcatttcgacctatccacgcccctgtgggcgacaccctaa

SEQ ID NO: 5798 - DNA, 171 bp, Xenorhabdus bovienii
  Coding DNA location: Contig name=SeqID_16914; Position on contig =61105..61275bp; Strand=+
atgatgttaaacatcagtgaaaaaactaccaaaattttttcgcaaattccccctttcaaccacagcactctggccatgcccgagggcgtaaattcggcacggtctgtgcctattgaaatctatcaaaccgccatcgcagctatattaatcgccacgtttatatcacggtaa

SEQ ID NO: 5799 - DNA, 141 bp, Xenorhabdus bovienii
  Coding DNA location: Contig name=SeqID_16914; Position on contig =61279..61419bp; Strand=-
ttgcgaagcctgatcggggcgaattgtgcggggctaggtcggcaactgagcgttattatcgacattgttagccgtgtagcccacatgggcgcgaataggtcgatggctgcgatgatcgttggcaagttatgctggtgttga

SEQ ID NO: 5800 - DNA, 873 bp, Xenorhabdus bovienii
  Coding DNA location: Contig name=SeqID_16914; Position on contig =61462..62334bp; Strand=+
atgctgaccaacccatccattcgtcttaacaaatacattagcgagagcggcatctgttctcgtcgcgattccgatcgttacatcgaacaggggaatgtttttattaacggtaagcgagccgccgttggcgatcaggtatttgccggagatatagtgaaagttaacggtcagcttatcgagccgcgtgatgaagaagacttagtgcttatcgcgctgaataagcccgttggcatcatcaccacaatggaagatagtgagcgggataacatcagtgatttcgttaaccacagcaagcgcgtcttcccgatcgggcgcttggataaggattcccagggactgatttttctgactaatcacggcgatctggtcaataagattcttcgtgccggaaataatcacgaaaaagagtacgtggtaacagttgacaaaccggtgaccgatgagtttattcagggcatgagcgcaggtgtgccgatgctgggaacggtgaccaaaaaatgtaaagtgcagaaagaagctccctttgtgtttcgtattacgctggtgcaggggcttaaccgccagattcgccgcatgtgtaaatactttggctatgaagttactaggcttgagcgcacgcgcatcatgaatgtcaacttgaaagggctgccacagggcgagtggcgagatctgaccgacgatgaactgatcgggttatttaagctgattgaaaactcatcgtccgaagaaaaaccggcgaaaaaagcgcagactaagctcgttgcagctaaaaagccgggctttaacgtgccgaaaaacgccgaaaaatccgacggcaactctgcttctcgtaagcgctttacccagcctgggcgtaagaagaaggggcgctaa

SEQ ID NO: 5801 - DNA, 99 bp, Xenorhabdus bovienii
  Coding DNA location: Contig name=SeqID_16914; Position on contig =62351..62449bp; Strand=-
ttgtactgtctagcaaactcatggcgatttatgtttaaatctttattgtcagcccgcaacgagagtcgcttaaaggatttagctagatccggcagctga

SEQ ID NO: 5802 - DNA, 222 bp, Xenorhabdus bovienii
  Coding DNA location: Contig name=SeqID_16914; Position on contig =62484..62705bp; Strand=+
atggcgcggatggccggtacccttggtgaagagtttggtcttgcagggagcgaaacttttgagtcaggttggatcattgattcgattgatggcacgagagcgtttatttatggtgtgccattatttaatacattaatcgcttatattgaaaacggtgaacctgttgtcggtgtgattggctttccagctatctcaactattgtatatgtcgctcaagggtag

SEQ ID NO: 5803 - DNA, 96 bp, Xenorhabdus bovienii
  Coding DNA location: Contig name=SeqID_16914; Position on contig =62680..62775bp; Strand=-
ttgcggcagttaacaagcttgaaaaacagcgataacacgcatcgagatcactgtacaacatccagcctccctacccttgagcgacatatacaatag

SEQ ID NO: 5804 - DNA, 153 bp, Xenorhabdus bovienii
  Coding DNA location: Contig name=SeqID_16914; Position on contig =62946..63098bp; Strand=-
atgaaacgatatcattataaggggcgtaaggatctcaatatatggcccgcgaaaggagcaaatatggcactgaataaaaaagtattacctgttttcaaatatcacccagaccccccattggaacaggggcattttctaccgataaaccgttaa

SEQ ID NO: 5805 - DNA, 111 bp, Xenorhabdus bovienii
  Coding DNA location: Contig name=SeqID_16914; Position on contig =63095..63205bp; Strand=-
ttgtcgttcaccttaaacatatcaaagcgaatgtggcaattgcccgttaatttagtaatgttactttttccccatttagaaatgtccctgttttcatgcataacagtatga

SEQ ID NO: 5806 - DNA, 858 bp, Xenorhabdus bovienii
  Coding DNA location: Contig name=SeqID_16914; Position on contig =63156..64013bp; Strand=-
atgtgccagagactgaatgttctgcgtaaagttgataacttattaatggctcataagcccaataacagcacaggtgttaaacgatttattttagagtttcttttctttggattgattaatgcacgctcgtgcttatttgccggtttcttttttttggctttatttttggttccagcaaaaggcatcatgggcataccgcgttatgatgtactattagtatttgcagtgacctttcaagcattactaatacggttaaaactcgaaacatgggatgaattgaaagcgatctgcgtctttcacttagtcggttttatgatggagctatttaagacatcagcatctattagttcatggcaatatcctgatgctgcgtttactaagctttggggagtcccactatttacaggttttatgtatgcggccgtggggagctacattatacagtcatggcgcttttttaaggtacgcattgagcattacccaccttattggatggcaacactggtggcactggcaatttatatcaacttctttagtcatcattatattgatgattatcgctggtacttaactgcttttattttcggtttgtatgcacgtggtactattttttatacgccgttggatcaagaatgcagaatgccactattacttgcttttatactgattggtttttttatttggttggcggaaaacttcggtaccttctttgggatctggcaatacccgaatcaattaggcgcttggtctgttgttcatgcaggaaaatggggggcatggtcattattggtggttgttacctttacgattgtcgttcaccttaaacatatcaaagcgaatgtggcaattgcccgttaa

SEQ ID NO: 5807 - DNA, 219 bp, Xenorhabdus bovienii
  Coding DNA location: Contig name=SeqID_16914; Position on contig =64215..64433bp; Strand=+
atggccgagcatcaaaaacggcaattgatgggtattgccagagaaaaaatcgcaccattacaggacgccgtggatttaaatatcgccaccaatacagagaaatctgcactaaccgaatggcgtaaatgccgggtgctgctcaatcgggtggattgcactaccgcacccaatatccaatggccggaacaacaatcagtgatccgtcggattggttcctga

SEQ ID NO: 5808 - DNA, 129 bp, Xenorhabdus bovienii
  Coding DNA location: Contig name=SeqID_16914; Position on contig =64391..64519bp; Strand=+
atggccggaacaacaatcagtgatccgtcggattggttcctgattatatcgggattatggggcgtgatcagaaagtctgccagatgggaaaactcttccgccatcagcttcgcccgttcccgcatatag

SEQ ID NO: 5809 - DNA, 162 bp, Xenorhabdus bovienii
  Coding DNA location: Contig name=SeqID_16914; Position on contig =64545..64706bp; Strand=-
atgtttgcgtaccggttcggtttggttacaataccggcaagcaacttctatcgtcaccgtcattttgagatccccttaaaaaggcataagaataccaggttaactctttggagtcatgaccaaattaaattcactatattactgattttattatttaattaa

SEQ ID NO: 5810 - DNA, 279 bp, Xenorhabdus bovienii
  Coding DNA location: Contig name=SeqID_16914; Position on contig =64644..64922bp; Strand=+
atgacggtgacgatagaagttgcttgccggtattgtaaccaaaccgaaccggtacgcaaacatggagcaggtaaagccgggtttcctcgttattattgcaagggttgccaaaaaaccttccaactcaattatcattacaatggccataagccgggtatgaaagaaaaaattgtcgatatggcgatgaatggctccggtgtgagagacacgggacgtgttttaagtatcggtatcaatacggtaatgcgtactttaaaaaactgtcgccaaaacaggtaa

SEQ ID NO: 5811 - DNA, 135 bp, Xenorhabdus bovienii
  Coding DNA location: Contig name=SeqID_16914; Position on contig =64925..65059bp; Strand=-
atgggctatgacctgcttcctttttgtatcaaaagcataccaaaaccaatgacgttattttttgttgcccacaaaagaccactgttcatccagttcacaaatgagggtgacatcatcataaacaacctgccttga

SEQ ID NO: 5812 - DNA, 117 bp, Xenorhabdus bovienii
  Coding DNA location: Contig name=SeqID_16914; Position on contig =65108..65224bp; Strand=-
atgccgttcgatacgttgagtcaaaatttttcccaccaaatgcttttctggctcgacttctctggcgtaacttccccaaccatcggtcgtgatgaaacgaatatgaaaaggggctaa

SEQ ID NO: 5813 - DNA, 156 bp, Xenorhabdus bovienii
  Coding DNA location: Contig name=SeqID_16914; Position on contig =65201..65356bp; Strand=+
ttgactcaacgtatcgaacggcataatctcaatctgcgcatccatatcaagcggctggcaagaagaaccctttgttattcacgctcaatagaaatccacgaaaaactcattgggacatatattgaaaaatatcattataacgcttgggagtcatga

SEQ ID NO: 5814 - DNA, 660 bp, Xenorhabdus bovienii
  Coding DNA location: Contig name=SeqID_16914; Position on contig =65370..66029bp; Strand=+
atggtgtttttatattttttcagtagtcactttgcaatggcgggtggtgtagttattggaggaactcgggttgtttacttaagtgataaaaaagaagtttctgtatctgtcaataacttagagaaagaatctgtttaccttattcagagttggattcaggatgaaaatgagaaaaccaaaactccgtttatcgtgacgccccctttatttaagttaccagaaaataacgaaaatattttgcgtattattaaagtgggtgatggattgccaatggatagggagtctatattctggctaaatgtgacgtctattcctgaaactgtaaaatcaagtgcagatgtcaatcagttacagattgttgttaactcgcgattaaaactattctaccgccctacacaactggaagagaactcgggggaggcttataagcatatcaagttcaggaaagaaaatggtgtattaattgcagagaattccacaccttattttatttctctttcacatctaaaagtggacggaaaagaaattgaaggagcgggtatgattaatccctttagccaatcaagttggccatttcctgtcaaaaatgcgaaaaatgtcagttggaaagcaatcaatgattacggtggagtcacacaggaagaactcgcagatctttag

SEQ ID NO: 5815 - DNA, 426 bp, Xenorhabdus bovienii
  Coding DNA location: Contig name=SeqID_16914; Position on contig =66070..66495bp; Strand=+
atgtcaaaaaatataaagcataatcttgctaaggaattgtgcgaaggcaagtattatcgattatggctgcctatatttatcatgatagggagtttttcttatcattttaaatcttatgctgaaaatgatttcaacatccatgcgctgagaataggagatgattttcctgatgatatcgatctttctatttttaatacttccaagcaaccccccggtgaatattgggtcgatacctacttaaataaagaaagtattgatacgggaaatgttgagtttattttaaatgatggtgaactgcggccaaaactcactgtgcaaaaattgcgggatttaggggtgaaaatcgatgtttttccggtgttgatgaatttaccatcagaagaggtgattacccaggggttacgcatgaaaatatttagtggataa

SEQ ID NO: 5816 - DNA, 1122 bp, Xenorhabdus bovienii; identical to SEQ ID NO: 3758
  Coding DNA location: Contig name=SeqID_16914; Position on contig =66521..67642bp; Strand=+

SEQ ID NO: 5817 - DNA, 2181 bp, Xenorhabdus bovienii
  Coding DNA location: Contig name=SeqID_16914; Position on contig =67657..69837bp; Strand=+
atgcgtaacccctgggtgattaccaatatcagcgaatatattccttcagccagcacgcagtttgattttaatcgacaacggctggatatcagtattccccaagttgcgctgaatcatcaggtgagaggttatatttcgcctgaatcatgggatcagggaatgacggctttattggttaactaccattatagtgggtcaacaaactggcaggataatcggagaactaatcagagcaattatttaaatctgcaaaccggcgttaattggcaggcatggcgtttacgaaattattccacttataccagtcagcgcaaaaattggcggagtatcaaatcgtatcttcaacgtgatattcatgctctcaaagggcagttgatcgttggtgatagtttcacgccttcttatctttttgatgggatagaatttcgcgggattcagcttgcttctgacgaaaatatgctgccggacagtatgaaaggttttgcaccggttgtaagcaggattgctcaaagtcatgctcaggtgacaatcaagcagaatggctatgtgatttatcagacttatgttgcacaggggccatttgtattaaccgatctctatccaaccactaccagtgggaatttagaaatcatcatcaaagaagctgatggccgggaacgccgttttatacaaccgttttctgctgcgcccattatgttgaggaaagacagcctgaaatattcgctgacaatgggacattaccgctcaccctatagccacagccgcaaaccttatttctttcaaggtactttgatctatgggcttcacaataatctcaccgcatatggtggtgtcatgttatcccgtgattatcaatctatggtgttaggttcaggaatcgatttgggcaatttcggctcgctttcttttgatgccacccatgctaatactcaattgctatcagacaaaaaatcccaagggcaggcttaccgactgcaatctctgaaagcgctttcactgacaggaactcatttaactgtggcagggtatcgctattcgactaaaggtttttacgatttcgatgatgccaatcatgctgataacctcaatggcaacaatcggttgtttggccgtatcaataagaaaagcaaactacaagtgcaagttaatcaaataatgggggatttcggcgggttgtatgtcacggcattccagcaggattactgggggcagagtggtcatgaacgtggtctcggtgcgggttataacatgagtctcggtggtatcaattacggcttgaattatacctatagccgtactcccgaccctggcaatcatgatcaattattctcattcagcgttcatgtgcctctcgaccgctggctgaaaaatagttgggccagttacagcttgacttcaggtaaaaacagccccacttcgcaacaggttagcctgaacggtacggtactggaggataataacctgcattacagcctgcaacagagttataccaaccaaggggatggcgtcagtggaaatattcataccgggtataagggagcctatggccggcttaatgctggttataactaccagcaccacggcagacaactgaattacggcgtcagtgggggaattgttgcacacccttacggcctgactttctcccaggaactgggcgaaacggcggtattggttcgagctgaaggcgcaaaaggcgttaaggtagccaataatacgggcgttaccaccgactggaacggctatgccgttgtgccttatgccagcagttaccgaaaaaaccgggttgcacttgatcctcattcttttgctgatgatgttgatattgatatcaatacgcaatttgttgttccgacaaaaggcgcgcttactctggccaattttcagacacgggtcggcagcagggtattgatgtttctctcataccaaggtcagccagtaccttttggtgctattgcgacgctggagaaaccgcatgatctcgacaagtccaacagcacaattgtcagcagtgaagggcaagcctatttcacgggaatgccgacccgtggaaagttacaggttaaatggggctttcagaatgccaaaacgtgtctagccaattataccttgccggaaaagcaaacattatcaggccatcctctatctggcatttatacaatgaaggtgaattgtgaataa

SEQ ID NO: 5818 - DNA, 501 bp, Xenorhabdus bovienii
  Coding DNA location: Contig name=SeqID_16914; Position on contig =69859..70359bp; Strand=+
atgttgattttccatcaaaattcccgttttttactggcaatgattattttgctggtgagtttggttactgaggcttatggcagtgagggaagctgccggattaaagaaggaaggaaacaacatgacttatctgccgtgtttcaaccgaaggtgactatttccagaagcgatatgcctggagccgtgatttatcgacatccggttatttcaaacccacaagatatactggggattcattgtgataaaccagagaaaatatcatggaaatttattggttatacgccaaccagtagcaggaatgatggtacttatgattcaggcgtgcctgggataggcatacggatgtatggttctaatatagaactgattaagacaaaccccaaaacaggcactggcccgattaaaaatggggtgattcaagcttatgtgggttctactattgtgcatacttatcatattcatgatgcattgatcacaactgaaaagctgtatcttggctaa

SEQ ID NO: 5819 - DNA, 366 bp, Xenorhabdus bovienii
  Coding DNA location: Contig name=SeqID_16914; Position on contig =70379..70744bp; Strand=+
atgggatcaatcgggatgtgggaattgtcaggtaatccgcgcactgcgggggaacaagatttcagtattgatctggattgtgacgacaatattcctattacgctaaaatttgagggaaatacagtgtcaaatgacaaccgtatattagcgcttgatcagagagggagtcattttacggccggaggaattggtcttcagattctgtatcaggatcaaccagtcatgataaattccgttttaaaggttggcaccagcctgatgggaatttactcggttcctttcaaagctcactatatccagacaggaagtgtgatcaccgcaggtaaagctaacgccactgcaaagatatccatcatttataattaa

SEQ ID NO: 5820 - DNA, 141 bp, Xenorhabdus bovienii
  Coding DNA location: Contig name=SeqID_16914; Position on contig =70749..70889bp; Strand=+
atgttaccagccataatctccttttatggctggcttgaccctttcttattcatcccttctcttttttctggcagaaaacgcccgattttattggcaattgaccttatgctcccagtttgtaggggaaatattgctaattaa

SEQ ID NO: 5821 - DNA, 1686 bp, Xenorhabdus bovienii
  Coding DNA location: Contig name=SeqID_16914; Position on contig =71018..72703bp; Strand=+
atgtcaaacagcgtacttaaccgccgttgggcggaacttttattggaagcactgacccgtcatggattgcgtcatgtttgtattgcccccggttcccgctccacgccattgacattatcagccgcagggaacgttaaactgatctgccatactcattttgatgagcggggattagggcatttggcgctgggtctggcgaaggcgagtaaagaaccggttgccgttatcgtgacgtcaggaaccgcggttgccaacctctatccctccttgattgaagccggtctgacaggcgagcggctggtatttctcaccgccgacaggccaccagaattaatcgattgtggtgcgaatcaggctattcgccagatcggtatttttgcctcccatcctactcagacgctttcactgccgcgtccgaccacagagatctctgccagttggctggtctctgtcgttgataatggcatgtcgaacttgaaacaaggaggattgcatattaattgcccgtttgctgaacctttgtatggcaatgatgtgatcgcgtatcaagattggcaacaaacattgggagagtggtggcagggaaatcaaccgtggctcaggcagccagaaactcatgttacatctaaagtgcaggattggggcttgtggcagaacaagcggggcgttgtactggctggccggatgaatgcagaagaaggtctgctcgttgcccagtggtcaagaaaaatgggctggccactgatcagcgatgtgctgtcccaaactgggcaaccgttgccttgtgctgacttatggctgaatcatccccgtgctcaggaaattctggcacgggcgcaattagtgattcaatttggctctagcctgactggaaaaagattgttgcaatggcaggctcaatgtcagccagaagaattctggattgttgatccgattgttggcaggcttgacccagcgaaccaccaaggacggaaatttacttgttatgtggctgattggctacgggaacatcctgctgactccacgcaagagcctacttcttcttgggcagatgaattgacctcatggtcagagcaagcacttgaatgtgtcaacgccagattggacgggaaatttggtgaggcggcagtggcgtatcagctgcatcaattactgccagaacagggacagttgtttgtcggtaatagcttgattatccgtctgattgatgcgttggggcaactccccgcaggttatccggtttacagcaatcgtggtgcaagtggtattgatgggctgatcgcaacagccgcaggagtacaaagggcaacgaacaaaccgacgctggcaattatcggggatctttcagcactctatgacttaaacagtctggctttgctgcgtgatctttccgcaccgatgatattgattgtcgtcaataacaatggcggccagattttttcattactgcctacgccagaagaagcgcgccagcgtttttactgtatgccgcaacatgtcaattttgatcacgctgcggctatgtttggtctgaattatgtgacgccacaaagttggcctgaattaaaacaacgtgttaaacaggcgtgggggcaaaaaacaacgacactgcttgaattaaaagtcacagacagcgaaggcgcgagatgcctgcaagagttacggaaacaggtggctgcattgtga

SEQ ID NO: 5822 - DNA, 807 bp, Xenorhabdus bovienii
  Coding DNA location: Contig name=SeqID_16914; Position on contig =72664..73470bp; Strand=+
atgcctgcaagagttacggaaacaggtggctgcattgtgaaactcgccagtcaggtatttcattcggataagtcgggaacatggttggtttggctgcatggcttgttgggatgtggtgatgaatggctacccttggtgaatgcttgtaatcagtatgcctcgctggtcattgacctgcccggccacggtcactcggccgatattactgtagcagggggtttcgcagagatgagcgctctcctgaatgaaaccttattcaagcaccagatccatgactattggctgatcggctactcactgggtggccgtattgccatgtaccatgcgacttacggcaaacatgaagggttacggggagtgctggtggaaggcggaaatcccgggctgttttcccaacaggagcgtgatgcgagattacagcatgatcagtgttgggtgcagcgttttcgtgaggaatcaatggagactgtccttgccgattggtatcaacagcccgtttttgccgatttatcatcggaacagcgtgagcaacttatccattgccgcagccaaaacaggggaagccggattgccgatatgttggaaaatacttcacttgggcatcagccgtggctggttcctgctctgcaacaaataaccacacattttgcctacttatgtggggaaaatgatgagaaatttcagaacatcgcgaagcaatatacattgccgttaaaaaccatcccacaggttgggcataacgcccataatggcaaccctgcggcgtttgccgccgaagtgaaccattttttatcactttttggttaa

SEQ ID NO: 5823 - DNA, 858 bp, Xenorhabdus bovienii
  Coding DNA location: Contig name=SeqID_16914; Position on contig =73483..74340bp; Strand=+
atgctttatcccaatgaagaaaaattgtacgcacccattgaatggcaagattgctcccaagggtttgaggatattctctaccataaatctgtagatggtattgccaagattactatcaatcgcccgcaggtgcgtaatgcgttccgtcccctgacagtaaaagagatgattcaggcgctggcagatgctcgttacgatgacgaagttggtacgattatcctgacgggaatgggggaaaaggcgttttgtgcagggggcgatcaaaagatccgtggcgattatggcggttatcaagatgacaacggcatgcatcatttgaatgtgctggattttcagcgtcaaattcgcacctgcccgaaaccagttgttgctatggttgcgggctattccattggtggtgggcatgtgttgcatttgatgtgtgatctgaccattgcagcagataacgcgatctttggtcagacaggcccgaaagtagggtcatttgacggcgggtggggcgcatcttacatggcgcgtatcgttgggcagaaaaaagcccgtgaaatctggttcctctgtcgtcaatatgatgcccaacaagcgctggatatggggctggtcaacacggttgtgccttatgcggatttggaaaaagagaccgtgcgctggtgtcgtgaaatgctggaaaacagcccaatggcgttgcgttgcctgaaagcggcactgaatgcggattgcgatgggcagtcgggtttgcaggagctggcggggaacgccaccatgttgttctatatgaccgaagaagggcaggaaggacgcaatgcgtttaacgaaaaacgcctccctgatttcagtagattcaagcgtaatccataa

SEQ ID NO: 5824 - DNA, 996 bp, Xenorhabdus bovienii
  Coding DNA location: Contig name=SeqID_16914; Position on contig =74340..75335bp; Strand=+
atgcgtaaagcaaccttatacccattcagcctgcccatggaggcaggtattattttacgttatcaacgccttaaaacccgtgatggttttctggtgcacttgcaggaaaatgaacggcacggttggggggaaatctccccgctacccgaattcagtcatgaaactctggaacaggccaaaaatgctgccgtgacatggctgcaacagtggtgtcaaaacgaacagggattaacggtagaacccgaagagagtgaactgccttccgtggcgtttggtatcagttgtgccctcgctgagctacagggtgaattacccggagatgctgattatcgcaaagcaccactatgtacgggcgatcctgatgacgtgatttggcgtctgggaaatatgactgggcaaaagatggctaaagtgaaagtcgggctgtatgaagcggtgcgggatggcatggttgtggatgtcctgctggaagccgtgcccgatctccagttgcggctagatgcgaatcgcagttggacacgcataaaagctgatgacttcgcaaaatatgtcaatcccgattaccggcaacgaattgcttttcttgaagaaccttgcaaaacccgtgaagaatccttggcatttgcccgtgatacaggaattgccattgcatgggatgaaagcgtgcgtgaaacggggtttacggtagaagcacaggaaggtgttgcggccattgtcatcaaaccgatgctggttggcagtattgtccgttgtcgtcagttagtttctgatgctcatcaggccggactggaagcggtaatcagttccagcatcgaaaccagttttggtctgacacagctcgcccgtctcgcgcattggctgacacccgatacccttcctgggctggatacgctggatctgattcagtcacaactcatcagctgctggccggaaagtcccattccctgtgtggcgctagatgatctggacaccgtatggagcaatgaatgtcattag

SEQ ID NO: 5825 - DNA, 1401 bp, Xenorhabdus bovienii
  Coding DNA location: Contig name=SeqID_16914; Position on contig =75326..76726bp; Strand=+
atgtcattagcggaatgtgcgcaatggccgtggcatcattgggcgatgctctacccagagaagcgggccgtcaggctgcatgaagagacgttatcctggcgacaattagcggaaaaaatcaacgccatcgctgcccattttcaccaacaggggctgtgggaaagtagcagtgtgatcctgagaggaaaaaacagtgcggatctcctgctgtgttatctcagtgcattgcaatgtggcgcaagagtattaccacttaatccgcaactccctgagcctttgttggaggaattgcttcctcgtctgaacatgacatttgtcatcgattttaccgattccccttcatctgctattcaggcgattaaacttgattggcaacctgaattatccgtgataccagagcaatgggtgccgtgggatagccatcgccctgccagtatgattttgacttcaggcacctctggattgcccaaggcggcagttcactctattggggctcaccttgccagcgcacagggaattctctcctgcatgaattttcagccaaatgacagttggctgctttcgctcccgttgtttcatatttccggccagggcattctttggcgctggctgctgaaaggtgcagaattagtgttgcgagatctgcatctattggatcgtgcattatctggctgtacccatgcgtcacttgtaccaactcaactctggcgtttgcttgaacagtcgcttgaacatgaactcactttaaaagcagtgctcttaggtggagcaatgataccaacggcattgactcaacaggctgaacaacttggtattcattgctggtgtggctatggactgacagaaatggcgtcaacggtctgtgtaaaacgggcagatggtttatcaggggtgggaaatccactaccgggcaaggatattcgcttggtggatgaagacattcagatccgcgctgacagcatcgctatgggttattggcttgatggaaaattgaagccactggcagataccgatggctggttttcgacccgtgaccgaggaatattcgaacagggcgaattgcgtattttagggcgcctcgacaatcaatttttcagtgggggagagggggttcagcctgaagatatagagcggattattaaccaacatccccagatcctgcaaaattttgttgtacctattcctgatagtgaatttggacatcgacctgttgtggtgattgaaacccaatatcctgcacttacggaaacacttgctgactggcttgctgataagctcgctgcatttcaacgccccgtggcttgttatcttctgcctgtacaattgaaaaatggtgggataaaaacttcacgccagcaggtcaagcaatgggtgctggaaaaatgggttatgtctaattaa

SEQ ID NO: 5826 - DNA, 129 bp, Xenorhabdus bovienii
  Coding DNA location: Contig name=SeqID_16914; Position on contig =76673..76801bp; Strand=-
gtgcacgtaagtaaatatctaaatttatcaaaatatatatatccctgcatctttatacatcatcaggtttataaattaattagacataacccatttttccagcacccattgcttgacctgctggcgtga

SEQ ID NO: 5827 - DNA, 543 bp, Xenorhabdus bovienii
  Coding DNA location: Contig name=SeqID_16914; Position on contig =76877..77419bp; Strand=+
atgaaaagtttcattgctgtcagcgtggtcagtttgttttttgtgtctggcgcggcaaatgcaatttccatgaatgtacaggctggaaagcattacacaagtacatctgtggggctaggtgataaaagtgcgggattatctttgaatggaaactggactcgcagtgatcataacggccaaattggtagtttgggcaccgctttcgctctgcctgtaggcccaataacggcaagcgttggtggtaaagtgctttatctgtcgccaaaagaagggaaagatggcgtcgcgttagctgcgggtgccggccttagctgggcggtgttgccttccttgtcactgtatggtgaagcttatggagcaccatcagggctgacatcaggcgttgattcttatacggaggcaacagggggtgtccgttatactttaattaggccgctgattgtggatgctggttatcgtgttattgatttgaaagggaaaaatggtaaccgtagcaataaagtttcagaaggtttttatattggtgccggtttcagcttctaa

SEQ ID NO: 5828 - DNA, 102 bp, Xenorhabdus bovienii
  Coding DNA location: Contig name=SeqID_16914; Position on contig =77409..77510bp; Strand=-
atgaacgatgcggatgatctcgattatactttccatctttcacgttgctgctttgttggctgcaaactaaaatctattaagtataggtttattagaagctga

SEQ ID NO: 5829 - DNA, 1149 bp, Xenorhabdus bovienii
  Coding DNA location: Contig name=SeqID_16914; Position on contig =77532..78680bp; Strand=-
atgctggcaatgccactagcttcggcaggtgtgggttttggaacaacactggtcatgttagtcgccctgtgggcattgatgagttatacagctctcctgctggtagaagtctatcaatacaatgaacccgatactgggctgggaaccattgcaaaacactatcttggtttgaaagggcaattattgaccggattcagtatgctgtttctgatgtatgccttaacatcggcttatatcagtggcgcaggtgaattactgaccagtagcattaatgcatgggcaggttcttcactctcattgtcaacgggcgtgattttattcaccatagttgccggaggcgttgtctgcattggaaccagttccgtcgatttcattaaccggatcttattcagcgccaaactgatctttctggtactgatgcttggcctgatgatgccccatattcgccatgtcaacttgttatccctgcccttggaacaaggcattgtgttatctgctattcctgtcattttcacctcatttggcttccatggcagcgtgcccagcatcgtacgatatatgaaaggagatatccgtaaattacgctggatatttatcatcggtagtgccattccattagccgcttatattttctggcaattgggtactttgggcagcattgctcccacctcatttatgggaatattagccgaaaaatccggtctggatggtttattgggcgccattcgtcatgttgtggcctccccccagacagaattatctgtccggatgtttgccaatctggcactcgtgacatcctttttaggcgttgccttaggcttatttgattttctggctgatctgttcaaacgtcaggataatatagcaggaaggtttcagacagggttgctgacgtttgtccccccactggtttttgcgttgttttatcccaaaggttttataatggctttgggctatgcagctgctgcactgtcaattttagcgctgttactgccgagtattctggtattcaaagctcgtcagcagcataagcgccaatatcgggtctttggcggaacccccgcattagttgtggttttcctgtgtggtatcattctaattgccattcagattggcattgtcgctggaatactgcctgaagtagggtaa

SEQ ID NO: 5830 - DNA, 177 bp, Xenorhabdus bovienii
  Coding DNA location: Contig name=SeqID_16914; Position on contig =78625..78801bp; Strand=+
atgaccagtgttgttccaaaacccacacctgccgaagctagtggcattgccagcatccccgcaccaattgtcgttccagcgacgataaaaatactaccaatagtgcgatttttcacgcgatcctcgcttctgaatatgttgaaaaatagttataagattggcaggttaaaggattga

SEQ ID NO: 5831 - DNA, 111 bp, Xenorhabdus bovienii
  Coding DNA location: Contig name=SeqID_16914; Position on contig =79129..79239bp; Strand=+
gtggacagtctgcttttcaggatttattttcatttggatggaagagagaggctggaatttgggagacacatagcaagtaggagctatggtatgaaagtacaggtaacgtaa

SEQ ID NO: 5832 - DNA, 93 bp, Xenorhabdus bovienii
  Coding DNA location: Contig name=SeqID_16914; Position on contig =79320..79412bp; Strand=-
atgggaaaccatcctagagttcgaatctctatccttccgccaaatttcgccggcttagctcagttggtagagcaactgacttgtaatcagtag

SEQ ID NO: 5833 - DNA, 105 bp, Xenorhabdus bovienii
  Coding DNA location: Contig name=SeqID_16914; Position on contig =79401..79505bp; Strand=+
atggtttcccatcggcggttttcaagaccgctgccttcgaccgctcggccatccttccatggcgcgagattatgcctataccgttctgatgtgtctagtccctga

SEQ ID NO: 5834 - DNA, 117 bp, Xenorhabdus bovienii
  Coding DNA location: Contig name=SeqID_16914; Position on contig =79459..79575bp; Strand=+
atggcgcgagattatgcctataccgttctgatgtgtctagtccctgaaggaaaaaaaatcgtgttttttttactgtttgctcaatcttcgatctgcaatggtctttttattctctaa

SEQ ID NO: 5835 - DNA, 2703 bp, Xenorhabdus bovienii
  Coding DNA location: Contig name=SeqID_16914; Position on contig =79673..82375bp; Strand=+
atgtataaacaagcatctatcaagccatccactattccccgtttttacgcgctatttgttattttgctttttacgtctctatttttattcgggtataactattttgatagttggctcacggagaaaaaatatgctattagcagcgtaactgttaagatgagattgcaaatcgaaaattatcgttatcacgccaatcatatctttgagcaatctaatattccgtcctcttcctcctcctctcaggaggcaacatcattatttaaattgcgtcccgatgtccattggctggaaagccgttataagactgtcgatgcaattatttttggtcagtacaatcattcaagtattcaactagctcagcggttgtctaactatctggaaattctctggggttcccgtaatgaatacgaatctatgtattacctcaatggtaaggataacaatttacttttggtaacgactcatcctattttaaaaccagaaatcaggtttaaggagagttatctgaccctgacgtctgaggccaaacgaactgaaatgttggctcaatcgatagcgctggatgaaaaagaaagcatttcagccatcaatgtgctgcgtggggagaatatttatttctatacttataaagctgcattcaatttgcctgggcaattaactaccgttattgcctttgaactgcccattaataatcttttgccgattgatatgtcaccggcaaactttcgcttgaacttgaccaactcgcatgatgccgagggctccaataaagttgaggtttcactgaacggtttttggctagagttctcccagcatctcaatgccatgccatataaattggtttatcaagtccctctgaaagcactgattatagatttactgatcaggaatatctggctcctgctctcaatattacttttctcaatgttctcattgagtggtttgttctatatccgccgtagatatatcacacctaatgcttcgatggatcatgagttgaaaattaaggactctttaggtaatgatatcatttccaatattcctatcggtttgttgatctacgactttgcatcaaatcggttaatcactagcaataaaatcgcagaacagctgataccttatcttgatttgaataaagttaaggcgatggcacaacaacatcatggcgtcattcaaacatctattgacgacgcgatttatgaagtcaaaatgtataacagcaatctattaccagagacatatctctttctgctgcaagatagagatcaggaggtcatgataaatagacggctccagtttgccaatcgagaatatgataaaactgttcaggccagacgctcaatgctatcaaatattaataatgaaataaaaataccgattcagagcttaaatgagattgctgtccaactgcaacagagatcacaagatgaaagcatgcagaacttgctggataagttattggttaaatcggaatatatcaccaaatgggttgaaaacatttcattactcaatgagctagagtctggtgactggcagtctgctactgaaatattttctctgtcttcacggttggagcatattctgaaagcttccctgtcgacattaaatgccaagggattgaaaacttattaccattttaatcttcatcatgaatctttgttcattggtgatggtgtggcaataactaaaatcatctcgctgttatttaattacgcaatagcggcaaccagttatggaaaaatatcactgtctattaatagttctggtaaatatgacaattacattcaaattgatctcattgataccggttcaggtcttagcgaaaaagatttaaccagtttgaattatcccttcttgaacaagtcagcagaagataagtattatacgaactctgggctaactttttatctatgtaatcaattgtgcaaaaaaatgggagggaattttgaaattaaaagtaagttgggtttgggtacacattatgtcatcaacctgcctcttttgcagcatagtgataacaatggcgaaacgcctcagcttttggaggacgtgacggctttaattgatatcagtaaccctgaaattagtaaaataatccacaattacttgaataattatggtgcgtcatacttcgataaaatcaaagagaatgttacagaagaatacgatattatccttacagatatgcagtacaaagtagaaaaaccaactatattattagtcgatggtttggctgacttgaagaaaatgaaacctaatctggttcagtgtaattataattttgttgatgcggttatcaatgcaatatcgttactggttgaggaaaatttcagtctagatgaatcttgctatgctcttgaaacccctaaatcagaatgcaatattgtcaacagtgttgacaatattctcaagggttaccaaacacagttggcagatagtgattataggaaattatttatagagacagtaccgatggatattactaaactgtatactgatatggaacgacatgatttgacatcactttcgcaaacggtacaccgccttaagggtgcgtttgctatgttagatttaaaattgctcaaatcatcatgtgaggcgttggaacaacacatagcagacaataatgaaatagaaatcaaaaatagcatcagccgtattgattcttttgtcacgaagctgttgcagcaaggtaaccaataa

SEQ ID NO: 5836 - DNA, 651 bp, Xenorhabdus bovienii
  Coding DNA location: Contig name=SeqID_16914; Position on contig =82377..83027bp; Strand=+
atgaataaccttaatgtcattattgccgatgaccatcccattgttttgtttggcatccgtaaatcactcgaacaaattgagtggattaatgttgtcgctgagtttgaaaattcaacgacactcattaacaatttaccgcacatagaagcggatgttctcataacggatttgtcaatgccaggtgacaaatacggtgatggtattaccctgataaagtatattaaacggcattacccaacactggctattattgttctcactatgaacaataatccagctattttaagcgctgtgcttgaacttgatattgagggaattgtattaaagcagggagcacctactgatttgcccagagcactttctgctttgcaaaagggtaaaaaatttacacctgaaagcgtttctaaattgctggaaaaagtcaatgccaatggttatggggataaacccttgtctccgaaagagagtgaagtactgcgtttatttgctgatggtcttcttgttactgatattgctaaaaaacttaatcgtagtattaagaccattagcagccagaaaaaatcagctatgctaaaattgggtgtagataacgatattgcgctgcttaattatttatcatctgtcactattgaaaaagatattggtagataa

SEQ ID NO: 5837 - DNA, 2760 bp, Xenorhabdus bovienii
  Coding DNA location: Contig name=SeqID_16914; Position on contig =83112..85871bp; Strand=-
atgctgtgggcattaggcgccttattaaccagcttttatctggtaaatatttttaatgaagtcaaatcagacattcgtcaagaatataacactaactacgatacaatgttctcttatattcggcatactaccaacaccttgcgggatatccaacatatgacggagaaacatttatcacaaaagaatgaaaaagatctaactattactctgccgtataataaccctgctttttcatatactcctctgaatatgaattcagattgtgatctcttacgtaaaagcacacataattatttagactcattaaataacctgatcttattttggaaagataatattgccgctccacgaggcctgaatcagatctttctggttggtacacaaagtatgtgtatggtgagcttttcagttcgcagtaccataacagaacctgaaacactgaagaaaatggtctacgaaaatttccgtaaactaatcattttgaaagaacaaggaaaagaacggaatgtcttttgggtcatgcctaacacaagagcagacagtggtactttttatattcttgcgccgatctatactaatgggcaaatgacagcagtgataggtatcgaacaagctatcaggttagattcatttctacaaacaagaaatcgacctatttctatcacaatgctaaaccactataatcagcctgagttatattatccagtaaagaatgataataaacttcgttacgctgactataatatacagaccccttattttggttatgacgagggttataccaatttattattaaaacgacgcttagctccttcttcatttaacgttattttttcattgccattaaaaaatatctatgatgaattcaaggtaacaattattaacagtatcgtattgaatattatttctgcgatcctgattattttctttgtctggctatttgaacgtaaaatatttgcccctgctgaagacaatgctattcgtcttgaagagcatgaacaatttaaccataaaattgttgcctctgcaccagttggcatcagtattttacggattaatgatggtgccaatattctcagtaacgaactggcgcataattacacccgaatgctaacatatgaagatcaaaaacgcatcgttgatattatctgcgataaaaccagcacctatatcgatgttgtcaccagtaacaacaatcacctgcaaattagctttgtacattcacgttatcgaaatgaagaagtagcaatctgtgtactagtagatatcagtacacgggtaaaaatggaacaatcattacaggaaatggcgtcagccgcagaacaggctaatcaggcaaaatccatgtttctggcaacagtcagccatgaattgagaacaccactgtatggcattattggtaatctggaactgctgcaatctcatacattgccattagaatctgcacggctgctatcagcaatggataacgcatcatcactgttactaaaaatcatcagcgatattctcgatttttccaaaatagaatctaagcagctcaaaattgattccaagaaattctcttgtaaagaaatcgtattgcatgtgatctcaaattatcttcctctcattgtgaaaaaagagttgggattatactgctatattgaaccgaacattcccgatattatcaataatgatcccgtaaggttgcagcaaatcatctccaatctgctgaataatgcaattaaattcacagaaactggctgtgttgtcattaccatttcgataaagcatagttacctgtatatcagtatcaaagataccgggtttggaatcgaagataaattacaaactcagttgtttgaaccattttttcaaatcaacgccaataaacaaaacttctcgcaaggtactggattgggattagtgatttgtgaaaaattgatcaatttgatggatggtgatatcgaatttgtttcacaacagcatattggtagtatcttttctatccgccttccactgtatggagcaaagtatcataccaaagagtattccaagaatcgtactcaacaaaaaatcgtactggctgttcgcaatgactatctagaaaaatatttacagaattttcttacgaagaactattttcagattgccttatatgacaaaaataaaatagatggcacagaactagtgatcattgaccagcctgatgtactagacattactgtacgttactacatagagatatcagaaaaacatattgggccgccaaaacaaattcgagaacattattggttacataacacttatcaactcagcgagcttgacagtgtcatcgataaactgctatcaaaaaataatcatgtctctcctgccactatatcaacgtcaacatcaattcaggcagatagccggttgagtaccattaagatcttggttgttgatgatcaccctttaaaccgacacttattgatcgaacaattaaatacaataggattcaaaacagccgcagcgaatgatggtattgatgccatcgagcacctgaaaaataattcaacggatattattctgacagacgtgaatatgccaaatatggacggatatgaattcacaaaatacctgagggataaaggatataccagccccatcattggcatcactgccaacgccctggcagaagaaaaacaacgttgtacggatgcaggaatggatcactgtctatcaaaacccgtctcattggcaatattaagggatacattaatagaatacagtgatatttaa

SEQ ID NO: 5838 - DNA, 147 bp, Xenorhabdus bovienii
  Coding DNA location: Contig name=SeqID_16914; Position on contig =85816..85962bp; Strand=-
atgtttttcatcaggcgaccttttgagatatctatcttcttttcaaacgtcactaaagatatcccgttacctttttcgggtgcttggctttatgctgtgggcattaggcgccttattaaccagcttttatctggtaaatatttttaa

SEQ ID NO: 5839 - DNA, 105 bp, Xenorhabdus bovienii
  Coding DNA location: Contig name=SeqID_16914; Position on contig =85965..86069bp; Strand=-
atgcctgctttttttgtgcaatttttttacaaagaacttacaagaaccaaatgctgctttgtattccctgctacactagtatatgctgtgaatagttattattaa

SEQ ID NO: 5840 - DNA, 2661 bp, Xenorhabdus bovienii
  Coding DNA location: Contig name=SeqID_16914; Position on contig =86123..88783bp; Strand=-
atgagggatagtggctccatgagcgacattgccagagaaatcacaccggtcaatatcgaagaagagctgaaaagctcatatctggattatgcgatgtccgttattgttggacgcgcactgccggatgttcgagatggactgaagccagtacaccgccgcgtactttttgcgatgaatgtattgggaaatgattggaataaatcctataaaaaatcagcccgtgttgttggggatgtgatcggtaaatatcacccgcatggcgacagcgctgtttatgacacgattgtacgtctggcacaacccttctctatgcgttatatgctggttgacggtcaggggaactttgggtcagtggacggcgattctgcggctgcgatgcgttataccgaaatacgcatggcgaaaattgctcatgaattgctggcagatctggaaaaagaaactgtcgattttgtgcctaactatgatggtacagaacagatccccgtagtgatgccaacccgtatccccaatcttctggtgaatggctcatcagggattgcagttggtatggcaaccaacattcctcctcataacttatctgaggtgattgatggctgtctggcttatattgatgatgaaaacatcagtatagaaggcctgatggaatatatcccaggacctgatttcccgacagcggccattatcaatgggcgcagcggaattctggaagcctatcgcaccggccgcggtaaaatttatattcgcgcccgcgcaaaaattgaaactgacgaaaaaaatggccgcgaaaccattatcgtcaatgaaatcccctatcaaataaacaaggcccggttgatcgaaaaaatcgccgagctggtgaaagataagcgcattgaaggaatcagcgcactgcgtgatgaatccgataaagatgggatgcgtattgttatcgaagtgaaacgcgatgccgtggctgaggttgtcctgaataacctatattcactcacgcagttgcaggtttcattcggtatcaacatggttgctctgcatcagggtcagcctaagctgcttaacctgaaagatattctttccgcgtttatcaaccatcgccgtgaagtcgttacccgccggactatctttgaactgcgtaaagcccgcgatcgtgcacatatccttgaagcactggctatcgcactggtcaatatcgattctgccatcgaattgatccgtcgggcatcaacccctgccgaagccaaagcaaatctgattgcccaagcgtgggaactgggtaatgttgcagcaatgctggaacaggctggtgatgatgctgcacgccctgaatggctggagccggaatatggcattcatgacggcaaatattacctgaccgaacagcaggcacaggccattttggatctgcgcttgcagaaactgaccggtctggagcatgaaaaactgctcgatgaatatcgtgaactgctgaaattaatcggcgaattgcttttcattctggaaaacccagaacgtttaagagaagtcattcgtgaagaactactggccatcaaagatcaatataacgatgcccgccgtactgaactcactgaaaactcagcggatatcaatattgaagacctgatcaatcaggaagatgttgtggtaacgctgtctcatcagggatatgtgaaatatcagccattgtctgattacgaagcccagcgtcgtggcggcaaaggcaaatcagcagcacgtatcaaagaagaagacttccttgagcgtttactggtcgccaatacacacgatactatcctctgtttttcaaacaaaggtaagatgtactggatgaaagtctaccagttgccggaagcaagccgtggcgcgcgtgggcgtccgattgtcaacctactgccactggagcaagaagaacgcattacagccatcttgccagtacgtgaatatgaagatgggctgaatatcttcatggcaaccgccagtggaactgttaagaagactaaactcagtgaattcagtcgtccacgtagtgccggtattatcgcggtaaaactaaatgacggtgatgaattgatcggtgttgacctgactgatggcagcaacgaagtcatgctgttctctgcgaagggtaaagtcgttcgcttcctcgaagaagatgaagagactctggaagacggtactatccgtgtgaaaggtgtgcgtgcaatgggacgtacagcggcaggggttcgtggtatcaaactgagtgcaggtgataaagtcgtctctctgatcatccctcgtggagaaggagaaattctgactgtcaccgaaaatggctacggcaaacgtactgctcagagcgaatatccgactaaatcccgtgcgactcaaggggtcatttctatcaaggtcagcgagcgcaacggtaatgttatcggtgcaattcaggttgaacccactgatcagatcatgatgatcaccgatgcgggaacactagtacgtacccgtgtttctgaagtcagcgttgttggccgtaacacgcagggtgttactttgatccgtacagcagaagatgaaaaggtcgttggtttgcagcgtgttgctgaacctgatgaagatgaagacgaagaaaataatataacgtctccttctgatgaagggaatagcgagtcagaagatcaggtataa

SEQ ID NO: 5841 - DNA, 195 bp, Xenorhabdus bovienii
  Coding DNA location: Contig name=SeqID_16914; Position on contig =88793..88987bp; Strand=-
atgtgtgaatcggggattttgacgttcatcagcgatatcgctcctaggaactgcttcatagaaaactgctccacagaaagtgtaacagtattatggggatgtgtgataagagggtattatacatgccttaatcttgaaatacccgcatctggtttttataaaactgtcaatttgtggtataatttaagcctttga

SEQ ID NO: 5842 - DNA, 765 bp, Xenorhabdus bovienii
  Coding DNA location: Contig name=SeqID_16914; Position on contig =88929..89693bp; Strand=+
atgaagcagttcctaggagcgatatcgctgatgaacgtcaaaatccccgattcacacatcccgtctcaccccaatgtggatcaacaggaaatcgaaaaatttgaagccgttgcttcccgctggtgggatcttgaaggtgagttcaagccattgcaccggattaacccactgcgtttgaactatatcctgcaacgtgccggaggtcttttcggcaaaaaagtgctggatgttgggtgtggcggtgggattctgtcagaaagcatggcgcgtgaaggtgcggatgtgacggggctggacatggggtttgaacctttgcaggtcgcccgattgcatgcactggaatccgatacttcagtcacttatgtgcaggaaacggtagaaagccatgctgaacagcatctgcattcttatgatgttgtgacgtgcatggagatgctcgaacatgtgccagatcctgaatccgtgattcgcgcctgtgccaaattggtcaaaccgggcggccatgttttcttctcaacgattaatcgtaatcgtaaagcctggctaatggctgtcattggtgctgagtatattttgaacatggtgccaaaagggacgcatgatgcgaaaaaatttattcgcccttctgaactgattggttgggtagataagactcctctgaaagatcagcatattattgggttacattacaacccgctgacagacaaatttcgacttggacacaatgtagacgtgaactacatgcttcatactcaatcggtttaa

SEQ ID NO: 5843 - DNA, 186 bp, Xenorhabdus bovienii
  Coding DNA location: Contig name=SeqID_16914; Position on contig =89602..89787bp; Strand=-
atgttactttcacaaaactatcggcgaaacgggggaaataaaatcttaaaaataatatctatttgccgttttattaatcccttaactgtcacgtttaaaccgattgagtatgaagcatgtagttcacgtctacattgtgtccaagtcgaaatttgtctgtcagcgggttgtaatgtaacccaataa

SEQ ID NO: 5844 - DNA, 111 bp, Xenorhabdus bovienii
  Coding DNA location: Contig name=SeqID_16914; Position on contig =89775..89885bp; Strand=+
gtgaaagtaacatcaagtaactacgcaggttatcggcttttcggcaaaattaatcctcaagttatccacaaaacttccccgttttgtgcacttgaaaaaatgcggatttaa

SEQ ID NO: 5845 - DNA, 93 bp, Xenorhabdus bovienii
  Coding DNA location: Contig name=SeqID_16914; Position on contig =89969..90061bp; Strand=-
atggggaaatacaccttctctttatcgtatctcgcctttatcgcctttcttgacattgacatattgacagcacgatgtacccgaaatggctaa

SEQ ID NO: 5846 - DNA, 2292 bp, Xenorhabdus bovienii
  Coding DNA location: Contig name=SeqID_16914; Position on contig =90060..92351bp; Strand=+
atgaaccagagtctgctagtaaccaagcgtgatggacataaagaacaaattgatctggagaagatccacagggtcgttgcctgggctgccgaaggtctgaaaaatgtctcagtgtcacaagtagaactgcgttctcagattcaattttacgatggcatcaaaacagccgatatccatgaaaccatgatcaaggcagcggctgatttgatttctggcgatgcgcctgattatcagtatctggcggctcgtttggccatcttccatctgcgcaaaaaggcttacggtcagttcgaaccacctgctctgcatgatcatgttgtacgaatggtgaatttaggcaaatacgacaagcatttgctggaagactattccaaagaagaattcgagcaaatggacagttttattgaccatttgcgtgatatggatttctcctatgcagccgttaagcagcttgaagggaaatatctggcacagaaccgtgttaccggtgaaatttatgaaagtgcccaatttctctacattctggttgcagcgtgcctattttccacttatccaaaagaaacgcgcctgagctacatccgtcgtttttacgatgcggtttcgacgtttaaaatttcgctgccaacgccaatcatggcgggggttcgcacaccaactcgccagttcagctcctgcgttctgattgagtgtggtgacagccttgactctatcaatgcaacatccagtgcgattgtaaaatacgtttcccagcgagcgggcattggtgtgaatgcaggccgcatccgtgctttgggtagcccaatccgtgatggtgaagctttccatacgggctgtattccattctataaacacttccagacagccgtgaaatcctgttcgcaggggggggttcgtggtggtgcagcgactttgttctatccgctgtggcatttggaagtagaaagcttgctggtactgaaaaacaaccgtggtgttgaaggtaaccgcgtgcgccatatggattatggtgtgcagctcaataaattgatgtatgaacgcctgatcaaaggggaagacattactctgttcagcccatctgatgttccagggctgtatgatgcgttctttgcggatcaagatgaatttgagcgtctgtacactcagtacgaaaatgacgtcactatccgtaaagaacgcattaaagcagtggagctgttctcactgatgatgcaggagcgtgcttcaaccggccgtatttacatccagaacgttgaccattgtaatacacacagcccatttgatccggcggttgcacctgtgcgtcagtcaaacttatgtttggaaattgcactgccaaccaagccaatgaataatatcaacgatgaaaatggtgagattgccctgtgtacattgtctgctttcaacctgggtgccattaataatctgacggaactggaagaattagcggaattggctgttcgtgcactggactccttgttggattatcaagattacccaatcatcgcggctaaacagggctcaatggggcgccgtacgctgggcattggtgtgattaacttcgcttattacctggcgaaaaacggtgtccgttattctgatagtagtgccaataacctgacacacaaaacatttgaagccattcagtattacctgctgaaagcctcgaatgggctggcgaaagagaagggtgcttgcccgtggtttggtgaaaccacttatgcacagggtatcctgccaattgatacttacaaaaaaacactggatacattgacccgcgaacctctgcatatggattgggaagccctgcgtaatgacatccggcagcatggcctgcgtaactcaacattgtcagcattgatgccgtcagagacgtcttcgcagatctccaatgcgaccaatggtatcgagccaccacgcggctatatcagtatcaaggcatcaaaagatggcatcttgcgtcaggttgtaccggaatataaccgtctgaaaggggcttatgagttgctgtggcaaatgccgggtaccgatggctacctacagctggtggggatcatgcagaaattcatcgaccaatcgatttctgccaatactaactatgatcctgctcgtttcccgaacggcaaagttccgatgaatcagttgctgaaagatttactgctcgcttacaaatatggcgtgaaaacactgtattaccacaacactcgtgatggagcggaagatgttcagggtgatctggaagaagtcgttgagtctgctgattccgattgtgacggcggcgcgtgtaaaatttga

SEQ ID NO: 5847 - DNA, 1131 bp, Xenorhabdus bovienii
  Coding DNA location: Contig name=SeqID_16914; Position on contig =92364..93494bp; Strand=+
atgtcctataccactttttcacaagtaaaaaatgatcaactacaggagccgatgtttttcggccagcctgtgaacgtagcgcgttatgatcagcagaaatatcctatttttgagaagctgattgaaaaacagctttcgttcttctggcgtcccgaggaagttgatgtttcccgtgatcgcattgactacaatgcattgccggatcatgaaaaacacatttttatcagcaatctgaaatatcaaacgctgttggattccattcagggccgtagtccgaatgtggcattcctgccgctgatttccattccagaattggaaacttgggttgaaacatggtcgttttcagaaacgattcattcgcgttcctatacgcatattatccgtaatatcgtcaatgatcctgccgttgtatttgacgatattgtagccaacgagcagatcttaaaacgcgccaaagatatttcggggtattacgacgttctgatcgaaatgactaactactatcatcagctgggcgaaggtacatacaatgtggcgggtaaaaacattacagttagcctgcgcgcattgaaaaaacagctttacctgtgtttgatgagtgttaacgctctggaagctattcgtttctacgtcagttttgcgtgttcattcgcttttgcggaacgcgaattgatggaagggaatgccaaaatcatcaaactgattgcgcgtgatgaagctctgcatttaacgggaacccagcatatgctgaacttactgcgctctggtcaggatgaccctgaaatggcagaaattgccagagagtgtgaacagcagtgttacgatctgtttgtgctggcggctgaacaagaaaaggagtgggcagattatctgttcaaagatggctccatgattggtctgaacaaagagattctgtgccagtatgtcgaatatatcactaatatccgcatgcaggcagtgggtttgaagctgccatttgaagctcgctccaacccaataccatggatcaatgcatggctggtttctgataatgttcaggtggctccacaggaagtcgaagtcagctcttacttagtcggtcagattgattcggaagtcaatgctgaggatctcagcggtttcgaactctga

SEQ ID NO: 5848 - DNA, 300 bp, Xenorhabdus bovienii
  Coding DNA location: Contig name=SeqID_16914; Position on contig =93463..93762bp; Strand=+
atgctgaggatctcagcggtttcgaactctgatatggctgattacaaagttaccctgccgtcacggcagggtttatccgtccattattcttctggtttccaccgtaacctactggaagccttggaacaaggcaaagtacagcttgaataccaatgtcgtcagggatattgtggttcctgtcgggttcgtttggtgaaaggaaaggtcggctatccctgcaagccattggcatttgttaatgagggtgagatcttaccttgtagttgccatccactcactgatattgaaatcgaaccgtga

SEQ ID NO: 5849 - DNA, 252 bp, Xenorhabdus bovienii
  Coding DNA location: Contig name=SeqID_16914; Position on contig =93909..94160bp; Strand=-
atgacatgcagtttaatggtttatgctgcactggagcataaaatccgcaccggactgaagcaaaatgccccgttctatcccgatatgaaaggtaaacccacccaatctcccacggcgcgttgggtgtttttgaccttcgaagggattagtactttcgagtttcaggaacaccgtatggtgacgggaatacagatgtatcaaaatgaactgctgaaaatattggggcaaccctatgaatcattttattcctga

SEQ ID NO: 5850 - DNA, 1407 bp, Xenorhabdus bovienii
  Coding DNA location: Contig name=SeqID_16914; Position on contig =94120..95526bp; Strand=-
atgtctctctctgaacctgccatcaaacgtctcgatcacctcggccttgtcgccgctttttgccatgagatcggtttaccccgcatgattgatgctattttgcctaaatatgcagagcatacggtttctcatggcgaggctcttttagcgatgatcctcaatgggttgggtttccacagtcgaacgctccatatgtgccctgatttttttaagcacaaacccgttgaacgcctgattggggtgggaattatggctgaacacctcaatgatgatgtgctcggccgcacgctggacgctttgtttgactgcggtgtctctgaaatttatcaggttatcgctgagcgggttattgataaattggcattaaaatccgattccgttcaccttgatatcacgagttttcacgtggatggtgagtacaaactccccgatgatgacgagacaaaacgcctcgttttggtgcgtggttacagtcgtgatcaccgtcctgacctgaatcaggttgtgctgcaacttatctgtgaaaatcaggcggggatccccgtatacatgcaggcgatgagcggaaacaccaacgacaccaaagcgtttgcagagacgacgaaacatcacattggctgcctgaaagcggcccaaaacagccgttatctgattgccgatgccgcgctttatacccaagagacactggcctcacttcatcaacaaaatcaaaaatttattacccgggttccgttaaccattaaagaggcgaaacagcacctgctgacggttaataccgaccagttacaaccggttacagaaggttatgccggtcattggattgaatcttgctacgggggcgttccacagcgctggttactggtcaacagtgaagcggcgatgcagtgtgaacatcagactttcaggaaaaatacgcggatttcgacggaaaaagaactgaaacagttcgaaaaactcagcaaaaagtcgtttccctgtggtgaagatgctttgcaggcattgtgtgacttcgaagcagaatgccagtttatcggcattgaggcccccaaagttcaaaaaatcgaggtgcataaggggcgaggccgcccggctaaaggtcaacatcccgatagtgttcattatcagctttctgcctcggtctacagccaactggggaaagtggcttatgcccgcctcaaagtcggcatgttcattctggcgacgaatgaaatggacgataaggcgctgaatatggaaactctgctggctaattacaaagcgcaacaaaaagtcgagcggggtttccgtttcctgaaaagtccggagtttctgacttcagcgatttatttgaaaaagccagaacgcatcgaaggcgttattaatgataatgacatgcagtttaatggtttatgctgcactggagcataa

SEQ ID NO: 5851 - DNA, 114 bp, Xenorhabdus bovienii
  Coding DNA location: Contig name=SeqID_16914; Position on contig =95618..95731bp; Strand=-
gtggacgcggtaagtcagtgtattgtattaccgactataacaaaagtgcagataatttcattgattaacttatccgtcattccgcacctcattcctgatttaaaaatcatgtga

SEQ ID NO: 5852 - DNA, 441 bp, Xenorhabdus bovienii; identical to SEQ ID NO: 2208
  Coding DNA location: Contig name=SeqID_16914; Position on contig =95734..96174bp; Strand=+

SEQ ID NO: 5853 - DNA, 537 bp, Xenorhabdus bovienii; identical to SEQ ID NO: 2180
  Coding DNA location: Contig name=SeqID_16914; Position on contig =96200..96736bp; Strand=+

SEQ ID NO: 5854 - DNA, 492 bp, Xenorhabdus bovienii; identical to SEQ ID NO: 5630
  Coding DNA location: Contig name=SeqID_16914; Position on contig =97010..97501bp; Strand=+

SEQ ID NO: 5855 - DNA, 354 bp, Xenorhabdus bovienii; identical to SEQ ID NO: 1741
  Coding DNA location: Contig name=SeqID_16914; Position on contig =97438..97791bp; Strand=+

SEQ ID NO: 5856 - DNA, 162 bp, Xenorhabdus bovienii
  Coding DNA location: Contig name=SeqID_16914; Position on contig =97895..98056bp; Strand=-
atggattctatctcatgcattatcattcgtactggtaggcgtatcgcgttttcgaaagaacttgccattgcttatgtaagaataagtttccattatttatatcacgctatattaacgtctttctatattttcaccatccattttatggaaaaaataatgtaa

SEQ ID NO: 5857 - DNA, 99 bp, Xenorhabdus bovienii
  Coding DNA location: Contig name=SeqID_16914; Position on contig =98277..98375bp; Strand=+
ttggttgaatgtttcaatttcattgtcaactttttatctgagtctttaatgaatggtttagtcagcctaaacagtgatttgtcaaactttaatatttga

SEQ ID NO: 5858 - DNA, 453 bp, Xenorhabdus bovienii
  Coding DNA location: Contig name=SeqID_16914; Position on contig =98442..98894bp; Strand=+
atgggtaagctatcgtgtttcccagttatggtgatggtaatagcaatgctgatatgcaatattgctgaagccaagtcaccctatgatggcgattatttgtgcaaaataaataaagaattgaacgatgtgactatcaagaatggggggatgtactttttcccgactaaccttgatacggccagagtttcctatagagatgagagttttactatttatgaaacaaggccagaagtgttcatgagtcctaaattaaccccgattacaaaatttggtatcttaaacaaaaaggaactaacggaaatgggggaaaacacattgatatatggaggagaggggcgtggtctgggctattttaggccaagtcaaaacgaatttttcatttctaagataaagattcctaatgtgaagggggcttatatcctgtctcttgaacattgtgttaagcagttgtga

SEQ ID NO: 5859 - DNA, 144 bp, Xenorhabdus bovienii
  Coding DNA location: Contig name=SeqID_16914; Position on contig =98869..99012bp; Strand=+
ttgaacattgtgttaagcagttgtgaattattcaaagagcagccccgaaggggcttcttcctgatctggtatcgtcacaggaatcaggatactgtgtcaaagcaagaaaagctttgtagggctaagaaaatttacatttggtag

SEQ ID NO: 5860 - DNA, 153 bp, Xenorhabdus bovienii
  Coding DNA location: Contig name=SeqID_16914; Position on contig =99027..99179bp; Strand=+
ttgaatgatcctatccttcctatctgtgatgataaagtcactcgattagtgctttatggcgtcataagagaagacatgatgcatatccgctacactattccaatagtctattccattgttagtctatgctcggacaacagtgatagcttttaa

SEQ ID NO: 5861 - DNA, 486 bp, Xenorhabdus bovienii
  Coding DNA location: Contig name=SeqID_16914; Position on contig =99259..99744bp; Strand=+
atggttgaattaaaaccgggaaaacatgtattagaaacatcagatggtaagaagcaacctttcctagtttattcaaaaaatcaaggaggaattatcaatccaaacagagaattatattatacttacaatatggtgtacgctattgaaaaccatgaaaataagttttcaccacaaaatacagaagttgtcattgatggtgtgacgcttgaagggccaattcgcagtagtgacgctgtatttattgataacaatgtttttcggtgtacatatccaattggaacgccatttccagaagaaattgtaatttatgataaaaaaagtaaaggaaatattaaaagtaaatgctttagaaaaaaagagtttattgatttttatgagcaagaatcaggagaggcactacattctgaacacgattcattaaatagtaatgatacttggattcgcctaataagctaccgtcttgatggtcaagttctaatagcatag

SEQ ID NO: 5862 - DNA, 1014 bp, Xenorhabdus bovienii
  Coding DNA location: Contig name=SeqID_16914; Position on contig =99726..100739bp; Strand=-
atggcatcaaataagaggagggttattatgtattatgtcggaatagatgtcagtaagaataaactggatatttgtttgttatatgatggagttaaaggtaaacgcaaaacaaaatcccttctgaataatgaacattcagcctgtatgttaatagcgtggctagctaaatatattcctgccctgcaacaagtcaatatcgttatggaagccaccggagtctatcatgaacggttggcttattcccttcatcaggctgggggaaggattgcaatagccaaccctttacgcgtgcgtgattttgctaaaggtatggggatactgactaaaacagacaaagtagatgcctatattttagcctgttacagtgccttaaaacaacccgatgtctggcaacctcctcctatagaaattcgcgaattgaaggctctcctatgccgtcgggatgcgttattagaagatatccagcgtgaacgtaaccgatatgaaaaaagcggctcaacccataccccaaaaagggttattgagtccatagaggcaatgatgcatcacatgaaaaatgagttagccgagcttgaggctcttattgccgagcatataaaccagcaccctaatttaaaaaaagattttgaacttttaacctcaataaagggggttggaactcagattggtcttaacatgctgattatcttacgtacgaatacctttactcgtgcaacgcaagtcgctgcatatcttggtgttattcctattgcaaagcagtcaggtacatcggtgcatggtcgagtgcgcttatctaaaacggggcctactaaaatccgtgctaagttgtttatgtctgcactcacagcagttcgttttaacccccacataaatgatttatataatcgattggttaataaagggaaggcaaaaatgttggctttaggcgctgcgatgcgtaagttagttcatttgtgctacggagtattaaatacgcagcaatcatatgatgaaaactatgctattagaacttga

SEQ ID NO: 5863 - DNA, 165 bp, Xenorhabdus bovienii; identical to SEQ ID NO: 4438
  Coding DNA location: Contig name=SeqID_16914; Position on contig =100733..100897bp; Strand=+

SEQ ID NO: 5864 - DNA, 93 bp, Xenorhabdus bovienii
  Coding DNA location: Contig name=SeqID_16914; Position on contig =100863..100955bp; Strand=+
atgaggctcaccttgtttcttatgatggtagctaaccaccataattactatgatacaagtgcaatttttcagaagggcggtcagttgctatag

SEQ ID NO: 5865 - DNA, 612 bp, Xenorhabdus bovienii
  Coding DNA location: Contig name=SeqID_16914; Position on contig =100988..101599bp; Strand=+
atggcctatacacaactgaccgaaatagaaagatatcagatttccagtttaaaggaagccggttttacacaacgttttattgcaacgtcgctcaatcgaaatccatcaacaattagccgggaattgaaaagaaatcaggcggtacagaaatactgccctcaacaggctcagcttaaggcgtcagaacgtcgccattctgccctaaaagcagtcaaggtgacgccagagataacaaagtggattaatcagttaatttggcaagatttaagtcccgaacaaactgtgggttatctcaagcgggaaatgagaatatctttacatcatgaaacgatttatagattgatttacaaagataaaattaatggtggtgatttatggcagcatctaaggattgctaaaaagccgtatcgtaagcgctatggaagttatgagcgcagaggaaaaatcaaaaacagagtcagtattgataagcgtccaaaaatcgttgataaaaaacagcgcattggtgattgggaaggtgatactatcgttggaaaagatcataaaagtgcattattgacattggttgaaagaaagtcgctatttaccctcattattaaacttgaaacttaa

SEQ ID NO: 5866 - DNA, 96 bp, Xenorhabdus bovienii
  Coding DNA location: Contig name=SeqID_16914; Position on contig =101646..101741bp; Strand=-
atggattttcgtaatttaaaattaaaatcagagttaggaatatttgatattatagccactaatcacaagtataatcttatgccttttttattatga

SEQ ID NO: 5867 - DNA, 132 bp, Xenorhabdus bovienii
  Coding DNA location: Contig name=SeqID_16914; Position on contig =101836..101967bp; Strand=+
ttgagtgataatctaaatcaacctttatttatttcttatgtactggatgtatctatatttagatgtgtagttatcacggtgatatctatggggaggttttttggcgttttggttgaattgcagtcaatttga

SEQ ID NO: 5868 - DNA, 108 bp, Xenorhabdus bovienii
  Coding DNA location: Contig name=SeqID_16914; Position on contig =102059..102166bp; Strand=-
gtgtcacaatttataaccctaaaggaaatcatcatgaaatctgtaaaatctttcctctcaaacgtacataacgtcgttatccgcctgtcaacaactcgctttatgtaa

SEQ ID NO: 5869 - DNA, 114 bp, Xenorhabdus bovienii
  Coding DNA location: Contig name=SeqID_16914; Position on contig =102135..102248bp; Strand=+
atgatttcctttagggttataaattgtgacacacttcacgaaaatataaattctgaaggagattttatgctcaaaataaaaagagtcaaggcatttattaaaatatttttttaa

SEQ ID NO: 5870 - DNA, 105 bp, Xenorhabdus bovienii
  Coding DNA location: Contig name=SeqID_16914; Position on contig =102309..102413bp; Strand=+
ttgtattttttatgttgtcatattggtttgcttttgttctgtaattgtttttcttttggttttcacacagatagtggagtaatctcactgatttttctaagctag

SEQ ID NO: 5871 - DNA, 93 bp, Xenorhabdus bovienii
  Coding DNA location: Contig name=SeqID_16914; Position on contig =102425..102517bp; Strand=-
atgccattttcactgatttccattagttatctccagctacttgagttcatcgttaagttaaatttttcagaaaaaacactcgttaaatgttga

SEQ ID NO: 5872 - DNA, 435 bp, Xenorhabdus bovienii
  Coding DNA location: Contig name=SeqID_16914; Position on contig =102495..102929bp; Strand=+
atggaaatcagtgaaaatggcattaataagataaaaagttatgaaggtttgagattgcacgcatatcctgatcctgccacaggtgctgaaccatggacaattgggtatgggcatacaaaaggagtgaagccagaacaaataattacagagcaacaggctgaaacatttttgcatgaagatctgataccaatttatgctgagattcaaagaattgtgaaggttcctttaacacaggggcagtttgatgctttatgctcgtttatttttaatttaggagtaggtaattttattcattcaacgttgctgaaaaagttgaatttggctgattatcaaggtgctgctgaggaatttttgaaatgggatagggcggatggacgtgtattagccgatttgcgtgttcgaagagcatctgagcagaaaatgtttatgtcataa

SEQ ID NO: 5873 - DNA, 102 bp, Xenorhabdus bovienii
  Coding DNA location: Contig name=SeqID_16914; Position on contig =102889..102990bp; Strand=+
gtgttcgaagagcatctgagcagaaaatgtttatgtcataacacgatgttgataagaccttattacgaaatgcaaaaaatattaattgctggattcgactaa

SEQ ID NO: 5874 - DNA, 108 bp, Xenorhabdus bovienii
  Coding DNA location: Contig name=SeqID_16914; Position on contig =103016..103123bp; Strand=-
ttgataagcccgaatttattgttcagatttaaacattatcataataaaccattttatttactattcttagaacggagctgtgttaaaaacccttactatagcaactga

SEQ ID NO: 5875 - DNA, 96 bp, Xenorhabdus bovienii
  Coding DNA location: Contig name=SeqID_16914; Position on contig =103092..103187bp; Strand=-
atggctatcgtgtcgtattacaaaatacaccaccacatatttaatccatattttttattcgggcttgataagcccgaatttattgttcagatttaa

SEQ ID NO: 5876 - DNA, 396 bp, Xenorhabdus bovienii
  Coding DNA location: Contig name=SeqID_16914; Position on contig =103144..103539bp; Strand=-
atgaaaacaacacctgtccttaggattgccagaccaacagacaatttgtctataatcaaagatatgtattgcaaaggattacaatttactctattaggtgaattcagagatcatgataattttgatggtgttatgttagggcatcccaatcattcttggcatctcgaatttactcaccaccacaatacatctgttggtaaagcaccgacacaagatagtttattggttttttatatcgaagatgagtctgagtggcagaaacagagccaattgatgcaagaagccggtttttctcttgtcccctcttataatccttattgggatcgaaccggaaaaacattcgaagatattgatggctatcgtgtcgtattacaaaatacaccaccacatatttaa

SEQ ID NO: 5877 - DNA, 357 bp, Xenorhabdus bovienii
  Coding DNA location: Contig name=SeqID_16915; Position on contig =783..1139bp; Strand=-
atggcatggcacagcgtgacacagtcacaaaccttgacggggaaaagtcgccggacgttataccgtgatatggcaaaaggtcgcctgtcatggcagacgaacgcgaatggacatcgtgaaatagagaccacagagctgatccgcgtttacggtgaactagtgaaatctggcacagcggaatggcccagagagacacagtcaaatggcacacaacatcagtccgaattgctcacggaaattcggactttgcgccaggagatcgcggatctgaaagccacggtgttgagactggaatataaaccgacaccgacgagagatttgaaagataaaaaatggtggcaatggtggcgttcataa

SEQ ID NO: 5878 - DNA, 180 bp, Xenorhabdus bovienii
  Coding DNA location: Contig name=SeqID_16915; Position on contig =1669..1848bp; Strand=+
atgaacaagcaagagaaaagttgcctgaatattgcaaaattcattcggggacagacgctgttattgctggaaaaaatcaatgaactggatttggatgatgaagcggaggcgtgtgagaagttgcatgatgatgccgaggctctctatcatcaattagtgtcgagatacggtgaggaatga

SEQ ID NO: 5879 - DNA, 255 bp, Xenorhabdus bovienii
  Coding DNA location: Contig name=SeqID_16915; Position on contig =2252..2506bp; Strand=-
atgaatatgaatcaagactggcaccccgccgatatcatcgctgcgctacgcaaacaaggaacgaccttagcggcaatctcccgtaaggcaggattaagttcatccacattagccaataccctgatccggccttggccaaaaggagaatggatcatagctaatcaacttgaaatgcacccttcccaaatttggccaagccggtatttcgatagcacaggccatttgatcgagcgcaaacccagaaaaaccccatga

SEQ ID NO: 5880 - DNA, 225 bp, Xenorhabdus bovienii
  Coding DNA location: Contig name=SeqID_16915; Position on contig =2776..3000bp; Strand=-
atggctaaactcttcacttatcaaacctcaaaaaatacctatgcactggcacgagatgcagctgatttaattaagtgcgcagaatatctctgccgacaaaatgacatacgtgagaatatgcaacacctccatagttgtatctacgccaccatgaaaaaaatacgcaaggtaagccgattgttggaaacctatgaagtgaatgaagtcatcgagactcgccagtaa

SEQ ID NO: 5881 - DNA, 201 bp, Xenorhabdus bovienii
  Coding DNA location: Contig name=SeqID_16915; Position on contig =3522..3722bp; Strand=+
atggatgagagagacgaattgatgcagcaaataagtaatttattgatcaatagtccggtgagatcagaggataagctggctgtgatgatgatgttttgttttcaactattgtcatcaactcagacagatggggtgaatatgcgtgtttctgatagcagagtcttatcattaaaatttgaattagaaacattgaaattataa

SEQ ID NO: 5882 - DNA, 891 bp, Xenorhabdus bovienii
  Coding DNA location: Contig name=SeqID_16915; Position on contig =3760..4650bp; Strand=+
atggatattaaaagacaaaatgaactattgaattttcatttgggtggtattgtgcaaatagataaggctgatggaatattaaagcctagggagagtacttctcaagcgattgaaaaaatgattcagcaattagataaaaatacagaactttatgttttattgacattagaagaagctgtcgatgctgtaaaaaatctatgtgggcctaacccaaatgcgtcatggaaagatggtttattttcatgttcagatattgtgacatcatttacgggtagtattattgatgcttatggtgcgctaaagctagcaaatgaactcagtagtaattttggtgtgaaagttaaggaatatattgataagcatggcaatagaaacataaagttaacgggtcgaacaggggttaggaattttttgacggctgcaaaatatggcgtgaataactggaaaatgatagaaatgggaataggatcgcaaggaatgcaaagtggtataattactggggctagatattgtatttttgttagtgctgcttataggtctcttgaattattgtttagggatgaatatgatgttcatagttttttcggaaatatttctatggatgtagcaaaaacagccgtaggattttttgctggcatgggggctaaggctgttgtaggaacttttttaactgctggcacctatgcccttgctgtatctgttggaatttttctagttggttttggagttgcgataatactatatcatcttgataataaatatgaaataagcaaaaaactgataaattttatgcgagaggatgcgataaggtatgccgaaaggaatagagtaaattacggacctcatcctgataaagttttcagcgagttagggagagcttggcgtggataa

SEQ ID NO: 5883 - DNA, 480 bp, Xenorhabdus bovienii
  Coding DNA location: Contig name=SeqID_16915; Position on contig =5073..5552bp; Strand=-
atgtcatatatgatttatttatcgttaaatggtaagaagcaaggcttaatatcagcagggtgttctactctcgattcgataggaaaccgataccaaaaggggcacgaagacaaaatacaggtattgagtttaaatcactcgctaatgcgtcaacagaacgtaagtcataatccagtacaattcgtcaaacccatagacaaatcctccccattattagcaatggctatagattccaacgaatcactgaatggcgcatttattttctatagaacaagccaaataggacaactagaacttttttatgaagtcaaaatcacagaggcaactatcactgatctttcctgtgtctacccacactctataaatgaacacgataaaatgccatatgagaaagttgttctaaattataaatccataacatggaatcatataacagcaggcacatcagcctatagcatatgggaagacagagtcttataa

SEQ ID NO: 5884 - DNA, 132 bp, Xenorhabdus bovienii
  Coding DNA location: Contig name=SeqID_16915; Position on contig =6371..6502bp; Strand=+
atgggaattaaaccaggacctaaacctattgctgaatcaacaggaaaggaagataaacgacagagagtgacaccggaaaataagcctaaacatccggatttgaaagagcatcaacacaaaaagggtgaataa

SEQ ID NO: 5885 - DNA, 234 bp, Xenorhabdus bovienii
  Coding DNA location: Contig name=SeqID_16915; Position on contig =6913..7146bp; Strand=+
atggcgttctatgaaaacaaaaagtctgttcttgaaacagataaaccagaacagtatcggaaaatacgtagtatcggtgagatccctccaggtccaggaatttatgaatgccagacctgtaagtacgaagatgtcgtgaaccgtgaatgcgagaagcttccaccttgctctaactgcaagaaaaagggccacaccaataagtggaagcttctcgtaaaagctacagataaatag

SEQ ID NO: 5886 - DNA, 285 bp, Xenorhabdus bovienii
  Coding DNA location: Contig name=SeqID_16915; Position on contig =7402..7686bp; Strand=-
atgagtttttttgacgacctaaaagcgtcactggaagaagctgtcgacatcaaaaatggtgttaaagcacccgaacgtgtcacacgttatgaactggcagatgtgaagtccatcagagcacaacttaacgtttcacagagtgaaatggcacaggttctgggaacaagtatcgacaccatcaaaagctgggagaccggaagacgtaatcctactggactggcagcaaaggtactggcgaccattcaggaaaacccaaaattctttcaggaactggcggcgcattaa

SEQ ID NO: 5887 - DNA, 333 bp, Xenorhabdus bovienii
  Coding DNA location: Contig name=SeqID_16915; Position on contig =7688..8020bp; Strand=-
gtgagtcatgctatagagtttatcgaaaccccgttatttacccggcagataaagcaaattgccacggacgatgaactcaaagctctccagaaagagctgattgaatttccgggtaaaggggccttaatccagaaaacgggtggcttgcgaaaaatcaggatggcgacaggctcacaagggaaaagcggcagtgccagggtgatttactttctggccaccgaagagattatctatttggtaatggcctacccgaaaagcaccaaagacagtctgacggatgctgaaaaatcagaactgaaaaagctgacaaaattactgaaagacgaggtgtaa

SEQ ID NO: 5888 - DNA, 93 bp, Xenorhabdus bovienii
  Coding DNA location: Contig name=SeqID_16918; Position on contig =610..702bp; Strand=+
atggtaagtttgctgaagctactaggatttacaatgattctcttagaagtatgggtaaattctttaaagggaatcatagagttaatgatttaa

SEQ ID NO: 5889 - DNA, 522 bp, Xenorhabdus bovienii
  Coding DNA location: Contig name=SeqID_16918; Position on contig =660..1181bp; Strand=+
atgggtaaattctttaaagggaatcatagagttaatgatttaagtaagcttaaagatatgaatttagagcctaatatgcttagagcggggactaaaaaatatcttaaaagtgaattccaaaaacctgatgcagctgttagttatgctgcagcatcagtaacagttaatggtaaaaaagaatattacttatctgtaaatggtgcagcttggtcaggcaattctcccaatgtcgtaaatattaagggggttaattttaatgtgattagaaaagatcgtggttctataccatcagctcctaatggaaagcaaactaactttaatcacgctgaacaaaaattatttagtcattttcaagataattttcaaggtaagagagtagatataaatatgtctattcagaatactagtgctacatctccaggaatgtgtgctggctgtaaacctaatagcaaagtatttgtagatcaaaacaaagattttattattaatatatttgagggtacaaccggtagaaaaccctaa

SEQ ID NO: 5890 - DNA, 432 bp, Xenorhabdus bovienii
  Coding DNA location: Contig name=SeqID_16918; Position on contig =1222..1653bp; Strand=+
atgaagaccttaaatagagaaactgtatctggagttagtttttatactatcagaatgacatatgaagaattaattattcttagggattgtttacatgatattttgcttaaatctgaagagattgaagaaaaaaacctagataaattgtcctggtatagatctgcttttttagaaatatcagattatatacaatccaatatttcacataaaacaaatataattttgaaaaaagaacatttaaacaatgaaatattctataaccttagattctcctatggagaacttaagttaattatatacactgttatgaatttggaggaagatatcaattataaacctttttatagaaagttctctttcagtaaaaaatgtaatgccaagttattgaatgattattttcataaattacaatctttatggtcagtagattaa

SEQ ID NO: 5891 - DNA, 525 bp, Xenorhabdus bovienii
  Coding DNA location: Contig name=SeqID_16918; Position on contig =1666..2190bp; Strand=+
atgactaaaacagaattaatagaatatctacattctgcttacccagagttgactatagatattacttacattaagggctattcagaagaagatatagtaaaattagaacgtttatatgatattaaaattcaaggtcaattacttgattttttaattcacatggggcgttgcagtggaggttttttttcaaatcaacctttaagtttttatagtgaaactgctaatatcagagatgagataaaatttcaaataggatgtgaagatggattaagagaagttcaacgatttgatttagtagaacaaaaacctttctttatttcaatggaaaatgaaggaattttgcattatttcttattaactgattcagataatcctgatttagtttattatcttgatactaactatgacacaatagtagatactggtttaacttttaatgaatatttaagaagcgttgtagattctagtagaggttatgcttgtaaaatcccacttgattatacaggagacttacttagaatataa

SEQ ID NO: 5892 - DNA, 672 bp, Xenorhabdus bovienii
  Coding DNA location: Contig name=SeqID_16918; Position on contig =2266..2937bp; Strand=+
atgaaaaactttaaaacttttacaaagatttctacattaactttgttagtttctactaacctagcttttgctaatgatatcattcctaatgattttaacactcaagttaaccaagttaataatataccagttatcaacatagctactccaactcttaacggtatgtccagaaatacctataaagagttcaatgttagtgaaaagggcgtgattttcaataattttatagattctgttaattctcaattagcaggtcaattagagaaaaatcataatcttaaggataggactgctggcttaatcattaatgaagtagttggcggtaatcaatctcaacttaaaggagctatagaaatagttggggaagatgctaaattagtaataactaatccaaacggtgtctttattgatggagctaaattcataaatataagagagtcttttattagtactggtaaacctgttttcaataaaaaagatttacttagtttagaagtaactaaaggtaaagttactattggagaaaaaggcttagattctgataaccttgttgttttcagtagatctcttcaagtaaatggaaaaattaatgcttatactattacagcgatgataggacctaattccatgagtatgaaggcaggggttacgcatgaaattttagtaggctaa

SEQ ID NO: 5893 - DNA, 315 bp, Xenorhabdus bovienii
  Coding DNA location: Contig name=SeqID_16918; Position on contig =2934..3248bp; Strand=-
gtgggatattttccgttttccaagcggaccccttatttaagtagttgccatgattctcccacctttcaactaggtgccataagaaaacattgggctatagagaatagtttacattgggtactggatgtcacttttcgagaagatgactcacggatgagagagcggatcgccacaagagtatttgcccaattacgtaaaatggcactcaatatcgttaaacgagataccaacagtaaactgagtttaagtgcccgaaggaaatcggccgggtgggataatggctatatggaagcgctgttatttaatcaattttag

SEQ ID NO: 5894 - DNA, 105 bp, Xenorhabdus bovienii
  Coding DNA location: Contig name=SeqID_16918; Position on contig =3411..3515bp; Strand=-
atgaaactcgttctgaataaagccggttgtagtggcacactgaagttgagattattgaggctattaagcagatggctatttatgcaggtttcccagcagagttaa

SEQ ID NO: 5895 - DNA, 1449 bp, Xenorhabdus bovienii
  Coding DNA location: Contig name=SeqID_16918; Position on contig =3496..4944bp; Strand=-
atggacttatgttatttttgcggaaataaattcaatcaaagttccatagtggaccatggagagcatgtcatacaacaggctataggtgggaatttgataagtaagggcatcctttgtaaaggatgtggtggcgacctcagccgggaaatagatactccttttaatgcaatatttgagggaatagcaacacggcttgatataaaaacagacagaaaggcaaataaaagcccgtccattcccggtgtgatcgtaagcgaaaaggatgcttatgatatgaaccttaaagacaccccagttttctggaagaatttcaaagtcacccccgttaaaccctttcacaggtttactgaggataagaagaaagtgattgtttattcttcagaaaaacagtttgaaaatcacaagaaaatcgtagagaaagaaattgaaaatatgggattggacacacctccagaaatcgtcatgtgtgacgacattgacggtaacgtacagtaccagtttcccatggagaacaccgcctttaaaagagggatcgcgaaaattgccattggcttcgcctgcacccacgggatctccagagaaaagttacccttggcgttaaaaatttcaaacgaaaatggcggactgatagatgacaaagtcgtgttaattcaatatgctcctttgagcatcattgataggataattgaaaaagaaaaagcagatttagccaactacccttcacacactttaatccttttcacatcaaaagaaaaaccctcattattatgttgttatgtagagctgttttcaacatttcagttctacattttgttaaataatagttatgaaggtgagcctgtttataaataccattatcaacgaatcgaaaaagcaaatgagtatgttttcacgccagacagaaggcattacaaagaacgaaatataatcttaggtggtctagggattacggatgaacgcatccaatcggcgtatgataaacagaaagataaacaaaacaccaaatcattacatgagatagaaattgatataatcagggaggagacggaaaaacagaagaacaaggcagatttcgaatctgacattaaaaattttgtcgattactgtgcgcaaaaattcattttgaataaggcgagtgactttgaaatgaatatggatttctatcgaaacttttcattgttcagtagaagctccgcagacaactctgatgaagatgaaaatttcgacatatcgagctatcgccgtttctttatatataaaaataagagagttgattaccccgaagccttattacaggtgaaggacaataactctccagagctgaacatacatagtttttacagatttgatcagctcgagaagtacagccaggacaaaggtatccgagaaaagattagacagattaagagccttattgagaaatcaaaaaatgaaactcgttctgaataa

SEQ ID NO: 5896 - DNA, 168 bp, Xenorhabdus bovienii
  Coding DNA location: Contig name=SeqID_16918; Position on contig =4896..5063bp; Strand=-
atgccgttcagcattaagttgccagaaacccttatcaaagaaccatatactttaaatatttttactgtatataatttcgcaaaccaagaaaaaattaaaatttaccttaaggatgaatcatggacttatgttatttttgcggaaataaattcaatcaaagttccatag

SEQ ID NO: 5897 - DNA, 1434 bp, Xenorhabdus bovienii; identical to SEQ ID NO: 2032
  Coding DNA location: Contig name=SeqID_16918; Position on contig =5363..6796bp; Strand=+

SEQ ID NO: 5898 - DNA, 579 bp, Xenorhabdus bovienii
  Coding DNA location: Contig name=SeqID_16918; Position on contig =7042..7620bp; Strand=-
atgtcacgagtttttgcctactgcagggtatcgacactggaacagactactgaaaatcaacgcagagaaattgaagccgccggttttaccgtcagaccccagagactgattgaggagcaaatcagcggttcggtggcagccagcgaacgccccggttttgccagactgcttgaccgcatggaaaatggcgatgtgctgattgtcaccaaactggatcgcctgggtcgcgatgcaatggatgtgcgaaagactgtggagcaactagcgacgtcagatattcgggttcactgtctggcgctgggcggtgttgacctcaccagtccggccggaaaaatgaccatgcaggtgatttctgctgtcgcggagtttgaacgggacctgttgcttgagcgtacccacgccggtattgcccgagccagggcttcaggtaaacgttttggtcgtccgcccgtcctgagcgaggaacaaagacagatagttacagaacgccttaatgccgggatcagtatcagcgccattgcccgggaatttaataccacccgacaaaccatactccgggtaaaggcaggacagcaataa

SEQ ID NO: 5899 - DNA, 96 bp, Xenorhabdus bovienii
  Coding DNA location: Contig name=SeqID_16918; Position on contig =7654..7749bp; Strand=-
atgcccaaatatcatgtactaaaacggtcggtttcggacaacctgcagcgacactgtacgaaagtgagtgttttttatttcgtacgtaagctataa

SEQ ID NO: 5900 - DNA, 624 bp, Xenorhabdus bovienii
  Coding DNA location: Contig name=SeqID_16918; Position on contig =7890..8513bp; Strand=+
atgaatgaatcttttttgagtcacttaaaggaagtatatcaagatcgtgaacgagatctcgttacattaagtgtgcgtgtcagtgttgaggagaatgcggccattcaggatttggtagattcagttggctgtaaccggcaggatcttctttatgaactaataaaaaaatacgcactcagtgaatgggaggtgatgagaaacgaagaactggatgccgaactcagtggcggaggtgcatctggtgataaccatacgaagacctattttctgcttaacacaaacaaagccaatagtgctaaggatcaccaatttatgattgaaaatggctttgctgctgcatttgaagaaggttatatccagaaaatagaaaaaatccatgaaggagatactgtctttttgtatgagtcaggcgtaggtattgttgcttacggctcagcaacgggtaaggtactgaaaacagatcatctcggtgtaaaagataaaacctattatcaaaaactggatgggtttcatgttctggataaaccactgcctgccaaaaaaatctgtactctgcttaagaggagaattcctttcgtacaaacacttatcaggcttaaagatggcgaaaagcttctgaaataa

SEQ ID NO: 5901 - DNA, 201 bp, Xenorhabdus bovienii
  Coding DNA location: Contig name=SeqID_16918; Position on contig =8704..8904bp; Strand=-
ttgttcatctatttcacagataagctgaatgttatttccatcaaggggcagcgtagtcacgttccgggggctaagttttttagtgttttcaggacagtagaggtggcaactttcagtacacgtgcggtatcacggatgccgccattattcattgccatatcgacaatttgctctttaacgcccagtttacaggcttggtag

SEQ ID NO: 5902 - DNA, 423 bp, Xenorhabdus bovienii
  Coding DNA location: Contig name=SeqID_16918; Position on contig =8845..9267bp; Strand=+
gtgactacgctgccccttgatggaaataacattcagcttatctgtgaaatagatgaacaagggtcgtttgtaggcagcaataagaatcagcgctggctttggtatgcttgggaaccccgaatgaaacgaatagtcgcacatgtttttggtgatcgcagcaggaagacactggataaactactggcattactgtctccttttaaagttcgattttattgcacggatgattatgcggtttatgattgtctttcagaagaagagcacttaacaggaaaaatgtttacccaacgaatagaaaggaccaatctcacccatcgtactcgcctaaaaaggctgaatcgaaagacgattggctattccaaatccgaagagatgcatgacaaggtgatagggacgtttattgagtgtgaaaactacgtttaa

SEQ ID NO: 5903 - DNA, 285 bp, Xenorhabdus bovienii
  Coding DNA location: Contig name=SeqID_16918; Position on contig =9355..9639bp; Strand=+
ttgataacggcctcgaatttgccgaacacaaacttatcagtaaaaatttattttgctcacccgtattccccctgggaaagagggataaatgagaacacgaatggattaatcagagattacttcccaaaaggaactgattttaataaggtatcagagctggagattaaccttgtggcaaaccgattaaataatcgccctcgtaaaacacgagattacaaaacaccgaatgagttatttaaaggaatacccactcatttacttcgttcattacggtattgcgcttaa

SEQ ID NO: 5904 - DNA, 204 bp, Xenorhabdus bovienii
  Coding DNA location: Contig name=SeqID_16918; Position on contig =9741..9944bp; Strand=+
atggaaagaacattttataacaattcagaagtacctatgaccataacgcttgaaggaagccacccagtaactccaagcgttctgaaattaattaatcctaaagaaatagtaactttatctgttaaagaaaactatataatgcaacttaatttatctataaacctgccggaaattaactttgatatggttttcacatctaaataa

SEQ ID NO: 5905 - DNA, 135 bp, Xenorhabdus bovienii
  Coding DNA location: Contig name=SeqID_16918; Position on contig =9891..10025bp; Strand=-
gtgatttgttttgatttggcgattaatcagatcgcgaaaatcggactgagttcccttcaagtgatctattattttgaaattttatttagatgtgaaaaccatatcaaagttaatttccggcaggtttatagataa

SEQ ID NO: 5906 - DNA, 1041 bp, Xenorhabdus bovienii
  Coding DNA location: Contig name=SeqID_16918; Position on contig =10041..11081bp; Strand=+
atgccgatcatagcacccatatcccgaaatgaacgtcgccagatgaaaaaaattatccaaacaacccgagataaaaattatgcacgcagactgatggccctgttgatgctccatcaggggatgtccgtctcttatgtcgccagaaccctttgtgcagcgcgctcttcggtcaatcgttggataaactggttgacgttctatggattagaagggctcaaaagcctgcccgctggcagacccgcaacatggaatttaacgtcactgttccctttgctgtcttttttggtccaacattcaccacaacaatttggctacctgcgttctcgctggagtttggagctttttatcattcaaatcaaagaactgataaaagtgaaattctcgaaaagccccttttatcgttatttatgccaggcgggtatcgtttggaggagagccgctcccaccttgaaattacctgaccccgagtacgatgagaaaatggcaaaaatcacggaagccttgtccaattcctcagagccccattcggttttttatgaagatgaagtcgatattcactttaatccgaaaatcggttcaggctggtatttcaagggacaacagaaacggatcgctacacccgggaaaaaccaaaaacattatcttgcgggttgtctaaacgccctgacagggaaaatcacttatgtcggaggcttaaataaaaactctgaattatttatcaatctgttagatgagataaaccgccaatatagctctgcagaaacaatcaccctaatcctagataattatggcattcataaaagccggaaagtcatggattggctggccagaaattctaaatttaatctcttatttttacccgcctactcaccttggctgaataaaattgaacgcctatggcaatctctacatgaaacggtaacgcggaaccattgctgtcagtttatgtggcagttgattcagtgtgtgcaagttttcatggaatcagcctcattgcagcaacagcagaaaatgaaaaaagggggtgtatcactattatga

SEQ ID NO: 5907 - DNA, 336 bp, Xenorhabdus bovienii
  Coding DNA location: Contig name=SeqID_16918; Position on contig =11268..11603bp; Strand=+
atgaataacattacttatgataagtacatatataaccaaactgaattcaatttttacatatctatattcattaacttaagtagacagaaaccattcgtaacaaaatatgtagaatcttttcactggtggaaatttgagtttccatatattcctataacatctggcataatttttcacagtgtgaaaaatacattacaattgaaatattttttatcagatccaagctcaacagggatttatcctcttcttcaaaaacaaaccatttatttacatcaaggaacagaagacgttagattttatttttatttagaagggtttgatggaatagtacaataa

SEQ ID NO: 5908 - DNA, 225 bp, Xenorhabdus bovienii
  Coding DNA location: Contig name=SeqID_16918; Position on contig =11570..11794bp; Strand=-
atgagacagaaccctgcgatgaaccccaatgtcttttgcgataaagcacctcgagctggtatctttgttcgcgggtcaactgttggtagtgtttgttttgagacttcatttcagacaattatttggctgtgtgagaacttcaaaatgtaccgacagttgacccacctttcaatccattgcctgttgcactattattgtactattccatcaaacccttctaaataa

SEQ ID NO: 5909 - DNA, 189 bp, Xenorhabdus bovienii
  Coding DNA location: Contig name=SeqID_16918; Position on contig =11929..12117bp; Strand=-
gtgtatgaccgcctcccagaggaagaacacctgactgggaagacattcacccaacgtttagaaagaaataatttaacgcatcgaacccggataaaaagactgaatcgaaaaacgatagggtattctaaatcggcggaaatgcacgataaagtgattggtactttcattgagcgtgagaactatttttaa

SEQ ID NO: 5910 - DNA, 123 bp, Xenorhabdus bovienii
  Coding DNA location: Contig name=SeqID_16918; Position on contig =12084..12206bp; Strand=-
ttggggatcgtagccggaaaacatgagacaaactgcttgcccttttatcgccctttaatattcggttttactgtacggatgattatgctgtgtatgaccgcctcccagaggaagaacacctga

SEQ ID NO: 5911 - DNA, 267 bp, Xenorhabdus bovienii
  Coding DNA location: Contig name=SeqID_16918; Position on contig =12181..12447bp; Strand=-
atggcaatgaataacggcgggatccgcgacaccgcccgtgtcctgaaagtggccacaagtaccgtcatgacaacgctaaaaacttacccccgaaacgtgacgacgcttccccttgacggagataacattcagctcatctgtgaaatggatgagcaagggtcgtttgtggggaacaagaaaaatcaacgcgggctctggtatgtctgggaacctcgcctgaaacggatagtggcgcatgtttttggggatcgtagccggaaaacatga

SEQ ID NO: 5912 - DNA, 210 bp, Xenorhabdus bovienii
  Coding DNA location: Contig name=SeqID_16918; Position on contig =12438..12647bp; Strand=-
atgctctcactttttaagggtggatcatggctaaagttaacgtttattgtcgttattgtcacacatcagaacatgtcaaagggcatggaaaatgaaatggtgaccatccccgttatcgctgttatgcctgctgtaaggtctttcagttggaatacacctatcaagcctgcaaacccggtgttaaagagcagattatcaatatggcaatga

SEQ ID NO: 5913 - DNA, 219 bp, Xenorhabdus bovienii
  Coding DNA location: Contig name=SeqID_16918; Position on contig =12673..12891bp; Strand=+
atgaccacccgtacagcaggcgccagagatactgttcgatatactgaggatgaatggctgctgcaaaatctgtcttactggctcatggtcaaaattgctcctgtcacccagccatccggtactacactatgcaacgattttaaaagcaaaccgaacatacaagttgctccagtattcggatacggaatgcatctcaatccaggcactatgatgccgtaa

SEQ ID NO: 5914 - DNA, 105 bp, Xenorhabdus bovienii
  Coding DNA location: Contig name=SeqID_16918; Position on contig =13007..13111bp; Strand=+
ttggcagggattgaattgatctgtatgttgtgcaaaggacaataccgacaaaaagaagggtgtccgatttcaccagcggcatttttctatcaattagctgagtaa

SEQ ID NO: 5915 - DNA, 336 bp, Xenorhabdus bovienii
  Coding DNA location: Contig name=SeqID_16918; Position on contig =13185..13520bp; Strand=-
atgaaatttgaatattcttttgcgttccgggaccaacttcatggccggttctactatttggcaagacatataggtcaggtcactgcccaagagtttctcgatagtttcattgttggatttgagggaagggtaaacgactatcctgaaagcactccagtatgtatggaggcagcagatcttggtttcactacttatcacgactatgttgaccccaaactccagttaagagctatttaccgtttttctgagtcagaaggtgtcgtttatccattactgtttctaagtaccaaacaaagtattaggcaggcgcttattcaatactgtctacgcctctaa

SEQ ID NO: 5916 - DNA, 354 bp, Xenorhabdus bovienii
  Coding DNA location: Contig name=SeqID_16918; Position on contig =13510..13863bp; Strand=-
atgtccatatatgggccgtatatggactcatcggtgatttgggtatattctttcattagtagttgtatttcattattggagaatcccatgaccctatctacttcgccacgcataactacagtctcagcattcaagaaagaactggcttctatggatgtttctgatcccgtagtcgtcacacaaaatggagaacctctctacgtggttcaagatcctgttcagtttgaaatgcagcaagagcagatggccctgttacggctgctatcttttgctgaaaaggacgtgcaagcaggccgaacggtttcatctgccgaccttagggccggactgaaaggattggttgatgaaatttga

SEQ ID NO: 5917 - DNA, 264 bp, Xenorhabdus bovienii
  Coding DNA location: Contig name=SeqID_16918; Position on contig =13827..14090bp; Strand=-
atgatcaacggcaatcccccgctccgccctcatttcttccagattacgcaggctcaggatgtaggccaggtaccaacgaacacactgagcgatgatatcaacagggtaatgcagacgtttgaacgcttttcggataagggacattgctctggactcgctcaaaaacaggggagcttacctgatgatcgcttaatgcgacagaaccctttcacatatgaaagcaaatcatgtccatatatgggccgtatatggactcatcggtga

SEQ ID NO: 5918 - DNA, 387 bp, Xenorhabdus bovienii
  Coding DNA location: Contig name=SeqID_16918; Position on contig =14181..14567bp; Strand=+
atggatgaaacctatatcaaaatcaaaggccaatggaaatatttgtatcgagctgtggactcagacggcaagacagtggattttttgttgacggctcgtcgggataagtcgtcggccttgcgtttcttcaaaaaggcgatgcgtcagcatggccaaccggacgtggtgacaatggataaaagtggcgccaataaagccgccgtggatgaattaaatcaaggaaagccaaaagaggaagccattgttatccggcaaaacaaatacctcaataatttgattgaacaggatcaccgcaacatcaaacggcgaatacatcccatgctgggatttaaacatttccggcgagctcaaacgttattgagcggtattgaattggtcagtatgtaa

SEQ ID NO: 5919 - DNA, 120 bp, Xenorhabdus bovienii
  Coding DNA location: Contig name=SeqID_16918; Position on contig =14677..14796bp; Strand=+
atgcgacagaaccctttagttcccttcttaagcaaatctcaggttaagttaaaaagtggcaaaagaattgaaagtataagctgtaacttatataatggaagtataagccataccttatga

SEQ ID NO: 5920 - DNA, 351 bp, Xenorhabdus bovienii
  Coding DNA location: Contig name=SeqID_16918; Position on contig =14807..15157bp; Strand=+
ttgtggacagtgatttttaccccaaggtttgacgcctggctacaggagcaagaagaagggatgcaggaaaaggtactggccgatctaaccaaccttgaaacgtatgggccgaaactatcgcgtccttacgccgatacagtgaaaggttccaggcacaaaaacatgaaagaacttcgcgtacagtattcaggccacccggtacgcgcgttctttgcttttgaccctaaacgtcaggctatcgtgttatgtgccggtgacaaaagtaacaataagcggttttacgacacgatgatccgcatagcggatgaagaatttaccgcacatttaaccgtgatcgaggagcagaaatga

SEQ ID NO: 5921 - DNA, 300 bp, Xenorhabdus bovienii
  Coding DNA location: Contig name=SeqID_16918; Position on contig =15154..15453bp; Strand=+
atgaaaacattacgtgatgctgtagcagcccgttcgccagagagccaggcacggattaaagaaatggcggatgaaatgattctggaaactggattacagctgatgcgagaagaattgcagttttcgcaaaaatccctggctgaatccatgggagtcagccagcctgcgataactcaaattgagcaacgaggcaatgatgttaagttggcaacgcttaaacgttatattgaggcaatgggcggaaaactgagtctgaccgttgaattaccagaaggagggggacggatatttcatatctga

SEQ ID NO: 5922 - DNA, 585 bp, Xenorhabdus bovienii
  Coding DNA location: Contig name=SeqID_16918; Position on contig =15601..16185bp; Strand=-
atgagggcggaacggggaattcatgttgaccattcgaccctttcccgttgggttcaccgtctgacccccttgattgtcagacgttatcgtcggaaaatgcctgacgtgggtcaccggtggcgaagggatgaaaccgatatcaaaatcaaaggacaatggcgttatctctaccgggctatcgattcgaacgggaatacggtggattttttgttaacagctcagagggataaggcggccgccctgcgcttctttaaaaaagcaatgcgtcaacatggtcagcctgagatcgtcacgatggataaaagcggtgccaataaagccgccgtggatgaatggaacaagggaacatcaaaggaagaagccattgttatccggcagaacaaatacctcaataatttgattgaacaggatcatcgcaatatcaaacggcggatatgtcccatgctgggatttaaaaatttcaggcgaacgcagagcgtattagcgggcattgagctggttaatatgttacgtaaaggacaatatccgcaagaaccggaatgtccgctttcacccgccgaatttttctatcaactcgctgcataa

SEQ ID NO: 5923 - DNA, 99 bp, Xenorhabdus bovienii
  Coding DNA location: Contig name=SeqID_16918; Position on contig =16196..16294bp; Strand=-
atgccccttatccgaaaagccttcaaacgtttacactatcctgttgatatcacccccgtgcgtgcgttggtatctagcctacgccctgagtttgcgtaa

SEQ ID NO: 5924 - DNA, 1122 bp, Xenorhabdus bovienii
  Coding DNA location: Contig name=SeqID_16918; Position on contig =16364..17485bp; Strand=-
atgaaagaattagtggatgtcttttctgattttccagacccacgttgtcagggaaaggtcaaacaccgtgttattgatatcttagtgatcgcggtatgcgctgtcattgctggggctaacgcctggactgatattgaacagtacggtcaactcaaaaaggattggctgagttcatttcttccgctcaaagggggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatggccacggacgtaccgtcagacggcgcggatgggttctgccactgacatcagaaacaaaacacttaaggtcttggccagatattcaagctctcctggtaacagaaacgatacgacaagaacactattctgacacggtgacttctgactttcgttattatttaagcagttgtcatgattctcccgcctttcagttaggtgcaatacgaaaacattgggctatcgaaaatagtttacactgggtactggatgtcactttccgagaagatgattcacggatgagagagcgggtcgccacaagaatatttgcccaattacgtaaaatggcactcaatattgttaaacgagatatcaatagtaaattgagtttgagtgcgcgaagaaaatcagcgggatgggataacggttatatggaagcactgttatttaatcaattttag

SEQ ID NO: 5925 - DNA, 126 bp, Xenorhabdus bovienii
  Coding DNA location: Contig name=SeqID_16918; Position on contig =17562..17687bp; Strand=+
atgcgacagaaccagaaactgctcaagcagatagagagcaaatttaccgctatttttatgaacaggcagggctattactcgctgataaagtcgatgctcgatttcaagaaatggcagagttgctga

SEQ ID NO: 5926 - DNA, 189 bp, Xenorhabdus bovienii
  Coding DNA location: Contig name=SeqID_16918; Position on contig =17672..17860bp; Strand=+
atggcagagttgctgaaaacggccccttattctggtgtgaaaattagaaataatgttgatgagtcgtacagaaaattaatagttcctcattttccatttatcttgttgtaccaatacataaaagaaaattcaaacatctgtattcttagagtgttacatacatcaagacaaataacctcgacattttaa

SEQ ID NO: 5927 - DNA, 141 bp, Xenorhabdus bovienii
  Coding DNA location: Contig name=SeqID_16918; Position on contig =18091..18231bp; Strand=-
ttgtcaaaattgctatcaattagtcaatccaagtcagattatttagctctttcaatggactttttcaaagacgaaccgccaaaagcagtaaccagttcatctcttaaattcaaacattcctcagccgagatcaaattgtga

SEQ ID NO: 5928 - DNA, 918 bp, Xenorhabdus bovienii
  Coding DNA location: Contig name=SeqID_16918; Position on contig =18403..19320bp; Strand=+
atgtctaatgatgaaactttgaacacacttcttgccaaaaagagcgttacgttgaaaaatatcacatccaatttaaaatacatgccagcagcaattttatgtttcttttttatatcgaatgcaaacgcttctatgttgaaagataaaattaaaactttagaagcacaaggttggcaagttggtgtatccatacttgactacaatggtaataagattgaatctgtaaacggagacgaacgattccccttagatagcacagtaaaagcccttgcatgtgcaaatatcctcgcaaaagtggacaataaatctctgagattggaagactctgtacttataaaagaaaaagacattgttacatactcccctattaccgaagggtatgtaaataaaaaaataactttaaaacaagcttgcgaggcaaccaccgcttttagtgataatacagctgctaatatagctatatcgtcagtaggcggcccaagtgaactaactaaatttatgcgttcaatcggcgataatacaactagatctgatagatatgaacctgacttaactattaaccctgagcatgacttaagagataccacaactcctaacgcaatgagcaatagtattaggaaactattaactggaaatgttttatctgaaaagtcaaaagagcaactgaaggaatggatgatggggaataaagttgccgataatatgttaagatccgaactacctaaaggttggtttatagcagaccgttcaggtgcaagtgactatggtattagaggtatcacttcaatggtttggtcagacaaagagcctccattattcatcagtgtctatcttagaaaaagtaacacttctcttgaagaacgttcagagaaaattgctgagattgggatggttatttttagcaagtatactcactaa

SEQ ID NO: 5929 - DNA, 165 bp, Xenorhabdus bovienii
  Coding DNA location: Contig name=SeqID_16918; Position on contig =19267..19431bp; Strand=-
atgcagccaatcgataaaatatctctgccggtggcaatgtcacggacaaaattatacttcagtgtatcgaaaaccatgccgataaacctaccggcatcagccggtagtcgtttagtgagtatacttgctaaaaataaccatcccaatctcagcaattttctctga

SEQ ID NO: 5930 - DNA, 330 bp, Xenorhabdus bovienii
  Coding DNA location: Contig name=SeqID_16918; Position on contig =19539..19868bp; Strand=+
ttgtcccttaaaggcaatcagggaaaaaccttttcggaagccgttgactattttcagcaacagataacccaaccaccttatcttaaacctgaccatgatgaatttgaagatagccacggacgtacagtcagacgacgcggaagggttctgccactgacatcagaaacaaaacacttaggttcttggccggatattcaggccctcctggtaacggaaacgagacggcaagaacaatattctgacacagtcacctctgattttcgttattatttaagcagttgtcaggatgttcccgcctttcacgctcaccctactcgatgcaggaggtaa

SEQ ID NO: 5931 - DNA, 318 bp, Xenorhabdus bovienii
  Coding DNA location: Contig name=SeqID_16918; Position on contig =19825..20142bp; Strand=+
atgttcccgcctttcacgctcaccctactcgatgcaggaggtaaatcaccgcaggaggtgatcgaaatccggcaaaacaaatacctgaataaccgcattgaacaggcccctcgccatgtcaaacgccgggtccgtccgatgctaggatttaaatcgttccgccgggctggcggggatcgaactcgttgccatgctctccctgatgaccgcttaatgcgacagaaccccgacaaggtccgtattccatctgacctgcattcctccattcatataaccagcaccagacatacatgggcaaccacatatacttggtgctaa

SEQ ID NO: 5932 - DNA, 549 bp, Xenorhabdus bovienii
  Coding DNA location: Contig name=SeqID_16918; Position on contig =20177..20725bp; Strand=-
atgtcacacgtgggtagccaaaccggaagggctgattattcggtatattatgaaacgcaaaaaacgttgttgcacgatggaaatgtgtcaatggcagttcaagtaaaccaaatatggtatttttccgatagcgaggacttggctaagctgacaaggactaacccccaatcacagaatacaagtgactctttttatcgctctgtgaaagagaagggtgaatattattttttgaaaaataattcaagtgtggaggttgttaatgtgacggaagataataaaatagaaatgatcctgtccagattattggggctgcttggaagagcgccatctaacaaagaatttggtagcctattaaccaagcaaggaatccccttccctgaccatattttcccacacctgggtaatagtctactagcgaataaaagtatttttgatgtccaatttactattgaacctgaacctgtaattaaaagtaaaaatgcaaagaataaagaaaagcgaaaggacaaaagggataaagctatagcagcaggaaaacctaaacgttaa

SEQ ID NO: 5933 - DNA, 255 bp, Xenorhabdus bovienii; identical to SEQ ID NO: 422
  Coding DNA location: Contig name=SeqID_16918; Position on contig =20759..21013bp; Strand=-

SEQ ID NO: 5934 - DNA, 252 bp, Xenorhabdus bovienii; identical to SEQ ID NO: 421
  Coding DNA location: Contig name=SeqID_16918; Position on contig =20890..21141bp; Strand=-

SEQ ID NO: 5935 - DNA, 276 bp, Xenorhabdus bovienii; identical to SEQ ID NO: 420
  Coding DNA location: Contig name=SeqID_16918; Position on contig =21190..21465bp; Strand=-

SEQ ID NO: 5936 - DNA, 363 bp, Xenorhabdus bovienii
  Coding DNA location: Contig name=SeqID_16918; Position on contig =21578..21940bp; Strand=+
gtgattgatggtaatgcaccacaagaatttgatggcggttatttaaaaacaaatggggatttacatgaaaaaataattttatttccccttataacaaaaagctttttaagtggcaataagacttcattttacctgatagggaaaagtgatccattaacgtataaaacaggaacggctaaaaacattaacctaaattacatatatataaaaaaaatgctttcagtttggacgggtagaaagaacaatgacatgccatttatgacctatcctaatggcgatattgtttctggcgaagttagacctgaatatgaaacgttaatgggcattcttgaatcaagaaacagcaaacagactaagatgtag

SEQ ID NO: 5937 - DNA, 1221 bp, Xenorhabdus bovienii
  Coding DNA location: Contig name=SeqID_16918; Position on contig =22026..23246bp; Strand=+
atgaaatttctctgtaataaacgcgtattatcctccctatttgctgtgtttttcatacaaggatgcgcacaaagcgactcattctctcccccgattaatggagagaatattcattttacgaccactatgcctgacgagttggatgctttacccatttcagccatgtatcgttctgaaatttgccgcaaagaacgccgaaccgcgaatatgaagtcgtattctgttccgggttttcatcgtgctacctaccctctatcaatcgatcagtcaaatcaagttgaggtcagtgtccctaaggaggggggagggaagtgtgattggaaactgagtaatattactttcgaagtgaagctgaaagatacgtcaaaaattgcgcctcttattgacgataattttggatttaatacgacatttgttattgatggtaatgcaccacaagaattcgatggtgggtatataaaaaaaacaggtaatttaaatgaagaaattactctatttcctttactaagagagcggtttttagggggacatagtcaatcattttatttggtaggaaaatatgatgttatgacatataaaatggataatggtagaaaaattcatcttaatgtcttatatgaaaaaaattttttaactcattggaatggaggaaaaaataaggatgcagatacatcaatgacttatcctgacggcacaataatatacaatggtgatgtaataccagactttgataaattaatgcgtattcttgaatcaagaaacagcaaacagactaagatgaccgccgccggtattaatcccacttatctttatgaagatcaggcatccggcaaacgcgaagatcgtcctggactggaaaactgcctgaaagcattgcgatcaggagacacactggtcgtgtggaaactcgaccggcttggacgcgatttgcgtcacttgattaataccgtacacgatctgaaccagcgcgatattggcttgaaagtactaaccggacacggcgcggctattgataccacaacggccgcaggtaagctggtcttcggtatttttgcagctttggctgagttcgaacgagagctgatttctgaacgtactttagcggggttggcatcagcccgggcacgtggcaaaaaaggtggacgtctattcaagatgacggcggcccaaattacgcttggcgatggccgcgatggggcaactggaaaccaaggtgagtga

SEQ ID NO: 5938 - DNA, 153 bp, Xenorhabdus bovienii
  Coding DNA location: Contig name=SeqID_16918; Position on contig =23218..23370bp; Strand=+
atggggcaactggaaaccaaggtgagtgaattgtgcaaggaactggacattacccggcaaactctgtacagacattatcccctaatggggagctgcgtccagatgggaaaaaattgcttggccgggtctggttgtgggcttatatcacattga

SEQ ID NO: 5939 - DNA, 1017 bp, Xenorhabdus bovienii
  Coding DNA location: Contig name=SeqID_16918; Position on contig =23383..24399bp; Strand=+
atgggacgagtgaagatcatatctgccctaaccgaaccttcaaaaagggataatctcgtgaccataagcattaggctcactgtcgcaataacactgcttactgcgacacagcccatattagctaaaataccagaaaattttgtctataccagctccggtgacctcgaagcggcatcagtcattatggcgcgtagcgacattggcggtgcgcagatcgtttatgattggcgcttactcgaacctgagaagaacaaatacaacttctcgcagattgagaaggatctggctcgtctcaaggtagccaagaaaaaacttttcatccagatccaggatcggttttttgaacaaaatgcccgatacgttcccgattatctgatgaatgatgccagatacggtggtgggatatcgccacaatttgataatcctggcgaaggaaagccgattggttcgggttgggtggtacagcaatgggatcctgctgtgcgccaacgttatcaggctctgttggcagcgattgcagagcgtttcgatggtcgagtctatggtgtgaacctaccagaaacagccattgatcttgacgaaaaaaagctacccaagggattttcctgcgataactatttcgcaggcgaaatggaaaacctcacctttacgcgaaaggtgttcaccaaatcacatgtggtgcaatatgtaaatttctggccgtgcgaatggaacaacgaccacaattacatgggccgactgtttgagttcgcgagtgccaataatattggacttggcggcccagatattgttcccaaccgcaaggcgcaaatgaagaactcatatccattcttcaacaaatacaaaagtaagctagcactcattgccatggcagtgcaggagccgaccttgacctacaggaaccccaatactggtaagccctttatcaaggacgagtttgtagaattcgcagaagattatctcggtgcagatatcattttctggagcacgacgtctccttggttgacaaagaaatag

SEQ ID NO: 5940 - DNA, 963 bp, Xenorhabdus bovienii
  Coding DNA location: Contig name=SeqID_16918; Position on contig =24544..25506bp; Strand=-
atgtctgataacatcgtagtcggtattgatatcgccaaacacaaatttgatgtcgccgtttgggcaggcgaaaatcattacaaaaggaagcattttccaaatgaccttaagggattcgacgccttcattaattggcttaaacccgcctcaaattaccatttttgcatggaagcaacaggaatttatggggatccgctcgcactttatctttcggataaggggcttcttatcagtgttgtcaatccggtacaaatccgtgcctttggtaaagcggaattactccgcaataaaaccgataaaattgacgccaaactgatagcacgttattgcgccagtcagcatcctccggcatggcagcccgcgccgctttgtgaacgccaattactggctttagtccgccatcgcaataagctgaatgaaatgcttttgacggaagagaatcgcctctccgtggcggatgaagttgtttgtgattctcatgcaaagataatcaccctgctaaagcaagaactcaaagacaccgaattgaaactaaaaaagcacattgatgactcgccttcgctgaagaaaaataaggggttactggaaagtattcccggtattggcgaacggttgagcgcaacactgctggcttatattggtgatggttcacggtttcatcatagtgggcaagtggtggcttacgctgggcttaatcctaaattacatgaatcaggacaactaaaagggcgggctcatctctcgaagcagggaagtgccgagctgcgaaaagcactttatatgcctgcgctggcagcgatcagttgcaataaagtagtgaaaaagcagtgggaacagctgacagcacgccataaaggggggaaagtcggtgtttgtgcagtgatgcgtaaactcttacgattagcctatggcgtgatgaaatcaggcacattatttaacgcagaaataccgcttgcagtttaa

SEQ ID NO: 5941 - DNA, 102 bp, Xenorhabdus bovienii
  Coding DNA location: Contig name=SeqID_16918; Position on contig =25465..25566bp; Strand=+
gtgtttggcgatatcaataccgactacgatgttatcagacataaggttatcctctttgtcagagacacaggagatatcgccatgattagacttataaaatag

SEQ ID NO: 5942 - DNA, 966 bp, Xenorhabdus bovienii
  Coding DNA location: Contig name=SeqID_16918; Position on contig =25758..26723bp; Strand=-
atgactactttatttttaatggttttttctttttatttcataggtagtgccaaggccagtgaaattataaaatatagaaccagtataacacataccaatccagatggtgatcctacactttataaccccgtagaaacttatggaggagtgattctttataacacgccatcacctagtggagccagcgtttatgttgaaattgatggacacactcgacaaattgattatacagatcagattgaattagcggtagatttttggaggggaatcgtccgtgatatatatccaatgctaactattagacatatgcgttctggggaggaggcaaattttttaattggctattcttcagcactaaatatgttatcaggaatagccggtcgtgaacctgcaatatcctacataccacacactgggcatgtaaacactctggcactaaggaatactaatctagctggtcaatacggaatatatgttgacaattaccttgcagaaatgaatgaggaacgtatgactatgatgatgagaacttttagcgatgttcataacaacggagaagcagtaaaacgatatatgtatatactactggtgcgccatcttggctatgctcttggttttgttccagaagattcgaatgttaatttatttggtaataatataccttggtattctccagaaatttattttgtatcactaaatgatagtgcaactcctaggcttatgtatagaaacaatacatttgaatatatcgaagacttagtgcgctttaatgctgaagaggatgcgtttagcataaatgatatacgtatttcacctcaagaagagtttgtcgcaaggatgtgtttaggaaatgagttaagtatgatacagactaaaacctccaaatcttacaatgacatgtgtagctcaaaatcaacaaaagtaacatacacattaattgcacgaataatatcaattattaattaa

SEQ ID NO: 5943 - DNA, 138 bp, Xenorhabdus bovienii
  Coding DNA location: Contig name=SeqID_16918; Position on contig =26811..26948bp; Strand=-
atggatcggagagggagcagatgtgagtggcgtgaaaaaaggattaccataactatcattaatcataaacttgttaataaccgccttcagagggcggtagaaattttcctaatatcaatgtgtcattattttatttaa

SEQ ID NO: 5944 - DNA, 408 bp, Xenorhabdus bovienii
  Coding DNA location: Contig name=SeqID_16918; Position on contig =26897..27304bp; Strand=-
atgagagataaattaaaatcattaattcccatagttgcattgtttctattttttatttcatcaataacaaaagcctcttcagtagaggatgcactaaggtgtaatagtagcgaacaattcacaggttatattactggtgtagctatgggatattatgttggcgcagatgacacaaatactcgtattacaataatgtttaaaaaagagaatgagaaaaataaaactggaacagcattaatgttacgtaaagattatggttcagatggagggcctggatttttagctttagcgcaaacagctatgcttacaggacaaaaaattaatataaactgtaatggatcatgggttgatggtatatggatcggagagggagcagatgtgagtggcgtgaaaaaaggattaccataa

SEQ ID NO: 5945 - DNA, 315 bp, Xenorhabdus bovienii
  Coding DNA location: Contig name=SeqID_16918; Position on contig =27429..27743bp; Strand=-
atgtttatcagcggcggaacaattttatcgattgacagtataaaaaaacaaccactcgcggaatctctgattaactcgccgttaatgcgacagaaccataaaattgaacgcctatggcaatctctacataaaacagtaacgcggaaccattgctgtcagtttatgtggcaattgattaagtgtgtggaagttttcatggaatcggcctcattgcagcaacagcagaaaattaaaaagggggtgtatcactattatgaaactttatttagattaacaaaaatatgtatcgaatttattttgataagctgcgtttaa

SEQ ID NO: 5946 - DNA, 111 bp, Xenorhabdus bovienii
  Coding DNA location: Contig name=SeqID_16918; Position on contig =27744..27854bp; Strand=-
gtgcagacgtttgaacgcttttcggatcaggggcatcgctctggactcgctcaaaaacaggggagcttacctgatgatcgcttaatgcgacagaacccaagaggaaggtga

SEQ ID NO: 5947 - DNA, 303 bp, Xenorhabdus bovienii
  Coding DNA location: Contig name=SeqID_16918; Position on contig =27819..28121bp; Strand=+
atgcccctgatccgaaaagcgttcaaacgtctgcactaccctgttgatattatcgctcagtgtgttcgcggggatctggcctacgcgctgagcctgcgtaatctcgaggaaatgctcgttgagcgtggaataaccgtcgatcattccacgctttcccgctgggttcatcgtctgatcccgttgagggtcaaacgctatcggcggagcaagcccgccgttgggcgtcggtggcgaagggatgaaactgatatcaaaatcaaagggcaatggcgtggttctgtcgcattaacagagaaaatctga

SEQ ID NO: 5948 - DNA, 186 bp, Xenorhabdus bovienii
  Coding DNA location: Contig name=SeqID_16918; Position on contig =28145..28330bp; Strand=-
gtggagcaagatcaccgcaatatcaaacgtcagatacggccgatgttaagctttaaatcgtttcgccgggcccaaacgattttagcggggatagagcgcgtttcgatgcgacgtaaaagacaatactcacaatcagaagataaggcattgtcaccgacagaaatgttttaccgattagctgcataa

SEQ ID NO: 5949 - DNA, 432 bp, Xenorhabdus bovienii
  Coding DNA location: Contig name=SeqID_16918; Position on contig =28322..28753bp; Strand=+
ttgctccactcagttgttcaggtatttactctgtcggatagtgagggtttcctctttgggtctatcggcgttgagcgtcgccagtgcagtggtattcgccccacttttatcaagggtcacgacctcaggctcaccgtgatggcggatcgccttgcgaaagaagcgcaacgcggcgggagcatcccgcttggccgtcagcaggaagtcgatagtttgcccggccgtatcgactgctcggtacaaatattttcattgtcctttgattttgatagaggtttcatccatgcgccagcgacgccccacaggacgtttatgtcgacgaaaagctttacccagcaatggggtaagccggataacccagcgatacagagtggaatggtcgacggttatcccccgctcagccatcatctcttcgagattgcgctggcttag

SEQ ID NO: 5950 - DNA, 237 bp, Xenorhabdus bovienii
  Coding DNA location: Contig name=SeqID_16918; Position on contig =28885..29121bp; Strand=+
atgcgacagaaccccctactgtgcctgctggatggttggcaaacaatggtatgtggacttctccgtactttgaaggatgctcaaattacagttattatttctggagtgagttattggaggatcgggcttccacttgcatggtggctctcgcagttttctctcggccctgatggtgtcgggtggggaatgtgttccgggctgttcatcgcttgttttataatgcagattagattgtaa

SEQ ID NO: 5951 - DNA, 723 bp, Xenorhabdus bovienii
  Coding DNA location: Contig name=SeqID_16918; Position on contig =29411..30133bp; Strand=-
atgagtagcgtaagtataaaattcagtgatggacgtaatgacgttgttggtgttgataatgccaatgcaattctgcgtgaagttggcgtgcggattagtttggtatctatcccagaagaagctaaacctattatcaaagtatcaaaaacccgtgcaactaacgatgaagagaagaaaaaacttatttccatctttaatttaaaccgcgcagattttctggagcaaatccggcttgctgggcgaactccagcagttaatcgcggtggctatttatctactacagaagtagatgttcccccttatccaaaagtttacgatatgaaagaaatgacagatgaaatgaaaaaatacgtactgagtaaatttggtcgactgcatgtaaattcttctgaagatggctccggaattgacgaagtaatgactgtgatttcaggcggcccattaaattggttctttgttctgaacaatggagtgactgctaacgtgttagttaatgaagttggaccaaacgatcaggctatacgcctcagctatccgggattgggccctcatggtggtttcattaatgcggatcaaggtttactggtggcatacgcacatggtccggaaacatttgtgatgcgttatgaggatcccagcgtagcccattcagaaatgctgaataccaatccttggatggacttttcgggtgacaggccgaaactattagataaagtaaaataa

SEQ ID NO: 5952 - DNA, 129 bp, Xenorhabdus bovienii
  Coding DNA location: Contig name=SeqID_16918; Position on contig =30183..30311bp; Strand=+
atggatttcaaagggttctgttgcaataagcaaagccttggtaatgtaatatctcacttatttgttgataaaggtgtcgtcaatgtcgttgatacgaaaagccttcaaacgtttacattatcccgttga

SEQ ID NO: 5953 - DNA, 693 bp, Xenorhabdus bovienii
  Coding DNA location: Contig name=SeqID_16918; Position on contig =30265..30957bp; Strand=+
atgtcgttgatacgaaaagccttcaaacgtttacattatcccgttgatatcatcgctcagtgtgtccgcgggtacctatcttatgcgctaagccagcgcaatctcgaagagatgatggctgagcgggggataaccgtcgaccattccacactgtatcgctgggttatcagaacaccattgctgggtaaggcttttcgtcgacataaacgtcctgtggggcgtcgctggcgcatggatgaaaccgacatcaaaatcaaaggtcagtggaaatacctttaccgggcggtcgatacggccggtaaaacgattgattttttattgaccgacaaacgagataccgcagccgccttgcgtttcttccgtaaagccctacggcaacacggggagcctgacatcatcaccctcgataagagtggggccaacaccgccgctatcgccttgctgaataccgataaatcaaaggaagaggccataaaaatctgccaggataagtttctcaataaccgcattgagcaagatcatcggaatatcaaacgtcggatacgacccatgttaggttttaaatcgtttcgccggacccaaacgattttagcggggatagagcgcgtttcgatgcggcgtaaagggcaatactcacaacccgaagataagacattgtcaccggcagaactgttttatcgattaactacataa

SEQ ID NO: 5954 - DNA, 438 bp, Xenorhabdus bovienii
  Coding DNA location: Contig name=SeqID_16918; Position on contig =31050..31487bp; Strand=+
atgtcccttatccgaaatgtgttcaaacgcctgcattatcctgttgatattatcgctcagtgcgttcgctggtatctggcctactcgctaagcctaagtaatctcgaggaaatgctcgttgagcgcgggattgccgttgatcattccacgctctctcgttgggttcatcgctgggttctgttgatcgttaaacgttatcggcggagcaagcccgaagttgagcgtcggtggcgaatggatgaaaccgatatcaaaatcaaaggacaatggcgttacctctaccgggctgtagactcagatggtaatacggttgaatttttgctgaccgcacatcgggataaaaaagcggcattgcgtttcttcaaaaaggcgatgcgtcaacatggacaacctgacggggtaactcttgataaaagcggtgccaataaagcggcgtag

SEQ ID NO: 5955 - DNA, 123 bp, Xenorhabdus bovienii
  Coding DNA location: Contig name=SeqID_16918; Position on contig =31677..31799bp; Strand=+
atgattttgctcgcgatctctctgttaatgcgacagaaccagcaaaagtatcatcaggccggccataatatttttattaatgcattaataaaatatagtaagcgttcggggaaccacacctag

SEQ ID NO: 5956 - DNA, 117 bp, Xenorhabdus bovienii
  Coding DNA location: Contig name=SeqID_16918; Position on contig =31753..31869bp; Strand=-
atgattatttggcaaacaaggggcgtccatgtatgcacgttaatgcaccagaaccgtgaatttaccctggctaggtgtggttccccgaacgcttactatattttattaatgcattaa

SEQ ID NO: 5957 - DNA, 132 bp, Xenorhabdus bovienii
  Coding DNA location: Contig name=SeqID_16918; Position on contig =31985..32116bp; Strand=+
atgagcgcttgcacgacaccagagtttcctgatcacggtccgacctgtcttgccatcacttctcgattgcccgtgcaacctttggaaactgcttttatatggactcccttcatttgcactttatggctttag

SEQ ID NO: 5958 - DNA, 288 bp, Xenorhabdus bovienii
  Coding DNA location: Contig name=SeqID_16918; Position on contig =32083..32370bp; Strand=+
atggactcccttcatttgcactttatggctttagtcgcttgtttccgggttcccataatctgcctcaaactccctgccatgcaccagcaactcccagataatccgggtatttttattcgccagcgccaccacagcaacattagtattacgtctcgacaacagactattcagccagttttctgttcaaccggttttctcttttacgtaccgtaccaccgccctggctccatggatcaacagtgtccgaaagtaattgtcaccctgtttgctgatcccctgcaaggttga

SEQ ID NO: 5959 - DNA, 312 bp, Xenorhabdus bovienii
  Coding DNA location: Contig name=SeqID_16918; Position on contig =32389..32700bp; Strand=-
atgatttcttcaagatcgcgcaggctgagcgagtttgggatcgttatcgctcaggggataagacagattgccgtacgactgcccgagattctagaggatgccagtaatagcttgccagataccttcaggcaactgctccagcggttgggtgaacacttgaaggagcttgatcgtcaggttacggaactggaacaggacattcaacattggcatcgtggcaatgcagacagccgaagattatcggaaatacccggtatcggcccgataacggccagtgacctgacggcatggcggggtctggtcccccgataa

SEQ ID NO: 5960 - DNA, 210 bp, Xenorhabdus bovienii
  Coding DNA location: Contig name=SeqID_16918; Position on contig =32755..32964bp; Strand=-
gtggcgaacgcccttgttgaaaaagcgacgggcggcatcgctgttccggttggcggtcaacaagaagtctaccgtattgccagcagagcccactgcccgataaagagagcgccactggcctttaatgttgagataggcttaatccatccgcccccgccgccccacggtgcgcttgtgttggcggaacgccttattctgcaaaggggttaa

SEQ ID NO: 5961 - DNA, 354 bp, Xenorhabdus bovienii
  Coding DNA location: Contig name=SeqID_16918; Position on contig =32862..33215bp; Strand=-
atgttaaaactgccctttgcgtatcatgtgcacccattcaattcctgccagcagggtctgggctcttctgaacgagccgaacccaagcatcgcccgcacccgtcgtttgatgtttcggtggtcttgctctatcagattattcaggtatgtgttttgccgtattttgatgtggtttttcttctgcttgcccgcattgaggccgtccaccgccgctttattggctccgcttttatcaagggtcacgacctctggtggcgaacgcccttgttgaaaaagcgacgggcggcatcgctgttccggttggcggtcaacaagaagtctaccgtattgccagcagagcccactgcccgataa

SEQ ID NO: 5962 - DNA, 132 bp, Xenorhabdus bovienii
  Coding DNA location: Contig name=SeqID_16918; Position on contig =33179..33310bp; Strand=+
atgggtgcacatgatacgcaaagggcagttttaacatccacaagggcaaggattgtcatcggcacaaccattctatcggctagcagcctaaaaaatcagctaaccgactttatgataactttcaaccagtaa

SEQ ID NO: 5963 - DNA, 972 bp, Xenorhabdus bovienii
  Coding DNA location: Contig name=SeqID_16918; Position on contig =33458..34429bp; Strand=-
atgcaaaataaaagaaaaacaatcggtagaatacttagcactgaatcattaccggagtcttcaaaggtgaaaggcacagaacaacgctttacgttgtcgtcaggtaaaacagctgtgttccaccaggagcacattccagcggataggctcgaagcacagaccatagtccagttctcagttaatggccgtgaccagagcgcactcactgaagaatcgctgagtgacatcgttcgaacaattaaacttcagcaatttttcccagcgatcggacgcaaagttggtgacaagatagaaatcctcgacggctcgcgtagacgtgctgctgccttgtattgcaagatcggcttaaatatccttgttaccaataccgatattagcagtgaagacgccagacagctggcagctgacatccaaacagcgaaagagcataatattcgtgaaatcggcctgcgcctgatacaacttcgcgatggtggcatgacccaaaaagagatcgctgcatcgcaaaaaatgtctcctgcaaaagtaaccagagccatacagtgcgcctcagtttccaatgatatggtggcgattttcccgatccaatccgagttgtcataccctgattataaattgctattggacattgatgttttcatcaagagcaacaatctctctataaatgatgtggtaaatgatgtgcgtgaaggtgttgctcagatggggaacagcgaccaaattgcggcagatgaaatgaaaaacctgatacttaagttctttaagcaaatcaccagtaaattagcgactaaaaacgactcaaccaaagcacagataagcccgatctgggagtttaaggaaaaggatgttttcgcccgtaagcgcgtaaaggataggtccattagctatgaatttaatcgggttcctaaagctttccaggaagagctggagagaatgattcaagtcgtattacgcaagcatttcaatgaataa

SEQ ID NO: 5964 - DNA, 1218 bp, Xenorhabdus bovienii
  Coding DNA location: Contig name=SeqID_16918; Position on contig =34419..35636bp; Strand=-
atgaatgatgcatataaacaattagatagagttgctgagcgctccgtgcgcttattacagtccttaaccgaacagatccagactcagaaagaagagttaaatgaaacatcgtattaccaagtgtattcaaaagctgcagtagcgaaactgccaaaattaacgcgtgcaagtgttgattatgctgtcagcgaaatggaagagcagggttatgaattcgagaaacgccaaacaggctcctcttccaaatacgcgatgacacttcagaacatcattgacctctatcatcatcgtggtgtaccaaagtaccgtgatcgctactttggagcattcactttttttgtcgggaacctgaagggtggcgtatccaaaaccgtcagtacagtatcactggctcatgccctgcgcacgcatccgcatcttatctatgaagacttaagaatattggttattgacctggatccccaagcatcagcaacgatgtttttaaaccacgagcaatctatcggttctgtggagacaacctccgcacaggccatgctgcaagatgtaagtcgcgaagaattgctggctgagttcatcataccttctgttgtgcaaggcgtagatgtcattgcagcttcaattgaagatgcatttattgcttcacgttgggaagagctatgcgcagagcatctaccaggccgaaatatctatactgttttaagagataatatcatcagtaaaatcagcaaggattacgattttatcttcatagatagcggcccacatctcgactcatttttatctaacgctatcacagcggcggatatcctaatgacaccaattccacccgctcaggtagactttcattcaacactaaagtatctcgctcgactgcctgaattggttgaattgattgagtcaacaggtgcgtcaacaagcttgatgggcaatattgggtttatgtctaagctattaaacaaaacggaccacaagctatgccatagcttggcaaaagagatttttggtggtgatatgcttgatttctctctacctcgccttgatgggttcgagcggtgtggcgagtcatttgacacagtaatttcggcaaacccttcaacctacataggaagcagtgaagcattgaagaacgctaaaaatgccgcagaagactttgccaagtcagtttttgatcgtgttgaatttttaagagcaaacagaggtaatcatgcaaaataa

SEQ ID NO: 5965 - DNA, 144 bp, Xenorhabdus bovienii
  Coding DNA location: Contig name=SeqID_16918; Position on contig =35924..36067bp; Strand=-
atgttaggctttaaatcatttcgccgatcccaaacgattttagcggggatagagctcgtttcgatgctgcgtaaagggcaatactcacaacccgaagataaaacattgtcaccggcagaactgttttatcgattgactgaataa

SEQ ID NO: 5966 - DNA, 159 bp, Xenorhabdus bovienii
  Coding DNA location: Contig name=SeqID_16918; Position on contig =36185..36343bp; Strand=-
atggagacgtttaaaggcgtttcggctcaggggcatcgtttggaactcgcgcaaaaaccgggaagtttacctgaagttccgttaatgcgacagaaccaaggacaatatccgcaatgtccgctttcacccgccgaatttttctatcaactcgctgcataa

SEQ ID NO: 5967 - DNA, 696 bp, Xenorhabdus bovienii
  Coding DNA location: Contig name=SeqID_16918; Position on contig =36308..37003bp; Strand=+
atgcccctgagccgaaacgcctttaaacgtctccattatcccgtcgatatcattgctcaatgtgtccgttggtatttggcctacgccctgagtttgcgtaacttagaggaaatgatggttgaacgggggattgccgttgatcattctaccctttcccgttgggttcatcgtctgattccgttgcttgtgaaacgttatcggcggtgcaagcctgatgttgggcatcgctggcgaatggatgaaaccgatatcaaaatcaaaggccaatggaaatatttgtatcgagctgtggactcagacggcaagacagtggattttttgttgacggctcgtcgggataagtcgtcggccttgcgtttcttcaaaaaggcgatgcgtcagcatggccaaccggacgtggtgacaatggataaaagtggcgccaataaagctgcagtggatgaattaaatcaaggaaagccaaaagaggaagccattgttatccggcaaaacaaatacctcaataatctgattgaacaggatcaccgcaacatcaaacggcgaatacatcccatgctgggatttaaacatttccggcgagctcaaacgttattgagcggtattgaattggtcagtatgttacgtaaaggacaatatccgcaagaaccagagtgttttctttcacccgccgactttttctatcaattggctgcataa

SEQ ID NO: 5968 - DNA, 240 bp, Xenorhabdus bovienii
  Coding DNA location: Contig name=SeqID_16918; Position on contig =37029..37268bp; Strand=-
atgtcgttgatacgaaaagccttcaaacggttgcattaccccgttgatatcatcgcccagtgcgtccgttggtatttggcctatgccctaagcctacgcaatctcgaagagatgatggcagagcgcggcattgaggtcgaccatgccacgatacctcgctgggtgttacgtttggtgcccctgctcggcaaggctttccgacctcgcaaaaagggttctgtcgcattaacagagcgctag

SEQ ID NO: 5969 - DNA, 492 bp, Xenorhabdus bovienii; identical to SEQ ID NO: 1438
  Coding DNA location: Contig name=SeqID_16918; Position on contig =37360..37851bp; Strand=+

SEQ ID NO: 5970 - DNA, 354 bp, Xenorhabdus bovienii; identical to SEQ ID NO: 1741
  Coding DNA location: Contig name=SeqID_16918; Position on contig =37788..38141bp; Strand=+

SEQ ID NO: 5971 - DNA, 1041 bp, Xenorhabdus bovienii
  Coding DNA location: Contig name=SeqID_16918; Position on contig =38236..39276bp; Strand=-
atgaaagcccttgtttatcatggcgcaggaaaaaagcattgggaagtaaaagccccccctcaactgattgagtcaaccgatgcaatcgtccgcattatcaaaaccaccatttgcggaacagatctacatattctcaaaggggatgttccaactgtagatgccgggcgaacattgggccatgaagggattgggatagtcgaatccgtgggagaatctgtccataatatcaaagtgggtgataaagtaattatctcctgcatcacagtttgtggtcgttgtcgttattgtaaacgccagctttattcccattgtgaagagggcggttggatacttggacataagatcgatggcacgcagagtgaaaaagtgcgtattccccatgcagataacagcctacaccgtctgccggaaggcattgatgaagaagcggcattaatgctcagtgacatcctgcctacgggtcttgagatcggtgtcatcaatggcaaggtgcaaccgggtaataccctcgccttgatcggcgcaggccctgtagggctttctgcgttactggcatcccagttttattcacccgcccatatcatcatgattgataccgatgataaccgccttcatgtcgcccaacagtttggtgctgacaccgtcatcaaccccacacatcaaaatgtggtggaagtcatccagaagctcactgatggcctgggtgtcgatgtcgcaattgagtgcgttggtatccctgcaacattcaagatctgccaagatatcattactgctggtggacatatcgctaacgttggtgttcatggaaaatccgttgaattgcacttagaagatctttggatcaaaaacatcactatcacgacaggattagtgaacacaagcagcacaccgatgctgttgaaaagcctccaatccggcaagatttcacccgaaaagctggtcactcatcgctattcgctaagtgaaattgaaaccgcctatgaagtttttggtaacgcggcaaaggagcaagctcttaaaattgttcttaatgcagaataa

SEQ ID NO: 5972 - DNA, 171 bp, Xenorhabdus bovienii
  Coding DNA location: Contig name=SeqID_16918; Position on contig =39256..39426bp; Strand=+
atgataaacaagggctttcataaggtctctcccataggttatttgtttttttgccgtgttagtccaattccttcaatgagtgaaaaccactcaatattaaaaagtgtagtctctttcacaataaaattggaacaaagacatcgttcctcagtgaagagccattttttctaa

SEQ ID NO: 5973 - DNA, 294 bp, Xenorhabdus bovienii
  Coding DNA location: Contig name=SeqID_16918; Position on contig =39538..39831bp; Strand=-
atgatcgataaaagcggcgccaatactgcggctctggccacgctcaatgccgacaaacctgaagaggaaaacatcaccctcaggcaaagcaagtatctgaataacctggttgagcaagatcaccgtagtatcaatcgtcggatacgacagatgctggggttcaaatcgtttcgccgggcacagacgctcctggccggcatcgaactgattcacatgatacgcaaagggcaatatcaacatccacaaagtgatggattatcacccgcggaacaattctatttgctggctgcctaa

SEQ ID NO: 5974 - DNA, 219 bp, Xenorhabdus bovienii
  Coding DNA location: Contig name=SeqID_16918; Position on contig =39895..40113bp; Strand=-
atgtcattgatccgaaaagccttccgtcgcctgcattatcccaccgatgttatcgctcagtgtgttcggtggtacctcgcttatgccctgagtctgcacaatctcgaggagatgatggctgagcatggtgttatcgttgacattccacgcttcaccgttggttcatccgtctggtgccattgctggataaggcatttcgccggcataaacggtcggtag

SEQ ID NO: 5975 - DNA, 108 bp, Xenorhabdus bovienii
  Coding DNA location: Contig name=SeqID_16918; Position on contig =40107..40214bp; Strand=+
atgacatggtcaggtaacaccataaaaaacaacatgttacccgacgattccttaatgcgacagaaccctactgctcgcctaaaaaataatcaccgcaatttttgctaa

SEQ ID NO: 5976 - DNA, 762 bp, Xenorhabdus bovienii
  Coding DNA location: Contig name=SeqID_16918; Position on contig =40352..41113bp; Strand=-
ttggaaaaacaggagcatagtttggaacgtaataagctgtttattataccagagccggttaatagcccgaggctgagaatattctgttttccctatgcggggggatctgcaaagacataccttgattgggccgaacattttacggataacattgaaattgttgccgtacagccgccgggtcgaacaactcggcttgatgaagcgccgtatgaagatttgtattcgctggtggatgagttaatggctcatgcggaatttatcacgaagatcccatatgctttcattggacacagtctgggctgtcgggtggcatttgagcttgcctgcaaattgcaatcctgtggttatccggttcctgtgcatttcttcgtatcaggctgcacagccccgcatttgagacataatttccccgatactcacgacttacctcacgatgaatttatccgtgagttacggaaaatgaatggcgctacagatgaagtcctgttaaacagcgagcttatggatttcttgctgccggttttaaaggctgattttaaaatggctgaaacttatcaggcaaaacggtgcctgctgaaaagcccgataacagttttaagcggagattctgacccagacattaaaccgattgaactctatgcctggtcagaattatccagcgaaggtctaactgtacaatatatcccgggcgatcatttttttatcgttcaaaataaagagaaggttattgaggttatgttagcgttactatctcagatatag

SEQ ID NO: 5977 - DNA, 3345 bp, Xenorhabdus bovienii
  Coding DNA location: Contig name=SeqID_16918; Position on contig =41116..44460bp; Strand=-
atgaatactgatactgagatggatagtacttttgaggttggtgctacttttgagattgatgaaatacaggcatctgctggtcagcaagacttatggttggcggagcaattaaccgaaaaacagctctacattgtgccggtcacctacgagttggtcggagcgttggatcaggcgagattattggacgcaattgcacagacgatccaaaacagtgaagctttccgtacggcatttgtcgaaactgaacaggagctggtacagcatatttatcctgcggttgaattgcctgttaccgttgtggatctgtctgagccaaacggggcttcggataatgatcagtcacaactacaacgggcactgacttattgccagcacaacttggagacgccatttacattgagccagcccggtttggctcgttttctgctgatcaaattaggagagcaacgccatattctgcatttttgcctccaccacctgatttgtgacaatgattctgtcgccttaattctcaataacattgcgactacatacgcaggagagccgttattcagtgacaacacaggagccgatatccttgaatatgctgaatttgcggcttggcagaatgaattactgcgtggtgactacttggacggtgatgaagcttattggctgaaggagttgtcgggagtagatggccggttggaactctctatcggtaatcccataccatcaaaaaatgaacagggcggtatggttcggcgtttgctggaaccgcatttagctaactccttcaatcattgtgcctctagcttgggtatttcaccggcactcgcttactttatcgtatatgctgcgctactgtaccgattgacggaacaacaaacgattgtgttcggtgtccccacgtctttgcgggatgataagcgtctggagaaaacgataggttactttatcaatgtgttaccaattaaagtgatcttccacccgaaaatcagttttgccgatattgccactcagttgagtagccagctttacaccggtatgcaacatcagcaatttccttacagccatattgtgcgcagtgtcagccattcgcagcagatctctcaggctccgctattcaacgtcatgtacaactattttgtcggtcaggcagattggacattacccggaactcgtgcttatcaacatgaattaaccccggtcgggggaaaattcccattgacgttgtttgtggttaatcacattgacaccgtggagctatgttttgaatatcaatatgaccatgttgcgacagactattctggtgtattaagcaacagttatcagcgattgtgtaccgcgatgatcctcaatgccaatcaagaggtattggctcagactttgctgagtgaggatgattatcaacgtcaggtgctgacattcaatcagaccggtattctctttcaggaagacttctgtcagcatttctttcgccaattgaacgtagaatctgagttaacagcagttgaatacctagttggatcgcattccgaaagaatgagttatgaaaaattatactctctgagccagaaagtcgctgatgaattacgccgacatattatttcagaaacggcacagcaggccagagttgtgattttctctggtgccagtcccttggctctagccactatcattgcctgtttgacggaaggtattgtatggatacctgtcgatagccacttacctcttaaccgtctattgctgattatcgaggatgcctgccctgatgccatcgtgattgagggagatgtcgtggagggcaaaaatgcgtcgttggttgcggagatggcgtgttttaataccccagtcattgagctgacgcgcgaatgggaagcagtgagcagagacaacaacaggaactttggccctttagcccctcaatgggaacgcatcacccaaagtgactgcctttgctacatgatttatacctccggtacgacaggcaaaccgaaaggcgttgaagtttatcgcaaagggctgaataactatctcaactgggcagcacaaacctatatgccgacaaaggcccatgatttgggtgggctgggcgtccccgtgacaacttccttcgggtttgatgccaccatcaccagtttgctcttgccattgatggcacgcggacacgtcatgttgttctcctcgcaagtcagtcaggatagccaagatgagccattgctgcgcttattagaactgaacaaaccactgggattaatgaaaacgacaccttcacaactggaacatctggcgctcagtttagggcagcggcagacatcgctggacgttaaagtgatcgttgtcggtggcgagcagatgagtcgcacccatctggattatctcaacgctattgctcctgaaagcatgtgttttaatgaatatggcccaacagagacggtcgtgggttgctgcgtagagcgattgaacatcgtggcagatccgcaaaggagtcagggggtgttacccatcggttctcctattgccaatacacggatgtatgttctcaatgaaagtggttgccatcaaccagcaggggttgtcggtgaattattcatcggtggggcgggggtagccaaaggatattggcagcgtcccgacttaacggcggcggcgtttattgaagatactttttcccatattaacggggaacggctttataaaaccggcgatttgggttgttttaccatggataacacgctgctgtgtctggggcggaaggataagcagatcaaacttcgaggctatcgaatcgagccggaagagcttgaagcatggattaagcaggtgccggatattgataaagctgtggtcgtagttgaaaaacggccccatgagcggctctgtggttatctggtagcggcttcggggtttgcgggcagtactcatcaactcattgatcaggtcaaacagtatctgcaaggtcaattgccagattatatgatcccaacgcaatggcgggtgattgacgctatcccttataccgttaacaataaaattgataccgcggctttattgacgttcgggcaaaaccaatattctcttgtggcagaagaacatgtggaatgtgaatttagctctgatattgccagacagctctgttcccatttcagtgaggcgctaaatcgcagcactgttttgccggaggataatttcttcgagctaggaggggattctctgatggctgtgcgtctactggcaaaaattaatacccattttaccattgagctaaaactcaaagctttttatcagcgtccatctctgacaaatttgattgagttagcggaggaacagttacgtcatagcaatacgaatatcaataggtaa

SEQ ID NO: 5978 - DNA, 1209 bp, Xenorhabdus bovienii
  Coding DNA location: Contig name=SeqID_16918; Position on contig =44474..45682bp; Strand=-
atgagcgatactacagtaaggttacttgacggtggtgaaggcgttctgaataacgtattttctccttatgctgattatttcatcgacatgcttagtcagcgtaactcttttattgcaactgaacctgttgggatctatgagagccaagttaagcattacatttgtcaggattattttaatgatgaacagaaagatctgtggaaaaagatcccgcagtttatagcacccatccagacactggaaaatatcggtgattttattacggttgattaccaaggccgtgttcccatgatcgtgagcaaagtagacaatgatcgctgtactgtatttgaaaacgtgtgtccacatcggggagccaggcttgaaaaccacacggaaggatgcaaaaaagcctttgtttgcccttatcatagttggtcattcagccatcaggggcatttgattgctgctcgttggcgggaaacatttcccgaaataccagaccaatatcgttcgctgaattcaattagtgcccaacaaagattcggtatgttgtggcaaataccgagcgatcctaagcttggcttttcgctggataattggttcgctgctattgaagatcaaatttccgcaatcgattttgaacagcatcaactgctgaattcccgcgaaagaatggtgcaagctaactggaagctgctgatcgaaaactttatcgaatattaccatgtccagtctttacaccggaaaagtttggcacccacattgaatggtcaattgtactcactggattcttttgcccagcacggccgtatcctgaccccactgaaaaatttggctcaggttctccagcaaacaccccacaagatacggcgggaaatggttgctacttatttactgttccctaacgtgattatcggggtgcagccttatcatgtttttgtctctttttaccatcccgtatcggccaaccaaacttggtcgaagaccttcaactttatccataaagcggatgaagagatcaaggaggtatgccaattagatgtggaatatttggcggaagcgttggaagaggattacgaagccatcgaacaagtccagaaaaatctggaaacaaccagtgctccgagcctgttgtatggtgaggcagagtctcttatcagccagttgcaccgcaacttagcggcgattttgcatccaaatggcagggaggcaaaccggcatgaataa

SEQ ID NO: 5979 - DNA, 1023 bp, Xenorhabdus bovienii
  Coding DNA location: Contig name=SeqID_16918; Position on contig =45682..46704bp; Strand=-
atgctcaggataggcattatcggtacgggtgctgttgcgtgttatttagcccatcaatgtaaacaacaagggtgtcaggtttttttattatcttcacgcggtacaagacatcaagcacaaccgatcagccaaatacagctgatcgatgagacaaaatctgaacaatcagtgagtcaagatctcggtagcattgttgtcgatgagcaccttacagactacagcgcttttttggctaaagagttcgatcaactgtacgtgtgcagtaaaactgtctccaatccgcatatttgtcagcaattatcgcgtcataaacactggcttcgtggcccagttatcttatttcagaatggttttgccacagaacggccatttattgatgaagcactggatgtcacgattattcgtggggttctcaatttctctgtgactcagcatggcaaacaaaaactgaaattgaggtttcttaaaaccagctatcttggcgtccctgaacagaccgaagaacgggcagaagcgaacattttagcggcgttggatttactcaatcgagcgggcattcccttcgaaagctgtacagatatagagcataaagcatttgctaaaaacacactgaatgcggcggcatccgtgtgtggattagtccgttcaggcgtcgaaacggcgatgcgcaatagccgttccagaacagtgatccaagcgattattgacgaatgtacggccattggtgagaaagccggatacatcggcgatagtgaaaattttcggcgccagtcaatgggatatttgatgtccattcctgattttaaatcctctttggtgctggatatccttcatggcaaagaaacagaggcagacaccttactcgctccctttatcagactgagccaacacgtgggcattgcggtgccaaatctggattttgtttatcgttatttcgatttttacaatacctatataacccaatcgtacataatccaatcttatacattcacggatatgactctggtcgaaggagatgcttaa

SEQ ID NO: 5980 - DNA, 1251 bp, Xenorhabdus bovienii
  Coding DNA location: Contig name=SeqID_16918; Position on contig =46706..47956bp; Strand=-
atgaaggggatcaatgggttttatccgctgtggattggcattgccgtgtcgatttttggtagtgagctgaccgaatttgcgttcgggttgtggttgctggaaaaacaaatgtcagtcactgcctacactaacatgtatttggtattagtgcttccggcctttttactgatgccgttagtcgggtatgtgattgatcattacgataaacgtaaggtgttattactgacagaaggaattgcaggtttagccttggcaattgtgcttatcttcaaccactttggctatctcaataacatcgtggtttatctctatatcgcattgaccagtgtgttgactgcgttgcagattgattgctacagcacgctggttttccggctggttccggccgcttcgctgaatcgggcgaattcgttgggcagcctcagcgattcattaccacaaatgcttgccccgatcatcggcgcgtttctgttctcacactacggtttggggattgtgctgacgatcgatctgttgacctttatgatcagtgcatttgctgccgggttattgttcagggtcagcgcagtgcagtttctgccgcacgatgatggcacactctctaaattgaactggaaggcgatttttccggatatcgggtgcgcccggttggtcaaggcatcgtcgaaaatgacttatatgattgcgtacacctttttcaaagccattttggtggggggagcgttaatcactattgtaccttatttcaccacctacttttctgtcgcagatgcaggctacatgatgtctatcggtggcgtctccatggtgatcgtcagccttatatcggcatggcggccatctatattaagacgtacgccgctattagtattggaattcctgttcgcggcgggttttgtggtattgacgcagataaagaatatttatgtcgccggcgcttgtattgcgattagctttatcacgatgcggataagcatcattaaaatgcaaacgttatggcaaaccacagtgccgaaaatatatcacggtcgtgtcttcgcgctgcgtaatctggttaagacattcagtagtttcattatttatctcatcactggaattgtattggatctcttactggctcaggaggagggatgggcgatttgggggcagggtaatccaatggatctttactttattgggatcaccttactgatattacctcccttgcttatctcgacacgccggttattagtcgctatagggggagaataa

SEQ ID NO: 5981 - DNA, 5673 bp, Xenorhabdus bovienii
  Coding DNA location: Contig name=SeqID_16918; Position on contig =47953..53625bp; Strand=-
atgacgcaactgccaaatgaaattaaacactctctgcaaagttggttacagtcggaattagcgagtgagcatgtgcctaccgatactgactttctggcgctgggtattgagtctctcacattgattagacttaaaaacaatattaaatcccaatatggggtggatatcggtatcgggaaattttttaagggattgtcgaatattgataaggttgccaatttcgtcagtcagcagacccaacctgctccggctggtagcgttaatgataagccgcagatgccgctatctgtgccagagatgccaacgccacaacaatcacaagcacaggtacagccacaggaaaccgtcaatatgcagcgtgagccgatagattcaccaacatctccattagcatcattgtcgccccctgtgtcgcctattgcgatggcgttcaacgagcctatagttaatacacctatggctaatgcacctattgatactgtccgcgaaaccaaacacgatattgatactaaacagggcattatggtggctcagttaaacgctatgcagcaactgttccaacaacagttggcggtattgcagaatgtcaggggaggaaccacgaattttgcaacagcgaatcaattgccagtgtcagcattgaccccagcattatccacagtacctacaacatcaaatacggttccgctaaacagcgctcaatcaaccaaacaatccgtcgaagttcctactaatcattctgaacagcctcagcctatggtgattaggccagcagcttcatcgggtgaaaaagccaaatttacctacaaaccgattgtgctttcagaatctgtgcaatgtgatgccgaaacaaccgcgtttattcaacaatacaacgcgaaaaccagcgcttcaaaaaccactattcagaaatatcggacagctctctgtgataaccgcaatgcgatccaattcaacagcaaacttaaagaactgtgttatccgattgtggggaaaacggcaaaaggggcacactttaccgatctggacggtaatgtttttatcgatatcgcgatgggatttggcgtcaatttttttggtcataatcccgactttatccaacaagcgttgcaaaaacggctccagcacggctttcatcttggtcccgttgatgagtccgggatggttgttgcggatctcatcactgaaatcaccggcgttgaacgggtcgctttcaccaattcaggctctgaggcgattatgcttgcctgccgcgtggcgagagctgccagcgggaaacaaaagattgtcatctttaataatgcctatcacggtcattatacggaaatcctttttatgggcggcatgaagcaaggagagcggttttctcaatccagcggtattcctgacaatttgggacaggatattgtggtgcttaattatggcgaacagcaaagcttggattacattacgacccatgggcatgaaatcgccatggtcatggttgaacctgtccaatcacgcaatattaatttacgaccgaaatcttttattaagacgttacggaaaatcaccgcacaacagaatatcgtattgttatttgacgagatcattacagggttccgttatcacgcccgaggcgcccaacattactatcaggtcaaggcagatttggtgacttatggcaaagtcatcggtggtggcctgcccgttggtgtgttagctggggatgccgcagtgatggattatattgatggcggtttctggcaatttggtgacgcgtcttacccgccgaatgaaaccaccttctttgcaggaacgttttgtaaacatcctttggcgatggcagcagcagaagcgacgctgttacatatgaaagcacaaggaccatcgttacaagctgatttgaacgacagaactacagggttcgttaaacggcttaatggtttattcacggcagcaaatagcgggatagacgttgcgaattttggatcactttttaaattcagccagaagaaaaatcacgaactgctcttccatcatttattgatgaatggggtttatacgtgggagggacgcacttgtttcctctctaccgctcatgatgataatgtactggaggcgtgtttcaacgccttcgagaaaaccgttgaaggaatctcagttccttctcgctcttcttcttttcgtccgcaggatagaccgactaccccgaaaacgcaggaaatagtggtcttggctgaactcgggatgcagaaaaatctggcgatggcgagttggtacgatccggcagcctcaaaatcttacaatgaattcattcagtgtgtgattaccgatgaattgcagccccatcgtttgaacagcacgattgagtatctattcaatcgtcaccaacagctgcgacaggtattttgccctgaaacgtttgaaacggcaccgggacaatttgattatcatgctgcaatgcgggctgagcagtcgcccctcgattcaccagagaaattttctcaatggcaacaagcatgtctggatgaagaatttatactcgaccgtgggccgatgttcagagtacatgtggtacagattgatctgtcccgaccattatgggatgggactcctttggcacaatacgcatcggatcattgccgggtggatatcatacttttggttgcccaccatactgttgtcgatggcgtctcttttgatattttcattgacgagttggtagctgtttatcatggtgccagtgacttgccacccgttttgcaatatcaagattatctgggacggttggctgcattcaaaaggacaccagactttattcatcagaaatcattctggcataaatatttatctggttggcagacggatttggctaatttaccagccccggtacctgccgtgctcactgaggaaggtgacgtgcttgctacggggggcttccatctggagaaattaccggctgaattgacggccaagcttttgcattacgccaccgaacatcgcgtgacaccttacatgttgatgtataccgtctactccatttttctgggttcggtacttaaacaatctcagttcgttatgtccacatcggtgtccgggcgcaactttgataatttcgataatctggtgggattaacgacagcgatgttgcccgttcgggtgaatacccgtaacgaacagcagtttttcagcgaatatcttgacctgacctgtgagcaattgttggagatcctttcccatcaggatgtgaccgttgacgatctgacgatgcaaaattgcagcttgggcaatcgttcggaaatgctgaaccgttatctcaattacgatttcaattttagcccccgtaaactcaggcttaatgacagcggtagttggtcgctattgttagacaatccaaaacgctacattattggtcaattgtctttggatgtattccagagcgaaaatgacctgtatctgcactgggagtatgcagtacaagcctacagcaaggtacaagttaaaatactgtccggcaaaatggggcaattattgagttacttggttaatgccccagagctagatacactgaccttggccgatattgccacttatctgaactcactggacgcaccctccattgccattgggccagtgcggaaggattttttgtaccaagcaccgatccataccctgtttgaacggcgtgcagccgatgaaccacaggcatgtgcattagttgataccagtttgccagaagggctgaagcaactttcatttgctgagttgaaccatcaggcgaatgcgttggcccatcacttgttacgccaaggattacaaccagaagagcctgtttttgtcagtgtgcgccgtggcgttcctttggcaatctccgtattagccatactgaaatcggggggcgtatatgttcctgtcgataaaaaactccctgtagctcaggttgaatatctgctctcaatactgactccgcgatttgcccttatcgacggggattatggcatctttaaaaccctctctcacgttcaatatttcaacttttacgatgaagaaacgctgttgcgtcaatgtggagtggatgagggaaatacggcgttactgcaaaatcccgaaaaagttattccagcagggcagaccgcttatattacctgtacctcaggcagtacccaaaaagcgaattgcgtgatgaattctcatggtgccatcgcccaccactgtttgatgatgaaggaatatctggcgatctgccccgaagatcggatgcttcaatttaccgatttgtgctgggatattgtccttgaagaacttttccctgtctggactgcgggcggtcgggttgtctttttcggtgatacaccgccaaataccttcgctgatttcaaccaattgctgattgagcaacagattacgctggctgatttaccgtctacctactggcaaggatgggtggagaatttgggcgatcctgcgatggattatccatcgcacttacgacgcattttagtcgggactgaaaaagttgacccacagacgcttaaaaaatggcagcagcacgttccgaaaggagggattttctccaatgcttatgctcagaccgaaaccaccattactgctacggattcggtaattacctctgatacatgggtaggtgaaacagtgccgctcggcaaaccattggcgaataccggtttttatgtgctagatgaagcgcggcagccagtgccgcgtggcgagtctggtgagctgtatattggcggtccgctggtatccaaagggtattacggtaataacagcctgaccgccgccaaatatgtgactgatccgtatattccgcttgaagcttgtaatcatgcaactccgcgcatgtataaaaccggtgacttggtcagcatggatgaacaggggtgtttgtcattcctcgggcgtaccgattttcaaattaaggtacgcggttatcggattgagccgactcagttggaaagtatcatcggccaatgggaaggaatcgaacaggttgtactgacgacaaacagtgtgattgatccacgcattccggtagcggaaacaaaattactctgttatgtgaaaactcaggctgataaagcggaacaaaaggcgttaagcgagcggatacgccagtttatcagtcgcaactttgctcactatatgcagccacatgccattatttatctggctgaattccctaaaactaccaatggcaaaatatcgataaagcgatttcctttgcaacatagtcctttgcaagctagctcatcaccaaacagcgcattacaacacagttcattacagccgcattattctgaaagtgtcgatcaaccaccatcacgagtcgatcttaacagcgctgcgggtcgtttgctgatgactcatcttgggcaacatgggttgagtatgaatgaaagttttgtggcgttgggcggagattcgttaaccgcgatcaaaattttgtctgcattgcaaaaagagcatggcatgactctgagactaccggagtttatggcttgcgaaacattgaccgacctgatcgaatggattgaatcggcgttggctgagagcagggatacagccgggtcgcaggcatccttaccgaatagccatgcagagatgacagggcaaaaagaaaaacccgtattacaggcccgtagtcgtaaaaaaaaggtaatggttgaatga

SEQ ID NO: 5982 - DNA, 4956 bp, Xenorhabdus bovienii
  Coding DNA location: Contig name=SeqID_16918; Position on contig =53630..58585bp; Strand=-
atgcgtaaacaaaagcaaaatgcaggagcagatcgttttgtcgatcaatggcgcggctgccttcagggacttgatactgataatgtacttattttggcgttactgaaaaaagcactcagtgatgttgacgcaatacggtttaacgacttgcaatctgggcgtcagctaagctggtgccaattactgtgcagcgttgcgcgtatttatcgttacttgcatgaattgaacgtttctcgtggtcagagggtggtgacaatttcgcataattgctgggaattactggctattgaattcgcctgtcagcttaaaggtgctatttatgctccgatatatgcaaattattctgaggaggtgatgacttactgcctgtcattggcagaacccgtattagttattactgaaagggtatcactcgcgcagacgctgccgcagaatacctcgtggcaggtgatgacattggagcattccagcactttcactgactttgccagcattgacagcgaaaccgacctgattagtccagataaaaccgtcagtcatgaagttgtcggggaagcgttactcagagcgctcactacagatttgcaggccacgcaggcagaacaagcattttgtttgatgtttacttcgggttccagtggcaaaccgaaaggcgtgttgctcagccagagtaatattctttcacagcaacaggctctgcaaacattatggcatttcgatggcccgcaatcttttctcagttatctgccgtggcaccacagttttggtggattatttgaaaaatacacggccattttcagtcaggcaatgttacatattgataacagccggggcatggatattgctcggctgtgtaccaatttgagtcagttaaaaccgacacgatttttcagtgtgccaaagatactgacagtggttgccaacaaaatgaaacattcagaggattttcagcgtgcagtggcaccgacattgcagatgatcttctctgccgcttccaaactacccgcagatattgaagactattttaatcattgtggtatctacgttgctgagggttggggactgacggaaaccagtccatgcctgacacttaaaggttcagactgtgaagaacacaacagcgtaggccgccctttacccaatgtaactctctgtattgatgaagatagcggggagattttggcaaaagggccgaatgtgatgttgggctattacgcagatgaagcggctaaccgtcgctgcttcaaacaggagtggttcagaacgggcgatctcggcaagatggtcaagggagaacttgtgcttctgggacggttggattcggtcaaaaaactgtctaatggcgaaaaggtgtccagcgatgctattgaacaaagtctgtttgagaaaaccgatattatcaaccatgccattattgatattgaacaacgtccctacgctaccgctttattgtttattaatcctgagctttgccgccagcgatttggtgagaattgcacactacaacattcatcacgcttgcaggagcatattgttgaggtggtacaacagcataatcatcaggtggcggagagttcgcttaaattgattgcggtggcggtcactgaaacttcactgtcccttgccaaaggtgaagtcacaccatcatttaaagtgtcccagcgtactgtacgcgaaaattatcaggttgtgcgtgatgccttatatgataccagcaagcctttccatctaaatccggcatgtcattcatttctgaaaattacggaaaatcatattgtttcatcggttgtttctgaagataccgcgccaaaacagcggattaactgggaaacatttgttcacatcattggccaagtgcgaggccaagagctagccgaggatgatgtacaacgttctttattggatctgggttataactcagtgaccatcatccaattagcagccagtttaagtcaggccatcggccacactgtcacagaagtcgtgttgttctccggttcgtcaattcatcagctttggcagagactggtagtacaaacatcagcagtgcaagccacagatgaaagtcacctgtgcactgaggacacaacatcactgccgcctaaacaaggtaatgctgatgtggcgattatcggctatgccggacgttttcctggcgcagaagattgcgatcagttgtgggaaaatatgctggcaggaaaaagccagttcagccgctgccctgaggatcgtccttttatggcgccactattagcagagtttgaggctaacggcattcagttgagcggggcattttgcgacgatattcgtcagttcaatcatagtttcttccaaattaaccccaaagatgcccgactgatggatccccaacacagattattgttgatggtgacatgggaagctattgagcaggctaacctgagcctgaatggtttgaaagaaagccgaaccggtgtatttgttggcatcagccagaatggttatcggcaattgttacaggagtatctcacggagacaggggaagagggatatccgagcagcgcaatcaacaatcagaatagtgtatgcgctaatcgcttatcgtattttttggatttaagagggccttcgttaacggtcgatactttgtgttcatcatcactggtggcattgcatcaagcgcggttgagtattgaacggggtgaatgtgataccgccattgtagcgggtgtacacctacaactggatatggcccatttcagggaaatgcagcaattgagcgtgttatcccatgatgggatatgccgtccttttgatgccaaggcaaacggaaccgttctgggcgaaggagccggggtggtgatcctcaaacgtcacgatcttgccattcgtgacaacaatgatgtcaaagcaagcctgctggcttccgaaatttatcatggtggacgcagtaatggcatcactgcccccgatctgcttgcacagcaacagttgctggaacagtgttgggcgaatgcagacgtgaaggcgagcgatatcggttatttcgaaactcacggtactggcactcatctgggcgatcctatcgaaatggcgggtatccatgcctgttttcatgaccaaaaagcgcagactccctgttatctgggcgctatcaaagccaacatcgggcatctcgaagctgccgccggtattgccgggttgatcaaacttttgctgattgataaacacagaatggcgccgccagtagcagcattcagcgagttgaatccacggatcactttggcggaagggcaactggcgatccctaccaccgcacaaccgctcgcccctgaaaaaacgtgtctggccgtcagtgcatttggcatgggaggaacaggggcgcatgtagtgatcaaaagccaaagtaaaaaaggactttctgatacagaaccagaaaacgagacattaccttgcgtgttgagcggatgcgatcaagcacacctaaaggctattgccagccgattattggccgatgtgcaacaacatgtgacacaaaagcaatttgtgcttaggcacttttgccaagcactggctcaacgtacggtattaccggttgtctgtacattgggggtaaatagtgctgaacaattggttgagcagttatccgcaatagtcagaggagaagtgattggttatcgcgccagtgaaaatggcccatcaattgctgctataactactgataaaacaacgatggcattagtttttgctgggcagggaactcaatcggtagcgatggcggcacagttgtatcgtcataatgtgcaatttgcccagtggattgatcagattgatcaattgtgttcggagatagcatatgaaagtgggcaactcaaggtggaggtcaaacaacttttgattgagccggtagacgaacagacgatcaaccgtaccgagtttgctcaggttattttgtttgccttcgaatatgtgctctatcaatgtctgcgtcccgccatcgggcgtattgatattctgcttggtcacagtcttggtgaatatgtggcggcctgcatcgcgaatgtattttccctgaaagaagggctgaggatcatcatcaaacgcgctcaattgatggaagccagcgatccccgtggtgcgatgatgatggtgaatggcacagcagagcaagttagcgctctgattgagaacgagctaaagattaaacagcaaactgaactgaatattgcagcagaaaacagtgaaactaataccatcatcagtggcacacgttgtgcgcttgagcgcttccggcaacaactggaacagcatggcttctatgcccgctttatcaatactaaccgggcattccattctccgatgatgagcaatgcggctcaagaatttggggcattcctcgctgatattcctcttaaagcggcagaagtgccgattttgtcgaatctgacggggcaaccggaaacagagtgtttcgctacagcagaatattggcagcagcacatgttaggccgcgtcctgttccgacgtaatctggagaacttaacggcgatgaccgggctgaagatcattgagattggtcccaaaagtatgctcggcacgtggttgatggaaaaacaaccgcatcaccttgcctccgcttattgcccctcccaaaacagccagcaactcaattattgcgatttattggcggtactggccagcgaccatttatccggctcgccgagagaatggctgacaatgtattcactattcacgttcaatcccgccttattgccggccagaaaactactgacagaaacgtgttggtttacggaatacaccgccacattagcgaatggcgcaaggcaacaggaaaagccggatgaatatgaacatggcaacctgattgatcatgaacctttcttcatcatgcagcagcaaattgactgtatgaacaccattttccaagcccaattagaacttatgaagggaaagtaa

SEQ ID NO: 5983 - DNA, 963 bp, Xenorhabdus bovienii
  Coding DNA location: Contig name=SeqID_16918; Position on contig =58676..59638bp; Strand=-
atgaaccaatcgatatattccattgaattgtcaaattcagaagttgatgatattcaggtactcatcgggagcttacaagaacgttaccattcaactgacgatcaagcatttgttcgcagcttgccagagtgggtagagtcattaccaacccgattacgtatcgaagtcaaaaaattccgccatcaaggttatccattagttgtaataaagggatatcccgatatgtccgaggtgatgggggcaacaccgaaccattggaagaatatttacaatacgaacagtaattatgactactactgttgtttgatgtctagcttatgcggtgacgtagtcggtttttctgatttacaagacggaaaactggtgcaagagatctttccaatccagaaagacgccggaaagcagttagggacaggctccgtggatctattactgcatactgaagatacctcgctggactaccgtgcggattacctcggctttatgtgtattcgcaatatttatcaaatcccgaccagcgtgtcagtacctgatttttccaaactcagtgagaaaaccatcactatcctcaagaaaaacaaattccatatttttaacgaccgtccttgtttgtcaaaagaagaacgacatgaaaattacactgtttgctctatcctgacgggcagtggcgatcatattcatatgcgctatgaccctctgtatatggataaagatgcattggataccgaagaacttgaggctgtgtctgaattggaagcattagctgaagcggcggtatttgatctggtcttaagtcccggtgaaattgcctttattgataattaccgctgtgctcatggccgcaaagcgtaccaacccagatatgacggcactgaccgctggttgaagcgtacccaaattttaacaagattacgggattttaaacacttgtcgttacccggccgcatcaacgtattgccttaa

SEQ ID NO: 5984 - DNA, 1170 bp, Xenorhabdus bovienii
  Coding DNA location: Contig name=SeqID_16918; Position on contig =59664..60833bp; Strand=-
atgatacaagagaatcctttctcatcccgcattgctaacagggcaaagaacattaatgcctcagtggcagtagggctggcagatatcgttgccaaattgaaaagtgaaggccgtgacattattgggttgaatgaaggtgagctggatttcagtactggcgccactattgttaatgaaacccttcgggcattgatagatggcagaactcgttatagctggctcaacggtgaacctgaattaagagagaagatctgccaaaaagtatttgaagataaccggattaaagcgacgcctgaaaatgtcatcgtgaccaatggctccaaacaagttatttatgaaatattacagacagtcattaaccccggcgatgaagtgattattcccgtaccctgttgggcgacatatcttgaagctgtcaaattagccggagggaaagcggttttaattgaaaatattggtgttgatttggatgttgaaaaaatcaaacaggctatcactgacaataccaaacttatcattatcaatacgccgaataatccgaccggagccgtttactcaaaatccgcattacagacactgtgccaaatcgtcaaagaaaaacaaatattcgtgttatctgatgaagcctatgaacaaattgtatttgatgatgaacatcatagcttggctgccattgatgacaatgaatacattattacggtgcaaacattttcaaaaagctttgccatgacgggctaccgtattggctatatgatagcccatcctgaattaatctgcagagtctctgacctgcatggtcatatgaccgataatgtctgcacttttgcccagtatggtgcgattgcctcacttgaaaagcccaaggatttgtatcaagaaaggttagagatactcaaaaaacgacgtgatcgatcataccaatatgcccgcgaatttttcgaatgtgagcttcctgctggcgcattttacctgttccccaatgttgaaaaatacctcaatgaccgttgtcgtgatgccactcaattctgtgaatatctgctcacccatgcaggggtagccctgatcccggcagaagcctgtctttatcgtggacatgtacgaatttcttttgctgcgtcaatggatgctattgagcagggatttgaacggatcgcaaacgtattgcggtaa

SEQ ID NO: 5985 - DNA, 1236 bp, Xenorhabdus bovienii
  Coding DNA location: Contig name=SeqID_16918; Position on contig =60944..62179bp; Strand=-
ttgaagcatgactcacacttaatagagaatccaaaagcatatgaggaagatggtatgttcttaagtaaagaatcgttcagtgatgaggagtggaacgatcccaagtttcagttacgtaacttaattaaaacatctgagggactggaaaaatgggttgcgttaactgacggagaaaggaaagccatagaagccgttaaaggaaaatatctgtggcagagtaccccgtattatgcctcgcttatggacaaacatgatgagaattgtccaattcgattacaaactattcctcatttaagagaaatgaacgtagcggaaaactctgataatgatccggtaggagatacagcaaacctcaagacagccagagtggtgcataaatatccgaatagaattgttttgctggtttcggatacttgccctgtctattgccgccattgtacgcgaaagtttcacacaacggatgtcagtggcacctattttggttcggatcttgtcgcatcttatgaagaagacttcgcttatatcgagaaccatcccgaaattgatgatgttctgctgacgggaggcgatcccttaatacattatgacaagtttcttgaaacgattattaagagactgagaagcatcagccacattaatatcattcgtatcggaacccgttatcccgtattcgcccctcagagagtgacagaaaagttctgtcagatgttggaaaagtaccatcccatctgggttaacacgcattttaatcaccctaaagaagtgactgaagaagcagccgctgcctgtgatcgattactgcggcatggtatccctgtgcaaaaccagtccgttttattaaaagggatcaacgatgatgtagcaacgatgcggtcactacttaaggcgctcttgagaatcagggtacgtccttattatttgtaccattgtgataacgtatcaggtgtctctcactttatgaccactctggagaaggggcaggaaattatggatgcgatggtagggttcgagacaggttttagtgtaccgcagtatgtcgttacgacaacattaggcaaattgtctgttaaccgggcacatgtcaccactcatgaagatggtcgtgttacggcgaagaattataaacaggactctttagatattactgaatatatcaagccgccttcagatttgaataattattccgctgaacaccgtaatagtgaaattattctctctaagacgatcgatttataa

SEQ ID NO: 5986 - DNA, 156 bp, Xenorhabdus bovienii
  Coding DNA location: Contig name=SeqID_16918; Position on contig =62171..62326bp; Strand=+
atgcttcaaaccacgacagtaaaatttaaaaacaggcgtaataaaatagctctcgtatcgacaaccaaagggataactcacggaaaaatgtgggtatataatactgagtgttttggtaacgtctggatagcactcattaataacaacagggtttaa

SEQ ID NO: 5987 - DNA, 105 bp, Xenorhabdus bovienii
  Coding DNA location: Contig name=SeqID_16918; Position on contig =62307..62411bp; Strand=-
atggagtatttgtttttaaaagtattatttatttttaagggggagatatattttaaagtctgcaatttttcagggtttatttatattaaaccctgttgttattaa

SEQ ID NO: 5988 - DNA, 219 bp, Xenorhabdus bovienii
  Coding DNA location: Contig name=SeqID_16918; Position on contig =62481..62699bp; Strand=-
atggtgagatgccggataaaagcgtgcttaattgctcattttatcgcctatttaacaaagtgccccacagatttttatggtatcctggatgttcaccttgatcggagccatgttttctcaccgactctgtttgttgacaaaatcgacattttacttctaccgtcgccatttaaactccctacaaaaaatatgggctatacacgaggaacaataaattga

SEQ ID NO: 5989 - DNA, 582 bp, Xenorhabdus bovienii
  Coding DNA location: Contig name=SeqID_16918; Position on contig =62698..63279bp; Strand=+
atgaaaacctacgttgcgaaagtggcccttcgggggatcagtcctatgatctggcaccgattcagactatcaggcgaaacttctttagccgcttttcactatatcattcagatcgctcaggggtggcaggatgatcaccttcaccaattccgtatttatggcaaaaattacagcatttcctactccgacgggattaggtttcctgataaccctgacaaaattacgctggatgattttgaatttgatgccggtgacctttttacctatgagtataacttttttgagcactggcttcacgacaggttctgttgcattaaggcatcgtcgggtaacatgctgttttttttatggtgttacctgtccatatcattgatccgaaaagccttccgtcgcctgcattatcccaccgatgttatcgctcagtgtgttcggtggtacctcgcttatgccctgagtctgcgcaatctcgaggagatgatggctgagcatggtgttatcgttgacattccacgcttcaccgttggttcatccgtctggtgccattgctggataaggcatttcgccggcataaacggtcggtag

SEQ ID NO: 5990 - DNA, 294 bp, Xenorhabdus bovienii; identical to SEQ ID NO: 5973
  Coding DNA location: Contig name=SeqID_16918; Position on contig =63343..63636bp; Strand=+

SEQ ID NO: 5991 - DNA, 543 bp, Xenorhabdus bovienii
  Coding DNA location: Contig name=SeqID_16918; Position on contig =63673..64215bp; Strand=-
atgccaagaacaatgttatcaaaatctttatggaataagctagctgtattgatgcaacaaagtggatatgtgtatcacaaagaagaacattatctgactttcgaagggatcctttaccggatgcgaacaggctgtccctggcgagatgtccccactgaatttggcaaatggaacaccatttttaagcgctttaatgatgggtctaagaaagctatttttaatttattattcaaattattatctgagaatacagatacagaatggttgttcattgatggcagtattgttcgggctcatcaacatagttcaggtgccgcttctgtggaagatgaagccatgggtaaaagtcggggaggactttctaccaaaattcatttagccgtagacagttatggcctacctgtccattttgagctgtccggtggtcaaactcacgacattgttcatgcggaaagttgggtgacgcattcgccttcatcggattttgtgatcgctgacaaaggttacgacagcagcactttcagaagggcagtgtcgcgttaa

SEQ ID NO: 5992 - DNA, 183 bp, Xenorhabdus bovienii
  Coding DNA location: Contig name=SeqID_16918; Position on contig =64214..64396bp; Strand=+
atgatggtctggggtaatggttttttcgcgaagacaatgataccagatcatcatgctgttcaaattcccctcataaaacgtcaacagcccctagtgactttgggctatactgggctgatttttacgctttatggtaaccccgtgagatatgcaacagaatttacacagcgcgatcaactgtaa

SEQ ID NO: 5993 - DNA, 747 bp, Xenorhabdus bovienii
  Coding DNA location: Contig name=SeqID_16918; Position on contig =64429..65175bp; Strand=-
atgaatcgaagaacgcgcatttactacacgccagaacaaatcgccggttggttgaaacgctgttatcccgataatcaggaaatgtatgtgtcacacgaaacgatttataaaacgttttttatacaaacccggggagcattaaaaaaagggctgcaacagtgcctcagaagcagaagaacagtgcgcaaatccagaacaacatcgctgaaagggaaaggattagggacaatcccagatgcgatacccatcagcgaaaggccacccaatgttgcagacagggccatacccggtcactgggaaggagacttgatacaaggctctaaaaactcatatattgtcacactggtagaacgccattcccgctttgttatgctggctaaaatcagtgacaacaagaccacgacagtaatatctgcactcatcaaacaagcccaaaaattacctgttgaactgtataaaacattaacctgggacaggggagctgaaatgaccaaccacaccctgtttactgtagccactgacattcaggtctatttttgtgatcctcaatctccctggcaacgtggctccaatgaaaatacgaacaggttactcagacagtattttccaaaaggaactgacttatcagttcacagccagcaaagattaaatagtgttgccaggcaactcaacgagagaccgagaaaaacgctaggctatgagtcacccgcagagcgattttaccagtgtgttgcatcgacccgttga

SEQ ID NO: 5994 - DNA, 222 bp, Xenorhabdus bovienii
  Coding DNA location: Contig name=SeqID_16918; Position on contig =65082..65303bp; Strand=+
gtgacacatacatttcctgattatcgggataacagcgtttcaaccaaccggcgatttgttctggcgtgtagtaaatgcgcgttcttcgattcatggcaacatcctcctcgtttaaggatagcgttgcatcgacccgttgaactcatagcgaaaagcagacttcggcgtcagcaagattacgttaagttggcaaagctatatgatacaattttatcatgctga

SEQ ID NO: 5995 - DNA, 459 bp, Xenorhabdus bovienii
  Coding DNA location: Contig name=SeqID_16918; Position on contig =65417..65875bp; Strand=+
atgcattgcgacgagtttgacctctgggcgaacctctcttcaaatgactatgttgaagacctgatgacaaatcatcggtacagccgtaaaaaagccgaggtagaggcgtcgaaatcatttaaaacagccttgccggcgggtatcaatactcaaaataaccattttagaacttatgaacatgacgctcaggctgcgggatatctgtggttcagcttggaagataactcagcttttttgtcagatataatgcttatcccagaatttcagggtaaggggatgggcagggattttatccgtgcgttcctgaatgaactgactcgccagggtgcgtatgaggtagaactaagagtgtcaccggacaatcaaagggctttaaaattatataaagagtttggttttcggataactggttttgatatgagtcttttgctggaacccgagttatcagcaatccgttaa

SEQ ID NO: 5996 - DNA, 726 bp, Xenorhabdus bovienii
  Coding DNA location: Contig name=SeqID_16918; Position on contig =65935..66660bp; Strand=-
atggtcattgtaacgagagttgagttggaaggttttttggcaacccttgcaataataacgaggaaacccggctttacctgctccatgtttgcgtaccggttcggtttggttacaataccggcaagcaacttctatcgtcaccgtcattttgagatccccttaaaaaggcataagaatatcaggttaacgctttggagtcatgacccaccattgctgagtaaggcttttcgtcggcataaacgtcctgtggggcgtcgctggcgcatggatgaaaccgacatcaaaatcaaaggtcagtggaaatacctttaccgggcggtcgatacggccggtaaaacgattgattttttattgaccgacaaacgagataccgcagccgccttgcgtttcttccgtaaagccctacggcaacacggggagcctgacatcatcaccctcgataagagtggggccaacaccgccgctatcgccttgctgaataccgataaatcaaaggaagaggccataaaaatccgccaggataagtttctcaataaccgcattgagcaagatcatcggaatatcaaacgtcggatacgacccatgttaggttttaaatcgtttcgccggacccaaacgattttagcggggatagagcgcgtttcgatgcggcgtaaagggcaatactcacaacccgaagataagacattgtcaccggcagaactgttttatcgattaactacataa

SEQ ID NO: 5997 - DNA, 123 bp, Xenorhabdus bovienii
  Coding DNA location: Contig name=SeqID_16918; Position on contig =66670..66792bp; Strand=+
atgaaagaaaaaattgtcgatatggcgatgaatggctccggtgtgagagacacgggacgtgttttaagtatcggtatcaatacggtaatgcgtactttaaaaaactgtcgccaaaacaggtaa

SEQ ID NO: 5998 - DNA, 369 bp, Xenorhabdus bovienii
  Coding DNA location: Contig name=SeqID_16918; Position on contig =66858..67226bp; Strand=+
gtgggcaacaaaaaacaacgtcattggctttggtatgcttttgatacaaaaaggaagcaggccatagcccatgtattcggtcctcgaacagatgccacctgcagaaaactgctcgacttattagccccttttcatattcgtttcatcacgaccgatggttggggaagttacgccagagaagtcgagccagaaaagcatttggtgggaaaaattttgacccaacgtatcgaacggcataatctcaacctgcgcatccatatcaagcggctggcaagaagaaccctttgttattcacgctcaatagaaatccacgaaaaactcattgggacatatattgaaaaatatcattataacgcttgggagtcatga

SEQ ID NO: 5999 - DNA, 123 bp, Xenorhabdus bovienii
  Coding DNA location: Contig name=SeqID_16918; Position on contig =67192..67314bp; Strand=+
ttgaaaaatatcattataacgcttgggagtcatgacccaatggtgttaggggtattgtgcccaattcagcgaaaagtttcacgaatgaaaataaatttattaaattcaattcattatgattaa

SEQ ID NO: 6000 - DNA, 756 bp, Xenorhabdus bovienii
  Coding DNA location: Contig name=SeqID_16918; Position on contig =67317..68072bp; Strand=-
atgactcaatcgatacgagtagtacaatttaagttaactcttaatacactggcgaaatgcggtgcagaaaatagctcaaaacaatgtataatgcaccaaaataatgacaccatgtatagtgcactgatgaaaacccatatgcggatctacggatacctgagagcatcaaccgatgaacaggatgcatccagagcaaaaagcgaactgcttgagtttacaaaggggcagggagtcaaaattgcttgctggtttgaagaaaatgaatcgggtgctcgtctccatcgcacagaactcttccgtttacttgatgttgtcatgccgggcgatgttatcttagttgagcaagttgaccgtcttagccggctgaatacagctgactgggaaaagttaaaatatatgattaatcataaggggctgaaggtagtttctttagatctcccaaccagttaccagttcatgaagaatacagacgaattcactgaacgtatgcccacagcactcaacaatatgatgcttgatatgcttgcagcagttgccagaaaagattacgaagacaggcggcgtcatcaggctcagggggtaaagaaagacaagcaggaaggtaagtataaaggccgcccgatagacaagaaactgcaccaaaaaatcgaaggtcttctcagggaacacaaaagctatagctatattgttgacttgctcggttgttctagacacacaatatctaaagtatcaaaagagattaaattaatagaatga

SEQ ID NO: 6001 - DNA, 108 bp, Xenorhabdus bovienii
  Coding DNA location: Contig name=SeqID_16918; Position on contig =68123..68230bp; Strand=+
atgaaaaaaatcaaatcaagtcgtattcaaattttgacagagcaggaaattcatgagctgtattctcgccccacttttaatcaagcacagcgcgaagaattcttttag

SEQ ID NO: 6002 - DNA, 360 bp, Xenorhabdus bovienii
  Coding DNA location: Contig name=SeqID_16918; Position on contig =68264..68623bp; Strand=+
atgggaaagatagaaacgagaatatatttaattcccctgatcggttatttccgcgctaaaccagtcgtacctaaatttaaactacgagaggtcaagcaagatgtagactacatctacgccacttatttcccaaacagagctcccaaatatccatttgtcgctaaaagtactcgagcaacattgattgtgaagatgtatgagatattgggatttgcaaggttattaaagcgcgatagacaaacattaatggatcgtttaaaagacgtagcaacaatctgcacgtatccaaaatatatttttgatgaatgtctggctttttttgggcaaaaacgaattgggctggttggaagtggagcataa

SEQ ID NO: 6003 - DNA, 147 bp, Xenorhabdus bovienii
  Coding DNA location: Contig name=SeqID_16918; Position on contig =68565..68711bp; Strand=+
atgaatgtctggctttttttgggcaaaaacgaattgggctggttggaagtggagcataattatgaaaacttatttataatgctggagaatgtttctgacagaaatggcatttatattcaattagttaaaaaaactcttcccaaatag

SEQ ID NO: 6004 - DNA, 5139 bp, Xenorhabdus bovienii
  Coding DNA location: Contig name=SeqID_16918; Position on contig =68811..73949bp; Strand=-
atggatattaatatgatgagaagcgataatatgccgattgccattatcggtatgagttgccgtttcccggggggtgttagctctccagaggaattctggcagctgttgtgtggttcaagtgacgcaattaccccagtcccccctgaacgctggtcaactcaggcttatagttcccgagatcgcaatttgccggggaaaatggtggcgcgagaaggcggatttatcgctgatgttaccggcttcgatgcggcggtgtttgatatcagtaatacagaagcgccttttatcgatccacagcatcgtttgatgttgcaggtgacatgggaaacgctggaacgggcgagaatagcgccaaaatcgttggcgggtcaggcggttggtgtctatatcggtgctttcactcatgattatatgcacctgcaatttactgatttgcgtcagactaccggttatacctcaaccggtgcaatgggaaccatgttgtcaaaccggatatcccatgcgtttgattttcaaggaccatccttgactattgatagcgcctgttcatcgtccctgttagcggtccatttggcttgtgaaagtttgcggcgcggagaatcacaactggcgctagcgggtggcagccagttaatgttgatgcctgatttttcggtagtagaaagctgtactggttttctatcattgaccaaccgctgtcatagcttttcagctaacgctgatggttatgtgcgtagtgaaggagtcggtgctgttttgctgaaacctttgaatgcggctttacaggatggcgatcccgttttggcggtgatccacggttcagctgccaatcaagatggccgcactcccacgattactcagccaagtagcaccgcacaacaacgagtgattcggatggcctgtgctcaggcggggatttccccggaagagattgattatattgaggcccatggtactgggactggggtaggtgatccgatagaagcagaagcactggggctggtctgtcggcccgaaccgacagaccgcccattgttgattggtgcatgtaaatccgtaattggtcatacggaagctgcggcgggcattgctggattaattaaagcggtattgtgtttacaacgaggacaggtaccgggcaatttacatgccgagccgcctaaccgctacattcgttttactgagttgggattgcaagttccacagcagttaactccattgtctgaaggaaaaatgatagctggggtgaattcctttggttttggcggaacgaatgtccatgtggtgttaagtaataatgcagaatcttccgtacaacttcggacgacgcaagggcaagctttcatgctgccattgtctgcgcagtctgagttttctctgaagcaacaagcgcagagcattgctgatttgctgcaacagcagccagatattgcccttgatgatttgtgctatagcttggcgacgactcgtcactgctttccgttacgtaaggggatcgcattcagtaaccgagaacagttgcgacagcggttgactaatctgaatgtgtcgtcggagcataataataaaaaagttgatcgtctggcttggatatttgcgggtattggcagtgaagattggcaagactctatcgcttggtttcagcaatttcccgaatttactgaacaattcgagcgttgtgaggcaatttggacgggattttctgcaccttccttatatgcggcattgatctctgccgatgaactgatagagccgccaatgcagtttgctgtacaaatatcaatggctgcgcagttgcagaagtgggggttcaaaccagcggcgttacttggtcatagttccggtgaaacggcggcttgttatctggcgggaatttatgatctgacgcaggcactgacactgttacatcagcgttaccattatctggaacgtgtgttgaataaaggcggcggattattaatcgtggcggcgacagttgagcagatattgcctcatttgtctgcccccggtgccgagcctgccgtagtgatagcagggcgtaatagtatcaatcgttgcttactgtctgggcctataagtgaattaaccgctgttgctgagcgcttaaagcagcagcgtatcgccagtagttggctcaattatagaattgcttctcattcccattatatagagtcaatcagggctgggttgactgcggatgcggcaaccgttcccgcggcagaacctttgttgccagtgttttcatcagtcaccggggagttgattaatggaaagttgagtcccgagcattgggctgacaatgtcgtctcgtcattccgttttgacgatgcggtagaaaacatgctcaaagcgggtttccaccattttctggaagtttcacctaaatccctactgagtgcaggattaaaggattggagccagccttatcgaggacaggtgtttgcttgtcgctcagggcagaactggccacaactgttaggacagctgtttgaagctggggttgaaccggactggcagactctgatgcctaccgcttgcccaattgatctacccacttactcctggcatcagcaatcttattggtatgaaccagagattagccgtcgccgccgattacgtatattgagcggtgtattattgggcgaagctcagccgggcagcgagagttggcaagctgagttggctgtagaacaagtgccttggttactcgatcatgttgtcatgggaaatgcaatgtttccggcggcgggctatattgaaatcatgttggcggcggctcgtatctgttttcctgacgttggattagcgcttgataatattgtgttgcaatcggctttactgctagagccaggcatagaattcaggttaaagacacagctagatcgccagcgaatggaagtgcaagtacacattacccgtaatctggatgagagtgtacattaccaacttgcagccagtgcacaggtgaacatcgttgtaccgggtgctactgcttgtgctattcctccattagcggtaaatgatcgctatccttgcatgtggaaccaagagatgttgtatcaggcatttcaacatctacatttcagttatagtggtgttttttgtactctgcgccatgcgtttgttggtaaagaagaaacaatctgtgagattgaattaccacctgcaccggagggaatgaattttcacccagcggctttggatggcatcttccaatcattgttggcgattcagtctgctgatgttcacgcgccaattcctgccaacgagttccgtatcccggtcagtattcagcatttgcgtatcaatggtaaattgtcaggtcgggttcatgcccatgcccgaaatactaagcagacgcaacaacaatggcttggtgatattgacgtctatactgatagcggtatgttgctttgtcagatcagcgggttttgcgttcagcttgtgggtaatagaaaaaacagcttgtctgccaaactgcacaatctggttgtcggccaaccacagtggcgtaaactgcccgctcagccatcaacagagtctgtgacgcaatgggctatccttgggggtgaaaacgctctggcagaagagttagttgatgagttgcaacgccgtggtgggtgtgcctcgttgtattctggtctgcctgacagttatcagaaaattcaagaattagttgatactcttcctgttgaaaccgaaaggatcctgatcctctggccgttgcaggctccgcggatggcttatcattcgttgatccatttgtgtgcggcgctggccgaacggtcgataaaaccacgtttgtggatagtgactcaatgtgctcatcaaatcactgagcaggatcagcccgatccatttgccgccgcattatggggaatgatgcgcgttattggtcaacaagaagcaactgcattatggggtggattactggatattgacagtatcacggctccagccaaatggtgggacgcgctattgataggtgatggcgaggatcaattagctctgcgccatgatcagcgttatgtgctacgccttgtgccattacctgaaatacccgcgctaccaccagtgcgttttcgtccagatggctgctatctgctgactggtgcttttggtgatatggggcgtcaattgatcccctggatggtacagcatggtgctcaacatttgttattgatcgggcgtcgtcttgcccttgatacggcggatcaaaagttattggaaatgctgcatcaacaagggatcgaggctaattatctgccggttgatctcggtgatgtggaaaggacccacatttgtttggctgagtatcgacaacaagccagccagccgctgcgtggggtgattcattgcgctgcgcatgttgaagatcagggatatcgtgaactcagccccgaggcgtttgatagagtatttgccactaaagcattagctgcctggacattgcatcaagcgttggctgatgcacctttagagcattttgttatgttttcctcgttgggggcattattggctttaccgggtatggcatcttacgcagcggctaacgctatgttggatagtctggcctgtttacggcgtcagcaaggtttacctgcgttaagccttaattgggggccatgggaagcggggatctctttgcgggatagtcgaacgctgccaatattggaaaatagtggcttacagccatttggttcagaggagggattagctgttttagagcgcttgtttgctcggattgagccgcaactggtgccattcttgacgaattggtcaaatttgctgtccagccagatgcgtcacctaccgctattgcgtgatattcagcaagaaaatgtggttcagactttacccatagaagcggcgcttgcagtgagtgatctggacgatgtcgttagcttgctacaaaccttttgtagtgagattgttgggacgtcaacagaagtattccatcccgatctacctttgactaacaacggtattgattcattgaatggtttaatattggtacaaaaaatcaacaaacaattacgtttggatattccgctggaattgttgttaagtgataagccgctggctgaacttgcatcattgattacatatcgattgcaagttaaggcaattacgaagtag

SEQ ID NO: 6005 - DNA, 2472 bp, Xenorhabdus bovienii
  Coding DNA location: Contig name=SeqID_16918; Position on contig =74002..76473bp; Strand=-
atgagtgaatccagatcttttgccggtaaatggcaatttgcagcaacttccggccaactgattactgttcagacggatggtacgctcagcctttcagccaagcaatcaggggcgataaatcaaatgattaatgcttatggcattagtagcttttggttacaggcgggcaatggtcaatacttggccgcgagcggtaatactcctcaagctaatcaatcgcgcaatggcgcggttgccgagatccggttggaaaagatgggatctggatttcgcttgtgtcgtatcagtagcagtggtgacagctatttggtggcgcaacaatctgggctggtttggcaggcagccactagcagtccgcccctgtcagcccaatttactcgtactatcgtgacaaaggacctggaattccttaaagaatggggggcaatgggatccgatctgcgttttgcttatctcgccgaagagaatttgaatgaaatggtgatgatggccgtcgatttgtccaatgccgacctgcatggttcgacattgattgacgctactttaactaatgtcaaagttgatgattgtaattttagtggttgtgacttaagcaagactgatctaacgcatattcatggtaaaaatgtgctttttgaaaagtgtatcgtcggtagtgataccaatatgcctgacgctgagctaccgaacgccattttccgtggctgtaagagcagtggtggtcagccgatattgaatcgtctaaaagcgcccggtgcggatttctctggagcgttgttaccttcggtgataatggagaatgctgatttatctcaggcgaatctgattaatgttgatctaagcggcgccagtctggcttcctgcaattttaccgcggcgatcatgacgttggtgaatttgcagaataccactttgcagacctcgaattttagtcaagccacgttagtggggactgattttaccggggcgaatatcaatcatgttaatttcagtggcgcaaatctgaccaacgcacggttatcgttaaccaccggttatagtcaacttaacctcagcgacagtaccttattagcgacggtgctgacagagatgaacttggttgatgccacgattaccgctaaaacggattttactcaggcacagatggatggtgttaatctgagcagccagaagctggatcaagtcatattcctgatggcgtcgatgaaaaaggcaaatctggattctacgtcactgaatggcgcagttctggtcggtgctaatctggccggtgccactgttctggggaatgtctctttagttggcgcgaatttatctaatgcgagtctggagaatgttaatttaactggcgctcaatttggtgctttatccacagtgacacatttggatgaagccgatgctcagacgctggataatcagcaactgcctgaacggttacgtcaaatgttgtatcagggaaagatattggttaatggtcaggcagaggtgttggttcgtcagccgggccagaactggctggtggaacatgatggtaaaccgttatttattcactatcaggatgggcaattaaacgttgcgcaagataatggcggtaatgcggcaattcttgccaacacatttatgcctaatgctatcctgactggcgctaatctgtacgcggttgatatgtctggcgctcattggtacggcagtaacgccagagccgataacgccaatttggaacaggtcaatttgtcgaatgctaacttagcgacaatgaatttcactcaggctcgattgtttggtgcgaatttgtcctatgctagtctggtgaatactgatttcagcaaggcaatgttagaacccaccgaaggtcttaagctggcatctctggcctttgcttcaattcaaggcactatctttacggaagctaaattgaccggcgctaatctgaccaatggcgcggtggctttaccgtttgaggaaacaggcaataagttaacaggtgtgcctttattcagtgcggcgcttgagctgatgagttcattaaatagtggcacagtctcaaaagagttgtgtcaggtattcactgataacggctacagtctgttatctaatgccaaaatcattgaaaagcaaagtgatcaatattggattatctccaaccagccgccagacaccgatctgaattatcgaggatattgtaactttatggtgattcgggtgagtgaggtcggtaataaccatctgcaagtttgtggtggatcgccattacgtatcatccgtactgcggctgacaatacattgcaaccggttaatgtcgcttttggggtgacaattgatatcactcaggcaatggatggagccaccacctgcccaagtggtttgcgttatcagttactcaatacgggtatcagctatcagtcattgatgacgccgggattaccacctcatccgccaaaatgtattcccagtccgacgacttggtgttga

SEQ ID NO: 6006 - DNA, 654 bp, Xenorhabdus bovienii
  Coding DNA location: Contig name=SeqID_16918; Position on contig =76478..77131bp; Strand=-
atggtcgcagatattcaaattttgggtactaatggcgtgaatggtgccgatggagccaatggcgctgatggtcaacgggggattgatggtcagaatggctctcgacgcaagccacccactgccggtggccctggtggtgatggtcaacccggtcagaatggcctggatggtcaatcaggttctagctggtggtttgccctgcgttgtaatcgttttgacgtacagagcgtggtgcgtattagcaatagtggcggtaatggcggtaatggcggtacagcgggttatggcggcaatggtggtgatggcggtaatggtggccgtggtagttcattatcgtcagggaagccgggtggtatcggcggtaacggtggcaatggtggaaatggcggcagtggcggggctggcagcgatggcggtaatgtttgggtcagatacatccagactagcttaccgaaaccaatatctgccacctctgatggcggggatggcggcgtcggacagccaggtggcgctggggggattgctgggcgcgggggtgtaaatggtgatggttcacatgcacccgatgggggatatggcattggcggtattagcgccagtggtggtcaggccgggagagccggaaaggtttctgtagttcaatcaagaggataa

SEQ ID NO: 6007 - DNA, 1260 bp, Xenorhabdus bovienii
  Coding DNA location: Contig name=SeqID_16918; Position on contig =77147..78406bp; Strand=-
atgaataaaatgaaaacggttaacgaaactttggctgaattgcgtgagcattatcatttgaccggtaccgagcggcagccaaagcaattgaacacttcggactttgacgggccggtgatattttctaacgacccgaaaatagccactgtgccacccgcgttttttaccgtacaaaccatacaagaattgaaggaacttgggggtgtgcctgacagtgagtatggaccaggcggaatggaaccccatcatccgctacctgaaccctattctgctgaacggttggcaaatgtcaccggtaatcatgctgatatatgtaaagctttccgcgcttatatctatggttattctcctttggtcaaagattatgaagatattctgaacgctaaacgtttcccgatgaaagtcgcgttatacagtggtgaagatatcgttgttactgccagtaatccattgattattggcagtaaagagagtcacggagaacctgttaacttaaattttaataagataacgattcaacctggcggtaaagttatttatctcaccaatggcacgattcaggcgaacgaagtgatcatagttaataccttaggtacagataatgatggctcgaacattgaaaatgttggagggaacggaggcaatggcgggagcggaaacagtggctccaatgggaaagacggcagtaatggtaaccccggtaaagataataaaaactcctgtgcaacgcaggctacgtcaggtactgcgggtggcggtggtactgatggcgccagaggaagtgacggcgagaaaggagggaatgcagaggatgtcaattttaaaaccggtaccatcacaggctttgtgaatatgctgacacaaggcggtaatggtggtaatggcggtaatggtggtaacggtggtcatggcggaaaaggagggaatggcggtggctctaccagcgaatgtagggctggaaacggcggtaatggcggtagtggtggcaatggtggtgccagcggtaatggtggtaacgcgggtaacggcggtaacatctattttacttacaacgaaggggggagcgcatcctttaaggccagggcaattgccggcaatggtggtaatggtggcaatggtggttctggtggtgtcggcggcggcggcggtagtggttattccagtggtagctcaggtaaaaatggtacatcggggagcacaggaactgccggaaaagcaggtaccgtaggctcagtttatgtcaacggcaaaaaacaataa

SEQ ID NO: 6008 - DNA, 4449 bp, Xenorhabdus bovienii
  Coding DNA location: Contig name=SeqID_16918; Position on contig =78399..82847bp; Strand=-
atgaaaacgcatattctacattttgacctagctcaaagccatttacgtacccaatccagtcaattaaacctttgggttggtgaatataatataccgttgcaagaacatgatgagtcaagtttagccagagcagctggagaaaatcctgcaatagatatggttctgcgttacggttcacacaatattagccatttcgcggaggtacctgaacactattttttacctcatcacgttacgctaattaaagtggttggtgataaatccgggccttatcgttcttcattaccggttctttatcatctttcttatcatattcccaatgctcatttacatcgttatgccaaacgtaacagagaaaaactggcagtaaataatatagagatggctttgccgggtaaacttagtgctctcggtgttaatagccaacatttagcgcgaaattctattcattgcggcgatttgtgggttgcgactaatgaaatgaaaacaccgtgggatgttgcttgctctattgtgttttcccatccggaattgtctaacagtcaggcttatgcagcatcaattgtcatgaatgcacatattgccccaccggaggcaatagacccactgcaatataaccgagtttatgaactggctatatcaatatcgagtcagggacccgcgacagagacaggcggttttgccacttatggccaattggttgaccctgatggcagcgcaatgttttacgaatttgactgggtaggtcaagacggacaggtgattttcgccgaaggtgatccggtgatgcaatataacctatcggatgaaacggagaattattctggctcgccagcatctaatgcgctgaaaacttcgcataatgatggtcgcctgcaaaatcataattggagtgtcagccaaagtgcgtctctggacgttgccgaattcaaagatcaggcagcagcattggctgttaagcgggacaccaaccaaatttggactgccaccaaccgtactcctaatcacggtatggatgtgtatgccgatagcatccgttacgatagcagcctaagccatttttccattgattttaagaacaaatacttacgtcagctaggtgtctatattcagttctttaaagacactaagatggaacagccgatcgataatccaaaggttgacggtgattggccgttttatttccctcaagagctggctgcgttattcgaaacgccatcacaaaaggccctgggtgtattggctaatgtcaatacgatcatggggatcccgatgcccacggatcccactaactttggcttgccctggccggctgaagcccaggcagctaaattcttgtttggcggcctgggaacctcccgttgggagaacccgattgtttggccgggtgtgattttgaccggtatgttccaatacggtattccggccctgatgatgttagctggggccatggtaactaacagccagtggtataaagattttatttctaataaggataacgttgccatactggccggtattgctttcccactgattggcggtggcgccgctgtcggttcagcgttattcaatactaaaaaggtgctaaccagtttagccagtattgccattggtattctggctaaaaaagggatggaagcgttagcgacttatgttacagcccaggtagcagccagtgcggctgcgcaggcggttccggtggttggttgggcgttccggctagctgcgattgcgctggatgtggcacagatcgctgtaaccacgggtgaattactttcctcgcccgccacattggaagtggatatcaagcgtcagatgacacttgcttttactctgcatcctgatcctgctcatggtgaagcgggccgtccggaaaccgcaatctggccgccggtggcagtacagtgccaggtgaccgttgaatataccaacggcacctactatacccagactattccattacccgcgacaggttccaatacaccactatcttttaatttcaattcggttggctggggtggaacactcaaaatcaaggctaatgtctattcagccactggctggttagcggggagctacaccagtgatctgctgaatgcgcagccagacgaccctaatgaaggcatcatgcgcgtcagcggtaatataaaagagatgttggtgccgctgactcaggtgactcaatacgaatattgggaacagttgtcttacgatagcggtaaaaaagagtaccagtggattgaaggcagcgtgccgttggaaacccagtcttcaaccaattgtagcaatgtaggcaataacatctgcaagctggtcaatatgacaatcctgaattcagattatcaggttggttattgctatcaggcttctggtcaggatattccactggaagatccattaagtccacccaatagcggccagatgtacgtgttgcaaaacatttccactttgagcaacgactcgttgaatgagcgtctgaaattatctgcggtaggtttcaaagtacaaccactgatcagttataacagttttggcgaaggaccggacgaaaaaaccatcacgccttataactttattattgattcacggtttggtgaatatcacttacgtcgggtggacctgcgtgatggcagccataattttggtttgacggataatccgctttcgtgggggactttcaccattccacatcttgatgcgatggtggttcacccgagcggctatgtcattgctgtcagttggcaatatagcaagatgcagatcctggcgttgggtgatcagggctatccggatgatcaggctccagcggcacagattgtctctggagaagggattcggcaagggctaacccatgggccaattgccctgaccgtaacgccagatggccgcatactattattggagacaatcaatacccgtattcaggcgtttgatactaaagggaacccattcccgagttttgcgggtgcaacactgtttcaacttgctaccgctgattatcaggcaacactggatgctcaggagttttccccggcattacaacaagcatttcgtgagcaggggttgacattcctgttcagtaacagtgatccaaactttatacgttcgctgaatgctggagtactggacgagcagattattgccacctttgcgcaagatgggatctatctaagttataaccagaccgcagacggtaatattgacccagttggcagcacaacggttgacgtgatacagcaagggcagagttggttggtatatgatccgcagaaaaccgcgacttatacgctgaccgctcagggacaaaccgtatctgtatataacgatttgagtcatgtacgggttatcgctatcggtcaaggtgccaaatggcaaattgatgatcttagcagcgctcgatcctggctgttaacccttaatgcaacgaatcctgctcaaattacggtaacggattatctgtcctatatgccactgaataagccagccgggattacgtatctggatgttgcggttgaggcgaagggatatatttatgtcttgtcataccgtaacgaagggcgggatccaacggattatatccttgatatctataatcctgacggtacttttctggtaactgtccctgattcgacattagtgcctgatccagctaaacgccagcatattgttgctggacatctggcgatagattcgttccgtactctggtggcgatgaattacggcaaattcttgggtgaaaatcaacgtacccaaccacagatcagccagtggatgccaactacaccaatattcgatctgggtatcgatcaattaccgatattccagcaacacgatatggataaaatccgcgcagtttttgctgacaacaaacaccctctgagtaacaaggcaacgatcgaaactatcaatgaaaatggttatttcatcattactgatgttagtacccgttacccagttatttgcaccgtggatggcgataatcagcagattatttctgtttacagtttctcggagacaactatgccattaaaaaattatagctcaggatttaaagaggttttgcaattattaggtatcccagagagcgatgtaacggagaaagtcgttgttgcatcttcgtcgcaaggctctttacggcctgacgacccacagtcactcgctccttcttatacggcagaagtgtcgtcagcatcggagctattgaccctttctggtatcccccctgttgaagcgccgatatcctttccggcaaccgttgatgtttttgcgattgctgaactggagattgctgatgacggggttctgaacattagcaatccgacttcaagaccgatagtggtggtggttgacactttggcgcttaagcaaggtgggcaactgatatgtgacgcctctgtgattctaaacgtacaaacttataccaaaactcaggagaattcccatgaataa

SEQ ID NO: 6009 - DNA, 1578 bp, Xenorhabdus bovienii
  Coding DNA location: Contig name=SeqID_16918; Position on contig =83317..84894bp; Strand=-
atgaatccactcgatcatacaattcccatgagaaaagaagcattgcaccatgtttccgcagcaaaaagtgctctgaatcgttttgccaatgcccagatcccgcaacatccatggatggcaccaaataattttggaagcccgcatcaggatagttggtgttctgagtccgtgtcactcagtggtcccattgaagacaaccttctgcttatcgagcaatacaaccccttcggatacacaccgaatatggtttgtaatagcaagaatcaaatgataggcgtctcgctggattacgtttcatctctgttctggctggttgtattcgacgaaaactgtaacatcatttcggcaacatctgtgggtgagtattccggtagtacctttggtggcggttacttctacatggacaacaacgacaacaccattgttgtgcagggcaacaaaattgccagttatccgacagccgatgtgcagtcaagagacaatgagatttatgcactcacaccaaactggcagagtgacgatatagtggagttagtcacaggttcagctcaaggaaattctctttactcgtcgcttcccgtttgggatgagacacgcccgaatctctactggtgcctgatagcaggtgagttcgactatcaaaactatccagagagcacattaaactcttcggcgcaaatggccgttgtggaaatcgaaccgagtactgggaatacgacactgatcaattctcttgaactggaaaaacagtggaacaacaatacattcgcggttgatgaaaagggagcctatattgttacgaatggtatcgacaataagggcttatgtacggaaggatatctttgggcgtttaatctggagaaaaatgaagttgttactcgttggaaaacttcttataaaaatgcaggatacctgaaaccgggtcagaaaaatatcggctcgggaacgaccccgacgctcactaaaatggagaacggcactgaactggtggcaattaccgataatgccgatcctcgcctgaacgtagtggtctgtaatcgtgagaacggggcgattatctccgaaaccccttgtttcctgagaatgaagagtgcggacgaagcttcgctgatcggtgttggtgatactttcgtggtcgaaaataatttcggtcactatccgacatggccgttctcccagttagttccgaatgcccccggcatggatatgatccgtatcaatcctgaaaattctgaccaacctgatgaaaaaaaatggtctatcccagatgttcacttttacgcgatgaacatgctctgtcgtggcagcggtatcatcttcgcgcatacctgtagctggtctgacgaaatatcagcgtcaaaaggcgggatgtattacatcagcgcgatcgactctttcgacggtcgagtgatctggcaaattcctcttggcagaggggtaaactactgtcatgagtatggtggtatttatttcaacaggaatggtgatctttacattggcacgaatcaatatctgattgctatcaagaatttcagggatcgttctaaaccgcttaaggaaaaagcacctgaaatctaa

SEQ ID NO: 6010 - DNA, 156 bp, Xenorhabdus bovienii
  Coding DNA location: Contig name=SeqID_16918; Position on contig =85072..85227bp; Strand=+
ttggcacaccactccggacgggttcaggagaccataaaaacaaactggtacatcactcgtcattttcggttctgtcgcattagcagagaaagtgcatcaaaagatgaatacgattattttttatgcagcgagttgatagaaaaattcggcgggtga

SEQ ID NO: 6011 - DNA, 585 bp, Xenorhabdus bovienii; identical to SEQ ID NO: 5922
  Coding DNA location: Contig name=SeqID_16918; Position on contig =85192..85776bp; Strand=-

SEQ ID NO: 6012 - DNA, 99 bp, Xenorhabdus bovienii; identical to SEQ ID NO: 5923
  Coding DNA location: Contig name=SeqID_16918; Position on contig =85787..85885bp; Strand=-

SEQ ID NO: 6013 - DNA, 156 bp, Xenorhabdus bovienii
  Coding DNA location: Contig name=SeqID_16918; Position on contig =85954..86109bp; Strand=+
atgtcggtgaaggaaaaaccgcagaaaccgggctttgcgtcgctgatgaaacaatttacccgggttgacccgtaccagtgtgtattgtgtggcagccggatgttttttaacagcgcggaggcgggtatcagggcagagaaattactggaaatgtga

SEQ ID NO: 6014 - DNA, 225 bp, Xenorhabdus bovienii
  Coding DNA location: Contig name=SeqID_16918; Position on contig =86114..86338bp; Strand=+
atgcgtttcaaaaatcacgatggttacggcagtctgcgcaggaaagatctgcctgaaattcagtttattgtgcaaaaaaacacactgactgatgaaaaaccagtcaaccactcagtggtgaaaccggagaacggtcatccgtataagaggttaagatcaggaaaagaggaaaaattaacattcaatttcctaaccatcgagttatctttgttatttacagggtag

SEQ ID NO: 6015 - DNA, 369 bp, Xenorhabdus bovienii
  Coding DNA location: Contig name=SeqID_16918; Position on contig =86458..86826bp; Strand=-
atgaatcccctttttatttattttctaaggctagcttgctcattacagtggtctattattcctgtccatagcagttatgatactcttcataatagcgggtatatcactatccatagcggtttatttgctccccacagtagtctttttactgtttatagtggtcgaaatatccttagagcctatgagttgactgtcaaaatagaaacagggacttttatgaactttcggcacttattattggatcgatccggtggatatgttgaaaattcagcagtgggtaagatatttcctatactccccatagtggtcacgactactcaccagaaaggtctgtttactgttttcatcggtcgatattgcactttatag

SEQ ID NO: 6016 - DNA, 1008 bp, Xenorhabdus bovienii
  Coding DNA location: Contig name=SeqID_16918; Position on contig =86828..87835bp; Strand=+
ttgtcggaaaattccttaataaacggggagttaataccagccttttcggaagttagaaaagaaacaggtgagttagtcacactgatgcctaacacgaacaatactgtccagccagtcgctcttatgcggttagggttgtttgtgccgactctgaaatccaccaaccgcagtaagcgaaaccttatatcctcaatggacgctaccgaggaattgaagcagctaactctcgctaagtcagagggttataacaatatcaagataaccggtgaacgacttgatatggataatgacttcaaaacatgggtcggcattatccattcattcgctaaacataaggtaatcggcgacaaggtgacgctcaagtttgttgattttgccaaactgtgcggtattccctcgacacgttcatcaaaacgccttagagagcgacttgatgaatctttgcggcgtatcgtctctactacgttatcgttcaccagcgacacaaaagcgtatcacactcacctcgttcaatcggctttctacgataccgaggcggacgccgttacgataaaggctgatcctgagatatttgagctataccagttcgaccataaggtgcttttgcaactccgagcaataaccgaattagctcgtaaagagagcgcgcaggcactttatacgttcattgagagtttgccctctaacccagctccagtatcaatggcgaggcttagagcaaggctaaatcttaaatcccgggcgaatacacaaaacgcaacagttcgccgggcaatggatcagctacgtgagataggctatttagatttcacggaaattaaaaagggtaaggtggtttatttcatgatccatgaaagagcgccaaaactaaacaaaacaaagcctgttaaaaccgttaagaaagtgaagactactaaggggagtgaaaaacagggtgatactgttttggctgaattaaccagagaagaattagaatttattgaaaaaataagaaaatcaaagtattaa

SEQ ID NO: 6017 - DNA, 351 bp, Xenorhabdus bovienii
  Coding DNA location: Contig name=SeqID_16918; Position on contig =87832..88182bp; Strand=-
atgtgggctacggctgtagtactaagaaaagtaaggtggctcagaaatgatacaggaactactctctttagtggtcgttactgtgatctttattggagctgttctgtaatatggataaccaccaacagcgcagcccatttcgttaaacgggttatgtatttcaagactactatggagagtaaagaaacaccgatcatagtggtcgattttggaaaacgggtcattgctaatatcaatggcaccatatattcgtcacctgaattaaaacaaaaaactctgtatggtcaggcaagtatgacgcaaatgaccactataaggagcgcctactctatagcggtcattctgatttaa

SEQ ID NO: 6018 - DNA, 186 bp, Xenorhabdus bovienii
  Coding DNA location: Contig name=SeqID_16918; Position on contig =88248..88433bp; Strand=+
atgtcccttatccgaaaagcgttcaaacgtctgcattatcctgttgatattatcgcccagtgtgttcgttggtacctcgcttatgccttgagtctgcgcaatctcgaagagatgatggcagagcgcggcattgggtcgactatgccacgatacctcgctgggtgttacgtggttctgttgcaataa

SEQ ID NO: 6019 - DNA, 621 bp, Xenorhabdus bovienii
  Coding DNA location: Contig name=SeqID_16918; Position on contig =88482..89102bp; Strand=+
atgtcgttgatactaaaagccttcaaacggttgcattatcccgttgatatcattgcccagtgtgtccgttggtatctggcctatgccctaagcctacgcaatctcgaagagatgatgaccgagcgagggatacgtgttgaccattctaccttatactgttggattatcaggctcacaccattactgggtaaggcctttcgtcgacataaacgtcccgtggctcgtcgctggcgtatggatgagacgtacatcaaaatcaaagggcaatggcgttatctttaccgggctgtggattcagacggcaatacggttgattttttgttgacagcccatcgggataaggaggccgccttgcgtttctttaagaaagcaatacgccagcatggacaacccgacgtggtgacgattgataaaagtggcgccaataaagccgcagtggacgagttaaccaaggaaaaaacaaaggataacgacatcattatccggcagaataagtatcttaataatctgattgaacaggatcaccgcaacatcaaacggcggatatgtcccatgctgggatttaaacatttccggcgagctcaaacgttattgagcggtattgaattggtcagtatgtaa

SEQ ID NO: 6020 - DNA, 144 bp, Xenorhabdus bovienii
  Coding DNA location: Contig name=SeqID_16918; Position on contig =89212..89355bp; Strand=+
atgcgacagaaccatattagatcggggttaaagggattcccaatagcttcacacattattttttttcgtgtagtggaaaatgggataaccattgtcagaattctacatcaatctatggattataggcgacacattgatgagtaa

SEQ ID NO: 6021 - DNA, 96 bp, Xenorhabdus bovienii
  Coding DNA location: Contig name=SeqID_16918; Position on contig =89376..89471bp; Strand=+
atggttcagaactttattttcacccaagatacaataattagttacaacataaatatgatgtgttctgcctaccgcgaaagaacgagcctgcattga

SEQ ID NO: 6022 - DNA, 129 bp, Xenorhabdus bovienii
  Coding DNA location: Contig name=SeqID_16918; Position on contig =89435..89563bp; Strand=+
gtgttctgcctaccgcgaaagaacgagcctgcattgatcgtggcaatttttcacaaacgcatgaatttgctaacgcgcctcgccgactggctgagacaatattatggatttttaaggaaatatatataa

SEQ ID NO: 6023 - DNA, 342 bp, Xenorhabdus bovienii
  Coding DNA location: Contig name=SeqID_16918; Position on contig =89580..89921bp; Strand=+
atgagcgattgggaggctgtccctgtattggctgcattggatctagacgaattggttgacttttacacaagtaaacttgggttccattgcgacaattttgttcctaatgaatatgcgataattagcagaggggaagctgaaatccatttttgggcatgtaacgataagtacattgcagagaacacttcttgctatcttttcgtgaaagatatccaaagtgtgtttcaagaactacaagcgcagactgaagtctctccgcttgcggaaactccatggggcatgttggagttccacctaattgatccaagtggaaatttacttaagtttgggcagccagtttag

SEQ ID NO: 6024 - DNA, 222 bp, Xenorhabdus bovienii
  Coding DNA location: Contig name=SeqID_16918; Position on contig =89918..90139bp; Strand=-
atgacaggttacctgactccactccttaatgcgacagaaccggttactctaaatgtgccttttttccggttagaatacaacgctgttatccgtaattgtagctgcttgaatttctatcttcttttcaacggaaaaagaagccatacgtttgaatggatttttcaagttcgatgtccatatactttgaataaacaggagttggggagaacgttaaacagctaa

SEQ ID NO: 6025 - DNA, 99 bp, Xenorhabdus bovienii; identical to SEQ ID NO: 5923
  Coding DNA location: Contig name=SeqID_16918; Position on contig =90161..90259bp; Strand=+

SEQ ID NO: 6026 - DNA, 585 bp, Xenorhabdus bovienii; identical to SEQ ID NO: 5922
  Coding DNA location: Contig name=SeqID_16918; Position on contig =90270..90854bp; Strand=+

SEQ ID NO: 6027 - DNA, 504 bp, Xenorhabdus bovienii
  Coding DNA location: Contig name=SeqID_16918; Position on contig =90970..91473bp; Strand=-
atgttcattgaggaacttatagacaagtctcacaatcgaaaatcattcaattgcggagaacccgcactgaatgattatctacaaaaattggcacagcaagatactaagaataacgttagtaaaacatatgtcgcaatttcatctaatgactcaaataaaaagattattggttattataccgttacgccttcatctataaattttgacgatcttcctaatagtttatccaaagggttagctaagcgcgctgttccagtttatttactatgccgtttagctattgatgtacattttcaaaataacggatttggagggcaattactgatcttagctggttatcgttgcctaaaagtcgctgaacaaattgggggaatcggactatttatcgaggctaagaatcaagcagtagctaaatggtatgaatcatttggagcgattccattatcttctgcgcagaagttgatcataccattcgaaacaattaaacaagctcttaaaacataa

SEQ ID NO: 6028 - DNA, 282 bp, Xenorhabdus bovienii
  Coding DNA location: Contig name=SeqID_16918; Position on contig =91482..91763bp; Strand=-
atgacacatatcaaactagctacagagcgattacaatttcgggttaattctgaaattaaagagtctattcaattagctgcatcaatcttacgtgtgaatgtaactgattttgttacacaaacagcaatgaaagaagcgcaaagagtaatcaatgaaaatgaaagtctcaaattatcatatagtgacaaaaaattaatcttggatcttttagataatccccctaaaccaaatgataagctaaaagcagcggcgatttcagcttctaaaaattttcaaggataa

SEQ ID NO: 6029 - DNA, 453 bp, Xenorhabdus bovienii
  Coding DNA location: Contig name=SeqID_16918; Position on contig =91843..92295bp; Strand=+
gtgagtacaaatttaaaatttggcctagtaggggtgcgcttggaattcggaaaaatcagtaaagttccctctatgttacttactaactgctctacaaaagggaacgcttgtaaagtgtcacattatgatggcaggtacatctctttcaccatcattacgcacaaaaacgtgaccatcaagcggctcgccgcgctcaccctcctcaatgcggaaggtgagcctcagcaggggattgaaatccggcaaaataaatacctgaataaccgcattgagcaagaccctcgccatgtcaaacgtcggatacggccgatgttaggctttaaatcgtttcgccgggcccaaacgattttagcggggatagagctcgtttcgatgctacgtaaaggacaatactcacaatcagaagataaggcattgtcaccggcagaaatgttttaccgattagctgaataa

SEQ ID NO: 6030 - DNA, 300 bp, Xenorhabdus bovienii
  Coding DNA location: Contig name=SeqID_16918; Position on contig =92401..92700bp; Strand=-
atggctaattacagagaattgttagcaaaagaaagcccagaaatgcaggcacgtattgaaaagcgagttgaacaggctagcatcaaattagcccttagtcagttacgtgatgaattagacatgtcacaggcggagcttgctgccgttatgggtgttcaacagccttccattgctcgaatggaaaatgcggatcatgatccgcgcctctcaacgctcaagcgctatgtggcagccttaggaggggaattaagtattgatgtgacacttccaaccggtaagcgtgtggcattctatctatga

SEQ ID NO: 6031 - DNA, 132 bp, Xenorhabdus bovienii
  Coding DNA location: Contig name=SeqID_16918; Position on contig =92703..92834bp; Strand=-
atgacgacaccatctaagcggcgggcaatcgttttatgtgctggcaataaaacaggggtaaatgaaaaacggttctacaaggaaatgatccgacaagctgattttgagtaccgccgtcacttggagaaataa

SEQ ID NO: 6032 - DNA, 354 bp, Xenorhabdus bovienii
  Coding DNA location: Contig name=SeqID_16918; Position on contig =92831..93184bp; Strand=-
atgccgatcagagcgcttattacaagcggtcccacagcgggttgctcacaagctgaggccttgattgacggaatagatgcagaacatttattagcggatcggggctatgacagtaataccgttgttgaacaagcagaaaaacaaggcatggcagcgcaaattcccggccgaaaaaatcgcaaagtgaaacgagaatatgatcgggaactctatcgactcaggcatttagttgaaaatgcttttcttcatcttaaacgctggcggggtatagcgacccgttatgccaaaaatagtgcctcatttcttgctactgttcagatccgctgtcttgctctttggttaaatgtcttatga

SEQ ID NO: 6033 - DNA, 492 bp, Xenorhabdus bovienii
  Coding DNA location: Contig name=SeqID_16918; Position on contig =93121..93612bp; Strand=-
atggatgacttaaccatgagcacacccgtacaccgccgtcacgatatttccgatcatatttggagtttgcttgaacctcacctgccgggacgtaagggagcctgggggcgtgttgcttatgataatcgattatttattaatgccgtgttctggattttacggacaggcgcaccctggcgagatttaccgcccgattatggcgactggaaaaatacgcatcgccgtttttgttggtggcgggacaaaggcgtatgggaagaactgcttgaagaactcatctttgaacccgatttcgaatggctgatgattgacgccagtcatattaaggttcatccccacgccgcaggggcggcaggaggcaatcaggatatggggcgcacaaaagggggctcaatacaaagatacatctggccgtggatgcgcatggtatgccgatcagagcgcttattacaagcggtcccacagcgggttgctcacaagctgaggccttga

SEQ ID NO: 6034 - DNA, 246 bp, Xenorhabdus bovienii
  Coding DNA location: Contig name=SeqID_16918; Position on contig =93644..93889bp; Strand=-
atgtgggaagttataacgacagagtgttttgacgggtggtttctggctcaggatgatgaactcagggaatcaatttacgaagcaatgggtgtattagagaaattcgggccgaatctcggtaggccttatgttgatacgctacatggctcagattttccaaacatgaaggaattgcgtgttcaacacgcaggtgatccgattagagctttttttgcatttgaccctagatggtgtcgtcataaataa

SEQ ID NO: 6035 - DNA, 183 bp, Xenorhabdus bovienii
  Coding DNA location: Contig name=SeqID_16918; Position on contig =93937..94119bp; Strand=-
atgtcccttatccgaaaagcgttcaaacgtctgcactatcctgttgatatcatcgctcagtgtgttcgcgagtatctagcctacgtaatatcgaagaaatgctcgttgaacgggggggatatattcactcatactttctctgttaatgcgacagaaccttcaacattgatcttgataatataa

SEQ ID NO: 6036 - DNA, 111 bp, Xenorhabdus bovienii
  Coding DNA location: Contig name=SeqID_16918; Position on contig =94191..94301bp; Strand=+
atgacatggtcaggtaacaccataaaaaaacaacatgttacccgacgatgccttaatgcgacagaaccccttaaaatggtttggtcggcagatattttccgtcgagcgtga

SEQ ID NO: 6037 - DNA, 471 bp, Xenorhabdus bovienii
  Coding DNA location: Contig name=SeqID_16918; Position on contig =94261..94731bp; Strand=-
atgattcagtcacaagttaaccgcgaagtccgcctggcgctcgccgacaaaatccggtcagtcaaaacgaagaaagatctctcgttcgcccaaattgccgacggcactggtttatcggaagccttcgtcaccgccgcactcctgggacagcatgcacttccggcgaaagtggctaatattgttggcaaaaagctggatcttgacagcgatgccatcatgttactgcagactatccctgttcgtggcagcattgaggatcgcattcccaccgatccgaccatgtatcgtttctacgaaatgctgcaggtttacggcaccacgttgaaagtgctggtacatgaaaagtttggtgacggcatcatcagtgccatcaatttcaaactggacgtgaaaaaggttgccgatccggaaggtggtgagcgtgcagtaatcacgctcgacggaaaatatctgccgaccaaaccattttaa

SEQ ID NO: 6038 - DNA, 396 bp, Xenorhabdus bovienii
  Coding DNA location: Contig name=SeqID_16918; Position on contig =94741..95136bp; Strand=-
atgataatcatcataaacgagacttttaccttatggaatatggggtgtaaccttcaccgcatcccacagcgagacagaagattcacaatgaaaaaagttattgacgactttcttaaatttcagagtgatactttccctgagcgcgttgagctgttcagaagcctggctacacagcaaagcccgcggacgttgtttatctcctgttcagacagccgtatggttccgaacctggtgacacaacgtgaatccagcgatctgtttgtgatcgtaatgctggcaactacagtccgtaatccggtggggtctcggcttcgatggctgacaaccctgatgtccgtgcagtgcctgttcggcagtcatcgccgtctgatattaatttcaactgtaaacaaatga

SEQ ID NO: 6039 - DNA, 489 bp, Xenorhabdus bovienii
  Coding DNA location: Contig name=SeqID_16918; Position on contig =95161..95649bp; Strand=+
atgaatttccgttatatcaggtattttctcgccgttgcagaacaccatggttttacccgagcagcaacagcgctgcatgtatcgcaaccagccctgtcacagcaggtcaggcttctggaagaaagcctcggcgtgcagctgtttgaccgcagcggacgcaatacccgcctgactgatgccggagaagtttatttacattatgtttgccgtgcatttcaggaactggatgaaggtaaacgggctattcatgatgtggaggatctcagcagaggttcgttgcgtgtcgctgtcacgcccacctttaccacctattttatcgggcctctggttgccgaattttatacgcgttatccctatatcacattgcaaatccaggaaatgtcccaggagagaatggaagagcggttaattaacgatgatctggatataggcattgcctttgatggcggagaatccccgggaattgcactcaagaaccctgctgactga

SEQ ID NO: 6040 - DNA, 462 bp, Xenorhabdus bovienii
  Coding DNA location: Contig name=SeqID_16918; Position on contig =95603..96064bp; Strand=+
atggcggagaatccccgggaattgcactcaagaaccctgctgactgaaacccttgctcttgttgtggcctgccaccatccgcgggcacagcagcgcaaaatcgccctgaatgaactcaacgatgaaaaactcattctgctgagtgcagggttttctacccgtgaacagattgatcgctattttcgtgagacagatctgcgcccgcaagtgcagatggagttcacttccatctgcgccgttttagacgtgatccgcaggacatcgctttcaaccctgctcccggcggcaattgccttgcagaataatgatctggtagcgatcccgcttgctgaccgacaactggaaagaacgggggtgttgatgcagcgaaaaggggcatggcaaacagcggctgggcgggtgtttattgaagttgcacaggagttggctgataaaacggttcctcgatataaatatacataa

SEQ ID NO: 6041 - DNA, 138 bp, Xenorhabdus bovienii
  Coding DNA location: Contig name=SeqID_16918; Position on contig =96006..96143bp; Strand=-
atgaaatggtcaggtaacaccataaaaaaacaacatgttacccgacgatgccttaatgcgacagaaccacagaacctacttatgtatatttatatcgaggaaccgttttatcagccaactcctgtgcaacttcaataa

SEQ ID NO: 6042 - DNA, 690 bp, Xenorhabdus bovienii
  Coding DNA location: Contig name=SeqID_16918; Position on contig =96143..96832bp; Strand=+
ttgatccgaaaagccttccggcgcctgcattatcccaccgatgttatcgctcagtgtgttcggtggtatctggcctatgccctgagtctgcgcaatctcgaggagatgatggctgagcgtggtgttatcgttgatcattccacgcttcaccgttggctcatccgtctggtgccattgctggataaggcatttcgccggcataaacggtcggtaggccgccgctggcgaatggacgaaaccgacaccaaagtcaaaggccagtggaaatacctgtaccgggccgtcgacagcacggggcagaccatcgactttctgctcaccgccaaacgggatgccgccgccgcgttgcgtttctttcgcaaggccatccgtcaccacggcgaacctgaaagggtgacgatcgataaaagcggcgccaatactgcggctctgaccacgctcaatgccgacaaacctgaagaggaaaacatcaccctcaggcaaagcaagtatctgaataacctggttgagccagatcaccgtaatatcaaacgtcggatacgacagatgctggggttcaaatcgtttcgccgggcacagacgctcctggccggcatcgaactgattcacatgatacgcaaagggcaatatcaacatccacaaagtgatggattatcacccgcggaacaattctatttgctggctgcctaa

SEQ ID NO: 6043 - DNA, 144 bp, Xenorhabdus bovienii
  Coding DNA location: Contig name=SeqID_16918; Position on contig =96936..97079bp; Strand=+
atgctggtattcaaaaacgtcaaacgggctcagaccgtattggccgggattgaatgggtcagcctgttgcgcaaaggacaataccgacaaaaagaagggtgtccgatttcaccggcagcctttttctatcaattagctgagtaa

SEQ ID NO: 6044 - DNA, 144 bp, Xenorhabdus bovienii
  Coding DNA location: Contig name=SeqID_16918; Position on contig =97218..97361bp; Strand=+
atgttaggttttaaatcgtttcgccgagcccaaacggttttagcggggatagagcgtgtttcgatgcggcgtaaagggcaatactcacaacccgaagataagacattgtcaccggcagaactgttttatcgattgactgcataa

SEQ ID NO: 6045 - DNA, 150 bp, Xenorhabdus bovienii
  Coding DNA location: Contig name=SeqID_16918; Position on contig =97402..97551bp; Strand=+
atgcgacagaaccaaaaagaggggaaccatagatttttatgctctcagggacatcgcagtcagctcggttttctgctggaaattgccgcgggtctcattgcttatacattccaacctaaaaaaaccgagcctgaatttacggggttctga

SEQ ID NO: 6046 - DNA, 561 bp, Xenorhabdus bovienii
  Coding DNA location: Contig name=SeqID_16918; Position on contig =97644..98204bp; Strand=-
atgactattacctttgtgagtgctccaagcggggcagatagtgttatagtttcttttttgcaagatattatagatggaggctcgcttagcgaagctgatacaaacaataaaataaataccaacgacgtctcatcgtcgaacccgattaaaatgtactatgtcgattgcaatgaatttgaaaaaacgaaatccttgatcaaggctgcccgctctacaggttggcggtatctattgtggtcaggcggctctgctgtgtccgatctccatttgaacatgcacgatgcaaatctcatcgtctcttcaatgacccttgatggcccgataccagtctcgacagttgaggcgctccttgcagcagaaatggatagcagagttcaacagcaaggctatgaagtgaggcaacttaatttaccttggtgttattttgtagctctgtggctacataacccaattcacgacattataattccgcttaagtcaacattaatccatggtatcacgatccacaaattgtatgaggtggaagaaatttccaacaaaattacagcgcaaatagattga

SEQ ID NO: 6047 - DNA, 675 bp, Xenorhabdus bovienii
  Coding DNA location: Contig name=SeqID_16918; Position on contig =98221..98895bp; Strand=-
atgactgatattcaaaatagtaatttaccgagatgcctttctttaaaaaaagtggcgctttctgcttccaagcgtagcatagaaaccaacagcttgtattctgatgggaagacaggctacctcacggatttctggagtaaagggtacatgcagcgtcaggagcaaacgtattggtgctggatcgctgtggctgcaagtataggcagttattatgcgcagaagccgaattattaccgacaagcgccaatttatgagaaagccaaaaatattacgccgcctggagcttgtgtagctccctatctccactttccaaataatgataagtgcaatcaggagggaatgccagaccggtccttggcgatgataggggcgtttgagaaagcaataaaaggaaaaggttatgtgccttttattataacagaactactcaataacaggccacttgtcgttgccgtttttttctcacacgaaattgccagtttaggtgatactaaggggcacgcagtggtgatatcagctgtattcaatgaaaagccgtttcattcagtttgggaagtatgcaacccgtgggacaaaacgagaacgttggagaatttcaagacattcccgttatattactatggagatccaacggctaaatgggaacaaacctgctttactaaaaaaccaatataa

SEQ ID NO: 6048 - DNA, 150 bp, Xenorhabdus bovienii
  Coding DNA location: Contig name=SeqID_16918; Position on contig =99099..99248bp; Strand=+
atgtgtgctaaattagaactcccgcgagttactgctagcaccttccggtccttctccaaactgggaataggtatttctctcttattcggattttctgtattatttctttctatatttagctgtgattacttctatgaaacaaaacactag

SEQ ID NO: 6049 - DNA, 141 bp, Xenorhabdus bovienii
  Coding DNA location: Contig name=SeqID_16918; Position on contig =99214..99354bp; Strand=-
ttggagtctaatactattgtaataagacatttgaaccaatcgattcatcaggcgaacctactatgggtcaaaaggatagcatcacgacgacacaaaacattagtaactagtgttttgtttcatagaagtaatcacagctaa

SEQ ID NO: 6050 - DNA, 102 bp, Xenorhabdus bovienii
  Coding DNA location: Contig name=SeqID_16918; Position on contig =99480..99581bp; Strand=-
atgagcactccctcaaatgacagactgaagtcagatttggtcaataaagattgtaaattcatggggacattttttcgttggcaaccagtaaccaacatgtag

SEQ ID NO: 6051 - DNA, 174 bp, Xenorhabdus bovienii
  Coding DNA location: Contig name=SeqID_16918; Position on contig =99933..100106bp; Strand=+
atgacgccgggaaaaaatcaaaaacacgaccttgtaggctgccttgacgcccaaataggccaagtgacttatgtcagcggtataaagaaaaatgctgatttatttatcaaaatgttaaagaaactgaatggccaatatcgccatgcaaaaaaacatcacgttgattttagataa

SEQ ID NO: 6052 - DNA, 126 bp, Xenorhabdus bovienii
  Coding DNA location: Contig name=SeqID_16918; Position on contig =100075..100200bp; Strand=+
atgcaaaaaaacatcacgttgattttagataactatggcactcataaaagccggaaagtcatggcatggctaaaaaaaatcctaaatttaatctgttgtttttaccggtctattcactatagataa

SEQ ID NO: 6053 - DNA, 267 bp, Xenorhabdus bovienii
  Coding DNA location: Contig name=SeqID_16918; Position on contig =100582..100848bp; Strand=+
atgttaaatattcttccggcgtcaattttagtaaaaacattgccaaacaataaaattggatttactgcacgtaatgcaacaacggttattgattttgaaccactagattatacctcagaaataggaaacacattaattctcgctgggcaggctttgatcacagcaagttctaataatgctccaggccctttcttaattgaatatgaaatacgcaatggtttaaatttttatgtaggaatgattataccaattgcagaaatgccttaa

SEQ ID NO: 6054 - DNA, 132 bp, Xenorhabdus bovienii
  Coding DNA location: Contig name=SeqID_16918; Position on contig =100823..100954bp; Strand=-
atgatgaggcttaatgagtttttggcgaaattgattatacccaatcatcatgctgttcagattaccttcacaaaacgtcaacacgccctaggctataagatcagtattaaggcatttctgcaattggtataa

SEQ ID NO: 6055 - DNA, 231 bp, Xenorhabdus bovienii
  Coding DNA location: Contig name=SeqID_16918; Position on contig =100979..101209bp; Strand=-
ttggcaacccttgcaataataacgaggaaacccggctttacctgctccatgtttgcgtaccggttcggtttggttacaataccggcaagcaacttctatcgtcaccgtcattttgagatccccttaaaaaggcataagaatatcaggttaacgctttggagtcatgacctttctatcaattggctgcataaaaaacaattacatcattttctcttgctagcgctctgttaa

SEQ ID NO: 6056 - DNA, 279 bp, Xenorhabdus bovienii
  Coding DNA location: Contig name=SeqID_16918; Position on contig =101099..101377bp; Strand=+
atgacggtgacgatagaagttgcttgccggtattgtaaccaaaccgaaccggtacgcaaacatggagcaggtaaagccgggtttcctcgttattattgcaagggttgccaaaaaaccttccaactcaactctcgttacaatgaccataagccgggtatgaaagaaaaaattgtcgatatggcgatgaatggctccggtgtgagagacacgggacgtgttttaagtatcggtatcaatacggtaatgcgtactttaaaaaactgtcgccaaaacaggtaa

SEQ ID NO: 6057 - DNA, 369 bp, Xenorhabdus bovienii
  Coding DNA location: Contig name=SeqID_16918; Position on contig =101443..101811bp; Strand=+
gtgggcaacaaaaaacaacgtcattggctttggtatgcttttgatacaaaaaggaagcaggccatagcccatgtattcggtcctcgaacagatgccacctgcagaaaactgctcgacttattagccccttttcatattcgtttcatcacgaccgatggttggggaagttacgccagagaagtcgagccagaaaagcatttggtgggaaaaattttgacccaacgtatcgaacggcataatctcaatctgcgcatccatatcaagcggctggcaagaagaaccctttgttattcacgctcaatagaaatccacgaaaaactcattgggacatatattgaaaaatatcattataacgctttgaagtcatga

SEQ ID NO: 6058 - DNA, 132 bp, Xenorhabdus bovienii
  Coding DNA location: Contig name=SeqID_16918; Position on contig =101806..101937bp; Strand=-
atggctaaagttgacattgattgtcgttattatctcaaatcagaaaaagtgaaaggacatggaaaaggtaatgagggacatcctcgttatcgctgctatgactgttgcaaagtctttcagttggggtcatga

SEQ ID NO: 6059 - DNA, 624 bp, Xenorhabdus bovienii
  Coding DNA location: Contig name=SeqID_16918; Position on contig =101997..102620bp; Strand=-
atgaatgaatcttttttgagtcacttaaaggaagtatatcaagatcgtgaacgagatctggttacattaagtgtgcgtgtcagtgttgaggagaatgcggccattcaggatttggtagattcagttggctgtaaccggcaggatcttctttatgagctaataaaaaaatacgcactcagtgaatgggaggtgatgagaaacgaagaactggatgctgaactcagttgcggaggtgcatctggtgataaccatacgaagacctattttctgcttaacacaaacaaagccaatagtgctaaggatcaccaatttatgattgaaaatggctttgctgctgcatttgaagaaggttacattcagaaaatagaaaaaatccatgaaggagatactgtctttttgtatgaatcaggcgtaggtattgttgcttacggctcagcaacgggtaaggtgctgaaaacagatcatctcggtgtaaaagataaaacctattatcaaaaactggatgggtttcatgttctggataaaccactgcctgccaaaaaaatctgtactctgcttaagaggagaattcctttcgtacaaacacttatcaagcttaaagatggcgaaaagcttctgaaataa

SEQ ID NO: 6060 - DNA, 96 bp, Xenorhabdus bovienii
  Coding DNA location: Contig name=SeqID_16918; Position on contig =102730..102825bp; Strand=+
atgcccaaatatcatgtactaaaacgttcggtttcggacaacctgcagcgacactgtacgaaagtaagtgttttttatttcgtacataagctataa

SEQ ID NO: 6061 - DNA, 3051 bp, Xenorhabdus bovienii
  Coding DNA location: Contig name=SeqID_16918; Position on contig =102864..105914bp; Strand=-
atggctcatcatacaaacaaaataaccggtaaaagtgaaaggctgtctgtattaactgatgctgagcaagaagccttgtatggtttgcctgattttaacgatgcgcagaggctgcaattcctggcattgactgaattagaactggctcttgccaataatcgaccaagcctgcatgaccaactctattgcattcttcagattggttatttcaaagccaagcaggcttttttccgttttgactggcatgaggtcagtgacgattgcgctttcgtgataagccactacttccatgatgaatctttcgggagcgaactgatcactaaacatgaacgttacactcagcgtgagcaaattacccaattatttagctatcagtcttggtctggggaatttcggcctcagctcacacaacaagcggctcatatcgtgcggcgagatgcagccccgggttttgttgccgccgaattggtcatctggctcaaccaaaacaaaattgtccgacccggttacaccacactacaggatctggtcagccaggcgctttctgttgaacgccagcgtctgggaaatattctggccgatgttttggacgaaacggctacagccttactggataagctgctggtacgtgatgatacgttgtctcaactggcagtactcaggcaagatgctaaagatttcggctggcgtcagatggctcgagagcgtgaaaagcgtgctacgctgaaaccattgtatgaaattttcaaagtgttacaccccagattgggtatttcacagcagaacctactgcattacgcaagtttggtgaatttttacactatttacgatttgcgtaatctgaaaaccgatcaaacccggctctatttgctttgttatgcctggtggcgttatcggcagtttactgacaacctggttgatgcgatggcctttcatatgaagcaactggaggatgaaagccgagctatcgcaaaaaagaccttcgctgatgaacaagacaaacgtcatcaggagacttcacaggtgggtcgcctgctgtcattgtacgtcgatgatcgggtatctgatatgacaccgtttggtgaagtacgtcagcaagcctgggcaattatgccaagagacgcggtgcaaaatacagcacggcgtatgcgcgataagccactgaaaaaactggcactacactggcaatcagtagacaaattatctgggcgtgttcgccgccatttgcgtccgttgtataccgtgctggattttgcctgtattgatcctgccagtccatggcttaaagcgctcatctgggctaaagatatcttcagcaaaagacagcgtttttcgcaacggccgcttgctgaatgtccgccggcaacattaccaaagcggctgtgcccgtacctgctgatatttgacacggatggaaatccggctcatttgcacgccgaccgctatgaattctggctataccgtcagataagaaaacggtttcagtcaggcgaattttaccttgatggcagcctgcaacaccgccatctttccgacgagctggtttcaaatgaaaaaaagcgcgatgttctggcgcaaatggagatccctttcctacagcaacctgttgatgttttgctggataccctgtcatctgaattacatcaacaatggcaggttttcaatcacgaactgaaacaaggtcagcttaagcatctggaatacgataaggacacacagaaattacattggcgcaaacccaaggtggataatcgaaaacctcaagagcaaacattttatgcccagctgccgttctgcgatattgccgatgtactcagtttcgtgaatgaacagtgccattttctatcagtaatgaaacctttacagccacgttatgcgaaaaaacaagccgaaactgatagtctgatggccgtcattattgcccaggccatgaaccacggtaatcaggtgatgtcgcgaaccagtgatattccctaccacattctggaaaatacttaccagcagtatctgcgtcaggcgacattacaggccgccaatgactgcatcagtaatgcgattgccacactgcctatctttccgcattattcgtttgatcttgacgttctgtacggtgcggtcgatggacagaaattcggggttgagcatacaactgtgaaagcccgctattcacgtaaatattttgggcgtggcaaaggtgtagtcgcctacacgctattgtgtaaccatatacctctcaacggctatctgataggcccaaacgaatatgaggcttaccatgtctttgatatctggtatcgcaacacctcgaatatcgtgccaaccgccatcaccggtgatatgcacagtgttaataaggctaacttcgcgatccttcactggtttggcctgcgttttgagcctcgtttcaccagtctgaatgcacaactacagatgttgtattgtgctaatgacccggaaatgtacaaaaaatgcctgattcaacccgtcggccagattgaccggcaacttattatccgcgaaaaagccaatattgaccggattgttgccacgttggggttgaaagaaatgacacaaggtctgcttattcgtaagctgtgtacttatacggcacccaatccaacgcgacgcgctatctttgagtatgatcggttggtacgcagcctctacacattgcgttacctgcgtgatcctcagttagaacggaatgtacaccgctcacagaaccggcttgaatcttatcatcaactccgttcagccatcgcacaggtcggcggcaaaaaggaactcaccggacgaaccgacatcgaaacggaaatcagtaatcagtgtgggcgattggttgctaacgcaatcatctactataactccgcgattttatcccggttactgaataaaccggaggtatcagacagcatcaagacactggcattgataaccaaaatgccccccgtcgcctggcagcatattttgctgaacgggcattataccttccagaacgaaggtaaaattattgaccttgatgcgcttatagcagggctgaatttcggctga

SEQ ID NO: 6062 - DNA, 579 bp, Xenorhabdus bovienii
  Coding DNA location: Contig name=SeqID_16918; Position on contig =106066..106644bp; Strand=+
atgacaaaaacattgattggttatgcacgttgctcaacagacaaacaggatttggctgcacagcaggaggcgctactccaacttggcgtatcccctgaccggatttatatcgacgaggggttaaccggctcaaaccgattgagaccaggactggaccaggcactcgcagccgttcgctgcggcgatacgctggttgtgccaaaactagaccgacttgcccgttcagttcctgatgctcgttatatcgccgactcactgcttgctcgtggggtcaaactggcacttggccccagtgtttatgatccgacagacccgatggggaaaatgtttttcaatatactggccaccttcgcagagttcgagggagatttgatacggctgcgcactcgggaaggtatggccattgcccgggcaaaaggaaaactacgaggtaaacaaccaaaactctcggataagcaacagaaagagctatgccgcatgcacggaacgggggagtactcaatcagcgatctggctgaactgttttcagtatcgaggccaaccgtctatcggactcttgcgcgtacaaataatatttaa

SEQ ID NO: 6063 - DNA, 1266 bp, Xenorhabdus bovienii
  Coding DNA location: Contig name=SeqID_16918; Position on contig =106469..107734bp; Strand=+
ttgcccgggcaaaaggaaaactacgaggtaaacaaccaaaactctcggataagcaacagaaagagctatgccgcatgcacggaacgggggagtactcaatcagcgatctggctgaactgttttcagtatcgaggccaaccgtctatcggactcttgcgcgtacaaataatatttaagagtagattatgctcagtaataatagatccagctatgatcagtttatccggagtattcatgcttaaattttattctttagttagtctattatggttatctatttctgcgcttgctcattcatcctctgcggtcggttttaaagaaattgacctagataaaggagaactcaggccattgagtgtagcaatttggtatcctgttaaaaatcaaaccaaaactataaacatcggcgacaatcagactttttatggaattaatgtcgtgcagaatggagtacctggttccgacgaatatccactggtggttctttcccatggctatggtggtagttggcgtaatctgagttggctggccaatgaattaaccggtcagggttatattgtagcggcgccggatcatcccggtacaagtgtatttaacaaagatatggaacaagccacaaagttatgggaacgaccacatgacttgagtcgagtgatcgacgctataaccacagactctaaacttggtggtaaggttgatatggaaagaatagcagctattggtcattctcttggtggatggaccgttattgcccttagcggtggacgctttgatacaggattgtttaaaaaagactgccagaagtattcaactctctgggcttgcaaccctgttttagtacttggacttgaaaagccagaactggagagaaacatggaagactcacgcataaaggcgtttatttccctcgatgcaggactgatccggggtttttcctcagagagtttggcaaagatacatatcccttctcttattattggcgctggcacagatgttggagatatgccggtcgaacttgaatccggctacttgaataaatatctctcgaaaacttactcgacctatgtcgaaatccctgatgctatgcattttagcttcatgcaagtctgcaaatcaggcgctataggattacttgaaggtgaaaataaagatgatggaattatctgcaaagatggcggaagcagaaataggaatgaaatccatcgcgaaattgcttttcttgtgacgggttttttggctaaaaaaattccaaatgtttcgcattga

SEQ ID NO: 6064 - DNA, 192 bp, Xenorhabdus bovienii
  Coding DNA location: Contig name=SeqID_16918; Position on contig =107731..107922bp; Strand=+
ttgaacgtagccaagtgtggtagcggccacaattttcacacatcgccactacttccggagctacaagcccgacaaaattttggacggttccggcttacaacccctagacgctgtcgtcatgatattttcagccaaagaacaaggcaacggatttgcactgcggcaagaaaagacgcgctattttttgcatag

SEQ ID NO: 6065 - DNA, 354 bp, Xenorhabdus bovienii; identical to SEQ ID NO: 1124
  Coding DNA location: Contig name=SeqID_16918; Position on contig =107847..108200bp; Strand=-

SEQ ID NO: 6066 - DNA, 477 bp, Xenorhabdus bovienii
  Coding DNA location: Contig name=SeqID_16918; Position on contig =108137..108613bp; Strand=-
atgagtacacctgcacaccgccgccacgatatttcagatcgcgtctggagcctgcttgaacctcatttgccaggacgtcaagacgcttgggggcgtgtagctgaagataatcggcgttttatcaatggggtgttttggattttacggacgggtgcgccttggcgagacctacatactgattatggtgactggaaaaatacccaccgccgtttttgtcgctggagagataaagggatatgggaaaaactgctcgaacaattggttaatgaccccgatttcgagtggttgatgattgatgccagccatattaaggttcatcccgatgcggcaggcgctaaagggggtaatcaggatatggggctcacaaaagggggctcaataccaagatacatttggccgtggatgcgcatggtatgccggtcagaattgttattacaagcggtaccacagcagattgttcacaagcggagaccttaa

SEQ ID NO: 6067 - DNA, 597 bp, Xenorhabdus bovienii
  Coding DNA location: Contig name=SeqID_16918; Position on contig =108716..109312bp; Strand=+
atgtcacgagtttttgcttactgcagggtgtctacccttgaacagaatacagaaaaccagcgtcgtgaaatcgaggcggctggatttgctatcagacctcagcgactgattgaagaatatgtaagcggatctgttgcggcgggtgagcgaccgggattcacgcggctgcttgaccgtatggaaaacggagacgtgctgattgtcacgaaacttgaccgcttaggacgtaacgccatggatatcaggaaaacggttgagttactcgcagactcagaaatccgcgttcactgcctggcattaggaggagttgacctgacaagtcctgctggaaaaatgacgatgcaagttatctctgcagtagccgagtttgagcgtgatctgttactcgagcgtactcatgctggtattgcgcgggctaaagcatccggaaagcgttttggccgcccgccggccctgagtgacgaacaaaagaagacggtatttttgcgtataaatgagggaaagagtatcagcgcgattgcacgcgaattcagcaccacgcgccagacaattctcagagtaaaagtggcaatggaagacattgacgctcctacgtga

SEQ ID NO: 6068 - DNA, 108 bp, Xenorhabdus bovienii
  Coding DNA location: Contig name=SeqID_16918; Position on contig =109505..109612bp; Strand=+
gtgcatatgacttctgataaaataatgtcagaagtcggctgcactaaacgcgattatgctcggtactcatgtgcaccaagacgcagaactacgctggatgattggtaa

SEQ ID NO: 6069 - DNA, 180 bp, Xenorhabdus bovienii
  Coding DNA location: Contig name=SeqID_16918; Position on contig =109637..109816bp; Strand=+
atgacttctgacattttgtgcagtcgtcttctgaaaatgacagtaggggcaagggatatggggaatgcctctaatgctttaagtgagctgaccaatattacccttcttccacttgatctttcggatataaattctgtcagggcattggcggccaggggttgcacatggtttgtttggtga

SEQ ID NO: 6070 - DNA, 93 bp, Xenorhabdus bovienii
  Coding DNA location: Contig name=SeqID_16918; Position on contig =110028..110120bp; Strand=-
atgaagataaataaagccatcttatatttatttagttatttaaattccatagggtttatggtgataataattgattccattggtctaaaataa

SEQ ID NO: 6071 - DNA, 264 bp, Xenorhabdus bovienii
  Coding DNA location: Contig name=SeqID_16918; Position on contig =110209..110472bp; Strand=-
atgatttcaagatgctttatttttttctttgtaatcatggtgagccccacagttagtgttgtgcagggtgattaccctgcacgaatatcaggttatatggctttatcccaacgcgcaaagacgttgacccaaccaccagaaacactatccatcaggttttcaacaagcactttacgttcttgttttttctctgagttatttattactttcgcattatttaaagctatttcacgttgtaattttctcatgcttgtgtccttttga

SEQ ID NO: 6072 - DNA, 1179 bp, Xenorhabdus bovienii
  Coding DNA location: Contig name=SeqID_16918; Position on contig =110435..111613bp; Strand=+
atgattacaaagaaaaaaataaagcatcttgaaatcattctaaaagtaagtgagcgatgcaatattaattgtacgtattgctatgttttcaatttgggaaatgaaatatcaataaattcaaaacctattatttctcatgacattattaaagttctgagagcgttctttgaacaggcatctcaggaatacgatattgaaacaattcaggttgattttcatggcggagagccattaatgatgggcaaggaaaaatttgaaaatgcttgcaacgagtttatttcagggagttataataaaacaaaattcaacttagcatgccaaacaaatgccattcttattgataatgaatggattgatattttttccaaatataatgtcagtgttggtatatctattgatggacctaaacacataaacgacaaacaccgcctagacagaaaaggccgtagtacctatgaaggtacagtgcgtggcttggtgatgttacaggaagcttggagtgcggggcgacttatagatcaacccggtattttatgtgtagccaatccgtcagtaaaaggagcggaaatataccgccattttgtcgatgttttgaaatgcaaaaaatttgacttccttattcctgatgaaagtcatgatacatgcacaaaccctgatggcctatcagatttttattgttcagcaattgatgagttcttttctgatgcagatcaggatgtatatgtacgttattttcttacacatatgcaatcaatgttaagctcagaatttagcccagtaatggggttaagtaaatcagggagtgacactatcgctctcacggttagttccgaaggtgatatttatgttgacgatacgctcagatcgaccaatgatcctatatttacaccgattggtaatgttctaaatttgacgctctcagaaactattgcttcatggcagatgcaaaagtatatgaccgtgaataatcaactaccaaccgcctgtactgattgcatctggaaaaaagtgtgtggaggtggtcgccatattcaacgatattcaaaagcagatgatttcaaacgtgaatctgtgttttgcccttcaataagaaaaatcatgagtcgtgctgcttcacatcttattgaatctggaatatcagaagatatcataatgaaaaatttgggaattaaatcatga

SEQ ID NO: 6073 - DNA, 864 bp, Xenorhabdus bovienii
  Coding DNA location: Contig name=SeqID_16918; Position on contig =111610..112473bp; Strand=+
atgatgaaatggttttcattgctaatattcctgttctccggaattagtatggcggatcttcctactgatttttggcggcttcgatatgacgaacgtggcctgccgttaatagatattaagattgacaacaaataccacacgctaatgttagatactggtagtggggaaggcatgcatctttataaacatagtatagaaaaattagttgctaatccaagtctaaaagctacccatgaatcacctcgtaagctaattgatgtttctggtggtgaaaacaacgtttctgtatggaagattaatcgattactcatttccaatatcccttttgataatgttgaagttgttggttttaaaccgtggggtttaaccataggaggcgaacaacctattaacgaagtgttgggacgtggaatgtttcacaataggctagttatgatggactttaaaaatgatcgactacagatgttagaacatcttcctgcagacattaataactggtcatcctatccactagaaaaaacaaagtcaggattacgtattactgcatacatgggtaacacacctttacatttgattgttgatactgccgctagccactccatcttgttctctaatcgcttgccagtcggcactctttttttaggttgtcgtgctattgatcctgagtcatccaattcagaatgcagagtaacaaaaataaatttgatagacgaaaaaggcaagtttcgtgatgatttagtcattgtacccaatgggttaactcctaaggaactagattttgatggcctgctaggcatgaattttatgcgataccaccaagtcattatcgatatgcgtaaaagcgtgttctatatcaatcgttaa

SEQ ID NO: 6074 - DNA, 1221 bp, Xenorhabdus bovienii
  Coding DNA location: Contig name=SeqID_16918; Position on contig =112475..113695bp; Strand=+
atgatgaacaaagagaactctatttttcgccctgaggctttacaatataaaaaaaatgcgtggcttggtgattttaccgtttcagcaccatcagtgctaccggttgccctgtggtgcgccattggagttttgttggtgataactctccttttatttaccacctatgccaagagagtatctgtaaacggtcgaataatctacacgcctgccgctgcagaggttgtgtttagtcaagatggagtaattgaccatatcaaggcacaccaaggggaaagagtaaaaaaaggagacataattgcgacgttttcgcgtgatgtaacctacgccggaggcagggtgaaccaggcactgctggacactgctcagcaccaaataaccgaattacaaaagcgagaggtagagcgtcgcaaagaaggagaagaggaacgtcagctcttacgcgaagaaatcagtaccaaagaccttgaaattgcagctatccgggtcgcagtcgctgccgaacaagaacgttctgtcagcctgaaaaaacgtatggctttttatcagcagttgctccaaaaaggcgtcactactttgcaagaaaaaatcgagcgcgaaaaagaatattataattccattgctcaactgaacatgcatcgaattagtatagtgcgtgcacaagaggagcggcttcaattagtggacaagcttgctcgctcagaagcacaagaaaaacaatctatcactgggatacaacaacagaaagtcactctgcaacaacagatgattaatgcatctgcgatgatggagactcgtattgtagcgccacttgatggtgttatagcatcaatgaatttattggaaggccagagaattacagagggcaagatcgcagcaggtgtagtgccagaaaacgctcgtccactcattgaaatggggattcctccgtctgcgttgcaagaagtaaaaactggccaacatgtagtgatgcgggttgcatcacttccgtgggaaaggtttggaaaagtatccggcaccattgcgaccgtaagtacgagtcctgaggggcttacgggaaataatcaacgatttcgtgtactgatagtgccagaggctggtacacacgttcttcccccaggggtagaagttgaggctgatatattgaccacgcatcggcgcatctgggaatggcttttttcacctgtaaaacagagtattaaccgcattataaatgagagttga

SEQ ID NO: 6075 - DNA, 2127 bp, Xenorhabdus bovienii
  Coding DNA location: Contig name=SeqID_16918; Position on contig =113699..115825bp; Strand=+
atgtttttttcctggaaaaaaaccccgctgattctacagtcagaaacaaatgagtgcgggttagcatgtttggcgatgataactggctattttggtaaacgcgtagatctcgcatcagcacgtaccatccatgaaacaactagtcacgggatgacactacgggaacttataacggcatttgaacgggtgggaatgacggctcgtgcttcaagaatagagcttgacgatctacgttcgctcagccgcccggttattcttcactggtcattcaatcactttgtagttttagtcaaagtgtcacatcgtagtgccgttatccatgatcctggcattggtcgtcgcagtatctcattgcgtgaattgtcagacaaatttactggcgtcatagtggaagcttggcctgcggagacattcgacaaaaaaccgatggaaatgaatgtatctgtatctgaccttttctgcggagttaggggtttgaagcgtattctttccggcgttctagtgctttctattttggtggaattactttctattgccgtgcccgcagcgtcacaatttaccattgatacactagttcagtcatcggatcgtgaaggaatattttttatcgggatcgtagttatttctgcgttactgattaagtccacattttctgtgattcgagcttgggtactgatgagtcttcgttatacgcttggagtgaaatgggctgaaatgttctttaatcggcttagccgactgacgctaccattttttgaaaaacgtcacacaggtgatataacgtcacgttttcagtctctgactgccatccaagaagcttttacggctgatatggtagcgtctatactcgatgcaatggtcatcatcatctcaatggtcatcatttttactaattcacctctcttggcaatgggtccgctagctgcagctatgggatatgtcgccctgaaagcgggtctattttctatgtacagaacccgtaaaattgaacatattgcatttgaagcggttcagtcgtcccattttcttgagactattcgagctattagtgccatcaaaatgctgaatctggcaccgattcgtcggcgggagtgggtaaatcacgttgtcaacagcacacacgcaggaaaccaactattcaaacttgatcttttaaccaatacggcagccatgcttcttgttggtttttcgggtatctacgtgcttagcgtgggcgctttagagtttgataagggaataactactggcatattgttggcggtgatgctttatgctgacatggtgatcactcgtacagtgaggctagtaaacgcagtttctgacttttgtctggtatctatgcacagtcaacgcctgactgatattgctgtttcgcccgtagaacgggatgaaggggaaagatctcccgcccagttaaatggacatatagtgatccgaaacctatcgttccgtcattcaccaagcgaccccaacatctttgaaggcataaatattgaggttatgcctggggaaagcgtagccattattggaccatctggatgtggtaagtcaacgcttcttcatgtactagctgggctgtatgaacccactgatggtgatattttaattaacgggataagtatatccagtataggaaaacgagctatcaggaaacatgtcgcttttgtcatgcaagatgacaagttattagccggaaccctacagaaaaatatcactggattctcagagtcaccagatatggaacgtatggctgaatgtgccaattatgctgcaattgacgatgaaatttgctcatttccgcaggggtatgattcaatgattggagatatgggtagcactctttcaggaggacaacgccaacgcatttctatcgcaagggcgttatatcgccaacccagagttttgctgcttgatgaagcaacaagtgatctggatattgataacgaacgaaaaataactcatgctattagccaactaccaataactcgtattttcgttgctcatcgaccagaaatgattaaatcagcggatagaatctttaaccttcaattgaatgcatggatggagaaaaattgtggttctgtcgcattaagcggtcatcaggtaagcccccctgtttttgagtga

SEQ ID NO: 6076 - DNA, 93 bp, Xenorhabdus bovienii
  Coding DNA location: Contig name=SeqID_16918; Position on contig =115858..115950bp; Strand=+
atgtctcttttatccccgtttcctaactgtaacgggtcgcaatcgaaaacggtcgagccgctacagctagggaatgggcgcaaatccccttaa

SEQ ID NO: 6077 - DNA, 123 bp, Xenorhabdus bovienii
  Coding DNA location: Contig name=SeqID_16918; Position on contig =115924..116046bp; Strand=-
atgattggcggtgcaatgttgtcgatagggattgttacaggtgtcagtgccaacgttttcttcagtaggggttctacgccagacaatggcattcggttaaggggatttgcgcccattccctag

SEQ ID NO: 6078 - DNA, 210 bp, Xenorhabdus bovienii
  Coding DNA location: Contig name=SeqID_16918; Position on contig =116125..116334bp; Strand=+
atgactgcgttcagtcatctggtcaccgtaaaacggcctgaaaacgattttgagcggtttttgtatttcatgttcggatggtatttaaagagaaaaaaccgcacagtgaagctcgtaggcgtttttatgccatttagggtatggaggcggctcattcaatgtgactgggatagcggctcttcatccgccgatacaaaaggggggacttaa

SEQ ID NO: 6079 - DNA, 189 bp, Xenorhabdus bovienii
  Coding DNA location: Contig name=SeqID_16918; Position on contig =116331..116519bp; Strand=-
atggatctgaaaattattcatgaaacagttgatgggaaatggacgttccgtgaacccagaccagacgctgtatttatcaaattttcatatgacggtcgttctcggtctggagaactgggtgaacgagtcacgggtagatcgctaaaaaacagcttagcagggatgagggggatcgcgttccctgattaa

SEQ ID NO: 6080 - DNA, 282 bp, Xenorhabdus bovienii
  Coding DNA location: Contig name=SeqID_16918; Position on contig =116566..116847bp; Strand=-
atgaacagtatcagtttcgaacaactgaaggcagaaatgctagataccccagcagctattcaagcatatcaggatgctgatcaggagctcaccatcgtcgaaatgctataccaaatgcgcgaacacgctgggttgtcaaaatcagaattagctaaaaaattgggcatatccccatccgcaatcacgcgactagagggcaatcctctgggtgctagtgtgaaaacattatcgcgttatgccagtgcctgcggtgctaacatcgatataagaatgacagtttga

SEQ ID NO: 6081 - DNA, 315 bp, Xenorhabdus bovienii
  Coding DNA location: Contig name=SeqID_16918; Position on contig =116844..117158bp; Strand=-
atgtttgatgtgataactcatccagatgcactattggaattgaagcagctacctgacgaactgcgaggtcgcatgttccgattgatagaacgactgagtgcggatggaaaccaattaaaaatgccacacagtagagttattggcggtggtctattcgaactacgggttggagctaaaaacatagctagaacgctatatgcgtttgaaataggacaaaaaatttatctattacatgcatttgtgaaaaaaacacaaaaaactccatctggctctatagaaatagcgagaaaacggttacaggagatgaacgaatga

SEQ ID NO: 6082 - DNA, 261 bp, Xenorhabdus bovienii
  Coding DNA location: Contig name=SeqID_16918; Position on contig =117032..117292bp; Strand=+
gtggcatttttaattggtttccatccgcactcagtcgttctatcaatcggaacatgcgacctcgcagttcgtcaggtagctgcttcaattccaatagtgcatctggatgagttatcacatcaaacattttcccccctgattaaaatataccaaaaaaagaaatttccgtcaaagataaatttaactaaaaagataaatttatctaaaatatgcctgccattcctgaatcatcgcatctttgcaggttatccgcctgtctga

SEQ ID NO: 6083 - DNA, 102 bp, Xenorhabdus bovienii
  Coding DNA location: Contig name=SeqID_16918; Position on contig =117277..117378bp; Strand=-
atgctccagattctaggcaccagtattgtgtcataccctctatcgcttcgtgctcaccatacacaacaacacagtaaaacccatcctcagacaggcggataa

SEQ ID NO: 6084 - DNA, 234 bp, Xenorhabdus bovienii
  Coding DNA location: Contig name=SeqID_16918; Position on contig =117423..117656bp; Strand=+
atgaaattcaatgaagattttttttatgaatggttgctggataagtcttccattaaacgtaattcaactaagcagaagattgcttactgtatggcctgcctgcttgagttgtctatcgaagacgaagggcaaaaagtaaaatctagccgtttatttgaacgtgcagacatcaataaagccgctcttcattacgctgtagggggaataaaaaatttgtgggaaattgacctctga

SEQ ID NO: 6085 - DNA, 252 bp, Xenorhabdus bovienii
  Coding DNA location: Contig name=SeqID_16918; Position on contig =117688..117939bp; Strand=-
atgttctgcattctggttatgtttctgggcgctataacccagttactcgtaaaaggtagtttaatcctcttaagggtactttttatgcttaatttaacggagtctgaattcataacggcaattaaaaaccgtggcgtactggtatcaggatatgaacccacggaacgcggtcatgtgtcatttgacgatacgactgttatccagcatggatttattttgtccgtcttcagagaagatattgtcaataactga

SEQ ID NO: 6086 - DNA, 330 bp, Xenorhabdus bovienii
  Coding DNA location: Contig name=SeqID_16918; Position on contig =118140..118469bp; Strand=-
atgcgattgacaaacgcgcaaaactcgctcacaataggagcaccgttggcgcaatgcaccaccctgcttttgggctatgaggccgtggccaacgggttgtggatctggacggcctcagatccacgcagatccacgctcagatccacaaaatttgattattatttgtacaaccatttttgcggcgcactgcgcggcggtggcaacaacaacctgttatatatatattatttttatttaataatatttatatatatagagttatccacattttgccatcgtgatttttccgtcagatccacactttttaggggagagacacgtatagagtga

SEQ ID NO: 6087 - DNA, 189 bp, Xenorhabdus bovienii
  Coding DNA location: Contig name=SeqID_16918; Position on contig =118520..118708bp; Strand=+
atgggattgggtcgggttagcgggacgcgcattgtgcgatgcgcgcgttgcgggcgggggagggtttggacggctgggtggctaggggcggcaggatgcttagtatgtttttatgtgtacaccgatgcttatagattttttttggttttttttatttttttgttttctaaaataaacataatacggtga

SEQ ID NO: 6088 - DNA, 129 bp, Xenorhabdus bovienii
  Coding DNA location: Contig name=SeqID_16918; Position on contig =118754..118882bp; Strand=-
gtggactcctgcggaaaaccggattattcaatggaattggatagggcaaaatcgacttccaggtgtcaccacaggaagtcgtatgaattagattgcgcgataaaaaattcgactttagacattttatga

SEQ ID NO: 6089 - DNA, 150 bp, Xenorhabdus bovienii
  Coding DNA location: Contig name=SeqID_16918; Position on contig =118910..119059bp; Strand=-
atgctttcgctgtacatccgcttcctcatgcgacgtattaaaaaccaaggtatttcaggcctggacaaattcagccatagacgatttgtggcaacgccatcacgtttgcaaatcacggtaataagcaatacagcgctaatacagcgctaa

SEQ ID NO: 6090 - DNA, 96 bp, Xenorhabdus bovienii
  Coding DNA location: Contig name=SeqID_16918; Position on contig =119071..119166bp; Strand=-
atgcacagaagcccaatattcagtataataaacacccaaaccacacttagcgcgataaaacgtactcaatccggcaatctccagaaacttttgtga

SEQ ID NO: 6091 - DNA, 240 bp, Xenorhabdus bovienii
  Coding DNA location: Contig name=SeqID_16918; Position on contig =119357..119596bp; Strand=+
atgttagtagttactaacatcaattttgcaggtttttggcgttttttcgcgccgttagcacattgtgcagcgctttgcgttaacggcgtattgggtggtctgtttagggtatgctacctatttttgcggattttttttttacagtttattattcttttccatctcgagattctctttcagggtttgtctgtcgttttccgagagtgcctcgattcgttttatggcattcatgacggttga

SEQ ID NO: 6092 - DNA, 387 bp, Xenorhabdus bovienii
  Coding DNA location: Contig name=SeqID_16918; Position on contig =119646..120032bp; Strand=-
atgacattcatcttatctgtgaagtggataagcaggggtcgtaagaaaaatcagcgcgggctctggtatgcctgggagccgcgtatgaaacggatagtggcacatacttttggggatcgcagcagaaaaacattggaaaaactacgggcactcttgtcaccctttaatatccggttttactgcacggatgattatgccgtttatgattgtcttcctgaagaagtccatcttactggaaagatatttacccaacgtatagagagaaccaaccttacccatcgtacccgaataaaaaggctgaatagaaaaacaatcggttattccaaatctgaagaaatgcacgataaagtgataggcactttcattgaacgtgaaaactatatttag

SEQ ID NO: 6093 - DNA, 291 bp, Xenorhabdus bovienii
  Coding DNA location: Contig name=SeqID_16918; Position on contig =120038..120328bp; Strand=-
gtggctaaagtagatgttgattgtcgttattgtcacaaatcagaagatgtcaaaggacatggaaaaggtcatagaggttatccccgctaccgctgctatgcctgcagtaaagtctttcagttggcatacacctatcaagcctgcaaaccgggagtcaaagagcagattattgatatggcgatgaataacagcggcatccgtgacacggcccgcgtattgaaggtggcaacagctactgtgatgaaaacgtttaaaaactcacccccggaacgtgacgacgcttcctcttga

SEQ ID NO: 6094 - DNA, 129 bp, Xenorhabdus bovienii
  Coding DNA location: Contig name=SeqID_16918; Position on contig =120415..120543bp; Strand=+
ttgcaatcaagacgttatttcagaagcttttcgccatctttaagcctgataagtgtttgtacgaaaggaattctcctcttaagcagagtacaaatttttttggcaggcagtggtttatccaaaacatga

SEQ ID NO: 6095 - DNA, 228 bp, Xenorhabdus bovienii
  Coding DNA location: Contig name=SeqID_16918; Position on contig =120540..120767bp; Strand=+
atgaaacccaggttattagcggcttgggatagagccatgttggctaaacggttcatcatcgaaaccatcaatgatcagcttaagaacgtcacacaaattgagcattcccgccatcgtagtttgatgctgaatttattaggtggattaattgcttactgcttaaaacccaaaaagccatcactcaatatcacaagcgctgaaaaaacaggacttcgggtgatggcttaa

SEQ ID NO: 6096 - DNA, 288 bp, Xenorhabdus bovienii
  Coding DNA location: Contig name=SeqID_16918; Position on contig =120861..121148bp; Strand=-
atgggccgactgtttgagttcgcgagtgccaataatattggacttggcggcccagatattgttcccaaccgcaaggcgcaaatgaagaactcatatccattcttcaacaaatacaaaagtaagctagcactcattgccatggcagtgcaggagccgaccttgacctacaggaaccccaatactggtaagccctttatcaaggacgagtttgtagaattcgcagaagattatctcggtgcagatatcattttctggagcacgacgtctccttggttgacaaagaaatag

SEQ ID NO: 6097 - DNA, 216 bp, Xenorhabdus bovienii
  Coding DNA location: Contig name=SeqID_16918; Position on contig =121049..121264bp; Strand=+
atggatatgagttcttcatttgcgccttgcggttgggaacaatatctgggccgccaagtccaatattattggcactcgcgaactcaaacagtcggcccatataattgtggtcgttgttccattcgcacggccagaaatttacatattggggttgtaagccggaaccgtccaaaattttgtcgggcttgtagctccggaagtagtggcgatgtgtga

SEQ ID NO: 6098 - DNA, 1266 bp, Xenorhabdus bovienii; identical to SEQ ID NO: 6063
  Coding DNA location: Contig name=SeqID_16918; Position on contig =121296..122561bp; Strand=-

SEQ ID NO: 6099 - DNA, 579 bp, Xenorhabdus bovienii; identical to SEQ ID NO: 6062
  Coding DNA location: Contig name=SeqID_16918; Position on contig =122386..122964bp; Strand=-

SEQ ID NO: 6100 - DNA, 3051 bp, Xenorhabdus bovienii; identical to SEQ ID NO: 6061
  Coding DNA location: Contig name=SeqID_16918; Position on contig =123116..126166bp; Strand=+

SEQ ID NO: 6101 - DNA, 225 bp, Xenorhabdus bovienii
  Coding DNA location: Contig name=SeqID_16918; Position on contig =126217..126441bp; Strand=-
atgtgtcaggcatggaaggagctgaaagccttgctggatacatggatcaatgaaggaatagagcggaaagtgtcacttagcgctgataatcagtgccttagatctgggttaaagggattcccaatagcttcacacattatcttttttcgtgtagtggaaaatgggataaccattgtcagaattctacatcaatctatggattataggcgacacattaatgagtaa

SEQ ID NO: 6102 - DNA, 183 bp, Xenorhabdus bovienii
  Coding DNA location: Contig name=SeqID_16918; Position on contig =126399..126581bp; Strand=+
atgtatccagcaaggctttcagctccttccatgcctgacacatataatggtttgtggctatttatgacacaggtgtcattttcagaagacgattgcacggaatgtcagaagtcgtcttctgaaaatgacaatcgtattgtccgacacacgttgatttatcggacaaaaacccttaacgtgtga

SEQ ID NO: 6103 - DNA, 309 bp, Xenorhabdus bovienii
  Coding DNA location: Contig name=SeqID_16918; Position on contig =126640..126948bp; Strand=+
atggtattagaggtatcacttcaatggtttggtcagacaaagagcctccattattcatcagtgtctatcttagaaaaagtaacacttctcttgaagaacgttcagagaaaattgctgagattgggatggttatttttagcaagtatactcactaaacgactaccggctgatgccggtaggtttatcggcatggttttcgatacactgaagtataattttgtccgtgacattgcaaccggcagagatattttatcgattgactgcataaagagtcatcatttccacctccgcacaaattttctctgttaa

SEQ ID NO: 6104 - DNA, 861 bp, Xenorhabdus bovienii
  Coding DNA location: Contig name=SeqID_16918; Position on contig =126945..127805bp; Strand=-
atgaacacgatctgctatcagagcgccgacgtagatggcttcaagattttctatcgcgaggccggtcgagctgacgctccaaagctcctactgttgcacggctttccgagtgccggccatatgttcagggacttgattccgttgctggccgatcgcttccacatcatcgcgcccgacttaccagggtttggccagtccgacatgccggcacgcggtgcgttcaaatacaccttcgataacattgccaaggtcatcgaccgattcaccgatgtggtctgctttgaccggttcgctgtttatgtgtttgactacggcgcgccgactggcttccggcttgctatgtggcatcccgaacggattacaggcatcatttcgcagaacggtaatgcctatgaagaagggttgagtgaaggctggaacccaatcagggcctattggcaggacgcctctcaggccaaccgcgatgcactgcgtgccttcctcgctcccgagaccacaaactggcaatatacttacggtgttcccgatgagacggccatctctccggacgggcaaaacctcgacaactattatctgactcgccccggcgccgctgatgtgcaactcgatctattaggcgactacaaaagcaacgtcgccctctatccgaattttcaggaatatttccgcactcacaaaccacccttccttgcggtgtggggccgaaacgatccgtttttcttgccacttggtgctgaagcgttcaagcgcgatatccccgaggcaaaagtcaccttctttgaaaccggtcacttcgccttggaaacccatgccagtgagattgcgacggccatccgcgatttcctcacacgctcgcattaa

SEQ ID NO: 6105 - DNA, 306 bp, Xenorhabdus bovienii
  Coding DNA location: Contig name=SeqID_16918; Position on contig =127958..128263bp; Strand=-
atggactatgtactcacgaaggcggctgaggccgatttacgcgcaatcatccgccatacgcgcaaacaatggggtgacgtgcaggtgcgccgctacgtcaccgcgctggaacagggcatcgcgcggcttgctgtcggccaaggctcttttaaggacatgagcgcgctctttccggcattgcgcatggcgcattgtgaacatcactatgtgttttgtctgccgcgtgaaaatgcgcctgcgttaatcgtggctatttttcacgagcgcatggatttgctgatgcgccttgccgaccggctcaaatga

SEQ ID NO: 6106 - DNA, 276 bp, Xenorhabdus bovienii
  Coding DNA location: Contig name=SeqID_16918; Position on contig =128263..128538bp; Strand=-
atgaccgataaggagaaaaccatgagccgtctgaccatcgacatcaccgaccggcagcaccaaagcctgaaggcattggccgccctgcaaggcaagacgatcaagcaatacgcactcgaacgcctgttccccggaatgagcgatagcgatcaggcatggcaggatctgaaagccttgctggatacacgcatcaatgaagggatggaggggaaggtgtgcgggaaaagcatcggcgcaattctcgatgaagaacttgccgggagcgaccgcgcttga

SEQ ID NO: 6107 - DNA, 288 bp, Xenorhabdus bovienii
  Coding DNA location: Contig name=SeqID_16918; Position on contig =128431..128718bp; Strand=+
ttgcttgatcgtcttgccttgcagggcggccaatgccttcaggctttggtgctgccggtcggtgatgtcgatggtcagacggctcatggttttctccttatcggtcatacacaaacccacattagcacatataatggtttgtggctatttattaaacaatggtcagatatcgttttgtccggcaaacgaccgtttgacggtcatgacggacatctgtccgaaaacatcttgatgaatgggatttcggacattatgatagatggacgcaataacggacaaatggggtga

SEQ ID NO: 6108 - DNA, 135 bp, Xenorhabdus bovienii
  Coding DNA location: Contig name=SeqID_16918; Position on contig =128722..128856bp; Strand=+
atggcactgatcggctatgcacgggtctcaacaatagaacagaacacagccttgcagacggatgcactgcacaaggccgggtgcgaacgggttttcgaggacaggtgttcaggtgcaaaaagcgaccgccggtag

SEQ ID NO: 6109 - protein, 262 aa, Xenorhabdus bovienii
  Coding DNA sequence: Name=SeqID_1
  Gene classification: Gene name=CyaA; Function=Adenylate cyclase; Function class=F Nucleotide transport and metabolism
  Homolog annotation: Query=1..252bp; Hit=224..477bp; Blast score=420; Percent Identity=78.0; E value=1e-118; Homolog= cyaA COG3072
LTPNEWLDLGGLNELSAEEYCGASLWQLYKSVDSPYKAVLKSLLLEAYSWEYPNGKLLSMEMKQHFHDGSIVSFGLDSYSMMLERVTRYLTATNDFTRLDLARRCFYLKVCEKMLGSHEDKGCTGWRHQVMSQLAHEWGWDASKLAMLDNRNSWKIGLVRDAHNELLDTMMMSYRNLIRFARRNNLSVSASPQDIGVLTRKLYAAFEALPGKVTLVNPQISPDLTEQDLTFIYVPPGGWYLYNHAPTIETIIGRPAGRCKAL

SEQ ID NO: 6110 - protein, 68 aa, Xenorhabdus bovienii
  Coding DNA sequence: Name=SeqID_2
  Homolog annotation: Query=1..62bp; Hit=381..442bp; Blast score=109; Percent Identity=70.0; E value=1e-23; Homolog= ref|NP_928988.1|
LEDSDNWRYVPVRRLFNTVERDVKRAMSFAMFEPNNQPTWERVRAAISNYLHGLWGGGGGGGGGGGGG

SEQ ID NO: 6111 - protein, 70 aa, Xenorhabdus bovienii
  Coding DNA sequence: Name=SeqID_3
RENSLSPFFSPSLGGRGVFSFLSPPGGGGGGKEKGRGREERGGGGGGGGLGGGPPLPPPGVLGVVWELAS

SEQ ID NO: 6112 - protein, 53 aa, Xenorhabdus bovienii
  Coding DNA sequence: Name=SeqID_4
KTVADLARLGNPPPGVPAGGGPAGGAPKKKGLKKKKLLRGKGKNRVYRGGKTL

SEQ ID NO: 6113 - protein, 118 aa, Xenorhabdus bovienii
  Coding DNA sequence: Name=SeqID_5
LCGGGRFKKIKKKKWGQKGAPFFWGGGGKKKRKKKKPPPFVKKKKGVFFKKKKEGFFLKGALFLKISQENRGKNFFGGVGFFFGNPNFGGKGKYFGGCFWFEKGFELGQGRFLLLSRI

SEQ ID NO: 6114 - protein, 60 aa, Xenorhabdus bovienii
  Coding DNA sequence: Name=SeqID_6
VGGGSAKGKIKTGGGGEKKEKIGIQTARGGWGKRYFNPPRLRSWGGEGAQEGGAGFSGKK

SEQ ID NO: 6115 - protein, 77 aa, Xenorhabdus bovienii
  Coding DNA sequence: Name=SeqID_7
  Gene classification: Gene name=BisC; Function=Anaerobic dehydrogenases, typically selenocysteine-containing; Function class =C Energy production and conversion
  Homolog annotation: Query=2..74bp; Hit=687..759bp; Blast score=95; Percent Identity=57.0; E value=9e-21; Homolog= PA5181 COG0243
MNPEDIALLGYQAGDRVDIETVWNDGIERKVYGFKLVPYAIPRGNLAGYYPETNPLVPMDSIGNGTGTPTSKSVPFK

SEQ ID NO: 6116 - protein, 64 aa, Xenorhabdus bovienii
  Coding DNA sequence: Name=SeqID_8
LGGGEEKKKKTGYKKTSDPIFYLGGGKKGGEKYKKPPPKKKTCPFPWSEPFLRGRENPKKKKGL

SEQ ID NO: 6117 - protein, 151 aa, Xenorhabdus bovienii
  Coding DNA sequence: Name=SeqID_9
LGTRGQKKRERGALGGQKEGGKKRAKGGPKKKEGGGPTPPLERKGGVPPPKKRPPPPPPAGKKKEGPQTKTPRPYVKKKKGGGVVFINEHHTPENWGGGGGRKKKKQQRPRGGGKKNDPDKKKKKRWRPGGAGTTNTRGRGGGGAVHAKDK

SEQ ID NO: 6118 - protein, 56 aa, Xenorhabdus bovienii
  Coding DNA sequence: Name=SeqID_10
MGGFFFLKNMGKRVPPKKKKDFWGFCVFWKKLPWGGLFFKGPTRLKIIPQNFGTPG

SEQ ID NO: 6119 - protein, 64 aa, Xenorhabdus bovienii
  Coding DNA sequence: Name=SeqID_11
MGHKRFQGKSVGFGAHQKGGEKKKGGFGAPPKKKRGGGKNEKGGEKRPPKGPFGRPQGRWHISY

SEQ ID NO: 6120 - protein, 103 aa, Xenorhabdus bovienii
  Coding DNA sequence: Name=SeqID_12
LGGEVGGGKGGGAKKYESGGKVGGGLGREETVGGIRGAGESGGRWGGKGVRGVGDGKQKGIAGGQGKWGGGERAGLGAGGEESCGGWEGRKTEKVELGWRSER

SEQ ID NO: 6121 - protein, 64 aa, Xenorhabdus bovienii
  Coding DNA sequence: Name=SeqID_13
TNSRRYDTEPIIFPIQHKLTDLFYQFTAPLIILMNEFQPFRVYKWGKLLKGGKGRFGINPFKNF

SEQ ID NO: 6122 - protein, 192 aa, Xenorhabdus bovienii
  Coding DNA sequence: Name=SeqID_14
LFRPPPPQKKKERIHFFFFRARGGRKKKKSGGGCFFFFSHTKKNFFFVGGGKKKKKKFFFLWGGGGGFCLYSPPRKGANYIPKRGWPFFPPPANPLCFFVKKKKKIFFFFFRGGEKKNKKTPARPPREKKKRGGGGGKKKTFFLFWRPHPPIIKKKNFGGGAPLFFSPPGGGVGSPRGEKNPPGGLGNTGFF

SEQ ID NO: 6123 - protein, 78 aa, Xenorhabdus bovienii
  Coding DNA sequence: Name=SeqID_15
LEKLENLVGFGGPPWGGGVWEKFVLWGALGGKKKRGPGGKKNPGCWVGGGFFFWGGGWFWGGGGGGGGGGGVFFFFAS

SEQ ID NO: 6124 - protein, 168 aa, Xenorhabdus bovienii
  Coding DNA sequence: Name=SeqID_16
VGPPPRPPPHTKKKIICFFCLGWRGGPPRRAPHHKKRRVRGGGGGRPAARPRAPPTVLYIFIFLLCVGGGGGGKIKRGRVRSAPPPHKKRKRVRPPPPTPKKVKRKKGRKKKGRRKKNFFFFYKKKKKRGGGGGGGGGGPRPPHKKKFLCFWGLRGGGAPPKRAPGKA

SEQ ID NO: 6125 - protein, 50 aa, Xenorhabdus bovienii
  Coding DNA sequence: Name=SeqID_17
MWGGGGGGGEEERGENRGGKAGESRSATDAAPARDASEGWWVCVFCCCLR

SEQ ID NO: 6126 - protein, 55 aa, Xenorhabdus bovienii
  Coding DNA sequence: Name=SeqID_18
LEGIKPGGELRGPGGVGGCWGGLNLREGGIGRGAGGLGRAEGSWRRIFGLYMTLR

SEQ ID NO: 6127 - protein, 167 aa, Xenorhabdus bovienii
  Coding DNA sequence: Name=SeqID_19
FYFFPPPPPSFIFFLFPQPPPPPRKKTKKKKGGFFFFFFFLGGGPPTPTFFFFFFFFGAHNKKKKAPPPPPKKKTLSPLPPTFFLKKIVKKKFFFFPPPTPFFFGVFFFFPPPKKIFFPPPFFIFFFFSPTPPPLKKIFFFFPPPPPPLFFFFFLPPPPQIYFFFFY

SEQ ID NO: 6128 - protein, 67 aa, Xenorhabdus bovienii
  Coding DNA sequence: Name=SeqID_20
LGFGGGVGGRGPPLRGFLGGFWGACGVGVEPLIPTCFASWGGFSFVLLFLACFRFGLQAFQYAQLAS

SEQ ID NO: 6129 - protein, 96 aa, Xenorhabdus bovienii
  Coding DNA sequence: Name=SeqID_21
MVSEIPGLGTPGNPSEVSIVVKRHPFPQRLENLSGTRTGHILRPFSAQKRMVKGKKLRLHLFTAQAKKLLGAFGNLTQTGRAEKNQRACGLNGPRV

SEQ ID NO: 6130 - protein, 82 aa, Xenorhabdus bovienii
  Coding DNA sequence: Name=SeqID_22
LGGGPPRGGLRGGGGGGFLRGGVSGGGGGGQKRGGGPPPGGGGETPSSPQSFFWVLGGGALSGGVFPPGGVPGGGVLGPGGG

SEQ ID NO: 6131 - protein, 113 aa, Xenorhabdus bovienii
  Coding DNA sequence: Name=SeqID_23
LESPAGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGNLQAWPQ

SEQ ID NO: 6132 - protein, 50 aa, Xenorhabdus bovienii
  Coding DNA sequence: Name=SeqID_24
NYGLHDIAGSAQTLLVIFGKTFPAAAHLFAPGAAFCLGNVNSVGKEKHAL

SEQ ID NO: 6133 - protein, 86 aa, Xenorhabdus bovienii
  Coding DNA sequence: Name=SeqID_25
MDATPNTHPKSPAPGVFSPKPRGFGLIWGFFAAPGFPLPPGPKGGAQNPQPGFLGGPPKGGRGFFFPPFGGAQKKFQKKIPTPPGV

SEQ ID NO: 6134 - protein, 64 aa, Xenorhabdus bovienii
  Coding DNA sequence: Name=SeqID_26
MELGGKKKKGITKFTPDWEKGWEGVFGGEKKRGVILAQCDRPRGGEIFWVFLDFGPGGEFILGY

SEQ ID NO: 6135 - protein, 109 aa, Xenorhabdus bovienii
  Coding DNA sequence: Name=SeqID_27
VGGGVLVWGGGGVWWAAVGWWGVGGGGGGGGCVVCVVWGWCGCVLWGGVGFGGGGGGFFWGGWGVGCGWVGVVVGLWVGVGGVVWGWGGSRKKKKGGGVGAGRPVGVGE

SEQ ID NO: 6136 - protein, 39 aa, Xenorhabdus bovienii
  Coding DNA sequence: Name=SeqID_28
MCVGWGLGVLVCVFVICMWVSGGFMWVVWGACGVCGVYC

SEQ ID NO: 6137 - protein, 46 aa, Xenorhabdus bovienii
  Coding DNA sequence: Name=SeqID_29
MVSEFRASVPRGIPSEVWEEVLAGIIVPKWATRTWLKTKKGGFAGR

SEQ ID NO: 6138 - protein, 70 aa, Xenorhabdus bovienii
  Coding DNA sequence: Name=SeqID_30
LRGGGAAPQKKREKKKTPPPSFFVGGWVENKGGAPPPFFFPPGVLKFPGKKALYPGLGPNKAPFGEKIGF

SEQ ID NO: 6139 - protein, 154 aa, Xenorhabdus bovienii
  Coding DNA sequence: Name=SeqID_31
VFLYSLPTKKKRRGGGVGVFFVFFFFFLGKGGKKKQKKKTPHPPPPPPPGLFFFFFFFLSPPPPPPARGGGRGGRLGVVDIEGGRAAPPPPPLSFFFFTPHHPLLFFFCCGGGGGGVPSPRGAGGGGGGVPSPPPPPPPLPLLYIKKRGGGGGL

SEQ ID NO: 6140 - protein, 125 aa, Xenorhabdus bovienii
  Coding DNA sequence: Name=SeqID_32
MRGGGGGGGSLLLSAPPSPTGREGAARGAGRRGGRKRKEKAEQDGGCCCWVLSCGGEGRGARAGAAAASSGARKLQHKNFLSRAGGEKHTHTHHSTLSLGGWSWRTIWIGMLHVRDLVDCGRLSS

SEQ ID NO: 6141 - protein, 72 aa, Xenorhabdus bovienii
  Coding DNA sequence: Name=SeqID_33
VWVAPKNSPKHKIYHTGFPRGGLPQNQGGTGSGLYFLPRSRNTLIQRAQRLVQAKGAIKVIKRVELDWTLRG

SEQ ID NO: 6142 - protein, 44 aa, Xenorhabdus bovienii
  Coding DNA sequence: Name=SeqID_34
MREKGAPPFFYIVVGRGEGGRGGGRAPQQKKKYIPKKKGGGGGV

SEQ ID NO: 6143 - protein, 62 aa, Xenorhabdus bovienii
  Coding DNA sequence: Name=SeqID_35
RICVGGVGCVWVFVVRVSICGVEHKTQRVLLVRLWPRLVMRAGVGGGLFRFVMGEVVGRKVI

SEQ ID NO: 6144 - protein, 109 aa, Xenorhabdus bovienii
  Coding DNA sequence: Name=SeqID_36
MGGGGEQIIFSPPPPGWVGKSGFIKKKQYIFVLWGEKKKKKYLWGGGEKKKKKKKGGGGGGSPGGEAKKKKQQPRGGGGVGGPPLKKKKKKVLLGGGRERQKKNIFFFF

SEQ ID NO: 6145 - protein, 83 aa, Xenorhabdus bovienii
  Coding DNA sequence: Name=SeqID_37
ILLLQSRAPIEPSGYALRRHVTPINTQRSAVGHKRLWVPISPTMVTGGFRVRGEKFTLLGAKIAPPQKNQNWGGVSQGGGGGY

SEQ ID NO: 6146 - protein, 61 aa, Xenorhabdus bovienii
  Coding DNA sequence: Name=SeqID_38
VRPYLQTMGVRGGVKRGARGWDHGREGASWGGGEGVGLIYFSAAGGRKKEDRPLYGAPAGF

SEQ ID NO: 6147 - protein, 77 aa, Xenorhabdus bovienii
  Coding DNA sequence: Name=SeqID_39
LGPGAGVFFCLFFWGGAPKTPRGKKKFLGGGVYGGVFWGGEGPFFLVFLGFLGEKKLGFWGRFSLRKNFSGGAGWVF

SEQ ID NO: 6148 - protein, 44 aa, Xenorhabdus bovienii
  Coding DNA sequence: Name=SeqID_40
MAKAPCPGSPKVPFFGSKNQTPRTGFAPWPNAILDGFSWKQARG

SEQ ID NO: 6149 - protein, 72 aa, Xenorhabdus bovienii
  Coding DNA sequence: Name=SeqID_41
LEKKKGAFLNPLVKKEGNIHNYVAPKTPVRENLCFSFLGMARNIQGMGVSLVIGGGVIGRRGPRVTSPVWLS

SEQ ID NO: 6150 - protein, 64 aa, Xenorhabdus bovienii
  Coding DNA sequence: Name=SeqID_42
VVGEGKNHPPLPPAGGGGGGGEEKKKKKKEGGGRGGRGGKKKKKKAPPARGGGGGGEKKKKKKK

SEQ ID NO: 6151 - protein, 112 aa, Xenorhabdus bovienii
  Coding DNA sequence: Name=SeqID_43
  Homolog annotation: Query=12..110bp; Hit=4..102bp; Blast score=156; Percent Identity=73.0; E value=7e-38; Homolog= ref|NP_037756.1|
MVYSQGGDAMSQPRIYGSKWNKARLAFLQQHPLCVMCHQQGRVTGATVVDHIIPHKLKGALDSGNKPEIAKAQKLFWDTKNWQPLCDSHHNSTKQRMEKRGKVVGCDINACH

SEQ ID NO: 6152 - protein, 55 aa, Xenorhabdus bovienii
  Coding DNA sequence: Name=SeqID_44
LVPGGGPHQGNKILRGGGGGGKNSAYTLNRNQEHLRVQKERQNNTGQRRTHRNPT

SEQ ID NO: 6153 - protein, 177 aa, Xenorhabdus bovienii
  Coding DNA sequence: Name=SeqID_45
MSTVRSPGGGGPRPWGLVFFFWVWGGGGGPPGSPGKTKQKKKKKKKTQGVWFFPPRRRCGGGAAGAPPPLPPSRGGGGGFSSSPPTQKKKKGKGRGPAPPPPKKKKKKEKRAVFFFFFFLCKREEKKKKEKRGGGFNKFPPPPPKKKRGGGGGGINLEKKKPPPQKKKAGGEKNFFL

SEQ ID NO: 6154 - protein, 65 aa, Xenorhabdus bovienii
  Coding DNA sequence: Name=SeqID_46
LGPFFFLGGFPKTRGGAPPPFVRKFFAPPLGGPEGEINWGGGGAARLAAKINNSVGIIRYEILVF

SEQ ID NO: 6155 - protein, 45 aa, Xenorhabdus bovienii
  Coding DNA sequence: Name=SeqID_47
MHILQVFILAQFQATFALTFCKLVQSRTSILALVCVGINHQKGGD

SEQ ID NO: 6156 - protein, 63 aa, Xenorhabdus bovienii
  Coding DNA sequence: Name=SeqID_48
LVCRGLPGLQGEGQRFGTPWQGHGEGVRFSALSGVFVVDGSFLGPGGFALLLVAAGGWCFQAS

SEQ ID NO: 6157 - protein, 58 aa, Xenorhabdus bovienii
  Coding DNA sequence: Name=SeqID_49
LRFPGFPGGLGGREIPAPMGVGAPGETPREGFGAFGLQGFTRFAGGGPEIWDPLAGAW

SEQ ID NO: 6158 - protein, 177 aa, Xenorhabdus bovienii
  Coding DNA sequence: Name=SeqID_50
LGKKGEKKKKGPRKSPRPKKRKYFQHKKERALFWAPPPPPGKNFKKNKKKKKEGAPRRPKRPKRREKKKKIFCGKKTKREPPPSFFFSPHQKKKKGAGGKKNQKGGGGKKKKKKKKRGGAGAPQKKKNIFLYTPAPRPPKNKKKTLPKKKKKEGGGGGPKQKGEKKKKKKKNHPPPA

SEQ ID NO: 6159 - protein, 72 aa, Xenorhabdus bovienii
  Coding DNA sequence: Name=SeqID_51
LVWGGPQELSIKSGPLVGFGEKGVPVGPGGGGGFLPPGGGGGPPPQGGGGFLKKKNKKGGGGGGGPPPQLAS

SEQ ID NO: 6160 - protein, 177 aa, Xenorhabdus bovienii
  Coding DNA sequence: Name=SeqID_52
GGCGAPPPLFGGGGGKYLLFFLATEAARFFFFFLWWGGCFIFFSGGGDPPPGGVFFFFPGGGGGFFFSPPPIFLEEPRAPPPGGVGGFFWGEINFWPPGGGPSFFVEGGKLFSPPGGGLPFSPQKFWGEGGKIFLGGGPPGFFAPKPRNPLLAPLGWPGGGVFWEGGFEKRRKEGEF

SEQ ID NO: 6161 - protein, 107 aa, Xenorhabdus bovienii
  Coding DNA sequence: Name=SeqID_53
LGLGGWGGGGGGARGGGGGGGGKGGREKKEKRGRKKKRGGKGGRGTTDPPTPHHPPRGGGGGGGGGGGVFFFFFFFFFGGGGVVGGGGGGGGEKRKKKRKRPGGGEK

SEQ ID NO: 6162 - protein, 52 aa, Xenorhabdus bovienii
  Coding DNA sequence: Name=SeqID_54
LGGGRWGVFFGSGGGGGQAGGGGVAVCGGEGLRGVPEGGGPHLMSAGERKAS

SEQ ID NO: 6163 - protein, 159 aa, Xenorhabdus bovienii
  Coding DNA sequence: Name=SeqID_55
LWGGGGGVCCIIIKKKSGGEGGGGVLFFFFFWVFFFFVWGASFFFFFFFKRGVGGGGEKRFLGGVGGVLLFFWGGGRGGVWLFFFLRGGGGGFFFFFGGGGFFFPPPWGGGGVNRGGGFFFPLFIIPLFFEGVFFIGGGPKKEGNFGGGGGGGPRGDQF

SEQ ID NO: 6164 - protein, 45 aa, Xenorhabdus bovienii
  Coding DNA sequence: Name=SeqID_56
MIVEGGGRPLFLFVFVGGGEKKKERGPPPKPEEGGGGGGGNRKYI

SEQ ID NO: 6165 - protein, 60 aa, Xenorhabdus bovienii
  Coding DNA sequence: Name=SeqID_57
  Homolog annotation: Query=1..60bp; Hit=242..313bp; Blast score=90; Percent Identity=66.0; E value=9e-18; Homolog= ref|NP_061811.1|
MSEKAFAQYVADTHTPEIQAARGRKSKRGAIPSSERTLKPWESLGISRRWYYHKKKNGLL

SEQ ID NO: 6166 - protein, 57 aa, Xenorhabdus bovienii
  Coding DNA sequence: Name=SeqID_58
MYFFLKEGGGGGGGLRSPREEKKEQTPPGLRPASASAPADEMLLLLLSLCSLMGGGV

SEQ ID NO: 6167 - protein, 48 aa, Xenorhabdus bovienii
  Coding DNA sequence: Name=SeqID_59
VGRGGGGGGGNRREGRGGGGKYGVGGGGRGKAGGGGGGTVRVRWIQKW

SEQ ID NO: 6168 - protein, 74 aa, Xenorhabdus bovienii
  Coding DNA sequence: Name=SeqID_60
LWGGGVKTKKKKRGGGGGGKKKKKPARGGGKNPPKPPKKGRGGHKKKNAPGEKKGPPFLGEKRGKIPQTPGGKK

SEQ ID NO: 6169 - protein, 90 aa, Xenorhabdus bovienii
  Coding DNA sequence: Name=SeqID_61
MGGKKKKNLRGGVFFKKKKKKKFFFWGGGGENLKKKKKRGRGQKKKKKKGRGGGGGGVKGEKKKKKKKYIPFFKKKKKNPKTGGGGGGGG

SEQ ID NO: 6170 - protein, 174 aa, Xenorhabdus bovienii
  Coding DNA sequence: Name=SeqID_62
VVFFFFFLLKRGGGGGGGGGGGRPGPAPPPPQKERIKNCKGGGGGGGCLVIFSLSPPPGGGGGKKKRGGGGGGPPRGGGMGGGVFFKKRGPPPPGGGGGSPPPRGGGGPRGNPPPFFSGIKPPGGGWRPRGAAGSGRPRLGPPRGAWGGPRAAVRAVVEAPAGRGGRWVGKVAS

SEQ ID NO: 6171 - protein, 63 aa, Xenorhabdus bovienii
  Coding DNA sequence: Name=SeqID_63
VCGCWLGWFFLFGFVFLGGGKKKGKKKKEGGVWGFLVGGGGRLGVGWGGVWVGGGGGGGGGGS

SEQ ID NO: 6172 - protein, 97 aa, Xenorhabdus bovienii
  Coding DNA sequence: Name=SeqID_64
MLRHHSEQLSIPWGEMSIKEKDFILGGESKSSKAKGPDFVFGIILTHLLLTKGEEITKEGSNDSVFGDSCQKGGEMSPKQKDRTTTTKFKNLVLSKS

SEQ ID NO: 6173 - protein, 92 aa, Xenorhabdus bovienii
  Coding DNA sequence: Name=SeqID_65
VGGGGGREKKKKKKKKKKTLFFGGGGGVYYNNTLSGGGGGETPPPFFIFSAQVCFFHKGEGVFSLPSRGGNFFGEGGEVGKKIWAKIGRGWV

SEQ ID NO: 6174 - protein, 48 aa, Xenorhabdus bovienii
  Coding DNA sequence: Name=SeqID_66
MGQNRAGVGVRGFFFKKGFGRDGPPLDFQGDKGVNIQGRAFFSEATLF

SEQ ID NO: 6175 - protein, 48 aa, Xenorhabdus bovienii
  Coding DNA sequence: Name=SeqID_67
MFTVMRAYHYQSIQKTHDFRERQLKNTSLQANMGLWTVVNWDIYWHSS

SEQ ID NO: 6176 - protein, 56 aa, Xenorhabdus bovienii
  Coding DNA sequence: Name=SeqID_68
SLLPAGPLYSILCDASFFDAKGAFDSAQIACANAWAGLTLASILADQELANFGMPK

SEQ ID NO: 6177 - protein, 76 aa, Xenorhabdus bovienii
  Coding DNA sequence: Name=SeqID_69
  Homolog annotation: Query=5..73bp; Hit=1..69bp; Blast score=68; Percent Identity=47.0; E value=2e-11; Homolog= ref|NP_760913.1|
MASTLLTDSKIRGLKPKNSAYYTWQAAATRGTGRLGVKTYPSGRKVFVYRYFKNGKEKFINLGDFPALSLAEALSK

SEQ ID NO: 6178 - protein, 59 aa, Xenorhabdus bovienii
  Coding DNA sequence: Name=SeqID_70
  Homolog annotation: Query=1..59bp; Hit=1..59bp; Blast score=70; Percent Identity=66.0; E value=7e-12; Homolog= ref|NP_406333.1|
MAIRYIKREEMQRLTGKSKTTLWRMYAKRNEFPKPDKTAGGTFLGWPEEVYEAWVREKK

SEQ ID NO: 6179 - protein, 63 aa, Xenorhabdus bovienii
  Coding DNA sequence: Name=SeqID_71
VTSPPLRGNAFCAWFLVSAKPTYFGNLLRRRWLHDRDSCQYFAVFRLSVADMAVFDKELLQAA

SEQ ID NO: 6180 - protein, 86 aa, Xenorhabdus bovienii
  Coding DNA sequence: Name=SeqID_72
  Homolog annotation: Query=1..86bp; Hit=1..86bp; Blast score=127; Percent Identity=75.0; E value=3e-29; Homolog= ref|NP_927393.1|
LAETKNQAQNALPRSGGEVTGDITISTDSEIAWRKNTDMAAIGFKNTGDGDTDSYMWFKTADNGNEYFKWQHSLSGGGTNEWMSLK

SEQ ID NO: 6181 - protein, 66 aa, Xenorhabdus bovienii
  Coding DNA sequence: Name=SeqID_73
MVHIKNKDRGFILLKPSAPITSRELWGRILGIGGAFFPLRGAHPKLKLRVFYTQKKKKPWGERGLP

SEQ ID NO: 6182 - protein, 139 aa, Xenorhabdus bovienii
  Coding DNA sequence: Name=SeqID_74
  Gene classification: Gene name=WecD; Function=Histone acetyltransferase HPA2 and related acetyltransferases; Function class=K Transcription
  Homolog annotation: Query=13..131bp; Hit=15..134bp; Blast score=65; Percent Identity=35.0; E value=2e-11; Homolog= sll0786 COG0454
MELSRYACLFGLNEELKQFISDDIAIKMVSEDWERRQYYRLREVTFRDEQKILKEDRDEYHVKALGIVAIEKMAGEHDRVIGAVLIFPDGEHTWYGGRLCVEPLYRRHHTIGKALINATVSTAKNLGCCTFLTHRAKSK

SEQ ID NO: 6183 - protein, 51 aa, Xenorhabdus bovienii
  Coding DNA sequence: Name=SeqID_75
LGGGEEKQQPTPGGGGGGGGGFFFFLGAGGGGGLFLLYKKNTPLFFLFIIK

SEQ ID NO: 6184 - protein, 70 aa, Xenorhabdus bovienii
  Coding DNA sequence: Name=SeqID_76
  Homolog annotation: Query=12..70bp; Hit=1..59bp; Blast score=68; Percent Identity=57.0; E value=3e-11; Homolog= pdb|1B6Q|
VCVVWGLKEKTMNKQEKSCLNIAKFIRGQTLLLLEKINELDLDDEAEACEKLHDDAEALYHQLVSRYGEE

SEQ ID NO: 6185 - protein, 175 aa, Xenorhabdus bovienii
  Coding DNA sequence: Name=SeqID_77
  Homolog annotation: Query=2..123bp; Hit=2453..2575bp; Blast score =124; Percent Identity=54.0; E value=5e-28; Homolog= ref|ZP _00126388.1|
VVQAFYRDLMTLLEHEQAPLALAQRCSGVPQSMPLFSALLNYRHSQTSEADAVNTIWTGIRVVAVEEQSNYPLTLSVDDLGAGFHLTAQAVVGIDPARVTAYLVTAISGLVDALARDPMAYSRKASASLFSSESVNLCLFMLIPHRISTLIDDREPRHHHATSHTPPLHHPNPVH

SEQ ID NO: 6186 - protein, 83 aa, Xenorhabdus bovienii
  Coding DNA sequence: Name=SeqID_78
VEAATGAALEPTPETAAIATAAPTSAAAGEDLPPKVAEGAPDAPAAAAPSIEDPAAEAMETMAEVAAEPTAEAPAASGPSQVA

SEQ ID NO: 6187 - protein, 149 aa, Xenorhabdus bovienii
  Coding DNA sequence: Name=SeqID_79
MRAEAERTRAQLKDTYRELGARTGDFEVPDREPGLCCLQWVQEELQELPVVVGGFMSYASLVTCEGAMNALSREGCRHFEVFDQADEDFKRDVYTVEDPVVKESVGALYDRMWGPHGREVVRERAEIARAQVMLLLVWRLLHVGCACVC

SEQ ID NO: 6188 - protein, 206 aa, Xenorhabdus bovienii
  Coding DNA sequence: Name=SeqID_80
  Homolog annotation: Query=1..171bp; Hit=96..266bp; Blast score=338; Percent Identity=98.0; E value=3e-92; Homolog= gb|AAG17045.1|
LAATTNSGVLASSYVDDDKVVDYYGVLQNIVELIFDGPKELKVVFFECDWFDAHSGTRVDKYGNVEVKHSSRIPSSMSDVVLANQAKQVYYLPYPHPSLRAWWVAIKVNPQVVAPESADYVSTSRDNDDAVFQPEAASNQDIAHRFHVTNGEGLENLCCNSSDLIEEPRSKRKRPVVVRRSVRIQRNQERMNKQRAEEASSDADDF

SEQ ID NO: 6189 - protein, 61 aa, Xenorhabdus bovienii
  Coding DNA sequence: Name=SeqID_81
  Homolog annotation: Query=1..61bp; Hit=794..854bp; Blast score=123; Percent Identity=93.0; E value=6e-28; Homolog= gb|AAG17043.1|AF187822_1
VFAPSVRLHVENESPQSTLQIFANPGKAVGKGSVRHMKGSDLNTLMLYMYSNIDSTQEAFE

SEQ ID NO: 6190 - protein, 115 aa, Xenorhabdus bovienii
  Coding DNA sequence: Name=SeqID_82
  Homolog annotation: Query=1..115bp; Hit=778..892bp; Blast score=202; Percent Identity=86.0; E value=8e-52; Homolog= gb|AAD20306.1|
LYPTGYPESKIRRIHSRKSHSGPNHAFMYKGETSSSRQPIRAKLPKKRTPNASNDHDISFKTFDASYVLTNKSGKVVAKFVGGKHKGSKTYVWVPKVLVSNAKGPKTVWVPKVKN

SEQ ID NO: 6191 - protein, 61 aa, Xenorhabdus bovienii
  Coding DNA sequence: Name=SeqID_83
  Gene classification: Gene name=RplI; Function=Ribosomal protein L9; Function class=J Translation, ribosomal structure and biogenesis
  Homolog annotation: Query=1..55bp; Hit=1..55bp; Blast score=103; Percent Identity=96.0; E value=3e-23; Homolog= rplI COG0359
MQVILLDKVANLGSLGDQVNVKAGYARNFLVPQGKAVPATKKNIEFFEARRVELKPNWLTF

SEQ ID NO: 6192 - protein, 75 aa, Xenorhabdus bovienii
  Coding DNA sequence: Name=SeqID_84
  Gene classification: Gene name=RpsR; Function=Ribosomal protein S18; Function class=J Translation, ribosomal structure and biogenesis
  Homolog annotation: Query=1..75bp; Hit=1..75bp; Blast score=115; Percent Identity=97.0; E value=8e-27; Homolog= rpsR COG0238
MARYFRRRKFCRFTAEGVQEIDYKDIVTLKNYVTESGKIVPSRITGTRAKYQRQLARAIKRARYLSLLPYTDRHQ

SEQ ID NO: 6193 - protein, 45 aa, Xenorhabdus bovienii
  Coding DNA sequence: Name=SeqID_85
MVMRVKHAVTEPSPMVKAKDERRSRDLVLEEDMADDADEAGDSEE

SEQ ID NO: 6194 - protein, 341 aa, Xenorhabdus bovienii
  Coding DNA sequence: Name=SeqID_86
  Homolog annotation: Query=2..341bp; Hit=46..383bp; Blast score=500; Percent Identity=76.0; E value=1e-140; Homolog= gb|AAN40035.1|
TKGEREGEKKEKEAFLSQTASECGGIKEMREVVLLRDGPLDHLLPAGSDAPSITSKRHERKSFSKIPFHYPRTCRHTPLLSVPLGNPPTFDGEDYARWSDLMKFHLTSLHKSIWNIVEFGVQVPSVGDEDYDSDEVAQIHHFNSQATIILLASLSREEYNKVQGLKSAKEIWDVLKTAHEGDEVTKITKRETIEGELGRFMLHQGEDPQAMYNRLKTLVNQVRNLGSEKWDDHEMVKVILRSLVFLNPTQVQLIRGDPRYKLMSPEEVIGKFVSFELMIKGSKKIIEQGTSSTPEAQPVTFKATEEKKEESTSSRQPIDASKLDNEEMALVIKSFRQSLKQ

SEQ ID NO: 6195 - protein, 131 aa, Xenorhabdus bovienii
  Coding DNA sequence: Name=SeqID_87
MSNYEEWQSQEFSHLMTDKGDKLCHIKGNELCHITESDVCCVVHYYIVDEKGYLINNGVRQTRLGKISPKLVQATEALRIEWLKKNDEVNDYEQRQEERRERYLERAEKARKEREAVHSQAKDMSSIIPLS

SEQ ID NO: 6196 - protein, 158 aa, Xenorhabdus bovienii
  Coding DNA sequence: Name=SeqID_88
LSIHEHKFTFKHLCWHSITKILRNGPRAHFPFISPVISLQNVLYLVTVTGATTRRGEERRRRNTTRRGAAMPMFVGSGTPTKALATPPTPRTPPTSPSPRDFSSPTSATSASWQRTAKGRRLNQNPPLNMNLLVMIIVMRKIICVPFLPTLTWNKRKN

SEQ ID NO: 6197 - protein, 41 aa, Xenorhabdus bovienii
  Coding DNA sequence: Name=SeqID_89
MKKDDLLDSQEDFLITENKKHVKVKNAYALEVENVRKYLVS

SEQ ID NO: 6198 - protein, 179 aa, Xenorhabdus bovienii
  Coding DNA sequence: Name=SeqID_90
  Homolog annotation: Query=14..164bp; Hit=346..493bp; Blast score=101; Percent Identity=37.0; E value=7e-21; Homolog= emb|CAD58034.1|
SLLPAVRNMETPLELQRLIANQELMKVCNKVIKKYHHTDERKKALMEVGLKEDLADKLLKDDRFGGIGYAHFTLSNNSATIRRISGRIEEIKKLKELSVEIKEEFECFTFQIDKEDNRVKFIFPNDKRPDEKIKQLLNNKAFKWSPTRKSFVRQATANGILAGKYLKLDIIKYLDSIKS

SEQ ID NO: 6199 - protein, 79 aa, Xenorhabdus bovienii
  Coding DNA sequence: Name=SeqID_91
MNTFTPAQFDDISTYIKDNSIYTPVRIFPVWTMINGCEAVRGDNQDEVIIFQNKVPVAMYILDDDEATVGIYQLKEKNR

SEQ ID NO: 6200 - protein, 72 aa, Xenorhabdus bovienii
  Coding DNA sequence: Name=SeqID_92
RTQRGGDLPFIEDTPRKKNNGDFTEPNKEKGFLAAKKPSVGFLKAHKKRAHFLAGGTKEKRLVKPPLGLKKP

SEQ ID NO: 6201 - protein, 205 aa, Xenorhabdus bovienii
  Coding DNA sequence: Name=SeqID_93
  Homolog annotation: Query=1..205bp; Hit=872..1082bp; Blast score=357; Percent Identity=84.0; E value=1e-97; Homolog= gb|AAL75973.1|AF466203_ 2
VPSLETYPLVVDPIIGNVRLTKVLMDGGSNLNIIYVETLGLLRIDLSSVRMGATPFHGIIPGKRVRPLGQLDLPVCFGTPSNFRRETLTFEVVGFRGTYHAVLGRPCYAKFMAVPNYTYLKLKMPGPNGVITVGPTYRHAYECDVECVEYAEALIADLESLSREAPDVKRHAGNFEPAETVKSVPLDPCNDASKQIRIGSELDPK

SEQ ID NO: 6202 - protein, 184 aa, Xenorhabdus bovienii
  Coding DNA sequence: Name=SeqID_94
  Homolog annotation: Query=1..184bp; Hit=681..864bp; Blast score=315; Percent Identity=83.0; E value=2e-85; Homolog= gb|AAL75984.1|AF466203_13
MDIATKFASGQEAVEAIFWKDKQPQGRPLEDVPKASTQRGTKKKGKKKSQAKRDAADADLVAAAEYRNPRKPPGGANLFDKMLKEPCPYHQGPVKHTLEDCAMLRRHFYKAGPPTEGGKALNDAKKEDHKAGELPEVRDCFMIYGGQVANASARHHKQERREVYSVKVAVPVYLDWSDKPITFD

SEQ ID NO: 6203 - protein, 147 aa, Xenorhabdus bovienii
  Coding DNA sequence: Name=SeqID_95
VAEEDCFTSRMVCQWRVFPYGRNIGVVVWAVMDKDRQGAAQKRQATVRLHEARPKRQRGAAKAAAPGGGRSPLAAKAGASAPSKAPEATAGAGGSKPTKVVPPASGVAEASKAARALPLSGKRVADFGTDITVDDYLGGKSLAYYCY

SEQ ID NO: 6204 - protein, 165 aa, Xenorhabdus bovienii
  Coding DNA sequence: Name=SeqID_96
VLSAASWRRRSAFSFSRAATLSDSLRHLLSEADFSRTASACCVRSLSTSADTTAVRAPDAVRLAKSATCRAHVRPLLQKKRWGREYNSADLTQRLRRLTQRLRHSLQPAGRCARLVPDQREGRHLASGAKRLAPRLRHYGGRRDRRARRNYSELALVRPCNASTN

SEQ ID NO: 6205 - protein, 513 aa, Xenorhabdus bovienii
  Coding DNA sequence: Name=SeqID_97
  Homolog annotation: Query=58..504bp; Hit=186..591bp; Blast score=223; Percent Identity=35.0; E value=5e-57; Homolog= gb|AAM01072.1|AC092748_ 10
MSGGLRNESASKLEKFEVASTSSFVADVDPRAIDLAMRIAERMFLKMKEDKAKNKIEEENDRWRPNDESTSSQGSSFKSTSHMCFIANGSDSESESEDEEEQESDSEDEDDLQQFFAQLSKKHRMSLLKLMKRAEEQKEMLHKQEDFLIRKIEDLEKLTKEHEKLKCSHDDLVQRYEDISIEQIKVVNHSSYIAQLENKNAMFKNTIERLNIENLALQEKHDMLVCSHNKFMDSHIMLEMAHEVVLTNFKSYQPHICTCTQVETILSCANKCCSQESQSSIELEISGISDISITQENKEFKEEVGRLRRSLTILKGKCHAQPSQDNRDNMMKKLEKGTTVACTKPLQKNIKLSKKDMSKTQGEKINAHIICSNNVPMCFNKERSKRSDRRCYGCKEKGHEIGSCPHMKNQNLARSRKMTIKKDESKGQMHCKDKHHICYNCREKGHLFKVCPKGKNPKLNLTIHSDMLRRPKFDSCARKVMTSPHSRTKAIWVPKSLLANLGGPIQKWVPKCN

SEQ ID NO: 6206 - protein, 128 aa, Xenorhabdus bovienii
  Coding DNA sequence: Name=SeqID_98
  Homolog annotation: Query=1..128bp; Hit=941..1068bp; Blast score=267; Percent Identity=97.0; E value=3e-71; Homolog= pir||T04112
VSWNSKKQTSIALSTAEAEYVVAGQCCAQLLWMRQTLRDFGYNLSKVPLLCDNESAIRMAENPVEHSRTKHIDIRHHFLRDHQQKGDIEVFHVSTENQLADIFTKPLDEKTFCRLHSELNVLDSRNLD

SEQ ID NO: 6207 - protein, 69 aa, Xenorhabdus bovienii
  Coding DNA sequence: Name=SeqID_99
MVRERRTPTNTMSKNTRDTRFIPRFGHTTKVPYFLVEAPTKSRVSFNPNPPFADHKGQAHTLIFAQTSG

SEQ ID NO: 6208 - protein, 279 aa, Xenorhabdus bovienii
  Coding DNA sequence: Name=SeqID_100
  Homolog annotation: Query=10..275bp; Hit=384..662bp; Blast score=162; Percent Identity=38.0; E value=6e-39; Homolog= gb|AAK50132.1|AC087797_ 17
LPIHPPSRQLSDIDDVDDDGYSYDDLVRMLGEADDYMHKEKENFKTLKELYKNLQVSFEELKTSHNDLKENCEKLADAQKSSIVHEVEVVTKDVGVTCDLLDSLTSEPLPTNSICDKCKISLNDNIALDESKIIVENGVLVDRINTLTHDLEKAYGGKTKLDFILGSQRCSLNREGLGYVPKKGKNAFVKQKTLFVKECDKVCHKCHKKGHVKKNCPKFKNVSSTCFEHCYVLSHNAKGVHTKFVGTSIVGNKKKAIWVPKTLVTNIQGPKQVWVPKRD

SEQ ID NO: 6209 - protein, 113 aa, Xenorhabdus bovienii
  Coding DNA sequence: Name=SeqID_101
  Homolog annotation: Query=1..110bp; Hit=559..667bp; Blast score=134; Percent Identity=64.0; E value=3e-31; Homolog= gb|AAN60991.1|
VLDSGCTQHMTGDMKMFTQMSEEDCSNYDSITFGDNRKGKVKGLGKIAISNDHSISNVLLVESLNFNLLSVAQLCDLGFCCNFTVEDVIISSVDGSNLKFKGFRHENLYLLAS

SEQ ID NO: 6210 - protein, 72 aa, Xenorhabdus bovienii
  Coding DNA sequence: Name=SeqID_102
MVVCMWLVRGNDGRGDGKWGTGSRWMGKGDVDVVWEYGVEVGIMVAAAMVEDVAAPGMPVGSVGTPPYPGMP

SEQ ID NO: 6211 - protein, 60 aa, Xenorhabdus bovienii
  Coding DNA sequence: Name=SeqID_103
MAKGDAKVKIITDVNDIKDDDDIESAFIPFVSFGDLDNNTFKGLTSLLSVEQEIQYDEHT

SEQ ID NO: 6212 - protein, 65 aa, Xenorhabdus bovienii
  Coding DNA sequence: Name=SeqID_104
LQSDLQSASLTGRLSVSLPQAVEPVLGAVQPVLVNFDQSVVSLRVSLPVRLADRLPGLPGAVQPP

SEQ ID NO: 6213 - protein, 89 aa, Xenorhabdus bovienii
  Coding DNA sequence: Name=SeqID_105
MYVIPRYLQGSGYQFHERNPRPRATQAKQQAFQIALSVRSRVGQLHETVHDFQLAAKLHLLLPRVTAGAGPVQAGLPEPQVVVARQSLS

SEQ ID NO: 6214 - protein, 106 aa, Xenorhabdus bovienii
  Coding DNA sequence: Name=SeqID_106
MGTSNDHLKFFRLRIDEDIIEKINREAQIKDGMKQDLISDVADWFATQRSKGEIPPRYFASRTCAEYEGIWVRKETAKRIEELAKTDGTNASRVLYTALARYVEKK

SEQ ID NO: 6215 - protein, 89 aa, Xenorhabdus bovienii
  Coding DNA sequence: Name=SeqID_107
  Homolog annotation: Query=1..76bp; Hit=1682..1757bp; Blast score=163; Percent Identity=94.0; E value=5e-40; Homolog= gb|AAL75982.1|AF466203_ 11
VAFFTNIIHRFGVPNSIITDNGTQFTGRKFLDFCEDHHIRVDWAAVAHPMTNGQVERANSMILQGLKPRVYNDLNKVRQAMDEGTPLGV

SEQ ID NO: 6216 - protein, 203 aa, Xenorhabdus bovienii
  Coding DNA sequence: Name=SeqID_108
  Homolog annotation: Query=1..203bp; Hit=419..621bp; Blast score=390; Percent Identity=92.0; E value=1e-108; Homolog= gb|AAL75983.1|AF466203_12
MGEPISFAPRKPIKSQVLADFVAEWIDTQLPTVPIQPELWTMFFDGSLMKTGAGAGLLFISPLGKHLRYVIRLHFPASNNVAEYEALVNGLRIAIELGVQRLDARGDSQLVIDQVMKNSHCHDPKMEAYCDEVRRLEDKFYGLELNHIARRYNETADELAKIASGRTTVPPDVFSRDLHQPSIKIDDTPEPEAPSAQSEAPSA

SEQ ID NO: 6217 - protein, 41 aa, Xenorhabdus bovienii
  Coding DNA sequence: Name=SeqID_109
TVITAPRKSTFLKSEKKKSGTVIEHKDTDSIFIRLERENAN

SEQ ID NO: 6218 - protein, 291 aa, Xenorhabdus bovienii
  Coding DNA sequence: Name=SeqID_110
  Gene classification: Gene name=DsbG; Function=Protein-disulfide isomerase; Function class=O Posttranslational modification, protein turnover, chaperones
  Homolog annotation: Query=62..281bp; Hit=26..236bp; Blast score=70; Percent Identity=28.0; E value=1e-12; Homolog= dsbC COG1651
MQINKMFKPALLSLFILSGFVHAQPAPGIAVLKATGTPELKKVQETQAGSIAEVKAAQDEFKQTFSQMNFTNFAESPVKGIYELHTGGNVIYFTPKSEDREGVIIFGEMWDSNGVSLTNESKLKAIKGEWKKLPVKSAISIGNKNAPSYYEITDPDCPYCHSYHGWIKDYSKTNPVQRNLIFMLNPGHPEAPAKIEHIICSKDKEQAINDMFEQKPVTLEKCPEAKGIIQQHQDIVKSLGVNGTPSFVFDVNEEPELIVGFNKNKVMEAIIQATEKVKASELTKPDATKKQ

SEQ ID NO: 6219 - protein, 81 aa, Xenorhabdus bovienii
  Coding DNA sequence: Name=SeqID_111
MILTLSTHVHENTQSIFMKMKTWYLSLSTIQRLCMGLLLTLIPVAAMAWTEPAAGDFGYQIYDVGINKIAKGPIGFAGGAS

SEQ ID NO: 6220 - protein, 394 aa, Xenorhabdus bovienii
  Coding DNA sequence: Name=SeqID_112
  Gene classification: Gene name=TufB; Function=GTPases - translation elongation factors; Function class=J Translation, ribosomal structure and biogenesis
  Homolog annotation: Query=1..394bp; Hit=1..394bp; Blast score=697; Percent Identity=92.0; E value=0; Homolog= tufB COG0050
MSKEKFERKKPHVNVGTIGHVDHGKTTLTAAITTVLAKTYGGSARAFDQIDNAPEEKARGITISTSHVEYDTPTRHYAHVDCPGHADYVKNMITGAAQMDGAVLVVAATDGPMPQTREHILLGRQVGVPYIIVFLNKCDMVDDEELLELVEMEVRELLSQYDFPGDDTPIIRGSALKALEGEAEWEAKIIELAEALDSYIPEPERDIDKPFLLPIEDVFSISGRGTVVTGRVERGIVKVGDEVAIVGITDTVKTTCTGVEMFRKLLDEGRAGENVGVLLRGTKRDEIQRGQVLAKPGSIQPHTQFESEVYILSKDEGGRHTPFFKGYRPQFYFRTTDVTGTIELPEGVEMVMPGDNINMIVTLIAPIAMDEGLRFAIREGGRTVGAGVVAKVIA

SEQ ID NO: 6221 - protein, 165 aa, Xenorhabdus bovienii
  Coding DNA sequence: Name=SeqID_113
  Homolog annotation: Query=3..155bp; Hit=345..462bp; Blast score=141; Percent Identity=47.0; E value=5e-33; Homolog= dbj|BAC21354.1|
MGEELRDWVGWVKSRFRNLLLKVISSFLWACMLFFSTFLGCVDVDVDLELSNDVLQLESLGVYCDPDPSEQVDHTITDPNVVFFWGLIYRRNIQICISSLKEDFMKSVCNNIYGKEKCAHSDITMSIVGPPQLPKSVFDLSVYSEKLPQHMMGHQLMKQNYNAVS

SEQ ID NO: 6222 - protein, 65 aa, Xenorhabdus bovienii
  Coding DNA sequence: Name=SeqID_114
MDVCHIVAVVLVVSARNLQVALNPSALVEMMMTIHQPLIQRPNPQLGALNPWMLKIFLMFIPIIS

SEQ ID NO: 6223 - protein, 464 aa, Xenorhabdus bovienii
  Coding DNA sequence: Name=SeqID_115
  Homolog annotation: Query=1..464bp; Hit=1121..1584bp; Blast score =808; Percent Identity=82.0; E value=0; Homolog= gb|AAM94552.1|
VFRNKHNEYGVVVRNKARLVAQGYTQIEGLDFGETFAPVARLEAIRILLAYACAHNIKLYQMDVKSAFLNGKISELVYVEQPPGFEDPKRPNHVFKLSKALYGLKQAPRAWYERLRDFLLSKDFKIGKVDTTLFTKRIGKDLFVCQIYVDDIIFESTNELFCEEFGRMMSKEFEMSMIGELSFFLGLQIKQLKDGIFISQSKYLKDMLKKFGLENAKPIKTPMATNGHLDLDEGGTMVDQKLYRSIIGSLLYITASRPNVMFSVCMCARFQASPREIHLKAAKRILRYLKYTPNIGLWYPKGAHFELIGYSDSDYAGCKVDRKSTSGCCQFLGRSLVSWSSKKQNSVALSTAEAEYISAGNCCAQLLWMKQTLLDYGIIFKNVPLMCDNESAVKLATNPVQHSRTKHIDIRHHFLRDHVGKGDISIYSIGTDDQLADIFTKPLDETRFCSLRSEMNVIDLSNVA

SEQ ID NO: 6224 - protein, 343 aa, Xenorhabdus bovienii
  Coding DNA sequence: Name=SeqID_116
  Homolog annotation: Query=1..333bp; Hit=280..595bp; Blast score=355; Percent Identity=52.0; E value=6e-97; Homolog= gb|AAO37468.1|
MILLGPLSFVSIGGILNVLGLWMPIQDLLGFIFYETNPNVFETFKSFAILAQNQFDFDIKKVRSDNGSEFKNARIDQYCDDKGIKHEFSSKYTPEQNGIVERKNRTLIDMARSMLAEYSISDSYWAEAINTACHSSNRLYCHKLLKKTPYELLIGRKPNISYFRVFGCKCYILRKGSRLSKFEKKCDEGFLLGYSSNSKAYRVFNKTHGIIEEAYDVEFDETSGSQDESDNLDDVGGTQLINAMKTMSIGEIKPKEDDDENSVVAIPSSTTINEEDHQSQQLNETMDTHDQGTFRPSVPPNASTSNYQTVSGRGHWGVRDDRVDGVGGGVGKGGRGGCGMGWG

SEQ ID NO: 6225 - protein, 93 aa, Xenorhabdus bovienii
  Coding DNA sequence: Name=SeqID_117
  Gene classification: Function=Uncharacterized BCR; Function class=S Function unknown
  Homolog annotation: Query=1..79bp; Hit=16..94bp; Blast score=102; Percent Identity=64.0; E value=7e-23; Homolog= Z2816 COG3139
MKLDDLLSAMTPEIYQRLVQAVELGKWQDGVPLTPEQKEHSLQMVMLWQAKHNHDPEHMTIGTDGQITIKSKQELKAMFQSEMVVKLKPQPEE

SEQ ID NO: 6226 - protein, 206 aa, Xenorhabdus bovienii
  Coding DNA sequence: Name=SeqID_118
  Gene classification: Gene name=PncA; Function=Amidases related to nicotinamidase; Function class=Q Secondary metabolites biosynthesis, transport and catabolism
  Homolog annotation: Query=3..199bp; Hit=15..211bp; Blast score=241; Percent Identity=58.0; E value=5e-64; Homolog= ZydjB COG1335
GGIDLQNDFCSGGALAVKESEEVITIANKAISLCQKNNITVIASQDWHPANHMSFAVNASQPVGESGLLNGIPQIWWPVHCVQGQFGADFHPALNQSAIQEIFRKGENPQIDSYSAFFDNDHKNATRLHGWLADQNIQRLIVLGIATDYCVKFTVLDALEQGYETYVITDGCRGVNLQDDDSLKAFKEMATKGAKLIPLHEITTLS

SEQ ID NO: 6227 - protein, 174 aa, Xenorhabdus bovienii
  Coding DNA sequence: Name=SeqID_119
LVLTALTYYEVSNSADKAKVVITPFASVDSGDFWVTGRTASESYVNRMAKLVAAYYGTVSPTTVKNSNASLLAMVHPTRSEAMRKKFNEREKKVTQFTTVSFITELNPEKPIQVTTNPEVEYKEHGSLPVYRLEIPVTKRKIIGETSPNPETAKYTVDYTIESNQFWLLDITGL

SEQ ID NO: 6228 - protein, 262 aa, Xenorhabdus bovienii
  Coding DNA sequence: Name=SeqID_120
MNKLLLICALSLTSAVATAKVTNISTQRVLPEVSTTVTLSNRDVNRIVCESGEAVKPVFSKEKPMKVEIGADRKTFFVKFLFLQSAGGNQYYSEPTELYLTCGNATFELIINPQHESARKVLLGSGTANTIKENQKLFSALSLEETATQLSISVMKDANDSGLGLPPTFEQQAINGRWEKAFPDRRGVAIPIELKKDREVNVEGTGLKATQFTIRALRNVQLSEMMFLNTRYGKNIFAITLESLSLSSGQMTSLVIIEREGL

SEQ ID NO: 6229 - protein, 411 aa, Xenorhabdus bovienii
  Coding DNA sequence: Name=SeqID_121
  Homolog annotation: Query=147..405bp; Hit=166..419bp; Blast score=80; Percent Identity=24.0; E value=5e-14; Homolog= gb|AAL59682.1|
MNIEDNKTTLLDKAKSWYYSKSSADRKKIVKYGTITSFIIIIFGFYYASGKAEIVNKPTSKTSVVADTAEDKLLKDDVVAQLQGDIKDSNAKITDDVAKKIQDMINKGEFKLAPTPPVNLAEADISPVKERNELGSTTGNPVEFSYPQPLSESSPVSSDNGTPVDGTTPPDTGPIWVGDIAIDNSTFTQPPAEVNTEKKNQIQLPVGFMKAHLLVGVNALTGEFGAENPQTVMFRVQAPAQLPNFIKMNLSGCFSVANVTGNLSMERIIALPISMHCITRDKRFIVEGAIKGFVSDRDGKRDMSARVVSRAGPLLASTIFAKSIEGFANVVGSQGVTQNVSALGSVNTIKNADLAKTAASQGLAGGLSEVGKYLLDLAKQTAPALETGSGKDVILFIQETATLEIKEVRIK

SEQ ID NO: 6230 - protein, 125 aa, Xenorhabdus bovienii
  Coding DNA sequence: Name=SeqID_122
MKFIKLTIILPVLILSGCGILPYHNDFACKLEDGYGKCISSADAYDEAVTGINKGKEITDSGVKDDPKASAAKAATSANSSVAYDKYRDRVYQQLTQLIAQPQTPVVKPAKVVRTLIMSYSPSMD

SEQ ID NO: 6231 - protein, 90 aa, Xenorhabdus bovienii
  Coding DNA sequence: Name=SeqID_123
  Homolog annotation: Query=1..82bp; Hit=99..180bp; Blast score=87; Percent Identity=48.0; E value=5e-17; Homolog= ref|NP_439773.1|
LGEIIGSDSKNAYLSINSKRVDFAIIDQKGEPFAVVEYQGSGHYQGNAAVRDTIKKEACNKAGIRYFEIPAKYSEDDVNNIGLYLNTLSN

SEQ ID NO: 6232 - protein, 90 aa, Xenorhabdus bovienii
  Coding DNA sequence: Name=SeqID_124
MSNEKYVCPNCGEQVYFWVEQLIEHRRVINTKTGRMKTQVKKINFGNRTTNSGVSCSKCYWFSSFDGEQLPKHFEDISGVDQFIESIENS

SEQ ID NO: 6233 - protein, 93 aa, Xenorhabdus bovienii
  Coding DNA sequence: Name=SeqID_125
  Homolog annotation: Query=7..89bp; Hit=8..90bp; Blast score=86; Percent Identity=49.0; E value=9e-17; Homolog= ref|ZP_00030857.1|
MRLIENYVPPSTDDLADLKGKLRFTGQQMAELAGVSGSNQWRKYTGGEKPRELNQHILFFIAAQLTLDQKELLSILDKMRKLGSEFEENLIQP

SEQ ID NO: 6234 - protein, 89 aa, Xenorhabdus bovienii
  Coding DNA sequence: Name=SeqID_126
MSAITMNTHNAIKSLKESGMSEAQAEKIVEIIADLQNVSAATKDDLKQAENNLKADLTSIKNDMDWLKKLIITVGIAVVIAAIKYIFVG

SEQ ID NO: 6235 - protein, 102 aa, Xenorhabdus bovienii
  Coding DNA sequence: Name=SeqID_127
  Homolog annotation: Query=11..94bp; Hit=4..87bp; Blast score=70; Percent Identity=41.0; E value=7e-12; Homolog= ref|NP_775004.1|
MQRNNKTTDDLFPLRDSEIVIVCELNEGKGFHFCRNALLSGSNNNLWWPLAEDEKLLSAIERVMVINHVARNVTRITPVRRGEKFVDYEVIYNKENNQIVKK

SEQ ID NO: 6236 - protein, 92 aa, Xenorhabdus bovienii
  Coding DNA sequence: Name=SeqID_128
MPSNSANPTKTKNKAIELIEKSIDALNLNSNRIVSNERANLVNQLESEGFPILSEIVEGFELDRYRENHQHQIYGCLLRKYISLFEEMEFGN

SEQ ID NO: 6237 - protein, 96 aa, Xenorhabdus bovienii
  Coding DNA sequence: Name=SeqID_129
  Homolog annotation: Query=4..95bp; Hit=54..145bp; Blast score=92; Percent Identity=48.0; E value=2e-18; Homolog= ref|NP_775003.1|
ECDSWKYYDLSCGGGYMAPITDKNFTIHVHGNGFSGMLSADAAGIAVTLFALNYFIWQAYEAGDHELNHWLIERQEWLKYYANQHSESEKILGAVR

SEQ ID NO: 6238 - protein, 207 aa, Xenorhabdus bovienii
  Coding DNA sequence: Name=SeqID_130
  Gene classification: Gene name=MglA; Function=ABC-type sugar (aldose) transport system, ATPase component; Function class=G Carbohydrate transport and metabolism
  Homolog annotation: Query=1..200bp; Hit=295..494bp; Blast score=318; Percent Identity=81.0; E value=2e-87; Homolog= rbsA COG1129
MKVIYGALPKTKGRILLDGKPLTIRNPQDGLANGIVYISEDRKRDGLVLGMSVKENMSLTALRYFSQKPYRLNHSAEQKAVTDFIKLFNIKTPSMEQSIGLLSGGNQQKVAIARGLMTRPKVLILDEPTRGVDVGAKKEIYQLINQFKKEGLSIILVSSEMPEVMGMSDRILVMHEGGISGEFSADNASQEALMVAAVGKQYGAVER

SEQ ID NO: 6239 - protein, 224 aa, Xenorhabdus bovienii
  Coding DNA sequence: Name=SeqID_131
  Gene classification: Gene name=AraH; Function =Ribose/xylose/arabinose/galactoside ABC-type transport systems, permease components; Function class=G Carbohydrate transport and metabolism
  Homolog annotation: Query=8..222bp; Hit=7..221bp; Blast score=283; Percent Identity=86.0; E value=1e-76; Homolog= rbsC COG1172
MNSNTAPTSRRLLTKAWLMEQKSLIALLILIVVVSFLSPNFFTLNNLFNILQQTSVNAIMAVGMTLVILTSGIDLSVGSLLALTGAVAASMVGTDVNALVAVVAALALGAAIGACTGVIVAKGKVQAFIATLVMMLLLRGVTRVYTDGSPINTGFSDNAELFGWFGIGRPLGVPAPVWIMLLVFAAAWYILHHTRLGRYIYALGGNESATRLSGINVDKIKITS

SEQ ID NO: 6240 - protein, 39 aa, Xenorhabdus bovienii
  Coding DNA sequence: Name=SeqID_132
MTQLTMHAATSAPSSPHMSHVTFDFGFFTMTQLAMHVAT

SEQ ID NO: 6241 - protein, 252 aa, Xenorhabdus bovienii
  Coding DNA sequence: Name=SeqID_133
  Gene classification: Gene name=ZnuC; Function=ABC-type Mn/Zn transport systems, ATPase component; Function class=P Inorganic ion transport and metabolism
  Homolog annotation: Query=1..249bp; Hit=1..249bp; Blast score=359; Percent Identity=71.0; E value=2e-99; Homolog= znuC COG1121
MSIMITLKNITVEFGSRKVLNNITFSLRQGKILTLIGPNGAGKSTLVRVVLGLIQPTSGTIEHSHPLKIGYVPQKLSLDPTLPLTVKRFMMLRPNVKSADIMPVLKRVNAEHLLQQPMQKLSGGETQRVLLARALLNHPQLLVLDEPTQGVDVNGQLALYDLINQIRTELNCAVLMVSHDLHLVMAKTDEVLCLNQHICCSGTPEVVSMHPEFIAMFGRHGAEQLAVYRHHHNHQHDLRGKIILKNGGEPRR

SEQ ID NO: 6242 - protein, 261 aa, Xenorhabdus bovienii
  Coding DNA sequence: Name=SeqID_134
  Gene classification: Gene name=ZnuB; Function=ABC-type Mn2+/Zn2+ transport systems, permease components; Function class=P Inorganic ion transport and metabolism
  Homolog annotation: Query=1..258bp; Hit=1..258bp; Blast score=316; Percent Identity=81.0; E value=2e-86; Homolog= ZyebI COG1108
MIELLLPGWLAGILLVIAAGPLGSFVVWRRMSYFGDTLAHASLLGVAFGFLLDVNPFYAVIAVTLILAMILVWLEKRPQLAVDTLLGIMAHSALSLGLVVVSFMTNIRVDMMAYLFGDLLSVTYEDLWLIAAGVAIVTGLLTWQWRALLSMTVSQDLAFVDGIKIQRLRVLLMLVTALTIGLAMKFVGALIITSLLIIPAATARRFSRTPEHMAVFAITVGMLAVTGGLTLSAFYNTPAGPSVVLCSAALFALSLTCKAKN

SEQ ID NO: 6243 - protein, 335 aa, Xenorhabdus bovienii
  Coding DNA sequence: Name=SeqID_135
  Gene classification: Gene name=RuvB; Function=Holliday junction resolvasome helicase subunit; Function class=L DNA replication, recombination and repair
  Homolog annotation: Query=1..331bp; Hit=1..331bp; Blast score=538; Percent Identity=83.0; E value=1e-153; Homolog= ruvB COG2255
MIEADRLISAEVLQDDEVIDRAIRPKLLSEYVGQPHVCEQMEIFIQAARQRGDALDHLLIFGPPGLGKTTLANIVANEMGVNLRTTSGPVLEKAGDLAAMLTNLEPHDVLFIDEIHRLSPVVEEILYPAMEDYQLDLMIGEGPAARSIKIDLPPFTLVGATTRAGSLTSPLRDRFGIVQRLEFYNVDDLQNIVSRSARYMGLGISEEGARQIAMRSRGTPRITNRLLRRVRDFSQVKGDGSINGDIAVQALNMLNVDSAGFDYLDRKLLIAIIDKFMGGPVGVDNLAAAIGEERETIEDVLEPFLIQQGFIQRTPRGRIATNHAYRHFGLSKEVE

SEQ ID NO: 6244 - protein, 67 aa, Xenorhabdus bovienii
  Coding DNA sequence: Name=SeqID_136
  Gene classification: Gene name=RuvA; Function=Holliday junction resolvasome DNA-binding subunit; Function class=L DNA replication, recombination and repair
  Homolog annotation: Query=1..67bp; Hit=139..203bp; Blast score=68; Percent Identity=59.0; E value=8e-13; Homolog= ruvA COG0632
VFNQSNDINLPAVAKQANSNADIEAEAASALVSLGYKLQEASRMVSKVAKPGADCETLIREALRAAL

SEQ ID NO: 6245 - protein, 420 aa, Xenorhabdus bovienii
  Coding DNA sequence: Name=SeqID_137
  Gene classification: Gene name=XerC; Function=Integrase; Function class=L DNA replication, recombination and repair
  Homolog annotation: Query=1..416bp; Hit=1..414bp; Blast score=467; Percent Identity=55.0; E value=1e-131; Homolog= Z4313 COG0582
MKLNARLIETAKSKDKTYKLADGGGLYLEVTSRGSKYWRMKYRRPTDKKEDRLAFGVYPAVSLADARTKRDEAKKLLAQGIDPKIEKKGGLPKSAGAYSFERVAREWHASNKRWSEDHSNRILRSLEQYIFPHIGRLDISILRTSHLLAPIKAVDAETKHDIARRLQQRVTAIMRYAVQNDILESSPANDMAGALTTVKSNHHPALPHERLPEFLTRLARYRGRLITRIALELTLLTFVRSSELRFARWEEVDLERATWKIPATRKPIEGVKFSGRGMKMKTEHIVPLCRQAVSLIETLRGLSGDCDVMFPNDHDPKKVMSESTVNNALRVMGYDTKTEVCGHGFRTMARGAMGESALWNDDAIERQLSHIERKNVRAAYIHTSKHLDERRLMVQWWADYLDANREKHITPYDFAKKRRK

SEQ ID NO: 6246 - protein, 104 aa, Xenorhabdus bovienii
  Coding DNA sequence: Name=SeqID_138
MNNVFLADPLSELKSKAKDFISIEDTLNIICEMLDCSLVTAAEIILLKLPDDRDWNNSPVNPPFFGEKLGIATFSYCDNRPLIRELLKNIIENDPFSFEDSIPF

SEQ ID NO: 6247 - protein, 242 aa, Xenorhabdus bovienii
  Coding DNA sequence: Name=SeqID_139
  Homolog annotation: Query=85..242bp; Hit=170..324bp; Blast score=70; Percent Identity=30.0; E value=2e-11; Homolog= gb|AAF27354.1|AF198256_8
MTERKLASEYRKFGFVKSQLEDVLGFSLGGERSLPDYLKPYKTRIGIQLDEAANIFAGCRPSEHINSGPLVDIIRGYRASLWDAYDNDILSGNNIIMDYNYNEEYRVDVTLVKDQVTKWAREHNLDWPFELPESEIDNESSSVDLLSKIESLELENKSLKTKINELKEIIPLLLSAYRDDDPLSIAIKLRNEVWVDYNEDSRSTIPTQEWVVAKLIDEYKEFEMTKAQAQAIEKVACPIKRK

SEQ ID NO: 6248 - protein, 71 aa, Xenorhabdus bovienii
  Coding DNA sequence: Name=SeqID_140
  Gene classification: Gene name=AlpA; Function=Predicted transcriptional regulator; Function class=K Transcription
  Homolog annotation: Query=11..70bp; Hit=8..67bp; Blast score=83; Percent Identity=66.0; E value=5e-17; Homolog= Z3946 COG3311
MPAIIITKENLIRLPEVQRRTGYGKAWIYKLIAGNKFPKQVKIGTRSIAFVESEIDDWISQRIAESRGEVM

SEQ ID NO: 6249 - protein, 306 aa, Xenorhabdus bovienii
  Coding DNA sequence: Name=SeqID_141
MEKITALIGNGQTYPKFSQSDISIIRKAVISGNWTVINKGICTLTDLGLRHNGQGLVWLNSGVSVHDAESDTGLTGKDKQSHEYHSEVRSVNHLNSGNYYGFVQLKDIDSYALNIITSISSEYHTRKNGTPLATFALLIDQKQRKQAVDNWILYRNPNQPDKYTILNKHHELAKCYQAKGWMREPLEYLSKLIRNDAEFSKLMRRLGYVPVRTRKLTGKRERFWLYRKTGNDKGVGTKKINKINRVTPFVQYAKRPVRAFEHIAVDGQWLYVYADHIRFLTKKRHRVEGVRVQGYTAKEIELREVV

SEQ ID NO: 6250 - protein, 103 aa, Xenorhabdus bovienii
  Coding DNA sequence: Name=SeqID_142
MPTPNKNAKSQLTTVRVPHDVMEGMEAVKQGNESNAGFIITAMRVEIARRQSEGNCKDPLLSSLDALARVEEIGTKVNEEIRLLISVAQEELQRRKTKASSEQ

SEQ ID NO: 6251 - protein, 62 aa, Xenorhabdus bovienii
  Coding DNA sequence: Name=SeqID_143
MDTPQHNQTRLKFTFLIASGNQRLVDIHPVRLITVLADCEGEARLLAGKSSLVFVSRQGVSA

SEQ ID NO: 6252 - protein, 82 aa, Xenorhabdus bovienii
  Coding DNA sequence: Name=SeqID_144
MSKPITIHQAAEKAQQLEFINQLIESYPHQIQGSEISVMPSLMAKLSGDIAVFLIEVIAGEEAIDNTSHCSDMSTVQGVNHA

SEQ ID NO: 6253 - protein, 56 aa, Xenorhabdus bovienii
  Coding DNA sequence: Name=SeqID_145
MPNPAPHDYYTHQNGETVQVLSVAFNRVTFVRDGYHTPCIMPVSRFTKEYTYAGRA

SEQ ID NO: 6254 - protein, 101 aa, Xenorhabdus bovienii
  Coding DNA sequence: Name=SeqID_146
MSDIYNHLVRNNFNAMSTEEIKDLRKHSEGAHSAVMAAMSAMGELAFWSADNENYANCQAREDLRRVGEALMYLPRIAEALNDTAQHADFEIHHREGFPKW

SEQ ID NO: 6255 - protein, 314 aa, Xenorhabdus bovienii
  Coding DNA sequence: Name=SeqID_147
  Homolog annotation: Query=7..310bp; Hit=5..292bp; Blast score=254; Percent Identity=48.0; E value=1e-66; Homolog= ref|NP_404500.1|
MVNHIDIRSVKMAAKDHWQGLLAACGVDVPTKGKHGACPLCGGTDRFHFIDDHGHGDWHCRQCDEPSFGDGLDLLVRAKGITIIEAAKVVADALALPLPEPKPARKEAPKSGAPLIAERIKKLAAQTTVGQSEYLTNKGLQCPHQKLLKDGSLLLVMQALDGAVTGAQTIKPNGEKRLVSGSQKKGSFIPLSGITGTPDTIIIADGYATALTVSQLHDGVVLAAIDEGNLFAVAEQVRERWPDAKIILAADNDMKSGHKNVGKVSAEKAAKSVRGWVTLPPTEEKADWDDYRQRHGIEAAKQAFSNGLYQVGEK

SEQ ID NO: 6256 - protein, 84 aa, Xenorhabdus bovienii
  Coding DNA sequence: Name=SeqID_148
  Gene classification: Gene name=RpsQ; Function=Ribosomal protein S17; Function class=J Translation, ribosomal structure and biogenesis
  Homolog annotation: Query=1..84bp; Hit=1..84bp; Blast score=137; Percent Identity=92.0; E value=1e-33; Homolog= rpsQ COG0186
MNDKIRTLQGRVISDKMEKSIVVAIERVVKHPLYGKFIKRTTKLHVHDESNECGIGDVVEIRETRPLSKTKSWTLVRVVEKAVL

SEQ ID NO: 6257 - protein, 63 aa, Xenorhabdus bovienii
  Coding DNA sequence: Name=SeqID_149
  Gene classification: Gene name=RpmC; Function=Ribosomal protein L29; Function class=J Translation, ribosomal structure and biogenesis
  Homolog annotation: Query=1..62bp; Hit=1..62bp; Blast score=63; Percent Identity=79.0; E value=5e-11; Homolog= HI0785 COG0255
MKAQELRDKSVEELNTELLNLLREQFNLRMQAASGQLQQSHLLKQVRRNIARVKTLLTEKAGA

SEQ ID NO: 6258 - protein, 136 aa, Xenorhabdus bovienii
  Coding DNA sequence: Name=SeqID_150
  Gene classification: Gene name=RplP; Function=Ribosomal protein L16/L10E; Function class=J Translation, ribosomal structure and biogenesis
  Homolog annotation: Query=1..136bp; Hit=1..136bp; Blast score=229; Percent Identity=96.0; E value=6e-61; Homolog= rplP COG0197
MLQPKRTKFRKVHKGRNRGLAVGTDVSFGTFGLKAVGRGRLTARQIEAARRAMTRAIKRQGKIWIRVFPDKPITEKPLEVRMGKGKGNVEYWVALIQPGKVLYEMDGVPEELAREAFKLAAAKLPIKTTFVTKTVM

SEQ ID NO: 6259 - protein, 233 aa, Xenorhabdus bovienii
  Coding DNA sequence: Name=SeqID_151
  Gene classification: Gene name=RpsC; Function=Ribosomal protein S3; Function class=J Translation, ribosomal structure and biogenesis
  Homolog annotation: Query=1..233bp; Hit=1..233bp; Blast score=415; Percent Identity=96.0; E value=1e-116; Homolog= rpsC COG0092
MGQKVHPNGIRLGIVKPWNSTWYANTKEFADNLDSDFKVRQYLNKELVKASISRIVIERPAKSIRVTIHTARPGIVIGRKGEDVEKLRKTVAEIAGVPAQINIAEVRKPELDAKLVADSISSQLERRVMFRRAMKRAVQNAMRLGAKGIKVEVSGRLGGAEIARTEWYREGRVPLHTLRADIDYNTSEAHTTYGVIGVKVWIFKGEILGGMAAVEQAEKPAAQPKKQQRKGRK

SEQ ID NO: 6260 - protein, 110 aa, Xenorhabdus bovienii
  Coding DNA sequence: Name=SeqID_152
  Gene classification: Gene name=RplV; Function=Ribosomal protein L22; Function class=J Translation, ribosomal structure and biogenesis
  Homolog annotation: Query=1..110bp; Hit=1..110bp; Blast score=166; Percent Identity=95.0; E value=4e-42; Homolog= rplV COG0091
METIAKHRHARSSAQKVRLVADLIRGKKVSQALETLLYTNKKAAGLVKKVLESAIANAEHNDGADIDDLKVTKIFVDEGPTMKRIMPRAKGRADRILKRTSHITVVVSDR

SEQ ID NO: 6261 - protein, 92 aa, Xenorhabdus bovienii
  Coding DNA sequence: Name=SeqID_153
  Gene classification: Gene name=RpsS; Function=Ribosomal protein S19; Function class=J Translation, ribosomal structure and biogenesis
  Homolog annotation: Query=1..91bp; Hit=1..91bp; Blast score=161; Percent Identity=93.0; E value=1e-40; Homolog= HI0781 COG0185
MPRSLKKGPFIDLHLLKKVEKAVESGDKKPIKTWSRRSTIFPNMIGLTIAVHNGRQHVPVFVSDEMVGHKLGEFAPTRTYRGHAADKKAKKR

SEQ ID NO: 6262 - protein, 273 aa, Xenorhabdus bovienii
  Coding DNA sequence: Name=SeqID_154
  Gene classification: Gene name=RplB; Function=Ribosomal protein L2; Function class=J Translation, ribosomal structure and biogenesis
  Homolog annotation: Query=1..273bp; Hit=1..273bp; Blast score=476; Percent Identity=92.0; E value=1e-134; Homolog= rplB COG0090
MAIVKCKPTSPGRRHVVKVVNPELHKGKPYAPLLEKNNKTGGRNNNGRITTRHIGGGHKQHYRLVDFKRNKDGIPAVVERLEYDPNRSANIALVLYKDGERRYILAPKGLKAGDQIQSGADSAIKAGNALPMRNIPVGSTVHNIEMKPGKGGQLARSAGTYAQIVARDGSYVTLRLRSGEMRKVLSDCRATLGEVGNAEHMLRVLGKAGASRWRGIRPTVRGTAMNPVDHPHGGGEGRNFGKHPVTPWGIQTKGKKTRSNKRTDQYIVRRRSK

SEQ ID NO: 6263 - protein, 100 aa, Xenorhabdus bovienii
  Coding DNA sequence: Name=SeqID_155
  Gene classification: Gene name=RplW; Function=Ribosomal protein L23; Function class=J Translation, ribosomal structure and biogenesis
  Homolog annotation: Query=1..100bp; Hit=1..100bp; Blast score=155; Percent Identity=97.0; E value=5e-39; Homolog= rplW COG0089
MIREERLLKILRAPHVSEKASTAMEKSNTIVLKVAKDATKAEIKAAVQKLFEVEVEGVNTLLVKGKVKRHGQRIGRRSDWKKAYVTLKEGQNLDFVGGAE

SEQ ID NO: 6264 - protein, 201 aa, Xenorhabdus bovienii
  Coding DNA sequence: Name=SeqID_156
  Gene classification: Gene name=RplD; Function=Ribosomal protein L4; Function class=J Translation, ribosomal structure and biogenesis
  Homolog annotation: Query=1..201bp; Hit=1..201bp; Blast score=345; Percent Identity=94.0; E value=2e-95; Homolog= rplD COG0088
MELVMKDAQSALTVSETTFGRDFNEALVHQVVVAYAAGARQGTRAQKTRAEVSGSGKKPWRQKGTGRARAGSIKSPIWRSGGVTFAAKPQDHSQKVNKKMYRGALKSILSELVRQERLIVVEKFSVEAPKTKLLVQKLKEMALQDVLIVTGEVDENLFLAARNLYKVDVRDAAGIDPVSLIAFDKVVMTADAVKQVEEMLA

SEQ ID NO: 6265 - protein, 210 aa, Xenorhabdus bovienii
  Coding DNA sequence: Name=SeqID_157
  Gene classification: Gene name=RplC; Function=Ribosomal protein L3; Function class=J Translation, ribosomal structure and biogenesis
  Homolog annotation: Query=1..210bp; Hit=1..209bp; Blast score=348; Percent Identity=92.0; E value=3e-96; Homolog= rplC COG0087
MIGLVGKKVGMTRIFTEDGVSIPVSVIEIEDNRITQVKDQESDGYRAIQVTTGSKKANRVNKPEAGHFAKAGVEAGRTLREFRLSADDEEYTVGQSISVEIFADVKKVDVTGTSKGKGFAGTVKRWNFRTQDATHGNSLSHRVPGSIGQNQTPGKVFKGKKMAGQMGNERVTVQSLDVVRVDAERNLLLVKGAVPGATGSDLIVKPAVKA

SEQ ID NO: 6266 - protein, 103 aa, Xenorhabdus bovienii
  Coding DNA sequence: Name=SeqID_158
  Gene classification: Gene name=RpsJ; Function=Ribosomal protein S10; Function class=J Translation, ribosomal structure and biogenesis
  Homolog annotation: Query=1..103bp; Hit=16..118bp; Blast score=184; Percent Identity=99.0; E value=2e-47; Homolog= HI0776 COG0051
MQNQRIRIRLKAFDHRLIDQSTAEIVETAKRTGAQVRGPIPLPTRKERFIVLISPHVNKDARDQYEIRTHKRLVDIVEPTEKTVDALMRLDLAAGVDVQISLG

SEQ ID NO: 6267 - protein, 53 aa, Xenorhabdus bovienii
  Coding DNA sequence: Name=SeqID_159
  Gene classification: Gene name=Bfr; Function=Bacterioferritin (cytochrome b1); Function class=P Inorganic ion transport and metabolism
  Homolog annotation: Query=1..53bp; Hit=105..157bp; Blast score=73; Percent Identity=67.0; E value=4e-14; Homolog= bfr COG2193
LAYADSAYDYVSRDLMIEVLSDEENHIDWLETQLDLLNRMGIQNYIQSQLIEE

SEQ ID NO: 6268 - protein, 71 aa, Xenorhabdus bovienii
  Coding DNA sequence: Name=SeqID_160
  Gene classification: Gene name=Bfr; Function=Bacterioferritin (cytochrome b1); Function class=P Inorganic ion transport and metabolism
  Homolog annotation: Query=1..65bp; Hit=42..106bp; Blast score=102; Percent Identity=86.0; E value=1e-22; Homolog= bfr COG2193
EVEYRESIEEMKHADKYIERILFLEGLPNLQDLGKLNIGEDIEEMLQSDLALEIRGAKDLREAIGICRFSL

SEQ ID NO: 6269 - protein, 61 aa, Xenorhabdus bovienii
  Coding DNA sequence: Name=SeqID_161
  Gene classification: Gene name=HipB; Function=Predicted transcriptional regulators; Function class=K Transcription
  Homolog annotation: Query=5..47bp; Hit=21..63bp; Blast score=58; Percent Identity=60.0; E value=1e-09; Homolog= Z5888 COG1396
SQRAGMSQEAFADKCGLDRTYISGIERGVRNPTLEIIYVIANGLQIELNELFNLETRLPPN

SEQ ID NO: 6270 - protein, 316 aa, Xenorhabdus bovienii
  Coding DNA sequence: Name=SeqID_162
  Gene classification: Gene name=URH1; Function=Inosine-uridine nucleoside N-ribohydrolase; Function class=F Nucleotide transport and metabolism
  Homolog annotation: Query=4..312bp; Hit=2..310bp; Blast score=475; Percent Identity=75.0; E value=1e-134; Homolog= PM1767 COG1957
MLPKKIILDCDPGHDDAIALLLAHGNPDIELLAVTTVVGNQTLNKVTRNALSIARIANIHNVPFAAGCHRPLVRDIQTAPAIHGETGLDGVVLPEPALRLDARHAVDLIIDIIMENPPKSITLVPTAGLTNIALAARKSPHIVERVKEVVLMGGGYHTGNWSAVAEFNIMIDPEAAHIIFNEKWPLTMVGLDLTHQAQATPDVIDAISKIKTRPAQFVLDALQFYGERYRESQGFDYPPVHDPCAVAYVIDPTVMTTQKVPVNIELTGTLTTGMTVADFRFPPPKDCHTQVAVKLDQAKFWQLVINALKNIGETAS

SEQ ID NO: 6271 - protein, 439 aa, Xenorhabdus bovienii
  Coding DNA sequence: Name=SeqID_163
  Gene classification: Gene name=DadA; Function=Glycine/D-amino acid oxidases (deaminating); Function class=E Amino acid transport and metabolism
  Homolog annotation: Query=10..439bp; Hit=3..432bp; Blast score=600; Percent Identity=67.0; E value=1e-172; Homolog= PA2317 COG0665
MLTGYNMNNNLDSLTYYAATKKYDLRFPTLTEDLDVDVVIIGGGFSGVNTALELAEKGITNIAILEGRTLGYGGTGRNGGQVMAGIGHDLDRIKRHVGEKGLETIFKISNMGAGIIRDRIAKYDIKADFCKGYGYLGYNARQEKTLRGWLKEFQAACPDEEIELYVGADVKKVIGSDLYTCALKHMGGGHVHSLNLLLGEAKAATEQGVRIFENSQVVNVEYGPRVTVRTAMGTVRASKILWACNAFLNGLEPTIYKKTINTYAFQLMTEELSDDLIEKISPIRGAYSDISPVINYYRVTKENRVLFGSATQYLEYIPSDLKAWNRKRMLDVFPYLKDVKIELAWGGPLSCSVNLFPQIGSLPEHDNVFYVQGYSGFGVTPSHIVCKILAEGMSEGSERYSLMSSIPHLNVVGKDKLRSLLLSVGKTWHQASGYWKGRR

SEQ ID NO: 6272 - protein, 122 aa, Xenorhabdus bovienii
  Coding DNA sequence: Name=SeqID_164
  Gene classification: Function=Predicted enzyme of the cupin superfamily; Function class=R General function prediction only
  Homolog annotation: Query=11..118bp; Hit=12..119bp; Blast score=111; Percent Identity=52.0; E value=1e-25; Homolog= PA2318 COG3450
MIKPLLLDQALPELMPIGSVTHLGSIVLEGDPQASGAMTHGEPTDNLTCGIFACTRGKFKMIYPFDEMATVHEGSVKLTDVKTGATVEYHKGDSWFAAKGTEMMWEITTERFVKHYMACVNA

SEQ ID NO: 6273 - protein, 497 aa, Xenorhabdus bovienii
  Coding DNA sequence: Name=SeqID_165
  Gene classification: Gene name=PutA; Function=NAD-dependent aldehyde dehydrogenases; Function class=C Energy production and conversion
  Homolog annotation: Query=4..497bp; Hit=7..500bp; Blast score=459; Percent Identity=44.0; E value=1e-129; Homolog= feaB COG1012
MSEITLLKPVTDFLQRPHGHYINGLSIPGQGNNTFSVVNPASDEVIAKVNRGEEAEINLAMEAASKAFHGSWAQTSPMERGKCLNRLADLLQKHGEELAQLESLCSGKPIQLARMLDVGASADYLRYFAGWSSKISGETLNVSLPSLKGEKYTAFTRREPIGVVVGIIPWNFSIMIAIWKLGAALACGCTLVLKPSEYTPLTMLRVAELAKEAGIPDGVINVVNGSGARVGSALLAHPKCAKVTFTGSVPTGTIIGKSAIEYGLTRATLELGGKNAAAFLSDMSVEKIVEGVLEAGYLNQGQICAAAERFYIPSVHMDAVLKLLSERLSAMKIGSPLDESTEMGPLANKEHYEKILSLFEKARQDGSEIVYGGHALEGEGFFVAPTIIRAKSAEDTLMQEETFGPIGTFLSYDDEEELIVMMNATPFGLSASLWTNDLSKAMRMIPRIQVGTLWINMHTFLDPAVPFGGVKSSGIGREFGSAFIEHYTELKSVMVRY

SEQ ID NO: 6274 - protein, 88 aa, Xenorhabdus bovienii
  Coding DNA sequence: Name=SeqID_166
MISAKRGLKLAFWQSITGLWGSLLFSLMASILVITGAGIEQFKISILAAMLLTLVLLLHRDARHFLLIPAGIAVMCSLFAGLRYAEYF

SEQ ID NO: 6275 - protein, 769 aa, Xenorhabdus bovienii
  Coding DNA sequence: Name=SeqID_167
  Homolog annotation: Query=6..764bp; Hit=62..792bp; Blast score=203; Percent Identity=25.0; E value=1e-50; Homolog= gb|AAL59681.1|
IIKIHYPKGTVAQWILYPDHNIDDILDEYAACRVQGDPINDMNVKNTSQYLRNGAENGIHPQMNGIPVRNFRVFYTLKCEEMIREDLLSSIEQIFDTAGMAPRRIGATELIRWMSEFFCGKKFAGEYNPERPLAKQMMSNDPAYERSFDNGGHHEALQNFSVTPNILGHRYGTCLFPNVIPQKDNNPLRTNELFGGYKGVIDDRGQIKYPFLYTLTIIYDELQTEIANKASQTMFQRVGAGLVFALKERINEFSEMQQTLAKGGDFAYFIPQLWVFGKTKKDVRAAVSEAKDLWGNHKFELMPETNMSKVMYLTALPFGFYNIDSNLKNMDRFFYADYENIARFLPVQGDFRGGGKPVQTYIGRKGQIIGLDMFDKRVNSHNFYVVAETGGGKSFLLNDLLDSYASCGAKIRITDLGASYKKLTHIRKGRYIDFALDNPMCMNPSGFIAKDAEDLEQNIAAAVLIYSSCAYSFTGQTVTEVEANLLDQACHASHRKGNQESGVDDVIAYLRSGEWKKGQEISPVAAQEIENQAQRLSFLLNNFGSNGQFKKFFVGKSEFSISQDEFVCVDLEKLKSQKQLFFPMIMQVMNAMTQDLYLSDRSQKSFILFEEIASMVKQQGNISMDGLASMVEEGYRRARKYLGAFGIVLQSPLDLLLLKGLGQVAQANAPFKYYLESKMYAEAVSKGVLPGIKGGFPLTLLESVKNARPRYGEVFIDSPLGMGVARLCVDKWRYWINTSDGDDVAQYNTLIQRGFQPVDALRQLSGVTL

SEQ ID NO: 6276 - protein, 662 aa, Xenorhabdus bovienii
  Coding DNA sequence: Name=SeqID_168
  Homolog annotation: Query=294..435bp; Hit=224..370bp; Blast score =119; Percent Identity=43.0; E value=1e-25; Homolog= gb|AAK02035.1|AF261825_4
VHAQKQESISKASQDKVDSIANDISDVVKGKTSSASSINNSLLSPMNGQDQMTTFDGKQSFDGKAVCKGTSEFMKMLVQPGAGGDVTILNVMQDTNMDGKLDITMAPNWNVSAVCSNGFMTCTDPNNTTTCTSWTWIADSKSYQLGRKRVALTDLGGCYCINNKCGSNLAWTNMGQILRNLGGGASQALAAVNPWYTLSDVKVDGVVASFVGGDAGSCNVGDSTGFFNSPDGSQLLTYQNNETKMKDDATNSTQSSDAYKAIVSGSLNPNESSETRRCEVRRNVGIDELTLDEIIKFDGGEGQVTQCGTDCLQLVLGKLGDDYWQGSCSYYEVKSNFILKDPSRIKSATLINAVFDDWMQVWVGDKVAWNGPYGNWLDAGPVPGACELSTSWNVNPNVDFAEYIKNPGPLQFKIRVEVSGEGEGYALLRVKTDMSCKLGAESISNTCTAYENDSTCKLVEEEIDGIKSFIGGINTGLKPLSQTHKVNGNFCSIEVKRDWFTKKRVYRCNTKNDYDTSKIIERKGYIEDNVKPDHYKDKMFSENGKVTLGEGDLFWPKLPTVNECVNVCKTRKEKTTPDMSVSGQVDKNKATGQKVYNYYYHECGTDNKCVTDSDEEVVKACQCINEFAEAAAIMQTMREAGQDMICSSGEVKNPNGTPLESN

SEQ ID NO: 6277 - protein, 540 aa, Xenorhabdus bovienii
  Coding DNA sequence: Name=SeqID_169
  Homolog annotation: Query=438..533bp; Hit=512..613bp; Blast score=90; Percent Identity=46.0; E value=1e-16; Homolog= gb|AAB61941.1|
MEPHWNQIEVNMIKILLIVFSLLFSSGSLAASNLICGIDQNNNGYLGDEGETATCIGNDPGLCPIGKIACNAVNNEQTSDPIYSCPVGTTLKNNVCIGDNEPHWEEYHALDFLMCTSCAGKTLYDEIYINWAPDYKYLGWDKPPYYYYGPRYYTGRYEAGELNTGMEFYIYKTNINNGTIDDNDKIKVRIGNYRERSGKNCIGLDCQGTWTIFVQIGDATATSPSITCVDTYTWNTVENKCKKVIVDQVCPINGGGACIPDGSGYSCSPNKCVNTNINIPVDEGDINGGMLVNDGKKTEDGICLDQLYIFSGRGQRCLPSGMSTGYKNCCANKGSALQDNAGSLASMASSVSTISKVYDVAEKGYQAYNAAITAGKTISQASTLAGSAMQGQMLIAFDPTSLAISVAIHFAMKYFMQACDQESMETAMFASSGYCHYVGEYCKKKVPLLGCVQKANAYCCFNSKLARIIHEQGRPQLSTIGDFGTAKAPQCRGFTPDEFQSIDFSKIDLSEYIEDMTKNTTEQIKGQISDTIKDFYEKTN

SEQ ID NO: 6278 - protein, 75 aa, Xenorhabdus bovienii
  Coding DNA sequence: Name=SeqID_170
MNLKDFYHQIKPDMSITNSHIISNVIDEISVINTKFDTNSNDLINMAEAHSSTYRNLSVEQTRMVNTIFNTPLFL

SEQ ID NO: 6279 - protein, 527 aa, Xenorhabdus bovienii
  Coding DNA sequence: Name=SeqID_171
  Homolog annotation: Query=221..522bp; Hit=16..333bp; Blast score=202; Percent Identity=36.0; E value=8e-51; Homolog= ref|NP_932212.1|
MKTSLSASAFLVAMLLSSHVEASQDVVGQLYNISEPDALKQIQERVANVDWQKELNKDREKWGAFKGVPLPTTLEDKTRKIVPFYSAPFEVKGEDGRLLFPKGYTFNPLVHVRLPQRLIVVEKGQEDWLKSIATESDMIIYASGDVIEVSQRIGRNAFILDKNLQQRLDIKVVPSIIQQEGEHLIIQEFSKQHVENAKNKALFDFNGKKLAWSVVGSVMDFLVPPAHATCKSSFINPITDISWSCIFPMRIAGVQVVGGEENPSNNQNPVCICKGAALPMIGLKTSFWEPKRIIDTVSDPYCMMPLGTQLSKPVPGTLAGGYNETNTSKRVFQQAHYFIFPAWKILNMFYDIPCLDDEGFDVAMMTEILPQWNNEALSLIINPEALLFANPVATIACSADAVAGTYGMPLNALFWCMGSWGNVYPLSGSITSTDFVEANAGIAARSIFTMGRLGLLWNTSDDGCYRELAPIWKKDRFKLQLMRPTRASACIPIGREGLLWTGGKHDPLKDNFMWMMFEKKDCCIRAY

SEQ ID NO: 6280 - protein, 239 aa, Xenorhabdus bovienii
  Coding DNA sequence: Name=SeqID_172
MKKLFITISLALTTNFVHAQEVAISPEMMKAAQSAVDHRVSNKEMNSFAENIVGYSKSSEFKQQQKDLQQQVFKTAGLDPDKQQQDERPELVKDQLVLFVSSSMPIHTLRNYARDLSKVGGVMVLRGAVGGISRIADTMKLSREILAVNQTCDTTSCKMWSTQILIDPVLFKQYDIKVVPALIFQPDMNINSYCDGLELMKKSETVIYGDASIAKMLEAMNRITPNKKYESLIKVIRGL

SEQ ID NO: 6281 - protein, 143 aa, Xenorhabdus bovienii
  Coding DNA sequence: Name=SeqID_173
MIIISIMFIIYSAFQYINIPLTSSVLPHVLIKTGDRPTQTDDYVIFTLEHPYLPHAKDQLTKRIGCIERQKLERINQHFYCDSKLIVIALEHDIQGASLPVFSFTGTIPAGKAFLVGDTPNSFDSRYWGFFDIQKTEKLIPII

SEQ ID NO: 6282 - protein, 132 aa, Xenorhabdus bovienii
  Coding DNA sequence: Name=SeqID_174
  Homolog annotation: Query=10..127bp; Hit=3..120bp; Blast score=62; Percent Identity=34.0; E value=1e-09; Homolog= ref|NP_904997.1|
MKFIDKSIAKTLLVIACFSFVLAITGCATVFTEKSVAVTIHSNPEGANVFRNGEMLGQTPLTVETTPRSSVFSITKEGYEGEVLMLETGVNRTTHGNAAVFPLFPITDAVDSVTGNYQKIEQTTATVTLKKK

SEQ ID NO: 6283 - protein, 195 aa, Xenorhabdus bovienii
  Coding DNA sequence: Name=SeqID_175
MINSLITSVFSLFVSFGSVSAHASLPNQLSLSESLIKTPKRDLFWYDLPTKTEKKSDEKYPRPAIPSAEALFQMHPKELKALLDDTLDYAVFKLSPEATMDYYKVLDVARRKSSAFTNLTGFVMLDKPELNAAQDYPITNPGNAEKKRRTDNDVTKNCKRPVMNTLCYSSHNLHVVSVSSSLKYLRTSNGNRAGL

SEQ ID NO: 6284 - protein, 462 aa, Xenorhabdus bovienii
  Coding DNA sequence: Name=SeqID_176
  Homolog annotation: Query=40..335bp; Hit=46..341bp; Blast score=84; Percent Identity=25.0; E value=5e-15; Homolog= gb|AAM90722.2|
MINLKKIVILTLTSLYITAANADNWADKWFDNAVYDTPSSFESQKRGYYTMGGFSARNNSSTDYPITISPPKLSVGCGGIDAFLGGFSFLDPDYLVEKAQRAMQAAPYVAFDMALKTMCKECADTLGKIEQITNFLNGIQMNECALAKPIATAAITQDAEALKGLWTEMTGTKSLDEASDRLWTESTSKIKANDNKPTQDLKSMIEGCPVEFKDLMQHGSIVERAAQKVGLGNYADTIRGYLGDVWIESKTADRIPVAVSIPSCPQNQKYSLDDMLTGRSFVKTINKQCVPSSSKPVRDIVYAKMQKVLNKMKAGQELGTDEIKFINSTNIPVYSILKQAITSKQDDVVLNVLAELVGLNYSYYIFSDLYRNTQSAFDAVNEMMSSPLSDPNNAKKPCRMDLFAPALTKFGDLIQQARDSSVKVEATYNSRLQSYMLNSGFIETFREQEMRDQRQRAGELAK

SEQ ID NO: 6285 - protein, 359 aa, Xenorhabdus bovienii
  Coding DNA sequence: Name=SeqID_177
MKPSLLLLLILIPSVSFASLDMEYVVQGGFSTVVNAFTRIKFMFNDRQYSSLMAAMVVFGIVSGLMYRAAKGGVELLETGKASMGLGWLAYTLIGTMIWFGLMVPKGTIHIYDQTRNQYQPVSGIPDFITFVAGGTNLIYQAFTDMANTNTATTTRFSGEGMPIKVLMALMTRNGASFDPYISKSITEMWKQCSPIAETRGFDANNLKTGSTTFNIVSTLSALRNPAVFTTWYSAANPGGSTVSCTTAYSNLQSAMGSPTAYDSRLKDICSKLGYNSANAASYVDCKGRMEDTLQTVYGSTTVTLNAAIGGIMVSQAISDALVQQNPEVAGTMLANRSMVNSALSDASTNPEWLTTIMA

SEQ ID NO: 6286 - protein, 857 aa, Xenorhabdus bovienii
  Coding DNA sequence: Name=SeqID_178
  Gene classification: Gene name=ClpA; Function=ATPases with chaperone activity, ATP-binding subunit; Function class=O Posttranslational modification, protein turnover, chaperones
  Homolog annotation: Query=1..857bp; Hit=5..861bp; Blast score=1379; Percent Identity=83.0; E value=0; Homolog= ZclpB COG0542
MRLDRLTNKFQLALAEAQSLALGRDNQFIEPTHLMSALLNQEGGSVRPLLTSAGVDTSSINNQLNQALDRLPKVEGNGGDVQVSNELGRYLNLCDKLAQKAGDNFISSELFILAAIEERGTLSDILKAVGTTKDKIAKAIEQMRGGEKVSDQGAEDQRQALKKYTIDLTERAEQGKLDPVIGRDEEIRRTIQVLQRRTKNNPVLIGEPGVGKTAIVEGLAQRIINGEVPEGLKNKRVLSLDMGALVAGAKYRGEFEERLKGVLSDLAKQEGSVILFIDELHTVVGAGKADGAMDAGNMLKPALARGELHCVGATTQDEYRQYIEKDAALERRFQKVYVAEPTVEDTIAILRGLKERYELHHHVQITDPAIVAAATLSHRYISDRMLPDKAIDLIDEAGASLRMQMDSKPEALDRLERRVIQLKLEQQALKKESDDGSKKRLEMLNMELVEKEREYSELEEEWKAEKAELTGTQNIKAELENMRLELEKARRSGDLAKMSEIQYGKIPELEKRLATATTVESHHMKLLRNKVTDAEIAEILARWTGIPVSRMLESEKDKLLRMEHELHKRVIGQNEAVDAVSNAIRRSRAGLSDPNRPIGSFMFLGPTGVGKTELGKALANFLFDSDDAMVRLDMSEFMEKHTVSRLVGAPPGYVGYEEGGYLTEAVRRRPYSVILLDEVEKAHPDVFNILLQVLDDGRLTDGQGKTVDFRNTVIIMTSNLGSDMIQERFGALDYAGMKDIVMEVVGHHFRPEFINRVDEVVVFHPLGKEHLTSIANIQLQRLYYRLEERGYQVTMTSTALEKLSDAGFDPVYGARPLKRAIQQEIENPLAQQILSGKLIPGKLVTLDLENDHIVAKQ

SEQ ID NO: 6287 - protein, 243 aa, Xenorhabdus bovienii
  Coding DNA sequence: Name=SeqID_179
  Gene classification: Function=Uncharacterized ACR; Function class=S Function unknown
  Homolog annotation: Query=1..242bp; Hit=1..242bp; Blast score=319; Percent Identity=61.0; E value=2e-87; Homolog= ZyfiH COG1496
MTPLIFPDWPQLDNVGACSTTRLGGVSLPPYDSLNLGNHVGDDSECVERNRKLLVEYAQLPQQPVWLEQIHGTRVINLDGQPAKDNQADAVYTNMPGQVCAVMTADCLPVLFCAIAGDEIAAAHAGWRGLCTGVLENTVSRFSTKPEMIRAWLGPAIGPEKFEVGREVMDAFVVTNPELEQAFTPYGNKFLANIYLLAKLKLQSIGINEVFGGTACTATEERNFFSYRRDGNTGRMATLIWLR

SEQ ID NO: 6288 - protein, 325 aa, Xenorhabdus bovienii
  Coding DNA sequence: Name=SeqID_180
  Gene classification: Gene name=RluA; Function=Pseudouridylate synthases, 23S RNA-specific; Function class=J Translation, ribosomal structure and biogenesis
  Homolog annotation: Query=1..325bp; Hit=1..325bp; Blast score=526; Percent Identity=81.0; E value=1e-150; Homolog= sfhB COG0564
MAQQIRLNATVAETQLGQRLDQALAELFSDYSRSRIKEWILDNKVQVNGKLINKPKEKVLGGEEISIDAIIEEDARWEPQDIELNIVYEDNDILVINKPRDLVVHPGAGNPDGTVLNALLYRYPAIADVPRAGIVHRLDKNTTGLMVIAKTVPAQTRLVESLQLREITREYEAIALGCMTAGGMVEEPISRHPTKRTHMAVHPMGKSAVTHYRVMEHFRAHTRLRLRLETGRTHQIRVHMAHIKHPLVGDPLYGGRPRPLKGASDEFREVMRNFDRQALHATMLRLYHPISGIEMEWHAELPDDMVKLVDVMKADIETFKDEMDW

SEQ ID NO: 6289 - protein, 244 aa, Xenorhabdus bovienii
  Coding DNA sequence: Name=SeqID_181
  Gene classification: Gene name=NrfG; Function=TPR-repeat-containing proteins; Function class=R General function prediction only
  Homolog annotation: Query=2..242bp; Hit=1..241bp; Blast score=335; Percent Identity=70.0; E value=4e-92; Homolog= yfiO COG0457
VMIRMKYLVAAATLSMVLSGCSNNKDAVPDIPQSQIYSAGQKHLQEGNYKGAIKQLESLDNRYPFGPYSQQTQLDLIYAYYKSAEFPMALASIDRFMRLNPTHPNIDYVIYLRALISQALDDSTLQSFFGIDRSDRDPEHARASFRDFNLLVSRYPNSQYTSDAAKRLVFLKERLAKYELAVVKYYTKRSAYVAVVSRVEQMLRDYPDTQATREALPYMEASYKKLGLMAEADKVAKLIAANPV

SEQ ID NO: 6290 - protein, 110 aa, Xenorhabdus bovienii
  Coding DNA sequence: Name=SeqID_182
  Gene classification: Function=Ribosome-associated protein Y (PSrp-1); Function class=J Translation, ribosomal structure and biogenesis
  Homolog annotation: Query=1..110bp; Hit=1..110bp; Blast score=156; Percent Identity=76.0; E value=4e-39; Homolog= yfiA COG1544
MLVNITSKQMEITPAIRSHVEDRLNKLNKWQVNLINPHIVLTKEPQGFLVDATIGIPNNTLVASAKHEDMYAAINELLTKLERQLNKVQHKGEARRADHSVKDSNFDVEV

SEQ ID NO: 6291 - protein, 384 aa, Xenorhabdus bovienii
  Coding DNA sequence: Name=SeqID_183
  Gene classification: Gene name=PheA; Function=Prephenate dehydratase; Function class=E Amino acid transport and metabolism
  Homolog annotation: Query=109..383bp; Hit=1..275bp; Blast score=405; Percent Identity=68.0; E value=1e-113; Homolog= pheA_2 COG0077
MERKLVNIREEISSIDANLLDLLGKRRQLACDIAQTKLLEHRPVRDKDRERELLNVLINKGKTHGLDGFYITRLFQMIIEDSVLTQQALLQQHLNQTPYDSARITFLGPKGSYSHIAARQFSARHFNQLVECSCHKFPDIFSLVEIGQADYGILPLENTSSGAINDVYDLLQQTPLFLVGEITLPINHCLLIGTETDTSKIKTVYSHSQPFQQCNQYLNQFPHWKIVYCESTAAAMQKVAELNSSEVAALGSEAGGALYGLRVLENNLANQQNNSTRFIVVAKKPIDVSNQVPAKTTFIMSTGQQAGALVDTLIILKKHDIIMSKLESRPINGKPWEEMFYIDVEANLRSMKMQQALKELSEITRFLKVLGCYPSENVISIDPC

SEQ ID NO: 6292 - protein, 373 aa, Xenorhabdus bovienii
  Coding DNA sequence: Name=SeqID_184
  Gene classification: Gene name=TyrA; Function=Prephenate dehydrogenase; Function class=E Amino acid transport and metabolism
  Homolog annotation: Query=101..372bp; Hit=1..272bp; Blast score=409; Percent Identity=71.0; E value=1e-114; Homolog= ZtyrA_2 COG0287
MAAKLSQLREQIDGVDKALLVLLAKRMYLVAEVGEIKSQLGLPIYVPEREASMLASRRQEAEVMGIPPDLIEDILRRIMRESYVSENDKGFKKLSTHLMPIVIIGGSGKMGKLFSRLLTLSGYEVRVLESGDWDKAEHILADAGMVIVSVPIHQTEEVIRRLPPLPEQCVLVDLASIKQRPLKAMLDVHQGPVLGLHPMFGPDVGSFAKQVVVYCDGRQPEAYQWFLEQISVWGARLHQISAEQHDKNMSFIQALRHFTTFSYGRHLAKEDIDLQQLISLSSPIYRLELAMVGRLFAQDPQLYADIIMSSPENIELIRRYHQSFGQAIEILESQDKSAFIASFNQVNEWFGDEATRFMKESQSLLQQASDSRI

SEQ ID NO: 6293 - protein, 364 aa, Xenorhabdus bovienii
  Coding DNA sequence: Name=SeqID_185
  Gene classification: Gene name=AroG; Function=3-Deoxy-D-arabino -heptulosonate 7-phosphate (DAHP) synthase; Function class=E Amino acid transport and metabolism
  Homolog annotation: Query=3..356bp; Hit=1..354bp; Blast score=539; Percent Identity=72.0; E value=1e-153; Homolog= aroF COG0722
MIMQKDALNNVHILGEQIFITPEELKQKYPLSRNDLHAITNARNTIADIIQHRDPRLLVVCGPCSIHDVDSALDYARRLKVLSTELSDCLYIVMRVYFEKPRTTVGWKGLISDPHMDGSFDIDAGLHIARGLLMNLVKMGLPLANEALDLNNPQYLGDLFSWSAIGARTTESQTHREMASGLSVSVGFKNGTDGNLNTAINAMKAAAMPHCFMGINQSGQVCLLQTQGNPNGHVILRGGGEPNYSSEHVADCESQMIKAGLTPSLMIDCSHGNSNKDFRRQSIVVDSVAEQIMSGNRSIIGIMLESNIHEGNQPSEQPRSEMQYGVSVTDACINWQTTEQILRKLHQQIAPRFAKRNMMMEKAG

SEQ ID NO: 6294 - protein, 83 aa, Xenorhabdus bovienii
  Coding DNA sequence: Name=SeqID_186
  Homolog annotation: Query=1..83bp; Hit=14..106bp; Blast score=68; Percent Identity=46.0; E value=3e-11; Homolog= ref|NP_668233.1|
LIDARYADIELGLINDIRLFILAYVFGLKLGKLPVDVMLNILVVIGCASTWQTADGLSMFRSQSHHFFINAIYSCLHFIFGSG

SEQ ID NO: 6295 - protein, 117 aa, Xenorhabdus bovienii
  Coding DNA sequence: Name=SeqID_187
  Gene classification: Gene name=RplS; Function=Ribosomal protein L19; Function class=J Translation, ribosomal structure and biogenesis
  Homolog annotation: Query=1..115bp; Hit=1..115bp; Blast score=190; Percent Identity=97.0; E value=2e-49; Homolog= rplS COG0335
MSNIIKQIEQEQMKQDVPSFRPGDTVEVKVWVVEGSKKRLQTFEGVVIAIRNRGLHSAFTVRKISNGEGVERVFQTHSPVVDSISVKRRGAVRKAKLYYLRERSGKAARIKERLNAR

SEQ ID NO: 6296 - protein, 250 aa, Xenorhabdus bovienii
  Coding DNA sequence: Name=SeqID_188
  Gene classification: Gene name=TrmD; Function=tRNA-(guanine-N1) -methyltransferase; Function class=J Translation, ribosomal structure and biogenesis
  Homolog annotation: Query=1..247bp; Hit=1..247bp; Blast score=419; Percent Identity=86.0; E value=1e-117; Homolog= trmD COG0336
MWIGVISLFPEMFRAITDYGVTGRAVKNGLLSIECWSPRDFTYDRHRTVDDRPYGGGPGMLMMVQPLREAIYAAKAEAGVDAKVIYLSPQGRKLDQQGVCELAAHEELILVCGRYEGIDERVIQTEIDEEWSIGDYVLSGGELPAMTMIDSISRFIPGVLGRQASAEEDSFADGLLDCPHYTRPEVLDGMEVPPVLLSGNHAEINRWRMKQSLGRTWLRRPELLESLALTDEQRMLLSEFQQEYQDQATN

SEQ ID NO: 6297 - protein, 182 aa, Xenorhabdus bovienii
  Coding DNA sequence: Name=SeqID_189
  Gene classification: Gene name=RimM; Function=RimM protein, required for 16S rRNA processing; Function class=J Translation, ribosomal structure and biogenesis
  Homolog annotation: Query=1..182bp; Hit=4..185bp; Blast score=300; Percent Identity=76.0; E value=5e-82; Homolog= rimM COG0806
MSKQTGLEPPVDPIVLGKLGSAYGIRGWLRVFSSTERTEDIFEYQPWFIQRSGQWQHVELETWKYHNQDLIIKIKEIDDRDAANLFTNCEVVVDSTQLPELETDDYYWRDLMGCQVINIAGYNLGTINDMMETGSNDVMVVKANLKDAFGIKERLVPFLDGQVIKKVDLATKTIEVDWDPSF

SEQ ID NO: 6298 - protein, 85 aa, Xenorhabdus bovienii
  Coding DNA sequence: Name=SeqID_190
  Gene classification: Gene name=RpsP; Function=Ribosomal protein S16; Function class=J Translation, ribosomal structure and biogenesis
  Homolog annotation: Query=1..82bp; Hit=1..82bp; Blast score=121; Percent Identity=80.0; E value=1e-28; Homolog= rpsP COG0228
MVTIRLARGGAKKRPFYQVVVTDSRNARDGRFIERVGFFNPIASGKAEALRLDLDRIEHWVGLGASVSDRVSALIKDAKKSAEAA

SEQ ID NO: 6299 - protein, 166 aa, Xenorhabdus bovienii
  Coding DNA sequence: Name=SeqID_191
  Gene classification: Gene name=Ffh; Function=Signal recognition particle GTPase; Function class=N Cell motility and secretion
  Homolog annotation: Query=1..166bp; Hit=288..453bp; Blast score=232; Percent Identity=84.0; E value=1e-61; Homolog= ffh COG0541
DRIASRILGMGDVLSLIEEIESKVDRTQAEKLASKLKKGDGFDLNDFLDQLKQMRNMGGMTSMLSKMPGMSQIPDAVKSQMDDKVLVKMEAIINSMTRKEREKPEIIKGSRKRRIASGSGTQVQDVNRLLKQFDEMQRMMKKMKKGGLAKMMKGMKGMLPPGFMGQ

SEQ ID NO: 6300 - protein, 159 aa, Xenorhabdus bovienii
  Coding DNA sequence: Name=SeqID_192
  Gene classification: Gene name=CyoB; Function=Heme/copper-type cytochrome/quinol oxidases, subunit 1; Function class=C Energy production and conversion
  Homolog annotation: Query=1..159bp; Hit=1..159bp; Blast score=233; Percent Identity=78.0; E value=4e-62; Homolog= cyoB COG0843
MWGKLTLDAIPLHEPIIVVTLIAILLGGLAVVGTLTYFRKWKWLWSEWLTSVDHKKIGIMYIVVAMVMMVRGFADAIMMRGQQALASAGEAGFLPPHHYDQVFTAHGVIMIFFMAMPFVVGLMNIVVPLQIGARDVAFPFLNSLSFWLFVVGVVLINLS

SEQ ID NO: 6301 - protein, 321 aa, Xenorhabdus bovienii
  Coding DNA sequence: Name=SeqID_193
  Gene classification: Gene name=CyoA; Function=Heme/copper-type cytochrome/quinol oxidases, subunit 2; Function class=C Energy production and conversion
  Homolog annotation: Query=1..320bp; Hit=1..304bp; Blast score=409; Percent Identity=63.0; E value=1e-114; Homolog= cyoA COG1622
MRLMKYKKTIGLSSLLAATLILSGCDMVLMNPKGAIGVEQKTLILTAFGLMLIVVIPAIVMAIIFALRYREANKSATYRPNWAHSNKIELVVWTVPILIIIVLATITWKTTQELDPYKPLDYEEKPVTIEVISLDWKWLFIYPEQGIATVNEIAFPTNVPVNFKITSDSVMNSFFIPQLGGQIYAMAGMQTKLHLIANTPDTYKGFSASYSGEGFSGMKFTATATPDRESFEQWVQKVKASPKTLDTVQAFNDLAEKSQNNPVEYFSRVKPKLFQETITKFMGDMKHGGMFGTASHGKTEHGEAADHNMNMSQPAHAGVEE

SEQ ID NO: 6302 - protein, 255 aa, Xenorhabdus bovienii
  Coding DNA sequence: Name=SeqID_194
  Homolog annotation: Query=9..255bp; Hit=4..253bp; Blast score=376; Percent Identity=84.0; E value=1e-103; Homolog= ref|NP_931079.1|
MKRHILTLTAVATALVSASASAEYQWGFANVSMNYLDWTKHTTQKTGQTSHKDDFAYLELEGGAGFSWGELYGFLDLENPFNSKTAQPGDNQRYTFKTTGRFYLGDTGFNLYGHVYGTYSLPGKANGGNFHEVNTLYGLGYNTTLAGVWFKPFVALHYVDQTFYSGNNGYVIGWVAGYDFQLWQEKFSITNWNEIELNRNQRYGNGGREGINGAVGLWWTPHPSFTTGIQYRYADNKLGEDFLQDGIVYSVKYNF

SEQ ID NO: 6303 - protein, 500 aa, Xenorhabdus bovienii
  Coding DNA sequence: Name=SeqID_195
  Gene classification: Gene name=ProP; Function=77 Permeases of the major facilitator superfamily; Function class=G Carbohydrate transport and metabolism
  Homolog annotation: Query=1..497bp; Hit=1..488bp; Blast score=539; Percent Identity=64.0; E value=1e-153; Homolog= ampG COG0477
MTNHYLNKLSRLRNYYILLLLGFASGLPLALTGGTLQAWMTVENLDIKTIGFFTLVGQAYVFKFLWAPAMDRYSPSFLGRRRGWMLVTQLLLIVSIATMAFLKPSEHLWWLAALAVSVAFFSASQDIIFDAYKTDLLSQEERGSGAAISVLGYRIAMLVSGGLALWLTTYIGWQNMYLIMAGMMLIGVYATLNAKEPKINTAPPKTLHQAVFEPLSDFFSRNNAWIILLLIVLYKLADAFALSLSTTFLIRGVGFTAAEVGMINKTLGLAATIVGALYGGYLMHKWSLFRALMIFGILQTVSNLGYWILAVTPKDIYVMGGAVFLENICGGMGTAAFVALLMTLCNKSFSATQFALLSALAAIGRVYVGPVAGWFAESHGWSMFYLFSIVIGLPGLWLLFICRKTLAYTEKNDSFISRTLFKGYYRIAFIIMLLAAFIFIIWLICSCLIIIISSMAHFIVLDELQKAISPVFSFSIAMGTVGLLLGGALDYLALRKTKFA

SEQ ID NO: 6304 - protein, 195 aa, Xenorhabdus bovienii
  Coding DNA sequence: Name=SeqID_196
  Gene classification: Function=Uncharacterized lipoprotein; Function class=M Cell envelope biogenesis, outer membrane
  Homolog annotation: Query=1..193bp; Hit=35..224bp; Blast score=216; Percent Identity=57.0; E value=2e-56; Homolog= ZyajG COG3056
MLKKIFTSLLALFFLAGLSGCANSGNTLAIQPKITLPPVDPTMKAITISISGVDHRQSQALAQVNRDARLVTLTPSRDLRFLLQEALEKQMVARGYMIGSPANANLQVVVNQLYANVKEGSLRHDISTKAEVSIIVYAQDGSQQIKNYRTSYNVQGPLSATNAKIADAVNTVLSDVIADMAQDSSVSTFIKQNVH

SEQ ID NO: 6305 - protein, 107 aa, Xenorhabdus bovienii
  Coding DNA sequence: Name=SeqID_197
  Gene classification: Gene name=BolA; Function=Stress-induced morphogen (activity unknown); Function class=T Signal transduction mechanisms
  Homolog annotation: Query=1..102bp; Hit=13..114bp; Blast score=139; Percent Identity=64.0; E value=6e-34; Homolog= bolA COG0271
MVRQEIEIKLQAAFKPSHLEVIDESYRHNVPAGSESHFKIIVISNEFVDQRVLSRHRSVYSVLAKELEEGVHALALHTYTEKEWAELGDTVLASPACRGGSTTTSGL

SEQ ID NO: 6306 - protein, 59 aa, Xenorhabdus bovienii
  Coding DNA sequence: Name=SeqID_198
MPEKLADYNTHQEPGRSYLKTENPCDQKRPETILKIQTQHYSDADSMSRELQTKAGNIR

SEQ ID NO: 6307 - protein, 434 aa, Xenorhabdus bovienii
  Coding DNA sequence: Name=SeqID_199
  Gene classification: Gene name=Tig; Function=FKBP-type peptidyl -prolyl cis-trans isomerase (trigger factor); Function class=O Posttranslational modification, protein turnover, chaperones
  Homolog annotation: Query=1..430bp; Hit=1..430bp; Blast score=631; Percent Identity=80.0; E value=0; Homolog= tig COG0544
MQVSVETTQGLGRRVSITVPAADIEKAISSELVNVAKKVRIDGFRKGKVPMNIVKQRYGASVLQDVLGDLMQRNFVNAIIENKINPAGAPSYKPEQFKDGEDFIYAVEFEVYPEIELKGLEEIEVEKPVVEVKDADVDAMLETLRKQQADWKETDEAAAAEDRVTVDFTGSVDGEEFEGGKSTDFVLAMGQGRMIPGFEEGVVGHKAGEEFTLDVTFPEDYHAENLKGKAATFAINLKKVEQRELPELTEEFIKRFGIADGTVDGLRAEVRKNMERELKNAVRSHIKTQVLDGLVNANEVEVPAAVIDGEIDVLRRQAAQRFGGNEKQALELPRELFEEQAKRRVVVGLLLGEVISSNELKVDEDRVNVLIEEMASAYEDPKEVIEYYSKNKEMLNNVRNIALEEQAVEFVLNKAKVSEKEAGFNDLMNQNQLA

SEQ ID NO: 6308 - protein, 207 aa, Xenorhabdus bovienii
  Coding DNA sequence: Name=SeqID_200
  Gene classification: Gene name=ClpP; Function=Protease subunit of ATP- dependent Clp proteases; Function class=N Cell motility and secretion
  Homolog annotation: Query=1..207bp; Hit=1..207bp; Blast score=368; Percent Identity=86.0; E value=1e-102; Homolog= clpP COG0740
MSYSGKQDQYAPNMSLVPMVVEQTARGERAFDIYSRLLKDRIIFLTGPVEDHMANLIVAQMLFLEAENPEKDINLYINSPGGVITAGMSIYDTMQFIKPDVSTICMGQACSMGAFLLTAGAKGKRFCLPNSRVMIHQPLGGFQGQATDIEIHAQEILKVKARMNELMAKHTGKPLEKIVEDTERDRFLSAAESVEYGLVDSIFTQRN

SEQ ID NO: 6309 - protein, 423 aa, Xenorhabdus bovienii
  Coding DNA sequence: Name=SeqID_201
  Gene classification: Gene name=ClpX; Function=ATP-dependent protease Clp, ATPase subunit; Function class=O Posttranslational modification, protein turnover, chaperones
  Homolog annotation: Query=1..423bp; Hit=1..424bp; Blast score=758; Percent Identity=91.0; E value=0; Homolog= clpX COG1219
MTDKRKDGSGKLLYCSFCGKSQHEVRKLIAGPSVYICDECVDLCNDIIREEIKELVPHRERSALPTPHEIRQHLDDYVIGQETAKKVLAVAVYNHYKRLRNGDTNNGVELGKSNILLIGPTGSGKTLLAETLARYLDVPFTMADATTLTEAGYVGEDVENIIQKLLQKCDYDVQKAQRGIVYIDEIDKISRKSDNPSITRDVSGEGVQQALLKLIEGTVAAVPPQGGRKHPQQEFLQVDTSKILFICGGAFAGLDKVISQRLNVSSGIGFSATVKGESEKATEGELLAQAEPEDLIKFGLIPEFIGRLPVVATLTELSEEALIQILQEPKNALTKQYQALFNLEGAELEFRKEALTAIAKKAMARKTGARGLRSIVEGVLLDTMYDLPSMEHVEKVVVDEAVVEEKSAPLLIYSKPDAQVSGE

SEQ ID NO: 6310 - protein, 572 aa, Xenorhabdus bovienii
  Coding DNA sequence: Name=SeqID_202
  Gene classification: Gene name=Lon; Function=ATP-dependent Lon protease, bacterial type; Function class=O Posttranslational modification, protein turnover, chaperones
  Homolog annotation: Query=1..571bp; Hit=1..571bp; Blast score=974; Percent Identity=90.0; E value=0; Homolog= lon COG0466
MNPERSERIEIPVLPLRDVVVYPHMVIPLFVGREKSIHCLEAAMDHDKQVMLVAQKEASTDEPGVNDLFSVGTVASVLQMLKLPDGTVKVLVEGLQRARITTLTDNGEYFYAQVEYLESPVVDEREQEVLVRTAINQFEGYVKLNKKIPPEVLTSLHSIEDLAKLADTIAAHMPLKINDKQTVLEMSDVVERIEYLIAMMESEIDLLQVEKRIRNRVKKQMEKSQREYYLNEQMKAIQKELGEMDDAPDEYETLRRKIEDAKMPKEAREKAEAELQKLKMMSPMSAEATVVRSYIDWMVQVPWVARSKVKKDLVKAQEVLDIDHYGLERVKERILEYLAVQSRVSKIKGPILCLVGPPGVGKTSLGRSIARATGRKYVRMALGGVRDEAEIRGHRRTYIGSMPGKLVQKMSKIGVKNPLFLLDEIDKMSSDMRGDPASALLEVLDPEQNVAFNDHYLEVDYDLSDVMFVATSNSMNIPAPLLDRMEVIRLSGYTEDEKLNIAKRHLLPKQIERNALKKGELAIDDGAILGIIRYYTREAGVRNLEREISKLCRKAVKTLLMDKQLKHIEINA

SEQ ID NO: 6311 - protein, 260 aa, Xenorhabdus bovienii
  Coding DNA sequence: Name=SeqID_203
  Gene classification: Gene name=DjlA; Function=DnaJ-domain-containing proteins 1; Function class=O Posttranslational modification, protein turnover, chaperones
  Homolog annotation: Query=2..260bp; Hit=7..271bp; Blast score=316; Percent Identity=67.0; E value=2e-86; Homolog= djlA COG1076
LIFGIASGAGFWGIAIGLLLGHVLDKVGMRNQRLSDKGPSRQALFFRSTFQILGHLTKAKGRVTETDIQLASQLMDRMQLHGDARVAAQQAFREGKQPRFPLRETLRQLRRACFGRFDLIRMFLEIQLQAAFSDGELHPNERIVLFVIAEELGISRAQFEQFLAMMEGGRHFGGQYQQHGRYQDHGQPRATLADACKVLGVKEHDDATTIKRAYRKLMSEHHPDKLVAKGLPPEMMDIAKQKAQSIQSAYDLIKKEKGFK

SEQ ID NO: 6312 - protein, 217 aa, Xenorhabdus bovienii
  Coding DNA sequence: Name=SeqID_204
  Gene classification: Gene name=RluA; Function=Pseudouridylate synthases, 23S RNA-specific; Function class=J Translation, ribosomal structure and biogenesis
  Homolog annotation: Query=2..217bp; Hit=3..219bp; Blast score=326; Percent Identity=76.0; E value=9e-90; Homolog= rluA COG0564
MLESYNPPTDPWLHVLYQDEHIMVVNKPSELLSVPGKAEDHKDSIMTRIQAEFPTAESVHRLDMATSGVMVVALTKAAERELKRQFREREPKKVYIARVWGKLEREKGLVDLPLICDWPNRPKQKVCFETGKSAQTEYQVLEYEAQATRVRLAPITGRSHQLRVHMLALGNPILGDRFYAHQQARELAPRLQLHAQELSITHPAYGTPMHFECKADF

SEQ ID NO: 6313 - protein, 969 aa, Xenorhabdus bovienii
  Coding DNA sequence: Name=SeqID_205
  Gene classification: Gene name=HepA; Function=Superfamily II DNA/RNA helicases, SNF2 family; Function class=K Transcription
  Homolog annotation: Query=1..969bp; Hit=1..968bp; Blast score=1505; Percent Identity=75.0; E value=0; Homolog= hepA COG0553
MPFTLGQRWISDTESELGLGTVVALDTRMVTLLFPASGENRLYARNDSPITRVMFNAGDTLTSHEGWKLKVDEVQQDNGLLIYIGTRLDTEEENITLREVFLDSKLTFNKPQDRLFAGQIDRMDRFALRFRARKHQSEQFRLAESGLRGIRASLIPHQLHIANEVGKRHAPRVLLADEVGLGKTIEAGMVIHQQLMAGRTERVLVIVPESLQHQWLVEMLRRFNLRFSLFDDGRYSEALHDSDNPFETEQLIICSLDFVRRNKQRFEHLLEASWDLMVVDEAHHLEWSEKAPSREYQVIEELAEQIPSVLLLTATPEQLGQESHFARLRLLDPNRFHDYQVFIDEQQKYRPVADAVTLLLSGETLNNDQQNLIVELISEQDIEPLLKAANSHQDEESEKARRELVAMLMDRHGTSRLLFRNTRGGVKGFPHRELHEIKLPLPAQYQTAIKVSEIMGAKKSVEARAKDMLYPERIYQEFEGENATWWNFDPRVEWLLGFLLANRDEKVLVICAKAETALQLEQVLREREGIRSAVFHEGLSLLERDRAAAYFASEDEGAQVLLCSEIGSEGRNFQFANQLVMFDLPFNPDLLEQRIGRLDRIGQSRNIKISIPYLENTAQSILLRWYHEGLNAFEQTCPTGRPIYDKYYETLVNFLAKPNEQAGFTPFITECREHHEQLRQQLEQGRDRLLEMNSNGGEQGQKLAETIAAQDNDTDLVSFALNLFDIIGINQEDRSDNIITLNPSDHMLVPDFPGLPVDGCSITFDREKALSREDTQFLSWEHPIIRNGLDLILSGDTGSCAVSILKNKALPVGTLLVELIYVVEAQAPKHLQLTRFLPPTPVRLLMDLKGTNLAPQVEFESFNRQLNAINRHNASKLVSAVQKEVHAILQQSEPLVEQQAREVIEKAKKEADNVLSAELSRLEALKAVNPNIRDDELEAVESEHKHLLLNLDQANWRLDAIRLVVVSHQ

SEQ ID NO: 6314 - protein, 781 aa, Xenorhabdus bovienii
  Coding DNA sequence: Name=SeqID_206
  Gene classification: Gene name=PolB; Function=DNA polymerase elongation subunit (family B); Function class=L DNA replication, recombination and repair
  Homolog annotation: Query=7..776bp; Hit=3..780bp; Blast score=1058; Percent Identity=66.0; E value=0; Homolog= polB COG0417
MQTKHVEQGFILTRHWKDTPSGIELVYWLATDQGARRITISHQKAVAFIPQHDLQKAKRIIGQEQRCEFKPVPLKDFNRQPVTALYCLQYRQLQQLEKALKEQDIPLYETDIRPPDRFMMERFITAPVWFNQKPDGSYQMKPNPTYRPKLKWVSLDIETSQHGELYSIGLAGCGEQTVFMLGPENGGRQDRDFKLEYVASRPQMLEKLNEWIAFYDPDAIIGWSLIQFDLKVLQKHAERYNVPLKLGRHHGLLEWREHGFKPGHFFASAEGRLIIDGIDALKTATWNFPSFSLESVAQALLGEGKAIDSPYDRMDEINRRFQEDKPALAHYNLQDCILVNRIFDKTDLMTFLLERATVTGLAVDRSGGSVAAFTHLYLPRMHRIGYVAPVHATDSGDSPGGFVMDSFPGLYDSVLVLDYKSLYPSIIRTFLIDPVGMVEGLAQPDSEHAIPGFRQAFFSRTQHCLPDIVTQIWHERDKAKKQQNAPLSQALKIIMNAFYGVLGASGCHFFDPRLTSSITLRGHQIMHQTRELIESQGYQVIYGDTDSTFIWLKHPHSEAEAGQIGHSLAQFVNQWWQSHLKTQFNLESTLELEFETHYRRFLMPTVRGTEQGSKKRYAGLSGDKMIFKGLETIRTDWTPLAQIFQNELYTLIFHQKPYQDYIRDYVANTLAGKFDDRLIYRKQLRRKLSDYQRNVPPHVRAARLADEYNQLNNRPLQYQNGGWISYLITQSGPEPLEDQTTLPDYEHYINKQLMPIADAILPFLQDNFMTLLTGQMRISFE

SEQ ID NO: 6315 - protein, 470 aa, Xenorhabdus bovienii
  Coding DNA sequence: Name=SeqID_207
  Homolog annotation: Query=5..468bp; Hit=4..459bp; Blast score=338; Percent Identity=41.0; E value=1e-91; Homolog= gb|AAN52497.1|
MKNELSKKQSELLASFNKEELLEIIHALIRNNELAQTTLVSGYLLESEDILKLIEKEYKKRSKSKRFFDYYETDIFFGELHSYMATLFDTIIPLKPAESEVLLSNMLQDFERLSETKDTSSGGWQDYYYYLVESWIKALSLQKDIDKVTVANKLFNIFQGEYYFSVSLLAEYKSTLGLDILRQLRDIFYQHKNDDEALELSSSIKDIEFFKTYLDKEKEFLYPRYYLDYAELLIEDVRSDEAIVLLENLREKNNKLPVELNDDKIMELLIKANIEEGKKEEARQLCIDAFKEYYNHRFYELYENTLDKDEKGSAIKLFLDIANQYEENRFFYLLFLIEVEKFDVINDYVLNLGKDNIIKITDSIIPSTARKVSSLLYKSGFPLSATLVRRALVEDVLGRGASKYYKYAVSDLKKSLDYGEKIQSTDDIASNQTYLTALYAKHKKKASFWSLAEEKIKGVSMDKDGAYYGK

SEQ ID NO: 6316 - protein, 457 aa, Xenorhabdus bovienii
  Coding DNA sequence: Name=SeqID_208
  Gene classification: Gene name=NorM; Function=Na+-driven multidrug efflux pump; Function class=Q Secondary metabolites biosynthesis, transport and catabolism
  Homolog annotation: Query=1..456bp; Hit=1..456bp; Blast score=550; Percent Identity=65.0; E value=1e-156; Homolog= ZydhE COG0534
VQKYLNEARSLLALGIPIIIAQFSQTAMGFVDTVMAGKAGAVEMSAVAVGTSIWLPTILFGQGLLMALTPIVAHMNGSGQRKNVAVQIQQGFWLATFLSILVIAVLYNCRFIIEAQHNVDPVLAQKAINFIHAIMWGAPGYLFYQTLRGQCEGLSKTKPAMIIGIMGLLVNIPVNYIFIYGKFGAPELGGVGCGVATATVYWVMFLLLLAYVKHTPSQKDIHTFDNFTGPNWRTQKRIVLLGLPIALALFFEVTLFAVVSLLVSPLGVAAVAGHQIALNFSSMMFMFPLSFGIAATIRVGYNLGKKSTEGAKISAYTSLAVGLMIACMTAAFTTLFREPIALMYNDNYEVVTLASHLMLFAAIYQISDSVQVIGSGVLRGYKDTRSVFFITFIAYWILGLPSGYILALTHYVTEPMGPQGFWIGFIIGLTAAAVMVGLRILWLQKQPTHFVLERSTH

SEQ ID NO: 6317 - protein, 214 aa, Xenorhabdus bovienii
  Coding DNA sequence: Name=SeqID_209
  Gene classification: Gene name=RibC; Function=Riboflavin synthase alpha chain; Function class=H Coenzyme metabolism
  Homolog annotation: Query=1..212bp; Hit=1..212bp; Blast score=315; Percent Identity=72.0; E value=2e-86; Homolog= ZribE COG0307
MFTGIIQGKAPIVAIDEKAHFRTHIVKFPAELLPGIETGASVSHNGCCLTVTNIDSDLISFDLMKETLRLTNLGDLNVGDLVNLERAAKFGDEIGGHLMSGHVITIAEIAKIFTSENNHEIWFRIHDKQLMKYILHKGFIGIDGISLTIGDVVNNRFCVHLIPETLERTTLGKKRLGQKVNIEIDTQTQAIVDTVERVMAQKEQEKVLSQTEEQ

SEQ ID NO: 6318 - protein, 383 aa, Xenorhabdus bovienii
  Coding DNA sequence: Name=SeqID_210
  Gene classification: Gene name=Cfa; Function=Cyclopropane fatty acid synthase and related methyltransferases; Function class=M Cell envelope biogenesis, outer membrane
  Homolog annotation: Query=1..383bp; Hit=1..382bp; Blast score=602; Percent Identity=73.0; E value=1e-172; Homolog= Zcfa COG2230
MSSSCIEDKKIITDPWHRIANELLQEADIEINGKRPFDIHVKNPNFYKRVLKEGSLGLGESYMDGWWDCEHLDVFFHKILRAGLEYRIPKNAKDILKVITARIFNLQSPKRAWVVGEEHYDLGNDLFTRMLDPYMQYSCGYWKDSNTLEEAQTSKLRLICEKLQLSSGMTLLDIGCGWGGLAAYAAKNYGASVTGVTISAEQQKYAQERCEDLDVKIILEDYRDLNLQFDRIVSVGMFEHVGPKNYANYFNIVRKNLKADGLFLLHTIGSNRDKLNVDSWINKYIFPNGCLPSVAKIAKASTGKFVMEDWHNFGADYDRTLIAWYEHFTASWSEIEHNYSPRFKRMFSYYLNACAGAFRARDIQLWQIMFSPRGIENGLRVPR

SEQ ID NO: 6319 - protein, 393 aa, Xenorhabdus bovienii
  Coding DNA sequence: Name=SeqID_211
  Gene classification: Gene name=ProP; Function=77 Permeases of the major facilitator superfamily; Function class=G Carbohydrate transport and metabolism
  Homolog annotation: Query=10..386bp; Hit=7..383bp; Blast score=397; Percent Identity=58.0; E value=1e-111; Homolog= ZydhC COG0477
MTTNNNSISFMFYLAGLSMLGYLAIDMYLPAFGVMKTELNTSESAISASLSIFLGGFAFAQLLWGQLSDRLGRKPVLIIGLSLFSISCLGMLWITDSTQLLVLRFFQAVGVCSAAVCWQALVVDRYDPERTKRVFAMIMPLVALSPALAPLVGAWLLSHVGWKIIFLVLMAVTLLLLIPTFFLTNKHKTIDTDSDKKGVSFFTLLKSPIFSGNVLIYAACSAGFFAWLTGSPTILADMGYDPTDIGLSYIPQTLAFMVGGYGCRILLEKIKSETVFPFLLAGYAVSMVIIYLISQFYEPSFMAILIPFCIMAAMNGASYPIAVANALSVYPKNSGKAAALQNALQLGLCFVASLIVSVFMKNPLLSTTTVMVSTVVLMAIGYWLQKQKYDKKD

SEQ ID NO: 6320 - protein, 302 aa, Xenorhabdus bovienii
  Coding DNA sequence: Name=SeqID_212
  Gene classification: Gene name=LysR; Function=Transcriptional regulator; Function class=K Transcription
  Homolog annotation: Query=1..301bp; Hit=1..301bp; Blast score=432; Percent Identity=69.0; E value=1e-121; Homolog= ydhB COG0583
MWSEYSLEVVDAVARTGSFSAAASELHRVPSAISYTVKQLEEWLAVPLFERRHRDVELTEAGGIFVKEARSVIKKMHHTRHQCQQVANGWRGQFSIAVDQVVKPERTLQLILDFYRHFPDIELLIYPEVFNGVWDALVDGRVDVAIGATRASPVGERYSFRDMGFMPWLCVASPAHELVSIAEKLNDDQMRAYSSLCLEDTSRSLPKRDTWALDNQRRLIVPDWDIGLACLMDGLCVGMVPKHRALPLIRSGKLIALELEQPLPDSPCCLAWSQKSHSPALSWLLDYLGDSETLNAEWLQED

SEQ ID NO: 6321 - protein, 341 aa, Xenorhabdus bovienii
  Coding DNA sequence: Name=SeqID_213
  Gene classification: Gene name=PurR; Function=Transcriptional regulators; Function class=K Transcription
  Homolog annotation: Query=1..341bp; Hit=1..341bp; Blast score=581; Percent Identity=80.0; E value=1e-166; Homolog= purR COG1609
MATIKDVAKRAGVSTTTVSHVINKTRFVAEDTKIAVWAAIKELNYSPSAVARSLKVNHTKSIGLLATSSEAPYFAEIIESVENSCYSKGYTLILCNSHNNLDKQKAYLAMLAQKRVDGLLVMCSEYPEQLLGMLEDYRNIPMVVMDWGESRGDFTDAIIDNAFHGGYLAGRYLIERGHRDIASIPGPLARNTGGGRHQGFLKALKEANIAIRNEWIVQGDFEPESGYQAMYKILNQKNRPTAVFCGGDVMAMGAICAADELGLRVPQDISIIGYDNIRNARYFTPALTTIHQPKERLGQMAFSALLDRIINKREDAQTIEVHPRLVERRSVADGPFIDYRR

SEQ ID NO: 6322 - protein, 192 aa, Xenorhabdus bovienii
  Coding DNA sequence: Name=SeqID_214
  Gene classification: Gene name=SodA; Function=Superoxide dismutase; Function class=P Inorganic ion transport and metabolism
  Homolog annotation: Query=1..192bp; Hit=1..192bp; Blast score=313; Percent Identity=80.0; E value=6e-86; Homolog= sodB COG0605
MSFELPALPYAKNALEPHISAETLEYHYGKHHNAYVVNLNNLIKDTEFAGKSLEEIIKTSEGGIFNNAAQVWNHTFYWNSLSPNGGGEPTGKVADAINSAFGSFAEFKQQFTDAALKNFGSGWTWLVKKADGSVAIVNTSNAATPLTSEDKPVLTVDVWEHAYYIDYRNARPQYLEHFWALVNWKFVEENLA

SEQ ID NO: 6323 - protein, 127 aa, Xenorhabdus bovienii
  Coding DNA sequence: Name=SeqID_215
  Gene classification: Function=Glutaredoxin-related proteins; Function class=O Posttranslational modification, protein turnover, chaperones
  Homolog annotation: Query=13..121bp; Hit=2..110bp; Blast score=196; Percent Identity=86.0; E value=3e-51; Homolog= ydhD COG0278
MSIEKNERPVEETTTIGKIERQIKENPILLYMKGSPKLPNCGFSAQAVQALSACGERFAYVDILQNPDIRAELPKYVNWPTFPQLWVDGELVGGCDIIIEMYQSGELQALIKDTADKYREQADCDSE

SEQ ID NO: 6324 - protein, 216 aa, Xenorhabdus bovienii
  Coding DNA sequence: Name=SeqID_216
  Gene classification: Gene name=DnaQ; Function=DNA polymerase III epsilon subunit and related 3'-5' exonucleases; Function class=L DNA replication, recombination and repair
  Homolog annotation: Query=1..213bp; Hit=1..213bp; Blast score=339; Percent Identity=75.0; E value=1e-93; Homolog= Zrnt COG0847
MSNKKDQNMLSGRFRGYYPVVIDVETGGFNAQTDALLEIAAITLKMDEEGWLVPADTLHFHIDPFEGANLDPAALAFTGIDPTNPLRGAVSEYTALHAIFKMIRKGMKDSNCNRAIIVAHNASFDHNFVMAAAERSSLKRNPFHPFATFDTAALSGLVLGQTILAKACITAEIPFDSNQAHSALYDTDRTALLFCELVNRWKRLGGWPLPSPDNES

SEQ ID NO: 6325 - protein, 135 aa, Xenorhabdus bovienii
  Coding DNA sequence: Name=SeqID_217
  Gene classification: Gene name=GloA; Function=Lactoylglutathione lyase and related lyases; Function class=E Amino acid transport and metabolism
  Homolog annotation: Query=1..135bp; Hit=1..135bp; Blast score=215; Percent Identity=76.0; E value=1e-56; Homolog= gloA COG0346
MRLLHTMIRVGNMQRSIDFYTQVMGMRLLRTSENPEYKYSLAFVGYTDESQGAVIELTYNWDVESYEMGTAFGHIALGVDDVAATCESIKLSGGNVTREAGPVKGGTTVIAFVEDPDGYKIELIENQSGSSALGN

SEQ ID NO: 6326 - protein, 320 aa, Xenorhabdus bovienii
  Coding DNA sequence: Name=SeqID_218
  Gene classification: Function=Transposase; Function class=L DNA replication, recombination and repair
  Homolog annotation: Query=7..315bp; Hit=3..313bp; Blast score=159; Percent Identity=34.0; E value=3e-39; Homolog= NMB1750 COG3547
MSDNIVVGIDIAKHKFDVAVWAGENHYKRKHFPNDLKGFDAFINWLKPASNYHFCMEATGIYGDPLALYLSDKGLLISVVNPVQIHAFGKAELLRNKTDKIDAKLIARYCASQHPPAWQPAPLCERQLLALVRHRNKLNEMLLTEENRLSVVDEVVCDSHAKIITLLKQELKDTELKLKKHIDDSPSLKKNKGLLESIPGIGERLSATLLAYIGDGSRFHHSGQVVAYAGLNPKLHESGQLKGRAHLSKQGSAELRKALYMPALAAISCNKVVKKQWEQLTARHKGGKVGVCAVMRKLLRLAYGVMKSGTLFNAEIPLAV

SEQ ID NO: 6327 - protein, 143 aa, Xenorhabdus bovienii
  Coding DNA sequence: Name=SeqID_219
  Gene classification: Gene name=MarR; Function=Transcriptional regulators; Function class=K Transcription
  Homolog annotation: Query=3..138bp; Hit=7..142bp; Blast score=174; Percent Identity=74.0; E value=3e-44; Homolog= slyA COG1846
LTLGSDLARLVRVWRALIDHRLKPLKLTQTHWVTLYNISQLPPEQSQIQLAKAIGIEQPSLVRTLDQLEEKQLITRHTCANDRRAKRIKLTEESETFIREVDSVIGSTRKDILEGITHDELILLASVIKKIEKNISQLHKQVI

SEQ ID NO: 6328 - protein, 157 aa, Xenorhabdus bovienii
  Coding DNA sequence: Name=SeqID_220
  Gene classification: Gene name=SlyB; Function=Outer membrane lipoprotein; Function class=M Cell envelope biogenesis, outer membrane
  Homolog annotation: Query=1..156bp; Hit=1..154bp; Blast score=122; Percent Identity=58.0; E value=1e-28; Homolog= slyB COG3133
MFKRFLVGAVVVTTLSGCADMGALSSDTYSIDQAKQVQNVTYGTILSVRPVYIKGAQAGNPNMLGLIGGAVLGGLLGNTVGDGTGQRLATAAGAIAGGVAGQGIEGAINKTKGVELDIRTDSGRNIVVVQKLDQVVFSKGQRVKIADGGNSTTVSPL

SEQ ID NO: 6329 - protein, 370 aa, Xenorhabdus bovienii
  Coding DNA sequence: Name=SeqID_221
  Gene classification: Function=Uncharacterized BCR; Function class=S Function unknown
  Homolog annotation: Query=1..369bp; Hit=1..369bp; Blast score=510; Percent Identity=69.0; E value=1e-144; Homolog= Z2654 COG2377
MKSGRYIGVMSGTSMDGVDVVLAAISDKVVAQQVSYSHPFPQELKQKLLSICQGQQTTLSMVGQFDYELGTLFAEAVKGLMDKAGLTASDITAVGCHGQTVWHEPDGEKPFTMQIGDNNRVAALTNITTVGDFRRRDMAYGGQGAPLVPAFHMAVLGHPTERRIILNIGGIANISALLPDSAVKGYDTGPGNMLMDAWIWRHKQLPYDKDAQWANEGTVNQRLLQKMIYDPYFARIAPKSTGREYFNMAWLEKQLADFPDVSSVDIQATLAELTAVSIAQQVVLSGGCERLLVCGGGARNPRVMSRLSALLPITEVATTDKYGLSGDDMEALAFAWLAFRTMSGLSGNLPSVTGADRETILGAIYPVASR

SEQ ID NO: 6330 - protein, 114 aa, Xenorhabdus bovienii
  Coding DNA sequence: Name=SeqID_222
  Gene classification: Gene name=PdxH; Function=Pyridoxamine phosphate oxidase; Function class=H Coenzyme metabolism
  Homolog annotation: Query=1..111bp; Hit=1..112bp; Blast score=155; Percent Identity=68.0; E value=5e-39; Homolog= pdxH COG0259
MSEHNETGIADLRREYIRGGLRRKDLTKEPIELFELWLKQACEAKLIDPTAMCIATVDEHGQPYQRIVLLKHFDARSLVFYTNLGSRKAKHLTQNNRISLHFPWYQLERQVSFL

SEQ ID NO: 6331 - protein, 151 aa, Xenorhabdus bovienii
  Coding DNA sequence: Name=SeqID_223
  Gene classification: Function=Predicted transcriptional regulator; Function class=K Transcription
  Homolog annotation: Query=1..130bp; Hit=29..158bp; Blast score=197; Percent Identity=74.0; E value=5e-51; Homolog= VC0747 COG1959
MLDVALHSQEGPVPLADISERQGISLSYLEQLFSRLRKNGLVSSVRGPGGGYLLGRDAGNIFVAEVISAVDESVDATRCQGREGCQGGDRCLTHTLWRDLSDRITSFLSSISLEELVKNQEVLDVADRQDSDKRRTPNGRPQETINVNLRA

SEQ ID NO: 6332 - protein, 404 aa, Xenorhabdus bovienii
  Coding DNA sequence: Name=SeqID_224
  Gene classification: Gene name=NifS (BS); Function=Cysteine sulfinate desulfinase/cysteine desulfurase and related enzymes; Function class =E Amino acid transport and metabolism
  Homolog annotation: Query=1..404bp; Hit=9..412bp; Blast score=731; Percent Identity=87.0; E value=0; Homolog= yfhO COG1104
MKLPIYLDYSATTPVDQRVAEKMMNHLTMDGVFGNPASRSHRFGWQAEEAVDIARNQIADLVGADPREIVLTSGATESDNLAIKGAAKFYQKKGKHIITCKTEHKAVLDTCRQLEREGFEVTYLAPMSNGMLDLKELEAAMRDDTILVSIMHVNNEIGVIQDIVTIGDICRSRGIMFHVDATQSVGKLPIDLSKLKVDLMSFSAHKLYGPMGIGALYVRRKPRARIEAQQHGGGHERGMRSGTLPVHQIVGMGEAYRIAKEVLETESERLHGLRLRLWNGIKDIEEVYLNGDLELGAPHILNVSFNYVEGESLMMSLKDLAVSSGSACTSASLEPSYVLRALGMNDELAHSSIRFSLGRFTTEEEIDYAIKLIHNAIGHLRDLSPLWEMFKQGVDISTIEWSHH

SEQ ID NO: 6333 - protein, 128 aa, Xenorhabdus bovienii
  Coding DNA sequence: Name=SeqID_225
  Gene classification: Gene name=IscU; Function=NifU homologs involved in Fe-S cluster formation; Function class=C Energy production and conversion
  Homolog annotation: Query=1..128bp; Hit=1..128bp; Blast score=222; Percent Identity=89.0; E value=8e-59; Homolog= iscU COG0822
MAYSDKVIDHYENPRNVGSFDSEDPSVGSGMVGAPACGDVMRLQIKVNNEGIIEDARFKTYGCGSAIASSSLVTEWMKGKSLEQAGAIKNTAIADELELPPVKIHCSILAEDAIKAAIADYKSKREAK

SEQ ID NO: 6334 - protein, 107 aa, Xenorhabdus bovienii
  Coding DNA sequence: Name=SeqID_226
  Gene classification: Gene name=IscA; Function=Uncharacterized ACR; Function class=S Function unknown
  Homolog annotation: Query=1..107bp; Hit=1..107bp; Blast score=172; Percent Identity=76.0; E value=6e-44; Homolog= PM0320 COG0316
MSISLTESAAQRILAFLDNRGKGVGLRLGVRTSGCSGMAYILEFADTVNEEDQVFEDKGVKVIVDGKSIVYLDGTELDFSKEGLNEGFKFNNPNVSSECGCGESFHV

SEQ ID NO: 6335 - protein, 173 aa, Xenorhabdus bovienii
  Coding DNA sequence: Name=SeqID_227
  Gene classification: Gene name=DjlA; Function=DnaJ-domain-containing proteins 1; Function class=O Posttranslational modification, protein turnover, chaperones
  Homolog annotation: Query=1..171bp; Hit=1..170bp; Blast score=162; Percent Identity=60.0; E value=2e-40; Homolog= hscB COG1076
MDYFTLFGLPVRYAIDREQLSIRYRELQRQFHPDRFANQPEREKAQALQQASIINDALYTLIHPLKRAEYMLSQQGFNLSGEQHTMQDTAFLMQQLELREELDAIEHSAEPEIALADFSSRLSKMIKTRSEQMEQQLDAAQWPIAADTVRKLRFLDKLQQQVEQLEERLLDDF

SEQ ID NO: 6336 - protein, 615 aa, Xenorhabdus bovienii
  Coding DNA sequence: Name=SeqID_228
  Gene classification: Gene name=DnaK; Function=Molecular chaperone; Function class=O Posttranslational modification, protein turnover, chaperones
  Homolog annotation: Query=1..615bp; Hit=1..616bp; Blast score=887; Percent Identity=79.0; E value=0; Homolog= hscA COG0443
MALLQISEPGLSAEPHQRRLAVGIDLGTTHSLVATVRSGQVETLADSENRHLLPSVVQYRKDETQVGWQARQQAASDPVNTVISVKRMMGRSLADIQQRYPNLPYQLQASENGLPLINTVAGLVDPIQVSSEILKSLAQRAEETLDGKLDGVVITVPAYFDDAQRQGTKDAARLAGLHVLRLLNEPTAAAIAYGLDSGQEGIIAVYDLGGGTFDVSVLRLSRGVFEVLATGGDTALGGDDFDLLLANWIREQAGISDSDHGLQRQLLDVATQAKIALSDADTAEISIAGWQGNITRAEFNELIISLVKRTLLACRRALKDASVTTGEVLQVVMVGGSTRVPLVRSMVGEFFDREPLTSIDPDRVVAVGAAIQADILVGNKPDSEMLLLDVIPLSLGLETMGGLIEKVIPRNTTIPVARAQEFTTFKDGQGAMSIHVVQGERELVNDCRSLARFTLRGIPPLPAGGAHIRVTFQVDADGLLSVSALEKSTGVEASIQVKPSYGLSDSEIARMLRDSMTNAQEDIQARKLAEQKVEAARVLESLTSALEKDADLLSQEEQAAIDAAVEVLIESAQGTSSDAIESAIKQLDKQTQEFAARRMDTSIRRALAGHSVDEI

SEQ ID NO: 6337 - protein, 111 aa, Xenorhabdus bovienii
  Coding DNA sequence: Name=SeqID_229
  Gene classification: Gene name=Fdx; Function=Ferredoxin; Function class=C Energy production and conversion
  Homolog annotation: Query=1..111bp; Hit=1..111bp; Blast score=185; Percent Identity=85.0; E value=9e-48; Homolog= fdx COG0633
MPKIVFLPHNELCPEGAVLEAKEGESILDVALRNGIEIEHACEKSCACTTCHCIVREGFDSLKESTELEDDMLDKAWGLEPESRLSCQAKVADEDLIVEIPKYSINHAREH

SEQ ID NO: 6338 - protein, 64 aa, Xenorhabdus bovienii
  Coding DNA sequence: Name=SeqID_230
  Gene classification: Function=Uncharacterized BCR; Function class=S Function unknown
  Homolog annotation: Query=1..64bp; Hit=3..66bp; Blast score=95; Percent Identity=79.0; E value=9e-21; Homolog= yfhJ COG2975
MKWADSRDIGEALYDKFPDVDPKTVRFTDLHQWVCELDGFDDDPQKSNEKILEAILLVWLDEFE

SEQ ID NO: 6339 - protein, 431 aa, Xenorhabdus bovienii
  Coding DNA sequence: Name=SeqID_231
  Gene classification: Gene name=PepB; Function=Leucyl aminopeptidase; Function class=E Amino acid transport and metabolism
  Homolog annotation: Query=4..428bp; Hit=32..456bp; Blast score=630; Percent Identity=72.0; E value=1e-180; Homolog= ZpepB COG0260
MTKQIMPITLSYEPANACWGEKALISSSEQGIIIHLEGNGKSGAIQRAGRKINGQGIHNVALTGEGWDLEKSWAFWQGFRGSKGLRTIEWPQLPAADKQELDNRIKFVDWVRDTINMPAEELGPEQLTQRAIDLLNGVAGDAISYRIIKGNDLREQGYVGVHTVGRGSSRDPVFLALDFNPTKEKNAPVFACLVGKGITFDSGGYSLKPSNSMDSMKSDMGGSATLTGALALAISRGLEQRVKLFLCIADNMVSSNAFKLGDIIRYRNGKTVEVMNTDAEGRLVLADGLIDASAEKAPLIIDAATLTGAAKMAVGNDYHSVFSFDDQLAADLLAAADAENELFWRLPLAEFHRSQLPSNFADLNNIASPSHTAGASTAAAFLSHFVENYKKGWVHIDCSATYRKSAVEQWAAGATGYGVRTIANLLLAKAK

SEQ ID NO: 6340 - protein, 143 aa, Xenorhabdus bovienii
  Coding DNA sequence: Name=SeqID_232
  Homolog annotation: Query=8..142bp; Hit=8..140bp; Blast score=183; Percent Identity=65.0; E value=4e-46; Homolog= ref|NP_930499.1|
MSLSNGSVATEMEVSSGSRITLSQPEEQPSQLIDALSGLFKQHKPVRRAFLVMAHDKSLDEKPNLLIGLELSDAPTDNEINALIQEAGEVACEYLTEDESVDFCLLNENERGISHYLIQHTQPFYQRKLGSWLRDTIPVVNRE

SEQ ID NO: 6341 - protein, 1667 aa, Xenorhabdus bovienii
  Coding DNA sequence: Name=SeqID_233
  Gene classification: Function=Large extracellular alpha-helical protein; Function class=R General function prediction only
  Homolog annotation: Query=2..1665bp; Hit=6..1651bp; Blast score=1854; Percent Identity=55.0; E value=0; Homolog= Z3787 COG2373
MLATLFTLFVLPGCDQSENPAKENTEERQASLSKSSDTANSHAKSAATSPENKQATAKKQEHQSSAQRYAGKDVTILDASDLQLDGASAMVVTFSVPLEPNQDFSQKLHLVDVKSGKLEGAWELSNNQMELRLRHLPPARELQLTVDEGVKGINERQLATAYEKKFKTAPITPTVGFASKGLLLPSKAAEGLPVLALNVDRVDVNFFRIKDEALPLFIADWQYSNNMNYWNSNELLKNTELVYTGRFDLNPTANTREKLLLPLSDIKELQREGVYLAVMQQAGKYTYSNPSTLFTLSDIGVSMHSYLNRVDVFTQSLEKGSSLKGVEIRLLDAKGQLLSKATTDSDGHATLEKNAKAKLLLAIQGGLTSMIDLTSPALDLSEFDIGGPQGYSKQFFVFGPRDLYRPGEMLIVNGLLRDADGRPLKPQPVKVDILKADNQVVRSFVWQPENELYQYRYPIPREAETGIWSLRFDLGDNTPRYYKFHVEDFMPERMALEIKGASNNQSVLKNENVNFAITGRYLYGAPAADNRLQGQLFLRPARDAVAKLPGYEFGSSKEEGLSRTLDEFDFTLNAEGKANLSVSEDEWKQVTSPVKVIVQASLLESGGRPVTRRAEQAVWPAEKLAGVRPLFNKKSIYNYRTGRDENRYNVDEDSLAEFEVVYADASGKKYATNDLRTRLIYERRDYYWRWSDSTGWDSGYDQKDLVMADNTIQIAENGTAKVSFPVEWGSYRIEVVNPQNQLVTSLNFWAGYSWQDNTGGTGAIRPDQVKMSLDKPAYKPGDKVKLHMVAPQEGKGYLLVESSDGPLWWQEIDVPEKGLDIDVSINQEWARHDLYLTAVIVRPGDKSRQATPKRAIGVLHLPLMDEGRKLNLTLNAPDKMRPNQDLTVKIKATSQQGQKLPKQVYVLLSAVDSGVLSITDFKTPDPYDAFFGRKRYSVDQYDVYGHLIEAEGRKANLRFGGDGDENALDRGGKKPLTEVKIIAEQAKPITLDANGEGEITLPIPDFNGELRLMAQAWGGEEFGHSERKIIVAAPVITQMSLPRFMAGGDQSQLALDLTNLTEQQQVLTVNFEAKGLIKLQDPISKKIILETGKRTTIQIPVKADYGFGQGEVFLTIDGLNLPDEKLKQYQNSWKIGVRPAHPAKTIQFADVIHQGQNWQLPQTATAGLVLDTLEGQLLLTSRPPLQIARYIRELYAYPYGCLEQTVSGLYPSLYSNEAELKKLGIDTQTDEKRRSAIDAGITHLLSMQRHDGAFSLWNRNGDEEFWLTAYATDFLFRATQQGYSVPADALKSANSRLLRYLQDKSVITDRYSGSRIETQFSVQAYAGLVLASQQKAPLSGLRQLYERHQQAGNGLSLVQLGIALKMMGDNTRSNEAVRLGVNKARQSGYGLGDYGSTIRDNALIVSLLTENKMLQKERDEKLLDLSNELSTRHYFSTQESNSLYLAGRYFIDASEQSWKAAINQQMPPLNRDSALTETLTAKQILEGIDISNRGDSTLYSRLNMVGYPLATPEPSSNVLKIKRTYLDLEGHYFPTERMRSGEMVVVKLEVDATQSVPDALVVDLLPAGLEIENQNLASSSASLSESATGLQDIVEGMQQANIRHMEYRDDRFVAAVAVQPHQTVTLLYLARAVAPGVYQVPAPQVESMYVPHWRAVGETNEKLEVVR

SEQ ID NO: 6342 - protein, 778 aa, Xenorhabdus bovienii
  Coding DNA sequence: Name=SeqID_234
  Gene classification: Gene name=MrcA; Function=Membrane carboxypeptidase (penicillin-binding protein); Function class=M Cell envelope biogenesis, outer membrane
  Homolog annotation: Query=17..778bp; Hit=19..770bp; Blast score=927; Percent Identity=60.0; E value=0; Homolog= pbpC COG0744
MRRLSSRIYLIALVILFTLLAAVWLADKIWPLPLHNVKMARVVVGEDGSPLWRFADNEGIWRYPVTLEQVSPEYIQALLTYEDRWFYKHPGINPVSLLRAAWQDIRAGKIVSGGSTISMQVARLIDPHPRTFTGKFRQIWRTLQLEWHYSKDQILEMYLNRAPFGGTLQGVGAASWAYLGKPPSELSPGESALLAVLPQAPSRLRPDRYPERAQAARDKVLQRLKQYNVWPAENVADIKEENVWLAPRQVPHLAPLLARRVANGNPQEVIQTTIDTGLQRQLEDMVLNWKYQLADKTSIGVLVVDHTDMAVKAYIGSVDLQDDSRFGHVDMISAWRSPGSTLKPFLYAMALDDGLIHGESLLQDVPRRFNDYRPGNFDSGFNGPVSASEALTRSLNLPAVQLLESYGAKRFTANLRNVGMVLRFPLGSEPNLSLILGGTAARMDELVSVYSAFARQGKVSPLRFTPQQRIRDRQLFSAGAAWIVRRIMAGEGRPKPDDSLSAEVPLAWKTGTSYGYRDAWAIGLNARYTIGVWVGRPDGTPVVGQFGYATAIPIMNQINGLLMENLRYSSQRIPVDPRPISVSQATICWPSGTMLTKEIIAKDISNCRQRRLSWILDNTIPPTLSAIGQEGTSGINERIWIDKNGLRVASDCPDARPETVALWPITLEAWLPAKERRSNRLPPINPQCPPLKTDEAPLLIVGVREGDILKRLPGKNTLDLRITTQGGNGQQWWFLNGEQVSVTKNNQSWVKTLSQPGKYQLSVLDLSGQISAINFVFK

SEQ ID NO: 6343 - protein, 407 aa, Xenorhabdus bovienii
  Coding DNA sequence: Name=SeqID_235
  Gene classification: Gene name=NagC; Function=Transcriptional regulators; Function class=K Transcription
  Homolog annotation: Query=7..405bp; Hit=6..404bp; Blast score=589; Percent Identity=73.0; E value=1e-168; Homolog= nagC COG1940
MSNHNAQKQIGNIDLVKQLNGAVVYRLIDQHGPISRIQIAEESQLAPASVTKITRQLLERGLIKEVEQQASTGGRRAISIITETHHFHTIGVRLGRHDATVALFNMSGKTLVEQHYSVPENTQQEVENRIISAIEDFIEKNQRRLRELIAISVILPGLVDPDEGVIRYMPHIKVDNWPLVKSLNNHFNISCFVGHDIRSLALAEHYFGATRNCEDSLLVRIHRGTGAGVIINKNILRNKRGNLGEIGHIQIEPLGERCHCGNFGCLETIVSNSAIETRVQHQLRQGFPSQLALNNCNIHAICLAANEGDPLAVEVIRQVGHYLGKGISIAINLFNPQKIVIAGDITEAEQVLLPAIQSCINTQVLKAFREDLPVVVSELNHCSAIGAFALTKRAMLNGVLLQHLLGG

SEQ ID NO: 6344 - protein, 387 aa, Xenorhabdus bovienii
  Coding DNA sequence: Name=SeqID_236
  Gene classification: Gene name=NagA; Function=N-acetylglucosamine-6 -phosphate deacetylase; Function class=G Carbohydrate transport and metabolism
  Homolog annotation: Query=1..384bp; Hit=1..379bp; Blast score=537; Percent Identity=67.0; E value=1e-152; Homolog= nagA COG1820
MYALTNCIIYTGYERLEKHAVIIADGLIQQVCPENELPKSIEKHDLHGANLSPGFIDLQVNGCGGVQFNERLENLTENTLNIMQKTNQRYGCTSFLPTLITSPDELMITAIEVMRSYLTKHPNQALGLHLEGPYINPIKKGTHNPAYIRKPTSEMVNYLCINADVITKITLAPEIVESKYIHQLTEAGIIVSAGHSNATYEEARHGFQQGISFSTHLYNAMPAISGRQPGLISAIYDSSEVYAGIICDGTHVSWPNIRNSKRLKTDKLILVTDAIVPAGLDPKTNTLEQFTFANKTIYYRNGLCVDENGTLSGSSITMIESVKNSVEYVGIALDETLRMVTLYPARAIGVDKRLGTIEPGKVANLTAFTHDFNICKTIVNGNEIELS

SEQ ID NO: 6345 - protein, 268 aa, Xenorhabdus bovienii
  Coding DNA sequence: Name=SeqID_237
  Gene classification: Gene name=NagB; Function=6 -phosphogluconolactonase/Glucosamine-6-phosphateisomerase/deaminase; Function class=G Carbohydrate transport and metabolism
  Homolog annotation: Query=1..261bp; Hit=1..261bp; Blast score=438; Percent Identity=75.0; E value=1e-123; Homolog= nagB COG0363
MRLIPLTNASDVGRWSAHYIVSKINAFNPTAEHPFVLGLPTGSTPLTTYRELIALYQAGKVSFRHVVTFNMDEYVGIPEDHPQSYHTFMQQNFFDHIDIPKENINLLNGNAADIDAECLRYENKIKAYGKIHLFMGGVGNDGHIAFNEPASSLSSRTRIKTLTIETRTANSRFFNNDVEQVPKYALTVGVGTLMDAEEVMILATGMNKALALQAAIEGNINHMWTVSCLQMHPKSIIVCDEPATMELKVKTVKYFRQLEADIFSEFAS

SEQ ID NO: 6346 - protein, 675 aa, Xenorhabdus bovienii
  Coding DNA sequence: Name=SeqID_238
  Gene classification: Gene name=PtsG; Function=Phosphotransferase system IIC components, glucose/maltose/N-acetylglucosamine-specific; Function class=G Carbohydrate transport and metabolism
  Homolog annotation: Query=1..393bp; Hit=1..393bp; Blast score=538; Percent Identity=70.0; E value=1e-153; Homolog= PM0876_1 COG1263
MNILSYLQRIGRALMVPVATLPAAAILVGIGYWIDPTGWGADNALAALLITSGNAILNNMGMLFAIGLAYGMSKDKDGAAALAGLIGFIVVINLCAPASIAMIKSMPIDEVPKAFGKINNQFVGILVGVLSAELYNRYSSVELPQALSFFSGRRLVPILNSFLMILVSFILMFIWPVVYDWLVAFGESIMNLGSSGAGLYAFFNRLLIPVGLHHALNSVFWFDVAGINDIPNFLGGQKSIEAGTAITGITGRYQAGFFPIMMFGLPGAALAIYHCARPENKAKVAGIMMAGAIAAFFTGVTEPLEFSFMFVAPVLYVLHAILTGISVYIAATMEWIAGFGFSAGFVDMLLSSRNPLAVKWYMLIPQGLVFFCLYYVVFRFTIKKFNLMTPGRELSATDETDGYDVDTAKQGKNVVNNIQEEARQYIAAVGGSDNLTGIDSCISRLRLSVKDSGLVNNRLTRHLGASGIIRLNKQNAQIIVGTRAELIASAMKEVLAKGPVAAITETQYSESDVQTKEDSQQTGIPILTLIAPVTGELVKLEDVPDEAFSSKLVGDGIAIKPTSDTVLAPIDGTVVKIFDTNHAVCIAADNGVEVIVHIGIDTVTLNGRGFERLIEEGVKVKAGEPLLKLDLDYLNTHAKSMISPVIISNIDDYFGIRMIAKDAVVAKESDLFQVI

SEQ ID NO: 6347 - protein, 283 aa, Xenorhabdus bovienii
  Coding DNA sequence: Name=SeqID_239
  Homolog annotation: Query=5..282bp; Hit=43..332bp; Blast score=139; Percent Identity=30.0; E value=6e-32; Homolog= ref|NP_630144.1|
MSEFLSEEKMGQYLKSWDDNGYIVIESAVSREQTQKTVDAIFYFLEMDKNDPVNFYNTDIRSRSGIDEMGRIPFYHHQTLWDNRQSQIIYSVYERIFGIKELLVSIDRVNMNPPVNDDWKYEGFIHWDIDVSKRPLESKIQGLLSLTDDDGNSGGFQCVPGFHKVIYEWLSKQPEGYNSRFPDTTGMKIVSIPLKAGDYVIFHGALPHGNKPNISDNPRLAQYFCCFPRTDLTEQQIAERIAAYKQGLPTTSITGKLFPVKKVNQQGTSSINLTELGELLLGS

SEQ ID NO: 6348 - protein, 248 aa, Xenorhabdus bovienii
  Coding DNA sequence: Name=SeqID_240
  Gene classification: Gene name=WcaA; Function=Glycosyltransferases involved in cell wall biogenesis; Function class=M Cell envelope biogenesis, outer membrane
  Homolog annotation: Query=2..238bp; Hit=67..312bp; Blast score=70; Percent Identity=25.0; E value=1e-12; Homolog= YPL227c COG0463
MHHGVNNIDVSIILPRYNESYLVIEKTIQRIKNIQEVLKVQVIIINDSNKNNFHDIDIIKVKKQYPDVEVVSNCGNYGKGYSIRRGVDLAKGRYIFYTDIDFPIKESDFFSAYQKIETSNVDLIIGERFSKNKSKANLYRKITSKFFLKIVNLLLNCKVSDSQCPFKMLRSDVAKEVFSKQKIKGYAFDAEIIYLTNRLSKKLYQFPVIWEDTRENWSFMRTFINYSIMILGIFSIKIYWIINDPKII

SEQ ID NO: 6349 - protein, 221 aa, Xenorhabdus bovienii
  Coding DNA sequence: Name=SeqID_241
  Gene classification: Function=Predicted phosphatase/phosphohexomutase; Function class=R General function prediction only
  Homolog annotation: Query=13..185bp; Hit=4..181bp; Blast score=115; Percent Identity=39.0; E value=3e-26; Homolog= ZyfbT COG0637
MKSGGVMEIFNIKAILFDMDGTLVQSLSEVEVVWSKWCEMHNISIKDVLDICHGVRSKDVILSIAPYLNVEEQIKLLDDLEIKYSATAKALPGAKEFLLSLGTCPWSVVTSASQRVAYHRMAICGLKIPDFIIGSDDVLNGKPYPDPYLMAAERLNIAAEDCLVFEDAHAGVQSALAAECKVIQIGGKEKMFDSVIGLINDWNEIKIAEMGINSFRVSMNL

SEQ ID NO: 6350 - protein, 374 aa, Xenorhabdus bovienii
  Coding DNA sequence: Name=SeqID_242
  Gene classification: Gene name=ProP; Function=77 Permeases of the major facilitator superfamily; Function class=G Carbohydrate transport and metabolism
  Homolog annotation: Query=10..365bp; Hit=20..374bp; Blast score=149; Percent Identity=30.0; E value=4e-36; Homolog= mlr3825 COG0477
MNNVISTRVVFLAAGMGIAAWAPLIPLVKADLNIDAGELGFLLLFLGFGSIVSMPITGFLTTLFGCRKVIISSGIFAIVSLPILILAPNVTQLGFMLFIFGASIGTVDVAMNIQAVEVEKNTNRNLMSGFHGFFSLGGIFGAAGVSILLYLNFSALAACLIISFILSVLFLFSFSGLISRHKNHGDSDSKKIVFPRGIIIVASLLCFLMGIIEGSVIDWSGVFLVSERNIDISFSGFGYAAFAAAMTIGRFMGDRVISKIGRGKVFFAGTLSIFIGFLIVVNVGTLNLSMIGFFFIGLGSSNIVPILCSISGTQKVMLPSHAVASIVTFGYFGIMIGPALIGFIAQSSGLETAFYILAIGALIMVANTKLIKKH

SEQ ID NO: 6351 - protein, 409 aa, Xenorhabdus bovienii
  Coding DNA sequence: Name=SeqID_243
  Gene classification: Gene name=WecE; Function=Predicted pyridoxal phosphate-dependent enzyme apparently involved in regulation of cell wall biogenesis; Function class=M Cell envelope biogenesis, outer membrane
  Homolog annotation: Query=6..403bp; Hit=9..386bp; Blast score=244; Percent Identity=36.0; E value=1e-64; Homolog= NMB1821 COG0399
MNFPQWPSFTEKTLKDIQEPLLSGQVNYWTGKKGMEFENKFAHWIGAEMAISCNSGTSAVNIAVGALNIGPGDEVIVPSYTFIATSFAVLQCGAIPVFCDTTEEHTIDPTKIEALITPRTKAIIVVHLYGVVSDMDPIMEIARQHNLKVIEDSAQCLGGKYKGKSAGTIGDIGTFSFCQSKHFTTGGEGGMVVTNNTEIGWECRAYRDHGFDVRRKFDLLALEEVSWHVHNRIGYNYRMTEIQSIIGLNELERFDDWNMNNRKRYAKIYDEKFADIDLIHGLPLNNEDRCNAYWLYPIVFDLAKLDCTAEIILSDLKKIGIPAFKIQWPEAYGEKVFRELRGFGSANFPFHSKEYTSPESVNYRDVVCETARSLLPRTISLYLHPTWDEEHIVYCADQLIAVLNSHRVS

SEQ ID NO: 6352 - protein, 555 aa, Xenorhabdus bovienii
  Coding DNA sequence: Name=SeqID_244
  Gene classification: Gene name=GlnS; Function=Glutamyl- and glutaminyl-tRNA synthetases; Function class=J Translation, ribosomal structure and biogenesis
  Homolog annotation: Query=1..554bp; Hit=1..554bp; Blast score=996; Percent Identity=85.0; E value=0; Homolog= glnS COG0008
MSEADARPTNFIRQIIDEDLATGKHTSVHTRFPPEPNGYLHIGHAKSICLNFGIAQDYQGQCNLRFDDTNPVKEDIEYVESIKTDVQWLGFQWSDNIRYSSDYFDTLHQYAIELINKDLAYVDELSPEQIREYRGTLKEPGKNSPYRDRSVEENLALFEKMRAGEFAEGKACLRAKIDMASPFIVMRDPVIYRIKFAEHHQSGNKWCIYPMYDFTHCISDALEGITHSICTLEFQDNRRLYDWVLDNITIACHPRQYEFSRLNLEYTVMSKRKLNQLVTENIVNGWDDPRMPTISGLRRRGYTAAAIREFCRRIGVTKQDNNVEIAALESCIRDDLNENSPRAMAVLDPVKLVIENMPEGEVILTMPNHPNKPEMGSREVPFSREVYIDRADFREEANRQYKRLVLGKEVRLRNAYVIKAERVEKDAEGNITTIYCHYDEQTLNKDPADGRKVKGVIHWVSAVHAVPAEFYLYDRLFSVPNPGAEDDFLSTINSESLVVRKGFVEPGLVNAQPERTYQFEREGYFCADSGLSSAEHLVFNRTVGLRDTWTKISQE

SEQ ID NO: 6353 - protein, 893 aa, Xenorhabdus bovienii
  Coding DNA sequence: Name=SeqID_245
  Gene classification: Gene name=Chb; Function=N-acetyl-beta -hexosaminidase; Function class=G Carbohydrate transport and metabolism
  Homolog annotation: Query=7..890bp; Hit=4..883bp; Blast score=977; Percent Identity=53.0; E value=0; Homolog= VC2217 COG3525
MKSVKLRTLAALITTVGLMGCVHAEMTSQQIVDSLSQLKVNFKIKDNQAGAHGTDCAILGADGASCNRVHITLANGNQAIDSSDWAIYFHNIRQILKVDHEQYKITHITGDLHKLEPTEKFTGIKANEKILLPIFGEYWQIYSTDFMPRWYATSGDAMPKILANTDTEDLSAFLSDFTGDQWKRTTSDNNIQMTPETRFVKNQQMVKISEDKLRGQVIPTPKMLTIHSQDVNLSRGVKLELGGLSNASIDVIRERFASHNIKLTDNGYRIAAQINANKFTGNWRVQGAYSLNITTQGTQIVAFDQSGVFYGLQSLLSLLPANGDPTIATLTAKDAPRFEYRGIFLDVGRNFHSKEAVLRLLDQMSSYKLNKFHFHLSDDEGWRLEIPGLPELTEVGSKRCHDLSETQCLLPQLGSGPDSNNMGSGYFSRQDYIDILKYAKARQIEVIPEIDTPAHARAAVVSMEARYKNLMAQGKEQEANEYRLLDPTDTTNATSVQLYDRRSYLNPCMDSSKRFVDKIISEIALMHKEAELPLKTWHFGGDEAKNIRLGAGYQDKDGPIEPGKGIINKKIEDKPWAKSQACQKMIAQGIVKDVNELDSHFAIEVSKIVNTHGIDTMQAWQDGLKHVKSAKDFATKHVAVNFWDTLYWGGYDSANDWANKGYRVVVSSPDYVYLDMPYEVSPKERGYYWATRFNDEAKIFSFAPNNMPQNAETSVDRDGNHFNTQSNKHWPGAYGLSGQSWSETMRTDDQMEYMIYPRLLPLAERAWHQASWEQNYQQGREYKGGVTHYVDTNALNNDWIDFANLMGQHELAKLDKANIAYRLPVPGGRIVSGTLEANIALPGLGIQYSLDGGKTWEIYDDRQRPHVSSNVKVRSVSTDGKRFSRDEEVKITL

SEQ ID NO: 6354 - protein, 149 aa, Xenorhabdus bovienii
  Coding DNA sequence: Name=SeqID_246
  Gene classification: Gene name=Fur; Function=Fe2+/Zn2+ uptake regulation proteins; Function class=P Inorganic ion transport and metabolism
  Homolog annotation: Query=1..146bp; Hit=1..146bp; Blast score=239; Percent Identity=83.0; E value=8e-64; Homolog= fur COG0735
MTDNNKALKNAGLKVTLPRLKILEVLQDPECHHVSAEDLYKKLIDIGEEIGLATVYRVLNQFDDAGIVTRHNFEGGKSVFELTQQHHHDHLICLDCGKVIEFSDEFIEERQKDIAERYGIKLSNHSLYLYGHCTAGDCRKDSTMHDENS

SEQ ID NO: 6355 - protein, 104 aa, Xenorhabdus bovienii
  Coding DNA sequence: Name=SeqID_247
KKNDKLISVDVEGVKSIFDDKKFPIYTLFHSYIVGVEVLIFRKEFFGEESSSIYHGKTDRIIKICQKMSISIENNISYFSNKSIYIFKKSKELINKLTDEEIIK

SEQ ID NO: 6356 - protein, 265 aa, Xenorhabdus bovienii
  Coding DNA sequence: Name=SeqID_248
MTYKNFVLFNDIKEIINSKEYNSDITCNNNIINYIHKNKITKNIKDEIYYKVSLNGDIYIIEFNEEDTIDEAVILLEGIFGYPLTYKNRNNKKYEVIKNSKNPKWFFESNYSQPVHTDEGHEKKQPSILALYCKTISKIGGNNILVDTKSIYNFLLNKYGYKVEILFNNKCINLINKNENLTKSILSTIKENIGISFSPLINNFKCTQEVYAMLKDINKFIHDKENQYRFKLKKNQCVIFSNYLYLHSRTEFPKDSNRTLYRIWF

SEQ ID NO: 6357 - protein, 37 aa, Xenorhabdus bovienii
  Coding DNA sequence: Name=SeqID_249
MQENEVTKNNTDVIWSMLLLSLDNNPIKKKIDSGTAL

SEQ ID NO: 6358 - protein, 193 aa, Xenorhabdus bovienii
  Coding DNA sequence: Name=SeqID_250
MAYTAIILLVALNLFIRTNDNISHRITEKSFLPSFLLSPYFINLLYFIKNKKIFTINLIISVILSYLVCYIAYQQTPDRIIYITIIYLSFTLYIFTLFFYNIIHIEIKHLSYLVNFSSKRKFIFINYTLCLLLFIICGLYYIIMTKSTAILIFYYSGIYSLTALINLSRSQYTKLITLCVIVLFSCLGGYIYA

SEQ ID NO: 6359 - protein, 82 aa, Xenorhabdus bovienii
  Coding DNA sequence: Name=SeqID_251
MSLGTKKKLLLTSALMTDVDVYILDEPTNGLDVTSISFLKEKFNSLADQKIIIFSSHDENFLKDLNIHDYKIHENRISKTGS

SEQ ID NO: 6360 - protein, 711 aa, Xenorhabdus bovienii
  Coding DNA sequence: Name=SeqID_252
  Gene classification: Gene name=DinG; Function=Rad3-related DNA helicases; Function class=L DNA replication, recombination and repair
  Homolog annotation: Query=1..699bp; Hit=1..698bp; Blast score=908; Percent Identity=64.0; E value=0; Homolog= dinG COG1199
MALSSSIKNQISQWYKALSIHIDGFIPREPQRQMIAEVAKTLADEEGRHLVIEAPTGVGKTLSYLIPGIAVSRAEKKPLVVSTANVALQDQIYSKDLPLLRKLIPDLKFTGAFGRARYVCPRNLEAICAAEGEQIDLMLLVEDKTEIANSEERELCRRLRSDYTTFAWDGLRDHHQLALSDSLWAKISTDKMNCLARNCQFYHRCPFFLARREIENADVVVANHSLVIAALENESVLPDAKNLLLILDEGHHIPDVARDSLEVEGEITLFQLNGQLDTFVRHVEQYLLQFRPAKPPALANITRLQAHCEKIRECFKELADITQVLLPERREAAEYLFELGKLPENLLLCCQQLFKLTDGLRGLSEAILNDLTDQTAKQDIVRLHHAILQTSRTSGYFENMVKLWRLASQEESSHAPISKWLTRRYEKNQSHLYFHCAGIRVSEQLTQLLWRNIPHVVVTSATLRSLNSFSRIQELTGLHENYDDRFITLSSPFEHVRQGRIIIPQMTQEPTIQNEMQHLEEMARYFRSQVLMGAYRGMLVLFSSQRAMEGFLTFVKELRLMLLVQGDQPRYRLVETHCRRIDEGQPSVLIGLQSFAEGLDLKGDYLSQVHIHKIAFPPVTNPVIITESEWLKSLKRYPFEVQSLPSASFSLIQQVGRLIRSHECYGEVVIYDRRLLSKSYGSRLLNALPVFPIEQPDVPSEDELLQMKKGQ

SEQ ID NO: 6361 - protein, 51 aa, Xenorhabdus bovienii
  Coding DNA sequence: Name=SeqID_253
MKKILLIIIVLFSLGSIGGVFLAGLNMYTRSTTPVEEPQQSQQENAPIGQQ

SEQ ID NO: 6362 - protein, 279 aa, Xenorhabdus bovienii
  Coding DNA sequence: Name=SeqID_254
  Gene classification: Gene name=SseA; Function=Rhodanese-related sulfurtransferases; Function class=P Inorganic ion transport and metabolism
  Homolog annotation: Query=1..278bp; Hit=54..331bp; Blast score=261; Percent Identity=45.0; E value=8e-70; Homolog= sseA COG2897
MKNEYFVSPQWLNDHLHDENVVIVDASAPMPTQTIDYHQLWLDNHIPGAQFFNLDKIANLQTNLPHMLPEPEIFRQAVSAMGISENHLVIIYDQGNMFSAPRAWWTFKIFGTRNIRILEGGLQGWQQVGYSTESGEVTRQPQIFNSQFTPEKVCSQEQILDALHNKAPIQFIDARAEDRFQAKVPEPRPGLRMGHIPGSKNVPWTALIDNGSYKSPDEIAAIFKKQGVDLKQPMMTSCGSGMTAAVLVLGLDMIGHKEVGLYDGSWAEWGADDSLPLEK

SEQ ID NO: 6363 - protein, 82 aa, Xenorhabdus bovienii
  Coding DNA sequence: Name=SeqID_255
  Gene classification: Function=Predicted membrane proteins; Function class=S Function unknown
  Homolog annotation: Query=1..82bp; Hit=1..82bp; Blast score=75; Percent Identity=71.0; E value=1e-14; Homolog= yeaQ COG2261
MGILSWVIFGLIAGIIAKWVMPGDNSSGIIMTVILGIIGAVVGGYISTFFGMGKVDGFNLGSFAIAVVGAIVVLFVYHKISN

SEQ ID NO: 6364 - protein, 313 aa, Xenorhabdus bovienii
  Coding DNA sequence: Name=SeqID_256
  Gene classification: Function=Predicted TIM-barrel enzymes, possibly dehydrogenases, nifR3 family; Function class=R General function prediction only
  Homolog annotation: Query=1..309bp; Hit=1..309bp; Blast score=529; Percent Identity=80.0; E value=1e-150; Homolog= yohI COG0042
MRVLLAPMEGVLDHLVRELLSEVNDYDLCITEFLRVVDSLLPVKSFYRLCPELEHQSRTPSGTPVRVQLLGQYPEWLAENAVRAVELGSWGVDLNCGCPSKTVNGSGGGATLLKDPELIYRGAKAMRDAVPEELPVTVKVRLGWDTGDHKFEIADAVQQAGATELVVHGRTKEDGYKAERIDWQAIGEIRRRLAIPVIANGEIWDWHSAQECMKVTGCDAVMIGRGALNVPNLSRVIKYNEPRLPWNGVLQLLQKYTYLEKRGNTGMYHVARIKQWLGYLRKEYDEADELFMQIRALKTSAAISNIISSAAEA

SEQ ID NO: 6365 - protein, 452 aa, Xenorhabdus bovienii
  Coding DNA sequence: Name=SeqID_257
  Gene classification: Gene name=SrmB; Function=3 Superfamily II DNA and RNA helicases; Function class=L DNA replication, recombination and repair
  Homolog annotation: Query=1..389bp; Hit=1..389bp; Blast score=629; Percent Identity=83.0; E value=1e-180; Homolog= rhlE COG0513
MNFESLGLKADILRAVEEQGYVEPTPIQQQAIPVVLSGKDLLASAQTGTGKTAGFTLPILQLLSESPAQAKGRRPVRALILTPTRELAAQVGENVCNYSKYLRLRSLVVFGGVSINPQMMKLRGGVDILVATPGRLLDLEHQNAVDLSHVEILILDEADRMLDMGFIHDIRRVLSKLPAKRQNLLFSATFSDDIKSLANKLLRDPVSIEVARRNSASEQIDQAVHFVDKKRKGELLSHMIGNQNWQQVLVFTRTKHGANRLAEQLSQDGVTAAAIHGNKSQGARTRALADFKSGRIRALVATDIAARGLDIDQLPHVVNFELPNVAEDYVHRIGRTGRAEATGQAISLVCVDEHKLLHDIERLLKREIPRIAISGYDPDPSIKAEPILNGSNSRGSQRGNGRQSPSNQGSTKPSRSSQNRSSQGSAKQNSDRPRSKGAPSRQGWPRTSSKAN

SEQ ID NO: 6366 - protein, 225 aa, Xenorhabdus bovienii
  Coding DNA sequence: Name=SeqID_258
  Gene classification: Gene name=AcrR; Function=Transcriptional regulator; Function class=K Transcription
  Homolog annotation: Query=8..225bp; Hit=11..225bp; Blast score=189; Percent Identity=48.0; E value=2e-48; Homolog= ybiH COG1309
MAAKTTQTSRGEQAKQQLIESAIEIFGKSGLEGATTRNIAQHAKQNIAAISYYFGSKEGLYLAVAQFIADKLKSEFSPLVEAIDRFFVETSQPYPQAQILAFIHEGMTRYNCLIFETSSINLSRIMSHEQLTPTAAYSVIHEQGLAPVYSRLNKLIANYIGADECQISTQIHTHALLGEILSFRLAREALLRQTGWDNLGTKEYELINQVLSQHITLLLNGLRQK

SEQ ID NO: 6367 - protein, 330 aa, Xenorhabdus bovienii
  Coding DNA sequence: Name=SeqID_259
  Gene classification: Gene name=AcrA; Function=Membrane-fusion protein; Function class=Q Secondary metabolites biosynthesis, transport and catabolism
  Homolog annotation: Query=4..325bp; Hit=3..325bp; Blast score=323; Percent Identity=56.0; E value=1e-88; Homolog= ybhG COG0845
MNSKKFALFLLAIIVVIGAIVGIDYYQEQNDKELMLYGNVDVRTVNLGFRVAGKLAALQVDEGDAITAGQALGQLDNAPFINALNQAKATRDAAKATLAKTEAGYRTEEIAQVRAETTQKESAFRFADSFLKRQQGLWQRKMISDNELDNAKTGQHQTLAAYQAAKDKLRQFEAGYRKEEIAAAKAQLAQAEAAVAQAELNSQDTQLTSPSAGVILTRAIEPGTMLAAGNTVFTLSLTKPVWIRAYIDEPNLNQAIAGREIQIYTDGRKNQPYHGKIGFVSPTAEFTPKNVETPDLRTDLVYRLRIIVNDPDEGLKQGMPVTLRFTNSNK

SEQ ID NO: 6368 - protein, 578 aa, Xenorhabdus bovienii
  Coding DNA sequence: Name=SeqID_260
  Gene classification: Gene name=CcmA; Function=ABC-type multidrug transport system, ATPase component; Function class=Q Secondary metabolites biosynthesis, transport and catabolism
  Homolog annotation: Query=8..576bp; Hit=11..579bp; Blast score=824; Percent Identity=71.0; E value=0; Homolog= ZybhF COG1131
MTSSAYTIILNGVEKTFPGLEIPAVSHLNAEIQGGSVTGLVGPDGAGKTTLIRMLAGLLKPNNGNIKIMGLDPIKDSVEVRSELGYMPQKFGLYEDLTVLENLNLYAELRGVLREERKATFQKLLTFTDLTHFTGRLAGKLSGGMKQKLGLACTLLGSPKVLLLDEPGVGVDPIARQELWQMVHELASDGMLILWSTSYLDEAELCRDVLLLNRGELLYRGQPQKLTQNIVGRSFLLDVKQGSRRKILQHALTLPQVTDGVIQGRSVRLILKAGVDQSDLLQQIGLPDAKLFDAEPRFEDAFIDLLGGGPSHRSALAEIMPQIPTNPTETVIEARSLTKKFGDFAATDHVDFQVKRGEIFGLLGPNGAGKSTTFKMMCGLIIPTSGNALVLDMDLKTSSGKARQRLGYMAQKFSLYGNLTVAQNLKFFSGVYGLKGRHQREKMADMVNAFNLEPILHQTTDSLPLGFKQRLALACALMHEPDILFLDEPTSGVDPLTRREFWLHINGMVDKGVTVMVTTHFMDEAEYCDRIGLVFRGKLIAAGTPDELKQLVTTPERPNPSMEETFIDLVVNYDKEPQ

SEQ ID NO: 6369 - protein, 391 aa, Xenorhabdus bovienii
  Coding DNA sequence: Name=SeqID_261
  Gene classification: Function=ABC-type multidrug transport system, permease component; Function class=R General function prediction only
  Homolog annotation: Query=21..391bp; Hit=7..377bp; Blast score=504; Percent Identity=72.0; E value=1e-143; Homolog= ybhS COG0842
MSHPERIRPEYQGSHKAVSFSWRRLKALCIKESKQIVRDPSSALIAVVIPLMLLFIFGYGINLDSGKLHLGILMEQQSEDARELVHAFTGSPYIDATVSDNRQLLINKMQMGGVRGIIVIPVNFDVQLARIDGYAPIQVITDGSEPNTANFVQGYAKGVWQIWLQQRGQNRAVSTAPLIDIQIRYWFNPAAISQHFLIPGAISIIMTVVGAILTSLVVAREWERGTMEALLSTQVTRTELLLAKLLPYQVLGSFVMVLCMVFTVFVLGIPYRGSLWLLALISSLYLATALGMGLLISTVTRNQFNAAMIALNAAFLPAIMLSGFVFEIDSMPAFIQATTYVIPARYFVSSLQTLFLAGNIGTVLITNLLLLIASAIVFIGLTAWKTRRHLD

SEQ ID NO: 6370 - protein, 368 aa, Xenorhabdus bovienii
  Coding DNA sequence: Name=SeqID_262
  Gene classification: Function=ABC-type multidrug transport system, permease component; Function class=R General function prediction only
  Homolog annotation: Query=1..367bp; Hit=1..367bp; Blast score=503; Percent Identity=72.0; E value=1e-142; Homolog= ybhR COG0842
MFYSLYTLVIKELQSLLRNPQTRATLIVPVLFQMTLFPWAATLEVKNATIAIYNEDKGQASIELTQRLAKSKAFPDIILLTSSQEIRPTLDNRKALLLVRFPQNFSANIASQTPTSIQVLLDGRNSNSAQISANYIQQIVMNYQKELLGNSASLNNSDLIIRNWYNANLDYKWFVVPSLVAMITTIGVLIVTALSVAREREQGTLDQLLVAPLATWQIFLGKAIPALVVATTQASIVLLIGTLFYQIPFAGSLLLFYGCTLVYGLSLVGFGLLISAVCSTQQQAFIGVFVFMMPAILLSGYISPVENMPVWLQDITWVNPIRHFTDITKQIYLKGADFSVIWHSLWPLLVITVTTGGIAYRLFRSKIA

SEQ ID NO: 6371 - protein, 236 aa, Xenorhabdus bovienii
  Coding DNA sequence: Name=SeqID_263
  Gene classification: Function=Integral membrane protein, interacts with FtsH; Function class=R General function prediction only
  Homolog annotation: Query=1..236bp; Hit=1..234bp; Blast score=263; Percent Identity=70.0; E value=1e-70; Homolog= ybhL COG0670
MDRYQRSSGSIVQKAGSGVQTYMAQVYGWMTCGLLLTAFVAGYVANSPEILNAIFSSSIVFYGLIIAQLALVFVLSGLVHKMSGALATGLFMLYSMLTGLTLSSIFVIYTSGSIASTFVISAAMFGALSVYGYTTKRSLSGLGSFLFMGLIGIVLASLINLWLKSPALMWAITYIGVLVFAGLTAYDTQKLKEMGAELDVNDKENLRRYSITGALTLYLDFINLFLMLLRILGDRR

SEQ ID NO: 6372 - protein, 150 aa, Xenorhabdus bovienii
  Coding DNA sequence: Name=SeqID_264
  Gene classification: Gene name=MoaE; Function=Molybdopterin converting factor, large subunit; Function class=H Coenzyme metabolism
  Homolog annotation: Query=1..150bp; Hit=1..150bp; Blast score=221; Percent Identity=72.0; E value=2e-58; Homolog= moaE COG0314
MENTRVCVQREIFNVGDEYQWLSQCDDDGAVVTFMGKVRNHNLGDSVKALTLEHYPGMTEKMLQAIIDEARQRWPLQRISVIHRIGALYPGEEIVFVGVTSAHRSMAFAAAEFIMDYLKTRAPFWKKESLVEGERWVATRESDQEAAGRW

SEQ ID NO: 6373 - protein, 81 aa, Xenorhabdus bovienii
  Coding DNA sequence: Name=SeqID_265
  Gene classification: Gene name=MoaD; Function=Molybdopterin converting factor, small subunit; Function class=H Coenzyme metabolism
  Homolog annotation: Query=1..81bp; Hit=1..81bp; Blast score=113; Percent Identity=70.0; E value=4e-26; Homolog= ZmoaD COG1977
MIKVLFFAQVRELVGADSLELPHEYPTVADLRHSLIEKGERWALALEEGKLLAAVNQSFVHAEHPLKDGDEVAFFPPVTGG

SEQ ID NO: 6374 - protein, 159 aa, Xenorhabdus bovienii
  Coding DNA sequence: Name=SeqID_266
  Gene classification: Gene name=MoaC; Function=Molybdenum cofactor biosynthesis enzyme; Function class=H Coenzyme metabolism
  Homolog annotation: Query=1..157bp; Hit=1..157bp; Blast score=256; Percent Identity=87.0; E value=9e-69; Homolog= moaC COG0315
MSQLTHINTAGEAHMVDISAKAETVREARAEAFVEMQAETLAMIVAGDHHKGDVFATARIAGIQAAKRTWELIPLCHPLLLSKVEVQLEAQAEHHRVRIESCCRLTGKTGVEMEALTAASVAALTIYDMCKAVQKDMVIGPVRLLEKSGGKSGNFKVGS

SEQ ID NO: 6375 - protein, 326 aa, Xenorhabdus bovienii
  Coding DNA sequence: Name=SeqID_267
  Gene classification: Gene name=MoaA; Function=Molybdenum cofactor biosynthesis enzyme; Function class=H Coenzyme metabolism
  Homolog annotation: Query=3..326bp; Hit=4..329bp; Blast score=493; Percent Identity=73.0; E value=1e-140; Homolog= ZmoaA COG2896
VEQLVDAFARKFYYLRLSITDVCNFRCTYCLPDGYHPHGHQSFLFLPEIRRVSRAFAELGTEKIRLTGGEPTMRRDFCDIIATVHENPQIKKIAITTNGYRMERDVARWKEAGLTAINVSVDSLDPRQFHAITGQDKFFQIMRGIDAAFDAGFSGVKVNAVLMKNVNDTSLPVFLEWIKHRSIQLRFIELMETGEGSELFRRRHLSGEVIRRHLLQEGWQQQQRARSDGPAQVFSHPDYQGEIGLIMPYEKNFCQSCNRLRVSAIGNLHLCLFGEQGIPLRDLLSDDTLLDDLKLRIQGGLRHKRETHFLHQGDSGITPNLSFIGG

SEQ ID NO: 6376 - protein, 302 aa, Xenorhabdus bovienii
  Coding DNA sequence: Name=SeqID_268
  Gene classification: Function=Uncharacterized ACR; Function class=S Function unknown
  Homolog annotation: Query=1..302bp; Hit=1..302bp; Blast score=423; Percent Identity=74.0; E value=1e-119; Homolog= ZybhK COG0391
MRNRTLDDLDRVVALGGGHGLGRVMSSLSSLGARLSGIVTTTDNGGSTGRIRRAEGGIAWGDTRNCLNQLITEPTVASAMFEYRFSGNGELAGHNLGNLMLKALDHLSVRPLEAINLLRSLLKVNAHLIPMSEHPVDLMAVDDQGNMVYGEVNVDQLNCVPQELMLYPHVNTTKEALEAIERADLILIGPGSFFTSLMPLLLLEDLTQSLRRSNASMIYIGNLGKELSHAAAGLSLSDKLEMMESKIGRKMIDAIIVGPCTDISSLSDRIVAQQILEAQDIPYRHDRELLRQAIENTLQKLG

SEQ ID NO: 6377 - protein, 675 aa, Xenorhabdus bovienii
  Coding DNA sequence: Name=SeqID_269
  Gene classification: Gene name=UvrB; Function=Helicase subunit of the DNA excision repair complex; Function class=L DNA replication, recombination and repair
  Homolog annotation: Query=6..675bp; Hit=2..673bp; Blast score=1048; Percent Identity=83.0; E value=0; Homolog= uvrB COG0556
MSKETSKVFKLHSDFEPGGDQPEAIRKLQEGLEDGLAHQTLLGVTGSGKTFTIANVIANLNRPTMILAPNKTLAAQLYSEMKEFFPENSVEYFVSYYDYYQPEAYVPSSDTFIEKDASVNEHIEQMRLSATKALLERRDVVVVASVSAIYGLGDPDSYLKMMLHLTDGMLIDQRAILHRLAELQYTRNDQAFQRGTFRVRGEVIDIFPAESNEHALRVELFDDEVERLSLFDPLTGQIQYNVPRYTVYPKTHYVTPRERITQAMEDIKVELEQRRKMLLATDKLLEEQRITQRTQFDLEMMNELGYCSGIENYSRYLSGRAEGEPPPTLFDYLAADGLLVVDESHVTIPQIGGMYRGDRSRKETLVDYGFRLPSALDNRPLRFEEFEALAPQTIYVSATPGRYELEKSGNELVEQVVRPTGLIDPEIEVRPVATQVDDLLSEIRIRAEKNERVLVTTLTKRMAEDLTEYLEEHGERVRYLHSDIDTVERVEIIRDLRLGEFDVLVGINLLREGLDMPEVSLVAILDADKEGFLRSERSLIQTIGRAARHLHGKAILYGDRITDSMAKAIDETERRRAKQQAFNEEHGIVPKGLNKKIGDLLKIGQPAHGKGKAKGRGKASPDTDDYRKLSAKELENKIRELEEKMYQYARDLEFEQAANIRDQVQALRAQFIANS

SEQ ID NO: 6378 - protein, 227 aa, Xenorhabdus bovienii
  Coding DNA sequence: Name=SeqID_270
  Gene classification: Gene name=BioD; Function=Dethiobiotin synthetase; Function class=H Coenzyme metabolism
  Homolog annotation: Query=1..225bp; Hit=1..225bp; Blast score=312; Percent Identity=67.0; E value=2e-85; Homolog= bioD COG0132
VTNKYFLTGTDTEVGKTIVSCALLQAANKQGYQTAGYKPVASGSEITSEGIRNGDALALQRNSSVSLAYQEVNPLVFVEPTSPHIVSAELNQPIEFEVISQGLERLTAKSDWVLVEGAGGWYTPLSENTTFADWVIQEELPVILTVGVKLGCINHAVLTAKAIQHSGLRLAGWIANEIEPAGKRQTAYLETLERMIPAPLLGVIPHLSELSDNNNIGEYINIDLLVN

SEQ ID NO: 6379 - protein, 257 aa, Xenorhabdus bovienii
  Coding DNA sequence: Name=SeqID_271
  Gene classification: Gene name=SmtA; Function=SAM-dependent methyltransferases; Function class=Q Secondary metabolites biosynthesis, transport and catabolism
  Homolog annotation: Query=8..253bp; Hit=4..248bp; Blast score=196; Percent Identity=47.0; E value=2e-50; Homolog= ZbioC COG0500
MDLAVKAVDKQAIAGAFGRAASRYDTAAKLQQQTGEYLMELAQAENLGVRVLDAGCGTGFFSAHWKQRGKQVIALDLASGMLNHAQEQQVADYYLQGDIEHLGLADNSVDICFSNLAVQWCNELPCALQEFHRVTRPGGLILFSTLAQGSLYELEAAWRQVDTYRHINQFLPLQAITDACQAYRHKIISRQYCQYYPQLLPLLNSLKGIGATHLHHGRQHGLMTRKRLNTLAEAYPRNNEDYPLSYQIAFGVIYCDK

SEQ ID NO: 6380 - protein, 383 aa, Xenorhabdus bovienii
  Coding DNA sequence: Name=SeqID_272
  Gene classification: Gene name=BioF; Function=7-keto-8 -aminopelargonate synthetase and related enzymes; Function class=H Coenzyme metabolism
  Homolog annotation: Query=1..382bp; Hit=1..384bp; Blast score=434; Percent Identity=63.0; E value=1e-121; Homolog= ZbioF COG0156
MNWSDTISRRLTERRGTSLWRSRQVHLGSDGRLLHTSDGQYLNFSSNDYLGLSQHPQIIAAWQQGAEQYGVGSGGSGHVTGYTAVHHTLEQQLAEWLGYSRALLFISGYAANQGVIAALMEKDDRIIADRLSHASLIEAAMHSPAQFRRFLHNDPNSLKQHLVKDCAGKTLVVTEGIFSMDGDCAPLASLAQQTKSTGSWLMVDDAHGIGIHGEQGRGSCWAQNVKPEILIVTFGKAFGLSGAAVLCDEQTAEYLIQYSRHLIYSTSMPPAQAVALSEAVRQIKEGDELRQRLQNNIRYFRREAHHLPFTLMDSETAIQPLIIGDNERCIALSHVLRQQKVWVKSILPPTVPLESARLRIILTASHTQQDIEILLEALHGSGC

SEQ ID NO: 6381 - protein, 346 aa, Xenorhabdus bovienii
  Coding DNA sequence: Name=SeqID_273
  Gene classification: Gene name=BioB; Function=Biotin synthase and related enzymes; Function class=H Coenzyme metabolism
  Homolog annotation: Query=4..345bp; Hit=4..344bp; Blast score=572; Percent Identity=80.0; E value=1e-163; Homolog= bioB COG0502
VNERQQWTIKQAQALFDQPFFELLFQAQQVHREHFDPQQVQVSTLLSIKTGACPEDCKYCPQSSRYKTGLEKERLMEVEQVIESARKAKNAGSTRFCMGAAWKNPHERDMPYLETMVKEVKELGMETCMTLGMLNQTQAQRLAEAGLDYYNHNLDTSPEFYGNIITTRSYQDRLDTLGNVRDAGIKVCSGGIVGLGEQIRDRAALLVQLANLPKPPESVPINMLVKVKGTPLENNDDVDPFDFIRTIAVARIMMPASHVRLSAGREQMNEQTQAMCFMAGANSIFYGCKLLTTPNPNEDKDLQLFHRLGINPQQTQTAFGDNQQQQNLTEAIINNVDYEQFYNAAV

SEQ ID NO: 6382 - protein, 422 aa, Xenorhabdus bovienii
  Coding DNA sequence: Name=SeqID_274
  Gene classification: Gene name=BioA; Function=Adenosylmethionine-8 -amino-7-oxononanoateaminotransferase; Function class=H Coenzyme metabolism
  Homolog annotation: Query=1..421bp; Hit=1..421bp; Blast score=648; Percent Identity=74.0; E value=0; Homolog= bioA COG0161
MNPSDLEFDLRHIWHPYTSMTHPLPTYPVISAAGVELELSDGRRLIDGMSSWWAAIHGYNHPVLNEAAKSQIDRMSHVMFGGITHPPAIELCQQLVAMTPAALECVFLADSGSVAVEVALKMALQYWQAKGEKRHRFLTLRHGYHGDTFGAMSVCDPDNSMHNLYKGYLPNHLFADAPQSRFEGEWQPEDITSFRQLLLQHHNEIAAVILEPIVQGAGGMRIYHPEYLRQVRKLCDEYQILLIADEIATGFGRTGKLFACEHAQIEPDILCLGKALTGGYMTLSATLTTRHVAETISQGEAGCFMHGPTFMGNPLACAVASANLKLLSDNQWQQRTQSIESQLKAELLPLKSHTTVEDVRVLGAIGVVEMKQPVDMASLQRRFVQHGVWIRPFGRLIYLMPPYITRSEQLSKLTNAINDVII

SEQ ID NO: 6383 - protein, 190 aa, Xenorhabdus bovienii
  Coding DNA sequence: Name=SeqID_275
  Homolog annotation: Query=1..190bp; Hit=1..191bp; Blast score=178; Percent Identity=50.0; E value=4e-44; Homolog= gb|AAF04395.1|AF191556_3
MSDEKSIMPSNEEMQATFSLSKEMHEKEISHHSTVAREIPELAHLFVKNPNVISSTGYGAGLIEYISGSFNLNTFQQYGSYPFIQISSHSAIIGYAPNVGQRVKFNGYVNAGHTIPIINWNNFYFAGTVHNIRSIINVQLTIQLYINQQNIFIRLFDGNIYLGDLISVYRPNSIIPVPIVISGVGSFSLI

SEQ ID NO: 6384 - protein, 328 aa, Xenorhabdus bovienii
  Coding DNA sequence: Name=SeqID_276
  Gene classification: Function=3-carboxymuconate cyclase; Function class=G Carbohydrate transport and metabolism
  Homolog annotation: Query=1..327bp; Hit=1..330bp; Blast score=348; Percent Identity=53.0; E value=6e-96; Homolog= ybhE COG2706
MKQVVYTASPNSSQIHVWSLNIAGELSLLQTVNVPGEVQPMVVNPDGKHLYVGIRPQFSIVTYAIGSDGQLEQQAIAPLPGSPTHISTDRAGRFLYSASYGFNKLSVHPIDENGTAKAPVQIVEGLQAPHSANIDRENRQLLVPCLKEDHIRIFNLDEQGYLTENRADEISTVAGAGPRHMAFHPEKSAIYCINELDATVDVLRKWDKYRIVQSVDSLTANFSSVCWSADIHMTPDGRHLYTCERSESLISHFRVSEDGYYLTLVGNYPTESQPRGFAIDHSGSFLIASGQKSDHISVSRIDKYSGKLTQLARYPVGKGPMWVTVLAL

SEQ ID NO: 6385 - protein, 271 aa, Xenorhabdus bovienii
  Coding DNA sequence: Name=SeqID_277
  Gene classification: Gene name=Cof; Function=Predicted hydrolases of the HAD superfamily; Function class=R General function prediction only
  Homolog annotation: Query=1..271bp; Hit=1..272bp; Blast score=322; Percent Identity=57.0; E value=2e-88; Homolog= ybhA COG0561
MSYRVIALDLDGTVLDPQKRILPESLAALNEARQAGVKVLIVTGRHHVAIHPFYQALQLDTPAICCNGTYSYDYHAKKVLDSNPLSTQEAVQVLSYLQGTEIQHLMYVDDAILYQFHDTVSRTLAWSDSLPEHQRPNLQQTNSFQDAIYDVNFIWKFATSSPNVVKLREISEQIEEKVGLECEWSWVDQVDITKKGNSKGMRLKQWVESQGISMKEVIAFGDNFNDISMLETAGLGVAMENAADAVKERADIVTRDNTQPGIAEVIRKYVL

SEQ ID NO: 6386 - protein, 383 aa, Xenorhabdus bovienii
  Coding DNA sequence: Name=SeqID_278
  Gene classification: Gene name=CysA; Function=ABC-type sulfate/molybdate transport systems, ATPase component; Function class=P Inorganic ion transport and metabolism
  Homolog annotation: Query=30..379bp; Hit=1..350bp; Blast score=431; Percent Identity=64.0; E value=1e-121; Homolog= modC COG1118
MCDCYRAGIGFIDAFRVADPLGQKTSGGSMLELDFEQRLGNLHMQVDTTLPTESITAIFGLSGAGKTSLINVIAGLSRPQRGRIVLNGRILVDIEQKIFLPPEKRRMGYVFQDARLFPHYRVKGNLQYGMSPDMKPQFDNIIGLLGIEHLLSRFPMTLSGGEKQRVAIGRALLTAPEILLMDEPLASLDLPRKRELLPYLEKLSADVKIPILYVSHNLDEILRLADNVIVMDKGKIRATGTLEEVWSNSILRPWLQKESLSSILTVSVMEHHQRYHMTAVAIGDKALWLPKIDVAPGTDLRIRIDASDVSLVLEPPKASSIRNTLQVKVIEFFEYDGQVDVKLALREHFLWARITAWAREELNLRSGQWLYAQIKSVSLNQTF

SEQ ID NO: 6387 - protein, 232 aa, Xenorhabdus bovienii
  Coding DNA sequence: Name=SeqID_279
  Gene classification: Gene name=CysU; Function=ABC-type sulfate/molybdate transport systems, permease components; Function class=P Inorganic ion transport and metabolism
  Homolog annotation: Query=3..229bp; Hit=2..228bp; Blast score=275; Percent Identity=75.0; E value=4e-74; Homolog= modB COG0555
LEMLSEYEWQAILLSLKISGISVLFSLPLGILMAWVLARCQFFGKSLLDSIIHLPLVLPPVVVGYLLLLSMGRRGVIGEFLYDWFGVSFAFSWTGAALASAVVAFPLMVRAIRLALESIDRRLEQAARTLGASSLRVFFTITLPLSLPGVIVGAVLAFARSLGEFGATITFVSNIPGETRTIPLAMYTLIETPGAETAAARLCVIAIVLALVSLMLSEWLTRWGRKRLGAAC

SEQ ID NO: 6388 - protein, 256 aa, Xenorhabdus bovienii
  Coding DNA sequence: Name=SeqID_280
  Gene classification: Gene name=ModA; Function=ABC-type molybdate transport system, periplasmic component; Function class=P Inorganic ion transport and metabolism
  Homolog annotation: Query=1..254bp; Hit=1..255bp; Blast score=317; Percent Identity=64.0; E value=8e-87; Homolog= ZmodA COG0725
MKKSMYQLLTGAVVSFALVGNSWSAEKVTVFAAASLTNALNDIAAQYKKEQQGDIVASYASSSTLARQVEQGAPADIFISADQQWMDYAAGKKLIAENTRHTLLGNQLVLIAPKESKLDKIDIDRKTKWKSLLADGRLAVGDPDHVPVGIYAKESLQSLGAWEAVNPLMARTNNVRSGMALVERAEVPLGIVYGSDAVASKKVKVVGIFPSESHKPVEYPIAIIKGHENQAVRDFYDYLKTPEAAVIFKRYGFSPL

SEQ ID NO: 6389 - protein, 46 aa, Xenorhabdus bovienii
  Coding DNA sequence: Name=SeqID_281
MFELIGSMAFALIMVPVVMALILGLIYGLGEVFNVISKTGNTERQP

SEQ ID NO: 6390 - protein, 62 aa, Xenorhabdus bovienii
  Coding DNA sequence: Name=SeqID_282
MSDHNLAKKLTVQHSALFFLNGKTVLHDTGGDLAILDNKKVTVTDETCDSYGYPVKNSQIFA

SEQ ID NO: 6391 - protein, 263 aa, Xenorhabdus bovienii
  Coding DNA sequence: Name=SeqID_283
  Gene classification: Gene name=ModE; Function=N-terminal domain of molybdenum-binding protein; Function class=R General function prediction only
  Homolog annotation: Query=1..263bp; Hit=1..262bp; Blast score=290; Percent Identity=65.0; E value=1e-78; Homolog= modE COG2005
MQAEILLTLKLQQRLFADPRRIELLKQIKITGSISQGAKQAGISYKSAWDAINEMNHLADEVLVERATGGKGGGGAQLTHYGERLLQLYDLLERIQQKAFDALKEDSLPLDSLLAAISRFSLQSSARNQFFGTIVERDHENIQQHVRILLADGKTSISAALTEQSANRLKLVKGKEVLVLIKAPWITLSKEPVTATPFDNALSGQVSLIETGTEHSEVILTLDGGESLCVTLTNQEMERSGLQPNDFVTALFNADKVIIATLC

SEQ ID NO: 6392 - protein, 494 aa, Xenorhabdus bovienii
  Coding DNA sequence: Name=SeqID_284
  Gene classification: Gene name=ModF; Function=ABC-type molybdenum transport system, ATPase component/photorepair protein PhrA; Function class=P Inorganic ion transport and metabolism
  Homolog annotation: Query=1..484bp; Hit=1..484bp; Blast score=685; Percent Identity=68.0; E value=0; Homolog= modF COG1119
MSELQITQGSFRLSDTRTLRLPSLKIISGESWAFVGANGSGKSSLARALSDELIQLSGERYCSFNTPVRLSFEQLQQLINEEWQRNNTDLLSEGEEDTGRTAAEMIQLHHKDNELCLELAAYFGIKDLLSRRFKYLSTGEVRKVLLCQALMANPDLLILDQPFDGLDTYAQNQLSQLFGSLAAKGITLVLILTRFHEIPDFVEQIGVLADCHLALAGKKESILSESLVAQLAHSEALKDIRLPETDEYRADEQFPEDQPLVSMCNVVVQYNDKPILHGLSWQINPDEHWQIIGENGAGKSTLLNLITGDHPQGYNNELILFGRRRGSGETIWDIKRHIGYVSNSIHLEYRVSTCVRNVILSGFFDSIGLYQAVSDRQQQLADEWLALLGFSEAIANNPFHSLSWGQQRLVLIARALVKHPALLILDEPLQGLDPLNRQLVLRFIDIMIAKGDTQLLFVSHHQEDAPECITHRLKFIPDGNIYRYETEDISQQSL

SEQ ID NO: 6393 - protein, 275 aa, Xenorhabdus bovienii
  Coding DNA sequence: Name=SeqID_285
  Gene classification: Function=Predicted metal-dependent membrane protease; Function class=R General function prediction only
  Homolog annotation: Query=1..268bp; Hit=2..269bp; Blast score=204; Percent Identity=45.0; E value=9e-53; Homolog= Z1787 COG1266
MSWALLAVSLALLDTRRIIAFSIAFLALIIGISTNVLTFPAIAALIVIAGLGTAHVYLKKHPTSRIITEVLLLISVVLLFMHYIPGFNNLKYLDKVQVGPLSAPFSMYFNFDKALIPFILLFCMPSLFTRKPVVEAFPHVWAALIVAIPALLGLATELGGLAVELHLPSWFPAFVVANIFFVSLAEEALFRGYLQQKLSQWINPYLALVITSLIFGAAHFAGGSLLMIFATLAGLIYGLAWMWSGRLWVAVAFHVSLNLGHLLFFTYPVKSLLIQ

SEQ ID NO: 6394 - protein, 250 aa, Xenorhabdus bovienii
  Coding DNA sequence: Name=SeqID_286
  Gene classification: Gene name=GpmA; Function=Phosphoglycerate mutase 1; Function class=G Carbohydrate transport and metabolism
  Homolog annotation: Query=1..250bp; Hit=1..250bp; Blast score=404; Percent Identity=81.0; E value=1e-113; Homolog= gpmA COG0588
MAVTKLVLVRHGESEWNKENRFTGWTDVELSDKGRTEAQQAGQLLKQEGFVFDFAYTSVLKRAIHTLWNILDQVDQQWLPVEKNWKLNERHYGALQGLDKAETAAKYGDDQVKLWRRGFAITPPDLTKDDERYPGHDPRYANLKPEELPATESLAATIERVVPYWEDVIKPRVANGEKIIIAAHGNSLRALVKYLDGMSEEEILELNIPTAVPLVYEFDENMQPIKHYYLGNADEIAAKAAAVANQGKAK

SEQ ID NO: 6395 - protein, 350 aa, Xenorhabdus bovienii
  Coding DNA sequence: Name=SeqID_287
  Gene classification: Gene name=AroG; Function=3-Deoxy-D-arabino -heptulosonate 7-phosphate (DAHP) synthase; Function class=E Amino acid transport and metabolism
  Homolog annotation: Query=1..350bp; Hit=1..350bp; Blast score=601; Percent Identity=82.0; E value=1e-172; Homolog= aroG COG0722
MNYQNDDIRIRKITELLPPVALLEKFPATKNTATTVREAREAIHNVLTGEDDRLLVVIGPCSIHDPKAALEYAERLNKLREELKADLEIVMRVYFEKPRTTIGWKGLINDPNMDCSFDINDGLRTARKLLIDINDMGLPAAGEFLDMITPQYLADLMSWGAIGARTTESQVHRELASGLSCPVGFKNGTDGTIKVAIDAINAASSPHCFLSVTKWGHSAIVSTTGNQDCHIILRGGKEPNYSAEHVNVVKEELMKAGLAPRVMIDFSHANSSKQFKRQMDVNDDVCDQIARGENAIIGVMVESHLVEGSQNLDSDKPLVYGQSVTDACIGWDDTETLLRQLSQSVKARRG

SEQ ID NO: 6396 - protein, 234 aa, Xenorhabdus bovienii
  Coding DNA sequence: Name=SeqID_288
  Gene classification: Gene name=PnuC; Function=Nicotinamide mononucleotide transporter; Function class=H Coenzyme metabolism
  Homolog annotation: Query=1..234bp; Hit=1..234bp; Blast score=257; Percent Identity=67.0; E value=9e-69; Homolog= pnuC COG3201
MVFFSINSILVHIPLGAGGYDLSYIEAVGTIAGLLCIWLASQEKIINYLFGLINVSLFAVIFFQIQLYASLLLQIFFFAANIYGWYAWSRVNEQKQTELKIRWLNPKQTIIVAAVSIFAILIMMFNIDQIFGYMAKIAVLVLQGMGFNITMPALEPDAFPFWDSVMTVLSIVAMVLMTRKHVENWLVWVIVNVISVVIYFHQGVLAMSLQYIILTGIALNGARLWIKAAKPNGS

SEQ ID NO: 6397 - protein, 58 aa, Xenorhabdus bovienii
  Coding DNA sequence: Name=SeqID_289
MLRPSEKSVIYAAVGRECCQADLDGSLAQSVEQLTFNQLVAGSNPARPTILNFRSNTP

SEQ ID NO: 6398 - protein, 255 aa, Xenorhabdus bovienii
  Coding DNA sequence: Name=SeqID_290
  Gene classification: Function=Uncharacterized BCR; Function class=S Function unknown
  Homolog annotation: Query=1..255bp; Hit=1..263bp; Blast score=248; Percent Identity=60.0; E value=5e-66; Homolog= ybgF COG1729
MNSNFRRYVLGLSLLVGVAAPWAATAQAPISNVGSGSTDERLSQLERVSDAHSQLLTQLQQQLADSQRDIDTLRGQIQENQYQLNQVIERQKDIYQQLDKITNPSSGTEGDNTATPSAKTDGNPPAAPASTGSEKGDYDAAVALAINTKEYDKAISAFQKFVKAYPKSKYLSNTNYWLGQLNYNKGKKDDAAFYFATVVKDYPKSQKSSDSLYKVGLIMQEKGQKAKAKAVYQQVVKQYPGTNSAKMAEKKIAGM

SEQ ID NO: 6399 - protein, 167 aa, Xenorhabdus bovienii
  Coding DNA sequence: Name=SeqID_291
  Gene classification: Gene name=OmpA; Function=Outer membrane protein and related peptidoglycan-associated (lipo)proteins; Function class =M Cell envelope biogenesis, outer membrane
  Homolog annotation: Query=1..167bp; Hit=1..173bp; Blast score=237; Percent Identity=77.0; E value=3e-63; Homolog= pal COG2885
MQLNKVLKGLMLALPIMAVAACSTNKNGNNDQSGVGTVDNSAKAGLSAEELARQQMQELQNNNIVYFGFDKYDINSDFAQMLDAHAAFLRSNPSIKVTIEGHADERGTPEYNIALGERRANAVKMYLQGKGVSADQLAIVSYGKEKPAVLGHDEAAYAKNRRAVIVY

SEQ ID NO: 6400 - protein, 265 aa, Xenorhabdus bovienii
  Coding DNA sequence: Name=SeqID_292
  Gene classification: Gene name=TolB; Function=Periplasmic component of the Tol biopolymer transport system; Function class=N Cell motility and secretion
  Homolog annotation: Query=1..265bp; Hit=167..430bp; Blast score=446; Percent Identity=84.0; E value=1e-125; Homolog= tolB COG0823
LAYVVKKASVGKYPYELRVSDYDGYNQFTVHRSPEPLMSPAWLPDGSQLAYVTFESGRSALVIQTLATTAVRQVASFPRHNGAPAFSPDGTKLAFALSKTGSLNLYMMDLASGQIHQVTDGRSNNTEPSWMPDNQTLVYTSDQGGRPQLYKIDINGGAPQRLTWEGSQNQDADVSSDGSFIVMVSSASGSQHIAKQDLATGSVQILTDTFLDETPSIAPNGTMVIYSSTQGLGTVLQLVSTDGRFKARLPATDGQVKFPAWSPYL

SEQ ID NO: 6401 - protein, 184 aa, Xenorhabdus bovienii
  Coding DNA sequence: Name=SeqID_293
  Gene classification: Gene name=PaaY; Function=Carbonic anhydrases/acetyltransferases, isoleucine patch superfamily; Function class=R General function prediction only
  Homolog annotation: Query=1..176bp; Hit=73..248bp; Blast score=283; Percent Identity=76.0; E value=9e-77; Homolog= Z4650 COG0663
MSTVLRQYLNLCPQVGQRVMLDSSSIVIGDVRLANDVSIWPLVVIRGDVNYVSIGARTNIQDGSVLHVTHKSPDNPAGFPLIIGEEVTVGHKAMLHGCRIGNRVLVGIGSILLDGAIIEDDVVIGAGTLVPPGKKLESGYLYIGSPAKQVRKLKPEELEGLLYSANNYTYWKDNYLADTSEGKE

SEQ ID NO: 6402 - protein, 89 aa, Xenorhabdus bovienii
  Coding DNA sequence: Name=SeqID_294
  Homolog annotation: Query=1..84bp; Hit=1..85bp; Blast score=110; Percent Identity=64.0; E value=5e-24; Homolog= ref|NP_931852.1|
MNQAIQFPDREEWNEVESKVIFPAMVDGLLVQCMISSDELAERYGKDHHPLDLFHRHRWDLEEKFEAAILSGHGDQFGRYSLPSDVSAK

SEQ ID NO: 6403 - protein, 272 aa, Xenorhabdus bovienii
  Coding DNA sequence: Name=SeqID_295
  Gene classification: Gene name=AroE; Function=Shikimate 5 -dehydrogenase; Function class=E Amino acid transport and metabolism
  Homolog annotation: Query=1..272bp; Hit=1..272bp; Blast score=324; Percent Identity=60.0; E value=5e-89; Homolog= aroE COG0169
MDKFAVFGNPIAHSKSPYIHRLFADQTGIDHQYGRVLAPIEHFEQTLDRFFEQGGLGANITVPFKERAYQRSDELTERARISGAVNTLKLIEGNRLLGDNTDGIGLLADLQRLGFITKGRHILIIGAGGAAKGVLSLLLELGCAVTITNRTFERAQIIADKFSRLGDIQPIEMESLLSPDFDIIINATASGIDGQIPEVSPLIFRNDTACYDMYYQHGLTPFLDFARQNGISRLADGLGMLVGQAANAFELWHGVFPEIESVLTALRRELHA

SEQ ID NO: 6404 - protein, 189 aa, Xenorhabdus bovienii
  Coding DNA sequence: Name=SeqID_296
  Gene classification: Gene name=SUA5; Function=Putative translation factor (SUA5); Function class=J Translation, ribosomal structure and biogenesis
  Homolog annotation: Query=2..189bp; Hit=3..190bp; Blast score=262; Percent Identity=68.0; E value=1e-70; Homolog= ZyrdC COG0009
MSNKVSPAFDVIITALKEEKVIAYPTEAVFGLGCDPDSEKAVNELLSLKNRPWEKGLILIADSYERLCLYIDDEQLSDIQKETVFSFWPGPVTWVIPAKTTTPKWLTGQFSTLAVRVTEHPLVKQLCSLYGKPLVSTSANLSGLEPCRSAEEVRQQFGNRVPVLEGEVGGRKNPSEIRDALTGKLYRQG

SEQ ID NO: 6405 - protein, 255 aa, Xenorhabdus bovienii
  Coding DNA sequence: Name=SeqID_297
  Gene classification: Gene name=Smf; Function=Predicted Rossmann fold nucleotide-binding protein involved in DNA uptake; Function class=L DNA replication, recombination and repair
  Homolog annotation: Query=6..254bp; Hit=109..361bp; Blast score=288; Percent Identity=58.0; E value=4e-78; Homolog= Zsmf COG0758
VLSQKQVAMVGSRLASFYGEKWGKIFAGELAKNGVVITSGLAIGIDGICHQAALSAGGKTIAVLGSGLEKIYPYRHDSLARLIEENGALVSEFFPEMPPKAKNFPRRNRIISGLSLALLIVEAYEKSGSLITARCALEQGRDIFALPGALGTPSSEGNHWLIKQGAYLAVNPTDIMEHINGAFRWLNIEKEERVQVDQIELPFADVLVNVSHEVTPVDVIAQRSCLPVTEVMTRLLELELMGKVAVVAGGYIRVN

SEQ ID NO: 6406 - protein, 170 aa, Xenorhabdus bovienii
  Coding DNA sequence: Name=SeqID_298
  Gene classification: Gene name=Def; Function=N-formylmethionyl-tRNA deformylase; Function class=J Translation, ribosomal structure and biogenesis
  Homolog annotation: Query=1..168bp; Hit=1..168bp; Blast score=253; Percent Identity=83.0; E value=5e-68; Homolog= def COG0242
MSVLQVLHYPDERLRTIAKPVEKVDAEIQSIIDDMFETMYEEEGIGLAATQVDIHQRIIVIDVSENRDQRLVLINPELMNEVGATGIEEGCLSVPEQRAFVPRFEQVKIKALDYHGQPFELEADDLLAICIQHEMDHLVGKLFIDYLSPLKRQRIRQKVEKIDRLRAKDK

SEQ ID NO: 6407 - protein, 315 aa, Xenorhabdus bovienii
  Coding DNA sequence: Name=SeqID_299
  Gene classification: Gene name=Fmt; Function=Methionyl-tRNA formyltransferase; Function class=J Translation, ribosomal structure and biogenesis
  Homolog annotation: Query=1..314bp; Hit=1..314bp; Blast score=434; Percent Identity=65.0; E value=1e-122; Homolog= Zfmt COG0223
VSDSLRIIFAGNPDFAAHHLAALLKSQHQVVGVLTRPDKPAGRGKKLTPSPVKALAEEHSISVFQPKTLRTEESQQWIMDRQADIMIVVAYGLILPQTVLDIPRLGCLNVHGSLLPRWRGAAPIQRAIWAGDPETGVTIMQMDAGLDTGNMLLKAASPITNQDTSASLYEKLANIGSEALLNTLNLLMLGNCQPSIQDDTLATYAEKLSKDEAKMDWHLPAIQLERCVRSFNPWPMSFFLIDEYPIKVWNAEAIAEQATQSPGTIIKADKKGIQIATADGILNITQLQPSGKKSMSAADFLNSKRDWFTPGNKIK

SEQ ID NO: 6408 - protein, 439 aa, Xenorhabdus bovienii
  Coding DNA sequence: Name=SeqID_300
  Gene classification: Gene name=Sun; Function=tRNA and rRNA cytosine -C5-methylases; Function class=J Translation, ribosomal structure and biogenesis
  Homolog annotation: Query=12..438bp; Hit=1..428bp; Blast score=588; Percent Identity=65.0; E value=1e-168; Homolog= sun COG0144
MLTTVSFFDHIMKNTYNLRSIAAKAIHQVLEQGQSLSTVIPELQQRISDKDKALLQELCFGVMRVLPQLEWFISQLMAKPLKGKQRIFHYLIMVGIYQLTYTRIPAHAALAETVNGAISLKRQQLKGLINGVLRQFQRQQQALVEQVNSVNSHLHPKWLLDHIQKTYPQDWQKIIDVNNQKPPMWLRVNQRYHSANQYFTLLQEANIEAELDENHPSAIRLLNPCPVNVLPGFDQGWVTIQDRSAQGCAELLTPCDGESILDLCAAPGGKTTHILEIAPKSKVLAVDIDEQRIKRVKENLQRLNLHAVVKTGDGRLPHEWATGEQFDRILLDAPCSATGVIRRHPDIKWLRRNEDIDQLVTLQSEILDAIWPYLKKNGTLVYATCSILPHENSQQIKAFLGRHTDAELSDTGTLEKPGIQIIPETTGGDGFFYARLTKY

SEQ ID NO: 6409 - protein, 458 aa, Xenorhabdus bovienii
  Coding DNA sequence: Name=SeqID_301
  Gene classification: Gene name=TrkA; Function=K+ transport systems, NAD-binding component; Function class=P Inorganic ion transport and metabolism
  Homolog annotation: Query=1..458bp; Hit=1..458bp; Blast score=742; Percent Identity=81.0; E value=0; Homolog= trkA COG0569
MKIIILGAGQVGGTLAENLVDENNDITVVDTDTDRLRQLQDKFDLRVVNGHGSHPRVLREAGAEDADMLVAVTNSDETNMIACQIAYSLFNTPNKVARIRSSEYIYESEKLFQPNDIPIDYLISPEQLVIDYIYKLIQYPGALQVVNFAEGRVSIVAVKAYYGGSLVGNALSSLREHMPHIDSKVAAIFRQDRPIRPQGSTIIEAGDEVFFVAASQHIRAVMSELQRLEKPYKRLMIVGGGNVGAGLALRLEKDYSVKLIEHNQERATELAELLHDTIVFYGDASDQELLSEEHIEQVDVFIALTNDDEANIMSAMLAKRMGAKKAMVLIQRSAYVDLVQGGVIDIAISPQQATISALLGHVRKADIVSVSSLRRGVAEAIEAIAHGDEHTSKVVGRKIGDIRLPPGTTIGAIVRGEEVIIANDYSIIQQGDHVIMFITDKKFVPEVEKLFQPSPFFL

SEQ ID NO: 6410 - protein, 66 aa, Xenorhabdus bovienii
  Coding DNA sequence: Name=SeqID_302
  Gene classification: Function=Uncharacterized BCR; Function class=S Function unknown
  Homolog annotation: Query=1..59bp; Hit=1..62bp; Blast score=78; Percent Identity=70.0; E value=2e-15; Homolog= yhdL COG3036
MTTYRHKKGVIKDNAIEALLHDPLFRQRVETNKKGKGSYSRKEKHGKSSGWEANDNNFFKLLSLAF

SEQ ID NO: 6411 - protein, 137 aa, Xenorhabdus bovienii
  Coding DNA sequence: Name=SeqID_303
  Gene classification: Gene name=SoxR; Function=Predicted transcriptional regulators; Function class=K Transcription
  Homolog annotation: Query=1..135bp; Hit=1..135bp; Blast score=187; Percent Identity=71.0; E value=3e-48; Homolog= ZyhdM COG0789
MYRIGQLAKLASVTPDTIRFYEKQGLMAHEERTEGGYRLYTEQDLQRLRFIRYAKQSGFTLETIVELLSIRVDPEHHTCQESKQIVDSRLQEVEDKLLEMQKMRNSLKMLSDACCGSAHTSTYCSILEILEEGATNK

SEQ ID NO: 6412 - protein, 130 aa, Xenorhabdus bovienii
  Coding DNA sequence: Name=SeqID_304
  Gene classification: Gene name=RplQ; Function=Ribosomal protein L17; Function class=J Translation, ribosomal structure and biogenesis
  Homolog annotation: Query=1..126bp; Hit=1..126bp; Blast score=204; Percent Identity=94.0; E value=3e-53; Homolog= rplQ COG0203
MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRAVESQTEAASAE

SEQ ID NO: 6413 - protein, 329 aa, Xenorhabdus bovienii
  Coding DNA sequence: Name=SeqID_305
  Gene classification: Gene name=RpoA; Function=DNA-directed RNA polymerase alpha subunit/40 kD subunit; Function class=K Transcription
  Homolog annotation: Query=1..329bp; Hit=1..329bp; Blast score=608; Percent Identity=98.0; E value=1e-174; Homolog= rpoA COG0202
MQGSVTEFLKPRLVDIEQVSSTHAKVTLEPLERGFGHTLGNALRRILLSSMPGCAVTEVEIDGVLHEYSTKEGVQEDILEILLNLKGLAVKVQGKDEVILTLNKSGIGPVTAADIIHDGDVEIVKPQHVICHLTDGSASISMRIKVQRGRGYVPASARIHSEEDERPIGRLLVDACYSPVERIAYNVEAARVEQRTDLDKLVIEMETNGTIDPEEAIRRAATILAEQLEAFVDLRDVRQPEVKEEKPEFDPILLRPVDDLELTVRSANCLKAEAIHYIGDLVQRTEVELLKTPNLGKKSLTEIKDVLASRGLSLGMRLENWPPASISDE

SEQ ID NO: 6414 - protein, 206 aa, Xenorhabdus bovienii
  Coding DNA sequence: Name=SeqID_306
  Gene classification: Gene name=RpsD; Function=Ribosomal protein S4 and related proteins; Function class=J Translation, ribosomal structure and biogenesis
  Homolog annotation: Query=1..206bp; Hit=1..206bp; Blast score=354; Percent Identity=93.0; E value=3e-98; Homolog= rpsD COG0522
MARYLGPKLKLSRREGTDLFLKSGVRAIDTKCKLEQAPGQHGARKPRLSDYGVQLREKQKVRRTYGVLERQFRNYYKEATRLKGNTGENLLTLLEGRLDNVVYRMGFGATRAESRQMVSHKAIMVNGCVVNIASYQVSPNDVVSVREKAKKQARIKAALELAEQREKPTWLEVDAAKMEGVFKRIPERTDLSADINEHLIVELYSK

SEQ ID NO: 6415 - protein, 129 aa, Xenorhabdus bovienii
  Coding DNA sequence: Name=SeqID_307
  Gene classification: Gene name=RpsK; Function=Ribosomal protein S11; Function class=J Translation, ribosomal structure and biogenesis
  Homolog annotation: Query=1..129bp; Hit=1..129bp; Blast score=228; Percent Identity=99.0; E value=1e-60; Homolog= rpsK COG0100
MAKAPIRARKRVRKQVSDGVAHIHASFNNTIVTITDRQGNALGWATAGGSGFRGSRKSTPFAAQVAAERCAEAVKEYGIKNLEVMVKGPGPGRESTIRALNAAGFRITNITDVTPIPHNGCRPPKKRRV

SEQ ID NO: 6416 - protein, 118 aa, Xenorhabdus bovienii
  Coding DNA sequence: Name=SeqID_308
  Gene classification: Gene name=RpsM; Function=Ribosomal protein S13; Function class=J Translation, ribosomal structure and biogenesis
  Homolog annotation: Query=1..118bp; Hit=1..118bp; Blast score=185; Percent Identity=88.0; E value=6e-48; Homolog= PM1393 COG0099
VARIAGINIPDQKHTVIALTSIYGIGKTRSQQICEAACIAENVKISELSEEQIDKLRDEVAKYVVEGDLRREVTLSIKRLMDLGCYRGLRHRRGLPVRGQRTKTNARTRKGPRKPIKK

SEQ ID NO: 6417 - protein, 443 aa, Xenorhabdus bovienii
  Coding DNA sequence: Name=SeqID_309
  Gene classification: Gene name=SecY; Function=Preprotein translocase subunit SecY; Function class=N Cell motility and secretion
  Homolog annotation: Query=1..443bp; Hit=1..443bp; Blast score=726; Percent Identity=97.0; E value=0; Homolog= secY COG0201
MAKQPGLDFQSAKGGLSELKRRLLFVIGALIVFRIGSFIPIPGIDATVLAKLLEQQRGTIIEMFNMFSGGALSRASIFALGIMPYISASIIIQLLTVVNPRLAEIKKEGEAGRRKISQYTRYGTLVLAIFQSIGIATGLPNMPGMQGLVINPGFAFYFTAVVSLVTGTMFLMWLGEQITERGIGNGISIIIFAGIVAGLPPAIGHTIEQARQGDLHFLLLLLVAVLVFAVTFFVVFMERGQRRIVVNYAKRQQGRRVYAAQSTHLPLKVNMAGVIPAIFASSIILFPGTIASWFGGGTGWNWLTTISMYLQPGQPLYVLLYASAIIFFCFFYTALVFNPRETADNLKKSGAFVPGIRPGEQTAKYIDKVMTRLTLVGALYITFICLIPEFMRDAMKVPFYFGGTSLLIVVVVIMDFMAQVQTLMMSSQYESALKKANLKGYNR

SEQ ID NO: 6418 - protein, 144 aa, Xenorhabdus bovienii
  Coding DNA sequence: Name=SeqID_310
  Gene classification: Gene name=RplO; Function=Ribosomal protein L15; Function class=J Translation, ribosomal structure and biogenesis
  Homolog annotation: Query=1..144bp; Hit=1..144bp; Blast score=195; Percent Identity=87.0; E value=1e-50; Homolog= rplO COG0200
MRLNTLSPAEGAKHASKRVGRGIGSGLGKTGGRGHKGQKSRSGGGVRRGFEGGQMPLYRRLPKFGFTSRKAMITAEIRLSDFAHVEGDVIDLNALKAANIVGPQIEFAKVMLSGEVNRAVIVRGLRVTKGARAAIEAAGGKIEE

SEQ ID NO: 6419 - protein, 59 aa, Xenorhabdus bovienii
  Coding DNA sequence: Name=SeqID_311
  Gene classification: Gene name=RpmD; Function=Ribosomal protein L30/L7E; Function class=J Translation, ribosomal structure and biogenesis
  Homolog annotation: Query=1..59bp; Hit=1..59bp; Blast score=91; Percent Identity=88.0; E value=2e-19; Homolog= rpmD COG1841
MAKTIKITQVRSSIGRLPKHKATLTGLGLRRIGHTVEREDTPAVRGMVNLVSYMVKVEE

SEQ ID NO: 6420 - protein, 166 aa, Xenorhabdus bovienii
  Coding DNA sequence: Name=SeqID_312
  Gene classification: Gene name=RpsE; Function=Ribosomal protein S5; Function class=J Translation, ribosomal structure and biogenesis
  Homolog annotation: Query=1..166bp; Hit=1..166bp; Blast score=261; Percent Identity=92.0; E value=2e-70; Homolog= rpsE COG0098
MAHIEKQAGELQEKLIAVNRVSKTVKGGRIFSFTALTVVGDGNGRVGFGYGKAREVPAAIQKAMEKARRNMKNVALNSGTLHHPVKGGHTGSRVFMQPAHEGTGIIAGGAMRAVLEVAGVRNVLAKTYGSTNPINVVRATLDALDSMKSPEMVAAKRGKSVEEIQG

SEQ ID NO: 6421 - protein, 117 aa, Xenorhabdus bovienii
  Coding DNA sequence: Name=SeqID_313
  Gene classification: Gene name=RplR; Function=Ribosomal protein L18; Function class=J Translation, ribosomal structure and biogenesis
  Homolog annotation: Query=1..117bp; Hit=1..117bp; Blast score=149; Percent Identity=92.0; E value=3e-37; Homolog= rplR COG0256
MDKKAARIRRATRARRKLQELGATRLVVHRTPRHIYAQVIAPNGSETLVAASTTEKAISEQLKFTGNKEAAAVVGKIVAERALEKGIKNVSFDRSGFQYHGRVQALADAAREAGLQF

SEQ ID NO: 6422 - protein, 177 aa, Xenorhabdus bovienii
  Coding DNA sequence: Name=SeqID_314
  Gene classification: Gene name=RplF; Function=Ribosomal protein L6; Function class=J Translation, ribosomal structure and biogenesis
  Homolog annotation: Query=1..177bp; Hit=1..177bp; Blast score=298; Percent Identity=86.0; E value=3e-81; Homolog= rplF COG0097
MSRVAKAPVVIPAGVEVKLNGQVISIKGKNGELSRKIHNAVEVKHADGQLTFAPREGFADAWAQAGTTRSLLNAMVIGVNEGFTKKLQLVGVGYRAAVKGNAVSLSLGFSHPVEHQLPAGITAECPSQTEIVLKGADKQVIGQVAADLRAYRRPEPYKGKGVRYADEVVRTKEAKKK

SEQ ID NO: 6423 - protein, 130 aa, Xenorhabdus bovienii
  Coding DNA sequence: Name=SeqID_315
  Gene classification: Gene name=RpsH; Function=Ribosomal protein S8; Function class=J Translation, ribosomal structure and biogenesis
  Homolog annotation: Query=1..130bp; Hit=1..130bp; Blast score=229; Percent Identity=94.0; E value=4e-61; Homolog= rpsH COG0096
MSMQDPIADMLTRIRNGQAANKVAVTMPSSKLKVAIANVLKEEGYIEDFKIEGDTKPELEVTLKYFQGKAVVESIQRVSRPSLRIYKKKDELPKVMAGLGIAVVSTSKGVMTDRAARQAGLGGEILCYVA

SEQ ID NO: 6424 - protein, 101 aa, Xenorhabdus bovienii
  Coding DNA sequence: Name=SeqID_316
  Gene classification: Gene name=RpsN; Function=Ribosomal protein S14; Function class=J Translation, ribosomal structure and biogenesis
  Homolog annotation: Query=1..101bp; Hit=1..101bp; Blast score=152; Percent Identity=92.0; E value=7e-38; Homolog= rpsN COG0199
MAKQSMKARDVKRAKLAEKFFAKRVELKAIISDVNASDEDRWNAVLKLQTLPRDSSPCRQRNRCRQTGRPHAFLRKFGLSRIKVREAAMRGEIPGLKKASW

SEQ ID NO: 6425 - protein, 179 aa, Xenorhabdus bovienii
  Coding DNA sequence: Name=SeqID_317
  Gene classification: Gene name=RplE; Function=Ribosomal protein L5; Function class=J Translation, ribosomal structure and biogenesis
  Homolog annotation: Query=1..179bp; Hit=1..179bp; Blast score=323; Percent Identity=89.0; E value=4e-89; Homolog= HI0790 COG0094
MAKLHDYYKDEVVQKLMSQFGYHSVMQVPRVEKITLNMGVGEAIADKKLLDNAAADLTAISGQKPLITKARKSVAGFKIRQGYPIGCKVTLRGERMWEFFERLISIAVPRIRDFRGLSAKSFDGRGNYSMGVREQIIFPEIDYDKVDRVRGLDITITTTAKSDDEGRALLAAFNFPFRK

SEQ ID NO: 6426 - protein, 104 aa, Xenorhabdus bovienii
  Coding DNA sequence: Name=SeqID_318
  Gene classification: Gene name=RplX; Function=Ribosomal protein L24; Function class=J Translation, ribosomal structure and biogenesis
  Homolog annotation: Query=1..104bp; Hit=1..104bp; Blast score=162; Percent Identity=93.0; E value=7e-41; Homolog= rplX COG0198
MAAKIRRDDEIIVLTGKDKGKRGKVKQVLSSGKIIVEGINLVKKHQKPVPALNQPGGIVEKEAAINVSNVAIFNAVTSKADRVGFRFEDGKKVRFFKSNDETIK

SEQ ID NO: 6427 - protein, 300 aa, Xenorhabdus bovienii
  Coding DNA sequence: Name=SeqID_319
  Homolog annotation: Query=1..300bp; Hit=1..313bp; Blast score=426; Percent Identity=69.0; E value=1e-118; Homolog= ref|NP_061811.1|
MTSFALDYFADHLPRKPYHTDDLLSGLRINNADVAKLARYIQHNPPHAAFWFVFDVDRVGAAIDWTDSNAPAPNITVKNQTNGHAHLLYGLQTAVRTAPDASIKALKYAASVERGLCVKLRADVNYSGLICKNPLNLHWQVTTWRQAVYTLDELADYVDLNVPEARVNDFNYGLGRNCQLFEKTRKWAYRAIRQGYPDFAQWQLAVIQRVEMYNVQLTNPLSLPECACIGRSIAKWTHQRMSEKAFAQYVADTHTPEIQAARGRKSKRGAIPSSERTLKPWESLGISRRWYYHKKKNGLL

SEQ ID NO: 6428 - protein, 408 aa, Xenorhabdus bovienii
  Coding DNA sequence: Name=SeqID_320
  Homolog annotation: Query=7..275bp; Hit=6..276bp; Blast score=67; Percent Identity=25.0; E value=6e-10; Homolog= ref|NP_604065.1|
MLKLIHSQSSLFFVSYVINALINWAFKFIAPLALYAETQSLQMMTISYGLLFTPNIIAPPFINLIDGKLARKTSLLILNFLGLASCAFSFFYFRKGFNSTAFLTILFMLSTVLTLFQTLIHSVIKDVFHDKDAIAITSRRIAFVDSLFPAVGPLIGAVMLSAFNYNHVFLIIAIVYTLSFLLIKILKIDERNSEIKDSFVVRTTKGFQLIKNSSFINFLLTRFFLSNIALHGFQSVLTFYLIDKFHLADIRVGFFFAISALGLLVGVRIGRFIYAQDINKWYVISATGIICAVSLIIIPLTNNIVIASLAWCAVMLLSSINLIVFYTERQTNFHQNDTTCVISASYVIIYSAIPLGSAVSFFLSKYFNASETMFILGTYMLLIGFYFLYVSIRNQKTLKIEKTSNSQN

SEQ ID NO: 6429 - protein, 324 aa, Xenorhabdus bovienii
  Coding DNA sequence: Name=SeqID_321
  Homolog annotation: Query=140..322bp; Hit=153..337bp; Blast score=68; Percent Identity=25.0; E value=1e-10; Homolog= ref|NP_762629.1|
MSQISAIIETNKNYFNSEILTSLKYLSENFKIPVKNNVSVNYNWQVYANYFLCVDAIKEGDSNSAEDYLRSALNSLTTDSSTRSIVDHGRPEVTVITPENIDSELSRTLKGIYDKPDNDVNDDGVYAFGPFPGNTSQEFARIKHAFDLLQSVSPEYYSFVTSLVKHIVLVGQTERGGIKSGSTLKTLGCIIISPNTKEEFSPVGQYIEDLVHEASHTRLFLEQTKDQLVNNPVVNLYAAPFRKDKRPMSGIYHANYVLGNIVAYFSKAVKVTPDDKEIHNDLFLARALARYNETYLVVQQHGDLTERGRQIFDEMKIQVDKCLN

SEQ ID NO: 6430 - protein, 81 aa, Xenorhabdus bovienii
  Coding DNA sequence: Name=SeqID_322
  Gene classification: Gene name=MazE; Function=Growth regulator; Function class=T Signal transduction mechanisms
  Homolog annotation: Query=6..80bp; Hit=6..81bp; Blast score=78; Percent Identity=51.0; E value=1e-15; Homolog= chpR COG2336
MAQVVVKKWGNSPSVRLPVAIMQAASLNVDDTVDIAVEDGRIIIIPVKAKEYSLDALLAGITPENIHEKMDFGSPVGKELI

SEQ ID NO: 6431 - protein, 110 aa, Xenorhabdus bovienii
  Coding DNA sequence: Name=SeqID_323
  Gene classification: Gene name=MazF; Function=Growth inhibitor; Function class=T Signal transduction mechanisms
  Homolog annotation: Query=1..110bp; Hit=1..111bp; Blast score=160; Percent Identity=69.0; E value=2e-40; Homolog= chpA COG2337
MVSRFVPDSGDIIWIDFDPVAGHEQGGHRPAVVLSPFAYNNKVGLLLCVPCTTKAKDYPFEVELSGSRDSVALADQVTCVDWRARKVTKKGHVNSSELEDIKAKAKALIG

SEQ ID NO: 6432 - protein, 246 aa, Xenorhabdus bovienii
  Coding DNA sequence: Name=SeqID_324
  Homolog annotation: Query=11..215bp; Hit=9..212bp; Blast score=120; Percent Identity=35.0; E value=2e-26; Homolog= emb|CAB62410.1|
MTMGGDNFIRSYKERMAKKQDNEQAILRFLKDEIYSTAEILSRVLNYTATSTVYTTLNRMCAKGLLSTEKVDLGGYRPFNVYGITQHGAVMVLDDHDDPFKLKAFEPSKITLSTLAHRFDVQRLSLAARHHGYQWKPTSNLKLEKGQKYPDGLMRKDGNIWAVEVERVAKSPKRYRDIVEIYLNQITQNGWAGVVYLFPEPQLRDRVKRIFYAVDAAMIGGRLQSLSPEMTDRFFDFKTYEEFASE

SEQ ID NO: 6433 - protein, 659 aa, Xenorhabdus bovienii
  Coding DNA sequence: Name=SeqID_325
  Homolog annotation: Query=52..617bp; Hit=58..630bp; Blast score=476; Percent Identity=44.0; E value=1e-133; Homolog= emb|CAB62409.1|
MSLSSALYSVLKAYPFAFSVIEADWLAVAVCGFVFSFVFFTLSRTLHAYSLLGVSSEAIRKAQLHNKTGDGKTIPLVWRQKANLDNPSKRIYARRWIARLFMSLVSALFGLTALAYLLLVFACFIINDKVTFELLLSENRFYPAFWLAGSLVAGGIVSSLVYFIFIRDVMARKDADINRVIIEKRNKHKGRTGELSDARSLQFASVPDFNPVDYFNTAAAKDAVFLGLDEKRHPIYIPRKIWVKSNVQIMGSVGSGKGVLACCALAQCTGMFNDTVIVFDPKNDEFAPHVLKGQSDKFLLLDLRQGKPAQLNIFRDLSSYQLNELLVSGFSLGRRGDNADFYRDNDRQAVRLLSSQFEHGTDVTALLEAAQRLPQKVRESASGFMTLLQELCSLSVLQTHEGIDLKDFILNGGCLYVVGSLRDESVIMLQKMLFVRCLQIIEERDRFHETTHVNIFLDEVKYLLSKSSLEALGTVRDKNCNILLTHQSLGDFGQCGADMKPEVVQATVIDNTPIKWIYRMKDYKVAEWASKQTGQILVDSERRNVTTETGNVELMSTETTVFKEKRELIDTNTIQHLPDGAAVMIGVGLARIAYSKPIKAARREIALTEYPTLKQPDFHFSASSFPEYAGEIPQREEAVTESVAQTHFNRESRDDNGWR

SEQ ID NO: 6434 - protein, 186 aa, Xenorhabdus bovienii
  Coding DNA sequence: Name=SeqID_326
MIIKKEKAEQIIAKHKKLIAWKPARVVAALIKIGMSEAEATAMVKTNTPARKEHKPHKPHNSHAKPVNLEALSTHYIVVGDYDLLGLRHQDALIVAIRNGKGKSSWNDGAMAVILFGLVKAYPIITTAEVNKFLNRGAFIDSIPLFIDGEMIDGETMPSADNESVKDVFRVVKQLKKITERRIDFQ

SEQ ID NO: 6435 - protein, 68 aa, Xenorhabdus bovienii
  Coding DNA sequence: Name=SeqID_327
MESVIDTCSNLDIELEPAKNAIEKSRSLLSTMIDVCGDNDDANLLLIAIDLAFDAGKEIARVRGVEYS

SEQ ID NO: 6436 - protein, 136 aa, Xenorhabdus bovienii
  Coding DNA sequence: Name=SeqID_328
MKILKPIETATNQEIVIEPREVYVVRGSGKTYLSEKGALNKLAYVRAQEQFNADERPSNFPAEEVIQEDGTSALRRGKMRPEFMERHAQVLEELKVAVRREREKIALRKKYSKAMNKINSLHETISELEIQIAELE

SEQ ID NO: 6437 - protein, 114 aa, Xenorhabdus bovienii
  Coding DNA sequence: Name=SeqID_329
MTQSILLERKRKAFIHAKLDALQKKHGSHSVFVKESGVNCRLDLDEEILTLALIKFFEDELDEHQHKLHELINTYDSFYNKFGNLTAEGNEFMNEILKLIAKKTEPINGDNNEK

SEQ ID NO: 6438 - protein, 92 aa, Xenorhabdus bovienii
  Coding DNA sequence: Name=SeqID_330
MKNETYLYFAETAIQKEKEEKYDLAALYWGKAKYLAADLKHRLWAQYNQENNEERHLLHNSYKQAANDDYIRTSKAISTDFRTPRLLSPCGQ

SEQ ID NO: 6439 - protein, 62 aa, Xenorhabdus bovienii
  Coding DNA sequence: Name=SeqID_331
MTTYEQAKQLARILELQGFFRRAANKWGEALSLTQEHKQEQECTKNNLRCVRQARITIREGL

SEQ ID NO: 6440 - protein, 72 aa, Xenorhabdus bovienii
  Coding DNA sequence: Name=SeqID_332
MVKKKRSKTQQGFMGMTIPQGMQLGKDEERDYLNSKKYIANFSIEGEFLKVPLNRAMRRHAKKMKIELKEAE

SEQ ID NO: 6441 - protein, 262 aa, Xenorhabdus bovienii
  Coding DNA sequence: Name=SeqID_333
  Homolog annotation: Query=10..121bp; Hit=5..116bp; Blast score=97; Percent Identity=43.0; E value=2e-19; Homolog= ref|NP_461551.1|
MSKKNELVTIDSNKLPVIEWQGVRVVTTETLATGYGTEPTNIRSNIANHRSRFIEGVHVFTLKGDNFQSFKNQGNNIDLVNKHANQITLFTEKGAARMSKILDTDEAWSFFEKMESAYFHQKKSATNPPALPGDYIAALEALLTTEKEKVVITQERDEARRTKSQISRSREAQALGKLSAATRKCRELEERLGESTKHATVTAVQNATEKEYNYAPLRKWCRENNIEVVKVPDTRYGHVKSWPAEAWLAIHGVDLKKLFGKK

SEQ ID NO: 6442 - protein, 82 aa, Xenorhabdus bovienii
  Coding DNA sequence: Name=SeqID_334
MERTRYVVTYLGDYPCGHRHPLSISMVARDAADAFTKAQETLAFTDDRLTSTNHTLFSVMPERFNESMLADMHLCPNAEVKS

SEQ ID NO: 6443 - protein, 176 aa, Xenorhabdus bovienii
  Coding DNA sequence: Name=SeqID_335
  Homolog annotation: Query=1..175bp; Hit=1..176bp; Blast score=193; Percent Identity=57.0; E value=1e-48; Homolog= ref|NP_707754.1|
MIINSNLLRAALVCVAKNDPRYYLCGVHITPKYLESTNGHVALRLEHGVNTRRKAIVQFYGKIPKKAETTELHFTKEPYAVHRDVNGARVGFTVLSILDGRFPDLSRIIPKKVENVIPHFQAEFLAYPYKMFEADSAFITVSLYPSSMTDACLMKFGDNINQRYGNPLFVVMPFRV

SEQ ID NO: 6444 - protein, 75 aa, Xenorhabdus bovienii
  Coding DNA sequence: Name=SeqID_336
MRIEYLDKGNTAQIVIASFITERSKHNRCVDAALLATPVRASSSGVFFRRTVITGKANHMIRAYKTICKEADSDR

SEQ ID NO: 6445 - protein, 386 aa, Xenorhabdus bovienii
  Coding DNA sequence: Name=SeqID_337
  Homolog annotation: Query=17..386bp; Hit=10..373bp; Blast score=272; Percent Identity=39.0; E value=8e-72; Homolog= ref|NP_927501.1|
MITVETAMQATTLSHAFGHLTDPRVNRTKQYALIDILTISICAVICGCEGFNAIEEYGKSKEDWFRQFLDLPNGIPSHDTFNDVINRLDPQEFGDAFTQWVGSLAKISDDIIALDGKTLRGTLDKANGAPALHLVSAWSVANQLCFGQVKVSDKSNEITAIPKLLALLDIGGSTITIDAMGCQYKIADQIVENQADYVLALKSNQGEFHDDIKLFLETQLANDFTGISHAKTQCTEGDHGRIEERRLWLVNDIGWLRARHPQWHTLGGIAVVESWREEQGKSASYERRYFITSHRDKSADFIACAIRSYWHIETKLHWQLDVSFGEDGQRLRSGHAAENMALMNKIALNLLKNEKTVKVGVKTKRQKAGWDNGYMLKVLTGGFTSV

SEQ ID NO: 6446 - protein, 67 aa, Xenorhabdus bovienii
  Coding DNA sequence: Name=SeqID_338
MADIDDVLVKATFHIDDGTDQTQRLIHIMRRNQHLHEGICPPLPPAPKVAEVKLTPVKKARNKQGKE

SEQ ID NO: 6447 - protein, 189 aa, Xenorhabdus bovienii
  Coding DNA sequence: Name=SeqID_339
MLANCIRKGIVESVNGMYSLTEQTAPNNMNVKEIASNQAAPTKVEVLRGLLSERGEMSSTELAKEAGFPVNNIGGLLGKDIEKGVIGMHKRDGRRFYYWVASVCLPVRHVELIKPEIEVGVSEPQPMKPVIESSDFITVPSSSALKRELQQLDQRLDVLQSERQQKASILDLIYELEDLLSVKAVSHDQ

SEQ ID NO: 6448 - protein, 105 aa, Xenorhabdus bovienii
  Coding DNA sequence: Name=SeqID_340
MINNSFHLTQIIASVWGDPSDITDAIWQAGYRKPERGEKEIAELIIDVMDGVPDQVPYSERPKNLNDILTTDLNNIIFDATWSETATPATVAKMILENGYQKGDE

SEQ ID NO: 6449 - protein, 85 aa, Xenorhabdus bovienii
  Coding DNA sequence: Name=SeqID_341
  Gene classification: Gene name=XerC; Function=Integrase; Function class=L DNA replication, recombination and repair
  Homolog annotation: Query=7..68bp; Hit=335..397bp; Blast score=58; Percent Identity=38.0; E value=1e-09; Homolog= Z1835 COG0582
MASHFDSYTYWSIHNLRRTMRTGVSELTVPHIAEIMVGHKLPGIWQVYDKHTYLNEQREAYERWWDKLTKIVSRPPNQKYPAVEN

SEQ ID NO: 6450 - protein, 189 aa, Xenorhabdus bovienii
  Coding DNA sequence: Name=SeqID_342
  Gene classification: Gene name=XerC; Function=Integrase; Function class=L DNA replication, recombination and repair
  Homolog annotation: Query=5..189bp; Hit=132..309bp; Blast score=79; Percent Identity=24.0; E value=2e-15; Homolog= Z1835 COG0582
MQDVKVNADAILRTFEIHVFPKFGELPHDEVKLPIWLTLIEGVTRQSPAIGKRILTYSKTAHRWAVRRGMTNNTPLSDVISSDLGGQDINTDVDTNVGDRTLSEEERVILFRLINAPKYNLRNALIVKLYLLFGCRIAELLKAKVNDFDYEKNIWIIPPANHKTGRRTKKPIIRPIIPKAKELIEQAKN

SEQ ID NO: 6451 - protein, 78 aa, Xenorhabdus bovienii
  Coding DNA sequence: Name=SeqID_343
  Gene classification: Gene name=XerC; Function=Integrase; Function class=L DNA replication, recombination and repair
  Homolog annotation: Query=1..77bp; Hit=3..78bp; Blast score=74; Percent Identity=53.0; E value=2e-14; Homolog= VCA0281 COG0582
MAITDSWLRSTNGKPQEKMITKSDRDGLSVRVTPKGKVIFQFRYRWGGKRDRIDIGTYPATSLKDARDAVTSYRGELE

SEQ ID NO: 6452 - protein, 124 aa, Xenorhabdus bovienii
  Coding DNA sequence: Name=SeqID_344
  Gene classification: Gene name=EmrE; Function=Membrane transporters of cations and cationic drugs; Function class=P Inorganic ion transport and metabolism
  Homolog annotation: Query=14..120bp; Hit=1..107bp; Blast score=102; Percent Identity=57.0; E value=9e-23; Homolog= Z1870 COG2076
MRHHFVSYGLVTGMNGLGYLLIAIISEVIATTMLKASDGFSRLMPSIVVVIGYCFSFWALSQVVKVLPLGIAYAIWSGLGIVLVSVAAIFLYQQKLDLPAIIGMLLIIMGVLVINLFSNSGANH

SEQ ID NO: 6453 - protein, 304 aa, Xenorhabdus bovienii
  Coding DNA sequence: Name=SeqID_345
  Gene classification: Gene name=MesJ; Function=Predicted ATPase of the PP-loop superfamily implicated in cell cycle control; Function class =D Cell division and chromosome partitioning
  Homolog annotation: Query=3..304bp; Hit=8..311bp; Blast score=538; Percent Identity=84.0; E value=1e-153; Homolog= ydaO COG0037
MNSQKNQYNFNKLQKRLRRDAGQAIVDFKMIEEGDRIMVCLSGGKDSYTLLSILQNLQKSAPVNFSLVAVNLDQKQPGFPEHILPAYLEELGIEYKIVEENTYGIVKEKIPEGKTTCSLCSRLRRGILYRTATELGATKIALGHHRDDILQTVFLNMFYGGKLKGMPPKLISDDGKHIVIRPLAYCREKDIERYAEARAFPIIPCNLCGSQPNLQRQVIKDMLRDWDKRYPGRIETMFRAVQNVVPSHLSDLNLFDFKSITHGSEVIDGGDLAFDREELPSQPAVESDEQLDFQADRLDVVEIK

SEQ ID NO: 6454 - protein, 327 aa, Xenorhabdus bovienii
  Coding DNA sequence: Name=SeqID_346
  Gene classification: Gene name=CorA; Function=Mg2+ and Co2+ transporters; Function class=P Inorganic ion transport and metabolism
  Homolog annotation: Query=1..327bp; Hit=1..327bp; Blast score=374; Percent Identity=54.0; E value=1e-104; Homolog= ydaN COG0598
VETIYGSVFKDSDAVYSCQLNGKGGIMAFGEDEAATAEQPFWQHLDYKNQASQRWIMSTALLPTSVKEGLSGESIRPKVLRTGEGTMITLRTVNRNENARPDHLVSFRIYINDRMIISSRHRKVRCIDQAMDDLHNGVGAKSTGHWLVEIAGAITDEMNDFIEELHDSLIGFEDDILEQKVPGRGELVLLRKQLIVLRRYMAPQRDVFLRLASERLPWMNDEDRRLMQEIADRLGRGLDDLDGSIARTAVLADEISSMMADAMNRRIYMMSLLTMVFLPTTFLTGLFGVNLGGIPGNEYRFGFGIFCFLLSILITIFAWWLRRTKWL

SEQ ID NO: 6455 - protein, 538 aa, Xenorhabdus bovienii
  Coding DNA sequence: Name=SeqID_347
  Gene classification: Gene name=OppA; Function=ABC-type dipeptide/oligopeptide/nickel transport systems, periplasmic components; Function class=E Amino acid transport and metabolism
  Homolog annotation: Query=2..538bp; Hit=10..544bp; Blast score=739; Percent Identity=66.0; E value=0; Homolog= mppA COG0747
MHNFKLLPSVLLMTGLSFSVSAANVPTGTQLDARQELVRQLKDEPASLDPIKSFGLTEAQVLRDLLEGLVNQDAYGEPISGVAIDWKTTDNQTWVFTLRQNARWSNGDKVTASDFVYSWRRLVNPANASSFSWFAALSGIQNAQEIIDGKLPSEKLGVEAIDPYTLKVSLDRPVPYFPNMTTNFSLYPVHKQSVEKYGNDWTRVGHLVGNGAFMLTGRVVNEKIVLTPNPYYWDHKNTVLKKVTFLPINQESHATKRYLAEDLDITESFPKNMYQKLLRDIPGEVFTPDQLGTYYYAFNTQRAPTNDIRVRRALSMTIDRKLIAGKILGTGEKPAWRFTPDVTAGFQPEKSRQEILTQQELDNQARTLLKEAGYGFGNPLKLSLLYNNLENNQRIAIAISSEWKKKLGVEVKLVNQEWKTYVDNRNTGNFDVVRASWTGDYNEPSSFLSLLTSTHSGNLAKFHNSAYDTLIKEASQETDEMTRNCDYNQAEKIITEQAPIAPIYQYTNGRLIKSWLKGYPITNPEDVAYSHSMYIIKH

SEQ ID NO: 6456 - protein, 167 aa, Xenorhabdus bovienii
  Coding DNA sequence: Name=SeqID_348
  Gene classification: Gene name=Tpx; Function=Peroxiredoxin; Function class=O Posttranslational modification, protein turnover, chaperones
  Homolog annotation: Query=1..167bp; Hit=1..167bp; Blast score=240; Percent Identity=71.0; E value=5e-64; Homolog= tpx COG2077
MTQTVKFQGSDITINGDFPQVGQTAKEFSLVAKDLADVTLSQYAGKRKVLNIFPSIDTGVCATSVRKFNQVASELNNTVVLCISADLPFAQSRFCGAEGLSNVVMLSTLRGGKFHEDYGVAISQGPLVGLTARAVVVLDENNQIIYSQLVDEITNEPDYDNALSVLK

SEQ ID NO: 6457 - protein, 48 aa, Xenorhabdus bovienii
  Coding DNA sequence: Name=SeqID_349
MKGLKPPSLDGDFDFNSLTYARLRGAWFDDFQSSAPKCANPPTSVGGS

SEQ ID NO: 6458 - protein, 333 aa, Xenorhabdus bovienii
  Coding DNA sequence: Name=SeqID_350
  Gene classification: Gene name=SPS1; Function=Serine/threonine protein kinases; Function class=T Signal transduction mechanisms
  Homolog annotation: Query=27..305bp; Hit=11..281bp; Blast score=130; Percent Identity=30.0; E value=3e-30; Homolog= DRA0335_1 COG0515
MQNTHNNYSSGEFSLSHALPIGYCFNEFEIEEVISEGGFSIVYRAWDHRLKRTIAIKEYMPSILVVRRQDLKLNLRRASLKKRFQIGLHNFMHEAHLMTCFNHPCLPRFLRFWQQNSTAYIATPFYSGMTLKKLQTKRPKIINQNWIYNMLFPLLDAIDTLHQAGYLHCDISLDNILIQDDQLPILLDLGSARKATERLSDEKEVTISPGFTAVEQYTANEEGQQGPWTDIYSLGAVLHTLIVGTPPPVSIVRNIEDNYQPLSKLCPAGYSSSFLHVIDRTLKIKLSERPLSITELMTQIKASTIKTCRVPVLSYTRPNTFTAYVPPVSSNSE

SEQ ID NO: 6459 - protein, 527 aa, Xenorhabdus bovienii
  Coding DNA sequence: Name=SeqID_351
  Gene classification: Gene name=TyrR; Function=Transcriptional regulator of aromatic amino acids metabolism; Function class=K Transcription
  Homolog annotation: Query=1..518bp; Hit=1..510bp; Blast score=657; Percent Identity=65.0; E value=0; Homolog= tyrR COG3283
MRLEVTCQDRIGLTRELLDLLVLRNIDLKGIEISPARRIYLNFTQIDFNTFRLLMAEIRRINGVIDVRTVAFMPSEKEHRAMWTLLESVPEPIFSIDMKGNIDLVNPASLVLFGLNRERIGQKNIGHLISNYNFLRWLESEHHQPHSANLVIKGQDYCMDIIPMQLTDENQSVKCVGAVIMLRSTTRVALAPSSKKFTVSDDSAFDKIVAVGPKMVHVVEQIRKIAMLDAPLLLIGDTGTGKDEFAKACHLRSSRRKQPFLGLNCASMPDDVAESELFGYAAGAYPNALEGKKGFFEQANGGTVLLDEIGEMSPQMQIKLLRFLNDGTFRRVGEDNEVKVDVRIICATQKNLVELVQKGEFREDLYYRLNVLTITLPPLRERQADIMPLADFFVIRFAEEQGLEKPKLAHELEHFLCSYHWPGNVRQLRNAIYRALTQFEGHQLHPQDIQLPELETEVAFSDDILAGSLDEISKRFERSVLIRLYRHYPSTRKLAKRLGVSHTAIANKLREYSLSGKKQMAEHEDDE

SEQ ID NO: 6460 - protein, 362 aa, Xenorhabdus bovienii
  Coding DNA sequence: Name=SeqID_352
  Gene classification: Function=Predicted membrane protein; Function class=S Function unknown
  Homolog annotation: Query=1..344bp; Hit=1..344bp; Blast score=454; Percent Identity=68.0; E value=1e-128; Homolog= ycjF COG3768
MTDPLKPRIDFDDRLQTQSEPSLKSQKEFNGQENEFCPVAPEREAEEQESEFEGAVNAALKPKRSFWRKVFSGAVLLLGISVVAQFIQWIYQSWQQHDWISLGVAAAGSMIVFAGIGTVISEWRRLYRLRQRTEERDIAKSLLQSHGIGKGRQFCENLAEQAGIGQQHPALQRWQAAVHKTHNDREIVMLYSKLVQPVLDVQAKKEISRSAAESALMIAVSPLAIVDMAFIAWRNIRLINRIAALYGIELGYFSRIRLFRLVLLNIAFAGASELVREVGMDWLSQDIAARLSARAAQGIGAGLLTARLGIKAMELCRPLPWIDSDKPKLGDFRHQLMTQLKSTLPTKMKSAVKRTENSTVIK

SEQ ID NO: 6461 - protein, 465 aa, Xenorhabdus bovienii
  Coding DNA sequence: Name=SeqID_353
  Gene classification: Function=Predicted ATPase; Function class=R General function prediction only
  Homolog annotation: Query=1..464bp; Hit=1..464bp; Blast score=757; Percent Identity=76.0; E value=0; Homolog= ZycjX COG3106
MKRLQNELKSLVNRGVDRHLRLAVTGLSRSGKTAFITSLVNQLLHVHNGARLPLFSAVRDGRLLGVKRVPQRDFGVPRFAYDENIAALHDTPPYWPIPTQGVSEIRLALRYRSEDSLLRYLKETSTLYLEIVDYPGEWLLDLPMLEQNYLAWSRQMNGMLKGERADWAKPWLELCQQCDPLAPADENLLARIAQAYTDYLHQCKTQGLHFIQPGRFILPGDLAGAPALQFFPWPDINGIGEPQLSKADKHTNIGMLRERFAYYCDHIVKGFYKEHFLRFDRQIVLVDCLQPLNSGPQAFNDMRLALAQLMQSFHYGKRTLFRRLFSPCIDKLMFAASKSDHVTADQHVNLISLLQQLVQEAWQNAAFEGISMDCVGLASVQATESGIVLHDGEKIPAIKGNRLSDDKLLTFFPGEVPQRLPNSDFWQKQGFNFESFRPKQVNVDTPLPHIRMDSAMEFLLGDKLT

SEQ ID NO: 6462 - protein, 120 aa, Xenorhabdus bovienii
  Coding DNA sequence: Name=SeqID_354
  Gene classification: Gene name=PspC; Function=Putative stress -responsive transcriptional regulator; Function class=K Transcription
  Homolog annotation: Query=7..120bp; Hit=8..119bp; Blast score=135; Percent Identity=60.0; E value=7e-33; Homolog= pspC COG1983
MSNTYRRKLYRLPEQGMVKGVCAGLASYFNVPVPLMRTITVLSLFFGLFGFTVLTYIILTFVMDPAPAGYQAEGVNKGPSGQKILDEVDYQLRASEARLRQMERYITSDTYSVRSRFRQL

SEQ ID NO: 6463 - protein, 73 aa, Xenorhabdus bovienii
  Coding DNA sequence: Name=SeqID_355
  Homolog annotation: Query=1..73bp; Hit=1..72bp; Blast score=95; Percent Identity=72.0; E value=2e-19; Homolog= ref|NP_929819.1|
MGYIFLGIPLILFVLFVLPIWLWLHYSNQSRGQLGSNEIQRLGQLAENARHMQERIKTLEEILDAEHPNWRQS

SEQ ID NO: 6464 - protein, 223 aa, Xenorhabdus bovienii
  Coding DNA sequence: Name=SeqID_356
  Gene classification: Gene name=PspA; Function=Phage shock protein A (IM30), suppresses sigma54-dependent transcription; Function class=I Lipid metabolism
  Homolog annotation: Query=1..217bp; Hit=1..217bp; Blast score=224; Percent Identity=74.0; E value=4e-59; Homolog= pspA COG1842
MGIFSRFADIVNANISSLLDKAEDPQKMIRLMIQEMEDTLVEIRSTSARTLAEKKQLLRRIGIGENQIEGWQEKAELALSKEKEDLARAALIEKQKISNLIDALKNELSILDETLGRIKGEVTELENKLTEARVRQQSLTLRHQAAASSREVRRQLDSGKIDEAMARFEQFERRIDHMEAEAEAIGLGKQKSLEQQFTELKADDEISAQLAALKAKMSVKDSQ

SEQ ID NO: 6465 - protein, 339 aa, Xenorhabdus bovienii
  Coding DNA sequence: Name=SeqID_357
  Gene classification: Gene name=PspF; Function=Transcriptional regulators containing an AAA-type ATPase domain and a DNA-binding domain; Function class=T Signal transduction mechanisms
  Homolog annotation: Query=1..333bp; Hit=6..330bp; Blast score=455; Percent Identity=69.0; E value=1e-128; Homolog= ZpspF COG1221
MHQFIDNLLGEANCFIEILEQVSALAKLNKPVLVLGERGTGKELIARRLHYLSPRWQGSFISLNCAALNENLLDSELFGHEAGAFTGARSKHQGRFERADGGTLFLDELATAPMQVQEKLLRVIEYGYLERVGGNQSLQVDVRLVCATNEDLPAMAARGKFRADLLDRLAFDVVQIPPLRQRQQDIMLLAQHFAIQMCRELNLSFFPGFTDEAKQQLLTYHWPGNIRELKNVIERSIYRHRDNEKELDTIIINPFASSQIFSSQMSIPACNHNEGTPYSLPSLPFDLRQWQNDSEKQLIIQALEKSQFSQKKAAGKLNLTYHQLRGLIKKHHINIHVMD

SEQ ID NO: 6466 - protein, 571 aa, Xenorhabdus bovienii
  Coding DNA sequence: Name=SeqID_358
  Gene classification: Gene name=OppA; Function=ABC-type dipeptide/oligopeptide/nickel transport systems, periplasmic components; Function class=E Amino acid transport and metabolism
  Homolog annotation: Query=47..559bp; Hit=29..541bp; Blast score=739; Percent Identity=70.0; E value=0; Homolog= sapA COG0747
MRYLIYWIILLFSASTLAADNAIPETTKATHEAIPADTLNNLSYVSAALRQNGFIYCVNGNLSTFNPQMAISGLTVDTLAAQIYDRLLGVDPLTYRLIPELASRWEVRDNGATYRFYLRHNVAFQSTDWFTPTRTMNADDVVFSFRRLFDKTHYYHYVNGGHYPYFDSLQFGDSVLSIQKIDKYTVEFRLNAPDASFLWHLATHYAPILSEEYGQKLHKINRQEQIDWKPVGTGPFMLEDYRAEQFIRLIRHDKYWKGKPHMEQVVIDAGAGGTGRISKLLTGECDVLAYPPANQFSVLHDNPNLHQTLRSGMNIAYLAFNTSKPPLDKLAVRQAIAYAINNQRLMKSIYYGTAETAASILPRASWAYDNSAEITEYNPEKSRKMLTELGLNGLELTLWVPTASQSYNPSPLKMAELIQADLAQVGIKMSIRPVEGRAQENQLMDKTHDMTLAGWSTDSNDPDSFFRPLLSCAAIASQTNLSRWCDSTFDDALHQALLNQQLASRIENYHIAQQILAQQLPVLPLAYPTRLQIFRYNIKGLVLSPFGNSSFAGVYRVQETTTPTGNKKESK

SEQ ID NO: 6467 - protein, 321 aa, Xenorhabdus bovienii
  Coding DNA sequence: Name=SeqID_359
  Gene classification: Gene name=DppB; Function=ABC-type dipeptide/oligopeptide/nickel transport systems, permease components; Function class=E Amino acid transport and metabolism
  Homolog annotation: Query=1..321bp; Hit=1..321bp; Blast score=405; Percent Identity=72.0; E value=1e-113; Homolog= sapB COG0601
MIIYILRRLLLLLVTLFFLSLISFSLMYFTPHGPLSGASLTDAYVFYFHSLLQWDFGISSINGERIIEQLYGVFPATMELCILSFSMALLIGIPLGIIAGVWRNKKADIIISTFALLGFSIPVFWLALLLTLLFSLYLGWLPVSGRFDLLYRMEQVTGSALVDAWLSKEPYRNEMIVNVILHMILPVITLAVAPMTEVIRLMRNSAEEVSASNYIKSAATRGLSRLTIIRRHLLHNALPPIIPKLGLQFSTMLTLAMVTEQVFNWPGLGHWLIIAIRQQDYSAISAGVMVIGALVISVNVLTDIIGAIANPLKHKEWYALR

SEQ ID NO: 6468 - protein, 295 aa, Xenorhabdus bovienii
  Coding DNA sequence: Name=SeqID_360
  Gene classification: Gene name=DppC; Function=ABC-type dipeptide/oligopeptide/nickel transport systems, permease components; Function class=E Amino acid transport and metabolism
  Homolog annotation: Query=1..295bp; Hit=1..296bp; Blast score=370; Percent Identity=69.0; E value=1e-102; Homolog= ZsapC COG1173
MPLDNFYREKKMPSPLKVIWRFFYADILAMTGFYGVLILIALSLLGGQIAPYQLDQQFMYQLMPPSWSHHGNVAFFLGTDDLGRDIFSRLLIGTSSTFGAALIVTAAAAIAGLAIGSLAAMTHGLKSAVLNHILETLLSIPSLLLAIIVVAFVGASLQHAMIAIWLALLPRIVRTIYTAVHDELDKEYIIAARLDGASNYRILRYAVFPNITAAIVSELTRTLSIAILDIAALGFLDLGAQLPSPEWGAMLGNSLELIYSAPWTVMLPGAAITLSVLLVNLLGDGLHRAINAGVE

SEQ ID NO: 6469 - protein, 330 aa, Xenorhabdus bovienii
  Coding DNA sequence: Name=SeqID_361
  Gene classification: Gene name=DppD; Function=ABC-type dipeptide/oligopeptide/nickel transport system, ATPase component; Function class=E Amino acid transport and metabolism
  Homolog annotation: Query=1..330bp; Hit=1..330bp; Blast score=547; Percent Identity=78.0; E value=1e-156; Homolog= sapD COG0444
MPLLDIRNLTIEFMTSEGPVKVVDRMSISLTEGEILGLAGESGSGKSLIAKAICGVTKDNLSVTADRFRFNDIDLLRLTLRQRRKVIGHNISMIFQEPQSCLDPSESIGKQLIQSIPGWTYKGRWWQRFNWRKRRAIELLHRVGIKDHYAIMHCYPYELTDGECQKVMIAIALANQPRLLIADEPTNAMEPTTQAQIFRLLSSLNQNNNMTILLISHDLQMMSKLVKRINVLYCGQTVESATPDELLVTPHHPYTQALIRSIPDFGNPLPHKGRLNTLSGAIPSLEHLPIGCRLGPRCPYAQKTCIETPRLRGVKNHVFACHFPLNMEEQ

SEQ ID NO: 6470 - protein, 269 aa, Xenorhabdus bovienii
  Coding DNA sequence: Name=SeqID_362
  Gene classification: Gene name=OppF; Function=ABC-type dipeptide/oligopeptide/nickel transport system, ATPase component; Function class=E Amino acid transport and metabolism
  Homolog annotation: Query=1..267bp; Hit=1..267bp; Blast score=404; Percent Identity=75.0; E value=1e-113; Homolog= sapF COG1124
LVETLLEVKNLTKTFRYRTGLFRHHHLDAVKPVSFTLQPKKTLAIIGANGSGKSTLARMLSGVIEPTSGDILINNHKLAYGDYSYRSQRIRMIFQDPSTSLNPRQRIGQILDVPLLLNTELSSSEREKQINQTLRQVGLLPDHAYYYPHMLASGQKQRVALARALILQPQIIVADEALASLDMSMRSQIINLMLELQEKHGIAYIYVTQHLGMMKHISDQVLVMHQGEVVERGNTAEVLASPLHDITRKLISSHFGEPLSAEAWRQDIT

SEQ ID NO: 6471 - protein, 262 aa, Xenorhabdus bovienii
  Coding DNA sequence: Name=SeqID_363
  Gene classification: Gene name=FabI; Function=Enoyl-[acyl-carrier -protein] reductase (NADH); Function class=I Lipid metabolism
  Homolog annotation: Query=1..262bp; Hit=1..262bp; Blast score=454; Percent Identity=87.0; E value=1e-128; Homolog= fabI COG0623
MGFMTGKRILITGVASKLSIAYGIAKAMHDQGAELAFTYQNDKLKLRVEEFAASLDSNIILPCDVAEDESIDALFAELGKVWPKFDGFVHSIGYAPAEQLDGDYVNAVNREGFKIAHDISAYSFVAMAKSCRNMLNPNSALLTLSYLGAERAIPNYNVMGLAKASLEANVRYMANAMGAEGVRVNGISAGPIRTLAASGIKDFRKMLAHCEAVTPIRRTVTTEDVGNAAAFLCSDLAGGVTGEILHVDGGFSIAAMNELELK

SEQ ID NO: 6472 - protein, 109 aa, Xenorhabdus bovienii
  Coding DNA sequence: Name=SeqID_364
  Gene classification: Gene name=Gst; Function=Glutathione-S -transferases; Function class=O Posttranslational modification, protein turnover, chaperones
  Homolog annotation: Query=1..109bp; Hit=1..109bp; Blast score=139; Percent Identity=60.0; E value=5e-34; Homolog= gst COG0625
MKLYYAPGACSLSPHIILRETGLDFSLIKVNLKDKTTENGTDFFKVNPKGQVPALVLDNDVILTEGSAIVQYIADQKPDRNLIAPAGTLERYQQIEWLSYVASEIHQSF

SEQ ID NO: 6473 - protein, 87 aa, Xenorhabdus bovienii
  Coding DNA sequence: Name=SeqID_365
  Gene classification: Gene name=Gst; Function=Glutathione-S -transferases; Function class=O Posttranslational modification, protein turnover, chaperones
  Homolog annotation: Query=2..86bp; Hit=116..200bp; Blast score=75; Percent Identity=41.0; E value=7e-15; Homolog= gst COG0625
MEAPESYRSITRQKLLQKFTYLDGILSKRSYIAGDHFTVIDAYLFTTCGWTPDITLDLSELSHLSAYLQNIRQRLHVQDALKAEGLI

SEQ ID NO: 6474 - protein, 292 aa, Xenorhabdus bovienii
  Coding DNA sequence: Name=SeqID_366
  Gene classification: Gene name=PdxK; Function =Pyridoxal/pyridoxine/pyridoxamine kinase; Function class=H Coenzyme metabolism
  Homolog annotation: Query=1..291bp; Hit=2..287bp; Blast score=412; Percent Identity=69.0; E value=1e-115; Homolog= pdxY COG2240
MKNVLSIQSHVVFGHAGNSAAVFPMRRMGVNVWPLNTVQFSNHTQYPQWRGCVMPPEHLAEIAQGIGEIDKLVSCNAVLSGYIGSAEQGNHILDIVKQVKQANPEAWYFCDPVMGHPEKGCIVAPGVAEFLCEKALPISDIIAPNLLELETLSMRKIENVEQAISAARALCEKGPDIVLVKHLSRAGYRADRFEMLLVTKEHSWHISRPLINTGERQPVGVGDLTSGLLLVNLLKSTSLTDEALQVALEHVASAVYEVMLETQERGEYELQIIAAQDKMVTPTHQFRAVQIG

SEQ ID NO: 6475 - protein, 428 aa, Xenorhabdus bovienii
  Coding DNA sequence: Name=SeqID_367
  Gene classification: Gene name=TyrS; Function=Tyrosyl-tRNA synthetase; Function class=J Translation, ribosomal structure and biogenesis
  Homolog annotation: Query=1..428bp; Hit=1..428bp; Blast score=741; Percent Identity=83.0; E value=0; Homolog= ZtyrS COG0162
MEPLMFSNNLIKQLQDRGLVAQVTDEEALAERLAQGPVSLYCGFDPTADSLHLGHLVPLLCLKRFQLTGHKPIALVGGATGLIGDPSFKATERKLNTEETVKEWVEKIRKQVSPFLDFDCGENRAEIANNYEWFGEMDVLTFLRDIGKHFSVNQMINREAVKQRLHRDDVGISYTEFSYNLLQSYDFANLNGKYGVELQIGGSDQWGNITSGIDLTRRLHQKQVFGLTVPLITKSDGTKFGKTEGGAVWLDPKKTSPYKFYQFWISTADADAYRFLKFFTFMSIEEINALEEEDKNSGKAPRAQYVLAEQVTDMVHGEAGLAAAKRITDSLFSGIVADLTEEDLAQLAQDGMPAIELEKDADLQQALVTAGLVPSRGQARTMIGSNAVSINGEKQSDAEYTFAASDRLFERYTLLRRGKKHYCLINWK

SEQ ID NO: 6476 - protein, 101 aa, Xenorhabdus bovienii
  Coding DNA sequence: Name=SeqID_368
  Gene classification: Function=Uncharacterized BCR; Function class=S Function unknown
  Homolog annotation: Query=1..101bp; Hit=17..117bp; Blast score=115; Percent Identity=56.0; E value=6e-27; Homolog= yacL COG3112
MEYEFTQDIAGHVTTSFSMDHEAIGHWLNEEVKGDLSVLDKITSALAGIKGSERQWQLIGHEYTLLMSEGEIMIRANQLQFDTEMVEEGMSYYDNESLAFC

SEQ ID NO: 6477 - protein, 865 aa, Xenorhabdus bovienii
  Coding DNA sequence: Name=SeqID_369
  Gene classification: Gene name=AcnB; Function=Aconitase B; Function class=C Energy production and conversion
  Homolog annotation: Query=1..865bp; Hit=1..865bp; Blast score=1534; Percent Identity=88.0; E value=0; Homolog= acnB COG1049
VLEEYRKHVAERAAQGIVPKPLDAAQAAALVELLKNPPKGEEDFLLDLLTNRVPPGVDEAAYVKAGFLAAIAKSETASPLVTREKAIELLGTMQGGYNIHALIDALDDEKLAPISVKALSHTLLMFDSFYDVEEKAKAGNSHAKQIIQSWADAKWFLERPELAEKITITVFKVTGETNTDDLSPAQDAWSRPDIPLHALAMLKNAREGIEPDQAGAVGPIKQIEELNKKGHPLAYVGDVVGTGSSRKSATNSVLWFMGEDIPFVPNKRGGGVVLGGKIAPIFFNTMEDAGALPIEVDVSNLNMGDVIDIYPYKGEIRHHDTNELLATFGLKTDVLLDEVRAGGRIPLIIGRGLTTKARESLELPHSDVFRQAKAIEKSERGFSLAQKMVGRACGTTGIRPGEYCEPKMTSVGSQDTTGPMTRDELKDLACLGFSADLVMQSFCHTAAYPKPVDVTTHHTLPDFIMNRGGVSLRPGDGIIHSWLNRMLLPDTVGTGGDSHTRFPIGISFPAGSGLVAFAAATGVMPLDMPESVLVRFKGKMQPGITLRDLVHAIPYYAIQQGLLTVEKKGKKNIFSGRILEIEGLPELKVEQAFELADASAERSAAGCTIKLDKAPITEYLQSNIVLLKWMIAEGYGDRRTLERRIIGMENWLKDPQLLEADADAEYSAVIEIDLAEIKEPILCAPNDPDDARLLSAVANSKIDEVFIGSCMTNIGHFRAAGKLLDQHKGQLPTRLWVAPPTKMDAAQLTEEGYYSIFGKSGARVEIPGCSLCMGNQARVADGATVVSTSTRNFPNRLGAGANVYLASAELAAVASLLGRLPMPEEYLQFMDKVDETAADTYRYLNFDQLNQYTEKADEVIFQTAV

SEQ ID NO: 6478 - protein, 475 aa, Xenorhabdus bovienii
  Coding DNA sequence: Name=SeqID_370
  Gene classification: Gene name=Lpd; Function=Dihydrolipoamide dehydrogenase/glutathione oxidoreductase and related enzymes; Function class=C Energy production and conversion
  Homolog annotation: Query=1..474bp; Hit=1..474bp; Blast score=869; Percent Identity=93.0; E value=0; Homolog= lpd COG1249
MSTEIKAQVVVLGAGPAGYSAAFRCADLGLDTVLVERYSTLGGVCLNVGCIPSKALLHVAKVIEEAKALAQHGIVFGEPQTDIDKIRLWKEKVISQLTGGLGGMAKGRKVNVVNGIGKFTGANTLVVESEKGATTINFDNAIIAAGSRPIQLPFIPHDDPRVWDSTDALELKTVPERLLVMGGGIIGLEMGTVYHALGSQIDVVEMFDQVIPAADKDIVKVFTKRISKKFNLMLETKVTAVEAKEDGIYVTMEGKKAPAEPQRYDAVLVAIGRVPNGKSLDAGQAGVEVDERGFIHVDKQMRTNVPHIFAIGDIVGQPMLAHKGVHEGHVAAEVISGKKHYFDPKVIPSIAYTEPEVAWVGLTEKEAKEKGISYETATFPWAASGRAIASDCSDGMTKLIFDKESNRIIGGAIVGTNGGELLGEIGLAIEMGCDAEDIALTIHAHPTLYESIGMAAEMYEGSITDLPNPKAKKKK

SEQ ID NO: 6479 - protein, 620 aa, Xenorhabdus bovienii
  Coding DNA sequence: Name=SeqID_371
  Gene classification: Gene name=AceF; Function=Dihydrolipoamide acyltransferases; Function class=C Energy production and conversion
  Homolog annotation: Query=1..620bp; Hit=1..630bp; Blast score=807; Percent Identity=77.0; E value=0; Homolog= ZaceF COG0508
MSIEINVPDIGADEVEVTEILVKAGDTVEAEQSLITVEGDKASMEVPSPQAGVVKEIKVAVGDKIETGKLIMIFESAKGAAEAAPVQQKAAALAAAPVAAESKEVNVPDIGGDEVEVTEIMVKVGDTITEEQSLITVEGDKASMEVPAPFAGTVKEIKIAAGDKVKTGSLIMVFEVAGSGTAPAATPAPVAAAPAASAAKEVNVPDIGGDEVDVTEIMVKVGDTITEEQSLITVEGDKASMEVPAPFAGTVKEIKIAVGDKVKTGSLIMVFEVAGAAPAVALAAAPSLAVESVKAAPAASQPAEGKNEFAENDAYVHATPVIRRLAREFGVNLAKVKSTGRKGRILREDIQAYVKNAIKRAEAAPTAAAGGGMPGMLPWPKIDFSKFGEIEEVEMSRIQKISGANLSRNWVMIPHVNLFDEADITEVEAFRAQQNKEAEKKQLGVKITPLVFVMKAAAKALEAMPRFNSSISEDGQKLILKKYINIGIAVDTPNGLVVPVFKDVNKKGIIELSRELAEVSKKARAGKLTASDMQGGCFTISSLGGIGTTGFAPIVNAPEVAIMGLSRSSMKPVWNGKEFVPRLILPMSLSFDHRVIDGADGARFITYINEVMSDIRRLAM

SEQ ID NO: 6480 - protein, 887 aa, Xenorhabdus bovienii
  Coding DNA sequence: Name=SeqID_372
  Gene classification: Gene name=AceE; Function=Pyruvate dehydrogenase, decarboxylase component; Function class=C Energy production and conversion
  Homolog annotation: Query=1..887bp; Hit=1..887bp; Blast score=1633; Percent Identity=87.0; E value=0; Homolog= aceE COG2609
MSDILKNDVDPIETRDWLQAIESVIREEGVERAQFLIDQVLNGARKGGVSVAAGVASRDYINTIPVEDEPAYPGNLDLERRIRSAIRWNAVMTVLRASKKDLDLGGHMASFQSSATFYDVCFNHFFRARNENDGGDLVYFQGHISPGVYARAFLEGRLTEEQMNNFRQEIGGNGLSSYPHPKLMPDFWQFPTVSMGLGPISAIYQAKFLKYLEHRGLKNTSQQTVYAFLGDGEMDEPESKGAITIATREKLDNLVFVINCNLQRLDGPVTGNGKIVNELEGIFAGAGWKVLKVLWGERWDELLRKDTSGKLVQLMNETLDGDYQTFKSKDGTYVREHFFGRYPETAALVKDMTDDEIWALNRGGHDPKKVYAALNQAQNTTGQPTVILAQTIKGYGMGDTAEGKNIAHQVKKMNMEGVRHFRDRFNVPVSDEQIEKLPYVTFDKDSEESKYLHEHRNALGGYLPSRRVNFDEKLEIPALEDFSSLLEEQSKEISTTIAFVRALNVMLKNKSIKDRLVPIIADEARTFGMEGLFRQIGIYSPNGQQYTPQDREQVAYYKEDAKGQILQEGINELGAASSWLAAATSYSTNNLPMIPFYIYYSMFGFQRIGDLCWAAGDQQARGFLVGGTSGRTTLNGEGLQHEDGHSHIQSLTIPNCISYDPAFAYEVAVIMHDGLERMYGEKQENIYYYITTLNENYHMPAMPAGAEEGIRKGIYKLEAFDSAKGKVQLLGSGSILRHVREAAKILSDEYGIGSDVYSVTSFTELARDGQDCERWNMLHPSEEPRVPYIAQIMNEAPAVASTDYMKLFAEQVRNFVPASEFRVLGTDGFGRSDSRENLRHHFEVDASYVVVAALGELAKRGEVDVKVVEEAIKKYNINPEKVNPRLA

SEQ ID NO: 6481 - protein, 270 aa, Xenorhabdus bovienii
  Coding DNA sequence: Name=SeqID_373
  Gene classification: Gene name=FadR; Function=Transcriptional regulators; Function class=K Transcription
  Homolog annotation: Query=17..250bp; Hit=1..234bp; Blast score=323; Percent Identity=79.0; E value=2e-88; Homolog= pdhR COG2186
MTSPKQHLLIEWLTADMAYSKIRQPKLSDVIEQRLEHLILEGSLRPGEKLLPERELAKQFEVSRPSLREAIQKLEAKGFLFRRQGGGTFVQSNLWQSFSDPLARLIADNQESQFDLLEARHALEGIAAYYAALRGTDEDFERIEKSHFAIQEAQQSGDVKAESDAVLQYQLVVTEAAHNVVLLHLLRCMIPILEQNIRRNFEFIYTRKEMLAAVSNHRAEIFRAIMAREPEKAREASHRHLAFIEEVLLDLTREHTRRERSLRRLQQHQE

SEQ ID NO: 6482 - protein, 284 aa, Xenorhabdus bovienii
  Coding DNA sequence: Name=SeqID_374
  Gene classification: Function=Membrane protein required for beta -lactamase induction; Function class=T Signal transduction mechanisms
  Homolog annotation: Query=1..283bp; Hit=1..283bp; Blast score=286; Percent Identity=54.0; E value=2e-77; Homolog= ZampE COG3725
MTLFILLLVLAWERVFKMGDHWQLERYLSPLFAIMKLFSLWSSLGMTLLVALLTWKLIDVLSDVVFGVPGILLYIMISLLCIGAGSLRYDYREYLRAVRLDDLDQQNNHLARLTMIQGTLPDTTKDERLREIQNALIWINFRYYLAPIFWLVVMGKLGPAILIGYGFLRGYQGWLAQHGTAVQRAQTGVDSLLHCLDWVPARLAGIAYALLGHGEKALPAWVASLSDLRTSQYKVVSQLAQFALSKEPHLNPIETPVAAVRLAKKATLTIVIIVALLTIYGALA

SEQ ID NO: 6483 - protein, 183 aa, Xenorhabdus bovienii
  Coding DNA sequence: Name=SeqID_375
  Gene classification: Gene name=AmpD; Function=Negative regulator of beta-lactamase expression; Function class=M Cell envelope biogenesis, outer membrane
  Homolog annotation: Query=1..180bp; Hit=1..180bp; Blast score=250; Percent Identity=66.0; E value=6e-67; Homolog= ZampD COG3023
MKLHEGWIDGARKVISPYYDLRPEGEIPSLLVIHNISLPPGKFGGPYIDQLFMGTLNSDEDPFFNEIKGLCVSAHCLIRRDGEIVQYVPFDKRAWHAGVSCYCDHEKCNDFSIGIELEGTDYEPFSEIQYLRLAEVTQLLICHFPDIRNNITGHSDIAPGRKTDPGPYFYWEHYRQLLKERVE

SEQ ID NO: 6484 - protein, 140 aa, Xenorhabdus bovienii
  Coding DNA sequence: Name=SeqID_376
  Gene classification: Gene name=HofG; Function=General secretory pathway proteins G and H and related periplasmic/secreted proteins; Function class=N Cell motility and secretion
  Homolog annotation: Query=3..140bp; Hit=4..142bp; Blast score=139; Percent Identity=46.0; E value=1e-33; Homolog= ZppdD COG2165
MNQQGFTLMELMVVMAIVSILGAIAIPSYQGYIQKAALTDMLQTIVPYKSGVELCRFETENYKDCNTGHASIPSGHNSRYISTVTVKDGEIIIVGQQNLNGLTTTLKPTQDTKTGVIYWRTICDTKNESLKLKCQETFKF

SEQ ID NO: 6485 - protein, 492 aa, Xenorhabdus bovienii
  Coding DNA sequence: Name=SeqID_377
  Gene classification: Gene name=GspE; Function=Predicted ATPases involved in pili biogenesis, PilB homologs; Function class=N Cell motility and secretion
  Homolog annotation: Query=78..488bp; Hit=68..456bp; Blast score=380; Percent Identity=49.0; E value=1e-105; Homolog= hofB COG2804
MTIACSKSPNEDFIAALRFISGSIINVDIWPKAKIESMLTQGNSLVSCTENHCAENDDEEHYRIEKLDVPYSNHSEIQTNDAHSEDMDTPVIQLINQTISTSIQKRASDIHFEPSQRGYRIRIRVDGILHAVSSPSPQMNTGIPARLKIMAKLNIAEKRQPQDGQFDWNDSKNSYAIRISTLPTLHGEKIVLRVLNTIHQLSLEQLGLPEPQLQLLKQKIHLPQGMILVTGPTGSGKTVTLYSCLQYLNQAKKNICSVEDPVEIPLNGINQTPVNNKIGLDFAKVLRALLRQDPDIIMVGEIRDNETAEISMKAAQTGHLVLSTLHTNSTIDTLSRLQNLGISGYTTASCVKLIIAQRLVRTLCPHCRQQDKEHTVINVDSGAISIKQPIPIEQAVSIKQPDSVKQSISIRQWLAVGCEHCFSGYYGRTAIYEFLEIKPTLQQALSEHSIDNLPQLLAAQQHSTLFSAGLVLVEKGITTLEEIYQITGQETA

SEQ ID NO: 6486 - protein, 399 aa, Xenorhabdus bovienii
  Coding DNA sequence: Name=SeqID_378
  Gene classification: Gene name=HofF; Function=General secretory pathway protein F; Function class=N Cell motility and secretion
  Homolog annotation: Query=1..399bp; Hit=1..397bp; Blast score=199; Percent Identity=34.0; E value=4e-51; Homolog= ZhofC COG1459
MKMEYIYQWQAVNKKGNIVKGESIGQSRQSVFQHLSHLDLQPYTIKCKKLIHYSEKEIAYRLHFIHQLSTLLASGIPLLKGLTLLLQECKQMLWRCVLTDIIQKISQGESFSTTLGHYPRLFSPLFRQLIAVGEETGQLETCCQLIINRLEQQNILRKKIQKAYRYPLIVAFVTILVILLMLIFVLPEFKQVYSSFDASLPLLTQWVLSASDFLINHGVLLLAIASLLIISYLWLRHQFPTLQTREKMFLLKLPLFKQLTIYQQTNQIFHILFMTQKAGLTLTTGLECALNATHHPVFMAGVKNLYRQIQQGIPMSDALKKEMYFPPLCQQFVMIGEESGELELFLGNLAAWYQEQSISLADSLVQLLEPVLMLIMAVIVGLLLLAMYLPVFQLGTILT

SEQ ID NO: 6487 - protein, 207 aa, Xenorhabdus bovienii
  Coding DNA sequence: Name=SeqID_379
  Gene classification: Gene name=CoaE; Function=Dephospho-CoA kinase; Function class=H Coenzyme metabolism
  Homolog annotation: Query=1..203bp; Hit=1..204bp; Blast score=222; Percent Identity=60.0; E value=2e-58; Homolog= coaE COG0237
MSYIIALTGGIGSGKTTISNVFSSLGVPLIDADIIAREVVAPGSPALQTIAEHFGADILLPDGSLNRVLLRQKIFAVPTEKQWINALLHPLIHTETQQQLSQVTAPYAIWVVPLLIENNLMHLADRILVVDVPPEVQISRTMTRDGVSREQVENILAAQANRHERLEKADDVIFNHHNEQDIISRVVELHQQYLKQAESVRQENRNE

SEQ ID NO: 6488 - protein, 252 aa, Xenorhabdus bovienii
  Coding DNA sequence: Name=SeqID_380
  Homolog annotation: Query=1..252bp; Hit=1..250bp; Blast score=338; Percent Identity=73.0; E value=3e-92; Homolog= ref|NP_930850.1|
MSDATSTIIFEHPLNEKMRSWLRIDSSLQQLEKQRHLDSSASCLAFFRTIAELIEILERGEVRSELLKELDRQQAKLKQWLGSPDVDTAMIHILIEQLKERSIALNKAPRLSQHIKEDRIISIVRQRLSIPGGCCSFDLPTLHLWLHLPQSVRDKTVNSWLDGLRPLQQALESILGLIRQSAIFSPKISHNGFYQGNADESDLLRLKLDVVLDALVYPQISGHKTRFAIRFLPMDSEHGVVPAHLSFELACC

SEQ ID NO: 6489 - protein, 65 aa, Xenorhabdus bovienii
  Coding DNA sequence: Name=SeqID_381
  Gene classification: Function=Uncharacterized BCR; Function class=S Function unknown
  Homolog annotation: Query=1..63bp; Hit=1..63bp; Blast score=94; Percent Identity=76.0; E value=2e-20; Homolog= yacG COG3024
MSEVLTVACPTCAKTVIWGEINPYRPFCSKRCQLIDLGEWASEEKKIASQDDSSENDSWSEEPDR

SEQ ID NO: 6490 - protein, 134 aa, Xenorhabdus bovienii
  Coding DNA sequence: Name=SeqID_382
  Gene classification: Gene name=MutT; Function=NTP pyrophosphohydrolases including oxidative damage repair enzymes; Function class=L DNA replication, recombination and repair
  Homolog annotation: Query=4..130bp; Hit=2..128bp; Blast score=154; Percent Identity=58.0; E value=2e-38; Homolog= ZmutT COG0494
MEKKHLHIAAGIIKNTNDEIFITQRHADSHMGGFWEFPGGKLEQGEIPEQALIRELKEEVGITVTHCELVETITHEFSDRNITLYFYLVDQWKNEPFGKEGQPSRWVLQTELIADEFPPANRSIVALLNKSGSH

SEQ ID NO: 6491 - protein, 547 aa, Xenorhabdus bovienii
  Coding DNA sequence: Name=SeqID_383
  Gene classification: Gene name=Uup; Function=ATPase components of ABC transporters with duplicated ATPase domains; Function class=R General function prediction only
  Homolog annotation: Query=25..525bp; Hit=22..526bp; Blast score=249; Percent Identity=35.0; E value=5e-66; Homolog= PA1425 COG0488
MQYAGQPLIEAKQIAYQFSGEIIPLFSGIDMFLNAEQHALVGRNGIGKSWLASILARQIPPTEGSVNHFCDVRYLSQGLTSFSGNAAEMLGLTEIMNANERILAGVGDMTDFDVMENHWDWQFQIESLLAEGELRSEVLNQPFSSLSGGEQTRLRLLALKHQGAEFMILDEPSNHLDRQGRLWLAQWLTTFSGGILLITHDPQLLQHVSVVYELSGLGLCRSTGGWETWLESKEQLRLSVQREVDQTRKNLKQALLDKQKDREKASKRQSQGKQRRENANQSKIILDRELGRSEATLSRQAKQHEERLQRSASLATDARTKLEIIAPQSIVVAAPQIATAPLLYLQNVILPFGSSSPISLTMNHRDRLAITGKNGSGKSTLLKVMAGLFPAKQGTCRITPSYRLMDQHFSFLDKNQSALQNFQLQSPGWPEDRYRTRLAQLRIRGEEVLKPVGYLSGGEQLKVALACLFCGPYAPALLLLDEPDNHLDIESRELLQKALHGYTGAMVLISHDAQFIANIGNMKELLLGGSEDSLHKKTSNHSLRNEF

SEQ ID NO: 6492 - protein, 902 aa, Xenorhabdus bovienii
  Coding DNA sequence: Name=SeqID_384
  Gene classification: Gene name=SecA; Function=Preprotein translocase subunit SecA (ATPase, RNA helicase); Function class=N Cell motility and secretion
  Homolog annotation: Query=1..902bp; Hit=1..900bp; Blast score=1533; Percent Identity=87.0; E value=0; Homolog= ZsecA COG0653
MLIKLLTKIFGSRNDRTLRRLRKSVEIINRMEPDLEKLSDEELKAKTEQFRARLKAGESLEKILPEAFATVREASKRVFGMRHFDVQLLGGMVLNERCIAEMRTGEGKTLTATLPAYLNALSGRGVHVVTVNDYLAQRDAENNRPLFEYLGLTVGINLPNMPAPAKREAYAADITYGTNNEYGFDYLRDNMAFSPEERVQRKLHYALVDEVDSILIDEARTPLIISGPAEDSSELYIKVDKLIPKLIRQEKEDSEAFQGEGHFSVDEKTRQVNLTERGLVLVEELLVGAKLMDEGESLYSPTNIMLMHHVTAALRAHVLFTRDVDYIVKDGEVIIVDEHTGRTMQGRRWSDGLHQAVEAKEGVEIQNENQTLASITFQNYFRIYEKLAGMTGTADTEAFEFSSIYKLDTIVVPTNRPMIRKDLPDLVYMTEAEKIDAIIEDIKERTNNGQPILVGTISIEKSEVIAKALTKAGIEHNVLNAKFHAMEADIIAQAGQAGTVTIATNMAGRGTDIVLGGSWQSEIAKLEEPTQEKIEQIKAAWQERHDEVLAAGGLHIIGTERHESRRIDNQLRGRAGRQGDAGSSRFYLSMEDSLMRIFASDRVTGMMRKLGMQPGEAIEHPWVTKAIANAQRKVESRNFDIRKQLLEYDDVANDQRRAIYAQRNDLLDVSDVSETIASIREDVFKVTIDAYIPPQSLEEMWDIEGLHERLVNDFDLDMPIKEWLDKEPELHEETLRERILEKAIEVYKQKEEIVSTEMMRNFEKGIMLQTLDTLWKEHLAAMDYLRQGIHLRGYAQKDPKQEYKRESFAMFANMLESLKYEVISTLSKVQVRIPEEVEALEHQRREEAERLAKKQHLSHEVEQGALMSETEAQMASGARKVGRNDPCPCGSGKKFKHCHGSL

SEQ ID NO: 6493 - protein, 61 aa, Xenorhabdus bovienii
  Coding DNA sequence: Name=SeqID_385
MQQLMLDTLHAMLIQAPSQFESILDIEITATILPDSHTPALWVAKTQGIRAGPTANHLSLL

SEQ ID NO: 6494 - protein, 178 aa, Xenorhabdus bovienii
  Coding DNA sequence: Name=SeqID_386
  Homolog annotation: Query=1..175bp; Hit=1..171bp; Blast score=228; Percent Identity=76.0; E value=3e-59; Homolog= ref|NP_930855.1|
MRDSRPQSLDTLFEDEAAVGKSPLQIIQQHAIALLKLNRAILSLLPAQLHPWCRVANYRKHILVLEAGNASWMTRLRYEVPVLLSTLRSEILPSLSSIDIRINPSLMVKRSNNAQDFARSSTTAPNNDNQNLPKRQLSHESAETLMILAERSPEKLKRKLERLAALAGEGTSTAKKKR

SEQ ID NO: 6495 - protein, 305 aa, Xenorhabdus bovienii
  Coding DNA sequence: Name=SeqID_387
  Gene classification: Gene name=LpxC; Function=UDP-3-O-acyl-N -acetylglucosamine deacetylase; Function class=M Cell envelope biogenesis, outer membrane
  Homolog annotation: Query=1..305bp; Hit=1..305bp; Blast score=569; Percent Identity=88.0; E value=1e-162; Homolog= lpxC COG0774
MIKQRTLKRTVQATGVGLHTGKKVTLTMRPAPANTGVIYRRTDLNPPVDFPANAKSVRDTMLCTCLVNEHNVRISTVEHLNAALAGLGIDNIVIDVDAPEIPIMDGSASPFVFLLLDAGIEELNVAKKFVRMKDAVRVEDGDKWAELAPYHGFSLDFTIDFNHPAIDSSSQRYSLDFSADSFVRQISRARTFGFMRDIEYLQSQGLCLGGSFDCAIVVDDYRVLNEDGLRFEDEFVRHKMLDAIGDLFMCGYNIIGAFTAFKSGHALNNKLLQAVLAHESAWEFVTFEDEAEMPLAFRAPSTVMA

SEQ ID NO: 6496 - protein, 42 aa, Xenorhabdus bovienii
  Coding DNA sequence: Name=SeqID_388
VSLFIKIARYRYKRKSGICQDTTFYYRMWMRIKLNLLSRLHA

SEQ ID NO: 6497 - protein, 402 aa, Xenorhabdus bovienii
  Coding DNA sequence: Name=SeqID_389
  Gene classification: Gene name=NupC; Function=Nucleoside permease; Function class=F Nucleotide transport and metabolism
  Homolog annotation: Query=7..400bp; Hit=1..400bp; Blast score=484; Percent Identity=75.0; E value=1e-137; Homolog= nupC COG1972
MSGVLFMSHIFHFILALVVIGGLAIFASNNRKDIRVRYIIQLLVIELVLAWFFLNSDVGLGFVKGFDNLFVHLLSYAAEGTRFIFGGMIEAKLAFFFLNVLCPIIFISALIGILQHIKVLPIIIRVIGTVLSKVNGMGKLESFNAVSSLILGQSENFVAYKDVLGKMSERRMYTMAATAMSTVSMSIVGAYMTMLDAKYVVAALVLNMFSTFIVLSLINPYSVESEGDIQMNNLHEGQSFFEMLGEYILAGFKIALIVTAMLIGFIALIAAINAIFDMIFGISFQECLGYVFYPLAWIIGIPSDEAFKVGSIMATKLVSNEFVAMQGLQDIAAQLSERSKGILSVFLVSFANFSSIGIVAGAIKGLNEKQGNTVARFGLKLLFGSTLVSFLSAAITGLVLSM

SEQ ID NO: 6498 - protein, 672 aa, Xenorhabdus bovienii
  Coding DNA sequence: Name=SeqID_390
  Gene classification: Gene name=Lig; Function=NAD-dependent DNA ligase (contains BRCT domain type II); Function class=L DNA replication, recombination and repair
  Homolog annotation: Query=1..671bp; Hit=1..670bp; Blast score=1028; Percent Identity=76.0; E value=0; Homolog= lig COG0272
MENIIEKINKLRATLRHHEYLYHVMDAPEIPDAEYDRLMRELKVLEEQHPELITADSPTQRVGAAPLTAFEQVRHEIPMLSLDNVFDEESYLAFDKRVRDRLKDSRDLVFCCELKLDGLAVSLLYEDGELVQAATRGDGTTGENITANVRTIHAIPLRLKGNNIPARVEIRGEVFIKQGGFEKLNDEVRRKGNKVFANPRNAAAGSLRQLDPRITGKRPLTFCCYGVGVLEGGELPTSHYERLMQFKQWGLPVSDKVELCQGTQQVIDFYHNIEQQRPILGFDIDGVVIKVDSLELQETLGFVAKAPRWATAFKFAAQEQMTIVRDVEFQVGRTGAITPVARLEPVQVAGVIVSNATLHNADEIERLGLRIGDTVVIRRAGDVIPKVVSVVQDKRPAESQEVIFPEYCPVCRSDIERVEGESVARCTGGLFCGAQRKEALKHFVSRRAMDVDGMGEKIIEQLVDKEYVKTPADLFRLTAGKLTGLERMGPKSAQNVIDALEKSKKTTFARFIYSLGIREVGEATAVNLVSYFATLEKLRAADTEALIAVQDVGGVVASHVVNFFNELHNQTVIDDLIDNIGIHWESVETLQSDTVGNPFAGKIVVLTGSLSRLSRDEAKDKLTALGAKVTGSVSKKTDLVIAGEAAGSKLVKATELGIEVIDEEEMLRLLGE

SEQ ID NO: 6499 - protein, 309 aa, Xenorhabdus bovienii
  Coding DNA sequence: Name=SeqID_391
  Gene classification: Gene name=ZipA; Function=Cell division protein; Function class=D Cell division and chromosome partitioning
  Homolog annotation: Query=1..307bp; Hit=1..326bp; Blast score=224; Percent Identity=45.0; E value=1e-58; Homolog= zipA COG3115
MMQDLRLILIVVGAIAIIALLLHGLWTSRKERSSLFRDRPVKRHKQERQEELDDNDGDELFDNSSKSHVQESVKPRNEHREEPVIKRSAPELSAVALDEVFDPLLSNQQPGAPGAKVKTVEEYQEEPQLSLFESTEQSAEAAESVVNTAVVEEQLNVLENETVGEVEQVKKETVLVLHVSAHHGQELDGEALLQSILQSGFRFGDMNIFHRHLNPAGSGAVLFSLANMVKPGSFNPELMDDFSTPGISMFMLVPSYGDANQNFKLMLQAAQRIASDVGGVVLDGERKMLTPQMIEHYKARIRNTLNACE

SEQ ID NO: 6500 - protein, 101 aa, Xenorhabdus bovienii
  Coding DNA sequence: Name=SeqID_392
VTNALCGWSTTHVIAKLLWLSHQQRLISDANPASLLSLLFKLIATTAEYSLDKSICQIAQVQVSTYFSYHKGDIPCFFGYFLHTKLLVSRKSCLYHTVSII

SEQ ID NO: 6501 - protein, 258 aa, Xenorhabdus bovienii
  Coding DNA sequence: Name=SeqID_393
  Gene classification: Gene name=CysZ; Function=Uncharacterized protein involved in cysteine biosynthesis; Function class=E Amino acid transport and metabolism
  Homolog annotation: Query=1..252bp; Hit=2..251bp; Blast score=320; Percent Identity=67.0; E value=1e-87; Homolog= cysZ COG2981
MTNSTKLPKHLSGFHYIAQGWHLITRPGIKRFVLLPLLANILLLGGSFWWLYHKLDGWILWALDKIPDWMQWLSYLLWPLAVVSILLIFTYFFSMLANFIASPFNGLLAEKLEAELTGIPAPNTGMVDLIKDTPRILKREVVKILYYIPRALVLLLLYFIPGIGQTVAPVLWFIFSAWMLAIQYCDYPFDNHKVSFSTMCSTLRQNKIDNLQFGAAVSVLTMIPVVNLFIMPVAVCGATAMWVDRYRAQHALHHNPSH

SEQ ID NO: 6502 - protein, 317 aa, Xenorhabdus bovienii
  Coding DNA sequence: Name=SeqID_394
  Gene classification: Gene name=CysK; Function=Cysteine synthase; Function class=E Amino acid transport and metabolism
  Homolog annotation: Query=1..314bp; Hit=1..315bp; Blast score=467; Percent Identity=79.0; E value=1e-132; Homolog= cysK COG0031
MSKIYEDNSLTIGHTPLVRLKHFGNGRILAKIESRNPSFSVKCRIGANMIWDAEKRGILTKDKELIEPTSGNTGIALAYVAAARGYKLTLTMPETMSLERRKLLKALGASLVLTEGAKGMKGAIDKADEIRDSDPDRYILLQQFSNPANPEIHEKTTGPEIWEATDGDIGAFVAGVGTGGTITGVARYLKNTQAAQVTIVAVEPEDSPVISQKLAGEELKPGPHKIQGIGAGFIPDNLDLTLVDRVFKVSNEEAIKTARELAEKEGILAGISSGAAVAAAVRLSQEDEYKDKNIVVILPSSAERYLSTALFADLAND

SEQ ID NO: 6503 - protein, 56 aa, Xenorhabdus bovienii
  Coding DNA sequence: Name=SeqID_395
VYLGIIKKLTHSMHSIVGFMLIHTIRVFVELDGAFHSGSAINFVHQNNYWLNTKAT

SEQ ID NO: 6504 - protein, 47 aa, Xenorhabdus bovienii
  Coding DNA sequence: Name=SeqID_396
VCINIKPTIECIECVNFLIMPKYTLFHYQFNGCTSQSGFSYTSFRIF

SEQ ID NO: 6505 - protein, 85 aa, Xenorhabdus bovienii
  Coding DNA sequence: Name=SeqID_397
  Gene classification: Gene name=FruB; Function=Phosphotransferase system, HPr-related proteins; Function class=G Carbohydrate transport and metabolism
  Homolog annotation: Query=1..85bp; Hit=1..85bp; Blast score=128; Percent Identity=90.0; E value=1e-30; Homolog= ptsH COG1925
MFQQEVTITAPNGLHTRPAAQFVKEAKGFSSDITLTSGGKSASAKSLFKLQTLGLTQGTAVTISADGEDEQHAVEHLVKLMGELE

SEQ ID NO: 6506 - protein, 58 aa, Xenorhabdus bovienii
  Coding DNA sequence: Name=SeqID_398
MGSSFSNNALPKAMPGDTKMPEIILYDLTAGDYLPLSLQGGGSKYPQILFIWGWNSVK

SEQ ID NO: 6507 - protein, 575 aa, Xenorhabdus bovienii
  Coding DNA sequence: Name=SeqID_399
  Gene classification: Gene name=PtsA; Function=Phosphoenolpyruvate -protein kinase (PTS system EI component in bacteria); Function class= G Carbohydrate transport and metabolism
  Homolog annotation: Query=1..575bp; Hit=1..575bp; Blast score=858; Percent Identity=79.0; E value=0; Homolog= ZptsI COG1080
MISGILVSPGIAFGKALLLKEDPIIINQKKITTEQTEQEISRFKQGRDKSSVQLEIIRKTAEKNLGAEKAEIFEGHIMLLEDEELEQEIVTLIKKNLATADAAVYSVIEDQAKALEELDDEYLKERAADVRDIGKRLLKNILGMPIIDLGTIEEEAILIANDLTPSETAQLNLDKVLGFITDLGGRTSHTSIMARSLELPAIVGTTNATTQIKNGSYLILDAVNNQIYVNPSNAEIDQLKKAKNEYLSEKTELAKLKDLPAITLDGHQVEVCANIGTVRDVMGAERNGAEGVGLYRTEFLFMDRDTLPTEDEQFEAYKAVAEAVGNQAIIIRTMDIGGDKDLPYMNLPKEENPFLGWRAIRICLDRKEILHSQLRAILRASAFGKLRVMFPMIISVEEIRELKAELALLKNQLRDENKAFDESIEVGIMVETPAAATIAHHLAKEVDFFSIGTNDLTQYTLAVDRGNELISHLYNPMSPAVLSLIKQVIDASHAEGKWTGMCGELAGDERATLLLLGMGLDEFSMSAISIPGIKKIIRNTNYDDAKALAEQALSQPTAQELMDLVDTFTREKTLC

SEQ ID NO: 6508 - protein, 169 aa, Xenorhabdus bovienii
  Coding DNA sequence: Name=SeqID_400
  Gene classification: Gene name=NagE; Function=Phosphotransferase system IIA components; Function class=G Carbohydrate transport and metabolism
  Homolog annotation: Query=1..169bp; Hit=1..169bp; Blast score=258; Percent Identity=87.0; E value=1e-69; Homolog= crr COG2190
MGLLDKLKSLVSDDKKNSGSIEIIAPLSGEIVNIEDVPDVVFAEKIVGDGIAIKPAGNKIVAPVDGTIGKIFETNHAFSIESDSGVELFVHFGIDTVELKGAGFKRIAEEGQRVQKGDLVLEFDLAFLEERAKSTLTPVVISNMDEIKELSKVSGSVVVGESVIMRIKK

SEQ ID NO: 6509 - protein, 70 aa, Xenorhabdus bovienii
  Coding DNA sequence: Name=SeqID_401
VNLSSCVSKNNRKIIGNTFSALFLFADPAYLRMVDESPLFYQVFYRLSLIIQGRFFCGLLLSQKTTFNAK

SEQ ID NO: 6510 - protein, 290 aa, Xenorhabdus bovienii
  Coding DNA sequence: Name=SeqID_402
  Gene classification: Gene name=CysK; Function=Cysteine synthase; Function class=E Amino acid transport and metabolism
  Homolog annotation: Query=1..289bp; Hit=4..292bp; Blast score=427; Percent Identity=74.0; E value=1e-120; Homolog= ZcysM COG0031
LEDFIGNTPLVKLQRLTESVDAEIWVKLEGNNPAGSVKDRAAFSMIQQAELRGEIAPGDVLIEATSGNTGIALAMIAVVKNYKLKLLMPENMSLERQASMRAYGAELILVSKELGMEGARDLAQKMEQEGEGKVLDQFNNMDNALAHFNTTGPEIWQQTQGRITHFVSSMGTTGTITGVSRYLKSQSDKVHTTGLQPAENSQIPGIRRWSPAYMPGIYKKELVDQLLDITQMEAETTMRLLAQKEGIFCGVSSGGAVSGALRIAAKNPGAVIVAIVCDRGDRYLSTGVFN

SEQ ID NO: 6511 - protein, 362 aa, Xenorhabdus bovienii
  Coding DNA sequence: Name=SeqID_403
  Gene classification: Gene name=CysA; Function=ABC-type sulfate/molybdate transport systems, ATPase component; Function class=P Inorganic ion transport and metabolism
  Homolog annotation: Query=1..362bp; Hit=1..365bp; Blast score=490; Percent Identity=68.0; E value=1e-139; Homolog= cysA COG1118
MSIEISKINKSFGRVQILSEISLGIESGEMVALLGPSGSGKTTLLRIIAGLEQQSAGQLKFNGQDVSRVHAKDRRVGFVFQHYALFRHMNVFDNVAFGLTVLPRRQRLSGEALRSKVMALLDMVQLSHLADRYPSQLSGGQKQRVALARALAVEPQILLLDEPFGALDAQVRMELRRWLRQLHEELKFTSVFVTHDQEEAMEVADRVVVMNQGCIEQVGTPQQVWREPESRFVLEFMGEVNQLHGEIKGSQLWIGGKIFPLNVTPLHQGNVDVFFRPWEMTLSTQQTASCPLPVQIVEISPRGHFSLLSVLPVGWGKDLLSVIWQGNSPVPVRGNQYFMGGTGARLYAGDLSLKVLRLAESA

SEQ ID NO: 6512 - protein, 279 aa, Xenorhabdus bovienii
  Coding DNA sequence: Name=SeqID_404
  Gene classification: Gene name=CysU; Function=ABC-type sulfate/molybdate transport systems, permease components; Function class=P Inorganic ion transport and metabolism
  Homolog annotation: Query=1..279bp; Hit=1..279bp; Blast score=382; Percent Identity=75.0; E value=1e-106; Homolog= cysWm COG0555
MTEFSEYTVAQRSSINWGKWVLIGTGILVSTLMLVIPIMWIFLTAFSKGFDLVKQNLFDPDMLHAIWLTVMIALITVPINLIFGVMTAWLVTRFQFPGRQLLLTLIDIPFAVSPVVAGLLYLLFYGVNGWMGSWLGSYDIQLMFSWPGMVLVTVFVTCPFVVRELVPVMLSQGSQEDEAAILLGASGWKMFWRVTLPNIRWALLYGIVLTNARAIGEFGAVSVVSGAIRGETYTLPLQVELLYQDYNTVGAFTAAALLAVMAIITLMVKSAVQWRLSHQ

SEQ ID NO: 6513 - protein, 278 aa, Xenorhabdus bovienii
  Coding DNA sequence: Name=SeqID_405
  Gene classification: Gene name=CysU; Function=ABC-type sulfate/molybdate transport systems, permease components; Function class=P Inorganic ion transport and metabolism
  Homolog annotation: Query=2..278bp; Hit=1..277bp; Blast score=348; Percent Identity=80.0; E value=3e-96; Homolog= ZcysU COG0555
MMLVASGKRVLPGFGLSLGSSLFYTCLILLLPLSALAVQLSSMTWAQYWQVIVNPQVVAAYQVTLLAAAAASLFNMVFGMLMAWILTRYHFPGRSLLDGLMDLPFALPTAVAGLTLATLFSATGWYGAWLSNFNIKVVNTWLGIAVAMAFTSLPFVVRTVQPVLEELGTEYEEAAQTLGASRWQTFRRVILPEVSPALMAGTVLSFTRSLGEFGAVIFIAGNIAWQTEVVSLMIFVRLQEFDYPAASAIASVILAASLLLLFSVNILQSRFGKRIGGH

SEQ ID NO: 6514 - protein, 345 aa, Xenorhabdus bovienii
  Coding DNA sequence: Name=SeqID_406
  Gene classification: Gene name=Sbp; Function=ABC-type sulfate transport system, periplasmic component; Function class=P Inorganic ion transport and metabolism
  Homolog annotation: Query=4..343bp; Hit=1..336bp; Blast score=454; Percent Identity=66.0; E value=1e-128; Homolog= ZcysP COG1613
MKTVAINNKLLSGLVAVALLGLISAYSANAYAVGLLNSSYDISRELFSTLNPQFEKQWNAQHPQDKLIIKQSHAGSSKQALSILQGLRADVVTYNQVTDVQILHDRGNLIPADWQQRLPSNSSPYYSTMAFLVRKDNPKQIHTWDDLVRHDVKLIFPNPKTSGNGRYTYLAAWGAFQQQNEQNPVKVGQLMRRLLQNVAVFDTGGRGATTSFIERSLGDVLISFESEVNNIRKQYGADNYEIIVPPVDILAEFPVTWVDKNVRKNGTEAVAKAYLNYLYSPAAQQIIVSFNYRVNDKNVMEAQKPRFPETRLFRLEEQFGSWPQVMKTHFNTGGMLDQLLAEGHK

SEQ ID NO: 6515 - protein, 38 aa, Xenorhabdus bovienii
  Coding DNA sequence: Name=SeqID_407
LITPTFPIAYRVSSFLIKTRYIKQGIVNYPVINILDTV

SEQ ID NO: 6516 - protein, 206 aa, Xenorhabdus bovienii
  Coding DNA sequence: Name=SeqID_408
  Homolog annotation: Query=1..205bp; Hit=1..201bp; Blast score=250; Percent Identity=57.0; E value=8e-66; Homolog= ref|NP_928686.1|
MGKFFVFNLLSKQRVVAVSSLLGGSLLLSACAGISEFSWSSLSPLEWFGSTLRVSEQGVGEVNKQTDMVQSAIEQGLKGKYRLRSGMETQNGKFVSIIQGMEGNQVKIELSGLAKGKVDRIDVLDDGAKTVWGTKIGTPFSELYDKAFGVCHRSCDFTTQPTVICIAPQSQHISYVFTGTWDGPEGLMPSDDVLKNWKISRIIWKS

SEQ ID NO: 6517 - protein, 44 aa, Xenorhabdus bovienii
  Coding DNA sequence: Name=SeqID_409
MLSIIVSTYRQCCIVLVFLAFLLMKCFIFTNECFFKSVVYITRQ

SEQ ID NO: 6518 - protein, 137 aa, Xenorhabdus bovienii
  Coding DNA sequence: Name=SeqID_410
MMNEKVIIAVFIISLSVSVMARASDQKLVLPSNIHDKLNHTTNQEKITISQENKSHIQSPCRFIISEGKPESPIHDHYQLYRDNEGKIQVRIISSIGDNIPITSKKLFTLQNKYQRCLSHFIIKIINLVLYNSITAE

SEQ ID NO: 6519 - protein, 140 aa, Xenorhabdus bovienii
  Coding DNA sequence: Name=SeqID_411
  Gene classification: Gene name=RimI; Function=Acetyltransferases; Function class=R General function prediction only
  Homolog annotation: Query=1..125bp; Hit=38..162bp; Blast score=196; Percent Identity=73.0; E value=4e-51; Homolog= Z3699 COG0456
MEIRVFRQDDFEAVTTLWERCDLINPGDDPEVDIERKLTHDADLFLVAEVAGEVVGTVMGGYDGHRGHAYYLSVHPEFRGRGIANALISRLEKKLLARGCPSILILVSEENDATICMCEKMEYDYLGQENTIFCKRLIID

SEQ ID NO: 6520 - protein, 35 aa, Xenorhabdus bovienii
  Coding DNA sequence: Name=SeqID_412
LFQCLLTFSYYCSTLRINICINILGEHGCRTKQAQ

SEQ ID NO: 6521 - protein, 405 aa, Xenorhabdus bovienii
  Coding DNA sequence: Name=SeqID_413
  Gene classification: Gene name=XerC; Function=Integrase; Function class=L DNA replication, recombination and repair
  Homolog annotation: Query=1..405bp; Hit=8..414bp; Blast score=435; Percent Identity=50.0; E value=1e-122; Homolog= Z1835 COG0582
MAAELNKLSDKKLKTLHGKKRNKIEFFADGAGLSAKASKAGGISWVFTYRLDGKKLNRLTIGRYPDMPLKQARETRDKCRNWLASGKDPKLQFNLTMQESLKPVTVKDAIEYWIEHYGRENRVNIDSLIRQLGKHIYPHIGEMALSDCEIIYWLQCFDKMKKEAPVASGGILQLCKQALKFCRVRRYAISHVLDDLTIQDIGKKQNKGQRYLEDNELGQLWKSINEDIYLPYYINLLKILVVFGCRTREIRLSKCSEWNLDSMLWTVPKENSKTGERIIRPIPECMKLFLENLIYQNHKNDYLLGAFKSTETVSEYGTKIWKKLGHVEKWSLHDLRRTFSTKLNDMKVAPHIVDQLLGHILPGVMAIYNKSQYLPEKLDALNMWCERLDVLSGNYENVVVLKIAQ

SEQ ID NO: 6522 - protein, 94 aa, Xenorhabdus bovienii
  Coding DNA sequence: Name=SeqID_414
MTIQYSIPTPEERRNILSEYGEPYDRLIREKERQHITSISRTSAWKLENEGRFPARKPLGRNSCAWLLSDLLHWVRNPPTVENVNNPYSRKRTN

SEQ ID NO: 6523 - protein, 30 aa, Xenorhabdus bovienii
  Coding DNA sequence: Name=SeqID_415
MEKLTALIGCDLTHSKISLIFGNQWINGKY

SEQ ID NO: 6524 - protein, 195 aa, Xenorhabdus bovienii
  Coding DNA sequence: Name=SeqID_416
  Homolog annotation: Query=29..117bp; Hit=237..323bp; Blast score=89; Percent Identity=56.0; E value=3e-17; Homolog= ref|NP_753396.1|
MVSTSYRGSLRLNSHQFERQPSLRGLIDYSCSDDALDLRWRRLISPVIAKIMNCAVLSPSSLSFSIESTSSCGTRASNFFDFAFIAFVAISVSISSWWLTVYTKNFHEKGLTWLTLKNNIVADTLSHSRNKNSDAPKCGNTLEASNQNIIGANAMADIQSNQTRLKFTFLIASGTQRLAGMPSLIFVSRQETHHE

SEQ ID NO: 6525 - protein, 135 aa, Xenorhabdus bovienii
  Coding DNA sequence: Name=SeqID_417
MSNKPISLKQALYRASLGVSLFTFITKKAKDECEINLNNLIALAGDIHQEVHRALLKHSPQPLVNKLLNCVVYRKSDPLDQASFRAGLCISLYEIILEQSSQHCSEELHDLLSLACDINQEVYYSLYAAVNGEDE

SEQ ID NO: 6526 - protein, 796 aa, Xenorhabdus bovienii
  Coding DNA sequence: Name=SeqID_418
  Gene classification: Function=Predicted ATPase; Function class=R General function prediction only
  Homolog annotation: Query=391..792bp; Hit=2..404bp; Blast score=409; Percent Identity=50.0; E value=1e-114; Homolog= Z0339_2 COG3378
MSQGNSRPLDVIRAVKQSAANHWQLLLPACGIDVPLKGKHGACPICGGTDRFHFIDDNHNGDWHCRQCDEPNHGDGLDLVARNKGITVFAAAKLVADVLAMPLPEPKTVKEQPRAAKLIAERIVALVATAVTGESQYLVKKGLQCPNQRLLKDGSLLLVVQTLDGTITGAQTIKPNGEKRLVAGTQKKGSFIPVSKITRTPDTIIITEGYATALTVRQLHKGVVLAAIDESNLSVVAGLVRERWPDTRIIIAADNDWHGQGERDKNGRLKKNVGKMAAEKTAIAINSWVTLPPTELKADWDDYRQHHGIETAKQAFNNGLYQVGEKRLMEAEAVVIQEAKPKKANNNLAQMAASQRGALVVERYGRIAVNPESDMVYHFNSTTWQTVSDNELRRAMVAIFDQHETPYNPNGINNAICAMKLQVPVIGEQRQDLIGFRNGVYELSTQQFTPHQPEHWLMNHNGITFTPPAIGENLPDHAPDFYRWLSHTAGSNENKMARIKAALFMILANRYDWQLFIEVTGEGGSGKSIFTYIATLLAGEHNTASGNMRALDEARGRYQFVGKSLITLPDQVKYVGEGAGIKAITGGDLIEVDGKYEKQFSTIIKAVVLATNNEPMSFTERNGGIARRRVIFPFNIPVKESEKDSQLPEKISRELPVIIRHLLTEFADQNKAKKLLQAQRDSNEALTVKSNSDPLYRFCGYLVSVNDATGMKMGNKNISPRAPRLYLYHAYLSFMEAHGFERPLTLTKFGESLPKIMLEYRKEYRKVRTNKGYSYNVELSGEAEEWLPSVPELRNS

SEQ ID NO: 6527 - protein, 35 aa, Xenorhabdus bovienii
  Coding DNA sequence: Name=SeqID_419
MGEQEIQSMNIILIAANPDVARRPVNHAEGAQRRR

SEQ ID NO: 6528 - protein, 91 aa, Xenorhabdus bovienii
  Coding DNA sequence: Name=SeqID_420
  Gene classification: Function=Transposase; Function class=L DNA replication, recombination and repair
  Homolog annotation: Query=1..86bp; Hit=1..86bp; Blast score=87; Percent Identity=50.0; E value=2e-18; Homolog= insA_g5 COG3677
MAKVDVVCRYCHKAEEVKGHGKGSSGHPRYHCYACRKTFQLNYTYQACKPGVKEQITDMAINNGGIRDTARVLNVGINTVLRTLKNMNPDK

SEQ ID NO: 6529 - protein, 83 aa, Xenorhabdus bovienii
  Coding DNA sequence: Name=SeqID_421
MSRGHLSATRRINAGSGMRGNQTRSKSSHMYLAIAVKKRWKNCWRFWHRLKSSIIVLIIMLFMIAFLRELTSEERNLPNASKE

SEQ ID NO: 6530 - protein, 84 aa, Xenorhabdus bovienii
  Coding DNA sequence: Name=SeqID_422
  Gene classification: Gene name=InsB; Function=Insertion element IS1 protein InsB, putative transposase; Function class=L DNA replication, recombination and repair
  Homolog annotation: Query=1..79bp; Hit=87..166bp; Blast score=67; Percent Identity=41.0; E value=2e-12; Homolog= insB_g3 COG1662
LALLASFEIQYYCTDNYAVYDCLPERTHLRGKKFTQRIERMNLTLRTRIKRLNRKTICYSKSEILHDKIIGTFIEREYYLARII

SEQ ID NO: 6531 - protein, 159 aa, Xenorhabdus bovienii
  Coding DNA sequence: Name=SeqID_423
  Gene classification: Gene name=Hcp; Function=Hemolysin-coregulated protein (uncharacterized); Function class=R General function prediction only
  Homolog annotation: Query=1..159bp; Hit=1..159bp; Blast score=155; Percent Identity=51.0; E value=2e-38; Homolog= Z0248 COG3157
MANIIYMTLNGKKQGLISAGCSTYDSIGNKYQEENKDKILVYSVDHDISREQNVNHQPIIITKPIDKSSPLLGVAISSNEHLDCLLDIYRNSSTGGLEKFYSIKLTNATIKNISSHYPNSLSHNDMQPYESITISYDSITWTHHIAGTSGYSIREENVF

SEQ ID NO: 6532 - protein, 140 aa, Xenorhabdus bovienii
  Coding DNA sequence: Name=SeqID_424
MLGLRLSNFIRICIVIFILAIGVILFFASLANVNLSYTKRNFIYYYSFTFDEIKSVPLISNDYIIYYDSPDGNNTMTNEIIFSNVKLSRLAELIKYTENMGFIKYYDKYWKDERWRKDNTIISIKQNDTERTILFLVEKN

SEQ ID NO: 6533 - protein, 228 aa, Xenorhabdus bovienii
  Coding DNA sequence: Name=SeqID_425
  Homolog annotation: Query=1..197bp; Hit=1..206bp; Blast score=172; Percent Identity=44.0; E value=5e-42; Homolog= ref|NP_406556.1|
MTKRSDIKDGRLVYTEKLGWLDLGHANGDDARKLMLSLALGDETTNKSHFIVRYVQYMGRGRSLGTSIKTRWRVRRGLSLHDKKRVALTIMMYTTHSFESYQDSFPFTLISDSGYSGEDLISNLFGFYQAINGINYLPQVGVVSKEKAYKRWDYYGDIGKYKNKSFKPLLFPDPEKYPNNTIPYNVPLPSFLNTITPISDIKTGHDVILIEDASWINIGKEYAGIAVE

SEQ ID NO: 6534 - protein, 130 aa, Xenorhabdus bovienii
  Coding DNA sequence: Name=SeqID_426
MKKILIIFIFLLYGCGNPTPKVLPKSEVLPDAVINEPYQASITITGGALNERSVWVKIYPIDSGLTWNPKESSFQWEGKEEIRKDYHHINITGIPKKTELIKIEVVGFTLGTMYPGKDFDKTYTIKVKNK

SEQ ID NO: 6535 - protein, 31 aa, Xenorhabdus bovienii
  Coding DNA sequence: Name=SeqID_427
MLAQHNKDSFLLFFMVLKIIFCKNKLTTKTP

SEQ ID NO: 6536 - protein, 384 aa, Xenorhabdus bovienii
  Coding DNA sequence: Name=SeqID_428
  Homolog annotation: Query=1..379bp; Hit=1..380bp; Blast score=513; Percent Identity=67.0; E value=1e-144; Homolog= ref|NP_287332.1|
MKKLLELRQQKADLTHQMRSLLTKAGDEKRSLTNDEAKQFDELRNQSDSLNAEIARYETLADDERSQAGKTQPTRDNLSNDELRHYILTGETRTLSTGVPSEGGYTVIPELNKQIMQQLTCESVMLQICTIKTTRSNEYKQLVSVGGAAVAHGEEGKSRGETTTPKMEEVSIKLFPVYAYPKTTQEIIDFSDVDILGWLTSEIADTFVDTEETDLVSGDGSKKAKGFLAYPRDTKSDKVRDFGTLQKLEVTTLEADSLIDLKFLLKNKYRKNAVWVMNSTTAAKVQKLKNGNGDYIWRERLQAGDPDMLLGLPVHYLEFMPDGVIGLGDFKRGYFIVDHETGTRTRPDNITEPGFYKVHTDKYLGGGLVDSNAIKILEVKTTSK

SEQ ID NO: 6537 - protein, 182 aa, Xenorhabdus bovienii
  Coding DNA sequence: Name=SeqID_429
  Gene classification: Function=Phage head maturation protease; Function class=R General function prediction only
  Homolog annotation: Query=6..182bp; Hit=10..190bp; Blast score=204; Percent Identity=59.0; E value=5e-53; Homolog= Z1848 COG3740
MNNDFEIRTASLSAADKKLVGYVIKWNSRSHVLWDEFIEQFAPNAFSASLTSGVDVRALYEHDHMNLLGRTTSGTLQLAEDTTGLSFELTPPDTQLGRDVLTLVERGDISGMSFGFRALKDQWDVGQTPYIRTVLEAELREITVTSLPAYPESGVEIARRSLNAVKPNHVDLRHYWLQLSEV

SEQ ID NO: 6538 - protein, 405 aa, Xenorhabdus bovienii
  Coding DNA sequence: Name=SeqID_430
  Homolog annotation: Query=1..399bp; Hit=1..398bp; Blast score=643; Percent Identity=76.0; E value=0; Homolog= ref|NP_287334.1|
MWPFKRKDTETRSLSMDEFLSLAGVSNTKSGEHVSPSTAEGLPAVMNAVTVISEAVATMPCYLYRVQHQNGKESREWLSNHPVDYLLNECPNDCQTPFQFKRTLMRHCLLNGNAYAVIVWGREGQPQSLHPYPPSAVVPQRLSDHRFAYTITEPYSGKVKTFLQEEILHLRYATEDGFLGRSPVTICRETLGLGLAQQRHGASIMKDGMMAAGVIKSAEWLDGTKGAKALEALERYKGARNAGKTPILEGGMEYQQLGMSNQDAEWLASRRFTIDDIARMFNVSPIFLQEYSNSTYSNFSEASRAFLTITMRPWLANFEQQIKSALLVASPKSGIRYQVEFDTADQLRANPRERFQSYETAIKSGVMCPNEAREREGLSPREGGDEFSQAWKQTVEIKKQPEGKE

SEQ ID NO: 6539 - protein, 125 aa, Xenorhabdus bovienii
  Coding DNA sequence: Name=SeqID_431
  Homolog annotation: Query=16..123bp; Hit=1..109bp; Blast score=83; Percent Identity=41.0; E value=8e-16; Homolog= ref|NP_037703.1|
MEANGRNQETTGGQGMRAGRLRHRVIIQKSEQSRAPSGQVIDKWVDVAPVWAEVRAISGRERLASGAVFSEATVRIWMRYRDDVTTANIILYNGANTRGTAFDIVAVIPDAKYTRLELLCKGGVF

SEQ ID NO: 6540 - protein, 98 aa, Xenorhabdus bovienii
  Coding DNA sequence: Name=SeqID_432
  Homolog annotation: Query=4..98bp; Hit=6..98bp; Blast score=117; Percent Identity=56.0; E value=4e-26; Homolog= ref|NP_707052.1|
MAEIPLNEIKQHCRLDERDTLDDALLMGYAEAALEVCQQHIGKRFDNGLAFTPAIKVGCLLYIGLLYENREMVTEAELKEVPFTIKSLWSVYRDVGVY

SEQ ID NO: 6541 - protein, 144 aa, Xenorhabdus bovienii
  Coding DNA sequence: Name=SeqID_433
  Homolog annotation: Query=1..141bp; Hit=1..141bp; Blast score=152; Percent Identity=58.0; E value=1e-36; Homolog= ref|NP_309622.1|
MPWQPLRRCSYPNCRERVKSGHCEQHQREARRQQDKQRGTRTQRGYSNRWGRYRLQYLKANPLCVHCLQQDIYASATIVDHIIPIQGEADVLFWPESNHQSLCPPCHNRKTVQTDPITKAKRKQGIYQERETEAAKHRGWLVAE

SEQ ID NO: 6542 - protein, 149 aa, Xenorhabdus bovienii
  Coding DNA sequence: Name=SeqID_434
  Gene classification: Function=Uncharacterized phage protein; Function class=S Function unknown
  Homolog annotation: Query=33..140bp; Hit=1..108bp; Blast score=166; Percent Identity=75.0; E value=6e-42; Homolog= Z1853 COG3747
MTNALLSGTDPLLKFLRTALFLKINSQGRQKIMARAPKPPTYLNDIAASQWKSKAKILGEREDLTAADWNNLELYCVNYAIYRKAVADLDIRGFSIVNSQGSESRNPSLSAKADAEKIMIKMSSLLGFDPVSRRKNPIETEEEDELDRL

SEQ ID NO: 6543 - protein, 553 aa, Xenorhabdus bovienii
  Coding DNA sequence: Name=SeqID_435
  Homolog annotation: Query=1..553bp; Hit=1..553bp; Blast score=909; Percent Identity=76.0; E value=0; Homolog= ref|NP_707056.1|
MNAWEQYAFDIQNGKISACNRLKQAVKRYYNDLNNPLYTFDSEVVARFIAFSCLCPHVKGHLRGKPIVLEPWQQFAFANLFGFKVKATGRRKYRSAYIQVPRKNAKSTVAAILANWFLVMEQEQQDIYTAAVSRDQARIVFDDARQMSLLSKPLKKRLSIQQHKVTYPKTNSLLKPLAAKASTIEGTNPSLAIVDEYHLHPDNAVYSALELGMGARPEGVLFAITTAGSNVISACKQHYDYCCQILNGEEQNASLFALIYELDDENEIDDETLWIKANPNLNVSVDSAALHDTIQKARGIPSQWTEMLTKRFNIWCQGETPWMGEGAWKACQTDYDENNLKGLECYAGLDLSSTGDITSVCYTFPVDNELLLLTRHYLPEAQLQNPANKNRAVYRQWAQAGWIRTTQGDCIDYDRIRDDILKDSQHFDIKLVGFDTWNATHLRTQLQGAGLDVEPFPQTYMRFSPVAKSAEVFVNRKVIRHNGDPVLAWAMSNVVMETDANANIKPNKKKSANKIDPAIAFLMSFGTWQSEHEEFAFGLSDEQKQRLATFDGI

SEQ ID NO: 6544 - protein, 60 aa, Xenorhabdus bovienii
  Coding DNA sequence: Name=SeqID_436
LASIKNAFILWRKLLNDTKEISYTCDFCHILIYLLIIPCIVESLLHQTVTVIRRNRINKY

SEQ ID NO: 6545 - protein, 392 aa, Xenorhabdus bovienii
  Coding DNA sequence: Name=SeqID_437
MTEITCIGDFLRVVKELSPQNKSVFYRGQRNSEYGINSSISRLLKSVKLNPISIKRYNTITRVFYDDEISKYHLASELYSTFREKHIVYPDVNIINGYSMNDIDLHVTAQHYGLSTRVIDWTYSPLIALYFATEKRKNNGIKYEDDSKDASVFMIWNEESNKLDVCSSDNFLKRIEAEKKIHKKISKDCESFYLTHRYKIYNMHDELERYVDELYNKLIDYTNHLEFGETIRLNSTDHLIDLVECRDNLNANEFIEKIFYFAVRFFNQSYNYSRPNATIDIFNDYNTIIEPLPINQRVKNQQGVLMFCKKVEDDVYPSSKFNEKNTINHIDDESLSEVSKNAGLLKIIIPKSSIKSIRKELELYGFSKDFVYPEIMSFTEYMQEKIISKHSI

SEQ ID NO: 6546 - protein, 91 aa, Xenorhabdus bovienii
  Coding DNA sequence: Name=SeqID_438
  Gene classification: Gene name=Nlp; Function=Predicted transcriptional regulator; Function class=K Transcription
  Homolog annotation: Query=13..77bp; Hit=7..71bp; Blast score=88; Percent Identity=72.0; E value=9e-19; Homolog= sfsB COG3423
MERVAGMNNVRNDWHQADIIAALRKRGTTLAAVSREAGLSSSTLANTLSRPWPKGEWIIANYLEIHPSEIWPSRYFDMYGQLIARKARDKS

SEQ ID NO: 6547 - protein, 43 aa, Xenorhabdus bovienii
  Coding DNA sequence: Name=SeqID_439
LKITGKIAVTGYLLTSSNTHHCHLNSSRRSALQPLISSERLAY

SEQ ID NO: 6548 - protein, 302 aa, Xenorhabdus bovienii
  Coding DNA sequence: Name=SeqID_440
  Gene classification: Gene name=HemF; Function=Coproporphyrinogen III oxidase; Function class=H Coenzyme metabolism
  Homolog annotation: Query=4..302bp; Hit=3..299bp; Blast score=471; Percent Identity=73.0; E value=1e-133; Homolog= hemF COG0408
MNIPNISQVKDFFLSLQDEICKQLERLDGHSNFMEECWQREEGGGGRSRVLKAGNVFEQAGVNFSHITGASLPQSASAHRPELAGRSYQAMGVSLVIHPLNPYIPTSHANVRFFIAEKEGEAPVWWFGGGFDLTPYYGFNEDAIHWHTVAKTLCQPFGDNVYPDYKKWCDDYFFIKHRNEPRGIGGLFYDDLNTPDFETCFNFTQAVGNGFLAAYLPIIERRKNINWGEREREFQLYRRGRYVEFNLVWDRGTLFGLQSGGRTESILMSMPPLVRWEYNHSPEPNSPEAELYTSFLIKKDWV

SEQ ID NO: 6549 - protein, 355 aa, Xenorhabdus bovienii
  Coding DNA sequence: Name=SeqID_441
  Gene classification: Gene name=LasB; Function=Zinc metalloprotease (elastase); Function class=E Amino acid transport and metabolism
  Homolog annotation: Query=69..350bp; Hit=263..521bp; Blast score=147; Percent Identity=37.0; E value=1e-35; Homolog= BS_nprE COG3227
MKNNEINRYSLIPPFVLEHISNDCDERSNQYVLKTLDHVHHLMNISIGEDLLQQENEVEFDDELNRTIYDAEHEEIFPGDKVARREGMPESEDIAVNEAYEYLGKTHEFYKKVFGRNSLDNKGIKLVATVHYGQNYMNAFWSRKQMVFGDGDKSGKYFNRFTSAIDVIAHELTHGVIESEARLFYAYQSGALNESISDVFGIMVKQYFDKQKASESDWLIGKGLLGSNFNPDNKPDVALRTFVNPGTAFSGDKQVGHMDQYKELPFTKDNGGVHIYSGIPNRAFYLLAVELGGYSWERAGKIWYETLLDERLSSDANFDDFAELTIKNAEKLFNKEVSDIVNNCWSKVGVIIPTK

SEQ ID NO: 6550 - protein, 44 aa, Xenorhabdus bovienii
  Coding DNA sequence: Name=SeqID_442
MNIRKGYFQPFLVYYRIILILLCLRIIDIVLMIILMLVLIILLE

SEQ ID NO: 6551 - protein, 30 aa, Xenorhabdus bovienii
  Coding DNA sequence: Name=SeqID_443
MILYLSILLLRIILASLYVVMCICFRVLRY

SEQ ID NO: 6552 - protein, 65 aa, Xenorhabdus bovienii
  Coding DNA sequence: Name=SeqID_444
MRNSKIDKYNIIPPCLLEYIANNCDENDKECALRTLEHVNSLMKNSAKEEKVSQPENNLSVDKKR

SEQ ID NO: 6553 - protein, 496 aa, Xenorhabdus bovienii
  Coding DNA sequence: Name=SeqID_445
  Gene classification: Function=Predicted GTPases; Function class=R General function prediction only
  Homolog annotation: Query=1..495bp; Hit=14..501bp; Blast score=793; Percent Identity=80.0; E value=0; Homolog= yfgK COG1160
MIPVVALVGRPNVGKSTLFNRLTRTRDALVADFPGLTRDRKYGRAEVEGQEFIIIDTGGIDGTEDGVETHMAAQSLMAIEEADIVLFMVDARSGMMPADHGIAKHLRSREKATFLVANKTDGIDTDTAIPEFYSLGLGDIYSIAASHGRGVTQLIEHVLLPFSEKEKTEEVELTEEEANAAYWAEIEQSELEAAEGEEKEAAFDPTTLPLKLAIVGRPNVGKSTLTNRILGEERVVVYDMPGTTRDSIYIPMERDGREYILIDTAGVRKRGKVTETVEKFSVIKTLKAIEDANVVLLIVDAREGISDQDLSLLGFILNSGRSLVIAVNKWDGMSQEDRDHVKDMLDLRLGFVDFARVHFISALHGSGVGNLFDSILEAYESATHRVSTSMLTRIMHMAEEDHQPPMIRGRRVKMKYAHAGGYNPPIVVIHGNQVTNLPDSYKRYLMNYFRRSLKVMGTPIRIQFKEGSNPYADKKNTLTATQLRKRKRLMAHLKKR

SEQ ID NO: 6554 - protein, 41 aa, Xenorhabdus bovienii
  Coding DNA sequence: Name=SeqID_446
VELRVDHFQQDIDLHLVMRHQKNDTCCCAGWAPECRKIHLI

SEQ ID NO: 6555 - protein, 390 aa, Xenorhabdus bovienii
  Coding DNA sequence: Name=SeqID_447
  Gene classification: Function=Uncharacterized proteins of WD40-like repeat family; Function class=S Function unknown
  Homolog annotation: Query=1..390bp; Hit=1..392bp; Blast score=487; Percent Identity=63.0; E value=1e-138; Homolog= Z3775 COG1520
MQLRKTLLVGLVASVLLAGCSSEQDTLAMSPLPKVENQFNPRVIWDKSVGSGVGQYYSHLSPVWQGSTVYVADRTGVVKAFEVDTGKELWATDLSEKAGFLSSRLPALLSGGLTVSGERLYVGTEQAKVIALDTTNGKVEWESNVAGEALSRPVVSDGLVLIHTGNGLLQALNETNGSAVWSVNMDTPSLSVRGESAPAVAYGAAIVGGDNGRISAVLMSQGQLIWQQRIAQMTGSTEIGRLNDIDMTPVISNNIIYAIAYNGNLVAMDMRSGQLIWKRDIGSVNEMVVTNDHIFIVDQNDRILSLRKSDGVTLWTQSDLLHRNLTAPEMYNGYLVVGDAEGYLHWLNMADGKFVAQHKVDGSGLLSRPVVAGDKLMVQAKDGKVYLYTR

SEQ ID NO: 6556 - protein, 206 aa, Xenorhabdus bovienii
  Coding DNA sequence: Name=SeqID_448
  Gene classification: Function=Uncharacterized BCR; Function class=S Function unknown
  Homolog annotation: Query=1..205bp; Hit=1..205bp; Blast score=169; Percent Identity=42.0; E value=2e-42; Homolog= Z3776 COG2976
VEVYTTETEQIDVIKRFFANNGKYLAVGLVLGIGALAGWHYWQSHQTNQLQGTAATFEKLNKSLESGSKESVVATEKFANETNNIYGVMADVDLAKRAVEQNDLAQAEKRLLAAAGKAKDEDMQALSNIRLARVQFAEDKTDAALKTLEQVKGKGWLVAVENIRGDILTKKGNIAGARAAYSRGLEADGPQPLKSSIQIKLNNLSS

SEQ ID NO: 6557 - protein, 102 aa, Xenorhabdus bovienii
  Coding DNA sequence: Name=SeqID_449
  Gene classification: Gene name=HisS; Function=Histidyl-tRNA synthetase; Function class=J Translation, ribosomal structure and biogenesis
  Homolog annotation: Query=5..102bp; Hit=327..424bp; Blast score=120; Percent Identity=59.0; E value=3e-28; Homolog= hisS COG0124
LQIWPVADVYLSSFGEGSQQAALILAEQIRDELPELRLMTNHGGGNFKKQLGRADKHGAKVALILGEDEIRAGNITVKDLRNGEQETLSQQAIAARLSELLG

SEQ ID NO: 6558 - protein, 338 aa, Xenorhabdus bovienii
  Coding DNA sequence: Name=SeqID_450
  Gene classification: Gene name=HisS; Function=Histidyl-tRNA synthetase; Function class=J Translation, ribosomal structure and biogenesis
  Homolog annotation: Query=1..326bp; Hit=1..326bp; Blast score=589; Percent Identity=85.0; E value=1e-168; Homolog= hisS COG0124
MAKNIPAIRGMNDCLPAETVIWQRVESTVKRVLAGYGFSEIRTPIVEQTPLFKRAIGEVTDVVEKEMYTFDDRNGESLTLRPENTAGCVRAGIQHGLLYNQEQRLWYIGPMFRYERPQKGRSRQFHQLGAEVFGLQGPDIDAEMILMTARWWRELGIAEHVRLELNSIGSLDARANYREALVAFLEQHKEKLDEDCQRRMYTNPLRVLDSKNPEIQALLNDAPALFDYLDTESKEHFDGLCRILDSAGIKYHLNQRLVRGLDYYNRTVFEWVTSALGAQGTVCAGGRYDGLVEQLGGKSTPAVGFAMGMERMVLLVQEVNPEFVADLACCGCLSLLLW

SEQ ID NO: 6559 - protein, 373 aa, Xenorhabdus bovienii
  Coding DNA sequence: Name=SeqID_451
  Gene classification: Gene name=GcpE; Function=Essential bacterial protein, involved in density-dependent regulation of peptidoglycan biosynthesis; Function class=M Cell envelope biogenesis, outer membrane
  Homolog annotation: Query=1..373bp; Hit=1..372bp; Blast score=627; Percent Identity=86.0; E value=1e-180; Homolog= gcpE COG0821
MHNESPIKRRKSTRIYVGNVPIGDGAPIAVQSMTNTRTNDVEATVRQIKSLERVGVDIVRVSVPTMDAAEAFKSIKQQVNIPLVADIHFDYRIALKVAEYGVDCLRINPGNIGNEERIRQVVDCARHYNIPIRIGVNGGSLEKDIQEKYGEPTPEALVESAMRHVDILDSLNFHQFKVSVKASDVFLAVGAYRLLAQKIDQPLHLGITEAGGARAGAVKSSIGLGLLLSEGIGDTLRISLAADPVEEVKVGFDILKALRIRSRGINFIACPTCSRQEFDVIGTVNALEQRLEDLITPMDVSIIGCVVNGPGEAEVSTIGVTGAKNKSGFYEDGIRQKERFDNNNLIDQLEAKIRAKATILDASNRINVNQLDE

SEQ ID NO: 6560 - protein, 54 aa, Xenorhabdus bovienii
  Coding DNA sequence: Name=SeqID_452
VRHRQWAHYRHKYVWIYVFLSVIHYAFLHYSPTSLYFVYKNYNYAVVNNTHRRT

SEQ ID NO: 6561 - protein, 323 aa, Xenorhabdus bovienii
  Coding DNA sequence: Name=SeqID_453
  Gene classification: Function=Uncharacterized BCR; Function class=S Function unknown
  Homolog annotation: Query=1..319bp; Hit=1..329bp; Blast score=261; Percent Identity=48.0; E value=1e-69; Homolog= yfgA COG1426
MKTETYPEEANLTTGQILRQAREKLELSQQTVADRLCLKLSTVRDIEEDNTQSNIALTFLRGYIRAYAKLVRVPESDILSTLNKQMPAKAGKVSPMQSFSSGKKRKKRDGWLMKITWGVLIVLLGMTGWWWWQNYTAQQKDLASMTTQSDAYNAQAQGDESDLGTSTTDLGQLSDHAKDDNSVAAAQEETSPALANPAANSNASSPGNQSVVNSVPATTNTAPNSAVNTSSADVNNISAVNSDELVMNFKARCWLQITDANGKTLFMGTKDKGSSLKLSGALPYKLKIGAPAAVDIQFQGKTVDMTRFVKVNRIAQLKLPENN

SEQ ID NO: 6562 - protein, 68 aa, Xenorhabdus bovienii
  Coding DNA sequence: Name=SeqID_454
MLLFSVNKSGMKRLKNWSRETTQVTTLVINDFLRSTQYEMISLHKLSWMFYQINLRKYFNLNSTSALS

SEQ ID NO: 6563 - protein, 136 aa, Xenorhabdus bovienii
  Coding DNA sequence: Name=SeqID_455
  Gene classification: Gene name=NrfG; Function=TPR-repeat-containing proteins; Function class=R General function prediction only
  Homolog annotation: Query=32..120bp; Hit=36..124bp; Blast score=59; Percent Identity=39.0; E value=9e-10; Homolog= PA3805 COG0457
MIRKSIIWSIVCFGLITGCAERSPHHGHQVVAIDTRLQLGKAYLAERNLSAAKYHFQKVLLAKPRHPEAHLGMALYEYYAGQPKAADQHYRMAMQYAAGNDTVIRHYAAFLCEQKRDEEAKKLVTGNNTSHYTCDK

SEQ ID NO: 6564 - protein, 392 aa, Xenorhabdus bovienii
  Coding DNA sequence: Name=SeqID_456
  Gene classification: Function=Predicted Fe-S-cluster redox enzyme; Function class=R General function prediction only
  Homolog annotation: Query=17..392bp; Hit=6..384bp; Blast score=685; Percent Identity=86.0; E value=0; Homolog= yfgB COG0820
MSQLNETVQPSTAAVSVTPEKKNGKINLLDLNRKQMRQFFLDMGEKPFRADQVMKWMYHYCYDDFEQMTDINKVLRTKLQQVAEIKAPEVAEEQRSADGTIKWAITVGDQQVETVYIPEDERATLCVSSQVGCALECKFCSTAQQGFNRNLRVSEIIGQVWRAAKIIGSLKSSGRRPITNVVMMGMGEPLLNLNNVVPAMEIMMDDFGFGLSKRRVTLSTSGVVPALDKLGDMIDVALAISLHAPTDDVRDEIVPINRKYNIEEFLAGVRRYLAKSNANQGRVTVEYVMLDHVNDSVEQAHQLAECLKDTPSKINLIPWNPFPGAPYGRSSNSRIDRFSKVLMGYGFTTIVRKTRGDDIDAACGQLAGDVIDRTKRTLKKRLAGEPIQVKPV

SEQ ID NO: 6565 - protein, 45 aa, Xenorhabdus bovienii
  Coding DNA sequence: Name=SeqID_457
LYGFVKLGHFYIASLLHFRLCADLISALSFDSVTINSITTICSDN

SEQ ID NO: 6566 - protein, 142 aa, Xenorhabdus bovienii
  Coding DNA sequence: Name=SeqID_458
  Gene classification: Gene name=Ndk; Function=Nucleoside diphosphate kinase; Function class=F Nucleotide transport and metabolism
  Homolog annotation: Query=1..141bp; Hit=1..141bp; Blast score=226; Percent Identity=80.0; E value=4e-60; Homolog= ndk COG0105
MTIERTFSIIKPNAVKKDAIGSIYARFESAGFKIIAAKMLHLTREQAEGFYAEHKGRPFFDGLVEFMTSGPIVVQALEGENAVQRHRDLMGATNPDNALAGTLRADYADSFTENAVHGSDSIESANREIAYFFSDDEIFPRH

SEQ ID NO: 6567 - protein, 59 aa, Xenorhabdus bovienii
  Coding DNA sequence: Name=SeqID_459
MRNRDCFVIGTALKRRINDLDQNAYLGFHRLNRHYFIELIGQDGTNWQKVSDLQCSGLV

SEQ ID NO: 6568 - protein, 108 aa, Xenorhabdus bovienii
  Coding DNA sequence: Name=SeqID_460
MKIFSYFLLLGLFYIPVSFADTSAKGVDNKMENKQSGNQGALRKCTHLLPEGHKYTISIIGTSDKTTKEVNKQFKGEFKLSSGSKKPLDKKRNEEIKPFIQCVTETVL

SEQ ID NO: 6569 - protein, 68 aa, Xenorhabdus bovienii
  Coding DNA sequence: Name=SeqID_461
  Gene classification: Function=Predicted transcriptional regulator; Function class=K Transcription
  Homolog annotation: Query=3..65bp; Hit=3..65bp; Blast score=91; Percent Identity=71.0; E value=2e-19; Homolog= PA2785 COG3655
VAIYITLDVLMAKRKVKSKELAQAIGITEQNLSLLKTGKIKGVRFSTLDAICQYLDCQPGDILEFKDD

SEQ ID NO: 6570 - protein, 150 aa, Xenorhabdus bovienii
  Coding DNA sequence: Name=SeqID_462
  Homolog annotation: Query=5..150bp; Hit=37..185bp; Blast score=79; Percent Identity=34.0; E value=2e-14; Homolog= ref|ZP_00136103.1|
GAKLILEKYGLGFSLTNRILLHFSENTLSSWKLTSGIFISTIPLLFLGGSLWAFHQLFGNYRKGDYFSKNTVKYLEYAGWGVIIWAMLDILFEPLLTVWLTMGAPAGQRFFSLSLSPSHLVAIFISVCLAVISRILYQACDIYDENKSII

SEQ ID NO: 6571 - protein, 191 aa, Xenorhabdus bovienii
  Coding DNA sequence: Name=SeqID_463
  Gene classification: Gene name=CitB; Function=Response regulator containing a CheY-like receiver domain and an HTH DNA-binding domain; Function class=T Signal transduction mechanisms
  Homolog annotation: Query=12..191bp; Hit=24..194bp; Blast score=101; Percent Identity=32.0; E value=4e-22; Homolog= PA1347 COG2197
MICSTEKIISALINFWEISNEPWGAKDNNSKFIYANNKYNELLSLPKGYDVGGYYDGELPSTTSDFQDEFQKHDRKVESLLDRVTSIEIHPFKGLDYLQPWYFDKFPLIDESGECRGTIFHGRPVDTITLEKLKKINIQTSLIFTPPSEIFSKREWEIIFYIMQGYSTKDIAERLFVSHRTVSNHIQNVYQ

SEQ ID NO: 6572 - protein, 146 aa, Xenorhabdus bovienii
  Coding DNA sequence: Name=SeqID_464
  Homolog annotation: Query=4..144bp; Hit=3..144bp; Blast score=174; Percent Identity=64.0; E value=2e-43; Homolog= ref|NP_927647.1|
MTTETIDHSTLHRLVEAGAVRAAHVIGTSGGWALTVKYGLTERLLAAQRSRQVRLFKKLETLVGYLKDIGIAQFDVDASNYSPENQPRQTRPDRSAALKRAHEAVSYDDWFREQVQTSIDDPRPAVSHEEAKHHFAARKDALRKES

SEQ ID NO: 6573 - protein, 93 aa, Xenorhabdus bovienii
  Coding DNA sequence: Name=SeqID_465
  Homolog annotation: Query=1..93bp; Hit=1..95bp; Blast score=104; Percent Identity=50.0; E value=3e-22; Homolog= ref|NP_929468.1|
MRLEWKPMALTDRENIMDYIARDNPAAAIALDDEFEAAAERACTEPEMYKPGRLKGTREVVVKPRYILIYQVEGEVLEVLRILHAAQQWPPTE

SEQ ID NO: 6574 - protein, 51 aa, Xenorhabdus bovienii
  Coding DNA sequence: Name=SeqID_466
VTEFSAVPTYNPLMDEKDIQAYLSAAKNENDPEYLLTALNNAKKAQESHNQ

SEQ ID NO: 6575 - protein, 281 aa, Xenorhabdus bovienii
  Coding DNA sequence: Name=SeqID_467
MTSKVGLGWVSSNTPQDVIDSIKNKEYEKNTKNINTFLSETDFKQLSVFLFQKYSTLKTSDVHRILSKKEDMIKISELTEFIPKSNWQRYFYQDFKTDADVHKNRDDAQEKIEDSWNRLSDLRNKVAHNRFISFEEMRMIKSKSEEINNVIDDALNKLDSVEVTKAQINEIKQELNDTIKEEATPLANKKMTETPTEVGAIYKVDQHPVARAESCIRKLTKHMYMELAKPFKDELRKHRAKLNTALESYKRDPNNQLNLNLLELEFDRADEYLSTVRKFTQ

SEQ ID NO: 6576 - protein, 148 aa, Xenorhabdus bovienii
  Coding DNA sequence: Name=SeqID_468
MSSGIYTSEYLLILSEDIEIIESEEDLVKSLELNKKYTFKKIENNTIIIHKDMEFDLFIKKIKAKNQSDRNFLITLSNKSAITNYVDKSIVNSMNQEFIKIISSSFNHSRLDKLRDDLSGVFRRNRRKFRCHESDVFLYMFRIIRMYD

SEQ ID NO: 6577 - protein, 229 aa, Xenorhabdus bovienii
  Coding DNA sequence: Name=SeqID_469
  Homolog annotation: Query=1..229bp; Hit=1..229bp; Blast score=303; Percent Identity=71.0; E value=2e-81; Homolog= ref|NP_053154.1|
MSHLVAYKSNALIEASYKLTLQEQRVLLMCIGKLNPQDEVPEKTFKLTANEFYLAFPDMGRENAERRLQEAIDRLWDRTILITRKDEKREIRWVQEKAKYFSGEGTSEIVFADSIMPYLTQLKGQFTKIAIKNVAALKRTYSIRIYELLQQFKQTGDRVIFLEDFRSMLGLEDKYKTFKSLNQLVLIPAIKELNEKSDLIVSVDTVKKGRTVIALHFRFKEDKQIKMAI

SEQ ID NO: 6578 - protein, 159 aa, Xenorhabdus bovienii
  Coding DNA sequence: Name=SeqID_470
  Gene classification: Gene name=Hcp; Function=Hemolysin-coregulated protein (uncharacterized); Function class=R General function prediction only
  Homolog annotation: Query=1..159bp; Hit=1..159bp; Blast score=166; Percent Identity=52.0; E value=1e-41; Homolog= Z0248 COG3157
MSYMIYLTLNGKKQGLISAGCSTLDSIGNRYQKGHEDQIQVLSLNHAISRQQNVSHQPVQFIKPIDKSSPLLAMAIDSNESLNGGFIFYRTSQAGQLELFYEVKITEATITDISCVYPHSINDHDMMPYEKVTLNYKSISWNHITAGTSAYSIWEDRVF

SEQ ID NO: 6579 - protein, 300 aa, Xenorhabdus bovienii
  Coding DNA sequence: Name=SeqID_471
  Homolog annotation: Query=47..282bp; Hit=26..260bp; Blast score=140; Percent Identity=33.0; E value=2e-32; Homolog= ref|NP_927759.1|
MGCQMSRNEFERAFMDGSIGFENGTLVPLSDSKLIREKRYSELQNELQKNLNDNEDLYVFLTFEEAIYFVTNICGPNPNSSWKEAGYLCMDIVTSFTGNIIDAKGFYKLSKELSSNFGVKVTEFVDRYGNRSIKLTGSTGVRKFLTAAKYKVNNWKIIDMGIGTQGMKNGLIDGTRKVVFVAAGYRLLELAFRDEYDIYNFYGNITMDAAKTAAGLLAGVVVTAAAGMFLAAGTYALAVAATAIVASILVGSLLYYIDNKYGLSKALIDHLRKMDELEAKYPRPCVQPFGFPCQEIKLKW

SEQ ID NO: 6580 - protein, 76 aa, Xenorhabdus bovienii
  Coding DNA sequence: Name=SeqID_472
  Homolog annotation: Query=1..76bp; Hit=250..325bp; Blast score=123; Percent Identity=76.0; E value=6e-28; Homolog= ref|NP_863192.1|
MVADSAWFLELTRQTHKRRFVATGGALKDVLKLEQESDQDMIIGDDVSEGDDDGSRLAFGWDSLPKKYKRIPERDK

SEQ ID NO: 6581 - protein, 181 aa, Xenorhabdus bovienii
  Coding DNA sequence: Name=SeqID_473
MQARYILNAGRYTYHYKIEEAAFETTDHLYNQIKGGSVSFKEKTYKKVGRSRKKIASYTLQANDEKKAWFDAVNAKTARLRQEADFPIRPSFKIEMLDWCRCVSIVAPIEIRNVEELHKLVDLVRRLLQRETTLDKEFLDYTYGKAQWIAEGLTESQTNSIGFLRSPYLNAKSPDCTNQGF

SEQ ID NO: 6582 - protein, 83 aa, Xenorhabdus bovienii
  Coding DNA sequence: Name=SeqID_474
MALLSLRFFYNISLTKRNINKLKNQGIISSRYRTHPAIVDTDYIALKHYRASLLLILNCDYPIQKHFVAFIAKTLNNLLKTRA

SEQ ID NO: 6583 - protein, 46 aa, Xenorhabdus bovienii
  Coding DNA sequence: Name=SeqID_475
MSHFTCSASKIGSLVLDNLYLYIAQWLYYDYFYVENNFNYVLFWLL

SEQ ID NO: 6584 - protein, 128 aa, Xenorhabdus bovienii
  Coding DNA sequence: Name=SeqID_476
MIDFAKFSTDGATKDDSVGISIKRIIEKDGLNAYATFISAGKKVGCHSHSQGDEWYIILSGDGEIWTGDVVDNEIINIKKEKFSKGCIFCIHQNTAHQLASHNDVELIFLCPKSHLSHDRVGFEDICK

SEQ ID NO: 6585 - protein, 229 aa, Xenorhabdus bovienii
  Coding DNA sequence: Name=SeqID_477
  Gene classification: Gene name=CitB; Function=Response regulator containing a CheY-like receiver domain and an HTH DNA-binding domain; Function class=T Signal transduction mechanisms
  Homolog annotation: Query=12..218bp; Hit=24..221bp; Blast score=107; Percent Identity=30.0; E value=8e-24; Homolog= PA1347 COG2197
MICSTEKIISALINFWEISNEPWGAKDNNSKFIYANNKYNELLSLPKGYDVGGYYDGELPSTTSDFQDEFQKHDRKVESLLDRVTSIEIHPFKGLDYLQPWYFDKFPLIDESGECRGTIFHGRPVDTITLEKLKKINIQTSLIFTPPSEIFSKREWEIIFYIMQGYSTKDIAERLFVSHRTVSNHIQNVYQKTETNCRKSLVDYCYEHNIANYVPENFFREPKSIHFNE

SEQ ID NO: 6586 - protein, 84 aa, Xenorhabdus bovienii
  Coding DNA sequence: Name=SeqID_478
  Homolog annotation: Query=1..69bp; Hit=1..69bp; Blast score=105; Percent Identity=81.0; E value=2e-22; Homolog= ref|NP_927384.1|
MIKCPLCGQSAHTRSSFEHSSQTKERYNQCQNINCGATFVSHETFVRFIAKPGDVENVTPHPRAKTKRQPRQKAAAPCQKADVQ

SEQ ID NO: 6587 - protein, 103 aa, Xenorhabdus bovienii
  Coding DNA sequence: Name=SeqID_479
MRCKGSYRQSPKNNPVIDFDACFSDKQALHEDCHFTRRSLASMPFKVLYSRTKHSPLSIKKPPLRWQKLEQCPFSLFIVRQLSDMAQQLSDEVVSSFSPLDVA

SEQ ID NO: 6588 - protein, 72 aa, Xenorhabdus bovienii
  Coding DNA sequence: Name=SeqID_480
  Gene classification: Function=Uncharacterized BCR; Function class=S Function unknown
  Homolog annotation: Query=21..72bp; Hit=2..53bp; Blast score=55; Percent Identity=61.0; E value=7e-09; Homolog= ydcH COG2841
MFPEYRDLVSSLKESNPRFQSLFEKHNRLNHEISHLEGPNGTGYSDKVVRLKKEKLHIKDEMQRILQAESQK

SEQ ID NO: 6589 - protein, 32 aa, Xenorhabdus bovienii
  Coding DNA sequence: Name=SeqID_481
LIYLTTELNHNMYNDRNKLCFFGKGLIFTTII

SEQ ID NO: 6590 - protein, 160 aa, Xenorhabdus bovienii
  Coding DNA sequence: Name=SeqID_482
  Homolog annotation: Query=3..160bp; Hit=2..162bp; Blast score=172; Percent Identity=51.0; E value=1e-42; Homolog= ref|NP_288789.1|
MKKYLLPLAAMMVSVSTFAQADKKLEDVAPYPKASEGMVRNVIDLAPEEDEGDYMVELMIGKDIKVDCNHHWFGGQLETKTLEGWGYDYYVLNNVTGPASTHMGCSGQKETVSFVQVQLGKDALIRYNSKLPIVVYTPKSMTVKYRIWQALDDVDNAVIK

SEQ ID NO: 6591 - protein, 48 aa, Xenorhabdus bovienii
  Coding DNA sequence: Name=SeqID_483
MKGLKPRSLDGDFDFNSLTYARLRGAWFDDFQSSAPKCANPPTSVGGS

SEQ ID NO: 6592 - protein, 35 aa, Xenorhabdus bovienii
  Coding DNA sequence: Name=SeqID_484
LNILRFLNDICMNAKESKQSLVSIFKYMQGTAGRK

SEQ ID NO: 6593 - protein, 239 aa, Xenorhabdus bovienii
  Coding DNA sequence: Name=SeqID_485
  Gene classification: Gene name=GlpF; Function=Glycerol uptake facilitator and related permeases (Major Intrinsic Protein Family); Function class=G Carbohydrate transport and metabolism
  Homolog annotation: Query=10..238bp; Hit=1..229bp; Blast score=290; Percent Identity=78.0; E value=1e-78; Homolog= aqpZ COG0580
MQISLRNRRMFKKLSAEFLGTFWLVFGGCGSAVLAAAFPQLGIGFVGVSLAFGLTVVTMAYAVGHISGGHFNPAVTLGLFVGGRIAAKEVIPYIIAQVIGGIAAAAVLYLIASGKSGFDATASGFASNGYGEHSPGGFSLQAAIIIELVLTAFFLIVILGTTDKNASVGFAPLAIGLALTLIHLISIPVTNTSVNPARSTAVAVFQGTWALDQLWLFWLIPLIGGAIGGLIYRTLLQKD

SEQ ID NO: 6594 - protein, 109 aa, Xenorhabdus bovienii
  Coding DNA sequence: Name=SeqID_486
MGVGSTLAVLADPINWWCYRWLDIPYVITERLISCHFEQPCDCVAFFIIFMVNFSTVDAFLKGKMMEQNITWEQGEYWVTTDKTKPLRWVGFMKNSVLSLSGCRILFGR

SEQ ID NO: 6595 - protein, 80 aa, Xenorhabdus bovienii
  Coding DNA sequence: Name=SeqID_487
  Gene classification: Gene name=ClpP; Function=Protease subunit of ATP- dependent Clp proteases; Function class=N Cell motility and secretion
  Homolog annotation: Query=1..63bp; Hit=45..107bp; Blast score=75; Percent Identity=57.0; E value=7e-15; Homolog= PA3326 COG0740
VISQLLILQEVNTDPIKIFINSQGGHVEAGDTLHDMIKFIKPEVIMIGTGWVASAGITIIAVSFTQTLSFSLTSKQNPAP

SEQ ID NO: 6596 - protein, 34 aa, Xenorhabdus bovienii
  Coding DNA sequence: Name=SeqID_488
MERDLRGLFFRVGIIALFSSVNSGYSLCIISILM

SEQ ID NO: 6597 - protein, 30 aa, Xenorhabdus bovienii
  Coding DNA sequence: Name=SeqID_489
MHHFYSHVINNINGINNIALKNVFMLKKCI

SEQ ID NO: 6598 - protein, 335 aa, Xenorhabdus bovienii
  Coding DNA sequence: Name=SeqID_490
  Gene classification: Gene name=DIT1; Function=Pyoverdine/dityrosine biosynthesis protein; Function class=Q Secondary metabolites biosynthesis, transport and catabolism
  Homolog annotation: Query=7..315bp; Hit=7..317bp; Blast score=390; Percent Identity=60.0; E value=1e-108; Homolog= PA2254 COG3207
MEHLDVEKVSSKILHELLQYRRRFSESEHTIEYEEQKVSEVQLPRIRAFVEQGKAVECILPAFPTKSPNPRKVLGTMPDMAEKLSLIFLNSLCQRIQLYYPPGANIVICSDGHVFSDLIHVDDETITHYQLEIEKLLHELGATNLSVFNLGNVESLTQYTSNYDQLRELLVNGYASSVEEIKATLKESEEGLQLYRAITRFLYEDSLLPGYDGSKTALQKDARQRAAGVIQRSWAWGNLLAEQFPLAIRLSIHPQPVDSIKIGIHMMPTRDDWLTPWHGVAANINGQFVLMKSDEVKKMQGKLVEIRGVPSHYMIEAVSQQNQQAAPLAVASQEQ

SEQ ID NO: 6599 - protein, 299 aa, Xenorhabdus bovienii
  Coding DNA sequence: Name=SeqID_491
  Gene classification: Gene name=TauD; Function=Probable taurine catabolism dioxygenase; Function class=Q Secondary metabolites biosynthesis, transport and catabolism
  Homolog annotation: Query=1..283bp; Hit=1..281bp; Blast score=242; Percent Identity=41.0; E value=3e-64; Homolog= VC1944 COG2175
MNIDELDCRIEPNMPFGLLITPNTSEQDITALSVDTLRELARTHKLVVLRGFSSGFTDPEKLTEYTSRWGEIMMWPFGAILDVMERPDPSDHVLDSTHVPLHWDGMYKPTIPEFQIFHCVSAPEASQGGRTTFVDTEQLIVDASDDERHEWKNTMITYRTSRVTHYGGEVVSPLICLHPDGKKWVMRYNEPMTGKDDKYADHHLLTIHGLSIEQQKEFERNLHGRLYDPRYFYAHQWQSGDLVISDNFTLLHGREAFITHSPRHLQRVHVHGTPVCENLSFRTISNSDSGVAEVELKEV

SEQ ID NO: 6600 - protein, 426 aa, Xenorhabdus bovienii
  Coding DNA sequence: Name=SeqID_492
  Gene classification: Function=Glycosyl transferases, related to UDP -glucuronosyltransferase; Function class=G Carbohydrate transport and metabolism
  Homolog annotation: Query=3..410bp; Hit=2..403bp; Blast score=154; Percent Identity=32.0; E value=2e-37; Homolog= DRA0329 COG1819
MARIVLAAIATPGHVFPICSIAKHLIGQGHEATIFTGSIFRQQAEALGASFVAFDQQVDVDYRNLEEKFPERGQHPPGNHQMTHALKQFFAGPIPVLYRQLEQLVEGADLLIVDNTFYAVLPLLQKPAHDRIPVIAIGVTPLSWSTRDTIFWGPRIPPELLPADLMREQLVDEETGQLIGQVRDAFNTALLEVASPPLTQDHNDVVLSRADRFLQLATKSFEFPRDDLPETVDFIGALGVEVQDDKTQLEWSDENLPLVLVTQGTLANVDLSQLLLPTLRALATLPVRVLAITAGRPVETLGEEIPDNARVVEYLNFEHWLPRSAIFITNGGYGSLNAAIRHGVPLVVAGTGDGKLEAVARVIWSRCGISLNTDTPSEKQLYQAVTRILSSPEWHYQSQRIKADYDAHNALESITRHVNELIAESA

SEQ ID NO: 6601 - protein, 45 aa, Xenorhabdus bovienii
  Coding DNA sequence: Name=SeqID_493
MDFELQRDGILGSIANYVTGVSERSQQSGNLKDGGYLNRHEHLHV

SEQ ID NO: 6602 - protein, 193 aa, Xenorhabdus bovienii
  Coding DNA sequence: Name=SeqID_494
  Gene classification: Function=Uncharacterized BCR; Function class=S Function unknown
  Homolog annotation: Query=2..192bp; Hit=1..191bp; Blast score=275; Percent Identity=69.0; E value=2e-74; Homolog= yceI COG2353
MLKKMLIGLTAGALLMSTGSAIAANYKIDTIGQHAFIEFRIQHLGMSWLYGSFRKFDGDFAFDPQNPATDKVNVVIKTSSVDTNHAERDKHLRKPNFLNTEKYPEAKFTSTEISQKGEKYTVIGDLTLNGVTKPVTLNAKLMGEGKDPWGGYRTGFEANGKIKLKDFDIKANLGPKSQEVELVISVEGVREKA

SEQ ID NO: 6603 - protein, 183 aa, Xenorhabdus bovienii
  Coding DNA sequence: Name=SeqID_495
  Gene classification: Gene name=CybB; Function=Cytochrome B561; Function class=C Energy production and conversion
  Homolog annotation: Query=1..180bp; Hit=1..180bp; Blast score=222; Percent Identity=66.0; E value=2e-58; Homolog= Z1693 COG3038
MLLKNTSTRFGHVSVLIHWLVALAVYGMFALGLWMVTLSYYDTWYHQAPELHKSIGSLIFFVMVIRIIWRFISPPPKPLTSYSHLTRISSKLVHFTLYLALFGILGSGYLISTADGQPISVFGWFDIPATLSEQGVQADTAGIIHLYLAWVVVVLSLLHTLAALKHHFIDRDSTLKRIFGFKP

SEQ ID NO: 6604 - protein, 37 aa, Xenorhabdus bovienii
  Coding DNA sequence: Name=SeqID_496
MRKFRYHSRLKCYLIFTNFRQIICLRMSDFINNRIIL

SEQ ID NO: 6605 - protein, 43 aa, Xenorhabdus bovienii
  Coding DNA sequence: Name=SeqID_497
LAIHNVYIVFPAIVIKECDYAKTLQSLALRVNNGIQGNAFYFS

SEQ ID NO: 6606 - protein, 209 aa, Xenorhabdus bovienii
  Coding DNA sequence: Name=SeqID_498
  Gene classification: Gene name=Gst; Function=Glutathione-S -transferases; Function class=O Posttranslational modification, protein turnover, chaperones
  Homolog annotation: Query=1..175bp; Hit=1..175bp; Blast score=155; Percent Identity=48.0; E value=2e-38; Homolog= PM1551 COG0625
MYTLWIANKNYSSWSLRPWILLKALEITFNEQLSYFEDDKSSYEKFKTFSPTGLVPCLVEGEITVWDSLAIVEYLAENHTQVWPQDRIAKAWARSASAEMHSGFATLRQTCAMNCSKQFEFREISLELQCDIDRLDALWSDGLTKFGGEWLAGNTFTAVDAFFAPVAFRAQTYGLKFSAISQAWVDRMLKHPAMVEWAEAAAKEPEIEH

SEQ ID NO: 6607 - protein, 36 aa, Xenorhabdus bovienii
  Coding DNA sequence: Name=SeqID_499
MHLYYLLHFPSYFYPFPLRINTELFFVHIRWLIKLK

SEQ ID NO: 6608 - protein, 36 aa, Xenorhabdus bovienii
  Coding DNA sequence: Name=SeqID_500
LREYLVWPINNEFLSNKSYQISVFVIESYPIFFYWL

SEQ ID NO: 6609 - protein, 636 aa, Xenorhabdus bovienii
  Coding DNA sequence: Name=SeqID_501
  Gene classification: Gene name=Acs; Function=Acyl-coenzyme A synthetases/AMP-(fatty) acid ligases; Function class=I Lipid metabolism
  Homolog annotation: Query=1..626bp; Hit=1..626bp; Blast score=964; Percent Identity=72.0; E value=0; Homolog= ZprpE COG0365
MSFQNFYQHSIDNPDAFWADQARRIHWQHPFAQVLDHSNPPFARWFSGGQTNLCYNALDRWLEIQPDAKALIAISTETNSEKVFTYKELHQEVNRAAAMMLSLGVKKGDRVVVYMPMVAEALFVLLACARIGAIHSVVFGGFASHSLATRLDNAEPVLVVSADAGSRGGKIIPYKPLLDEAIELAKHTPRHVLMVNRGLATINWLEGRDIDFDSLRQTHFDADIPVTWMESNETSCVLYTSGTTGTPKGVQRDVGGYAVALATSMDAIFGGKAGGVFFCTSDIGWVVGHSYIVYAPLIAGMATIMYEGLPIRPDASIWWQIVEKYRVTRMFSAPTAIRVLKKYPTDCIAKYDISSLEALYLAGEPLDEHTARWVAETINVPVIDNYWQTETGWPIMAIARGLDDRPSRFGSPGFPMYGFNVKLINELTGQECGDNEKGMLVAKGPLPPGCIQTIYGDDTRFVNTYWKHFAQQIYSTFDWGIRDSDGYYFILGRSDDVINISGHRLGTREIEECIASHEDVAEVAVIGIKDEVKGQAAVAFAVLKEGREIQSADPFAALEKALMELVDKQLGSVGRPARVYFVAQLPKTRSGKMLRRTMQAICEGREPNDIALIENPASLEVIRDAVSHQVTANKKI

SEQ ID NO: 6610 - protein, 483 aa, Xenorhabdus bovienii
  Coding DNA sequence: Name=SeqID_502
  Gene classification: Gene name=PrpD; Function=Uncharacterized protein involved in propionate catabolism; Function class=R General function prediction only
  Homolog annotation: Query=1..483bp; Hit=1..483bp; Blast score=835; Percent Identity=80.0; E value=0; Homolog= ZprpD COG2079
MSTSVVNNRPDYDQVIVDIVDYVMDYTITSPVAYETAHYCFLDTLGCGLEALEYPACKKLLGPVVPGTVVPNGARVPGTQFQLDPVQAAFNIGTLIRWLDFNDTWLAAEWGHPSDNLGGILAIADWLSRTAVANGKQPLTIKDVLTGMIKAHEIQGCLALENAFNKVGLDHVVLVKVASTAVVAQMLGLAREEILSAVSLAWVDGQSLRTYRHTPNTGSRKSWAAGDATSRAVRLALMAQKGEMGYPSVLTAKTWGFYDVLFNGQPFKFQRPYGAYVMENVLFKIAFPAEFHSQTAVEAAMTLHQQLKMAGKQVEDIAQITIRTHEACIRIIDKQGPLNNPADRDHCIQYMVAIPLLFGRLTAADYENNVAADPRIDALREKIRCVEDPDFTRDYHDPEKRSIANALTITFNDDSQLDEVKVEFPIGHARRRKDGIPLLLKKFSTNLARQFPETQQRKILSVSLDRTLLENMPVNEYLDLYVI

SEQ ID NO: 6611 - protein, 391 aa, Xenorhabdus bovienii
  Coding DNA sequence: Name=SeqID_503
  Gene classification: Gene name=GltA; Function=Citrate synthase; Function class=C Energy production and conversion
  Homolog annotation: Query=17..391bp; Hit=15..389bp; Blast score=609; Percent Identity=78.0; E value=1e-174; Homolog= prpC COG0372
MSKQNTMTGSPEAATFKPKKSVALSGMIAGNTALCTVGKNGSDLHYRGYDILDLAAYCEFEEIAYLLVHEKLPSRAELAAYKTKLKAFRGLPSSVKSALETLPAVAHPMDVMRTGVSVFGCTLPEKEDHNLTGARDIADRLLASLGSILLYWYHYSHNGRRIDVETDDDSIGGHFLHLLHGQKPRDSWEKAMHSSLILYAEHEFNASTFTSRVIAGTGSDTYSAIIGGIGALRGSKHGGANEVSFEIQQRYDSPDKAEADILTRLERKEVIIGFGHPVYTVSDPRHKVIKEISLHLSKEAGTTQMFDIADRIESVMRDNKKMFPNLDWFSAVSYHMMGVPTAMFTPLFVIARTAGWAAHIIEQRIDNKIIRPSANYTGPENLPFTPIDQRK

SEQ ID NO: 6612 - protein, 300 aa, Xenorhabdus bovienii
  Coding DNA sequence: Name=SeqID_504
  Gene classification: Gene name=PrpB; Function=PEP phosphonomutase and related enzymes; Function class=G Carbohydrate transport and metabolism
  Homolog annotation: Query=5..296bp; Hit=1..292bp; Blast score=457; Percent Identity=81.0; E value=1e-129; Homolog= prpB COG2513
MELYMAFSSAGLAFRRAIEAESPLQVVGTINANHALLAKRAGYKAIYLSGGGVSAGSLGLPDLGISTLDDVLTDIRRITDVCDLPLLVDADIGFGSSAFNVARTVRSIIKAGAAGIHIEDQVGAKRCGHRPNKEIVSKEEMVDRIKAAVDARTDEHFVIMARTDALAVEGLEAALDRAEAYIAAGADMLFPEAITELKMYQVFAARTQVPILANITEFGATPLFTTEELGSVDVAIALYPLSAFRAMNRAAEQVYTTLRRDGTQKNVIDLMQTRNELYESINYYDFEQKLDALFSQKNQR

SEQ ID NO: 6613 - protein, 570 aa, Xenorhabdus bovienii
  Coding DNA sequence: Name=SeqID_505
  Gene classification: Gene name=PspF; Function=Transcriptional regulators containing an AAA-type ATPase domain and a DNA-binding domain; Function class=T Signal transduction mechanisms
  Homolog annotation: Query=24..564bp; Hit=3..527bp; Blast score=630; Percent Identity=60.0; E value=1e-180; Homolog= ZprpR COG1221
MKHYGEIIKNRKEQERGEQMASGHTGECDNNKPVIWTVSVSRLFDLFRDITPEFDHQADITPINLGFEQAVQHIRKRLETEHCDTVICAGSNGAYLKSRLSVPVIIAKSSGFDFMQALARARQISARIGVITYQNTLPALEEFQQRFNLRIEQRSYVTEEDARTQVNALKAVGIKVIVGAGLITELAYEAELVGVFLYSADTIRQAFHDALEMARMTKLNLVSSSPYPTEDKLRIRHTLNDIRGDSAAVEHVRNTIMLYARSTATVLIQGESGTGKELVAQAIHHEYSLRYGQSVGKHPRPFVAVNCGAITESLLEAELFGYEEGAFTGSRRGGRAGLFEIAHRGTLFLDEIGEMPLPLQTRLLRVLEEKSVVRVGGYRPIAVDVRIICATHCDLDTWVREGSFRADLFYRLSVLRINVPALRERGSDIGLLAVEYLRRAFAALNLPVSSSRIRELSACHAALQSYHWPGNVRELRNLMERIALYLSAHPEQTLTPALILSLSPERQIDIGSVKSNAKTSEIEPPSSMAVSSSIHDIVARFAGNRQAAAEYLGISRTTLWRRLKQEPGKD

SEQ ID NO: 6614 - protein, 55 aa, Xenorhabdus bovienii
  Coding DNA sequence: Name=SeqID_506
MAGFWLTKSPEKQVGYHRNMLHFKNVILVIVITILVNKEPIPIRFFHLIFPRLLL

SEQ ID NO: 6615 - protein, 35 aa, Xenorhabdus bovienii
  Coding DNA sequence: Name=SeqID_507
VVSNLLLRTFCEPKTSHLAISPPHFNQFIRWNDNE

SEQ ID NO: 6616 - protein, 48 aa, Xenorhabdus bovienii; identical to SEQ ID NO: 6457
  Coding DNA sequence: Name=SeqID_508

SEQ ID NO: 6617 - protein, 49 aa, Xenorhabdus bovienii
  Coding DNA sequence: Name=SeqID_509
MFTFISWGLCSVSPTQKRDPNYPQMVCRLMSEWCYVRLVTFRRDLTTTY

SEQ ID NO: 6618 - protein, 36 aa, Xenorhabdus bovienii
  Coding DNA sequence: Name=SeqID_510
LNQKLKFPENIFTLFNLRFLSRRLCWRALAVPFVGF

SEQ ID NO: 6619 - protein, 47 aa, Xenorhabdus bovienii
  Coding DNA sequence: Name=SeqID_511
VRSKITKKGRIPSWKSDRKRLCRISRTEIIFSSYIKAKEKIKVRLIH

SEQ ID NO: 6620 - protein, 98 aa, Xenorhabdus bovienii
  Coding DNA sequence: Name=SeqID_512
  Homolog annotation: Query=1..98bp; Hit=1..98bp; Blast score=162; Percent Identity=90.0; E value=1e-39; Homolog= ref|NP_931182.1|
MDKKLFDDLVESMNQMVAIEKGELSVPAENIHRHRLPDVKNLRETFGLKQSEFAEAVGVSASLIQSWEQHRRIPSGSSLKLLKMLERNPTLISELSAL

SEQ ID NO: 6621 - protein, 66 aa, Xenorhabdus bovienii
  Coding DNA sequence: Name=SeqID_513
MNIAAYLRGVDYCNLFFHMKGLKPPSLDGDFDFNSLTYARLRGAWFDDFQSSAPKCANPPTSVGGS

SEQ ID NO: 6622 - protein, 38 aa, Xenorhabdus bovienii
  Coding DNA sequence: Name=SeqID_514
  Homolog annotation: Query=1..38bp; Hit=58..95bp; Blast score=67; Percent Identity=86.0; E value=4e-11; Homolog= ref|NP_931181.1|
MGKSGGVRIIYYTITKTGRFYLLLIYPKNKKDDLAPKE

SEQ ID NO: 6623 - protein, 52 aa, Xenorhabdus bovienii
  Coding DNA sequence: Name=SeqID_515
  Homolog annotation: Query=1..52bp; Hit=1..52bp; Blast score=96; Percent Identity=92.0; E value=8e-20; Homolog= ref|NP_931181.1|
MEYLLFIETPVFSRDRADLLTDDEFRRLQEHLLKNHEQGSTISATGGCKKIR

SEQ ID NO: 6624 - protein, 65 aa, Xenorhabdus bovienii
  Coding DNA sequence: Name=SeqID_516
MAALKLPLKNRHKKSNTNGVGSDRLLKVSRPHLGNDNELLSEGQLHFSIHMKISYYVRFYFYNRT

SEQ ID NO: 6625 - protein, 165 aa, Xenorhabdus bovienii
  Coding DNA sequence: Name=SeqID_517
  Gene classification: Function=Prophage antirepressor; Function class =K Transcription
  Homolog annotation: Query=50..161bp; Hit=2..114bp; Blast score=131; Percent Identity=54.0; E value=3e-31; Homolog= Z1818 COG3617
MVALRLPSLRINVGRAANTTPERGISPQLLLLFLASRHHLIVDFPRKKSKESEMANLSVTPFMFENQQVRTLTKNGNPWFVAQDVCDALKIKNSRDAIAKLDDEKGVALTDTLGGEQKINIINESGMYFLTIRCRDAVKIGTLSHRFRKWVTSVVLPTIERLVTI

SEQ ID NO: 6626 - protein, 87 aa, Xenorhabdus bovienii
  Coding DNA sequence: Name=SeqID_518
  Homolog annotation: Query=1..54bp; Hit=122..175bp; Blast score=61; Percent Identity=46.0; E value=3e-09; Homolog= ref|NP_931180.1|
LDQFIICPCCERPASIVGIKYYHREKSEIVALCNNSQCPSLPFKVDLSFSHYLQVKDESRNVRDVRRLINGMISTQKLKLVNALTSR

SEQ ID NO: 6627 - protein, 48 aa, Xenorhabdus bovienii
  Coding DNA sequence: Name=SeqID_519
MFLVVGLVVKDQQPKHKYVIYYIVNKLDQIPPAHPFYFYGHEWTLPRC

SEQ ID NO: 6628 - protein, 79 aa, Xenorhabdus bovienii
  Coding DNA sequence: Name=SeqID_520
MYLYNINILYLLYSYTYFKIMYSVKTRDKGGTAPNICVPTFDKAFLGNAQRLLPAANSRGAADRFVCRAKCGSPLRPKQ

SEQ ID NO: 6629 - protein, 71 aa, Xenorhabdus bovienii
  Coding DNA sequence: Name=SeqID_521
MNYGLVIKRAASIQNFSHNTTQNYRKILTKPKPHQTTRHVSQDIKLDEKSIMDGVARQKRNVLIGIFHSLP

SEQ ID NO: 6630 - protein, 138 aa, Xenorhabdus bovienii
  Coding DNA sequence: Name=SeqID_522
MHIPFFYSFPINSCQGASVFFGMAAQQFFPDVDIKIVLGGDRKGEDFHYWLEIDKKVYDLTVDQFISWMDKQYNCPDKPIYAEKKHPLAKYFFYKKRFSPLEAYSIFCDRHANERDVVAVYDFLKAELKKLGWNNPRR

SEQ ID NO: 6631 - protein, 40 aa, Xenorhabdus bovienii
  Coding DNA sequence: Name=SeqID_523
LHVSVHGFLSASNVLVNKYIISSLVDKGKCGQEYAHPFLL

SEQ ID NO: 6632 - protein, 119 aa, Xenorhabdus bovienii
  Coding DNA sequence: Name=SeqID_524
  Homolog annotation: Query=1..112bp; Hit=1..112bp; Blast score=173; Percent Identity=71.0; E value=4e-43; Homolog= ref|NP_931625.1|
MYRDMQKILSHWGGWVVQGRVNIGWKSVSAGFENAVTYTSNNKLSCSDDDGMVIDGCVAKLRNVGMSQECDFIEDHYVKGISKRAIGRSSKLSESEVRKRMLVAESFILGCLEVLNKNS

SEQ ID NO: 6633 - protein, 165 aa, Xenorhabdus bovienii
  Coding DNA sequence: Name=SeqID_525
  Gene classification: Function=Predicted transposase; Function class=L DNA replication, recombination and repair
  Homolog annotation: Query=1..117bp; Hit=165..281bp; Blast score=134; Percent Identity=56.0; E value=3e-32; Homolog= Z4330 COG3335
VDIDLNPKIGADWCFKGQQKRVVTPGKNQKHYLAGCLNAKTKEITYVGGLRKNSDLFIKLLDTLNNQYVNAKTITLILDNYGIHKSQKVIAGLAKNPKFNLLFLPVYSPWLNKIERLWQSLHETVTQNHCCQFMGQLLEHVKAFMEITSLQQQKPGRVKMGVSSL

SEQ ID NO: 6634 - protein, 373 aa, Xenorhabdus bovienii
  Coding DNA sequence: Name=SeqID_526
  Homolog annotation: Query=1..369bp; Hit=3..372bp; Blast score=242; Percent Identity=36.0; E value=8e-63; Homolog= ref|NP_415977.1|
MKELVDVFSDFPDPRCQGKVKHRFIDILVIAVCAAIAGANAWTDIEQYGQLKKDWLSSFLPLKGGIPSHDTFRRCFSLLNPSLFEHHFYQWVSRDLSSEKRAIIAIDGKSLRHSFDKKIDQSALHMVSAFTVEKGLSLCQCAVDGKSNEIKAIPALLSMLSLKGHLVTMDAIGCQRTIAQQLRESEADYILSLKGNQGKTFSEAVNYFQQQQITQKPYLKLDHDEFDDSHGRTVRRRGWVLPLTSEAKHLRSWPDIQALLVTETIRQEHYSDTVTSDFRYYLSSCYDSPAFQLGAIRKHWAIENSLHWVLDVTFREDDSRMRERVATRIFAQLRKMALNIVKRDINSKLSLSARRKSAGWDNGYMEALLFNQF

SEQ ID NO: 6635 - protein, 403 aa, Xenorhabdus bovienii
  Coding DNA sequence: Name=SeqID_527
  Gene classification: Gene name=XerC; Function=Integrase; Function class=L DNA replication, recombination and repair
  Homolog annotation: Query=1..394bp; Hit=1..387bp; Blast score=419; Percent Identity=54.0; E value=1e-117; Homolog= intA COG0582
MPKKITPLSPTTVSNAKAKLDSKTGKPKDTIYRDGDNLELLVKASGIKLWYFRYYKPFTQKRTMIAFGEYPSIGLADARRLKDEAKAMLAKDIDPVDWRKQQAAAIHEENSNTLKNIATRWFEVKKTTVSEDYAKDIWRSLEKNIFPKLGSTPISNLKAPMLVEVLKPIEARGNLETIKRLTQRTVEIIDYAMNLGVIDANPFTTVSKAFPKPKKKHNPTIRPEELPGLMQALSVARIERQTRLVIEWQLLTAMRPGEAVKARWSEIDFDNRIWNVPAQTMKIDRPHTVPLCQPALDILEIMKPISRHREFVFPHRSTPNICMNSQTANTALKRMGYQDILTAHGIRSIVSTAMNEQGFMPDAIEAVLAHGEKNSVRAAYNRATYLEQRRVMMQGLRMKIFSG

SEQ ID NO: 6636 - protein, 31 aa, Xenorhabdus bovienii
  Coding DNA sequence: Name=SeqID_528
MSGTGVFCCLNFINHIVNRIGTVGHHLWRKT

SEQ ID NO: 6637 - protein, 49 aa, Xenorhabdus bovienii
  Coding DNA sequence: Name=SeqID_529
VYSDAIRILIWWSWRELNPRPKFLHPRYYMLSLVFTFACQLRTDTPLTN

SEQ ID NO: 6638 - protein, 72 aa, Xenorhabdus bovienii
  Coding DNA sequence: Name=SeqID_530
VESRQRKNNEEFRALITGIIIQYSDILAFNILGADSGFDGIRETQGACRGAVGLVKSRKIIVANDENYALAA

SEQ ID NO: 6639 - protein, 160 aa, Xenorhabdus bovienii
  Coding DNA sequence: Name=SeqID_531
  Gene classification: Gene name=SmpB; Function=tmRNA-binding protein; Function class=O Posttranslational modification, protein turnover, chaperones
  Homolog annotation: Query=1..160bp; Hit=1..160bp; Blast score=275; Percent Identity=85.0; E value=1e-74; Homolog= smpB COG0691
MTKKKAHKPGSATIAMNKRARHEYFIEEEFEAGLSLQGWEVKSLRAGKANISESYVLLKDGDAYLFGATITPLNVASSHIVCDPTRSRKLLLNKRELDSLYGRINREGYTIVALSMYWKNAWSKIKIGVAKGKKAHDKRSDIKEREWKVDKERIMKNSGR

SEQ ID NO: 6640 - protein, 33 aa, Xenorhabdus bovienii
  Coding DNA sequence: Name=SeqID_532
MWLNKNLMAFGTINMHLLLNITQKRFLSLTHTV

SEQ ID NO: 6641 - protein, 144 aa, Xenorhabdus bovienii
  Coding DNA sequence: Name=SeqID_533
  Gene classification: Function=Oligoketide cyclase/lipid transport protein; Function class=I Lipid metabolism
  Homolog annotation: Query=1..143bp; Hit=14..156bp; Blast score=231; Percent Identity=74.0; E value=2e-61; Homolog= yfjG COG2867
MPQISRSALVPYSVEQMYKLINDVKSYPDFLPGCVGSSVISRSNNEMTAAVEVSKAGISKTFVTRNTLSDNKSISMQLVDGPFRKLMGGWHFTPLSEDACKVELHLDFEFTNKLIELAFGKVFKELAGNMVQAFTQRAREVYSV

SEQ ID NO: 6642 - protein, 103 aa, Xenorhabdus bovienii
  Coding DNA sequence: Name=SeqID_534
  Gene classification: Function=Uncharacterized BCR; Function class=S Function unknown
  Homolog annotation: Query=1..100bp; Hit=1..101bp; Blast score=125; Percent Identity=69.0; E value=5e-30; Homolog= yfjF COG2914
VRVRFTVSDINVEVVYALPERQYLCNVKVPQGSTVEQAIVASGLLTLRSDIDLTKNKIGIYSRPAKLTDTMVEGDRVEIYRPLLADPKEMRRKRAERAKNSTQ

SEQ ID NO: 6643 - protein, 114 aa, Xenorhabdus bovienii
  Coding DNA sequence: Name=SeqID_535
  Gene classification: Gene name=SmpA; Function=Small protein A (tmRNA -binding); Function class=J Translation, ribosomal structure and biogenesis
  Homolog annotation: Query=1..112bp; Hit=53..163bp; Blast score=107; Percent Identity=46.0; E value=3e-24; Homolog= HI0838 COG2913
MRCKLLTAATVSLVMLTAGCSMFERVVYRPDINQGNYLTPAAVSKIHKGMTQQQVAYTLGTPMLTDPFGSQIWYYIFREQPGHKKATQETLTLTFDNNGVLTDIKNEKALPEDQ

SEQ ID NO: 6644 - protein, 557 aa, Xenorhabdus bovienii
  Coding DNA sequence: Name=SeqID_536
  Gene classification: Gene name=RecN; Function=ATPases involved in DNA repair; Function class=L DNA replication, recombination and repair
  Homolog annotation: Query=1..557bp; Hit=1..553bp; Blast score=702; Percent Identity=69.0; E value=0; Homolog= recN COG0497
MLTQLTISNFAIVRELEIDFRSGMTAITGETGAGKSIAIDALGLCLGNRGEANMVRAGATRTDICARFSLADAPSARKWLEAHQLDESRDDDNECLLRRTITADGRSRGFINGTAVPLSQLRELGSHLIQIHGQHAHQLLLENRHQRRLLDIYAGQFELQHEMKQAYQQWRQSCQALARFQQQALERRSRQQLLEYHLKELNELAPQVGEYQEQDSEYKRLANCGQFLSVSQNVLQILNDNDEQNIVSLLNYARNELTELASMDHKFNELLNMLEEAAIQINEVSDELRHYSDLLELDPNRLFELEQKISQQISMARKHHVAPEELPALHQQLLEEQHQLSQQEDNCAHLSELVRLHYQQALNVAEKLHQVRQQYAVELSQLITNSIHQLSMPHGRFTIDLTFEPEHLNIDGASKVEFNVTTNPGQPHQSLAKVASGGELSRMALAIQVITAKKMETPALIFDEVDVGISGPTAAIVGRLLRELGESTQVMCVTHLPQVAGCGHQHFYVNKQTDGEETETHMQLLDKKARLQELARLLAGNEVTKNTLANAKELLAA

SEQ ID NO: 6645 - protein, 299 aa, Xenorhabdus bovienii
  Coding DNA sequence: Name=SeqID_537
  Gene classification: Function=Predicted kinase; Function class=R General function prediction only
  Homolog annotation: Query=8..299bp; Hit=1..292bp; Blast score=476; Percent Identity=76.0; E value=1e-135; Homolog= yfjB COG0061
MLKETTAMNNEFKCIGIVGRPRHPEALATHEMLYHWLVSKGYYVIMDRQVARDISLKGVQTGGLTEIGKIADLVIVVGGDGNMLGAARVLSRYDIKVIGINRGNLGFLTDLDPDNALQQLSEVLNGEYRDEKRFLLEAQVTKKGQKSRRSTALNEVVLHPGKVAHMIDFEVYIDERFAFSQRSDGLIIATPTGSTAYSLSAGGPILTPNLNAIVLVPMFPHTLSARPLVISSESSIRLKFSRNSNDYEVSCDSQIVLPIQDSEEVIIKRSEYNLHLIHPKDYNYFNTLSTKLGWSKKMF

SEQ ID NO: 6646 - protein, 276 aa, Xenorhabdus bovienii
  Coding DNA sequence: Name=SeqID_538
  Gene classification: Gene name=GrpE; Function=Molecular chaperone GrpE (heat shock protein); Function class=O Posttranslational modification, protein turnover, chaperones
  Homolog annotation: Query=84..276bp; Hit=1..194bp; Blast score=202; Percent Identity=57.0; E value=2e-52; Homolog= grpE COG0576
LSIHDDVVSFGYQPVIKHFMGGQRFRVTWTADNTDAFEFVIHCCCFLQHMVLPSQYDCSLESLVLIPIISGSSANNTKYAEIFMSSKDQKVPDEQVSENTENVFEQQMDAEKADTPETESIVDPRVAELEEQLKQAQIGERDAMLRARAEVENIRRRTELDIEKAHKFALERFANELLPVIDNLERALEAVDRSNDALLPMIEGVELTLKSFTNAVGKFGIEVVGDTNVPFNPEVHQAMTMMESDQHEPNHVMLVMQKGYTLNGRLLRPAMVAVSK

SEQ ID NO: 6647 - protein, 30 aa, Xenorhabdus bovienii
  Coding DNA sequence: Name=SeqID_539
LIGIPHCLSDNRITTKMPPCVWRHCNHGIA

SEQ ID NO: 6648 - protein, 226 aa, Xenorhabdus bovienii
  Coding DNA sequence: Name=SeqID_540
  Gene classification: Gene name=Ung; Function=Uracil DNA glycosylase; Function class=L DNA replication, recombination and repair
  Homolog annotation: Query=1..225bp; Hit=1..225bp; Blast score=343; Percent Identity=73.0; E value=9e-95; Homolog= ung COG0692
MPASLTWHEVIGHEKTQPYFVDTLTYVANERKAGKTIYPPQQDVFNAFRYTELSDVKVVILGQDPYHGPNQAHGLAFSVQPGIPAPPSLVNMYKELESDIAGFSRPNHGCLVSWAKQGVLLLNTVLTVERSNAHSHANLGWETFTDKVIAAINEHRHGVIFLLWGSHAQKKGHFINTQQHYVLKAPHPSPLSAHRGFLGCKHFSQANSLLEAQGLAPIDWYPTLPE

SEQ ID NO: 6649 - protein, 30 aa, Xenorhabdus bovienii
  Coding DNA sequence: Name=SeqID_541
MTSCHVRDAGIANPFLYDCQIGLSLPIPFA

SEQ ID NO: 6650 - protein, 383 aa, Xenorhabdus bovienii
  Coding DNA sequence: Name=SeqID_542
  Homolog annotation: Query=1..322bp; Hit=7..314bp; Blast score=297; Percent Identity=48.0; E value=2e-79; Homolog= ref|NP_930588.1|
MTLSINSSFFSELGIYSLQGSPLQLQSSPPVKSPSDKADVTHSTTQPTTVPLSENTQQNNNLYQSLVRDRHLSAMALPELHANDIAGKHSKRIDYDLSLVTRDVYRMNSMGIGDYVRLTKDEISKAGIDPAILEDSSTGFQAGVYRNKGLYIVSFTGSNEIQDFMASIRQGLGFKEEQYGQAVKLAQAALKGFGENVIFTGHSMGGGLASVAALTTGKPAVIFNAAGVSDSTLKSMGLSPKASREVAENGLIRNYIVEHDWLDNLQKTLPIPQPMGNKILLEYEYEPEGILDSIFAYRYAFHSFKAHFMEAVQELLTVHKPWLNKAGEMIAATEDSMQNKAIPMQKQALNTWGMNMDEAKISEQLREERHQLVSQQLEKHYSV

SEQ ID NO: 6651 - protein, 57 aa, Xenorhabdus bovienii
  Coding DNA sequence: Name=SeqID_543
LENAALLPVTPNQKRQNQPTINLTGKSGQTARFIISDKQKQWIQPYSSFHLYEYYTE

SEQ ID NO: 6652 - protein, 448 aa, Xenorhabdus bovienii
  Coding DNA sequence: Name=SeqID_544
  Gene classification: Gene name=SrmB; Function=3 Superfamily II DNA and RNA helicases; Function class=L DNA replication, recombination and repair
  Homolog annotation: Query=2..444bp; Hit=1..443bp; Blast score=622; Percent Identity=78.0; E value=1e-178; Homolog= srmB COG0513
MMTATNFSEFELDERLLNALNEKGYERPTAIQAEAIPPAMDGRDVLGSAPTGTGKTAAYLLPVLQHLLDFPRKKSGPPRILILTPTRELAMQVAEQAQALAAHTNLDVATITGGVAYMNHAEVFSENQDIVVATTGRLLQYIKEENFDCRAVETLILDEADRMLDMGFANDVETIAGETRWRKQTLLFSATLEGETIRDFAERLLTDPVEIDAEPSRRERKKIQQFYYRADNLEHKTALLCHLLQQPDVTKSIVFVRKRERVREIVDYLHKAGIQACFLEGEMVQTKRTDAVKRLNDGRVNVMVATDVASRGLDIENISHVFNFDLPRTADVYLHRIGRTARAGRKGTAIALVESHDHPLLGKVTRYLNEPLKVRVVDELRPQTKAPSEKKSYKPSKKVLEKRKEKKKVEEEAKKTRVKVRHRDSKNIGKRRTPSGDSKPETSEPTND

SEQ ID NO: 6653 - protein, 37 aa, Xenorhabdus bovienii
  Coding DNA sequence: Name=SeqID_545
LSQSSYTSIWVADYKQVRRILHPIKISCGQVAFIRGL

SEQ ID NO: 6654 - protein, 246 aa, Xenorhabdus bovienii
  Coding DNA sequence: Name=SeqID_546
  Gene classification: Gene name=SmtA; Function=SAM-dependent methyltransferases; Function class=Q Secondary metabolites biosynthesis, transport and catabolism
  Homolog annotation: Query=10..245bp; Hit=49..284bp; Blast score=256; Percent Identity=52.0; E value=1e-68; Homolog= yfiC COG0500
MGLIHKPAFRCGGFTFKQFFVGHDKCAMKVGTDGVLLGAWAPVDNRKKCLDIGCGSGLVALMIAQRTDDHSVIDAVELDTHAARQAIENVQESPWADRVKVHQQDIHDFTQQNHLQYDLIVSNPPYFEPANACRNEARSQARYTGSLTHRGLLDCVEHLIKATGLFCVVLPYNIGETFEQMAAERGWFTHHRVNIRDRQDKPLHRLLLAFSRQGQETQVSELTIRVSDGVYSTEFRQLVTDFYLYY

SEQ ID NO: 6655 - protein, 44 aa, Xenorhabdus bovienii
  Coding DNA sequence: Name=SeqID_547
LIVILSYNHLLFRISPFMYSTNHSLYFPGNTILRQEKRTIHFIA

SEQ ID NO: 6656 - protein, 245 aa, Xenorhabdus bovienii
  Coding DNA sequence: Name=SeqID_548
  Gene classification: Gene name=RpoE; Function=DNA-directed RNA polymerase specialized sigma subunits, sigma24 homologs; Function class=K Transcription
  Homolog annotation: Query=55..245bp; Hit=1..191bp; Blast score=327; Percent Identity=84.0; E value=1e-89; Homolog= rpoE COG1595
VRYEITGGCKIKLRSKLNFTQNRDSKSCLFGKQGIMAGVIKYKCGVLPQESEPRMSEQLTDQMLVERVQKGDQKAFNLLVIKYQHKVASLIARYVPQGDVPDVAQEVFIKTYRALYSFRGDSAFYTWLYRIAVNTAKNYLVAQGRRPPSNDLDANDAENYDASSSLKEISNPENLMLSEELKEVVFRTIESLPDDLRVAITLRELDGLSYEEIADIMECPVGTVRSRIFRAREAIDNKVQPLIQQ

SEQ ID NO: 6657 - protein, 216 aa, Xenorhabdus bovienii
  Coding DNA sequence: Name=SeqID_549
  Gene classification: Gene name=RseA; Function=Negative regulator of sigma E activity; Function class=T Signal transduction mechanisms
  Homolog annotation: Query=1..195bp; Hit=1..188bp; Blast score=210; Percent Identity=57.0; E value=7e-55; Homolog= ZrseA COG3073
MQREKLSALMDGEALDSEVVRLIAEDTVMQKQWERYHLIRDTLRGEVGDVLHLDIASRVALALEKEPIHINPAAIPESQPKPETWQKMPFWNKIRPWASQMTQVGIAACVSLAVIIGVQQYNSDGSVDADTQSDTPVFNTLPVMGSASPVGLAAPVDDEALGSDLNMQVRESNKRIDAMLQQYELSRRIHSEQNQRLPPADNTQSVGAKIQQAPQQ

SEQ ID NO: 6658 - protein, 319 aa, Xenorhabdus bovienii
  Coding DNA sequence: Name=SeqID_550
  Gene classification: Gene name=RseB; Function=Negative regulator of sigma E activity; Function class=T Signal transduction mechanisms
  Homolog annotation: Query=1..315bp; Hit=1..314bp; Blast score=280; Percent Identity=46.0; E value=2e-75; Homolog= rseB COG3026
MKHICFFIFLLAGSLFNPLKASAQQSGTEALLQDMGNAVQTLNYELAFINLERELLIPLRYRHAIIDGQPIAQIIQMDGSRREIIQRGNQISYYEPGLDSFSLRGNHIVDYFPPIIFADFSRLQKYYRFIDAGSTHVGDHPVYFVRIISKDETRYNYNLLIDAKSHLPLLIDLLDKDHNIVIEQFRVVSSTVNDSIKKDLIAIVDLKLPPMLAISPSEKVKFDWQVGKMPEGFKEISRNRLKLAETESLESIMYSDGLFQFSVNVAHAGKEVVNKQPFRQGRRTVYTLVRGKNTIAIVGELPFATAKQIVASVTFTGDH

SEQ ID NO: 6659 - protein, 154 aa, Xenorhabdus bovienii
  Coding DNA sequence: Name=SeqID_551
  Gene classification: Gene name=RseC; Function=Positive regulator of sigma E activity; Function class=T Signal transduction mechanisms
  Homolog annotation: Query=1..149bp; Hit=1..149bp; Blast score=141; Percent Identity=45.0; E value=3e-34; Homolog= ZrseC COG3086
MVKEWATVVRWQKGRALLRYGSSSGCGSCQANAACGSYLLEKLGPKNIHQLELEISQPLQPGQKVEVGIPESSLLRSAMLVYLTPLLGLFLGGLLFQYWVTDQLWVVMGGVIGGVTGFFFARKIAKYWDNQQAYQPVVLQIGLPPDTIKVLQQE

SEQ ID NO: 6660 - protein, 74 aa, Xenorhabdus bovienii
  Coding DNA sequence: Name=SeqID_552
MDTQMDIKRQFIGLATGQRGVFYMPNLRKPSHACGFQYDQKVRAVNGKADYSCCRTLIVSGGKPICNTTGWYAC

SEQ ID NO: 6661 - protein, 598 aa, Xenorhabdus bovienii
  Coding DNA sequence: Name=SeqID_553
  Gene classification: Gene name=LepA; Function=Membrane GTPase LepA; Function class=N Cell motility and secretion
  Homolog annotation: Query=1..598bp; Hit=1..598bp; Blast score=1073; Percent Identity=90.0; E value=0; Homolog= lepA COG0481
MKQIRNFSIIAHIDHGKSTLSDRIIQICGGLSDREMAAQVLDSMDLERERGITIKAQSVTLDYQSIDGQVYQLNFIDTPGHVDFSYEVSRSLAACEGALLVVDAGQGVEAQTLANCYTAIEMDLQVVPVLNKIDLPAAEPERVAEEIEDIVGIDATDAVRCSAKTGVGVQDVIERLVKEIPPPEGNSDAPLQALIIDSWFDNYLGVVSLVRVKNGTLRKGDKIKVMSTGQVYNADRLGIFTPKRIDRDILNCGEVGWLVCAIKDILGAPVGDTLTTARQPADKALPGFQKVKPQVYAGLFPISSEDYEAFRDALGKLSLNDASLFYEPESSTALGFGFRCGFLGLLHMEIIQERLEREYDLDLITTAPTVVYEVETVSDDIIYVDSPSKLPPLNNIKELREPVAECNMLLPQEYLGNVITLCVEKRGVQTNMVYHGNQVALTYEIPMAEVVLDFFDRLKSTSRGYASLDYNFIRFQHSDMVRVDVLINGERVDALALITHRENSQYRGRELVDKMKELIPRQQFDIAIQAAIGAHIIARATVKQLRKNVLAKCYGGDVSRKKKLLQKQKDGKKRMKQVGNVELPQEAFLAILHVGKDN

SEQ ID NO: 6662 - protein, 322 aa, Xenorhabdus bovienii
  Coding DNA sequence: Name=SeqID_554
  Gene classification: Gene name=LepB; Function=Signal peptidase I; Function class=N Cell motility and secretion
  Homolog annotation: Query=1..322bp; Hit=1..324bp; Blast score=402; Percent Identity=62.0; E value=1e-112; Homolog= ZlepB COG0681
MANTFALILTLATLITGIIWCIDRFKFAPERRKKLAQIQEQAAGAESQEALATEINKPSWVETFASVFPVLAIVLLLRSFVYEPFQIPSGSMMPTLLIGDFILVEKFAYGLKDPITQTTLIKTGKPKRGDIAVFKYPVNPSLDFVKRVIGLPGDKIVYDDINKELQVFPGCGWNTVCKNLPVTYRDMFPSEWTIKEDITPEGAPMRGVYPIPIEEQLGSNSIRQGERVERLGNVSHHILTVPGASNIPFFSQPGLPLGTWVVPEGHYFMMGDNRDNSSDSRVWGFVPEKNLVGRATAIWISFEKQEGEWPTGVRLSRIGGIH

SEQ ID NO: 6663 - protein, 32 aa, Xenorhabdus bovienii
  Coding DNA sequence: Name=SeqID_555
MCYQFSQNSSKKHTQQTCGDRPYKTVAFALAS

SEQ ID NO: 6664 - protein, 226 aa, Xenorhabdus bovienii
  Coding DNA sequence: Name=SeqID_556
  Gene classification: Gene name=Rnc; Function=dsRNA-specific ribonuclease; Function class=K Transcription
  Homolog annotation: Query=1..226bp; Hit=1..226bp; Blast score=374; Percent Identity=87.0; E value=1e-104; Homolog= rnc COG0571
MNSIIINRLQRKLGYTFIQHDLLLQALTHRSANSKHNERLEFLGDSILSFVIANALYHRFPRVDEGDMSRMRATLVRGNTLAELAREFELGECLRLGPGELKSGGHRRESILADSIEALIGAIFLDSDIQTIERIILSWYETRLNEISPGDKQKDPKTRLQEYLQGRHLPLPSYLVVQVRGEAHDQEFTIHCQISGFEQPVRGVGSSRRKAEQAAAEQALKQLELE

SEQ ID NO: 6665 - protein, 301 aa, Xenorhabdus bovienii
  Coding DNA sequence: Name=SeqID_557
  Gene classification: Gene name=Era; Function=GTPases; Function class =R General function prediction only
  Homolog annotation: Query=1..301bp; Hit=1..301bp; Blast score=515; Percent Identity=84.0; E value=1e-146; Homolog= era COG1159
MSEEKNYCGFVAIVGRPNVGKSTLLNQLLGQKISITSRKPQTTRHRIMGIHTEGVYQAIYVDTPGLHIEEKRAINRLMNRAASSSIGDVELVIFVVEGTHWTADDEMVVNKLRNLHCPVILAINKVDNVTDKAILLPHIGFLSKQMNFLDVVPISAEKGMNVDTIAKIVRAHIPEAGHHFPDDYITDRSQRFMASEIIREKLMRFLGDELPYSVTVEIEQFVTNERGGYTIHGLILVEREGQKKMVIGNKGSKIKTIGIEARQDMEKLFDNKVHLELWVKVKAGWADDERALRSLGYIDDL

SEQ ID NO: 6666 - protein, 245 aa, Xenorhabdus bovienii
  Coding DNA sequence: Name=SeqID_558
  Gene classification: Gene name=RecO; Function=Recombinational DNA repair protein (RecF pathway); Function class=L DNA replication, recombination and repair
  Homolog annotation: Query=1..236bp; Hit=1..236bp; Blast score=341; Percent Identity=72.0; E value=4e-94; Homolog= recO COG1381
VDGWQRAFVLHGRPYSETSLLLDFFTENEGRVRVLAKGVRRRRSHLKGCLQPFTPLLVRWSGRGEIKTLRDADPISLALPLTGSVLYSGLYVNELLSRVLEQGAAYPALFFDYLQCLQVLAASECTPEYALRRFELALLTNMGYGVDYLHCAGSGEPVSDTMTYRYREEKGFIASLVVDHFSFTGNELKALAAGEFTDSLTLKAAKRFTRIALKPYLGGKPLKSRELFRQFVPKKTDTPNQQNEN

SEQ ID NO: 6667 - protein, 250 aa, Xenorhabdus bovienii
  Coding DNA sequence: Name=SeqID_559
  Gene classification: Gene name=PdxJ; Function=Pyridoxal phosphate biosynthesis protein; Function class=H Coenzyme metabolism
  Homolog annotation: Query=8..249bp; Hit=1..242bp; Blast score=338; Percent Identity=74.0; E value=3e-93; Homolog= pdxJ COG0854
MLLQELKMAEVLLGINIDHIATVRNARGTQYPDPVQAAFVAEQAGADGITVHLREDRRHITDRDVQLLAKTIQTRMNLEMAVTDEMIDIACQIKPVFCCLVPEKRQEVTTEGGLDVLGQKVHIAAAVKRLSEAGIFVSLFIDADHQQIDAAAEVGAPFIEIHTGAYADAENDTQQEQEFLRIKEAVTYAAGKGIKVNAGHGLTYHNVQRIAALPEIYELNIGHAIIGRAVFSSLPAAVADMKTLLREARR

SEQ ID NO: 6668 - protein, 126 aa, Xenorhabdus bovienii
  Coding DNA sequence: Name=SeqID_560
  Gene classification: Gene name=AcpS; Function=Phosphopantetheinyl transferase (holo-ACP synthase); Function class=I Lipid metabolism
  Homolog annotation: Query=1..126bp; Hit=1..126bp; Blast score=187; Percent Identity=74.0; E value=2e-48; Homolog= acpS COG0736
MAIVGLGTDIVEISRVEEIVERSGERLAKRVLSDREWQQYQQHNQPIRFLAKRFAVKEAAAKALGTGIRNGLAFNQFEVINDPLGKPTLKLHGEAETLADKLNVRSLHVTLADERRYACATVILES

SEQ ID NO: 6669 - protein, 86 aa, Xenorhabdus bovienii
  Coding DNA sequence: Name=SeqID_561
  Gene classification: Gene name=NapF; Function=Ferredoxin 2; Function class=C Energy production and conversion
  Homolog annotation: Query=1..86bp; Hit=1..86bp; Blast score=129; Percent Identity=80.0; E value=4e-31; Homolog= yfhL COG1145
MALLITKRCINCDMCEPECPNQAITMGAEIYEIDSERCTECVGHYEKPTCQSVCPITNTIILNPDHQETEEQLWDKFVLLHHADKI

SEQ ID NO: 6670 - protein, 33 aa, Xenorhabdus bovienii
  Coding DNA sequence: Name=SeqID_562
MTKTPETHRIERYYHNHSQQLSWKKAYNYWGFF

SEQ ID NO: 6671 - protein, 298 aa, Xenorhabdus bovienii
  Coding DNA sequence: Name=SeqID_563
  Gene classification: Gene name=AlkA; Function=3-Methyladenine DNA glycosylase; Function class=L DNA replication, recombination and repair
  Homolog annotation: Query=97..291bp; Hit=102..300bp; Blast score=92; Percent Identity=27.0; E value=4e-19; Homolog= BS_alkA COG0122
MKLSSFTEIILPDNYHTQDFLAFHHRDEKGVSEIVQQSRMKKGIIWHGNPALLTVSIDKHRAQIQLEVDGDDAHQSEKALSTLASHMLGLLQPVEEFESMYQADPVIGELVTRQAGLRIYQSATPFEALSWAIIGQQISLNAAISIRRRFIQAIGVKHSSGLLCHPTHEQIIQCSEHDLRQCGFSVSKANALLNVSQLIDSAELKLAITEGEIKRLTDNLLAIKGIGMWTINYALLRGFNYLNGSLHGDVAVRRNLQYLLKQGDKVNAEQTEAWLSEFSPWKALVAAHLWRQQSSSGY

SEQ ID NO: 6672 - protein, 44 aa, Xenorhabdus bovienii
  Coding DNA sequence: Name=SeqID_564
MSVGKGESIYLLDPDGHQLEIHVGSLASRLNTLRKTPYKGLEWY

SEQ ID NO: 6673 - protein, 34 aa, Xenorhabdus bovienii
  Coding DNA sequence: Name=SeqID_565
MLTDLNHLTLTTSNLEHSLDFYINLLGFTPHVRW

SEQ ID NO: 6674 - protein, 215 aa, Xenorhabdus bovienii
  Coding DNA sequence: Name=SeqID_566
  Gene classification: Function=Predicted HD superfamily hydrolase; Function class=R General function prediction only
  Homolog annotation: Query=23..212bp; Hit=22..208bp; Blast score=149; Percent Identity=44.0; E value=2e-36; Homolog= ZyedJ COG1418
MLFFSPFEDLAQQLLPIAVEGDDGAHDIAHLHRVWRNAKRICEVVESGNLQWVLAAVLLHDCVSVEKNDPNRHLASHMAAEKAALILKNLGWGGEDIAAVCHAIEAHSFSAGLTPRTLEAKIVQDADRLDSIGMVGVARCFYTAGRMRSALYDFHDPLAKHREYNDTAYTLDHFYTKLFKIESGFQTETGRQMARERTERMEHFLEAFLNEIQVT

SEQ ID NO: 6675 - protein, 43 aa, Xenorhabdus bovienii
  Coding DNA sequence: Name=SeqID_567
VPALPVPLPDASSIHHYIFLHYISLSLQVLLLMKISLIITISH

SEQ ID NO: 6676 - protein, 159 aa, Xenorhabdus bovienii
  Coding DNA sequence: Name=SeqID_568
  Gene classification: Function=Cytosine/adenosine deaminases; Function class=F Nucleotide transport and metabolism
  Homolog annotation: Query=1..150bp; Hit=23..172bp; Blast score=213; Percent Identity=67.0; E value=6e-56; Homolog= ZyfhC COG0590
MRRAMELAMQAQSHGEIPVGAVLVADNKIIAEGYNHPITEHDPTAHAEIIALRRGGIELQNYRLLNTTLYVTLEPCVMCAGAMVHSRIQRLVYGASDMKTGAAGSLIDILRHPGMNHQIEITGGVLAQECATMLSTFFKQRREQHKALKKLKIQQQETP

SEQ ID NO: 6677 - protein, 516 aa, Xenorhabdus bovienii
  Coding DNA sequence: Name=SeqID_569
  Gene classification: Gene name=MltE; Function=Soluble lytic murein transglycosylase and related regulatory proteins (some contain LysM/invasin domains); Function class=M Cell envelope biogenesis, outer membrane
  Homolog annotation: Query=294..482bp; Hit=1..189bp; Blast score=249; Percent Identity=61.0; E value=4e-66; Homolog= yfhD_2 COG0741
MLYFTFHTEPTALTRDNYLSNIKINYFVIVIIALLSAAIIGLNISWPNKQQEQINRILARGELRISTISSPLISANSKNEATGFDYELAKRFAEYLGVKLVIHFRTNINQIFDDLDNDNADFLAAGLIYNEERLDQARTGPAYYSVSQQLIYRKGTPRPRTFGDLNGTLVVTEGSAHARELKKYKEESYPNLTWEDTSRDNTRELLEQVSEGKIDYTISDSISFSLQQRIHPNLAFAFEVNGERPLTWYLKRSDDYSLYSAMLDFFNQMSENDVIPQLEEKYFSHIYQFDYFDTISFIRAINSTLPIYQPIFEKYAGSLDWQLVAAIAWQESHWNPQATSPTGVRGMMMLTRPTAEWVKISDRLDPEESVKGGMAYLHYLMERLPKTIPEDERIWFALAAYNMGYGHILDVRKLTAEQKGNPDRWRDIKSRLDLLSKKKFYTNTTYGYARGYEAYRYVENIRRYYQSLEGYLRAKNKRSKKAEHETPIDKVIVPLSDGEGNKAVVNEKTPEVKTPT

SEQ ID NO: 6678 - protein, 33 aa, Xenorhabdus bovienii
  Coding DNA sequence: Name=SeqID_570
LHIPVLLRKMLNYWKFNHAIFHISYGTYRTDKR

SEQ ID NO: 6679 - protein, 1301 aa, Xenorhabdus bovienii
  Coding DNA sequence: Name=SeqID_571
  Gene classification: Gene name=PurL; Function =Phosphoribosylformylglycinamidine (FGAM) synthase, synthetase domain; Function class=F Nucleotide transport and metabolism
  Homolog annotation: Query=7..979bp; Hit=2..973bp; Blast score=1587; Percent Identity=77.0; E value=0; Homolog= purL_1 COG0046
MREPITMEILRGSPALSAFRITKLLSQCQDQQLPVTEIYAEYVHFAEIHSPITGNEREKLNRLLKYGPFLDEHEPKGQLLLVTPRPGTISPWSSKATEIVHNCGLKQIARLERGIAYYIQSDEMSDGQWQELSALLHDRMMESVFTQPEQAEALFSHQEPAPLKQINILQSGRAALESANIELGLALAADEIDYLMRAFRTLGRNPTDVELYMFAQANSEHCRHKIFNADWVIDGQEQPNSLFKMIKNTFEQTPDYVFSAYKDNAAVMEGSPVGRFFPNRESGVYDYHQEPAHILMKVETHNHPTAISPWPGAATGSGGEIRDEGATGRGAKPKAGLVGFSVSNLKIPGFEQPWEEDFGKPDRIVSALDIMLEGPLGGAAFNNEFGRPALLGYFRTYEEKVNSHNGAELRGYHKPIMLAGGIGNIREEHIQKGDISIGAKLIVLGGPSMNIGLGGGAASSMTSGQSDAELDFASVQRDNAEMERRCQEVIDSCWQLGDKNPILFIHDVGAGGLSNAMPELVSDGGRGGRFELRNILNDELGMSPLQVWCNESQERYVMAVAPEQLALFEDICRRERAPYAVIGEATEERHLLLNDNHFDNQPIDMPLDVLLGKTPKMLKNVVTLKAQGHNLERRGIDLAEAVKRVLHLPAVAEKTFLITIGDRSITGMVARDQMIGPWQIPVADCAVTTASLDSYYGEAMSIGERAPIALLNFAASARMAVGEALTNIASAYVQDLKRVKLSANWMSASGHAGEDAGLYAAVKAVGEELCPALGLTIPVGKDSMSMKTCWNQNGEEREMTAPLSLVITAFARVEDVRYTVTPELSTDDDNALLLIDLGQGQNALGGTALAQVYRQLGDKTADVRSTEQLAGFFNAIQQLVSEQKLLAYHDRSDGGLLVTLAEMAFAGHCGLRADISAFDEDILAALFSEELGAVIQIRQTDREQVEKLLADYGLSECVHYLGQAQAGEDFVISSNDMDVYRQNRSTLRLWWAETTWQMQRLRDNPECADQEHQAKQDLNDPGLNVKLTFDPAEDIAACYISKQVRPRVAVLREQGVNSHVEMAAAFHRAGFDAVDVHMSDLLSGRITLDQFQTLVACGGFSYGDVLGAGEGWAKSILFNSQVRDDFANFFARPDTLALGVCNGCQMISNLHELIPGTEHWPRFVRNRSERYEARFSLVEVADSPSLFLQGMAGSRLPIAVAHGEGQVEFRNSQSLAELEKHQQVALRFVDNYGLATENYPANPNGSVNGITAVTSLDGRVTAMMPHPERVFRTVSHSWHPKEWGEDGPWMRIFRNARKQLG

SEQ ID NO: 6680 - protein, 68 aa, Xenorhabdus bovienii
  Coding DNA sequence: Name=SeqID_572
LLQYGDTSIELHQLQFLLARTIDDYVSSHSEYHSRSILLQNWCSEGLRNICKQHSSLLNHKTRVKQVL

SEQ ID NO: 6681 - protein, 91 aa, Xenorhabdus bovienii
  Coding DNA sequence: Name=SeqID_573
LDGRHLTSASFWAYVAYFHLIVDLHKKLNEQLPFIMHIACQLSNKNTNRLILLKIKITSSYTRLCDEYFLISIMYFCRQFMTLNHIKLFYQ

SEQ ID NO: 6682 - protein, 36 aa, Xenorhabdus bovienii
  Coding DNA sequence: Name=SeqID_574
MILAFGPYQTTGDTWSEAPPTCSSSSMKGTHWRDSR

SEQ ID NO: 6683 - protein, 34 aa, Xenorhabdus bovienii
  Coding DNA sequence: Name=SeqID_575
LLLFLVFENSGLLRAMRVHIQTDAYMNTMDRSYL

SEQ ID NO: 6684 - protein, 491 aa, Xenorhabdus bovienii
  Coding DNA sequence: Name=SeqID_576
  Gene classification: Gene name=BaeS; Function=Signal transduction histidine kinase; Function class=T Signal transduction mechanisms
  Homolog annotation: Query=2..485bp; Hit=8..490bp; Blast score=565; Percent Identity=63.0; E value=1e-161; Homolog= ZyfhK COG0642
MSVSINVITGYEMISLNKWRLFPRSLRQLVLMAFWLVLLPLLVLAYQAYQSLDQLSTQAAEINRTTLADARRSEAMIGVALEMERSYRQYCVLGDARLEKLYQRQYRQYLNMLGNQMMMLANKEYTERFNQLLSGLAKISCSNGMPEPAANKRLEQFSTANNLLVQETRNIIFIRGEQLQKDIADKGQLFGWQSLILFLLSAFLITLFTRMIIGPVKRIESMINRLGAGQTLDNQIESFQGPRELRSLAQRIIWLSERLSWLESQRHEFLRHISHELKTPLASMREGTELLADEIAGPLTADQKEVVSILDSSSKHLQQLIEQLLEYNRKLADSSVEHQIVSLKEIVDSVVLSHQLPARAKNINTEIQLDTSFCWAEPKLLMRVIDNLYSNAVHYGAESGNIWISSRQVGKNIQIDIANTGTPIPELEKSMIFEPFYQGKLQRKGAVKGSGLGLSIAQDCIKQMGGELHLIEPEFADVCFRIELPLTAEND

SEQ ID NO: 6685 - protein, 291 aa, Xenorhabdus bovienii
  Coding DNA sequence: Name=SeqID_577
  Homolog annotation: Query=33..282bp; Hit=3..249bp; Blast score=241; Percent Identity=50.0; E value=2e-62; Homolog= ref|NP_930534.1|
MYNRFTYRFMTKTEQQNIVIQPMKKPAVMQHFLERASALRFRAIILLFIPYLLAGCAETTGNDELLTIAQAIMPEQRVTDYRLKGCDGIWDIVKPAAMENGLYWLKVMDCTDRLSSLEARDAAKRFTPTAPTDWGHVFKQSILMSRATPTLTERRKIVENLNRYSPQSPSALRPLLQLWREQQYLKINLAEERLKFQRLQFDSDSKIDRLKEIRARLEHDLRSISRKLENLTDIERQLSSRKQDQSSVATSGETEHLGNVESSEQLKPEAKPEMNQKTESEANLPEEKGAE

SEQ ID NO: 6686 - protein, 445 aa, Xenorhabdus bovienii
  Coding DNA sequence: Name=SeqID_578
  Gene classification: Gene name=AtoC; Function=Response regulator containing CheY-like receiver, AAA-type ATPase, and DNA-binding domains; Function class=T Signal transduction mechanisms
  Homolog annotation: Query=6..445bp; Hit=5..444bp; Blast score=713; Percent Identity=85.0; E value=0; Homolog= yfhA COG2204
MTVRNPARLLLVDDDPGILKLLGMRLTSEGFRVTTAESGHEALRLLAKEKADLVISDLRMDEMDGMALFAEIQKQHPGMPVIILTAHGSIPDAVAATQQGVFSFLTKPVDRDALYKAIDAALELSKPAIDGQWCEQIVTRSPLMLRLLEQAKMVAQSDVSVLINGQSGTGKEVLAQAIHRVSPRVKKPFIAINCGALPEQLLESELFGHAKGAFTGAVSSREGLFLAAQGGTLFLDEIGDMPLALQVKLLRVLQERKIRPLGSNRDIDIDVRIISATHCDLPKAMQRNEFREDLYYRLNVVNMKIPALNERAEDIPLLANHLLRASAKRHKPFVRSFSTNAMKCLMAASWPGNVRQLVNVIEQCVALTTAPVISDALVMQALEGENTALPTFVEARGQFELHYLRKLLQMTKGNVTHAARMAGRNRTEFYKLLARHELDANDFKE

SEQ ID NO: 6687 - protein, 550 aa, Xenorhabdus bovienii
  Coding DNA sequence: Name=SeqID_579
  Gene classification: Gene name=NadE; Function=NAD synthase; Function class=H Coenzyme metabolism
  Homolog annotation: Query=266..545bp; Hit=5..286bp; Blast score=304; Percent Identity=54.0; E value=2e-82; Homolog= XF1961_2 COG0171
MNYGPGEPQSMSRTLNIVLAQLNWLVGDIEGNSKRMLQTVQEQQEKGADLVMFSELALSGYFPEDLLFRADLHQRCREQLVRLQEASSQVAILVGHPWQQDGKTYNALSLFWKGEVIARYFKQLLPNYGVFDEERYFKAGDQSCVVPFKGYNLGLLICEDLWFDAPIDALKQAGADIILSLNASPYNREKPNIRSTLIQSHCQRTQLPIIYLNQVGGQDQLIFDGCSKVFDANGKITHRMAAFEEQVEQCRFNEMNIEPMANLIPQLSPLAQIYKALVLSVRDYVQKNCFKGALLGLSGGIDSGLTLAIAVDALGKDHVQAVMMPFRYTSEMSIHDAREQAELLGVEFDVVSIEPMFDAFMTQLEPMFAGTEKDTTEENLQARCRAVILMAMSNKRRRLVLTTSNKSESAVGYSTLYGDMAGGFNALKDVPKTMVFALSKYRNTVSPAIPQRVIDRPPSAELAPDQLDQDSLPPYDMLDAILEGYVEKDKSVADLVAEGFDEAIVRKVIRLVDINEYKRRQAPIGPRITERDFGKDRRYPITSGFGRKNW

SEQ ID NO: 6688 - protein, 112 aa, Xenorhabdus bovienii
  Coding DNA sequence: Name=SeqID_580
  Gene classification: Gene name=GlnK; Function=Nitrogen regulatory protein PII; Function class=E Amino acid transport and metabolism
  Homolog annotation: Query=1..112bp; Hit=1..112bp; Blast score=183; Percent Identity=94.0; E value=3e-47; Homolog= glnB COG0347
MKKIDAIIKPFKLDDVREALAEVGITGMTVTEVKGFGRQKGHTELYRGAEYMVDFLPKVKIEIVVPDDIVDTCVETIIQTAQTGKIGDGKIFVFDVARVVRIRTGEQDEEAI

SEQ ID NO: 6689 - protein, 396 aa, Xenorhabdus bovienii
  Coding DNA sequence: Name=SeqID_581
  Gene classification: Gene name=Hmp; Function=Flavodoxin reductases (ferredoxin-NADPH reductases) family 1; Function class=C Energy production and conversion
  Homolog annotation: Query=151..396bp; Hit=2..247bp; Blast score=285; Percent Identity=53.0; E value=6e-77; Homolog= hmp_2 COG1018
MLDSQVIATVKSTIPLIVSTGPKLTAHFYERMFKHNPELKDIFNMSNQLNGAQREALFNALCAYASNIDNLQALLPAVEKIAHKHTSLNIQPEHYQIVGTHLLATLDEMFHPGDEVLNAWGKAYGVLANVFINREEEIYQRGESEEGGWRGLRQFRVNKKQPQSDVITSFEFVPADGGKVIDYKAGQYLGIYLDTPAFENREIRQYSLTTAPNSHSYQIAIKREAQGKVSNYMHDNVQEGDTILLAAPRGDFFLDVQPDTPVTLISAGVGLTPMMSMLQHLHNQYHVGTVNWFHAAEHGGYHAFADKVNAITQSMPNLHTQVWYREPRNEDQQGADYQHMGLMDLSVVKDSISEEGMQFYFCGPVVFMQYIAQQLLAIGIDKQHIHYECFGPHKVL

SEQ ID NO: 6690 - protein, 55 aa, Xenorhabdus bovienii
  Coding DNA sequence: Name=SeqID_582
MCGQFWAGRNDQWDGGFYGSDNLAIQHRKLLNFSQIALKFITCILNTTYGFWQCF

SEQ ID NO: 6691 - protein, 41 aa, Xenorhabdus bovienii
  Coding DNA sequence: Name=SeqID_583
LIKTLTQTIVYSHDTYSADSSPIIIFVTLVRPCSNTNPPLD

SEQ ID NO: 6692 - protein, 307 aa, Xenorhabdus bovienii
  Coding DNA sequence: Name=SeqID_584
  Homolog annotation: Query=1..304bp; Hit=70..373bp; Blast score=334; Percent Identity=54.0; E value=1e-90; Homolog= ref|NP_927501.1|
VHDTIARIISCIEPRQFQPCFIGWMQTVNQLTEGSLIAIDGKTLRASYHREERRSTIPMVSVFAIENKRVLGQQRTSSKSNEITAIPELLALLDIRGCLISIDAMGCQTKIARQRVEKDGDYLLAVKDNHPTLAKAVIQRLSESTAEKSKQEDVHFEYAHGRTEAREYHGLPAGKLTQQFPEWKGLKRIGVALGYRMDKSGKESLEYRYYISSAALNKEQFKQAIRSHWLIENSLHWVLDVTINEDTCRIYRENAAENIAYIRHIALNTLRKEKSQLSTRRKQKKTWMQVDYAVQVLEVGFEQVGKK

SEQ ID NO: 6693 - protein, 65 aa, Xenorhabdus bovienii
  Coding DNA sequence: Name=SeqID_585
LYLVPSSPEPKAGRILKTTATVTLKAFKRKGCSKPVSLCMTRLPGSFPVLNLVNSSHALSAGCRR

SEQ ID NO: 6694 - protein, 31 aa, Xenorhabdus bovienii
  Coding DNA sequence: Name=SeqID_586
MILYAPFRENPYGYRRIFTAFRSNRRQKAVI

SEQ ID NO: 6695 - protein, 35 aa, Xenorhabdus bovienii
  Coding DNA sequence: Name=SeqID_587
LPWSIPLDKNGLYCMIFRPSGVFFRDVAELGKVCK

SEQ ID NO: 6696 - protein, 159 aa, Xenorhabdus bovienii
  Coding DNA sequence: Name=SeqID_588
  Gene classification: Gene name=Hcp; Function=Hemolysin-coregulated protein (uncharacterized); Function class=R General function prediction only
  Homolog annotation: Query=1..159bp; Hit=1..159bp; Blast score=160; Percent Identity=53.0; E value=6e-40; Homolog= Z0248 COG3157
MANSIYLTINGSKQGLISAGCSTYDSIGNKYQEGHEDQIFVYSFDHDISRDQNVSHLPVIITKPIDKSSPLLGVTISDNEKIDCVLDFYRTSQSGGAEKFYSIKLRNAFIKHISVHYPNSLTHSDAQPYENITISYESITWQHHIAGTSGYSIHEDIVY

SEQ ID NO: 6697 - protein, 145 aa, Xenorhabdus bovienii
  Coding DNA sequence: Name=SeqID_589
MILNIKKEIKIIFSIILILFILIVGILSIFLILITANENYTEENYIKYLIFTTDEIKNSPRISNNYIIMYRSMDGNSPQINEITYINTKNKKKIEEYVKSIGYIFIEKNDFGEKWQDSNDHYRTIYITENPDEKKITLSVEYSQY

SEQ ID NO: 6698 - protein, 231 aa, Xenorhabdus bovienii
  Coding DNA sequence: Name=SeqID_590
  Homolog annotation: Query=1..212bp; Hit=1..213bp; Blast score=221; Percent Identity=53.0; E value=6e-57; Homolog= ref|NP_406556.1|
MSKRKDIIDGSLAGSKRSGLVYTELLGWIDLGHARGDDIRKILANMESGDKDNHPYYEVVYTQSMGAFSGRFATSKFTKWRVKKGLSLQDRYSIALTMMMKTAYLFESYQSRWFFNWYTDSGFSSEDFISDLLGFYRVVKPMNYFSIIKPVSKNDALRRWDYYGEIGKYKNRSFNPLIFPDPDKLPNNARPYYVELPGFMKAISPMKYFTTDKFEIINGDGTDFKFWFITI

SEQ ID NO: 6699 - protein, 47 aa, Xenorhabdus bovienii
  Coding DNA sequence: Name=SeqID_591
MIHRLCLYVYSFDYHLFKLLLYFLDNSARSGLLILLLAVSNGILKRF

SEQ ID NO: 6700 - protein, 39 aa, Xenorhabdus bovienii
  Coding DNA sequence: Name=SeqID_592
LSVFDNYSVNISISTIRRNRLVSFACNAVNIYRLGIFYC

SEQ ID NO: 6701 - protein, 49 aa, Xenorhabdus bovienii
  Coding DNA sequence: Name=SeqID_593
LHADGNKVSGLGIWSYELLISNLLLIFVTLVRPYGDTNRFSINTECSSV

SEQ ID NO: 6702 - protein, 45 aa, Xenorhabdus bovienii
  Coding DNA sequence: Name=SeqID_594
MTRYPVLIPCCHLHAIVCVKYPVKAISFDKKSLHCVTFWPSGVFF

SEQ ID NO: 6703 - protein, 417 aa, Xenorhabdus bovienii
  Coding DNA sequence: Name=SeqID_595
  Gene classification: Gene name=GlyA; Function=Glycine hydroxymethyltransferase; Function class=E Amino acid transport and metabolism
  Homolog annotation: Query=1..417bp; Hit=1..417bp; Blast score=751; Percent Identity=90.0; E value=0; Homolog= glyA COG0112
MLKREMNIANYDPELWQAMEQEVRRQEEHIELIASENYTSPRVMQAQGSQLTNKYAEGYPGKRYYGGCEYVDVVEQLAIDRAKELFGADYANVQPHSGSQANAAVYMALLKPGDTVLGMNLAHGGHLTHGSPVNFSGKLYNVVPYGIDESGKIDYNDIRSQAHKHQPKMIIGGFSAYSGVVDWAKMREIADEIGAYLFVDMAHVAGLIAAGVYPNPVPHAHIVTTTTHKTLAGPRGGLILAKGGDEELYKKLNSSVFPGGQGGPLMHVIAGKAVALKEAMEPEFKTYQQQVAKNAKAMVDVFLERGYKVVSGGTENHLFLLDLVDKDITGKDADAALGRANITVNKNSVPNDPRSPFVTSGIRIGTPAITRRGFKEAETCELAGWMCDVLDNINDEAIIENVKQKVLAICAKYPVYA

SEQ ID NO: 6704 - protein, 417 aa, Xenorhabdus bovienii
  Coding DNA sequence: Name=SeqID_596
  Gene classification: Gene name=ProP; Function=77 Permeases of the major facilitator superfamily; Function class=G Carbohydrate transport and metabolism
  Homolog annotation: Query=5..407bp; Hit=1..374bp; Blast score=401; Percent Identity=59.0; E value=1e-112; Homolog= hcaT COG0477
MGGLMVVPSTFWLGLSYFTYFFSFGIFLPFWAVWLKGEGIEPAMIGILLGVGLVARFLGSMFISPTVKDPSKLIIALRLLSLLALLFAIGFAFGSHWAWIFSVMIGFNLFFSPLVPLSDALAGTWQKQFTFDYGKVRVWGSIAFIISSSLTGILMSSNGINFSISNLELSISFDRINNWVGSNLFGHHPIILAFLIFSLSVMLLGMMLKPSIMPAGKIKAVNTHTVSFKELLSEKSVWQFLLCVTLLQGAHAGYYSFGSIYWENAGYSPATIGYLWSLGVVTEVIIFTFSKQLFRRWNARNLLLLSAICGILRWGLMGTSTELPVLIIIQLLHCGTFTVCHLAAMRFIGARKENEIIRLQAIYSGLAMGGGIAVMSVIAGFLYEYMQNGIYWVMALVAFPVLFLRPKAEARVYPLPK

SEQ ID NO: 6705 - protein, 256 aa, Xenorhabdus bovienii
  Coding DNA sequence: Name=SeqID_597
  Gene classification: Gene name=SuhB; Function=Archaeal fructose-1,6 -bisphosphatase and related enzymes of inositol monophosphatase family; Function class=G Carbohydrate transport and metabolism
  Homolog annotation: Query=1..256bp; Hit=12..267bp; Blast score=434; Percent Identity=82.0; E value=1e-122; Homolog= suhB COG0483
ARKAGNYIAKSYETPDAVEASQKGSNDFVTNVDREAERLIIDIIRKSYPKHTIITEESGEHLGEEDDFHWVIDPLDGTTNFIKRLPHFAVSIAVRIKGRTEVAVVYDPMRNELFSSARGQGAQLNGYRLRGTNARDLDGTILATGFPFKAKQHTTPYIKILGKLFDRCADFRRTGSAALDMAYVAAGRVDGFFEIGLKPWDFMGGELLVRESGCIVTDFVGGHNYINSGNIVAGSPRIVKDMLSEMREELSEALKR

SEQ ID NO: 6706 - protein, 236 aa, Xenorhabdus bovienii
  Coding DNA sequence: Name=SeqID_598
  Gene classification: Gene name=PykF; Function=Pyruvate kinase; Function class=G Carbohydrate transport and metabolism
  Homolog annotation: Query=1..236bp; Hit=234..470bp; Blast score=372; Percent Identity=84.0; E value=1e-103; Homolog= pykF COG0469
MEASDGIMVARGDLGVEIPVEEVIFAQKMMIEKCNAARKVVITATQMLDSMIKNPRPTRAEAGDVANAILDGTDAVMLSGESAKGKYPIEAVSIMATICERTDRVMSSRIEITKAQKLRVTEAVCRGAVEIAEKLEAPLIVVATYGGKSARSIRKYFPNAPILALTTNEITARQLLLVKGVSTQIVKEIASTDDFYRIGKEAALASGMANKGDAVVMISGALVPSGTTNTSSVHVL

SEQ ID NO: 6707 - protein, 78 aa, Xenorhabdus bovienii
  Coding DNA sequence: Name=SeqID_599
VVQQILLQSTFYKFAPRPIMNKLPRHWAVLLAMLITINKIQIWFISKWIFLYFYAISLSLSLSLSLSLSLSLSLSLSL

SEQ ID NO: 6708 - protein, 46 aa, Xenorhabdus bovienii
  Coding DNA sequence: Name=SeqID_600
VRKFIHRFQYKNTYCFYLFGFRANIHYMAIILINSLVASMLSLWLK

SEQ ID NO: 6709 - protein, 32 aa, Xenorhabdus bovienii
  Coding DNA sequence: Name=SeqID_601
LRLEQPANRVEARITAPNTTLVPFITIPSRLS

SEQ ID NO: 6710 - protein, 48 aa, Xenorhabdus bovienii
  Coding DNA sequence: Name=SeqID_602
VNSAEVISQLVNFRTQSVNLSGKLFNFSCDLNNPLTEWKPELLPQIQL

SEQ ID NO: 6711 - protein, 36 aa, Xenorhabdus bovienii
  Coding DNA sequence: Name=SeqID_603
MAYLTWYAIFVICCKIISCRNALGYQGAYSHELLPL

SEQ ID NO: 6712 - protein, 36 aa, Xenorhabdus bovienii
  Coding DNA sequence: Name=SeqID_604
MAYQVRYAIFIFADPFVHLKNRLQIPPTPSQDNGSA

SEQ ID NO: 6713 - protein, 344 aa, Xenorhabdus bovienii
  Coding DNA sequence: Name=SeqID_605
  Gene classification: Gene name=ErfK; Function=Uncharacterized BCR; Function class=S Function unknown
  Homolog annotation: Query=3..305bp; Hit=9..308bp; Blast score=330; Percent Identity=58.0; E value=2e-90; Homolog= ycfS COG1376
MKRFLTFIGMSLIGMLSLSGAINIAHAMEYPLLPTNSRLIGENAIYVVSDDGLSLEAIAAKYQIGLLAMLEANPGVDPYLPKPGTKLIIPSQMLLPDTPRQGIIINLAEFRLYYFPKGKNYVVVYPIGIGQLERDTPTMTTSVSQLIKNPTWTPTTNIRKDYASRGIILPTVVPAGADNPMGDFALRLAAGRGEYLIHGTNASFGIGMRVSSGCIRLRPDDIEDLFYSVPRGTRVQVINEPIKYTVEPTGKRYVEIHQPLSDKQTDDPQTRPIQRTEGLVKFINNRETDAVLVDQEIIRRSGIPVLVNTGIVLSNQEEQEVSRPIEIREEATYGVNPVELPPLN

SEQ ID NO: 6714 - protein, 33 aa, Xenorhabdus bovienii
  Coding DNA sequence: Name=SeqID_606
LSDISAYSVHGRMRIFILFGFLLDFRKGDRRVS

SEQ ID NO: 6715 - protein, 137 aa, Xenorhabdus bovienii
  Coding DNA sequence: Name=SeqID_607
  Gene classification: Gene name=PaaI; Function=Uncharacterized protein, possibly involved in aromatic compounds catabolism; Function class=Q Secondary metabolites biosynthesis, transport and catabolism
  Homolog annotation: Query=1..136bp; Hit=1..136bp; Blast score=190; Percent Identity=64.0; E value=4e-49; Homolog= ydiI COG2050
VIWKRTTDVNALNQFNSKCMLEHVGIEITQIGDDFIEGTMPVDQRTKQPFGLLHGGASVVLAESLGSLAGYLCLEGEQKVVGVEINANHIKAVSKGVVKGVCKPVHLGRSHQVWQIDIYNERQQLCCTSRLTTAVLS

SEQ ID NO: 6716 - protein, 1023 aa, Xenorhabdus bovienii
  Coding DNA sequence: Name=SeqID_608
  Gene classification: Gene name=GlcD; Function=FAD/FMN-containing dehydrogenases; Function class=C Energy production and conversion
  Homolog annotation: Query=1..542bp; Hit=1..542bp; Blast score=917; Percent Identity=78.0; E value=0; Homolog= ydiJ_1 COG0277
MIPRIPQAPHVSELAQEYLTALKEVGFTGDTASSYADRLTMATDNSIYQLLPQAVIFPRSSADVALLARVAGEERFYSLTFTPRGGGTGTNGQSLNNGIVVDMSRYMNRILEINPEQGWVKVEAGVIKDQLNQYLKPFGYFFSPELSTSNRATLGGMINTDASGQGSLVYGKTSDHVLGVRAVLLGGEMFDTRPMSTLFAESIAQEESVIGRIYKTVLERCRERRKLIVEKFPKLNRFLTGYDLRHVYSDDMQTFDLTRILTGSEGTLAFITEATLDITPLPKVRRLVNVKYDSFDSALRNAPFMVEAKALSVETVDSKVLNLAREDIIWHSVKELITDVADKDMQGLNIVEFSGNDEQQIDQQVYDLCQRLDELMGENQTGIIGYQICHHLVDIERIYAMRKKSVGLLGNSKGAAKPIPFVEDTCVPPQHLADYITEFRQLLDSHQLNYGMFGHVDAGVLHVRPALDMCDPQQEILMKQISDEIVRLTAKYGGLLWGEHGKGFRAEYSPDFFGEILYDELRRIKAAFDPLNRLNPGKICSPIDIDAPMMKVDAAKRGTYDRTIPVNVRTAFRGAMECNGNGLCFNFDVKSPMCPSMKVSQHRIHSPKGRATLVREWLRLLTEQGMDPKLLEQGLDQARPSLRGLIDKTLYSWQAWRGEYDFSHEVKEAMSGCLACKACSTQCPIKIDVPSFRSRFLALYHSRYLRPLRDHIVANVENNTPLMAKVPQVFNFFLKRPWVQKISQHTIGMVDLPLLSYPTLQQQLSDHYAARTTLEQLETLSQSQRKQHVLIVQDPFTSYHDAKVVADFVRLTEKLGYQPVLLPFSPNGKAQHVKGFLTKFAKTAEKTANFLNRVDRLNIPMVGVDPALVLCYRDEYKDILGERRGNFNVQLVHEWLMSILPETPSQEKRDGSTSSYDWYLLGHCTEVTALPNSGKQWTDIFRHFGCQLNNVSVGCCGMAGTYGHEKKNIDNSIGIYKLSWAPALDNLVLERCLSTGYSCRSQVKRIEGQVVKHPLQALLEIIP

SEQ ID NO: 6717 - protein, 369 aa, Xenorhabdus bovienii
  Coding DNA sequence: Name=SeqID_609
  Gene classification: Gene name=PerM; Function=Predicted permease; Function class=R General function prediction only
  Homolog annotation: Query=8..355bp; Hit=8..354bp; Blast score=362; Percent Identity=59.0; E value=1e-100; Homolog= Z2716 COG0628
MEKSQSRQDLPKLLFVLFFILLLIATCFWVLSPFVLGFIWSGMVVIATWPLLEKLQQHLWGKRWIAVSIMTLLLVLLFVIPIALLVSSLLENSTPLIEWAKSPSTFQLPQLEWLSRIPVIGEDLYIKWQDMIADGSNILLTKIPPYIGKTATWFFTQAANAGRFLFHLAIMVLFSVLLYWKGEQVMLSIRHFAIRLADQRGDAVVLLAAQSIRAVALGVVVTALVQAIAGGIGLAIAGIPYAMILTVLMFICCVAQLGPLLVLVPSIAWLYWTGETTWGTILVIWSLVLTTMDGVLRPFLIRLGADLPMVLILTGVIGGILSLGLIGLFIGPVVLAVSYRLLLAWMNEVPKPENKTEDTEKYFKKDHIE

SEQ ID NO: 6718 - protein, 58 aa, Xenorhabdus bovienii
  Coding DNA sequence: Name=SeqID_610
MSLFIKNPLNKWELEKKNEGYNFFATNYMVFLLTFGYEFIFVIKLGVYIHQYDNCAKK

SEQ ID NO: 6719 - protein, 62 aa, Xenorhabdus bovienii
  Coding DNA sequence: Name=SeqID_611
LRDNSKNSKKKSLSWADRQRLHTAIFITLLAPAFGVYRLEQQFVGNVCFDEKNTNLINEFIH

SEQ ID NO: 6720 - protein, 48 aa, Xenorhabdus bovienii
  Coding DNA sequence: Name=SeqID_612
LLCVVFACQPMIGFFFWNFYCYPSIIHPCQKRLCYTKQKSLQIFQQAF

SEQ ID NO: 6721 - protein, 792 aa, Xenorhabdus bovienii
  Coding DNA sequence: Name=SeqID_613
  Gene classification: Gene name=PpsA; Function=Phosphoenolpyruvate synthase/pyruvate phosphate dikinase; Function class=G Carbohydrate transport and metabolism
  Homolog annotation: Query=1..790bp; Hit=1..789bp; Blast score=1354; Percent Identity=82.0; E value=0; Homolog= ppsA COG0574
MSNNGLTPCNVLWYNQLGMNDVNRVGGKNASLGEMITNLAELGVSVPNGFATTAQAFNDFLEQSGVNQRIYQLLDETNVDDVNQLAKAGAQIRRWVIDTPFTVQLENDIQDAYLQLSEGEPDASFAVRSSATAEDMPDASFAGQQETFLNVQGIDAVMVAIKHVFASLFNDRAISYRVHQGYDHRGVALSAGVQRMVRSDLASSGVMFTIDTESGFDQVVFITSAYGLGEMVVQGAVNPDEFYVHKPTLQNNRPAIVRRNLGSKRIRMVYADSKEHGKQVRTEDLPDVLRNRFSLADDEVEALARQALLIEKHYGRPMDIEWAKDGNNGKLYIVQARPETVRSNQQVMERYQLNAQGSVLVEGRAIGHRIGAGTVKVIHNLSEMDRIQAGDVLVTDMTDPDWEPIMKKAAAIVTNRGGRTCHAAIIARELGIPAVVGCGDATERLKEGQEVTISCAEGDTGFVYQNKLDFSIQSSQVDELPKLDVKIMMNVGNPDRAFDFACLPNEGVGLARLEFIINRMIGVHPRALLEFSQQTPELQEQINALMVGYDNPVEFYIGRLTEGVATLAAAFWPKRVIVRLSDFKSNEYANLVGGDRYEPHEENPMLGFRGAGRYVSDSFRACFALECEAIKRVRNVMGLTNVEVMIPFVRTVTQAEAVVAELAVQGLKRGENGLKVIMMCEIPSNALLAEQFLEHFDGFSIGSNDMTQLALGLDRDSGVVSELFDERNDAVKQLLSMAIQAAKRQGKYVGICGQGPSDHEDFAEWLVKEGIDSLSLNPDTVVKTWISLAENN

SEQ ID NO: 6722 - protein, 41 aa, Xenorhabdus bovienii
  Coding DNA sequence: Name=SeqID_614
MPNWLYQSTLHGVRPLLDIETILFTFGSTNRKIKAVLYSVK

SEQ ID NO: 6723 - protein, 33 aa, Xenorhabdus bovienii
  Coding DNA sequence: Name=SeqID_615
MLTIVLVCDKNDSANNSTNPIIHRQPNNKRKIQ

SEQ ID NO: 6724 - protein, 287 aa, Xenorhabdus bovienii
  Coding DNA sequence: Name=SeqID_616
  Gene classification: Function=Uncharacterized BCR; Function class=S Function unknown
  Homolog annotation: Query=12..287bp; Hit=2..277bp; Blast score=429; Percent Identity=74.0; E value=1e-120; Homolog= ydiA COG1806
MTENHISQTQENETLERSVFFISDGTAITAEVLGHAVLSQFPLTVTSYTLPFVNSKMRAEEIKTQINAIYLETQLKPLVFYSIISDEVKSIITSSDGFCQDIVQTLVAPLQQEIGLEPKPELHRTHGLSKKNLGQYDARIAAIDYALAHDDGVSLRNLEQAQVIILGVSRCGKTPTSLYLAMQFGIQAANYPFTADDMDNLQLPAALKPFQHKLFGLTISPERLAAIREERRENSRYASLRQCRLELAEVEALFRKNKINYLNTTNYSVEEISTKIIDSMGLKRRMF

SEQ ID NO: 6725 - protein, 40 aa, Xenorhabdus bovienii
  Coding DNA sequence: Name=SeqID_617
MTFARESIVQRYCEKSTVENAGVSRSEHAAFQSHTVNNFG

SEQ ID NO: 6726 - protein, 348 aa, Xenorhabdus bovienii
  Coding DNA sequence: Name=SeqID_618
  Gene classification: Gene name=AroG; Function=3-Deoxy-D-arabino -heptulosonate 7-phosphate (DAHP) synthase; Function class=E Amino acid transport and metabolism
  Homolog annotation: Query=1..347bp; Hit=1..347bp; Blast score=544; Percent Identity=74.0; E value=1e-155; Homolog= ZaroH COG0722
MHKTDELRTRPIGRLITPKALAEQYPISEKILQNVTLSRKRIESILTGNDPRLLVIIGPCSIHDVDAALDYAARLQVLREKYQHSLEIVMRTYFEKPRTVIGWKGLISDPLLDGSCQVNKGISLARKLLNDINELGMPTATEFLDMVTGQYIADLISWGAIGARTTESQIHREMASALSCPVGFKNGTDGNTHIAIDAIRAARAKHMFLSPDKDGQMTIYQTGGNPHGHIIMRGGKKPNYKAEDIAAACQKLHEYQLTERLIVDCSHGNCQKIHRRQLDIAKDIGQQIQSGSTSIAGVMAESFLVEGTQKVVHGEPLTYGQSITDPCLGWQDTEQFINTLAEAVKNRT

SEQ ID NO: 6727 - protein, 49 aa, Xenorhabdus bovienii
  Coding DNA sequence: Name=SeqID_619
LTMEKLAYCQCYHANLLQQQILLELFSDPVKNDCTGVPTVRNYWDNHVP

SEQ ID NO: 6728 - protein, 37 aa, Xenorhabdus bovienii
  Coding DNA sequence: Name=SeqID_620
MPLRQTKTRSFIRTNKIPANSPDQYRGDGLFLCTKHR

SEQ ID NO: 6729 - protein, 703 aa, Xenorhabdus bovienii
  Coding DNA sequence: Name=SeqID_621
  Gene classification: Gene name=CirA; Function=Outer membrane receptor proteins, mostly Fe transport; Function class=P Inorganic ion transport and metabolism
  Homolog annotation: Query=36..703bp; Hit=11..660bp; Blast score=768; Percent Identity=58.0; E value=0; Homolog= ZchuA COG1629
MGYFCAQNTVKLWRLTCMTSIKLPNLKLSSLSVVILTGLSSAHATTIPAEENTSSKDTLTVYATGNERDSFEAPMMVTVIKGNSANNRVAGNAHDLLRNLPGINVSGSGRTNGQDISMRGYSKKGVLTLVDGIRQGTDTGHLNGLFLDPSLIKQVEVVRGPSALLYGSGALGGVIAYQTVDAADLLQEGKNTGFRVFSRAATGDHSLGFGGAAFGKTEQLDGLFAFSTRDVGNIRYGNGLTGHNDETIGNMLAKGKWNINDSQSLSSELRYYRNQSHEPKNPQAITDNAKNDNPRADRTTTQRDAQLTYRLNPAEYNWLNTKADIYYSDVTINAKTKEKGFEGRKQETYGVKLENRSHLGVNTFSVHQFTYGGEAYKQKQKPNGNTESFPDADIRFASGWVQDEITLRDLPVSLIVGTRYDNYNASNAKYDDISANKWSSKGAVSITPTPWSMLFTSYSQAFRAPTMGEMYNDSKHFHMPPMRGKPGFTNYWKPNPNLRPESNETLESGFGLRFDDLFSSNDELKFKASYFDTQAKDYITSIVTMPDMRSTTSINIPKTKIWGWDASMSYESNWFSWNLAYNRTTGKNEETGESIADLSPDTLTSMLDIPLSNTGFSLGWIGKFTQHTQFRGVNGDKNERGQKLSQYAGYGVNDFYVSYHGDGKLKGLTTSVVLGNAFDKEYYSPLGAPQDGRNGKLFISYQW

SEQ ID NO: 6730 - protein, 357 aa, Xenorhabdus bovienii
  Coding DNA sequence: Name=SeqID_622
  Gene classification: Function=Putative heme degradation protein; Function class=P Inorganic ion transport and metabolism
  Homolog annotation: Query=6..345bp; Hit=4..335bp; Blast score=381; Percent Identity=57.0; E value=1e-106; Homolog= ZchuS COG3720
VNQSLYERYLQAKADNKAKYARDLAAYLNVSEGELLHSRVGIDAKRLSVDASALLQELVTVGETKAITRNDFAVHEQVGRYENTQFSPHVGLILNPRELDLRLFFDHWASVFSLVEPAKNGLRHSIQFFDRQGDALHKVYTTKDTDMAAWEALIEKYQTDENPALEIQPEKASEHKEVTEQLKAQLDEEWRAMTNVHQFFMMMSRHNLNRQQIFNAVGNDLAYRVENSSLTKIVETAHNDQNEIMIFVGNRGCIQIFTGKLERLMPYQEENSPQKWVNIFNRDFTLHLIESAIVESWVTRKPTTDGFVTSLELFDAEGNQIAQLYGQRTEGTPEQAHWRKQIAALPKLESEKETCIV

SEQ ID NO: 6731 - protein, 272 aa, Xenorhabdus bovienii
  Coding DNA sequence: Name=SeqID_623
  Gene classification: Gene name=FecB; Function=ABC-type cobalamin/Fe3+- siderophores transport systems, periplasmic components; Function class=P Inorganic ion transport and metabolism
  Homolog annotation: Query=21..257bp; Hit=34..273bp; Blast score=158; Percent Identity=37.0; E value=5e-39; Homolog= mll1151 COG0614
MKKWLLTFMLATSGNAFSAERIVTIGGDVSEIVFALGEGQHVVARDSTSQNPKALLSLPDVGYMRMLNSEGILSMRPSLVIASESAQPSLALKQVEDSSVKVIKVTSEASLEAVPEKILTVAKAVNQEKRGETLTSQYRQQLAELNTSNIPTKVIFIMSHGGIMPMAAGQQTAADQIIRSIGAQNAMQGFKGYRPLSQEGVIASQPDLLLVSTEGLKTLGGMDKLWQLPGLNFTPAGKKKQVVVVDEMGLLGFGIQTPAVMKQVREAAEKVQ

SEQ ID NO: 6732 - protein, 333 aa, Xenorhabdus bovienii
  Coding DNA sequence: Name=SeqID_624
  Gene classification: Gene name=BtuC; Function=ABC-type cobalamin/Fe3+- siderophores transport systems, permease components; Function class=P Inorganic ion transport and metabolism
  Homolog annotation: Query=12..327bp; Hit=13..325bp; Blast score=307; Percent Identity=59.0; E value=1e-83; Homolog= ZchuU COG0609
MSRSRFPSFGLMALGLLLFLLAISSANMGALPLSFKTLWESSLDDPQWQIWLNIRLPRILLAILVGGALAVSGAVMQGLFRNPLADPGLLGISSGAALTVAMVIVLPFTLPASIALYGHIIAAFVGSLLVSFLIFSLNKYNHGNLSKLLLAGIAINALCMSFIGVLSYVSNDQQLRQFSIWMMGSLSQIEWPTLIIAASLIIPVCILAFSQSRKLNLLQLGDEEAHYLGINVQRTKYQLLLLSALLIGCAVALSGVIGFIGLVIPHLVRLRFGGDHTWLLPISVLGGACLLLSADTLARTLVSPAEIPVGLITGLIGAPYFLWLILKPSGGRL

SEQ ID NO: 6733 - protein, 264 aa, Xenorhabdus bovienii
  Coding DNA sequence: Name=SeqID_625
  Gene classification: Gene name=FepC; Function=ABC-type cobalamin/Fe3+- siderophores transport systems, ATPase components; Function class=P Inorganic ion transport and metabolism
  Homolog annotation: Query=9..262bp; Hit=1..254bp; Blast score=272; Percent Identity=52.0; E value=3e-73; Homolog= Z4919 COG1120
MESVMSENLLEARNLNYFIGHRQIINDISLSIQKGEIVAIIGPNGAGKSTLLRLLTGYIPSNSGECLLKGVPISRWPTQQLARIRAVMRQYSSLSFPFSVEEIIAMGRVPHENTHRKTAIDEAIMLTECEELRHRNYQQLSGGEQQRVQLARVLAQLWHPEPTESCLFLDEPTSALDLYHQQHTLRLVHRLTRQRPLAVCCVLHDLNLAALYADKIILLHKGKLVASGSPQDVLRDDILKQWYRADLGVTQHPETYQPQVYLRQ

SEQ ID NO: 6734 - protein, 165 aa, Xenorhabdus bovienii
  Coding DNA sequence: Name=SeqID_626
  Homolog annotation: Query=35..150bp; Hit=48..176bp; Blast score=90; Percent Identity=40.0; E value=1e-17; Homolog= ref|NP_930239.1|
MKIINILFCAALYCLLISPVRADEKMVNAEKQQILSADYNMEFKNYSSSVNDIVIAKRSTDCMYDSGADQIRIEPGNQQSTHLQDNDNLFSACTLRPKWVEWAVSSGSMSCALRFERGFDGGWYTVIKGCPDIVKSATCGDADCNQNNVYGSSSYMDISVELLIQ

SEQ ID NO: 6735 - protein, 36 aa, Xenorhabdus bovienii
  Coding DNA sequence: Name=SeqID_627
MIVTNSIRTIVILSALDYKELFLLLYIKDKQVSKRF

SEQ ID NO: 6736 - protein, 81 aa, Xenorhabdus bovienii
  Coding DNA sequence: Name=SeqID_628
MVRIRCSFVFKHSDIIAALLIINEAVMQSSLLKRAMVDLSIASSKSLTVRLDHLLLFLVRVCLVVVRRLNIYIVIRHGLRT

SEQ ID NO: 6737 - protein, 125 aa, Xenorhabdus bovienii
  Coding DNA sequence: Name=SeqID_629
  Gene classification: Gene name=AraC; Function=AraC-type DNA-binding domain-containing proteins; Function class=K Transcription
  Homolog annotation: Query=10..121bp; Hit=6..112bp; Blast score=112; Percent Identity=50.0; E value=5e-26; Homolog= rob COG2207
MWEVNMLESVINDIVRWLESQLQRTEGIKIDAIAHKSGYSKWHLQRIFKELKGCTLGQYVRRRRLHEAAKSLHEDSLPILDIALQYGFSSQATFTRIFKKHFNTTPAKFRASGQLPEFKTFLHCE

SEQ ID NO: 6738 - protein, 33 aa, Xenorhabdus bovienii
  Coding DNA sequence: Name=SeqID_630
MVNFPIVDHFFAFMPCRAIHSFQFVNQPVIQLL

SEQ ID NO: 6739 - protein, 338 aa, Xenorhabdus bovienii
  Coding DNA sequence: Name=SeqID_631
  Gene classification: Gene name=LplA; Function=Lipoate-protein ligase A; Function class=H Coenzyme metabolism
  Homolog annotation: Query=1..338bp; Hit=1..338bp; Blast score=501; Percent Identity=68.0; E value=1e-142; Homolog= lplA COG0095
MSTLRLLLSDSHDPWFNLAVEECIFRQMSPDQRVLFLWRNANAVVVGRAQNPWKECNTRRMEQDGIKLARRSSGGGAVFHDLGNTCFTFMAGKPEYNKTVSTQIILEGLKKAGIHAMVSGRNDLVLSSPEGERKISGSAYRETKDRGFHHGTLLINADLNRLADYLNPDPKKLQAKGITSVRSRVTNLSELLPDITYEKVCGGIIEAFFEYFGEVAKSELISPQALPDLPGFTDVFAKQSSWEWNFGQAPTFSHTLDTRFCWGGIELHVDIEHGTIGRCQIFTDSLEPAPFELLAEKLVDVLYQPQAVGQVIQQIREQYSLLDKELQQLYHWLVNELK

SEQ ID NO: 6740 - protein, 44 aa, Xenorhabdus bovienii
  Coding DNA sequence: Name=SeqID_632
LSPAKNRALRYHKALPDLMAKDGVTSCGLAKKHVANTHYQGKSV

SEQ ID NO: 6741 - protein, 154 aa, Xenorhabdus bovienii
  Coding DNA sequence: Name=SeqID_633
  Gene classification: Gene name=Spr; Function=Cell wall-associated hydrolases (invasion-associated proteins); Function class=M Cell envelope biogenesis, outer membrane
  Homolog annotation: Query=1..154bp; Hit=5..154bp; Blast score=213; Percent Identity=66.0; E value=9e-56; Homolog= ZnlpC COG0791
LFLLFNLFLIGCTNPVSKSNLPPLRTALSDPIMVIAQLKEQLNQWHGTPYRYGGIDRRGVDCSGFVYRTFHDRFNIYLPRTTSEQTKLGTQISKEDLMPGDLVFFKTGSGESGLHVGIYDINDEFIHASTSKGVIRSSLDNVYWRRVFWQARRM

SEQ ID NO: 6742 - protein, 370 aa, Xenorhabdus bovienii
  Coding DNA sequence: Name=SeqID_634
  Gene classification: Gene name=XerC; Function=Integrase; Function class=L DNA replication, recombination and repair
  Homolog annotation: Query=29..343bp; Hit=17..318bp; Blast score=76; Percent Identity=26.0; E value=4e-14; Homolog= HI1572 COG0582
MAYYSIEKRPRADGTVRYRCTVGVKSGGKYIYRENRTFGKQSHAKTWGAMRVAELEQNGVPTQNDTKELTVGELLYKYINDPNLGMKAGRTKKYALNILLNSDLSKLILTELSISHIIEHCKQRHSTGITPATINQDVIYLSSVLKSARPVYDIDYTSNPASEARSLLTQMGLIGKGQRRSRRPEREELERLIEALRKRSGHWKSKIPYEDILNFSILTCMRIGEVCKIRWDDIDEKQRAVLVRDRKDPRKKVGNHMFVPLLGEAWNIVQRQPKSDSGLIFPYNTLSISQGFHRACIKLGIEDLRYHDLRREGASRLFEAGFSIEEVAQVTGHRSLNVLWQVYTELYPQSLHDKFNRLMQQKKDDSTPTT

SEQ ID NO: 6743 - protein, 50 aa, Xenorhabdus bovienii
  Coding DNA sequence: Name=SeqID_635
LIELRLTKQRQPNLPNTVISSTNLPTGLLITLMGYHTLKTNQIWISMFLL

SEQ ID NO: 6744 - protein, 35 aa, Xenorhabdus bovienii
  Coding DNA sequence: Name=SeqID_636
LRKSQYLHKQKVWWKSPYPRWDITPCGNRGDFHPS

SEQ ID NO: 6745 - protein, 42 aa, Xenorhabdus bovienii
  Coding DNA sequence: Name=SeqID_637
LTQPLGKSQWLLYVLDKRNKFIVFQRITWTQGAGQNELTPCF

SEQ ID NO: 6746 - protein, 33 aa, Xenorhabdus bovienii
  Coding DNA sequence: Name=SeqID_638
LHTNIIVAQIISRLQICSLIRYQWVIAKMGIPT

SEQ ID NO: 6747 - protein, 36 aa, Xenorhabdus bovienii
  Coding DNA sequence: Name=SeqID_639
VGFLTFNFCMVPARFRFKRRCEINYKDSFSLRSYHS

SEQ ID NO: 6748 - protein, 179 aa, Xenorhabdus bovienii
  Coding DNA sequence: Name=SeqID_640
MRLIKVYSDSYVFEEPHQKVQGKNRLTIACHGFGHIDGISQVVMDDQYRNAVQLALSIKTWTDVDKLHNIRLVSCETANPAPNEEYLRITPDLRRYPPWITSFGSQLSLFLPDILVKAYMGTIDSDCSDSFTWNFYTKHGHDDTNTMLSKYFKLYKGGLDHYHSVVFLNGRFHKQHYIE

SEQ ID NO: 6749 - protein, 66 aa, Xenorhabdus bovienii
  Coding DNA sequence: Name=SeqID_641
MQHNIQLHSESGLRLSWCEQYSTRNFLRVHIHLILPLTPVSHPTPPPQHPPTIHPTTRYSPLLAIY

SEQ ID NO: 6750 - protein, 32 aa, Xenorhabdus bovienii
  Coding DNA sequence: Name=SeqID_642
MSEKKKLSWLLFWFLSPVNTPNDHIQPSINSQ

SEQ ID NO: 6751 - protein, 76 aa, Xenorhabdus bovienii
  Coding DNA sequence: Name=SeqID_643
MSELVSTTVQNDKAVADAKNKQKYLLSEARVESKKQLDILEQQMRLKQLQWDMYCVKLLELDFSTAPDINWPKKPE

SEQ ID NO: 6752 - protein, 147 aa, Xenorhabdus bovienii
  Coding DNA sequence: Name=SeqID_644
  Homolog annotation: Query=3..146bp; Hit=4..142bp; Blast score=120; Percent Identity=45.0; E value=4e-27; Homolog= ref|NP_930553.1|
MSKKYIFSVNNEKYDPPCPGFWPVAEREHYPNTFPESGVEVDEAVHELFSGSWPSGKMLGCDETGYPVWVDTPPPPKEVLIERAEYQRRELLSAASEKIAPLQDAVELEMATDAEKSALTAWRKYRVLLNRVDCTTAPDVKWPEPPK

SEQ ID NO: 6753 - protein, 375 aa, Xenorhabdus bovienii
  Coding DNA sequence: Name=SeqID_645
  Homolog annotation: Query=47..142bp; Hit=76..173bp; Blast score=88; Percent Identity=50.0; E value=2e-16; Homolog= ref|NP_929317.1|
MQKIGDITNTADGNGEYTNGNVAAGVAPTILDAAWFNTIQREIINVISKAGIKLNKNNDAQLSEAIFQLISNGKIVLTDNLGNSSGLAASQKLINQVNENANTRLEKNENGADIPNKPKFVDNLGLTKTVERANNALDKNSGGELLAPVKFSGFRTNTGSIVISTQSDGNGVGDGQTQLGYNVGNDSAPVFNHYLRGQGITNIDTLGGCDIREGLRVGKQVQPGDFGNFDSRYLKLSQNGSDIPNKSAFRTALELGDAALRTVGNEYTNIPSMGYFLASLGYNGWQQIPSQDGSGDLIIQWGGFGGYKYGEGATVKFLRPFPHRCVFVVPVAIVPWETKTTTIEPVYLAEKSATYATFRKGGTETLDGLYIALGY

SEQ ID NO: 6754 - protein, 198 aa, Xenorhabdus bovienii
  Coding DNA sequence: Name=SeqID_646
  Gene classification: Function=Uncharacterized BCR; Function class=S Function unknown
  Homolog annotation: Query=8..196bp; Hit=7..192bp; Blast score=111; Percent Identity=32.0; E value=4e-25; Homolog= ymfQ COG3778
MKQYSVSEYTSALNGLLPTGMAWTRNPNSVMSATIRAIAHSYHRSDQDAHSLLEGAFPATATIMLSEWEKSLGLPDDCAIGEIDSISLRQKSVVSKLLRTGGQSKSYFIGLAAELGFKITITEFRQARVGMSACGDALNGEDWPFVWRINAPTTTINYAIAGGSYCGDPLRSWGNQKLECQFNRLSPSHTILQFGYGQ

SEQ ID NO: 6755 - protein, 392 aa, Xenorhabdus bovienii
  Coding DNA sequence: Name=SeqID_647
  Gene classification: Gene name=XkdT; Function=Uncharacterized homolog of phage Mu protein gp47; Function class=S Function unknown
  Homolog annotation: Query=15..391bp; Hit=1..354bp; Blast score=110; Percent Identity=26.0; E value=3e-24; Homolog= HI1520 COG3299
MMRTFGFSGYGSGTMPFKRKTLTELREQNRSYLQSELQETGPLLRFSNMGVLADMDAGMAHLHYGYLDYIAKQTTPFTATDEWLSGWAALKKIFQKPAFPARCEKYQFTGIEGQIISAGTILNRGDGYQYKTVDETRIHHGRGHAVLIAILPDVTDDNSGGGAAGNAPSGTVLTLDQSIAGVDVEGTAISPITGGANIESETDFRSRMLLAYQGSPQGGSDDDYKQWALAVPGVTRAWVKPRAAGAGTVGVYIMCDNNGREGFPIGTDGVSSHEPYAVHASGDQLRVADYIYPLRPVTALIWVLSPIKRTIDFTLNGLAHAGTEITHRITMAIDNVLFESGNPDGTGKILVSDLQYAIADVPGTAGFVITSPTKNIELSVGHLPVRGEVKYT

SEQ ID NO: 6756 - protein, 148 aa, Xenorhabdus bovienii
  Coding DNA sequence: Name=SeqID_648
  Homolog annotation: Query=2..143bp; Hit=3..150bp; Blast score=145; Percent Identity=53.0; E value=1e-34; Homolog= ref|NP_404848.1|
MSDIASWWDVKSIHADWIVGRGDLVTGDDLQTAMIISLFTDRQARSDDDIDGVDRRGWWGDSGADYPIGSRLWLLHRQKLTPAVALAAEDYAREALQWMLDDGVAESIDIRTQIVWPNRLNMIIRYQRPGRDDEDVRFFWVWERDNAV

SEQ ID NO: 6757 - protein, 205 aa, Xenorhabdus bovienii
  Coding DNA sequence: Name=SeqID_649
  Homolog annotation: Query=14..205bp; Hit=7..198bp; Blast score=222; Percent Identity=57.0; E value=3e-57; Homolog= ref|NP_404847.1|
MNSMTRLWRCVIMEVKNLYRRAMMMLGLGRVTTCNDKGAIQQVQYQTAMEVRDKTNRMAEFGFSSGLPTGTDVVLAFLGGDRSNAVVIGSNHQQYRHQGLNPGEVVIYNQWGLHILLTESGITVEAQGKSVTVNNASTATINASTKVLLNTPVLEVSGNIIDNCNSNKTTLQQLRDSYNNHTHPVPGVESGGSTVTSQTTGATVK

SEQ ID NO: 6758 - protein, 363 aa, Xenorhabdus bovienii
  Coding DNA sequence: Name=SeqID_650
  Homolog annotation: Query=5..350bp; Hit=2..349bp; Blast score=380; Percent Identity=53.0; E value=1e-104; Homolog= ref|NP_404846.1|
MKKNNDDLSLVIGGRIIHGWDSIRVTRGIERLPSDFELILMDYYPGSKEKQLVEAGQPCQVLLGDEPVITGYIDIWNSSINKSTHQIRVTGRSKCQDLVDCSAKWPQNVISSATALQIAQKLAQWYGIEVTSDVTDMQPVPQFTLNWGESSQEVIDRITRWSALLYYDTPDGNLFFTRVGDKVAASGVEQGKNIELTDYQSSMNERFSEYSGLSMNVSGLSELSDGQGYNVVTIATATDPEAEKMRYRNYVTIIESTLHSHQRHQEAIDWEMNRRYGRAKVLKVLVDSWRDISGALWQPNTLIPIHLPVFGLESEQWLLSEVSYVRNSDDGTRAELTLMPPAAFTVQPYEFYDTIMEMRNYGS

SEQ ID NO: 6759 - protein, 484 aa, Xenorhabdus bovienii
  Coding DNA sequence: Name=SeqID_651
  Homolog annotation: Query=17..482bp; Hit=1..466bp; Blast score=406; Percent Identity=43.0; E value=1e-112; Homolog= ref|NP_404845.1|
MPLSRGFFASKFKVVDMAFIKDAISSLLGGDSSSWKWSEHLRPASFRGVPFAVVSGESVFGRRQAVHEYPYRDTAWIEDLGRATRKITLRGFIVQDSLVYNAPDVITQRKNLVAACETGSTGTLIHPTLGELTVSVTESGLRMTENAESCRVFEFTLTVIESGLQVFAVTNSTKSATEIKQNWFRAYTTTLAKYIAVVRGEIRSVVQGMKIIKATANQWIGMVTRSVDEVTNLSDMLKTTLGSERYGRYQRGKIGGTVSGATGIRSRDPQYRDDAEIVKKTTVAVVMGRKSISESIDKLTHSLTVEEFSQAAQGVVDSIISSAGSTDEKIAIFENLAAFQNTRYQQSSTDRHVTEMTVLLLVVLSAGAMAQVASEFTPANNHEANDLQRRVCHALDTALVMSGDLGMDDIYQSLMSLRYEFVTSAELKGAESGRLAQFSLPAILPSLNVANRIYQDSGRSDELIQATNPRHPAFMPVKFKALRK

SEQ ID NO: 6760 - protein, 56 aa, Xenorhabdus bovienii
  Coding DNA sequence: Name=SeqID_652
MKKPCDRAIFVWLSLQQDTSLEFYGVSYAHGIKPECYRLTSRLYSPPLNSQNLQHW

SEQ ID NO: 6761 - protein, 66 aa, Xenorhabdus bovienii
  Coding DNA sequence: Name=SeqID_653
MHRFGRFVLLVGIVWLIAALNMGTTVSSYGETVHNIGLVSSKQNHVIIGCFIILYGLLVTLFYTEK

SEQ ID NO: 6762 - protein, 642 aa, Xenorhabdus bovienii
  Coding DNA sequence: Name=SeqID_654
  Homolog annotation: Query=1..283bp; Hit=1..265bp; Blast score=97; Percent Identity=28.0; E value=6e-19; Homolog= ref|NP_404844.1|
MANAFDFELHADENATKALAEIEARLKGLQPVLDSTREGLRFGGSETLDNVGSVSNKLRDMSQFAKDNVQHIGAIIPPLKNVGELTAKYGGLAKKYGGIIGGVGAIGYGATKLYQGMRDAGKDAITRSTRAKNSGMSVADFTRMSGAMQISTGASMDATDQSVESLYPVLQNALTNRNSAIKAELNKIGVEIAKNKNGNADVYQTMKNLAAEWNNIVPETQNTLREHLGLDGNTLSFLRDGGQKKEGKLKIEELLNKSDKSGLTIQDKDNERIEKVGERINEIEARAAGAFRNFKNDMLLTGFGQWDKARETAKDKNPVHGFFAGAAAFANPFGFNNGGDQLALLKKARKDKEFRKTLTFKENTDLLLTYASEDLIKKLNAYYFPNEKPSHVGEKVPDFPIVEEPNYPNPLKSTGKKPRGIRNNNPGNLTDAPNAVGKDYGNGHVYMKFATPHDGITALSRQLMLHGDRGQNTLNHVIPIYAPKAAGNKTKEYIDYTAKQLGISPNEKMDLHNPAMIEKLINAIIKMENLGQQPYSQEQIKNGIYASIDDPRWAGLRSDYYLQNQRSQYGSNGQNQQFPSLYSNRQDAESEAEIAKGMAKAFQEAIRDKLQVEIILVNDKTGERQKFQSKSAGKVTTSMQHP

SEQ ID NO: 6763 - protein, 31 aa, Xenorhabdus bovienii
  Coding DNA sequence: Name=SeqID_655
LRLFSPPTQFRSTQEPRILWPPVVKIGDICR

SEQ ID NO: 6764 - protein, 99 aa, Xenorhabdus bovienii
  Coding DNA sequence: Name=SeqID_656
  Homolog annotation: Query=2..99bp; Hit=4..96bp; Blast score=80; Percent Identity=45.0; E value=6e-15; Homolog= ref|NP_404843.1|
MMEKTKVIRLSTPIEDNAQKIIYEEIHLREPCLMDVEQFYDVQAKNLNSSLPAMRCLIALVSGVTETALKRMSITDFNQCREFLMFFLSGNLDSSIGDD

SEQ ID NO: 6765 - protein, 122 aa, Xenorhabdus bovienii
  Coding DNA sequence: Name=SeqID_657
  Homolog annotation: Query=1..122bp; Hit=1..122bp; Blast score=157; Percent Identity=68.0; E value=3e-38; Homolog= ref|NP_404842.1|
MGNTSNRLAGTAYVTVDGFRIMVVGDFTYSPSTVTRETLTGMDSVHGYKEKPVPGFISCRVRDSGGTTVADFNNQTNVTIVAELGNGKTIIGEGMWSVNHQEVKSEDAEFEVRWEGGSVTEN

SEQ ID NO: 6766 - protein, 490 aa, Xenorhabdus bovienii
  Coding DNA sequence: Name=SeqID_658
  Homolog annotation: Query=1..490bp; Hit=1..498bp; Blast score=612; Percent Identity=65.0; E value=1e-174; Homolog= ref|NP_404841.1|
MAIPFSHIPNNLRTPLFFVEFDNSMANSAIATQRSLIIGQMLDSATATPDIPVRVSSAEQAASQYGHGSLLHGMVAAYLANDSAAELWVLPLKDGDNLLTAKGLVKVSSLPTHAGVISLYIAGQRVQVTVMATDNTAQIAAALATAINRKISLPVTATVANDTVTLTARNKGAHGNGINLCLNYRGQAGGEVTPAGLALVITPMTGGAGAPELKNGLSNLSDRSFDFIVNPYTDTASMDEMKSFLSDIGGRWSWEQQLYGHAISVVSGTYGELADAGARRNNQHETLLGVTKSPTPNYIWSAAVTGAVAPSLRNDPGRPLQTLPVAGVLAPADQLDLIERNNLLHSGISTVTVADDGTVQVENLITTYQKNPYGDNDDSYLQIETLFLLAFVSRYIRTQITSKFRRMKLAKDGTRFAAGSAIVTQNVVRAELIAQYRTLEYNGYVQDSKAFSEGLRVEINAHNPNRLDVLWTGTLISQLRVFALLNQFRL

SEQ ID NO: 6767 - protein, 60 aa, Xenorhabdus bovienii
  Coding DNA sequence: Name=SeqID_659
LTSLFSVTGGDKHTSPSFNRRCQNRVSGTSAPDSGKNSPLTGQRTSRPVTGLTNMGFTPD

SEQ ID NO: 6768 - protein, 179 aa, Xenorhabdus bovienii
  Coding DNA sequence: Name=SeqID_660
  Homolog annotation: Query=1..178bp; Hit=27..213bp; Blast score=161; Percent Identity=46.0; E value=6e-39; Homolog= ref|NP_670247.1|
MNASIIRNMVVQALMGKTDANSSVYSPRDWSTRGDDYPCILVQTPFDHKKSLGRNVPQFNTVTTVRITGRTEAFDGEFDNGVEKAGLALEALREQIERAVINSYELTKNTQQYAEIRSQIDIDASGESHFAQLLMDIDIEYYQGEEDFYPIDTHPLDGIDVTVAMPAHTPEPKISINLE

SEQ ID NO: 6769 - protein, 111 aa, Xenorhabdus bovienii
  Coding DNA sequence: Name=SeqID_661
MPIDWDKHLLAPLHEQFGERVNWRPKSGKPYDIMGVFDRAYTQQVESLDGDSSVNTTKPLLGVRDAVFKSPPQQQDRVFVYSINAEFVVSDVQPDSHGGTHLQLNRIKHKK

SEQ ID NO: 6770 - protein, 130 aa, Xenorhabdus bovienii
  Coding DNA sequence: Name=SeqID_662
MRHYVQWWCDMAKKQEIVTDGLGELPTELQVNVTENLQKPQSEPALTKFPDTLPEEPEDEDVPEWVVLKGNTVQHDGVAYPENSVIYLSGEDAERLIQLGVVMRLDDLKSQLLSGNSVTVQDGVRVQQEA

SEQ ID NO: 6771 - protein, 348 aa, Xenorhabdus bovienii
  Coding DNA sequence: Name=SeqID_663
  Homolog annotation: Query=1..342bp; Hit=1..340bp; Blast score=153; Percent Identity=31.0; E value=5e-36; Homolog= ref|NP_918991.1|
MNIYDTNVLVQVVPNLKTSQNWLLDKFFPNIVESDTEEVSIDVDVGLRRMAPFISPLVEGKLVESRKFQTNSFKPAYIKDKRAPDLRKPIRRQIGERIGGQYTAAEREMLNIQFELADQIDMINRRLEWMAASALASGTITVAGVGYETKVVNFGRSADLTVTLSGSDKWPTKVDAGKTNNQPTQDIETWSQRILKNSGAVPTDLVFTTQSWNAFRLDTTVTDSAIKFPALNPYGNQINPGTQVQKGAVYKGRWGQFDLWVYNDWFIDPADGKEKPMLPEGTVIMSGADLMGTRAFGAIIDPAFSYGPMAYAPKSWLQEDPAQRFLMMQSAPLVIPSRVNAALCAMVV

SEQ ID NO: 6772 - protein, 93 aa, Xenorhabdus bovienii
  Coding DNA sequence: Name=SeqID_664
LGFQFWECPAFIENHPMMVKLAHQVNATRHTVGGGINIVYQNRTGDLAAIVCPFFTDRVFPCCRNDTQYRTALQNTRFGNRYAVGDNLQRTGN

SEQ ID NO: 6773 - protein, 206 aa, Xenorhabdus bovienii
  Coding DNA sequence: Name=SeqID_665
MSITRFAHLIPSFGMKSKMSEEEQDEKKKGKKAKSRKAEEDKEETDAENDDPDAEGSDDDKETEGKKAKKAKKAKKAKSEDDDDDDPDAEDDEDDENAEEDEDVKKGRRAERKRCAKIFGSQYAAGRPDMAAHLALNTSMSASEAISTLKAMGTVQSQPSRASLDSRMRTEQQVRVGPDASQPATGSPEALVSKMTSLYDANKGAK

SEQ ID NO: 6774 - protein, 284 aa, Xenorhabdus bovienii
  Coding DNA sequence: Name=SeqID_666
  Gene classification: Gene name=SppA; Function=Periplasmic serine proteases (ClpP class); Function class=N Cell motility and secretion
  Homolog annotation: Query=3..278bp; Hit=4..289bp; Blast score=188; Percent Identity=38.0; E value=7e-48; Homolog= Z2361 COG0616
MMNLPHLAQRLFNVPLAIHPRKAEVVMAALTDRLGITKIQAGMDWDDEDESFSRRKRDTGYDVLEGIAVIPVQGTLVQKLGYLRPYSGMTGYDGIRQVFLTALNDPKVKGICLDIDSPGGEVAGCFDLADLIYQSRGDKPIHAILNENAYSAAYAIASAADKITVPRTGGVGSVGVIVIHCDWSQRIKEDGLTVTIITYGDRKAESNPYIKLSDEARQSIQDDIDVMGKLFVSTVARNRGVSEKIIRDTQAACFLAADGVQLGLADAVATPDAAFQTLMNEVGD

SEQ ID NO: 6775 - protein, 548 aa, Xenorhabdus bovienii
  Coding DNA sequence: Name=SeqID_667
  Homolog annotation: Query=27..533bp; Hit=44..543bp; Blast score=479; Percent Identity=49.0; E value=1e-134; Homolog= ref|ZP_00030874.1|
MSVKILGPDGEPLPPSNTKLKFNSLSGSSRIPYDAADSSSDQLANWQPALGSPDNEINIYRDRIVSRMRDLARNDGWASGTITRVLDNAIGANYRPIFKPDYRMLKLLTGNNAFDATWADEYGKVIEAHWRSWANDPGLYCDVERKQTVSQMLRLGFRHKLLDGDALAILQYRTDRLGPGRGRYATTVQIIDPDRLSNPQQNFDMQNIRGGVEIDSDGAPIGYHIREAHMGDWWSGAKTMTWQRVQRETAWGRPMVVHDFDHERGAQHRGIGILAPIVQRLKMLIKYDQSELEAAILNAIFGAYIESPYDSQMVASALGDTVDSSGDELSAYQTQRAEYYEDKRLNLQNGARIPHLFPNEKIVTISATRPTSNFDGFESAVLRNIAAATGLSTQQVTQDWSDVNYSSARAAMLEAWKTLTRRRDDFAVGFAQPIASAFVEEIHDIEKLPLPNNAPDFLDAKAAYCRARWMGPGRGWVDPVAEKKGAILGMNAGLSTLEMEAAENAGEDWEEMLDQRAREIEAFKERGIPLPEWAEPTPQQQNNRGSGE

SEQ ID NO: 6776 - protein, 83 aa, Xenorhabdus bovienii
  Coding DNA sequence: Name=SeqID_668
MRQRTSLLTGMSREQLKTALGTAQQAYIELSTGTKGVSFSYTQGDGTRSVSYQQTSLGDLLALIQAIQTELGITTRRPITVRY

SEQ ID NO: 6777 - protein, 658 aa, Xenorhabdus bovienii
  Coding DNA sequence: Name=SeqID_669
  Homolog annotation: Query=29..617bp; Hit=19..590bp; Blast score=424; Percent Identity=41.0; E value=1e-117; Homolog= ref|ZP_00044983.1|
LITVNKGDNAAWQNFTLVLNQCRSDICPPEPLSLSEWANKYAVLSKENSAQTGKFRSFGYQDGIMDAITDPGVTQVSVMKSARVGYTKILDHVVGYYLSHDPSPILVVQPRVEDAEDYSKTEIAPMLRDTPVLKEIAGEAKAKDSGQTILKKQFSNGANLTLVGANSPGGFRRITCRIILFDEVDGYPSGGAGAEGDQIALGIKRSETFWNRKIVLGSTPTVKETSRIEKAFKDSDQRYYHVPCPHCGEFQVLEWGGPDTPYGLKWDKDSNDKGLPDTAYYVCRHNGCVIHDSDKPLMIKGGEWRAEKPFTGHAGFHIWAGYSLFPNAAWKYLVAEWLRVKDDPLMRQTFINLVLGEPYEDRGEKALSERKLLERCEVWAAEVPDGVALLTAGIDTQDGRFEIEVVGWGRNEESWSIAHDVIEGDLETDEPWARLDAYLKQIWRRADGRGFTIMAACMDSGGHHTQKVYGFARERLGRRIWAIKGESARGGKRSPVWPTKRLTSRSKSSFKPIIIGVNAAKDTIRGRLHIEPPENTDPSPSYMHFPADRELHYFSQLLAERSVIKVSGGQQYRVWEQIPGRANEALDCRVYSYAALCGLMYMGLKLNALADNIVGNPDRLIAPPVQPEIKTNLRFPGAIIPESTEEAPKRKHMSQLLP

SEQ ID NO: 6778 - protein, 194 aa, Xenorhabdus bovienii
  Coding DNA sequence: Name=SeqID_670
MNQSEFAKLHGVSRKTVTQWKARGWLVTDGDDINVEASNANIARYRKSVTRPEKKVAGNSKGNKQGNTLQGNTSGNNPDPDTPAKIVERILTERGATMTLDEARTMKENYLALLTQYDYDLKSGQVLPWQDMIDVVRQEYSRMRTRLIAIAPEHGPRLRALATTSTDTAFVAALQEIIYEAMEELSLDHSKQGG

SEQ ID NO: 6779 - protein, 40 aa, Xenorhabdus bovienii
  Coding DNA sequence: Name=SeqID_671
LRLTPCNLANSDWFICYPRVTCYPNFKSSQLVKYRGAQCP

SEQ ID NO: 6780 - protein, 89 aa, Xenorhabdus bovienii
  Coding DNA sequence: Name=SeqID_672
MPVIYKISGKDPKNYAPLPSCYLALPSHYYTEYLPSTWGGTTVPGLTTESNHPMGNTVHQEYRCPLQYSWRLLHDTLLSVVSHPNHQHH

SEQ ID NO: 6781 - protein, 144 aa, Xenorhabdus bovienii
  Coding DNA sequence: Name=SeqID_673
MKLKTYGLTGQALDWAVALAIGATEKIMPSGRTWLKLPNDSYYVSNRGSYNFKPSTNWAQCGPLIAEHSIMLAQSGDKWYAFSKDNEFNPYRGSHYIDCLFNDADGWGETPLIAACHAIVASCIGEDIDIPDELCSPLDDLIRS

SEQ ID NO: 6782 - protein, 169 aa, Xenorhabdus bovienii
  Coding DNA sequence: Name=SeqID_674
MTTHNYIEQLKLLNTQIEASLRYIENVRLLKGEAEADTFAENDLKSLLSYHSQKLLYHYQKAEESQRQQHRVIALDCSRVSFGQDISNATEKLILKRARVFEEYPVTWIIQLGAKGVLFSRVTNGRIDEDYAPVNRQKANVYASAILNEFEPPKGLQLSDMQTIQRQSE

SEQ ID NO: 6783 - protein, 116 aa, Xenorhabdus bovienii
  Coding DNA sequence: Name=SeqID_675
MCRHVCHQIGLFDNKSQGGTTVPGLYLFVPLVEYVLKIKVSFLLATIHRTASHIRLSINTADQYTIAQLDILIRFITSATSFRIFCFKSNKTISNISGKIFCPVIVNIASRFHLYK

SEQ ID NO: 6784 - protein, 68 aa, Xenorhabdus bovienii
  Coding DNA sequence: Name=SeqID_676
MKYELIPTVILPTSAEVGNIINQLKSELSKFEGNPSLASLMVHELHQRLCAAIKCSVESKSQQIDTSA

SEQ ID NO: 6785 - protein, 221 aa, Xenorhabdus bovienii
  Coding DNA sequence: Name=SeqID_677
  Homolog annotation: Query=4..202bp; Hit=8..206bp; Blast score=132; Percent Identity=43.0; E value=3e-30; Homolog= ref|ZP_00030878.1|
MSMANLKDLSNQLAAIRKQIPFAMAQALTSVARDIEKAQKVALERRLENPTAFTVKSVRSQGARKDNLTAKVFVMPTAASYLEPFEVGGVHKLNGAALLNPKNVKLNKHGNLPRNKLSQLKGKQDVFIGELTTRYGNDVNGVWQRKKAKKVKKGKKRLKRSPNGTRRERPKQRPPKLLIRFGDALPVDPVLGYQERAQQMAQSLMPAAISQALDEAIRTAK

SEQ ID NO: 6786 - protein, 142 aa, Xenorhabdus bovienii
  Coding DNA sequence: Name=SeqID_678
  Homolog annotation: Query=70..139bp; Hit=41..110bp; Blast score=85; Percent Identity=58.0; E value=1e-16; Homolog= ref|NP_440482.1|
LLPTGSKGLLDWPCSFPKQITRRTIGLSLFESPIMNLLITGVHMKKLAILLAALLSFGACAKTRVDVSKIYGNIKVVSSGADYKVKVVSSSPDLKVKIVTSSANSPGKWKMVNSFPDYKIQFVNSFPDFTIKYVDSFPGPTK

SEQ ID NO: 6787 - protein, 61 aa, Xenorhabdus bovienii
  Coding DNA sequence: Name=SeqID_679
VTITTNYINFSHISPIKMGTFIAISNYWSHDLVLDNQSLYDNHLRVVFYYMEGRQHPPSVR

SEQ ID NO: 6788 - protein, 82 aa, Xenorhabdus bovienii
  Coding DNA sequence: Name=SeqID_680
MFLVLCAAFLPLVILITITLLFVLIAGIRDCKIKNYSFNDRVGIAIIGVVAALSFCLACFLWSQLPAFIEWMVPPGFRSRFY

SEQ ID NO: 6789 - protein, 36 aa, Xenorhabdus bovienii
  Coding DNA sequence: Name=SeqID_681
LKFQSTLYLGYCQRPKHGQYPIIGLGFFDYIAITTL

SEQ ID NO: 6790 - protein, 31 aa, Xenorhabdus bovienii
  Coding DNA sequence: Name=SeqID_682
LIIFDSDLYARCKGNMSWLIQADGDNPAQRN

SEQ ID NO: 6791 - protein, 340 aa, Xenorhabdus bovienii
  Coding DNA sequence: Name=SeqID_683
  Homolog annotation: Query=35..325bp; Hit=6..263bp; Blast score=269; Percent Identity=49.0; E value=5e-71; Homolog= ref|NP_597905.1|
MPSVNAGGIFVSEFRALTAHINKTQPYRKSNLRNPLMGISAGGFLREQVRFSIRKYPMSNIIPFEYDGHPIRFNEEGWINATDIAMKFDKEPTAWLRQIDVLEYISALSFRVFGISGTVPEINEIKRLAISSGAARAKILRFAKKSGLVKVKSGPTGGTWLHPKLAIRFARWLSVDFEIWCDEQIDVLIRGIQPTFTDQRINAIFLLDKPATWEKRFQQPFYQALSRMSGLLYKGHVGGTPSLFGMITSKWVYQVVLPDSVYAEAKEAAKSSGDKIHQYLKPEARKLVQEQLKAVTILANGCVDYKDFEARCVQSFGKSGEQGLLILPIEREFSYSAVRH

SEQ ID NO: 6792 - protein, 30 aa, Xenorhabdus bovienii
  Coding DNA sequence: Name=SeqID_684
LTLHVSLEVTLSQQHLSLFLPNNKRIIFNN

SEQ ID NO: 6793 - protein, 51 aa, Xenorhabdus bovienii
  Coding DNA sequence: Name=SeqID_685
MLLQAKHGESNEKIHSSLPSGRHDSFSFNADLCLCLHTLGSISPSIYKLYS

SEQ ID NO: 6794 - protein, 44 aa, Xenorhabdus bovienii
  Coding DNA sequence: Name=SeqID_686
MILGLQESSCLLLDCYYIQSGLSIPHLAIQFIYAWGYRTKGMQA

SEQ ID NO: 6795 - protein, 77 aa, Xenorhabdus bovienii
  Coding DNA sequence: Name=SeqID_687
MKAPVQQAAAREIDVDIAKAAFEEYRKQFGDAQSFERFHQRGGFCWAELAVFLFQRIQYLEKAIREIEKNTLPPQSK

SEQ ID NO: 6796 - protein, 157 aa, Xenorhabdus bovienii
  Coding DNA sequence: Name=SeqID_688
  Homolog annotation: Query=1..152bp; Hit=1..148bp; Blast score=149; Percent Identity=52.0; E value=2e-35; Homolog= ref|NP_930139.1|
MKLTLTHYTIIVLIVTTGIATFGSYHYSTEYEKQKEANGRQATEIQQLTDTLNYQNTHIDMLHELDTKHIRELDNAKSEIDTLRSDVAAGRRKLRIKAVCPVHETTPSGSVGDAGTPQLTEAARQDYYDLLRMMAENERQTKYLQDYVNTECYKVKK

SEQ ID NO: 6797 - protein, 144 aa, Xenorhabdus bovienii
  Coding DNA sequence: Name=SeqID_689
  Gene classification: Function=Phage-related lysozyme (muraminidase); Function class=R General function prediction only
  Homolog annotation: Query=3..142bp; Hit=42..181bp; Blast score=110; Percent Identity=46.0; E value=7e-25; Homolog= XF1669 COG3772
MKISNKGLGFIQQWEGLKLKAYPDPATGGIPWTIGYGHTKDVKPGQVITEQQAEAFLHDDLIPAYATLERLVKVPLTQGQFDALCSFIFNCGSGNFSGSTLLKKINAGDYAGAAAEFPRWNKAAGKVMNGLTRRRASEQQMFLS

SEQ ID NO: 6798 - protein, 116 aa, Xenorhabdus bovienii
  Coding DNA sequence: Name=SeqID_690
  Homolog annotation: Query=5..115bp; Hit=1..107bp; Blast score=113; Percent Identity=54.0; E value=6e-25; Homolog= ref|NP_040644.1|
MGWNMKMKENPDFWMHLGDWLISVREQGIWATLAGTMAFFRGRYNGGGWVKVSIDAFMCAMFAWFIRDVLNFMGLNPDLAYIGSVVIGYLGTDFIGQLLRKAAEKRAGVSSDENQQ

SEQ ID NO: 6799 - protein, 53 aa, Xenorhabdus bovienii
  Coding DNA sequence: Name=SeqID_691
VSQFESEILRQFCRRNHFQYLRISYCGRHPINSTHRGDHSSPHGRPLFKWGGI

SEQ ID NO: 6800 - protein, 57 aa, Xenorhabdus bovienii
  Coding DNA sequence: Name=SeqID_692
MRRSNLTIVNYNFHKAHKLIQRPSNDGLFTFWRTNPNGKGAVLKIASSREIGVSVRI

SEQ ID NO: 6801 - protein, 245 aa, Xenorhabdus bovienii
  Coding DNA sequence: Name=SeqID_693
  Homolog annotation: Query=106..234bp; Hit=419..555bp; Blast score=84; Percent Identity=38.0; E value=2e-15; Homolog= ref|NP_440489.1|
MPVSGRPGSFALSFQADKMEGIEPLLKELNTVILHHSDIASFVRQRNIDVQVLTGLFQSVIETSSNLELKSNSTDDLILMIRKTDAEFYIKTLAKLASEFVGGYQVPQANIITKVFEIVNLKWQDKRLNLQSTGLDDRHILYYIHAAKILGFISNGGTVTALGQQLAEASQDRRLRIAARSFESSHCGWAWVTWSGANNINGIDPKTAEEFLLDKCLSLSMKTINRRASTLRQWYEALQPHYCEL

SEQ ID NO: 6802 - protein, 34 aa, Xenorhabdus bovienii
  Coding DNA sequence: Name=SeqID_694
MAVCYLSFSLYVSHALRTQWVYLVCPYQGLVLPR

SEQ ID NO: 6803 - protein, 107 aa, Xenorhabdus bovienii
  Coding DNA sequence: Name=SeqID_695
MSAVFLGDTHLGSLFMRNIYEYFEEPRFFSVSNEVGSLFIVYWIGDDYDYDKWLVIPISKERLEYLERKKIDIYASLVYQEQKYYYQVNRNYDDSVESVFLRLESKI

SEQ ID NO: 6804 - protein, 146 aa, Xenorhabdus bovienii
  Coding DNA sequence: Name=SeqID_696
MANNTQKAMVESLEVIFPSYYPRGVPPREAQDAEGAFFRIVKTSPPTVDCFKNMYESNPKRLNKFKGLSLKCCYGISVFTDETSAVNAFEKFPQGTEDSYIAKGVVDRTDGKMLKTGEPDSTHHTLWLGDGTKIHKKFSCIRGLVK

SEQ ID NO: 6805 - protein, 46 aa, Xenorhabdus bovienii
  Coding DNA sequence: Name=SeqID_697
LGGVVNTSIPIDNSTCWRDQLVQIQDCAPVWPFCFVSDIFQYMLCG

SEQ ID NO: 6806 - protein, 125 aa, Xenorhabdus bovienii
  Coding DNA sequence: Name=SeqID_698
MVLGGYMRTEHTRSAQTISPSTEIVDKFFDTNSQKEFFIRRLSCRNDIKRQLFIVTIKNDNKSDGFYVVPFAELTVCRSKVRYIVKPTQQYPDLGDNLPSISNNIEKIIRNFILNYRPAVTASPR

SEQ ID NO: 6807 - protein, 43 aa, Xenorhabdus bovienii
  Coding DNA sequence: Name=SeqID_699
LSQQKAPHWARLRIRSEYSYKFPLFGDIKPMPDKKQRFILSSY

SEQ ID NO: 6808 - protein, 259 aa, Xenorhabdus bovienii
  Coding DNA sequence: Name=SeqID_700
  Homolog annotation: Query=1..258bp; Hit=1..269bp; Blast score=211; Percent Identity=42.0; E value=7e-54; Homolog= ref|NP_459880.1|
MKLESALKHFHPKTPTFSDASTSTAPDRMKGMDTAAALGMAGSQAKFGMAAFFAKNEVSEEDKFSTVEELTRYARRTVPKLISKAAGNKLGPCLVILSKMAFEDYARSAASTCQCSECRGKGLIYGMKEVEKHPGIIRADGEVIIAPWIEKEQVGELCQKCNGKGKLSSRCRCKGRGVVVDEEKTALQGVPVDKICPRCSGRGYSRVPSSVAYTAIKAYLPELNERTWRRNWKPFYEKLVSKCYAEESRAEAAFNKMTK

SEQ ID NO: 6809 - protein, 285 aa, Xenorhabdus bovienii
  Coding DNA sequence: Name=SeqID_701
  Homolog annotation: Query=3..283bp; Hit=4..284bp; Blast score=285; Percent Identity=53.0; E value=7e-76; Homolog= ref|NP_459879.1|
MMDNTAHKTLFTIPEPRYSTALATVKPLPVQRKITGNKQVDAYLWVLAVIKTNEPAHLEAAEEALKKLKITPKAAQQKYSDYLMKSGAHPFQIAFGTMSMDNPQGYINSAKEQIKKASQVRASFASYEATLELTEPEKLMLVGELSDIYEPFYYWNETEQAEGCMHGDRICETDKLRQTTAKGFAEQLPEPRTLSDVVREFLYWDWLYQMRNVAAKELDPGGYGDGDRYHIYDREGYLEGKLATIQAVSRQEAIDVCKWVLEEERFHDRELTDKIILNLVGECAV

SEQ ID NO: 6810 - protein, 31 aa, Xenorhabdus bovienii
  Coding DNA sequence: Name=SeqID_702
VCCVVHHYAVSRSLITLISTLDYFALHQWRF

SEQ ID NO: 6811 - protein, 88 aa, Xenorhabdus bovienii
  Coding DNA sequence: Name=SeqID_703
MRTITLKVHYQKEFHPFICYVEGETIIDELKEIEEFMLSSPELKMEGDYLFTFSFKYEDGAPDNGWEYELIAFYPMDEDGKVSETPLM

SEQ ID NO: 6812 - protein, 456 aa, Xenorhabdus bovienii
  Coding DNA sequence: Name=SeqID_704
  Gene classification: Gene name=DnaB; Function=Replicative DNA helicase; Function class=L DNA replication, recombination and repair
  Homolog annotation: Query=2..432bp; Hit=29..461bp; Blast score=241; Percent Identity=37.0; E value=1e-63; Homolog= dnaB COG0305
MNNYDFESSVIGGLLISGLTPDASDVLATLEPEAFATPFYRETFKTIRAQAKTRGLIDSLMVADAMGENHFANVMMTAKNCPSAANLTGYANKVSANYERRLMIELMDEAKERILSGTVENAAESMDWFISQVAEVRKPRDEIRPLHVSELLDDYTEVLEKRLKNGEQSDTLKTGIEELDEITGGINPVDLVIVAARPGMGKTEFALKVAEGVANQTITGTKQKRGVLIFSMEMDSQQIIERQLAGAANLPVSVLRNPARLDDEGWDWVTVGLGRLQNLDVWIIDASKLTVEQIASISRRHKKAHPALSLIMVDYLGLIDKPKAERNDLAVAHISSSLKRLAKDLKTPVIALSQLSRNVETRPNKRPVNADLRDSGSVEQDADSIIMLYRDAVYNENSPAAPYAEIIVTKNRFGQLGTVYQRFRNGHFVSVDQEEAARVCQNNNKPHKRFTKGANV

SEQ ID NO: 6813 - protein, 284 aa, Xenorhabdus bovienii
  Coding DNA sequence: Name=SeqID_705
  Homolog annotation: Query=23..281bp; Hit=19..270bp; Blast score=260; Percent Identity=52.0; E value=2e-68; Homolog= ref|NP_037739.1|
MGSLAVNNVIQLSPPTTFGSGERVANTDDGYTRLANELYEELIGANLTRNQAKVAHAICRKTYGFSKKVDRISDSQLSQLTRLPRQKVNKAKNELITMKVIVKVGMMIGPNKNLSEWEIPECHQNSDFVTKTVTKSVTKSVTVLSPKQGHTKDTITKEKKESNTPLTPHEGNNGEVAKPKKRKPTPKINYDEYLNAYNEAVGDRLPHAVEINTPRQKALKKLIPKLLTPNVDGFGAYVRAFVGQARPFFFGGSDSGWTADFDYLLREKTLTGVREGKFAEKDHE

SEQ ID NO: 6814 - protein, 93 aa, Xenorhabdus bovienii
  Coding DNA sequence: Name=SeqID_706
MDTRDVGEAESQHTGDVSQRILRRADRREEAMNKAVSIENYKRRAKELIPHIPKENGFTFIPNKFLDDLLKEDFSVEQFNEILRVFKPGVVNG

SEQ ID NO: 6815 - protein, 79 aa, Xenorhabdus bovienii
  Coding DNA sequence: Name=SeqID_707
MINTAIEKAIKLWGSQKRFAEHIGKAQSTVSDWLTGKKRISPENVVIIVEATNGAVQAHELRPDLPKVFPPPTEHDHVS

SEQ ID NO: 6816 - protein, 58 aa, Xenorhabdus bovienii
  Coding DNA sequence: Name=SeqID_708
MFCKSLLATPKLYRFLYCRVNHNLLSYKLIAIAIIHIIKHQSNAIAILIYHRHSDILK

SEQ ID NO: 6817 - protein, 194 aa, Xenorhabdus bovienii
  Coding DNA sequence: Name=SeqID_709
MHEGGFSQGSLAKAAGMAQSSVWKLTSGTATRTTRLVDIARVLGVRPEWLSDGKEPMRTEKNNESECNDMEIIEYKGMFPVDMYEGDEPTGDRIMIPNLVESETCRAYKLHVNSGCSEAPAGAIIVIDSNEAAGTNDLVYARVNKALSVYKFVQGGSHGYLSVDDSRVPLVNVGSPDVEVIGVVVFLLRNMKHR

SEQ ID NO: 6818 - protein, 109 aa, Xenorhabdus bovienii
  Coding DNA sequence: Name=SeqID_710
MESGNQSTTYNVELVQKYGLVDSYSIEYINKKRPNHSLLKGHYGSEVIYSLYIMNGDYMVLVDAFKTLSEANQEARKIIGNYPQTEKNLASLDNKGNYENFYLRRNRAS

SEQ ID NO: 6819 - protein, 53 aa, Xenorhabdus bovienii
  Coding DNA sequence: Name=SeqID_711
MKTFIFGAIERANTKQSRPICIKAQATNEQEARKSLAPTHVILGWMGQIVNRN

SEQ ID NO: 6820 - protein, 49 aa, Xenorhabdus bovienii
  Coding DNA sequence: Name=SeqID_712
MRLFYLHLQFRPSMELITFPFLLQSRRLLVVYCSCLIPIRINIVYLSYD

SEQ ID NO: 6821 - protein, 45 aa, Xenorhabdus bovienii
  Coding DNA sequence: Name=SeqID_713
METLLVPLMVEIEDGDKTSAYLICRGIYRQSKVLAEKLREVAGGG

SEQ ID NO: 6822 - protein, 51 aa, Xenorhabdus bovienii
  Coding DNA sequence: Name=SeqID_714
LENTQKLSEKLQSLLQLWMEGNLTEDDAYILSIATDINHNVLQEIARVRGE

SEQ ID NO: 6823 - protein, 116 aa, Xenorhabdus bovienii
  Coding DNA sequence: Name=SeqID_715
MFMNDIRKHICVNEDRLSEMKEDDLNYLISSSEDVILAMTNGLLSIGNLASAAVHSEEYSQDDAMTDLERIAHLLTVVPLIIEAEHENNISAGIELRERQAIKKENQLIESIRKKS

SEQ ID NO: 6824 - protein, 138 aa, Xenorhabdus bovienii
  Coding DNA sequence: Name=SeqID_716
MKKFASIENATNQDITIELRDVYVVRGSGKTYLSEKGALNKLAYVRAQEQFNAEDRPSNFPAEEVIQEDGTPALRNGEMRPEFIELHAQVLEELKADVRRERDLIRTQKEHKKAIEKYRKAQDELIALGNKILKLKSK

SEQ ID NO: 6825 - protein, 117 aa, Xenorhabdus bovienii
  Coding DNA sequence: Name=SeqID_717
MENTSLLARRRKSFVNAFFEHLRKKGKASSFKRKVNGIEYQIDLDDKVFTQALITLYENKVCKAARMNEQQIINYYAEYFNNYGNLTPAGKEFISFITELIAKQLHQKDLGNDKTKK

SEQ ID NO: 6826 - protein, 72 aa, Xenorhabdus bovienii
  Coding DNA sequence: Name=SeqID_718
MTKRRSKTRQGFDGITIPQLFRLKENSITEYANSKKFIAPYSIGDEVLIPLNRAMRRHAKKKGIKLEEVNND

SEQ ID NO: 6827 - protein, 254 aa, Xenorhabdus bovienii
  Coding DNA sequence: Name=SeqID_719
  Homolog annotation: Query=4..253bp; Hit=25..273bp; Blast score=271; Percent Identity=55.0; E value=8e-72; Homolog= ref|NP_707753.1|
MTKKNELITINKTQMPVVEYQGQRVVTFSMIDQVHARPEGTAGRNFRENRSRLIEGEDFYELTADEIRRQSLTHIFAPRTPKGIVLTESGYLMLVKSFTDDLAWQVQRELVNSYFRRPQTVLSELEMIARIASHTAQQQRQINHIGEQVEQVHETVEQIKRGTIPVGWIGFSLAATESGLTNPKCRTLAEQYNVPIDTVTIMTPDGQPRPMKIVFKEDFISAFHLMMGEAEKRGTRWTHPKMGIFQVIGWEGKQ

SEQ ID NO: 6828 - protein, 152 aa, Xenorhabdus bovienii
  Coding DNA sequence: Name=SeqID_720
  Homolog annotation: Query=40..147bp; Hit=34..141bp; Blast score=100; Percent Identity=49.0; E value=1e-20; Homolog= ref|NP_543056.1|
MTIRSYSPHIALVHVTKEETPDTSAYSETAEMEKVTYIPVMNYDHNLTLCMRKAEHVVRLTFAQWEYRQIVDVVVTANIRGLYVIGQAVQNLYDSLPTISFFNHDTDKDDGMAEFHVGILKCIDEGQEGVDWLNEMLIKAEIISIKPEVKSC

SEQ ID NO: 6829 - protein, 201 aa, Xenorhabdus bovienii
  Coding DNA sequence: Name=SeqID_721
  Homolog annotation: Query=1..179bp; Hit=1..174bp; Blast score=121; Percent Identity=39.0; E value=6e-27; Homolog= ref|NP_707754.1|
MLIASDLLRAALICVAKGEDAEKRPQLSGVHITRKHLEATNGHALVRMELTENVINFDDDTDVDLIIRFCGDIPEKACFTDIQLGDEPKAFHLGEDEVVFSLTHLEIINGRFPDLDKAIPTEKQNVIPYFGAKYLAYPYLMFGRGAVLIEPSGMETACRFRFGAFTNKLYGNPVFIVLPLYKDAFEAAEQKVRELEADRDR

SEQ ID NO: 6830 - protein, 67 aa, Xenorhabdus bovienii
  Coding DNA sequence: Name=SeqID_722
MADIDDVLVKATFHIDDGTDQTQRLIHIMRRNQHIHEGICPPLPPAPKVAEVKLTPVKKARNKRGKE

SEQ ID NO: 6831 - protein, 126 aa, Xenorhabdus bovienii
  Coding DNA sequence: Name=SeqID_723
MIKINQSELLVAILNEAARQNSGIEIEEHQFNEITKAADLICAVLEGKAIEQQMIPWVNVQDRMPVDDDGYSPPCLVYVSCGSLSGGGYDHWDTNINQWSVHENDEVTHWCYMTDIPAPVTKEKQP

SEQ ID NO: 6832 - protein, 106 aa, Xenorhabdus bovienii
  Coding DNA sequence: Name=SeqID_724
MISNSFHLTQIIASVWGDPSDITDAIWQAGYRKPERGEKEIAELIIDVMMGVPDQVPYSERPKNLNDILTTELNNIIFDATWSDTVTPATVAKIILENRYQKGEKQ

SEQ ID NO: 6833 - protein, 89 aa, Xenorhabdus bovienii
  Coding DNA sequence: Name=SeqID_725
MRMNTAFLLMAEFETSQIPLSTIAEKYLKLTPATAERKAIEGKLKFPTYRMNDSQKSPRIVHVHDLAEYIDKQRELAAKEVERMQFKRK

SEQ ID NO: 6834 - protein, 55 aa, Xenorhabdus bovienii
  Coding DNA sequence: Name=SeqID_726
MLRQIKFVRFDVISEGQTNESNIRAFVLIIEFFLNRLNDIINQLVMIYWGAIGVP

SEQ ID NO: 6835 - protein, 57 aa, Xenorhabdus bovienii
  Coding DNA sequence: Name=SeqID_727
MLLSLVCPSEITSKRTNFIWRSMKKQVYPSYSTTNYAVGGQLMRSFGFWSANKPDPQ

SEQ ID NO: 6836 - protein, 131 aa, Xenorhabdus bovienii
  Coding DNA sequence: Name=SeqID_728
  Gene classification: Gene name=RhaT; Function=7 Permeases of the drug/metabolite transporter (DMT) superfamily; Function class=G Carbohydrate transport and metabolism
  Homolog annotation: Query=1..105bp; Hit=4..102bp; Blast score=59; Percent Identity=46.0; E value=8e-10; Homolog= PA3558 COG0697
MRGYLWGLASVLLVTVAQLLLKWGVVRLPELSLSTYWLDIDWFWAHHNPLLMVMAGLAGYALSMLCWLFALQYLPLNKAYPIISLSYVFVYLMAALLPWFNETLSWLKTAGVLFILLGVWLISRPEAKRSH

SEQ ID NO: 6837 - protein, 116 aa, Xenorhabdus bovienii
  Coding DNA sequence: Name=SeqID_729
  Gene classification: Gene name=RhaT; Function=7 Permeases of the drug/metabolite transporter (DMT) superfamily; Function class=G Carbohydrate transport and metabolism
  Homolog annotation: Query=8..112bp; Hit=6..107bp; Blast score=65; Percent Identity=47.0; E value=1e-11; Homolog= Z3516 COG0697
MTSNLALLILVSLLTCAGQLCQKQAVTCWQKTDTPHKGVSVAIWLTGAILLLGIGMIFWLRLLQYLPLSIAYPMLSINFVVVTLVGQFLYQEKVGLKHWIGVFAIMFGILLMSLNQ

SEQ ID NO: 6838 - protein, 553 aa, Xenorhabdus bovienii
  Coding DNA sequence: Name=SeqID_730
  Gene classification: Function=4-amino-4-deoxy-L-arabinose transferase and related glycosyltransferases of PMT family; Function class=M Cell envelope biogenesis, outer membrane
  Homolog annotation: Query=12..550bp; Hit=6..548bp; Blast score=474; Percent Identity=46.0; E value=1e-133; Homolog= Z3515 COG1807
MLNSWASRVGAFLMALFFILTYLLPLNGRLLWQPDETRYAEISREMLQRGDWIVPYFFDIRYFEKPVAGYWFNNISQWIFGDNNFAVRFGSVFSTLLSAFLLYRLAMMMWQNRQIAFVSSLIYISMFIVFSIGSYSVLDPMFSLWVTAGIVSCYWALKAGSTRERMLALSALGLACGMAFMTKGFLALALPVISMIPITIYQKRFWEMVRFGPLAVIFAILISLPWVIAIALREPDYWHYFFWVEHIQRFASDKAQHIAPMWYYLPILVLGVLPWLGLLPGSLMKSWKEKKSHPEMFFLLCWFIIPFVFFSIAKGKLPTYVLPFIGPLALMMAKYSIDCVSNGNMKALKMNGLVNVLFGIIAILVLLVMQTLLNRPFYQPSEWPKWVLGTVAFGAWGIIGYLCFIHNGKRWMWAAACSLVLSLTFGSALPNRTIDSKLPQSFIRQNVQELADSKYILSEAVGLGAAVAWELKRSDIYMFDRTGELEYGLAYPDSQYRYVAQEKFPTWLEKARKEGQVAIVFLLSSKGGLPELPKPDLVRRSDRFVLVIYKKQS

SEQ ID NO: 6839 - protein, 303 aa, Xenorhabdus bovienii
  Coding DNA sequence: Name=SeqID_731
  Homolog annotation: Query=7..302bp; Hit=1..296bp; Blast score=525; Percent Identity=82.0; E value=1e-148; Homolog= ref|NP_929892.1|
MVGNNVMKKVGLRIDVDTYRGTKEGVPQLLEILQRHHIQASFFFSVGPDNMGRHLWRLLRPKFLWKMLRSNAASLYGLDILLAGTAWPGKKIAKDLGYLMKQAMEAGHEVGLHAWDHQGWQAKVERWSEVELAEQVQLGIDALKKATGQAITCSAVAGWRADERVLTVKQRFGFDYNSDCRGTHPFRPLLPDGTIGTVQIPVTLPTYDEVVGTQVRDVDFNRFILDEIKNDLGVSVYTIHTEVEGMSKSSQFETLLNMLPQQNIQFCKLSHLLPENRETLPVGKIVRSDFPGREGWLGCQQKV

SEQ ID NO: 6840 - protein, 661 aa, Xenorhabdus bovienii
  Coding DNA sequence: Name=SeqID_732
  Gene classification: Gene name=WcaG; Function=Nucleoside-diphosphate -sugar epimerases; Function class=M Cell envelope biogenesis, outer membrane
  Homolog annotation: Query=306..651bp; Hit=1..346bp; Blast score=603; Percent Identity=80.0; E value=1e-172; Homolog= yfbG_2 COG0451
MKAVIFAYHDIGCVGLNALIKAGFDIQAVFTHTDDPNENHFFSSVARIGADFGLPVFAPENVNHPLWIDRIREMKPDVIFSFYYRNMLSQDLLSLAEKGAFNLHGSLLPKYRGRAPVNWAVLNGETETGVTLHKMVIKPDAGDIVAQQTVLIGETDTSLDVHGKIREAAVELLDSILPQIKSSHYLSIPQDENQATYFGRRTAEDGEIDWHKSAKEINNLVRAVTEPYPGAFTFLGERKITVWRSRPLTQVHDKLPGTVLSTAPFVIACGEGALEITSGQGESGLYVQGSRLVLEMGIVTGVRVGSKATAQISRRKRVLILGVNGFIGNHLTERLLNDGKYDIYGMDIGSSAIERFIGNPRFHFIEGDVSIHTEWIEYHIKKCDVILPLVAIATPIEYTRNPLRVFELDFEENLKIVRYCVKYNKRIIFPSTSEVYGMCDDKEFDEDTSRLIVGPINKQRWIYSVSKQLLDRVIWAYGVKEGLKFTLFRPFNWMGPRLDNLNSARIGSSRAITQLILNLVEGSPIKLVDGGEQKRCFTDINDGIDALFRIIENRDGLCDGQIINIGNPTNEASIRQLAEMLLESFEEHELRGNFPPFAGFKKIESSSYYGQGYQDVEHRKPSIKNAERLLGWKPTIDMKQTIDETLDFFLRGEIEELTRED

SEQ ID NO: 6841 - protein, 337 aa, Xenorhabdus bovienii
  Coding DNA sequence: Name=SeqID_733
  Gene classification: Gene name=WcaA; Function=Glycosyltransferases involved in cell wall biogenesis; Function class=M Cell envelope biogenesis, outer membrane
  Homolog annotation: Query=18..325bp; Hit=7..314bp; Blast score=480; Percent Identity=73.0; E value=1e-135; Homolog= yfbF COG0463
MQSLKFFRSIEIVTFEKIKKVSVVIPVYNEEESLPQLLERTIAACQQLEQKYELILVDDGSRDSSADILTQAAETPENHVIAILLNRNYGQHSAIMAGFHQADGDLVITLDADLQNPPEEIPRLVKTAEEGYDVVGTRRANRQDSWFRKTASKIINAMITKATGRSMGDYGCMLRAYRRHIVHAMLQCHERSTFIPILANTFARRTTEIDVTHAEREFGDSKYSFMKLINLMYDLLTCLTTAPLRLLSVVGSIIAVTGFLLAVLLIALRLIFGSIWAAEGVFTLFAILFMFIGAQFVAMGLLGEYVGRIYNDVRARPRYFIQKVVGVRKINDNQEKS

SEQ ID NO: 6842 - protein, 385 aa, Xenorhabdus bovienii
  Coding DNA sequence: Name=SeqID_734
  Gene classification: Gene name=WecE; Function=Predicted pyridoxal phosphate-dependent enzyme apparently involved in regulation of cell wall biogenesis; Function class=M Cell envelope biogenesis, outer membrane
  Homolog annotation: Query=1..379bp; Hit=12..390bp; Blast score=510; Percent Identity=64.0; E value=1e-145; Homolog= yfbE COG0399
MDNFLPFSRPAIGHEEIEAIEQVLRSGWITTGPQNHQLEQDFSRIFGCRHAIALCSATAGMHLVLLALGIGPGDEVITPSQTWVSTINMICLLGAEPVMVDVDRDTLMVSAEAVRKAITPNTKAIIPVHYAGAPCDLDALRIVADEANIPLIEDAAHAVGTRYKNEWVGERGTAIFSFHAIKNMTCAEGGMFVTDNDELAHRVRCLKFHGLAVDAFDRQIQGRKPQAEVIEPGFKYNLSDIHAAMAVVQLGKLESMNARRGELVARYTAALSNSPLQMLSVPEYEHGHTHHLFMVRVDQDVCGIDRDTFMARLKERNIGTGLHFRAAHTQKYYRERYPVLSLPASEWNSATLCSLPLFPDMNNDDVDRVVNAITEILSEHRNSDI

SEQ ID NO: 6843 - protein, 255 aa, Xenorhabdus bovienii
  Coding DNA sequence: Name=SeqID_735
  Gene classification: Gene name=FepC; Function=ABC-type cobalamin/Fe3+- siderophores transport systems, ATPase components; Function class=P Inorganic ion transport and metabolism
  Homolog annotation: Query=6..249bp; Hit=4..244bp; Blast score=190; Percent Identity=42.0; E value=1e-48; Homolog= ZbtuD COG1120
MTCQPILELNNITVDKRLTTLSESVIAREQIHLVGLNGSGKSTLLSAIAGILPYSGKIHLNGRNLCDYRQHELAKYRAWFSQSVSVPIMPVYQYLDMYRPDSVPLDQSESVLYELCRQLKLTSLLSSSIGQLSGGEWQRVRLAGVFLQIWPELNPNGKLLLLDEPTNNLDITQQAVLDQLIKQFCSLGGSVLMSSHDLNHTYEQATSVWLLSHGKLLVSGIPQNVMTNQNLSEIFEVNIRHIQNTSYKLWRVDHL

SEQ ID NO: 6844 - protein, 331 aa, Xenorhabdus bovienii
  Coding DNA sequence: Name=SeqID_736
  Gene classification: Gene name=BtuC; Function=ABC-type cobalamin/Fe3+- siderophores transport systems, permease components; Function class=P Inorganic ion transport and metabolism
  Homolog annotation: Query=11..327bp; Hit=8..323bp; Blast score=293; Percent Identity=60.0; E value=2e-79; Homolog= ZbtuC COG0609
MHSVYELITLQKKRDYRVIALLSILFIMLFILSLCAGELWFWPNQWLSDSARLFIWQLRLPRAIAVIVVGASLAVSGAVMQALFENPLAEPGLLGISNGAGVVVVCLILVFHGIAPLWLLSIGAVLGAFAMTAILLGFSRKHQVTNTRLLLIGVAFGVIFGAMMTWMVYFSTSLDLRQLMYWMMGSFSGIDWRQKWLVIALVPATFWLSQQGKILNYLSLGELQAQQLGISHNKWRNLFVSVVGLLVGLSVALAGAISFIGLVIPHILRLTGLTDHKTLLPACALAGSSGLLLADLFSRLSLSHAEVPIGVVTVTLGAPIFIWLLLKTHHR

SEQ ID NO: 6845 - protein, 54 aa, Xenorhabdus bovienii
  Coding DNA sequence: Name=SeqID_737
VHWRHQKKEMYPIVYNGILKVRKRPHNNAAFFMCFILLVKLFPPDFSTFDLGET

SEQ ID NO: 6846 - protein, 98 aa, Xenorhabdus bovienii
  Coding DNA sequence: Name=SeqID_738
  Gene classification: Gene name=HimA; Function=Bacterial nucleoid DNA -binding protein; Function class=L DNA replication, recombination and repair
  Homolog annotation: Query=1..98bp; Hit=1..98bp; Blast score=153; Percent Identity=87.0; E value=3e-38; Homolog= himA COG0776
MALTKAEMSENLFEKLGISKRDAKDLVEIFFEEVRHSLENGEQVKLSGFGNFDLRDKNQRPGRNPKTGEDIPITARRVVTFRPGQKLKNRVEKALPKE

SEQ ID NO: 6847 - protein, 795 aa, Xenorhabdus bovienii
  Coding DNA sequence: Name=SeqID_739
  Gene classification: Gene name=PheT; Function=Phenylalanyl-tRNA synthetase beta subunit; Function class=J Translation, ribosomal structure and biogenesis
  Homolog annotation: Query=145..795bp; Hit=1..651bp; Blast score=976; Percent Identity=73.0; E value=0; Homolog= ZpheT_2 COG0072
MKFSELWLREWTNPAISSEALSDQITMAGLEVDGVEKVAGQFHGVVVGEVVECGQHPNADKLRVTKVNVGGDRLLDIVCGAPNCRQGLRVAVATVGAVLPGDFKIKTAKLRGEPSEGMLCSFSELGIANDHDGIIELPADAPIGTDLRDYIKLNDSVIEISITPNRADCLSIMGVARDVAVINKLSMTEPQIEFVKLTTEATFPIRVDAPEACPRYLGRVIKNVNVKAETPLWMREKLRRGGIRSIDPIVDVTNYVLLELGQPLHAFDLERLSGSITVRLAEQGEKLTLLDGNEIELSADTLVIADEKQALAMAGIFGGQYSGVNAETQHILLECAFFAPLAITGRARRYGLHTDASHRFERGVDPQLQYKAMEYATQLLIAICGGEAGEIIDVTSGSYLPKSVTITLNRKKLDRLIGHHIVDDEVTDILTRLGCQVTVQNDSWQAVVPSWRFDMQIEEDLVEEIARIYGYNNIPDVPVRADLVMTAHREANLPLKRVKTMLVDKGYQEAITYSFVDPKIQQYLHPQEEALILPNPISADMSAMRLSLLTGLLTTVVYNQNRQQNRVRLFETGLRFVPDENAEHGIRQELMLGGVIAGNRFEEHWLIEKQAVDFFDLKGDLESVLELTGMLSSISFRAEEHPALHPGQSAGIYLENNYIGYIGVVHPELERRFDLNSRTVIFELLWASLVDRVIPEMKEVSRFPSNRRDIAIVVPENVAAEDVLAECKKVGVNHIVGINLFDVYCGKGVAEGYKSLAISLILQDTVRTLEEEEIAATVNKCVAALEQRFKASLRD

SEQ ID NO: 6848 - protein, 327 aa, Xenorhabdus bovienii
  Coding DNA sequence: Name=SeqID_740
  Gene classification: Gene name=PheS; Function=Phenylalanyl-tRNA synthetase alpha subunit; Function class=J Translation, ribosomal structure and biogenesis
  Homolog annotation: Query=1..327bp; Hit=1..327bp; Blast score=600; Percent Identity=88.0; E value=1e-172; Homolog= ZpheS COG0016
MSHLTELVAKAKAAVEEAQDVAALDLVRVEYLGKKGHLTLQMSSLRDLPADERPAAGAVINQAKQEVQEALNARKAKLEADVLNARLAAEKIDISLPGRRMENGGLHPVTRTIERIETFFGELGFSVESGPEIEDDYHNFDALNIPAHHPARADHDTFWFDATRLLRTQTSGVQIRTMKERQPPIRIIAPGRVYRNDYDQTHTPMFHQAEGLIVDKNISFTNLKGTLHDFLNNFFEEEMQVRFRPSYFPFTEPSAEVDVMGKNGKWLEVLGCGMVHPNVLRSVGIDPEVYSGFAFGMGMERLTMLRYGVTDLRAFFENDLRFLKQFK

SEQ ID NO: 6849 - protein, 38 aa, Xenorhabdus bovienii
  Coding DNA sequence: Name=SeqID_741
MPQIAISEVIKIKKPPHWRLKRCFSFLFLRAKPPDFRR

SEQ ID NO: 6850 - protein, 41 aa, Xenorhabdus bovienii
  Coding DNA sequence: Name=SeqID_742
LLPLLLSPKIWLTIDWVNKDIMERMAMMKLAFFRFFFYFSA

SEQ ID NO: 6851 - protein, 118 aa, Xenorhabdus bovienii
  Coding DNA sequence: Name=SeqID_743
  Gene classification: Gene name=RplT; Function=Ribosomal protein L20; Function class=J Translation, ribosomal structure and biogenesis
  Homolog annotation: Query=1..117bp; Hit=1..117bp; Blast score=144; Percent Identity=93.0; E value=1e-35; Homolog= VCA0290 COG0292
MARVKRGVIARARHKKILKQAKGYYGARSRVYRVAFQAVIKAGQYAYRDRRQRKRQFRQLWIARINAAARQNGMSYSRFINGLKKASIEIDRKILADIAVFDKVAFAALVEKAKGALA

SEQ ID NO: 6852 - protein, 65 aa, Xenorhabdus bovienii
  Coding DNA sequence: Name=SeqID_744
  Gene classification: Gene name=RpmI; Function=Ribosomal protein L35; Function class=J Translation, ribosomal structure and biogenesis
  Homolog annotation: Query=1..65bp; Hit=1..65bp; Blast score=86; Percent Identity=90.0; E value=5e-18; Homolog= rpmI COG0291
MPKIKTVRGAAKRFKKTASGGFKRKHANLRHILTKKSTKRKRHLRPKGMVSKGDLGLVVACLPYA

SEQ ID NO: 6853 - protein, 112 aa, Xenorhabdus bovienii
  Coding DNA sequence: Name=SeqID_745
  Gene classification: Gene name=InfC; Function=Translation initiation factor IF3; Function class=J Translation, ribosomal structure and biogenesis
  Homolog annotation: Query=1..112bp; Hit=68..179bp; Blast score=155; Percent Identity=90.0; E value=6e-39; Homolog= infC COG0290
MDYGKFLYEKSKSVKEQKKKQKVIQVKEIKFRPGTDEGDYQVKLRNLIRFLEDGDKAKITLRFRGREMAHQQIGIEMLNRIREDLSELAVVESFPSRIEGRQMIMVLAPKKK

SEQ ID NO: 6854 - protein, 60 aa, Xenorhabdus bovienii
  Coding DNA sequence: Name=SeqID_746
MIRQTGGSAFGLISTKSTPASSAFSRASLRLTIPICSPSNPVKRTSEARISSLMRFGRAG

SEQ ID NO: 6855 - protein, 89 aa, Xenorhabdus bovienii
  Coding DNA sequence: Name=SeqID_747
  Gene classification: Gene name=ThrS; Function=Threonyl-tRNA synthetase; Function class=J Translation, ribosomal structure and biogenesis
  Homolog annotation: Query=1..89bp; Hit=554..642bp; Blast score=145; Percent Identity=79.0; E value=8e-36; Homolog= thrS COG0441
YVQELVKKLQDAGVRAKADLRNEKIGFKIREHTLRRVPYMLVCGDKEVESGKTSVRTRRGKDLGSINVSEFTEKLLTEIRSRNLHQLEE

SEQ ID NO: 6856 - protein, 210 aa, Xenorhabdus bovienii
  Coding DNA sequence: Name=SeqID_748
  Gene classification: Gene name=GntR (BS); Function=Transcriptional regulators; Function class=K Transcription
  Homolog annotation: Query=1..201bp; Hit=14..216bp; Blast score=65; Percent Identity=28.0; E value=5e-11; Homolog= mll6782 COG1802
LSKKIAETIRNKLVIGELLPGQRLSEAALSEQLEISRNTLREVFRVLTQEGLLKHQPNRGVFVAIPDIASIIDIYRVRRLIECQALTQAYSMHPSVAKMKEAVTSAQLYRNNQDWVGVGTANMRFHTAIVELTDSERLIAFYRNISAELRLAFGLLNDPELLYAPYIDKNAYILELLDSGQTELAAKKMKDYLELSERTVLAAYTRKNNE

SEQ ID NO: 6857 - protein, 388 aa, Xenorhabdus bovienii
  Coding DNA sequence: Name=SeqID_749
  Gene classification: Gene name=PutP; Function=1 Na+/proline, Na+/panthothenate symporters and related permeases; Function class=E Amino acid transport and metabolism
  Homolog annotation: Query=1..378bp; Hit=7..377bp; Blast score=297; Percent Identity=50.0; E value=1e-80; Homolog= BH1820 COG0591
MATSAIGPGFITQTATFTATMGAAFAFGILASILIDFVVQQNIWRIVTLTKMQSADIANAVIPGSGYLLAALVMFGGLVFNVGNIAGAGLGLNALIGLEPKWGGLLSALMAIYIFTSRKAGVAIDRIIVVLGVVMIGLTLFVAIVSNPPVGEALRQTVLPDDINFATITTIVGGTVGGYICYAGAHRLLDKGMTGVENIDAVSSAATKGILAVGLMRYFLFLAILGVVASGVTLDIASETANPASQAFQVVVGEFGLRIFGLILWSAAITSVIGAAYTSISFARVFKKQLTDRQLNIVTLCFITLSLAVYLLIGTPPAALLVFAGGFNGLILPLGLTIFVYVGWKRADLMGGYHYPRWLLWSGFITCVLTWYMGAMSISSIFAFLKAA

SEQ ID NO: 6858 - protein, 255 aa, Xenorhabdus bovienii
  Coding DNA sequence: Name=SeqID_750
  Gene classification: Function=Uncharacterized proteins, homologs of lactam utilization protein B; Function class=R General function prediction only
  Homolog annotation: Query=5..252bp; Hit=4..251bp; Blast score=264; Percent Identity=55.0; E value=8e-71; Homolog= ML0333 COG1540
MIKAIDLNSDLGESFGQWKMGNDAEMLGIVSSANVACGFHAGDPVGILQTLKSAKENQVAIGAHVSYPDLVGFGRRSMDIASHELTADVIYQIGALQGLALAAGTSVRYVKPHGALYNTIANDERQALAVIEGILVIDPNLALVGLAGSNILRLAQEKGLKTIAEAFADRAYTAAGELVSRREAGAVLNDANLVAQRMLQLVTEGGVDSIDGKFTPIKADSICVHGDSPGALDMAKQVKKVLRQAGITIQSFIHA

SEQ ID NO: 6859 - protein, 532 aa, Xenorhabdus bovienii
  Coding DNA sequence: Name=SeqID_751
  Gene classification: Gene name=DUR1; Function=Allophanate hydrolase subunit 2; Function class=E Amino acid transport and metabolism
  Homolog annotation: Query=229..520bp; Hit=8..290bp; Blast score=190; Percent Identity=41.0; E value=3e-48; Homolog= ML2550 COG1984
LRFLPVNFNTILVELSGLPETLALFDSLSIAPVLGIEEIIPAARTLMIRFRPTKISIHQLVAEMGHRDLHECSHSQGKQIEIPVHYNGEDLAEVAEILGGTVQDVIRQHTENEYTVAFSGFAPGFAYMVSDTAQWNIPRRQTPRTRIPAGAVALAGEFSGIYPQASPGGWLIIGITTERMWDLSRPDPALLQPGYRVNFRDAERATVTVSLPETSRTNSVSQSETSRYLEIRSVGLQTLFQDLGRFGKSGLGISESGAMDKSALRSANRIVGNASEQACLEIVQGGFKAVACGQMMVAVTGALCSIEIKTPQGELIYVSAYKPIDLNDGDEIILGRPDAGTRSYLAVRGGFTIPSVLSSRSFDTLSHIGPEPLKAEDKLAVGTTSHCAAVSFSETPAFVMPNKNEVVVLDVLLGPRTDWFTQESIDLLRNQIWQVTPQSNRIGLRLNGECSLSRIKRQELPSEGTCAGAIQIPASGQPVLFLSDHPLTGGYPVIASVAHYHLDLAGQIPVNAKVRFNPIRQFHEISGSEDLL

SEQ ID NO: 6860 - protein, 591 aa, Xenorhabdus bovienii
  Coding DNA sequence: Name=SeqID_752
  Gene classification: Gene name=AccC; Function=Biotin carboxylase; Function class=I Lipid metabolism
  Homolog annotation: Query=14..459bp; Hit=11..457bp; Blast score=567; Percent Identity=65.0; E value=1e-161; Homolog= ML0726_1 COG0439
MNTTVNNINKNPNKVLIANRGEIAVRIIRACRDYGVQTIAVYADADINAQHVQLADEAYGLSGNSSAETYLNIPRLLAIAKQSGATMVHPGYGFLSERAEFARAVMDAGLIWIGPNPETIDELGDKVKARKIAHKVGAPLVVGTSEPVKDAQEVVAFAEEHGLPIAIKAAFGGGGRGLKVAWRLDEVEELYHSAVREATAAFGRGECFIEQFLDKPRHIEAQVIADKQGHVVVLGTRDCSLQRRNQKLVEEAPTPFLTQQQRERIHQAAKAICAEANYVGAGTVEFLLSADGTLSFLEVNTRLQVEHPVTEETTGIDLVIEQLRIAEGHPLSIQETPVPRGHSFEFRINAEDAGKGFLPMSGTISEFTPPSGPGIRLDSGVISGSTIPATFDSLMAKLIVTGTTREQAISRARRALREFKIRGVASVLPFHQAVMEHPDFVSDDVFNVHTRWIETDFANEIEALPRQVVTEDDSITRTYIEIDGRRHELGLPADLLAGFSHLAPVREQQSSQSAIKEKMPADSRQVKAPISGILHSWIVKEGEQVNEGDVIAVMEAMKMEVQINAHRAGKITFCVQAGDYQDAESTLAHIE

SEQ ID NO: 6861 - protein, 89 aa, Xenorhabdus bovienii
  Coding DNA sequence: Name=SeqID_753
  Homolog annotation: Query=1..89bp; Hit=1..89bp; Blast score=93; Percent Identity=59.0; E value=6e-19; Homolog= gb|AAG31733.1|AF264949_1
MVKTISQKAARESLGSPEFFEGGVYVTKNGVSELFVQTANERDAELEERVLERQVHALLKLTMMAKQDVVHERTMTPDEALKKLRASRK

SEQ ID NO: 6862 - protein, 112 aa, Xenorhabdus bovienii
  Coding DNA sequence: Name=SeqID_754
  Homolog annotation: Query=40..109bp; Hit=2..71bp; Blast score=65; Percent Identity=51.0; E value=1e-10; Homolog= gb|AAG31734.1|AF264949_2
MSNIRLTETAVRCLEDIESFNALRLSPQKAIKITESLLRESITAISDDPKRYRFNASLLDLGLFVRERLDIDRGYRVLYEIKDDLIYILLFLSTKQDLTDALYRHQILRSLQ

SEQ ID NO: 6863 - protein, 117 aa, Xenorhabdus bovienii
  Coding DNA sequence: Name=SeqID_755
  Gene classification: Gene name=FrdD; Function=Fumarate reductase subunit D; Function class=C Energy production and conversion
  Homolog annotation: Query=1..117bp; Hit=2..119bp; Blast score=158; Percent Identity=72.0; E value=7e-40; Homolog= frdD COG3080
MNQRPKRSDEPIFWGLFGAGGMWSAIVGPAMVLLLGFLIPLGLAPEALSYDRVLTFCQSFIGRIFLLLMISLPLWCGMHRLHHGMHDLQIHIPASKWGFYGTAAILSVVALIGVFTL

SEQ ID NO: 6864 - protein, 131 aa, Xenorhabdus bovienii
  Coding DNA sequence: Name=SeqID_756
  Gene classification: Gene name=FrdC; Function=Fumarate reductase subunit C; Function class=C Energy production and conversion
  Homolog annotation: Query=1..131bp; Hit=1..131bp; Blast score=172; Percent Identity=70.0; E value=1e-43; Homolog= frdC COG3029
MTTKRKPYVRGMESHWWHKLGFYRFYMIREGTAIPAIWFSLLVLYGLFALKDGSESWVGFISFLQHPAVLVINIITLLATLLHTKTWFELAPKALNIIVKNEKMSPEPIIKLLWAITLIATAVILGVALFY

SEQ ID NO: 6865 - protein, 244 aa, Xenorhabdus bovienii
  Coding DNA sequence: Name=SeqID_757
  Gene classification: Gene name=FrdB; Function=Succinate dehydrogenase/fumarate reductase Fe-S protein; Function class=C Energy production and conversion
  Homolog annotation: Query=1..244bp; Hit=1..244bp; Blast score=441; Percent Identity=84.0; E value=1e-124; Homolog= frdB COG0479
MTEMKNLKMEVMRYNPEIDSEPHFVTYEVPYDEQTSLLDALGYIKDNRAPDLSYRWSCRMAICGSCGMMVNRVPKLACKIFLRDYPQGMRIEALGNFPIERDLVVDMTHFIESLEAIKPYIIGNDRKPADGPNVQTPTQMAKYHQFSGCINCGLCYAACPQFGLNPEFIGPAAVTLAHRYNLDSRDHGKKERMPQINSDNGVWSCTFVGYCSEVCPKHVDPAGAIQQSKAESAKDFLISMLKPQ

SEQ ID NO: 6866 - protein, 598 aa, Xenorhabdus bovienii
  Coding DNA sequence: Name=SeqID_758
  Gene classification: Gene name=SdhA; Function=Succinate dehydrogenase/fumarate reductase, flavoprotein subunits; Function class=C Energy production and conversion
  Homolog annotation: Query=1..583bp; Hit=1..583bp; Blast score=1003; Percent Identity=84.0; E value=0; Homolog= frdA COG1053
VQTFNADLAIIGAGGAGLRAAIAAAEANPQLKIALISKVYPMRSHTVAAEGGSAAVTQSHDSYDFHFNDTVSGGDWLCEQDVVEYFVKHCPTEMIQLEQWGCPWSRKEDGSVNVRRFGGMKIERTWFAADKTGFHMLHTLFQTSLKYPQIQRFDEHFVLDILIDEGQVRGLVALNMMEGTKVQIRANAVIMATGGAGRVYRYNTNGGIVTGDGMGMAFRHGIPLRDMEFVQYHPTGLPGSGILMTEGCRGEGGILVNKDGYRYLQDYGMGPETPLGQPENKYMELGPRDKVSQAFWHEWQAGRTIATPRGDVVHLDLRHLGEKKLLERLPFICELAKAYVGVDPVKEPIPVRPTAHYTMGGIETNPQCETRIKGLFAIGECSSVGLHGANRLGSNSLAELVVFGRLAGEEAVKHIQQATPANENVLDAQARDIEDKLNKLLNQKGGEHWAKIRDELGTSMEEGCGIYRTPELMQKTMDKIAELKERFKHIEITDRSSVFNTDLLYTIELGFGLDVAECMAHSAMNRKESRGAHQRLDAGCTERDDENFLKHTLAFYNPEGAPRLEYSDVKITKSKPAKRVYGGEAAAQEKQQKEQAND

SEQ ID NO: 6867 - protein, 325 aa, Xenorhabdus bovienii
  Coding DNA sequence: Name=SeqID_759
  Gene classification: Function=Truncated, possibly inactive Class II lysyl-tRNA synthetase; Function class=J Translation, ribosomal structure and biogenesis
  Homolog annotation: Query=1..322bp; Hit=11..332bp; Blast score=517; Percent Identity=78.0; E value=1e-147; Homolog= yjeA COG2269
MNEVADWQSSAPIANLLQRAKILAEIRRFFADRGVLEVETPAMSQATITDIHLVPFQTRFVGPGAADGLTLYLMTSPEYHMKRLLTAGSGSIYQMGRSFRNEEAGRHHNPEFTMLEWYRPHYDMYRLMNEVDDLLQQILDCESAESLSYQQAFIRYLEIDPLTASKEKLREVAAKLDLSNIADQEEDRDTLLQLLFTMGVETHIGLEKPTFIYHFPASQASLAEISKEDHRVAERFEVYFKGMELANGFRELTDSHEQRLRFVQDNRKREAMGLPVMPIDEHLLKALEHGMPECAGVALGVDRLIMLALGAERISEVIAFPVGIS

SEQ ID NO: 6868 - protein, 358 aa, Xenorhabdus bovienii
  Coding DNA sequence: Name=SeqID_760
  Gene classification: Gene name=UgpQ; Function=Glycerophosphoryl diester phosphodiesterase; Function class=C Energy production and conversion
  Homolog annotation: Query=8..353bp; Hit=12..357bp; Blast score=551; Percent Identity=76.0; E value=1e-157; Homolog= ZglpQ COG0584
MQTPIKTIMAGLLLASSMSGIAHAADKIVIAHRGASGYLPEHTLPAKAMAYAQGADYLEQDLVMTQDNELIVLHDHYLDRVTDVAERFPNRARANGRYYAIDFTLPEIKSLKFTEGFDIEEGKKVQSYPRRFPMGKSDFRIHTFQEEIEFIQGMNKSTGKNMGIYPEIKAPWFHHQEGKDITAKVLEVLKQYGYTKKSDKVYLQCFDANELKRIKHELEPKMGMDLKLIQLIAYTDWKETYEQIQDGSWVNYSYDWMFKPGAMKEVAKYADGIGPDYHMLISDDSTPSNIKLTGLVKEAHMSHLAVHPYTIRVDQLPKYATSGNQLFDIVFDKANVDGAFTDFPDLAVKFLEKRHEHK

SEQ ID NO: 6869 - protein, 451 aa, Xenorhabdus bovienii
  Coding DNA sequence: Name=SeqID_761
  Gene classification: Gene name=UhpC; Function=Sugar phosphate permease; Function class=G Carbohydrate transport and metabolism
  Homolog annotation: Query=1..445bp; Hit=1..445bp; Blast score=767; Percent Identity=87.0; E value=0; Homolog= ZglpT COG2271
MLSIFRPAPHKARLPAQEIDPVYRRFRWQIFMGIFFGYAAYYLVRKNFGLAMPHLAEQGFSKGDLGFALSGISIAYGISKFIMGSISDRSNPRVFLPAGLILAAAVMLFMGFVPWATSSIAIMFVLLFLCGWFQGMGWPPCGRTMVHWWSQKERGGIVSIWNCAHNVGGGLPPLLFMLGMAWFQDWKAAFYMPAFAAILVAIIVFSLMRDTPQSCGLPPIEEYKNDYPPDYTDKNEKELTAKEIFLQYILPNKLLWMIAIANVFVYLLRYGILDWSPTYLKEVKHFAMDKSSWAYFLYEYAGIPGTLLCGWMSDKVFRGNRGATGVFFMTLVTIATIVFWLNPAGNPNIDMLCMLVIGFLIYGPVMLIGLHALELAPKKAAGTAAGFTGLFGYLGGSVAASIIVGYTVDFFGWDGGFMVMIGGSALSVVLLLFVMLSESKHKQEIARNASQ

SEQ ID NO: 6870 - protein, 1078 aa, Xenorhabdus bovienii
  Coding DNA sequence: Name=SeqID_762
  Gene classification: Gene name=EntF; Function=Non-ribosomal peptide synthetase modules and related proteins; Function class=Q Secondary metabolites biosynthesis, transport and catabolism
  Homolog annotation: Query=26..619bp; Hit=449..1033bp; Blast score =317; Percent Identity=34.0; E value=5e-86; Homolog= BS_dhbF COG1020
MNTHTHKAILHTAFTEQTSSPDDNINSSNISHRIAALEPWFDDVPSRLAKLAKTIPNDIAVSDPYETLAFGELQQRVENAANILHQYGVKMGSNVAIAAERGIPWFVTMLAVWRIGAVYIPLNTMMPEKRLNDILASLSESVLVSDDTVSAGLKASTLIPLHTLLNNTSEIINDEITENIDMLALGDHPAYVMFTSGSTGLPKAVQVQHDNLAACLCAFGKLLSVNQHDCMLALTTFSFDISLLELLLTVVHGGSIYITSIDTQRDAQALSQTLSDPQFTFAQATPVTWLMALNAGWKPRSKLSMLCGGEALSQDLADQLTASGGTLWNLYGPTETTIWSTAFRMRKGDKVQLGGPIPGTTITIVDKYLRPVPKGTVGEILIGGLGVTAGYRNNPTETAKRYVPDMTQKGKRAYLTGDMARMLEDGSLIYMGRQDDQVKVRGYRIELGEIETALRKQNGVQDAIIRVVGSGDLAKIQAFVLFDPNRVVPEEWVRETQVSLREILHEAWIPAEYYRIPYIPLTSSGKRDRKRLDEVAERLNASYDVVLPQTETEKQVYAIWRDLLATDVLGVTDNFFQVGGHSILVARMVERIEKAFSLRIPISGIYVEPTVARISSILDEMMEAYQANPASAGGVYHSEALIQQHAETLRKDVYLKESVRPDGLPHANWYQPDTVLLTGATGYLGLHLLEQLLKQTAARIICLCRDSDEEHARDRIKAGFDKYQIDVANGLERVDFIIGDLGQPRFGLLPETWAQLAENVDVIYHNGALVNFIYPYSALKSINVDGTRTALEFACTARLKHFHYVSSVNALFATESPRPFMEDDRAMSESVRDPSGYSGSKWVSEGIINIARQRGVPVSIYRPGLILGHTRTGAAQGNDYLVASLKGYLAMGFYPEHGLLLDIVPVDYVAASLVHISKQPESDGKFFNLFNPVQVSIRQFFDWVQEFGYILNPVPFNEGKEKILALDDTHPLYPLIPLIRDMTEKPYRALDPVYVHEIHPELELKQTLALLANTDIKCPVITAGYVHQVLQYLIDTGFLPAALPENFKPEAYLGTANRKRSHELDSRREQQKKVFGLA

SEQ ID NO: 6871 - protein, 53 aa, Xenorhabdus bovienii
  Coding DNA sequence: Name=SeqID_763
MAFHTPCHMEKMGWAAYSIELTKRIPGVEGMRQLGVLFASFCEANSVVNRLTL

SEQ ID NO: 6872 - protein, 367 aa, Xenorhabdus bovienii
  Coding DNA sequence: Name=SeqID_764
  Gene classification: Function=Uncharacterized BCR; Function class=S Function unknown
  Homolog annotation: Query=1..361bp; Hit=5..371bp; Blast score=360; Percent Identity=52.0; E value=1e-100; Homolog= PA0574 COG3177
MWIWQHEDWPDFQWDESVLAPVLRQIHFNQGLLLGRSETENTEQTTLDNLLASILYSCEIEGEKLNATSVRSSLANRLGISEEKPYPTSEQADGMAQIALDVVEKYNEPLTLERILKWHELMFPVGYTLFNPVKGGQLRNGGMEVVSGRIDKPVIHFEAPPAETLCQEIAKFIVWFHHSRHEENLDPVLRAAITHLWFVTLHPMEDGNGRITRFLTDLVLAQGESRSIRFYAMSVSICEQRKQYYDILEKTQRGGLDITDWMIWFLQTLNDTLIAKLKAIDGVVKKSRFWKRIDQTQLTEEQTKVLNRMLDGDFEQGINSSQYQKVAKVSRATATRHLSHLLELGYMEKTGAGGRSTRYVIHHDKKQ

SEQ ID NO: 6873 - protein, 366 aa, Xenorhabdus bovienii
  Coding DNA sequence: Name=SeqID_765
  Gene classification: Gene name=GldA; Function=Glycerol dehydrogenase and related enzymes; Function class=C Energy production and conversion
  Homolog annotation: Query=1..365bp; Hit=14..376bp; Blast score=412; Percent Identity=58.0; E value=1e-115; Homolog= ZgldA COG0371
MLKVIQSPSKYIQGPGALSHIGQYTKMLADHVFVIADNFVMSLIGDTVSKSLEEHAVTSHFEIFNGECSRGEIKRLSDISASNQCQAVIGIGGGKTLDTAKAIAHECKLPVIISPTIASTDAPTSALSVLYTELGEFDGYLLYPQNPNIVLMDTRIIAKAPVRLLVAGMGDALATYFEARANSAAHKPTMAGGATSNTGLALAKLCYDTLLAEGYKAKLAVEAGVSTPAVENIIEANTYLSGIGFESAGLAAAHAIHNGFTVLEECHHLYHGEKVAFGTLAQLMLENSPNEELETVLDFCVQVGLPVTLEQLGLRDSEKLHQKIMEVAKASCAEGETIHNMPFKVTPEQVHAAIMAADRMGMDWLY

SEQ ID NO: 6874 - protein, 222 aa, Xenorhabdus bovienii
  Coding DNA sequence: Name=SeqID_766
  Gene classification: Function=Uncharacterized ACR; Function class=S Function unknown
  Homolog annotation: Query=8..207bp; Hit=8..207bp; Blast score=258; Percent Identity=78.0; E value=3e-69; Homolog= ZyhhQ COG1738
MFHLTTQQKATALIWLSLFHILIITSSNYLVQLPVSIFGFHTTWGAFTFPFIFLATDLTVRIYGAPLARKIILTVMLPALLISYFISALFFQGTWQGFGALVTFNLFVARIAAASFMGYVLGQILDVGVFNRLRQKRRWWIAPTAAMFFGNLLDTLAFFFIAFYRSSDAFMATHWVEIALVDYAFKLFICMLFFLPAYGILLNLILKFSFSHSTDKTLVNNH

SEQ ID NO: 6875 - protein, 64 aa, Xenorhabdus bovienii
  Coding DNA sequence: Name=SeqID_767
MWKSESQINAVAFCCVVKWNILYLFDEWGKGTQKNKLSLPELSGKTHHTRVAQQKQSAAVDDIL

SEQ ID NO: 6876 - protein, 92 aa, Xenorhabdus bovienii
  Coding DNA sequence: Name=SeqID_768
  Gene classification: Gene name=SirA; Function=Predicted redox protein, regulator of disulfide bond formation; Function class=O Posttranslational modification, protein turnover, chaperones
  Homolog annotation: Query=9..87bp; Hit=1..79bp; Blast score=122; Percent Identity=73.0; E value=9e-29; Homolog= sirA COG0425
VFEPTEIVMSNVFANPDKTLDTQGLRCPEPVMMVRKIVRHMDAGQTLLIIADDPATTRDIPGFCRFMEHALIAQETGQTPYRYLIKKSENVA

SEQ ID NO: 6877 - protein, 767 aa, Xenorhabdus bovienii
  Coding DNA sequence: Name=SeqID_769
  Gene classification: Gene name=ZntA; Function=Cation transport ATPases; Function class=P Inorganic ion transport and metabolism
  Homolog annotation: Query=68..761bp; Hit=43..730bp; Blast score=786; Percent Identity=63.0; E value=0; Homolog= ZzntA COG2217
MFSIFKKHKQLQHGSLSYKNKEHQDKDHEHSHGSHGKEDKGSHDSHQHAQGHCSHDHAPTIRDTTPLELTANQRFNWIIHGMDCPSCAGKIENAVKKLPEAKQVKVLFTTEKLVVDADSDIRAAVEQAVKQAGFEIKQTDSTTKLPPAANHWKTFSPILILIALMVISWGIAKINPPTGQIAFIITTLIGLYPVATKAIKLIRSGTPFAIETLMSVAAIGALFIDATAEAAMVILLFKVGEVLESYAAGRARRGVSALMALVPEQALLVTGGEKKTVPAADLRPGDIIEIAPGARLPTDAELLSPFASFDESALTGESIPVERQQGEKVAAGCLSVDSAVQMRVISEPGHNAIDRILQLIEEAEERRAPIERFIDRFSRIYTPLIILFSVLVVVIPPLVLAEPWETWLYRGLTLLLIGCPCALVISTPAAITSALAAATRRGALIKGGAALEQLGSVTTIALDKTGTLTEGKPQVTEIEPVENISVETLLALAGAVESGSHHPLAKAILNAAENKGVTVVEAEHRKALSGIGVEGLLSGQKILVSAPERLPENTLSTAWKQRVTELESSGKTAVAVVQGEQFVGLIAMQDTLRQDAIDAIRALKKQGINAVMLTGDNPRAAAAIADQLGIDYRAGLLPEDKVKAVTELNEKHHTMMVGDGINDAPAMKAASIGVAMGSGTDVALETADAALTHNRLTGLPEMITLSRTTHYNIRQNITIALGLKAIFLITSLLGITGLWMAVLADSGATALVTANAIRLLRVKSQKR

SEQ ID NO: 6878 - protein, 89 aa, Xenorhabdus bovienii
  Coding DNA sequence: Name=SeqID_770
  Gene classification: Function=Predicted membrane protein; Function class=S Function unknown
  Homolog annotation: Query=1..88bp; Hit=1..89bp; Blast score=80; Percent Identity=51.0; E value=3e-16; Homolog= yhhL COG3776
MFIQLGKVIMVLVWGIMIFNLIHPFPNPLRYFMDIAMVFTVIMHAFQLLLLKNSQPKDQKFSVFLQTKIFFFGVFELLAWQKKQRQDKK

SEQ ID NO: 6879 - protein, 192 aa, Xenorhabdus bovienii
  Coding DNA sequence: Name=SeqID_771
  Gene classification: Function=N6-adenine-specific methylase; Function class=L DNA replication, recombination and repair
  Homolog annotation: Query=3..190bp; Hit=2..189bp; Blast score=271; Percent Identity=69.0; E value=4e-73; Homolog= ZyhhF COG0742
MTKKSQSTSLGQIRIIGGKWRGRKLPVPDSEGLRPTTDRVRETLFNWLMPIIQEARCLDCFSGSGALGFEALSRNASHATLLEYDRNVAKQLSANLALLKAENANVVQGNALQYLNQTGTPFDVVFLDPPFRKGMLVETINLLEANGWLAEESWIYVEAESESAATEAPSNWQLHREKIAGQVAYRLYIRRQ

SEQ ID NO: 6880 - protein, 448 aa, Xenorhabdus bovienii
  Coding DNA sequence: Name=SeqID_772
  Gene classification: Gene name=FtsY; Function=Signal recognition particle GTPase; Function class=N Cell motility and secretion
  Homolog annotation: Query=1..448bp; Hit=1..497bp; Blast score=472; Percent Identity=62.0; E value=1e-133; Homolog= ftsY COG0552
MAEEKKRGFFSWFGRGRQEKKQQEEQLEQDKSAAEEAEQQRLAEEVARRAAEEAEQQRLAEEAARRAAEEAEQQRLAEEAVRRAAEEAEQQRLAEEAARRAAEEAEQQRLAEEAARHAAEEAEQQHLVEEPSVLPKEQDRPSKEGFFARLKRSLVKTRQNLGSGFLGLFRGKKIDDDLFEELEEQLLVADVGVETTRKIINNLTAHASRKELKDAEALYTKLKEEMSDILAKVDKPLDIEGKSPYVILMVGVNGVGKTTTIGKLARQYQSQGKSVMLAAGDTFRAAAVEQLQVWGERNKIPVIAQHTGADPASVIFDAIQSAKAKGVDILIADTAGRLQNKSHLMEELKKIVRVMRKLDEETPHEIMLTLDACTGQNAVSQAKLFHEAVGLTGITLTKLDGTAKGGVIFAIADQFDIPIRYIGVGESIEDLRPFKADDFIEALFARED

SEQ ID NO: 6881 - protein, 221 aa, Xenorhabdus bovienii
  Coding DNA sequence: Name=SeqID_773
  Gene classification: Gene name=FtsE; Function=Predicted ATPase involved in cell division; Function class=D Cell division and chromosome partitioning
  Homolog annotation: Query=1..218bp; Hit=1..218bp; Blast score=368; Percent Identity=85.0; E value=1e-102; Homolog= ftsE COG2884
MIRFEQVSKAYLGGRQALQGVDFHLLPGEMAFLTGHSGAGKSTLLKLICGIERPSVGHIWFGGHDISRLKPRETPFLRRQIGMIFQDHHLLLDRTVYENVAMPLIISGASAEDIRRRVSAALDKVGLLDKAKNVPIQLSGGEQQRVGIARAVVNKPTVLLADEPTGNLDGELSEGIMRLFEEFNRVGVTVLMATHDVALIERRNYRILTLNQGRMQGGHHG

SEQ ID NO: 6882 - protein, 326 aa, Xenorhabdus bovienii
  Coding DNA sequence: Name=SeqID_774
  Gene classification: Gene name=FtsX; Function=Cell division protein; Function class=D Cell division and chromosome partitioning
  Homolog annotation: Query=8..326bp; Hit=33..352bp; Blast score=377; Percent Identity=61.0; E value=1e-104; Homolog= ftsX COG2177
MVKNVRHSAKKTTPPKPKSKSLKGGWRVQQRYAWKSTLSDMLRQPLATLLTIMVIAISLTLPSVFYIVWKNVNQAVEQWYPVPQLTVYLDKSLNDGGARQVIEQLKVIDGVKSVNYLSREEAENEFRAWSGFAGALNLLEENPLPAVAIISPQMDFQDSTVLTTLRDRVSQIKGIEEVRMDESWFTRLTALADLIGQIAAVIGILMVVALLLVIGNSVRLSIFSRRETINVMKLIGATDGFILRPFLNGGVLLGGLGAVFSLILSSLLVWKLSNVVTDVAGVFGTTFKLYGLGWDESLLLVLISGMIGWLAAWFATIQHLRRFRPE

SEQ ID NO: 6883 - protein, 284 aa, Xenorhabdus bovienii
  Coding DNA sequence: Name=SeqID_775
  Gene classification: Gene name=RpoD; Function=DNA-directed RNA polymerase sigma subunits (sigma70/sigma32); Function class=K Transcription
  Homolog annotation: Query=1..284bp; Hit=1..284bp; Blast score=452; Percent Identity=84.0; E value=1e-127; Homolog= rpoH COG0568
MTKEMQTLALVPQGSLEGYVRASNAYPMLSAEEEKELAERLHYQGDLDAAKKLILSHLRFVVHVARSYSGYGLPQADLIQEGNIGLMKAVRRFNPEVGVRLVSFAVHWIKAEIHEYVLRNWRIVKVATTKAQRKLFFNLRKAKQRLGWFNQDEVDLVAKELGVTSKDVREMESRMSAQDMAFDMSDDDSHDSQPVAPVLYLQDKASDFADGIEEDNWENHAADKLSLAMEGLDERSQDIIRARWLDDDNKSTLQELADKYGVSAERVRQLEKNAMKKLRLAIEA

SEQ ID NO: 6884 - protein, 379 aa, Xenorhabdus bovienii
  Coding DNA sequence: Name=SeqID_776
  Gene classification: Function=Glycerate kinase; Function class=G Carbohydrate transport and metabolism
  Homolog annotation: Query=1..372bp; Hit=1..372bp; Blast score=416; Percent Identity=63.0; E value=1e-116; Homolog= HI0091 COG1929
MKIVIAPDSFKESLSALQVAEAIEQGFREIFPQATYIRLPMADGGEGTVESLVAATGGQRISCSVTDPLGQPVDAFFGLLGDGKTAVIEMAAASGLHLVPMEHRNPLITTSYGTGELILAALEHGVQKLILGIGGSATNDGGAGMMQALGAKLWDGDSRILPLGGAALTRLESINLSSLDPRLNQLEITVACDVNNPLCGELGASAIFGPQKGATPEMVKVLDSALHHYGMKIESLTGKKVIDVAGAGAAGGMGASLLGCLDANLQSGIEIVINILKLEEAIQGADLVITGEGRMDSQTIQGKTPIGVARVAKKFGIPTIALVGGMSRDYHVVHQHGLDAVFSIVPGACSLSDALVNGADNLRVTARNVASVWRMAYSQ

SEQ ID NO: 6885 - protein, 133 aa, Xenorhabdus bovienii
  Coding DNA sequence: Name=SeqID_777
  Homolog annotation: Query=1..130bp; Hit=1..130bp; Blast score=156; Percent Identity=56.0; E value=7e-38; Homolog= ref|NP_931291.1|
MKLTIKPIRVLSPQDKIDLKKIWPEQDAQEWEVLLAGDQKLFVAQFNDRLLAAVKVTLNSSTGILEDFCVREVTRRRGVGSYLLEQVKAAFPEINRWEWSLNHFPDIHAPALSGFMAASDFRYDAQKNDYYCE

SEQ ID NO: 6886 - protein, 370 aa, Xenorhabdus bovienii
  Coding DNA sequence: Name=SeqID_778
  Homolog annotation: Query=25..370bp; Hit=2..333bp; Blast score=247; Percent Identity=40.0; E value=3e-64; Homolog= ref|NP_930525.1|
MKLTEISLKGFKSIDNVKGQTIVFGDITLLLGANGSGKSNLISFFRMLVSMTSGDLQKYIGRQGVSQLLHYGSKVTESMNFSIRLEDEAEWDTYEATLSYALSDRLFFSDECVTSQKQNNATQSKYVLPRDGSESGLHSDKHTTSKEITAFLAGIKTFQFHDTSDTSRIKDRTYVDDASYLRSDAGNLAAFLKMMKDNAQYRTYYDRIVRHIRKVMPQFEDFVLDALPGNELFVRLNWSDNYRPDHLFGPEQISGGSLRFMALTVLLLQPPELLPKVIVLDEPELGLHPEAITELAGMIKRASKNTQIVVATQSTRLVDEFDAEQLIIVERDNQTGASTFKKLKHESLSEWLQRYSLSELWEKNVLGGQP

SEQ ID NO: 6887 - protein, 233 aa, Xenorhabdus bovienii
  Coding DNA sequence: Name=SeqID_779
  Homolog annotation: Query=10..232bp; Hit=12..226bp; Blast score=155; Percent Identity=40.0; E value=4e-37; Homolog= ref|NP_930524.1|
MGEERSWRAAVIRLHVTAEGQTEKAFVSRVLAPHLATFGVYADARCVLTGRDKRVSKEYRGGLLSYQKAKADIQTWMKEDRDRNCRFTTMFDLYALPDDFPNYRQANQQDAYSRVRILEDAFLNDVKDERFIPYIQLHEFEALIFSDPAKLDWEYLEHDTAIASLVSMAEDQNPELINDGKETAPSKRIFNALSDYDKVSAGVSVVEHIGLQKLREKCRHFNEWVTQLENLSR

SEQ ID NO: 6888 - protein, 69 aa, Xenorhabdus bovienii
  Coding DNA sequence: Name=SeqID_780
VKSFEYYYQREFDYLRQLAKIVSEENPHLRDVLGGGDPDVERLFEGASVLTARHWITWRSASSLAPAFL

SEQ ID NO: 6889 - protein, 624 aa, Xenorhabdus bovienii
  Coding DNA sequence: Name=SeqID_781
  Gene classification: Gene name=VgrG; Function=Uncharacterized BCR; Function class=S Function unknown
  Homolog annotation: Query=13..575bp; Hit=67..622bp; Blast score=361; Percent Identity=38.0; E value=1e-99; Homolog= VCA0018 COG3501
VALSEQLGTSVSLTVMRDGVTERTVNGIVAGAEQGNTDGLRTYYTFIVRPEMWLMTLNQDSRIFHYQSVPDILARLLKEHRIKAESKFYKDHQQHAIREYTTQKRESAYDFWCRLAAEEGIMFWLEEDKLFYSNAHLGMLAALTLTYNVQANTDNSDSTAWQWNYGEYLCPDETLHKDNNFLRPSYPLQHTAALEKGMGHSVFESYGRFQKDAEGRPFTQLRLEQLQNQSKVGKASTNCIKLRPGRIFVLQSHPIGAMNDRWQIVTVSHQGHQPQASGEAGEGTTLINQISFIPGRQDWRPPFQYKPLADGDEVATVVGPEGEEIYVDKHGAIKVHFHWNRYDEADDRASCWVRVAQGWNGDGYGFMAIPRIGQEVIVSYLNGDIDRPIVTGCTYNGRNRPPLDLPAEKTRTTFKTRTHKGEGFNELRFEDAKGSEEIYIHAQKDQLIEINHDKTQRVGHDESHYVLNNRKHEIGHDEFIRIMHEQHIQIDLDQFETITKDRKTRINNNWQENIFADHLQEVGRDKTAKINNNYTLNVVNNIQSLTKVHTLQASESVLIKGKAGSIKLGGSGVTITGKITLQGDVSVTGGSPGTVPSLSGSANEGLVMAEDCREKARKPQESSE

SEQ ID NO: 6890 - protein, 398 aa, Xenorhabdus bovienii
  Coding DNA sequence: Name=SeqID_782
MSWIPDYAEHWVVDYAYTTPQGEHDSARAIVHATSQPQALSALAEYVLQAGDSPGQYQSIQPLPEYLAASAEVELPLLRQFRQGVERNARVIPLNAHNNNPLLPAARGVLQFAVTETLPARERGQYRYMVIDATVYRRVMGSFIVPDLMVSNLRWESLFQGETQITLEDSAPYLVELTDDPTVHSAFQQKITQPITPEPGIFIDSDQPFPVIRNHLRKFTYLRNEQHQSWVFYRFYVPQGLLPLLKSLPDEQLMHFMRPIMRIGYFDSQTGQYYALSVAENSLDQEKTAPVVINRSLVGILAGQTQARAVAQIVKFIAETQPELSPEQQEQLPAFVVQQANLACLAGFAHQRSILYLVAGRSLARDNEALWQRAWQHACVEAQALACYEYCFKNRALS

SEQ ID NO: 6891 - protein, 1041 aa, Xenorhabdus bovienii
  Coding DNA sequence: Name=SeqID_783
MEKSILTNAGDALETAAKKAAKTFEKMVDEAKTRIPHELDMDTVVRPCDANIRPVYPVRYAYMNFFGDTWIDAQLPPPINTFIDPYDDSLSASVLGGYSIRMPRPGWIYVKEEGAIKTRGSQQGGKLLIFKFSPEIVTLEGKRGMVTKYTKYEQKAGSSSWEEIHPASGTAGLGYPFLAIDKDVTQISLIYSEVELAKSVLNKMDNDKNFRKNAMQFVDLDSEVSDYAIDARQEHFDGLVEDFKDPEKQFQAYKNQLADPLLHAADLGDITTEGSFFMDADMEMRYIDSLICPYYKDKAKIVVLHDPVGYQRDILMAYKLLNLWELSYSATNMYPLTIGNFVEILSASKNKEIKKCVEECIHQENWKTWWPKLTTPIKSVKDRKKEILEFYKCFFESEMIAGKLGGLTHYFKNFFSVSDKKDIYTEGDAKEFERFCILHAELMEPLKHSEEGLLAMESIIAGPLAIDGNSAWEVALNGIVNSLGHDGVDKGSIAKFLNRGIDIILSVVGNLLARLYVFTTELSYKGILHLHVLSVKQVTHKLVPKILDYLGLEIKQGKYFELTEKEYYKFLKEIEEYENQGVSGKIKKGMDHAESGLKRFVGKKVFDWSNRLDNYNNNIKIKIPLIKFKRPELNPQFKFFYNENKSAGYLLSSGLSGLDLFMKSYMLYKLTSMSRFEKNAPFNANRLPYYYVSSYANTILGGLIAAKGVSAIGGDAIKVAASLAGKLNSPAAKALLDSASRRLLLESALITKWVNGGLITTGFVSGALSYYDAYNSFGFGNDKEAYSHISIGTGSIIMAVGWSMAVAASEVTFGISLLIALGASLMLGGTFAAIYFNWVDLETLLKNCFWGNGEKYAFWSTDKDRLSLDSQLKRMRNFDEEIKNKYLVEKQVFLNLFIKPILKIENNKQGKMIYKFILPSFKWGESDIYHEVMPSGLSDGYSDPDASITERSYGRYHYFVAKDKFDKAIDIARKNRENLIYDEESGLTTLTVEVDEQYSVYMKVFWYYKPTEDIVSPLHYKWGKEPTLENAVYGYEDEVLR

SEQ ID NO: 6892 - protein, 322 aa, Xenorhabdus bovienii
  Coding DNA sequence: Name=SeqID_784
MSILIKKIFKKIFRVKTPPTEPLSTFGDPVLEEKLILLDNKTVKRAGFLDAINSKECHFRHNLIRARKEVIIPVFVGFMLGFCFFINNFVKVWKANEEDYLWFLKDAKESYGEQFYLNPNAPAYTKSLQIISDDKKVSLLEYLYIKYYKDSFYGEERARRYLIIDASFGLFFLSANILIISIFLRLRKPANFIIDHEKQLFYTWKKGKVYVSRYKELGVAFANNILHFKCYGLNEKNELTYQFFIPYLSLFNSDEDKAYIFAFMSKYLLQGKEAVSSVDFKRQERLPWFRKQIKPADWETQITAIVAELDRLGPPKGATDPK

SEQ ID NO: 6893 - protein, 68 aa, Xenorhabdus bovienii
  Coding DNA sequence: Name=SeqID_785
  Homolog annotation: Query=5..67bp; Hit=278..340bp; Blast score=72; Percent Identity=46.0; E value=1e-12; Homolog= ref|NP_927501.1|
VDTSFYLSSPDITPEFIGASTREHWHLENSLHWLLDVVYQEDVCRVHDMNEAESLAIIRRLALNLAKL

SEQ ID NO: 6894 - protein, 37 aa, Xenorhabdus bovienii
  Coding DNA sequence: Name=SeqID_786
MLTVGIMMITLLFTVIKISVKEKEALYASLIYKSYSE

SEQ ID NO: 6895 - protein, 370 aa, Xenorhabdus bovienii
  Coding DNA sequence: Name=SeqID_787
  Gene classification: Gene name=LivK; Function=ABC-type branched-chain amino acid transport systems, periplasmic component; Function class=E Amino acid transport and metabolism
  Homolog annotation: Query=7..370bp; Hit=6..369bp; Blast score=548; Percent Identity=74.0; E value=1e-156; Homolog= ZlivK COG0683
MKISKTKTVLAGFIAMAISQPVWAEEIKVAVVGAMSGPVAQYGDMQFTGARQAIADINAKGGINGDKLVGVEYDDACDPKQAVAVANKIINDNIRYVIGHLCSSSTQPASDIYEDEGVMMITPAATNADLTTRGYQTILRTTGLDSDQGPTAAIFIGNSIKPQRLAIVHDKQQYGEGLARSVRDSLKKAGITAVLFEGVTAGDKDFSALVARLKKENVDFVYFGGYYPEMGQILRQAKQAGLTARFMGPEGVGNTSLSNIAGAASEGMLVTLPKRYDQVLANKAIVDAIKAKKQDPTGPFVWTTYAALQSLSTAMKRTGSAEPAELAADLKANPVDTAMGNLSWDAKGDLKGFEFGVFEWHADGTSTAAK

SEQ ID NO: 6896 - protein, 308 aa, Xenorhabdus bovienii
  Coding DNA sequence: Name=SeqID_788
  Gene classification: Gene name=LivM; Function=Branched-chain amino acid ABC-type transport system, permease components; Function class =E Amino acid transport and metabolism
  Homolog annotation: Query=1..308bp; Hit=1..308bp; Blast score=416; Percent Identity=85.0; E value=1e-116; Homolog= livH COG0559
MLEHILYFIQQMLNGLTLGSTYALIAIGYTMVYGIIGMINFAHGEVYMIGSYLSFIVIAALMMMGIDVGWLLIATAFLASIIIASAYGWSIERVAYRPVRHSKRLIALISAIGMSIFLQNYVSLSQGSRDLALPGLISGQWTLGESNGFSASVTAMQLTIWIVTIVAMLVLTLFIRYSRMGRACRACAEDLKMASLLGINTDRVISMTFVIGAAMAAVAGVLLGQFYGVINPYIGFMAGMKAFTAAVLGGIGSIPGAMLGGLILGVSEALTSAYLSTEYKDVVSFALLIGVLLVMPTGILGRPEVEKV

SEQ ID NO: 6897 - protein, 424 aa, Xenorhabdus bovienii
  Coding DNA sequence: Name=SeqID_789
  Gene classification: Gene name=LivM; Function=Branched-chain amino acid ABC-type transport system, permease components; Function class =E Amino acid transport and metabolism
  Homolog annotation: Query=1..415bp; Hit=1..415bp; Blast score=550; Percent Identity=77.0; E value=1e-156; Homolog= livM COG0559
MKPANWINAIIATVTLFILAAFMMGMQLSLQGTKLVVQRADEVRWMWISIGCAIVFLFQLCRPMIQQTVQKIPSKSWKLADLDGSTRKQQLLGVLIVAAAIIWPFVVSRGSVDIATLTLIYVMLGLGLNVVVGLSGLLVLGYAGFYAIGAYTYALLNHYYGLGFWQSLPLAGLTAALFGLLLGFPVLRLRGDYLAIVTLGFGEIVRILLLNNTEITGGPNGISQIPKPTLFGLEFNRSVKEGGWDTFHNFFGLKYDPSDRIIFLYLVALLLVVLTLFVINRLLRMPLGRAWEALREDEIACRSLGLSPTCIKLTALTISAAFAGIAGTLFAARQGFISPESFTFAESAFVLAVVVLGGMGSQTAVILSAIILVVSREMMRDLNEYSMLLLGALMVLMMIWRPQGLLPMKRRQLELSTEQRDHKA

SEQ ID NO: 6898 - protein, 257 aa, Xenorhabdus bovienii
  Coding DNA sequence: Name=SeqID_790
  Gene classification: Gene name=LivG; Function=ABC-type branched-chain amino acid transport systems, ATPase component; Function class=E Amino acid transport and metabolism
  Homolog annotation: Query=5..256bp; Hit=4..255bp; Blast score=385; Percent Identity=78.0; E value=1e-107; Homolog= livG COG0411
MNATPLLQVSGLTMRFGGLLAVDNVELALNQGEIVSLIGPNGAGKTTIFNCLTGFYRPTCGMIKLREKHLEGLSGQEIARLGVIRTFQHVRLFREMTVIENLLVAQHRFLKNSIFAGLLKTPAFRRAEAEALNSAAIWLERVGLLPLANRQAGNLAYGQQRRLEIARCMVTRPEILMLDEPAAGLNPKETEALDALIVELRTQYQVAILLIEHDMKLVMGISDRIYVVNQGAPLAQGRPEEIRHNPEVIKAYLGEAY

SEQ ID NO: 6899 - protein, 233 aa, Xenorhabdus bovienii
  Coding DNA sequence: Name=SeqID_791
  Gene classification: Gene name=LivF; Function=ABC-type branched-chain amino acid transport systems, ATPase component; Function class=E Amino acid transport and metabolism
  Homolog annotation: Query=1..233bp; Hit=9..241bp; Blast score=369; Percent Identity=82.0; E value=1e-102; Homolog= ZlivF COG0410
MLEFNQVSTHYGKIQALHQVSLNIQQGEIVTLIGANGAGKTTLLSTLCGEPRATEGCIIFRGNEITQWQTARIMREAIAIVPEGRRVFARMTVEENLAMGGFFAHKQQYHERITRVYQLFPRLLERRSQRSGTMSGGEQQMLAIGRALMSQPQLLLLDEPSLGLAPIIIMQIFDTIQQLRDEGMTIFLVEQNANQALKLADRGYVLENGHIVLEDRGAALLANEAVRSAYLGG

SEQ ID NO: 6900 - protein, 154 aa, Xenorhabdus bovienii
  Coding DNA sequence: Name=SeqID_792
MKDTKLVLPDELKAEAIKAFCDSMSGKSSSKNIDKTIKMMFDKNDDYLFSASVSIISEIIHYNVTATLDDGSKKFSGGAWGASTAGYADYWSGTVTTANPTDLFAKTVHFWAYTWTFAGKLIFQDSNYYPLGGFMGKGLGTLTGLAKGDGDWNS

SEQ ID NO: 6901 - protein, 66 aa, Xenorhabdus bovienii
  Coding DNA sequence: Name=SeqID_793
  Homolog annotation: Query=1..66bp; Hit=1..66bp; Blast score=76; Percent Identity=57.0; E value=8e-14; Homolog= ref|NP_929974.1|
MLHVADYPQMKQIAWYLKDDAELDEKEALAFYERNWKYVEPEALEPHEKALIDKLVKEYGGGILNV

SEQ ID NO: 6902 - protein, 625 aa, Xenorhabdus bovienii
  Coding DNA sequence: Name=SeqID_794
  Gene classification: Gene name=ChiA; Function=Chitinase; Function class=G Carbohydrate transport and metabolism
  Homolog annotation: Query=146..590bp; Hit=156..587bp; Blast score =131; Percent Identity=30.0; E value=2e-30; Homolog= VCA0027_1 COG3325
MTNKYTYTSSKAMSDISDVIGDPLTAWKQQEGGRVYNVIFNSNVYTNTYWVERWHVPGQSGQESSPHNAWQYVRAATAEEINAHGNPTEGTVNPKEEIPSPVLQSDRYTEETYEKVKYKPDGSGTNLSYTATRVCKPMYNQYERDPAKPKLSAYITDWCQYDARLDDKNENPEDRGRGFDLSTIDPTTYDKLIFSFLGICGDIGVKKEKVNEVWKGWNSQTNQKITEGHIVPLDPYGDLGTARNVGLPESSKNTSINAGTFLPYYQQSKAAGLLGGLRELQKRARAAGHKLELAFSIGGWSLSSYFSKMAEDKNQRTVFINSVVDFFERFPMFSCVDIDWEYPGAAGDVHNIISEDDGKNYALLVKDLRIKLDDQFGIGSKEISIACSGVKAKLAKSNIAELVKNGLDNIFLMSYDFFGTGWAAYIGHHSNLYSPNEPDPNGEYDLSAEAAINYLHQDLGIPLSIINLGYANYGRSGKGAKLETRLYDKPGDALGTMEKGAPEFFDIVNNYMDSEHTLSTGKNEFVLMTDTNANADFLFSEKQGHFISLDTPRTVKQKGEYVTEHQLGGIFSWSGDQDCGLLANAAREGMGYIAKSNHETIDMGPLYNPGKPYYLKSLRELKSSR

SEQ ID NO: 6903 - protein, 1235 aa, Xenorhabdus bovienii
  Coding DNA sequence: Name=SeqID_795
  Homolog annotation: Query=1..1230bp; Hit=135..1358bp; Blast score =1736; Percent Identity=71.0; E value=0; Homolog= ref|NP_929696.1|
LESVLNQGKLTDNVAQKAVLGYLNNFEEVSNLEIISGYEDGIDLANDKTYFIAKTRTQPYRYFWRTLDMKQRNTDSNELYPTAWSEWKPISVPLENARNGVVRPVIMNNRLYISWFEVSKEEEKNKNDESKTIIRYRTKLNLAHLGFDGTWSSGTTVREEVLDHAMDKMIAVLDRTEKEDRLALVAFTRLKGKNSEGPYDYDIVFSYICDNMLMASTDLPPSTTKLSDQDDYGNKLVWFFFREPQNGGMDEFKQLILYPVHINRKWPIEKERTFEGSLGNKEDFDLKADYLEDSLDMYLTSISTYKYDFSLSKNILYCIWLEDKNKNRCWLDYKVLTEEDFKQGKIEFSVRVKRCHSDDLSDITIVTGFSLPKANADDIGGRIRVILSVGRRVREKFQIKQTKQTQYLQFPENPPTPVWYADKQIRLNTLFAKELVSKASQKLDLVLSWDTQNLPEESISGSGTEPIDLKGANGIYFWVLFFHMPFMVAWRFNVEQRYEEANRWLKYIFDPYENEDKPALKQGKPRYWNSRPLIDEPKKNYSLMQPSDPDAIASGEPIHYRKAIFYFLVRNLIDDGDMEYRKLQPTARTIARLSYATASSLLGRRPDVQLASFWQPLSLEDALYRYDNSELRQLEMQSQPLPHIPVVHDNTIRALDNELFMKPINNELTEIWDRMENRIYNLRHNLTLDGKEINMALYDEKISPRDLMNLRYQRVVTARNASRMNFKTPNYRFEPMLARARAGVETMIQFGGTLLSLLERKDSLSFEKFQMLQSSDLYRFSIDLQQQEININQASLEVLQVSKKSAQERHEHFKGLYDENISSTEQQVIELQSQSASALLTAQTLRTGAAALDMLPNIYGLAVGGSRWGAALNAAAEMIMIKHQSDSIKADSLNVSESYRRRRQEWEVQYKQAEWEVNSIDQQINVQNLQLTASMKRLAQVEAEQQKSLALLDYFSSRFTNESLYTWMISQLSNLYLQAYDAVSSLCLSAEASLQYELDSEQTFIEGSSWNDLYQGLMSGETLKLALQRMERAYVEQNSRLQEITKTISLKALRKTAWESDLATLKQHSPITFNLQESDFAKDYPNLANRRIKSVSVSLPMLIGPYEDICAQLSLGVNTRMVKADIQTMEKLVKEGINADSPYLARSIHPNQQISLSTGINDSGMFTLNFDDERFLPFEGACVESSWTFGFTNNSQNLDSLTDVILHVRYTAKIGSSTFGKAVQKLLVEQKITDS

SEQ ID NO: 6904 - protein, 110 aa, Xenorhabdus bovienii
  Coding DNA sequence: Name=SeqID_796
  Homolog annotation: Query=1..110bp; Hit=1..110bp; Blast score=154; Percent Identity=83.0; E value=2e-37; Homolog= ref|NP_929696.1|
MSNSIEAKLQEDLRDALVDYYLGQIVPKGKNFQFYRDKIKNVDDLYDFLLLDTQVSSKVITSRVSHVTQSIQQYINRIVLNLEPGLSMTQEETYDWQEFANRYGYWSANQ

SEQ ID NO: 6905 - protein, 818 aa, Xenorhabdus bovienii
  Coding DNA sequence: Name=SeqID_797
  Homolog annotation: Query=1..665bp; Hit=1..664bp; Blast score=827; Percent Identity=61.0; E value=0; Homolog= ref|NP_929697.1|
MDKNHNYSDEQQNMKKVSPLLTAVAEISLPEIPSPEKYSLTTVKQHNTPPSVSLVDSLRNLGYHSIFDIVSLSKQRFIKRHNESLAGHAEIIFDKAVSMANQLVQYYRQNPLRQYDGQTAAFLSTTTDNQNTNEQTGKLPDYSGLFPEPWDDFCQPDAIESLDSPANYLLDLYKFIQQIEVDGTNQAILLASRRSDISHLMLDSDALYKELPALTIVNDVLSESARIYINQTGEANKPVNQVLGETRFPFTLSYNLPTQQINRRLAESKNELGTVIRQVDTHFPWHTEISKYDQILLAYSQLSNEQISLLTEAAPFSQNLLSRDQLIKAYYGSSTTELVPDKDISRHAYIVAQDDSVEGPIKLVENSPNAYDRISITCKNQADKTISVKLRAENVLTYYRVKARMEPFDNSPPFSRQLKLTYVESDNSDIGNLDDGPYFGNMTIYAATPKETPSGENQPTGPIDGIVFQAMSYRLAIAKSGTSSSELSPQANDFFINNYGLSEEESAQLKKIAIFGDQTGTQVTHIENLFSSGNYRPIVSPNAHFSNPIFFNGQSTATFPAAYHYGGVYINAGQQDALEIIRADNGREIKAVSNFRYDRLNRFVRLQRWLGLPYHQLDLLLASGIKAEADNLDMSITDNVLKELGLFRHLNKNLLLLRLTKPEWLGLSNSKTSNSLSLNEIYLLTRYQDFVNNANQNEDKIHDYFSYANKPQANGKAVKDNNDESEKCAEILADILGWNADEIYLACTLRELTPPQAKNLPHIDWLRRLQQLAVTTSLSVKTLWDASTLTLNTDFSLYQSVGEAVMAALKTQGDNENV

SEQ ID NO: 6906 - protein, 546 aa, Xenorhabdus bovienii
  Coding DNA sequence: Name=SeqID_798
  Gene classification: Gene name=ChiA; Function=Chitinase; Function class=G Carbohydrate transport and metabolism
  Homolog annotation: Query=75..510bp; Hit=161..587bp; Blast score=132; Percent Identity=27.0; E value=7e-31; Homolog= VCA0027_1 COG3325
MDNTEKDTESKLVYNTDPGYQHPSPVQGYGKEATQKTYQLNGYNPATSTDILTYTPTRMAKTVFNTYNDDDEFSIACYFTDWAQYDARGTIEFPTDEQFKTQGGRGADLTRIKGDSTNGSPFKKLIFSFAGIVGDEGPKKTTILSAAKGWGFGADEVETLKNYTGWPIPIDPWADVSAYFNCGFDSGAFDPYPTIYNQDKAKGLLGGFNSLKKADPNLEVSVSIGGWSMSGAFYDICRSEPYRKQFIDGIRDLFSRFSMFNHIDIDWEYPGSAGMGNQFSADDYVYYKKLIEELTAANIPNLQGISIAASADPKKIDDAHIPELMKAGVTGINLMTYDFFTLGDGKLSHHTNLYRNKDDQHSKYSIDDAVQHLITLGVDKKKIFIGYAGYTRNAKGADITSKSPLQGSYNSQGNIVGTFESAVIEWTDVIYNYVDFENGIGRNGYEIIQDSVAKADYLYNKDLKVFMSLDTPRSVREKARYVKEKGLGGLFIWSGDQDNGLLTNAAHEGLGRTVKKSVIDMSPFYFDNDDLPSYDKPKEPQCKDCV

SEQ ID NO: 6907 - protein, 396 aa, Xenorhabdus bovienii
  Coding DNA sequence: Name=SeqID_799
  Gene classification: Gene name=ProP; Function=77 Permeases of the major facilitator superfamily; Function class=G Carbohydrate transport and metabolism
  Homolog annotation: Query=13..362bp; Hit=11..362bp; Blast score=248; Percent Identity=39.0; E value=6e-66; Homolog= BS_yvmA COG0477
MNSQTSSRNLKTIFYLVCFSAFLGSLAQNIYTPVIPLIKVVFNTSLPLVNLTISAFTFVLAVMQLVYGPLIDSKGRKTVLLPSLVIFVMGSLGCAMTTDIYWLIFFRVIQAIGLGAIPVVAATIIGDLYEGQQRAKAMSTYQMLLALTPAVGPLFGGYLAELNGYVAIFQCLAIIGGLLIIGNLFWLPETKPELPTQNKKMKDHFHQILSNNISQSVFCISFMLFYCYFCLLTFLPIILSSEYHFSPADIGWMFIPMSLAMIGGSYSYRMIHQHVSQKRALIITSLLNLFIILIFAMTYSMSIAVLVTITVFYGFTLGLSMPTHATLLISEFVEERATAIGLYNFIRYTGMSAGPMISSFLLFDNHYEWIFIAGALLFALAIGLAILILKSRYQPN

SEQ ID NO: 6908 - protein, 100 aa, Xenorhabdus bovienii
  Coding DNA sequence: Name=SeqID_800
  Gene classification: Gene name=HipB; Function=Predicted transcriptional regulators; Function class=K Transcription
  Homolog annotation: Query=5..68bp; Hit=14..77bp; Blast score=59; Percent Identity=40.0; E value=5e-10; Homolog= CC2330 COG1396
MEEANLLVGQRIQAKRKELSMTATSLAKKIGISQQQLSRYETGKNRINIVHLVEITILLDTPISWFFEDCYKDKKEGSTVNKLTDQYIPIAETVIGKDGR

SEQ ID NO: 6909 - protein, 291 aa, Xenorhabdus bovienii
  Coding DNA sequence: Name=SeqID_801
  Gene classification: Gene name=MurI; Function=Glutamate racemase; Function class=M Cell envelope biogenesis, outer membrane
  Homolog annotation: Query=1..290bp; Hit=1..286bp; Blast score=361; Percent Identity=65.0; E value=1e-100; Homolog= murI COG0796
MRQRMAIAPQAENTFSLEATTSDLPKTARPTILVFDSGVGGLSVYQEIRQLLPELHYIYAFDNEAFPYGEKTAEVIIERVVRVVDEIQKRHPLAIVIIACNTASTVSLPALRERFSFPVVGVVPAIKPAAKLTCNRVIGLLATRATVNRDYTKELITRFATDCQVHSIGSAELVELAERKLHGEKIPLEILEKILKPWLRMREPPDTVILGCTHFPLIAEELSQVLPDGTRLIDSGAAIARRTVWLVKNQNNLFLTTADNLAYCTKIDLNSEALRPVLRDYGFLTLEKLAT

SEQ ID NO: 6910 - protein, 616 aa, Xenorhabdus bovienii
  Coding DNA sequence: Name=SeqID_802
  Gene classification: Gene name=CirA; Function=Outer membrane receptor proteins, mostly Fe transport; Function class=P Inorganic ion transport and metabolism
  Homolog annotation: Query=5..616bp; Hit=4..614bp; Blast score=689; Percent Identity=57.0; E value=0; Homolog= ZbtuB COG1629
MTNNKRILLSAASVAVFSSWSHFAAADNQDPLVVTANRFKQPIPSVLAPMTVVTREEIDRWQSSSLVDVLRRLPSIDIAQNGGIGQHASLFVRGTESHHTLVLVDGIRLNQAGITGAADYSQIPLSMVQRIEYIRGARSAVYGSDAIGGVINIITKREQQGTTLNAGIGSHGYQNYNGSTQQKLGENTLLTAAAGYTYTKGFDVVAGGGTGGHRQPDSDGFMSKMLWLGVDHKFNDQFSGFARAHGLNNRTAYDAYYDSDNQMLIDTRELFSRTYDAGLQFTQGIYSAQWIASYSHVKDYNYDPKYGRYGKGSNLSNSKQYNVQWGNSWQVGHGAISGGVDWKRESVAAGSNNIPVQKDVDNTGLYLTTQQKIHDVTLEGAVRSDRHSEYNWNTTWQTGMGWEFIDGYRLIVSYGTAFKAPTLNQLYSKWGNESLKPEKSKQWEGGIEGLTGPLNWRLSVYHNDIEQLINFANNHYENIGKAKIKGVEWTGTMDTGIFQHQLTLQYVDPRDGNNKRLARRAKQQVKYQLDWELYNIDWGVTYQYIGQRDDADYSVYPPKPLKLGGVSLWDISASYPITNHLTIRARIANLFDKNYETAYGYRTPGREYFLTGSYNF

SEQ ID NO: 6911 - protein, 34 aa, Xenorhabdus bovienii
  Coding DNA sequence: Name=SeqID_803
MSSFLAHEPLFDRGSFWTVSRLHRSMTLYSLDSI

SEQ ID NO: 6912 - protein, 395 aa, Xenorhabdus bovienii
  Coding DNA sequence: Name=SeqID_804
  Gene classification: Gene name=TrmA; Function=SAM-dependent methyltransferases related to tRNA (uracil-5-)-methyltransferase; Function class=J Translation, ribosomal structure and biogenesis
  Homolog annotation: Query=34..391bp; Hit=6..363bp; Blast score=581; Percent Identity=79.0; E value=1e-166; Homolog= ZtrmA COG2265
MCQKTGHPLHFPYNAARKFFLTRPYENQIMQNVLPTEDYENQLMEKVHRLKGMMMPFSAPEPEVFRSPASHYRMRAEFRIWHEQDALYHIMFDQQTKQRIRIDQFPVANELINQMMQAIIAGVKDNSLLRHKLFQVDYLSTLSNKIIVSLLYHKKLNDEWREHAITLRDQLKANGFDVQLIGRASKTKIMLDHDYIDEELPIAGKTMIYRQVENSFTQPNASINIHMLEWAMGITKGAKGDLLELYCGNGNFSLALAQNFDRVLATEIAKPSVAAAQFNIEANQIDNVQIIRMSAEEFTQAMNGEREFNRLHGIDLKSYQCETIFVDPPRSGLDDATVKMVQGYPQILYISCNPETLSQNLEILTQTHKISRLALFDQFPYTHHMECGVLLEKRN

SEQ ID NO: 6913 - protein, 125 aa, Xenorhabdus bovienii
  Coding DNA sequence: Name=SeqID_805
  Homolog annotation: Query=1..118bp; Hit=1..118bp; Blast score=155; Percent Identity=74.0; E value=9e-38; Homolog= ref|NP_931899.1|
MEQYRQDKSTMLLALIVGLATHGTFSAFFNSLVPFSIFPIIALVLSLYCLHHRYLNYPMADGLPKLAAGCFFLGIFIYSAIIRVEYPEIGSNFLPVVIDTALVFWIYRKIKGRKQQAILTSESHG

SEQ ID NO: 6914 - protein, 216 aa, Xenorhabdus bovienii
  Coding DNA sequence: Name=SeqID_806
  Gene classification: Gene name=AcrR; Function=Transcriptional regulator; Function class=K Transcription
  Homolog annotation: Query=4..208bp; Hit=19..223bp; Blast score=323; Percent Identity=92.0; E value=6e-89; Homolog= yijC COG1309
VSNVTGVRAKQKEKTRRSLIEAAFSQLSAERSFTSLSLREVAREAGIAPTSFYRHFRDVDELGLTMVDESGLMLRQLMRQARQRIAKGGSVIRTSVSTFMEFIGNNPNAFRLLLRERSGTSAEFRAAVAREIQHFIAELADYLEQASHMPRHFTEIQAEAMVTIVFSAGAEALDIDEEKRRRLEERLVLQLRLISKGAYYWYRREQEKKLSLKPLE

SEQ ID NO: 6915 - protein, 64 aa, Xenorhabdus bovienii
  Coding DNA sequence: Name=SeqID_807
LAECSFNQRTTGFFFLFRSDTSYVTHHNPDISIRLYNEANISDSAVFAVIVLLKLLSHIPRFHF

SEQ ID NO: 6916 - protein, 465 aa, Xenorhabdus bovienii
  Coding DNA sequence: Name=SeqID_808
  Gene classification: Gene name=Lpd; Function=Dihydrolipoamide dehydrogenase/glutathione oxidoreductase and related enzymes; Function class=C Energy production and conversion
  Homolog annotation: Query=22..465bp; Hit=1..444bp; Blast score=765; Percent Identity=81.0; E value=0; Homolog= udhA COG1249
MQYTHFDAIVIGSGPGGEGAAMGLVKQGKNVAVIERYNSVGGGCTHWGTIPSKALRHAVSRIIEFNQNPLYSDNSRILRSSFSEILRHADVVISQQTKMRQGFYERNRCQMFAGEAAFIDEHRVSVRYADGSVDILSADKIIIATGSRPYCPPDVDFTHSRIYNSDTILQLDHEPRHVIIYGAGVIGCEYASIFRGLGVKVDLINTRDHLLSFLDQEMSDALSYHFWNSGTVIRHNEEYEKIEGLDDGVIVHLKSGKKVKADCLLYANGRTGNTDKLGLENVGLETDSRGLLKVNRVYQSSNENIYAVGDVIGYPSLASAAYDQGRIAAKAIMTGNANLHLVEDIPTGIYTIPEISSIGKTEQQLTAMKIPYEVGRAQFKHLARAQIAGMNVGSIKILFHRETKQILGIHCFGERAAEIIHIGQAIMEQKGEGNTIEYFVNTTFNYPTMAEAYRVAALNGLNRLF

SEQ ID NO: 6917 - protein, 305 aa, Xenorhabdus bovienii
  Coding DNA sequence: Name=SeqID_809
  Gene classification: Gene name=LysR; Function=Transcriptional regulator; Function class=K Transcription
  Homolog annotation: Query=1..298bp; Hit=1..298bp; Blast score=496; Percent Identity=85.0; E value=1e-140; Homolog= oxyR COG0583
MNIRDLEYLVALAEYRHFRRAADSCHVSQPTLSGQIRKLEDELGVMLLERTSRKVLFTQQGMLLVEQAKTVLREVKVLQEMASLQGESMSGPLHIGLIPTVGPYILPLIIPELHKLFPKLEMYLHEAQTQNLLAQLDSGKLDCAILALVKETEAFIEVPLFEEPMKLAIYEGHRWANRTHIKMEELAGEKLLMLEDGHCLRDQAMGFCFQAGAKEDTHFRATSLETLRNMVSAGSGITLLPDLAVPKERKRDGVCYLECIEPEPKRTIILVYRPGSPLRGRYEQLAEAIRTKMGDYFEVFGKTSK

SEQ ID NO: 6918 - protein, 54 aa, Xenorhabdus bovienii
  Coding DNA sequence: Name=SeqID_810
MTRISGSAEMPVFGKRYKVFQIADIHSQPQYLISMIELINKSLYARGNKTIKCL

SEQ ID NO: 6919 - protein, 52 aa, Xenorhabdus bovienii
  Coding DNA sequence: Name=SeqID_811
MLLIFSFTQHLKRCIKFIKKNYYYIILSFMGSKLTIFLFRNQHRFAKRFVIT

SEQ ID NO: 6920 - protein, 459 aa, Xenorhabdus bovienii
  Coding DNA sequence: Name=SeqID_812
  Gene classification: Gene name=ArgH; Function=Argininosuccinate lyase; Function class=E Amino acid transport and metabolism
  Homolog annotation: Query=1..456bp; Hit=1..456bp; Blast score=754; Percent Identity=84.0; E value=0; Homolog= argH COG0165
MALWGGRFSQEADQRFKQFNDSLRFDYRLAEQDIIGSVAWSKALVTVGVLTSEEQQKLELALNELLGEVRANPKAILQSDAEDIHSWVEGQLIAKVGDLGKKLHTGRSRNDQVATDLKLWCKDQIADIQQALVELQQALVITAENNQDAVMPGYTHLQRAQPVTFAHWCLAYAEMLGRDESRLQDALKRLDVSPLGCGALAGTAYDIDREQLASWLGFASATRNSLDSVSDRDHVLELLSDASISMIHLSRFAEDLIFFNSGEAGFIELSDRVTSGSSLMPQKKNPDALELIRGKCGRVQGALTGMMITLKGLPLAYNKDMQEDKEGLFDALDTWRDCLHMAVLVLDGIQVQRGRCEEAAKQGYANATELADYLVAKGVPFREAHHIVGEVVIAAIAEGKALEELSLFELQKFSEAISLDVYDVLSLQSCLDKRLAKGGVSQKQVAQAIAEVKQRLTMG

SEQ ID NO: 6921 - protein, 403 aa, Xenorhabdus bovienii
  Coding DNA sequence: Name=SeqID_813
  Gene classification: Gene name=ArgG; Function=Argininosuccinate synthase; Function class=E Amino acid transport and metabolism
  Homolog annotation: Query=5..403bp; Hit=6..403bp; Blast score=610; Percent Identity=73.0; E value=1e-175; Homolog= VC2642 COG0137
MTKSIKKIVLAYSGGLDTSAIIPWLKEHYDNCEVVAFVADVGQSREDLEGVEQKALRSGASECHVIDLREEFIKEYVYPVLKTGALYEGSYLLGTSMARPIIAKAQVELALKVGADAVAHGATGKGNDQVRFESTYTALAPHLKVVAPWREWDLRSREALLDYLKVRDIPTTATLEKIYSRDENAWHISTEGGVLESTWNAANKDCWVWTAEPEDAPNEPEYVTVTVEKGEVVGVNGKVLSPYQCINALNELGAKHGIGRIDIVENRLVGMKSRGCYETPGGTIMMAALRGIEQLVLDRDSFKWRQQLGLEMSYVVYDGRWFAPLRQSIQAAAETLADSVSGEVVLKLYKGQVTAEQKKSTYSLYSEEFATFGEDEVYDHRHAEGFIRLYSLSSRIRTLNSKK

SEQ ID NO: 6922 - protein, 39 aa, Xenorhabdus bovienii
  Coding DNA sequence: Name=SeqID_814
MLLVIGITFYFCSSQPNTVPLIDKTKPITPKSAYRWVCH

SEQ ID NO: 6923 - protein, 257 aa, Xenorhabdus bovienii
  Coding DNA sequence: Name=SeqID_815
  Gene classification: Gene name=ArgB; Function=Acetylglutamate kinase; Function class=E Amino acid transport and metabolism
  Homolog annotation: Query=1..257bp; Hit=2..258bp; Blast score=344; Percent Identity=71.0; E value=6e-95; Homolog= argB COG0548
MEPLVIKLGGVLLDSEEALARLFSTLQSYRKTHKRPLVIVHGGGCLVDELMQRLQLPIVKKQGLRVTPADQINIVTGTLAGTANKTLLAWAIKYRLPAIGLCLGDGGVVQVSQFDEEFGHTGKAHPGKSDLLKILLDVGYMPIISSIGITEEGELMNVNADQAATAIAQVLNADLAFLSDVSGILDGKGQKIPELTAEKIKQLIEHGIITNGMIVKVNAALEAAKTLGHPVDIASWRHTDQLIALFNGIPTGTRISA

SEQ ID NO: 6924 - protein, 334 aa, Xenorhabdus bovienii
  Coding DNA sequence: Name=SeqID_816
  Gene classification: Gene name=ArgC; Function=Acetylglutamate semialdehyde dehydrogenase; Function class=E Amino acid transport and metabolism
  Homolog annotation: Query=1..334bp; Hit=1..334bp; Blast score=494; Percent Identity=71.0; E value=1e-140; Homolog= argC COG0002
MLNTLIVGASGYTGAELAAYLQRHLHVHLSGLMVSSQSSDAGKCFSDLYPQYKGIVDLPLQPLTDVAEAVNGIDVVFLATAHEVSHDIVPIFLQAGCTVFDLSGAYRVQNTQFYSKYYGFEHKNTAWLDQAVYGLAEWQAEKIKTAQLISVPGCYSTVSQLSLKPLLEKNLLDTEQWPVINAVSGVSGAGRKATINNSFCEVSLQPYGIFNHRHQPEIAAHLGTEVIFIPHLGNFSRGILATITCKLKSGVTEEQIREAYQQAYHDKPLVRLYTEGMPALKSVVGLPFCDIGFAVQGQHLIIVGAEDNLLKGAAAQAVQCMNIRFGFAETQALL

SEQ ID NO: 6925 - protein, 385 aa, Xenorhabdus bovienii
  Coding DNA sequence: Name=SeqID_817
  Gene classification: Gene name=ArgE; Function=Acetylornithine deacetylase/Succinyl-diaminopimelate desuccinylase and related deacylases; Function class=E Amino acid transport and metabolism
  Homolog annotation: Query=4..381bp; Hit=4..381bp; Blast score=600; Percent Identity=73.0; E value=1e-172; Homolog= argE COG0624
VNIKLPSFIKLYHQLIATPSISATDAELDQSNEILINLLAGWLKDLGFNIEIQPVPETRSKFNMLATLGSGSGGLLLCGHTDTVPFDEGRWTQDPFTLTERDNKFYGLGTADMKGFFAFIIDALRDIDASKLSHPLYILATADEETSMAGARYFAANTAIRPDFAIIGEPTSLQPIHAHKGHLAHVIRIEGKSGHSSDPARGVNALELMHESITQLMELRTTLQERYHNPAFVIPHPTMNFGHIHGGDAANRICACCELHMDIRPLPGLTLQDMDELLHKALEPVKQRWPGRLSVTPLHPPIPGYQCPTDHKLVSVIENLLGTKAETVNYCTEAPFIQELCPTLVLGPGSIEQAHQPDEFLSMEFVEPTKKLISQLVEHFCLQAH

SEQ ID NO: 6926 - protein, 31 aa, Xenorhabdus bovienii
  Coding DNA sequence: Name=SeqID_818
MLKCLHVYTFRCLNRMGEAICLVNSKVTYPK

SEQ ID NO: 6927 - protein, 295 aa, Xenorhabdus bovienii
  Coding DNA sequence: Name=SeqID_819
  Gene classification: Gene name=MetF; Function=5,10 -methylenetetrahydrofolate reductase; Function class=E Amino acid transport and metabolism
  Homolog annotation: Query=1..294bp; Hit=1..294bp; Blast score=520; Percent Identity=83.0; E value=1e-148; Homolog= metF COG0685
MSFFHANQREALNQNLAELEGQIRVSFEFFPPSTTTMEQTLWKSIERLSKLKPKFVSVTYGANSGERNRTHSIIKGIKDKTGLDAAPHLTCIDANREELRNIAHDYWESGIRHIVALRGDLPDSSGKPEMYGADLVELLKKEADFDISVAAYPEVHPEAKSAQSDLINLKRKIDAGANRAITQFFFDVESYLRFRDRCVATGIDVEIVPGILPVSNFRQLQRFATMTNVRIPSWMTRMFEGLDDDPESRNLVGASIAMDMVKILSREGVKDFHFYTLNRAELSYAICHTLGVRPC

SEQ ID NO: 6928 - protein, 57 aa, Xenorhabdus bovienii
  Coding DNA sequence: Name=SeqID_820
LIVDRINGRWAKIRFLCGSQSNGGDVNRNRLPNRGHPTFQERKLYVLRYFLKYTVCG

SEQ ID NO: 6929 - protein, 93 aa, Xenorhabdus bovienii
  Coding DNA sequence: Name=SeqID_821
  Homolog annotation: Query=1..93bp; Hit=1..93bp; Blast score=119; Percent Identity=55.0; E value=1e-26; Homolog= ref|ZP_00021644.1|
MKVIWTPQALQDSETIWEYLVTKNPVAAVKMDELFETAAERLIEFPYMGHAGEISGTFEVFPYENYRLVYEVSGESVWILALVHTSQLWPPVK

SEQ ID NO: 6930 - protein, 88 aa, Xenorhabdus bovienii
  Coding DNA sequence: Name=SeqID_822
  Homolog annotation: Query=1..82bp; Hit=1..86bp; Blast score=62; Percent Identity=60.0; E value=2e-09; Homolog= ref|NP_929527.1|
MNKQAVFTMKLESELREDFMAATAAEHRPASQVVRELMREYIQRHEYRNFLQRKVDTARQSINAGEGIEHTDAKAIFAARRARKKADK

SEQ ID NO: 6931 - protein, 878 aa, Xenorhabdus bovienii
  Coding DNA sequence: Name=SeqID_823
  Gene classification: Gene name=Ppc; Function=Phosphoenolpyruvate carboxylase; Function class=C Energy production and conversion
  Homolog annotation: Query=1..878bp; Hit=1..883bp; Blast score=1352; Percent Identity=77.0; E value=0; Homolog= ppc COG2352
MNQQYSAMRSNVSMLGKLLGNTIKEALGEGILDKVETIRKLSKSSRAGNEADRQQLLSTLQNLSNDELLPVARAFNQFLNLANVAEQYHSISPHGEAASNPVALEALFNRLKDKKFSNDDLINAVNELAIELVLTAHPTEIARRTLIHKLVEVNACLAQLDHDDLADYERNNIMRRLRQLIAQSWHTDEIRKIRPTPIDEAKWGFAVVENSLWEGVPAFLREFNEQLEESIGYSLPVEAVPIRFTSWMGGDRDGNPNVTAEITRHVLLLSRWKAADLFLKDIQVLVSELSMSECTPELRQLAGGNGVLEPYREIAKQLRTQLNSTLTYLEKHLKGEQVLPPAGLLLHNEQLWQPLYACYQSLKTCGMEIIANGQLLDTLRRIRCFGLSLVRIDIRQESSRHTDAIAELTQYLELGDYASWSETEKQTFLLRELNSKRPLIPHRWQPSEETLEVFETCKVIAESPQDAIAAYVISMAKVPSDVLAVKLLLKEAGCSLKLPVAPLFETLDDLNNAESVIQQLLGIGWYRELIQDKQMVMIGYSDSAKDAGVMAASWAQYRAQDALIKVCEQEGVTLTLFHGRGGTIGRGGAPAHSALLSQPPGSLKGGLRVTEQGEMIRFKFGLPQVTISSLALYTSAILEANLLPPPEPKPEWKQVMDTLSDVSCDMYRDYVREQPEFVPYFRAATPEQELAKLPLGSRPAKRRPTGGVESLRAIPWIFAWTQNRLMLPAWLGAGAALQHVIDAGKLSVLADMCRDWPFFNTRIAMLEMVFAKADLWLAEYYDQRLVDKKLWPLGITLRNQLAEDIKTVLTISQDEQLMADLPWIAESIALRNVYTDPLNVLQAELLQRSRQQEQPDPHLEQALMVTIAGVAAGMRNTG

SEQ ID NO: 6932 - protein, 52 aa, Xenorhabdus bovienii
  Coding DNA sequence: Name=SeqID_824
VVSDLVLLYLIHFTRSLIALIGIHPVCRAYFCLFLMFYSYQKMNDLGEFYEI

SEQ ID NO: 6933 - protein, 812 aa, Xenorhabdus bovienii
  Coding DNA sequence: Name=SeqID_825
  Gene classification: Gene name=LysC; Function=Aspartokinases; Function class=E Amino acid transport and metabolism
  Homolog annotation: Query=1..449bp; Hit=1..448bp; Blast score=673; Percent Identity=75.0; E value=0; Homolog= ZmetL_1 COG0527
MSALATAGAEFGRQLHKFGGSSLADVKCYQRVAEIMANYSQPGDLMVVSAAGSTTNQLIDWLKLSQSDRISAHQVQQSLRRYQQELIRGLLPEVIAEELVAHFISDLERLSVLLDKPITDITYAEVVGHGEIWSARLMAAVLEHKGISSAWLDARQFLRAERAAQPQVDVNLSQPLLSQLLIQNPSKRLVVTGFISRNQKGETVLLGRNGSDYSATQVGALAGAKKVTIWSDVAGVYSADPRKVKDACLLPLLRLDEASELARLAAPVLHTRTLQPVSVSDIDLQLRCSYQPEQGSTRIERVLATGTGAKIVTSHDDVCLIELHISSAHDFKQIYKDIDSLLKRAQVRPLATGLHADCNLIQLCYTSEVVNSALDVLQDASLPGKLSLREGLALVALVGAGVCKNPLHSHRFYQQLKDQPVEFIWHAEEGISLVAVLRLSQTSHLIQGLHQSLFRAEKRIGLVLFGKGNIGSRWLELFAREQKNISARSGFEFILAGIVDSRRSLLNYQGLDASRALAFFDDEATQHEDDALFLWMRAHPYDDLVVLDVTASEELAKDYIDFASYGFHVISANKVAGSSNSNTYRMVRDAFAKTGRHWLYNATVGAGLPINHSVRDLRESGDTILSISGIFSGTLSWLFLQFDGSVPFSDLVEQAWQQGLTEPDPRIDLSGQDVMRKLIILAREAGYEIEPDQVRVESLVPVEARTGSIEDFFENSAVINEQMLQRLEASREMGMVLRYVARFDATSGKAKVGVEAVRADHPLASLLPGDNVFAIESRWYRDNPLVIRGPGAGRDVTAGAIQSDLNRLSQLL

SEQ ID NO: 6934 - protein, 386 aa, Xenorhabdus bovienii
  Coding DNA sequence: Name=SeqID_826
  Gene classification: Gene name=MetC; Function=Cystathionine beta -lyases/cystathionine gamma-synthases; Function class=E Amino acid transport and metabolism
  Homolog annotation: Query=4..383bp; Hit=4..383bp; Blast score=604; Percent Identity=76.0; E value=1e-173; Homolog= metB COG0626
MGCKQATVAVQSGSNIDEQYGCVVPPIYLSSTYNFTGFNEPRAHDYSRRGNPSRDVVQQVLAELEGGAGAAMTSSGMSAIHLLCTVFLQPGDLLVAPHDCYGGSYRLFDSLSKRGAYNVIFVDQSDNQALKQALAQKPKLVLIETPSNPLLRIVDIQYICGLAHEVGALAIVDNTFLSPVLQKPLDLGADLVVHSCTKYLNGHSDLIAGAIIAKDPVIAENLAWWANNIGVTGAAFDSYLLLRGIRTLSARVMLQQNNAAAIAEYLQQQPQVKKLYYPALKNHPGHEIALKQQAGFGAMLSFELDGDEQTLRHFLSALKLFTLAESLGGVESLISHTATMTHAGMSAEARAQAGITDSLLRVSVGIEDSQDLIADLDKAFQAAATR

SEQ ID NO: 6935 - protein, 105 aa, Xenorhabdus bovienii
  Coding DNA sequence: Name=SeqID_827
  Gene classification: Gene name=MetJ; Function=Transcriptional regulator of met regulon; Function class=E Amino acid transport and metabolism
  Homolog annotation: Query=1..105bp; Hit=1..105bp; Blast score=191; Percent Identity=92.0; E value=1e-49; Homolog= metJ COG3060
MAEWNGEYVSPYAEHGKKSEQVKKITVSIPLKVLKILTDERTRRQVNNLRHATNSELLCEAFLHAFTGQPLPNDDDLRKERHDEIPEAAKDIMRELGIDPETWEY

SEQ ID NO: 6936 - protein, 117 aa, Xenorhabdus bovienii
  Coding DNA sequence: Name=SeqID_828
MQTSGVFVSTVLPVKFTGRKWSLLTRAWNAETFVEAINTTTRRNVTLLACVERVAFTTNVQIQVVINGRVDGDNVTARARCSNCFVFRMNTFSHRKPLLRPCRYPALLPPDTTRRVD

SEQ ID NO: 6937 - protein, 732 aa, Xenorhabdus bovienii
  Coding DNA sequence: Name=SeqID_829
  Gene classification: Gene name=PriA; Function=Primosomal protein N' (replication factor Y) - superfamily II helicase; Function class=L DNA replication, recombination and repair
  Homolog annotation: Query=1..732bp; Hit=1..732bp; Blast score=1026; Percent Identity=68.0; E value=0; Homolog= priA COG1198
MTVVQVALPVPLTRSFDYLLPEGLPLPTTGVRVLVPFGKRNAIGIVTGTAGSSEIPFEQLKPLAAILDAQPLFPDDLWQLLQWSACYYHYPLGEVLFHAMPVLLRQGKPAEFTPLWQWQVTEAGHEFPLEQLKRSVKQQQALASLRLKPIYRHQISELAFSESALQSLKKKALIDLHPIQPEAKNWHEQFQIIGERLQLNTEQASAVGTVRAEDQVFSPWLLAGITGSGKTEVYLSVLENILAQGKQALILVPEIGLTPQTIRRFRERFNAPVDVLHSALNDSERLSVWLRAKRGDNAIVIGTRSALFTPFAHLGVIIIDEEHDSSYKQQEGWRYHARDLAVFRAKKEDIPIMMGTATPALETLFNVQQGKYRQLTLTQRAGEAKPAVQHLLDLKGLPLTVGLSQPLINRIGEHLKADNQVILFLNRRGYSPALLCHECGWIAECQRCDHYYTLHQNHRHLRCHHCDSQRPIPRQCPQCGTTHLIPVGLGTEQLEDGITKLFPHIPVTRIDRDTTSRKGALEQQLAAVHQGGARILIGTQMLAKGHHFPDVTLVVLLDVDGALFSADFRAAERFAQLYTQVSGRAGRAGKRGEVVLQTHHPEHPLLQVLLEKGYDAFARQAMEERQQVFLPPFASHILLRSEDHDNQQAPAFLQQMRQLFEHHALRDEHLWIMGPVPALQAKRGGRFRWQLLIQHPSRIFLQKMMAAIYPQIAALPQARKVKWNIDVDPTEG

SEQ ID NO: 6938 - protein, 341 aa, Xenorhabdus bovienii
  Coding DNA sequence: Name=SeqID_830
  Gene classification: Gene name=PurR; Function=Transcriptional regulators; Function class=K Transcription
  Homolog annotation: Query=3..336bp; Hit=4..337bp; Blast score=475; Percent Identity=68.0; E value=1e-134; Homolog= cytR COG1609
MEKKNCALATMKDVANVAGVSTATVSRTLMNPDKVSARTRQKVESAVLEVGYYPHNLTKNLRRNESRAILVIVPNISDPFFTEVIRGIEETAAEHGYLVLIGDCKHQQQQEHAFINLLITKRIDGMVLLGSNIPFDVSKEEQKNLPPMVMANEFAPDLELPTVHIDNLTSAFNATYHLQKLGHKRIACITGPEIMPLCHYRLQGYIQALHRTGEAIREDYILRGDFTHESGAELAEILLNLPEPPSAIFCHSDIMAIGAMWQAKKMGLKLPEDLSVIGFDNLNLAQYSDPPLTTVAQPCYEIGYYSILLLLEQLQGRIVSKGSRLLDAELLIRASTCSPKS

SEQ ID NO: 6939 - protein, 262 aa, Xenorhabdus bovienii
  Coding DNA sequence: Name=SeqID_831
  Gene classification: Gene name=FtsN; Function=Cell division protein; Function class=D Cell division and chromosome partitioning
  Homolog annotation: Query=1..262bp; Hit=1..319bp; Blast score=143; Percent Identity=36.0; E value=2e-34; Homolog= ZftsN COG3087
VAQRDYVSRGRSNPRQKGTGKKKNQAQGLPKTTLAVAVALVVMFIGGLYFIAHTKNDSVQNPPPPAHHSKNQGLPPKPEERWTYIKELENRPVGLPSIQEPTSANQPTNQPAKLTQEQLQLLAQMEADIRQPPTPLKEVPYNSEPVPRSQVIITPPEQKPLVAQEKTPPAQSLAPSETNKSPKPAINESKLMLQCGSFRTIEQAESVRASLAFAGIESQITTKDNWNRVVVGPYKNKEAAEKMRSHVTNAGVPGCILRPAGG

SEQ ID NO: 6940 - protein, 60 aa, Xenorhabdus bovienii
  Coding DNA sequence: Name=SeqID_832
MTHCCLSITTDDDLAITANTYDCSHELAPGYKIEDVTHGTLACYATIASCIAGKAPRVCY

SEQ ID NO: 6941 - protein, 176 aa, Xenorhabdus bovienii
  Coding DNA sequence: Name=SeqID_833
  Gene classification: Gene name=HslV; Function=Proteasome protease subunit; Function class=O Posttranslational modification, protein turnover, chaperones
  Homolog annotation: Query=1..176bp; Hit=1..176bp; Blast score=296; Percent Identity=89.0; E value=5e-81; Homolog= hslV COG0638
VTTIVSVRRNGQVVIGGDGQATMGHTVMKGNVRKVRRLYNDKVIAGFAGGTADAFTLFELFERKLEMHQGHLTKAAVELAKDWRTDRMLRKLEALLAVADENASLIITGNGDVIQPENDLIAIGSGGSYAQAAARAMLETTELSAREIAERALTIAGDICIYTNHNHNFEELPSKA

SEQ ID NO: 6942 - protein, 443 aa, Xenorhabdus bovienii
  Coding DNA sequence: Name=SeqID_834
  Gene classification: Gene name=HslU; Function=ATP-dependent protease, ATPase subunit; Function class=O Posttranslational modification, protein turnover, chaperones
  Homolog annotation: Query=1..443bp; Hit=1..443bp; Blast score=739; Percent Identity=88.0; E value=0; Homolog= hslU COG1220
MSEMTPREIVSELDNHIIGQDKAKRAVAIALRNRWRRMQLDETLRHEVTPKNILMIGPTGVGKTEIARRLAKLANAPFIKVEATKFTEVGYVGKEVDSIIRDLTDAAVKMVRLQSIEQNRYRAEELAEERILDVLLPPAKNNWGQTETQSEPSTARQAFRKKLREGQLDDKEIEIDVASAPVGVEIMAPPGMEEMTNQLQSMFQNLAGQKQKARKMKIKDAFKLLVEEEAAKLVNPEELKQQAIDAVEQHGIVFIDEIDKICKRGQTSGPDVSREGVQRDLLPLVEGCTVSTKHGMVKTDHILFIASGAFQVSSPSDLIPELQGRLPIRVELQALTTEDFERILTEPNASLTEQYKALMATEGMNIDFTTDGIRKLAEAAWRVNETTENIGARRLYTVLERMMEDISFDASERQGHSVEINADYVKEHLDELVADEDLSRFIL

SEQ ID NO: 6943 - protein, 305 aa, Xenorhabdus bovienii
  Coding DNA sequence: Name=SeqID_835
  Gene classification: Gene name=MenA; Function=1,4-dihydroxy-2 -naphthoate octaprenyltransferase; Function class=H Coenzyme metabolism
  Homolog annotation: Query=7..302bp; Hit=6..301bp; Blast score=360; Percent Identity=66.0; E value=1e-99; Homolog= ZmenA COG1575
MNSTTSISQMQAWLESLRPKTLPLAVAAVVSGSALASWTGHFKWPVALLALLTAALLQILSNLANDYGDVAKGSDTEKRIGPMRGMQKGMITAKQMKTALKITVLLSCLSGIALITVACNSPSDIIGFLTLGVLAIVAAITYTVGTKPYGYMGLGDLSVLIFFGWLSVIGTYYLQANTFDLSTVLPATACGLLSVAVLNINNLRDIESDRQNGKNTLAVRLGAKKARYYHAALLIGAILCLAAFTLLHLKGWSGWLFLLAVPLLLKHMWKVLHDRTPKGMRPMLVQMVKAALLTNALFSIGLVFN

SEQ ID NO: 6944 - protein, 69 aa, Xenorhabdus bovienii
  Coding DNA sequence: Name=SeqID_836
MKYAHQSWRIKVLPRSHLLDRYHKVRKYHISWDLRLVYARDRQYILFKLVLAKSSILKFMCKTDTYSLN

SEQ ID NO: 6945 - protein, 169 aa, Xenorhabdus bovienii
  Coding DNA sequence: Name=SeqID_837
  Gene classification: Gene name=MenG; Function=Demethylmenaquinone methyltransferase; Function class=H Coenzyme metabolism
  Homolog annotation: Query=1..161bp; Hit=1..161bp; Blast score=261; Percent Identity=84.0; E value=3e-70; Homolog= menG COG0684
MKYDTSELCDIYQEDVNVVEPLFSNFGGRTSFGGQIITVKCFEDNGLLYDVLEENGSGRILLVDGGGSVRKALVDAGLAQLAVNNEWEGIVVYGAVRQVDSLAELDIGIQAMAAIPAGSNSEGIGESDIRVNFGGVTFFSGDYLYADNTGMILSDVPLEIDEEDEDDEV

SEQ ID NO: 6946 - protein, 40 aa, Xenorhabdus bovienii
  Coding DNA sequence: Name=SeqID_838
MSRWKLTKKMKMMKYNHFIIYYAKMLKRAYSSPFSTKLQY

SEQ ID NO: 6947 - protein, 80 aa, Xenorhabdus bovienii
  Coding DNA sequence: Name=SeqID_839
  Gene classification: Function=Uncharacterized BCR; Function class=S Function unknown
  Homolog annotation: Query=1..79bp; Hit=3..81bp; Blast score=63; Percent Identity=67.0; E value=6e-11; Homolog= yiiU COG3074
MSFEVFEKLESKVQQAIDTITLLQMEIEELKERNAALSQDIQSAASSHDSLVRENEQFKQEQLAWQERLRTLLGKMEDVQ

SEQ ID NO: 6948 - protein, 68 aa, Xenorhabdus bovienii
  Coding DNA sequence: Name=SeqID_840
MFVITRNIVTNPKCKRDHISMMNKTPIKCEFAHFVDATRRFQFRYFSFTLINDKFTVIFLLREESTNN

SEQ ID NO: 6949 - protein, 265 aa, Xenorhabdus bovienii
  Coding DNA sequence: Name=SeqID_841
  Gene classification: Gene name=GlpF; Function=Glycerol uptake facilitator and related permeases (Major Intrinsic Protein Family); Function class=G Carbohydrate transport and metabolism
  Homolog annotation: Query=1..262bp; Hit=1..260bp; Blast score=344; Percent Identity=69.0; E value=6e-95; Homolog= glpF COG0580
MSQTTTPTLSGQCISEFLGTALLVFFGLGCVAAARLAGAQLGLWEISIIWGFGVALAVYLTAGISGAHLNPAVTIALCLFASFDRKKVLPYIIAQMLGGFAAAAIVYMMYYNLFLDYEQVHNIVRGSQESLFTAGVFSTYPASQLSVLHAFIVEVIIAAVLLCLILALTDDGNGIPRGPMAPLLIGILIAVIGGSFGSLTGFALNPARDFGPKLVAYLAGWGDIALTGGRDIPYCLVPLVAPFIGAILGAFGYRKLIARHLPRAV

SEQ ID NO: 6950 - protein, 507 aa, Xenorhabdus bovienii
  Coding DNA sequence: Name=SeqID_842
  Gene classification: Gene name=GlpK; Function=Glycerol kinase; Function class=C Energy production and conversion
  Homolog annotation: Query=5..505bp; Hit=7..506bp; Blast score=880; Percent Identity=83.0; E value=0; Homolog= ZglpK COG0554
MTIENITEKKYIVALDQGTTSSRAVVLDHDANIVCISQREFPQIYPKPGWVEHDPMEIWASQSSTLVEVLAKADISSDQIASIGITNQRETTIVWEKETGRPVYNAIVWQCRRTADICTKLKQKEGLEEYIRHNTGLVVDPYFSGTKIKWILDNVEGIRHRAENGELLFGTVDTWLVWKMTQGRVHVTDYTNASRTMLFNIHNLDWDQKILDELGIPRMMLPKVSSSSEIYGQTNIGGKGGTRIPIAGIAGDQQAALYGQLCVHPGMAKNTYGTGCFLLMNTGTDAVRSSHGLLTTIACGPRGEVNYALEGAVFVGGASIQWLRDELKLIADAADSEYFATKVKDSNGVYVVPAFTGLGAPYWDPYARGAIFGLTRGANSNHIIRATLESIAYQTRDVLDAMQADSGTRLQSLRVDGGAVTNNFLMQFQADILGTRVERPDVRESTALGAAFLAGLAVGFWKDLDEVKSKATIEKEFRPGIETTERNHKYNGWKKAVARAQEWEDRA

SEQ ID NO: 6951 - protein, 395 aa, Xenorhabdus bovienii
  Coding DNA sequence: Name=SeqID_843
  Gene classification: Gene name=ProP; Function=77 Permeases of the major facilitator superfamily; Function class=G Carbohydrate transport and metabolism
  Homolog annotation: Query=1..390bp; Hit=3..392bp; Blast score=412; Percent Identity=65.0; E value=1e-115; Homolog= ZemrD COG0477
MRKIEHFNLLVMLIALAAVGQMTQTIYVPVIADMASDFGQPAGEVQRVMAAYLFSYGLSQIFYGPLSDKIGRRPVILAGMTLFLVATTCALFASSLLVLVIASVFQGLGTGVAGVMVRTMPRDLYTGTSLRYANSLLNMAVLVSPLLAPMIGGMVGHYFGWRACYWFLLSLGATVAFFLFQHLPETRPVQTKQSTMLVSFQQLLSNSAFVAYLIMLVGGLAGVAVFEASSGVLMGAVLGLDSLTVSILFILPIPAAFLGAWYAGRDGKTFYRLMWHSVMCCLLAGVLMWLPGWFGIMNVWTLLIPATLFFFGAGMLFPLATTGAMEPFPYLAGAAGALVGGLQNVGSGVTTWLSAMLPQNSQFSVGMLMFSMALLILSCWLPISQRVQRQEHTAS

SEQ ID NO: 6952 - protein, 53 aa, Xenorhabdus bovienii
  Coding DNA sequence: Name=SeqID_844
VIVGNRLIDYVLQFDCLYLCQYFGFICTLLLTYMDNITVIFSSCEIVSCLEKI

SEQ ID NO: 6953 - protein, 248 aa, Xenorhabdus bovienii
  Coding DNA sequence: Name=SeqID_845
  Gene classification: Gene name=Hmp; Function=Flavodoxin reductases (ferredoxin-NADPH reductases) family 1; Function class=C Energy production and conversion
  Homolog annotation: Query=1..248bp; Hit=1..248bp; Blast score=399; Percent Identity=73.0; E value=1e-111; Homolog= Zfpr COG1018
MANWVTGKVTDITNWTDSLFSIKVHAPIERFTAGQFAKLALEIEGERIQRAYSFVNSPDDNSLEFYLVTVPEGKLSPRLAALKNGEELLVTEQAAGFFVLDEIPDCQTLWMLSTGTAIGPYLSILQQGNNLERFENIVLVHAVRLEQDLSYLPMMQQLEKKFQGKLRIQTIVSREKCPNSLMGRIPALIENGELEAAVGLPMQAENSHIMLCGNPQMAKDTQQLLKEQRNMAKHLRRKPGHITSEQYW

SEQ ID NO: 6954 - protein, 148 aa, Xenorhabdus bovienii
  Coding DNA sequence: Name=SeqID_846
  Gene classification: Function=Uncharacterized membrane protein; Function class=S Function unknown
  Homolog annotation: Query=1..138bp; Hit=1..138bp; Blast score=132; Percent Identity=48.0; E value=1e-31; Homolog= yiiR COG3152
MTLQQWGFSFKGRIGRREFWIGIGICFALIFMLLTLHGMNAFPMHYAAVGIALILYPTAAIIAKRLHDRNKHGGWVLLLALAWVLLFLDWSAMAAIWQWGIGRFIPTLIFVMIVLDCGVFRSMDGPNRFGEMAETVEYISASEPAPKR

SEQ ID NO: 6955 - protein, 264 aa, Xenorhabdus bovienii
  Coding DNA sequence: Name=SeqID_847
  Homolog annotation: Query=63..256bp; Hit=3..195bp; Blast score=188; Percent Identity=55.0; E value=9e-47; Homolog= ref|NP_931931.1|
MPCKVKSINIRAKQMPMPIQNSRRPIRPLNENPHCCNVMYSFPIVDAVFPVFTLSEYNMKTGMNKLLVTILIAFGISLPLSTFAGEPSITPDTRSQLMYLLPDSPTFEETIPVFREKYNKKYPEIPLHEYKVIVSKDISLPFIRAASKINEKIYSSAVLERGSEKIKSLQITLLPPQSEPEKEHNLALIKQYITALISQFEPSLSPDQANQQLEKFLQAAQSHRFFSQKIGAIRYVIVNSSENIMTFAIEPIKLSLSDAPASKN

SEQ ID NO: 6956 - protein, 255 aa, Xenorhabdus bovienii
  Coding DNA sequence: Name=SeqID_848
  Gene classification: Gene name=TpiA; Function=Triosephosphate isomerase; Function class=G Carbohydrate transport and metabolism
  Homolog annotation: Query=1..255bp; Hit=1..255bp; Blast score=389; Percent Identity=81.0; E value=1e-108; Homolog= tpiA COG0149
MRHPLVMGNWKLNGSTHMVNDLIAGLRKELSNVDGCGVAIAPPTVYVSLAKNALAGSRIALGAQDVDVNLSGAFTGETSAEMLKDVGAKYIIIGHSERRTYYKESDELIAKKFTILKEQGLIPVLCIGETEQENEAGQTEAVCARQIDAVLNTLGVEAFKDTVIAYEPVWAIGTGKSATPAQAQAVHKFIRDHIAKQDAAIAEQVIIQYGGSVNASNAAELFTQPDIDGALVGGASLKADAFAVIVKAAAEAKKA

SEQ ID NO: 6957 - protein, 337 aa, Xenorhabdus bovienii
  Coding DNA sequence: Name=SeqID_849
  Gene classification: Gene name=Sbp; Function=ABC-type sulfate transport system, periplasmic component; Function class=P Inorganic ion transport and metabolism
  Homolog annotation: Query=16..337bp; Hit=8..329bp; Blast score=507; Percent Identity=76.0; E value=1e-144; Homolog= sbp COG1613
MVTRWAARRYAVLTALLMVLAGGSAWAKEVQLLNVSYDPTRELYQQYDQAFSQYWQQKTGDHVTVRQSHGGSGKQATSVINGLQADVVTLALAYDVNAIAERGRIAKNWIDRLPENSAPYTSTIVFLVRKGNPKHIKDWSDLVRPGVSVVTPNPKTSGGARWNYLAAWGYGLAQNNQDQGKTKAFVKALYKNVEVLDSGARGATNTFVERGIGDVLIAWENEALLATHALAQDKFEIVTPSLSILAEPTVAVVDKVVDKRGTRELATEYLKYLYSPVGQEIAAKNYYRPRDKAIAEKHHAVFPVLKLFTIDEVFGGWDKAQEAHFATGGIFDEIIRR

SEQ ID NO: 6958 - protein, 50 aa, Xenorhabdus bovienii
  Coding DNA sequence: Name=SeqID_850
MRCKICSVFLRKTGWKRRSSFTKPFSPATYFFKGSHILWLPFSALYSTYA

SEQ ID NO: 6959 - protein, 325 aa, Xenorhabdus bovienii
  Coding DNA sequence: Name=SeqID_851
  Gene classification: Gene name=PfkA; Function=6-phosphofructokinase; Function class=G Carbohydrate transport and metabolism
  Homolog annotation: Query=5..325bp; Hit=2..320bp; Blast score=523; Percent Identity=80.0; E value=1e-149; Homolog= pfkA COG0205
MINKIKRIGVLTSGGDAPGMNAAIRGVVRVALTEGLEVYGIYDGYLGLYENRMKKLDRFSVSDMINRGGTFLGSARFPEFRDDKVREIAIENMRKNDIDALVVIGGDGSYLGAKKLTEAGFPCIGLPGTIDNDVAGTDYTIGYFTALETVVEAIDRLRDTSTSHKRISIVEVMGRYCGDLTLSAAIAGGCEFIVLPENEIPFDREELLAEIKAGIQKGKRHAIVAITEHVCNVDELAKYIEAETRHETRATVLGHIQRGGAPVAYDRILASRMGAYSVQLLLEGFGGRCVGIQNEKLVHHDIIDAVQNMQRVFKKDWLETAKQLY

SEQ ID NO: 6960 - protein, 98 aa, Xenorhabdus bovienii
  Coding DNA sequence: Name=SeqID_852
  Gene classification: Gene name=PfkA; Function=6-phosphofructokinase; Function class=G Carbohydrate transport and metabolism
  Homolog annotation: Query=5..95bp; Hit=2..92bp; Blast score=155; Percent Identity=84.0; E value=5e-39; Homolog= pfkA COG0205
MINKIKRIGVLTSGGDAPGMNAAIRGVVRVALTEGLEVYGIYDGYLGLYENRMKKLDRFSVSDMINRGGTFLGSARFPEFRDDKVREIAIENMRKFSR

SEQ ID NO: 6961 - protein, 45 aa, Xenorhabdus bovienii
  Coding DNA sequence: Name=SeqID_853
MIRKNTQSALRLCLFSDALLIMNKFPVNPNGFYASLAQRSKDLGE

SEQ ID NO: 6962 - protein, 299 aa, Xenorhabdus bovienii
  Coding DNA sequence: Name=SeqID_854
  Gene classification: Gene name=MMT1; Function=Predicted Co/Zn/Cd cation transporters; Function class=P Inorganic ion transport and metabolism
  Homolog annotation: Query=1..295bp; Hit=1..295bp; Blast score=407; Percent Identity=70.0; E value=1e-114; Homolog= yiiP COG0053
MSINYGRWVSAAALSATILASVLLVVKIVAWWLTGSVSLLAALVDSLVDLAASLTNFFAVRYSLQPADKEHTFGHGKAESLAALAQSMFISGSAIFLFLTGFQHLVSSSPLEHATIGIWVIVIALISTICLVTFQKWVINKTQSQAIRADMLHYKSDLLMNGAILLALVFSMYGFRRADALFALGIGAYILYSALRMGYDAVQSLLDRALPDEERQEIIEMIKRYPGIAGGHDLRTRQSGPTRFIQFHLEIDDHLPLVEAHALAEGIENKLRDRFPGADIIIHQDPCSVVPEKHKNRWD

SEQ ID NO: 6963 - protein, 314 aa, Xenorhabdus bovienii
  Coding DNA sequence: Name=SeqID_855
  Gene classification: Gene name=CdsA; Function=CDP-diglyceride synthetase; Function class=I Lipid metabolism
  Homolog annotation: Query=10..314bp; Hit=7..310bp; Blast score=311; Percent Identity=56.0; E value=7e-85; Homolog= PA2536 COG0575
MTKIDNDLMLLLGGIFGVLIIASAIGGILSLWYSGAKRSATIDNLNARIRGWWMMCIICVLAVIVGSVGSVILFTVMSFFALREFITLTPTRRGDHEALFWCFFVFMPIQYVLVGMQWYGLFSVFIPVYVFLFLPVRIALVGDTTRFLERTAKIQSAMLITVFALSHAPALLMLHIPGYEEQNIKLLLFLMIVVQMSDILQYVFGKLFGKRPIVPKLSPNKTVEGFIGGILASSLLGMSLYWVTPFSPWEAGLMSLAITLMGFIGGLCMSAIKRDSGVKDFGGIIEGHGGMLDRIDSLCFAAPIFFHLTRYFYT

SEQ ID NO: 6964 - protein, 213 aa, Xenorhabdus bovienii
  Coding DNA sequence: Name=SeqID_856
  Gene classification: Gene name=PlsC; Function=1-acyl-sn-glycerol-3 -phosphate acyltransferase; Function class=I Lipid metabolism
  Homolog annotation: Query=23..211bp; Hit=15..203bp; Blast score=180; Percent Identity=47.0; E value=7e-46; Homolog= PA2537 COG0204
MANSHKISLLARCMGATLLGLCRVLTGVQVRWIGCQPSTSSRIYYANHTSHLDGLVIWSGLPPKLRYQIHPVAARDYWDKTRLRRYLMYKVFRAVLIERKGEHTSKSGVLAPLEAILAKKESLIFFPEGTRGDGEQLNPFKGGLYHLARQYPDAEMIPVYLENSNRVLPKGKRLLVPIICSATFGKPLDKLGENESKVAFLQRAQSALEELMR

SEQ ID NO: 6965 - protein, 52 aa, Xenorhabdus bovienii
  Coding DNA sequence: Name=SeqID_857
MSMNLPEPHFYLYWLIAQKISKITEPLLMPSIELFFSPKMSREPLMAAFLVG

SEQ ID NO: 6966 - protein, 44 aa, Xenorhabdus bovienii
  Coding DNA sequence: Name=SeqID_858
MHLYAPLLFSKYISNYLMRNRGQLRCPLLHVRVIAISRVYPSLV

SEQ ID NO: 6967 - protein, 96 aa, Xenorhabdus bovienii
  Coding DNA sequence: Name=SeqID_859
  Homolog annotation: Query=15..96bp; Hit=6..83bp; Blast score=80; Percent Identity=56.0; E value=4e-15; Homolog= ref|NP_927796.1|
MRDDLDLYIEERTKENPRFKAALAEEEKELELAIEMQNILAEWRKNAGLTSAQVAEKMGIKPPTVSKIERNIVKASIDTLSRYARACGVNDINISL

SEQ ID NO: 6968 - protein, 87 aa, Xenorhabdus bovienii
  Coding DNA sequence: Name=SeqID_860
  Homolog annotation: Query=1..81bp; Hit=26..104bp; Blast score=70; Percent Identity=41.0; E value=9e-12; Homolog= gb|AAL59719.1|
MVALIKRLRENPTSLREPHSKPIEGYKGLFELRTKAKDGIARSFFCYAAGKKIYLLRCFVKKTNTTPLNELRIAIARRNELTEPSRD

SEQ ID NO: 6969 - protein, 85 aa, Xenorhabdus bovienii
  Coding DNA sequence: Name=SeqID_861
  Gene classification: Gene name=XerC; Function=Integrase; Function class=L DNA replication, recombination and repair
  Homolog annotation: Query=16..76bp; Hit=267..327bp; Blast score=90; Percent Identity=65.0; E value=4e-19; Homolog= ZintT COG0582
MRSSSESGSFFLHTVKPDLPKGQATHVLRHTFASHFMMNGGKIIALQQILGHASITQTMAYAHLAPDYLQYAITLNHLKCGIKVA

SEQ ID NO: 6970 - protein, 49 aa, Xenorhabdus bovienii
  Coding DNA sequence: Name=SeqID_862
VHCKCLKKKPHKGAERQGWCLWQGKLLLMQLYVKGINRNQFISRSTRTS

SEQ ID NO: 6971 - protein, 165 aa, Xenorhabdus bovienii
  Coding DNA sequence: Name=SeqID_863
  Gene classification: Gene name=Spy; Function=Uncharacterized periplasmic protein; Function class=S Function unknown
  Homolog annotation: Query=61..162bp; Hit=44..143bp; Blast score=78; Percent Identity=43.0; E value=3e-15; Homolog= yiiO COG3678
MRNIAILALASMFVLRATDALAETAGTDNVTADDFSQYCMPYGNKNTVSYCLNDERNYNYSCIFAGVTLTEQQRQQIWDLVKKQRLHEKPVADIRAERRKMYSLLNSTNFDEAAVRLQLEKIAKENVDLSIEIARIRNQIYQLLTAEQKVQLQKRYEVRVDREMN

SEQ ID NO: 6972 - protein, 52 aa, Xenorhabdus bovienii
  Coding DNA sequence: Name=SeqID_864
MSVHGHHQLIRFYACFLPPRAKYDNKLCYSITLRSFTCSDASLQQQGYSDPH

SEQ ID NO: 6973 - protein, 230 aa, Xenorhabdus bovienii
  Coding DNA sequence: Name=SeqID_865
  Gene classification: Gene name=OmpR; Function=Response regulators consisting of a CheY-like receiver domain and a winged-helix DNA -binding domain; Function class=T Signal transduction mechanisms
  Homolog annotation: Query=1..229bp; Hit=1..231bp; Blast score=354; Percent Identity=87.0; E value=5e-98; Homolog= cpxR COG0745
MHKILLVDDDRELTSLLKELLEMEGFTVVLAHDGEQALQYIDSSIDLLLLDIMMPRKNGIETLKELRQDHQTPVIMLTARGSDLDRVLGLELGADDYLPKPFNDRELVARIRAILRRSNWSEQQADSGTPVLEVDKLQLNPGRQEASFDGAILDLTGTEFTLLYLLAQHLGQVVSREHLSQEVLGKRLTPFDRAIDMHISNLRRKLPNRTDELPWFKTLRGRGYLMVSAK

SEQ ID NO: 6974 - protein, 456 aa, Xenorhabdus bovienii
  Coding DNA sequence: Name=SeqID_866
  Gene classification: Gene name=BaeS; Function=Signal transduction histidine kinase; Function class=T Signal transduction mechanisms
  Homolog annotation: Query=1..456bp; Hit=1..456bp; Blast score=635; Percent Identity=75.0; E value=0; Homolog= cpxA COG0642
MINSLTARIFAIFWLTLALVLMVALMAPKLDSRQLTPLLDSEYQQGTILAKQIEKELTRYPANELFWWLRLDRAIAKWTPPGQLLLLVTSEGRIVDIQTSEKQVVRNFIGQSNNADHPKKKKYGRSEILGPFSIRDGEDHYQLYLIRPAGSPQSDFINLMFDRPLLLPAATMLISAPLLLWLAWSLAKPARKLKNAADQVAKGNLRPHPELESGPQEFLAAGSSFNQMINALDRMVTAQQRLISDISHELRTPLTRLQLASALLRRRHGESKELQRIETETQRLDEMINDLLVLSRNQHKNELLRENIKANDIWHDILENAKFEVEQMNKTLDIVSPPGSWVIYCNPAVLGSALENIVRNALRYSSSHIAVAFKADNHGVTITVDDDGPGVSPEDREQIFRPFYRTDEARDRESGGTGLGLAIVETAVSQHRGWVKAEDSPLGGLRLIIWLPLHVR

SEQ ID NO: 6975 - protein, 31 aa, Xenorhabdus bovienii
  Coding DNA sequence: Name=SeqID_867
MDLILLCFFNKKNHKHKPFVLSSDEVRPSLL

SEQ ID NO: 6976 - protein, 31 aa, Xenorhabdus bovienii
  Coding DNA sequence: Name=SeqID_868
LKYILGCLIKATALGYGSQNACPTLGDYVWI

SEQ ID NO: 6977 - protein, 91 aa, Xenorhabdus bovienii
  Coding DNA sequence: Name=SeqID_869
MLKAVNKKAIHIINVFSACNNVISVKIKADDNTNEIKTILGVLYLLAITNCLNTIYTIGHLKNYSNAECQNRSKKRYGFTPSYQLLIRFTQ

SEQ ID NO: 6978 - protein, 155 aa, Xenorhabdus bovienii
  Coding DNA sequence: Name=SeqID_870
  Gene classification: Gene name=TagD (BS); Function =Cytidylyltransferase; Function class=M Cell envelope biogenesis, outer membrane
  Homolog annotation: Query=2..148bp; Hit=6..148bp; Blast score=157; Percent Identity=55.0; E value=4e-39; Homolog= aq_1368 COG0615
MKTVITYGTFDLFHVGHVRLLKRLRNLGDRLIVGISSDEFNSIKGKKSFFSFEERAEIVKACRHVDDVFAENTWKQKREDIIKYKASIIGMGSDWVSKFDDLNDICEVIYLDRTENISSTGIKSALAKVTPNEISQMETQISTMLEIVKVLSANK

SEQ ID NO: 6979 - protein, 368 aa, Xenorhabdus bovienii
  Coding DNA sequence: Name=SeqID_871
  Gene classification: Gene name=TagB (BS); Function=Putative glycosyl/glycerophosphate transferases involved in teichoic acid biosynthesis TagF/TagB/EpsJ/RodC; Function class=M Cell envelope biogenesis, outer membrane
  Homolog annotation: Query=8..365bp; Hit=23..366bp; Blast score=221; Percent Identity=34.0; E value=9e-58; Homolog= MTH361 COG1887
MKKFIIALLKKITYLIPKKNNRVCFKSFPDYSGNAIAVYEYMKKNTDYELIWLIDNEIKPKIGAKKSKSISGLWTFFRAKYIITTHNDFVSISPSNQIYISLWHGMPLKKIGYTGNEHIGMKSISALRISTSELTRSLISASFNEPANNVFITGQPVCDKLFSQKKISDFFDVPNDVRKVIFYLPTFRQDFNEKKIEGRKVSSHNIFRFDKYNHHEFIKYLEYEKILLIVKLHPAEECYLNEIEENGYFKFIKSKDIDLYDVLAVADSLITDYSSVYIDYLILDRPLAFVVPDKEQYIQSRNGFTLEPYDDWTPGNKIISVSDLFNFIDMLSSGQDNYKNDRQRVKRIMHRYDDDQNSKRVFDMLIKR

SEQ ID NO: 6980 - protein, 375 aa, Xenorhabdus bovienii
  Coding DNA sequence: Name=SeqID_872
MIYILLPFILFFFVFLEQIKISKKNSFILCFFVVCIEILFFGSRYKVGVDWQNYVNYFKTLDESYRFEIGYYLINVIFKFIGLNYWAISFFASFIFSITLFATIWKKVPFPILFLALYFMINMLNQIEAVRSLIAYSIILYSLQQVILGRYLKALIFSCFSILFHQTMIVFIPCIFLYNKKISNGYFFTLLFIGLFLYAINISPINALLTELSNYFFKDRLQHYLLIQTDGKYESVLSVTLIIKIIIFSAITLFKKKLDKKYIKNPSFNVFYNIGAGYILIYVYMLNEPAIIYRLSDLFVIGFIATICFFINFLNELNKKIVILGILVISLLIYNSPFSDKYYQNYIINYTSFLSLIFSNEKESYNVNSYWNNPK

SEQ ID NO: 6981 - protein, 378 aa, Xenorhabdus bovienii
  Coding DNA sequence: Name=SeqID_873
  Gene classification: Gene name=RfaG; Function=Predicted glycosyltransferases; Function class=M Cell envelope biogenesis, outer membrane
  Homolog annotation: Query=5..365bp; Hit=3..353bp; Blast score=122; Percent Identity=26.0; E value=6e-28; Homolog= HI1698 COG0438
MKNTKITFVVGDISAKGGTERVTCSIINALNKVVPVELISLEKTGEPFFSISNSVKLKYINEDPSSSTLYGKKVFFLKRFFLDALYIAKTLPKIRNYLIQVESSHVVSTDTKMALLLKLATFATKTKVIAMEHFGYYVPHKMIRGIRSILYRYVHAVVILTNEDKQCYLKFNKNLHIIPNIVAFQSIENPNLDSRRIIAVGRLTYQKGFDILIKAWESVESQTSEWRLDIFGEGEDYDKLTSLIEEKELTQISIRNFSSDIEKEYLQSSFLVMSSRYEGLGMVLIEAMACGIPCISFNCPTGPSTIIQNGINGYLVPEQQEKALSEKILYLIQNESEIKIISKNTKKSITPFTENVVVDKWLSLLYGETIDANKNFEK

SEQ ID NO: 6982 - protein, 436 aa, Xenorhabdus bovienii
  Coding DNA sequence: Name=SeqID_874
  Gene classification: Gene name=RfbX; Function=Membrane protein involved in the export of O-antigen and teichoic acid; Function class=R General function prediction only
  Homolog annotation: Query=17..407bp; Hit=15..409bp; Blast score=72; Percent Identity=22.0; E value=8e-13; Homolog= TM0620 COG2244
MQIKTLKNKGILDLTYYVLGDLFIKGMMFITLPLLTIFLTPAEYGTLSILTTMITFFAVLFSVNIENSVNNYYMRNGEDFGGFLYSNIIFIIFFQLIVFSVFYLLSSEISDFFKVKKIDSILVGIICTVIFYYNLYMLYLQGAKKSRDFSLINVFNKLLEIGLLLLLAWEITNNKYLSKIYAQLVAISIFLPYILFKLKNLCSFNFKFSYVKYSLAFSIPLIPHVLSNTILSQSDRVMINLMIGEKETGLYSFAYNLGLSMAVVISAWNSMWQPRFYELYNKKDFDEINGLISFYSKIISAIGVLTILITGPIVKIFVSPDYYGSLKIIPIIIASNALFFQYYLYVNYTFYHRKSLIISSSTLVAALVNLSLNYFLIPKWGVEGAAYATLIAYFILAIIHYLNAKKVSTDKVISLSLAFKWSIPIYFTAIIVAWMS

SEQ ID NO: 6983 - protein, 361 aa, Xenorhabdus bovienii
  Coding DNA sequence: Name=SeqID_875
  Homolog annotation: Query=4..285bp; Hit=3..290bp; Blast score=80; Percent Identity=28.0; E value=4e-14; Homolog= gb|AAD52167.1|AF144879_6
MQYILFYGELPPSVINGVSLSNEKNIEILNDFYKIIKVEEKPVSSKYRWFSKIINIFYDFLSVRKKCRKYKFDFIYVSLPTSILGAFKILTITTLSTFLLQKNRIVLHLHRGDFDKIYKNSFFYRLILNILIKKTYRIVSLSEQHRRQLLNFFPDKKISVVTNTIREEFFIKKLTLDKIRFLYLSNYLGAKGIFHLLRAFTQLKKENINSNVELCCYGAFLDPSIKEEILSYNGTNGISIHETLDGLDKINVLEQIDALILPSFNEGQPLSIIEAMYYECAVITTDVGFIKEMLPIHYPLLLDSPDEKILKTAMNKFISMNNNEKEKLVCELKNNYDKNFSNSIHKTLVKKVFNCENNFCK

SEQ ID NO: 6984 - protein, 369 aa, Xenorhabdus bovienii
  Coding DNA sequence: Name=SeqID_876
  Gene classification: Gene name=RfaG; Function=Predicted glycosyltransferases; Function class=M Cell envelope biogenesis, outer membrane
  Homolog annotation: Query=200..315bp; Hit=189..305bp; Blast score=72; Percent Identity=38.0; E value=6e-13; Homolog= aq_572 COG0438
VKIIFVNNSLVPYRHHFFNYLFSKNNNEINDSIVLYLTEKESIRKWNENENENENENEKYKYFFLKRIFQARNKKTTTSDYIINHSYLKFLKNIDVVFTLGYSYSTYIIMCLYAKIKGIKTVCFCETNESDKSRNKIKGKLKKILLNFLYDHFTVPGENAKTYLLNLGIPEKKITIIGNSAPFGKFNLKQNSHQDKKYNRIRILYVGRFSAEKNIIFALKNLEKVNEKIKITLVGNGELENDINHLATKSKHEYSILPFCDREELPTLYNANDILLLPSLSETWGLVVNEALEFGLAILASNHVGCAPELVKNNGEIFSVRSENDFLDKAKRIIDDISNYKKNSRIIYEHNNVLTNSEKMMKCLRNITK

SEQ ID NO: 6985 - protein, 311 aa, Xenorhabdus bovienii
  Coding DNA sequence: Name=SeqID_877
  Homolog annotation: Query=51..269bp; Hit=75..300bp; Blast score=104; Percent Identity=30.0; E value=2e-21; Homolog= ref|NP_661125.1|
MFEKHNKIIRKLFYIEEWNTGIIKRKKSDIKNISDYILHEDISWLKKYNTFQADPFILERNGLIYIFYESLSLINSKGDIKCRVLDNHFKELDDILLIGLNNTKCHLSYPFYFEHENKLFLIPETSELSEVSLFECVHFPNEWKKIHTLVSGVKLTDSSIIRSNKEYYLLSTDLDNNLIIHMNTNLFGDWKRIFPKLKLCNQHSRGAGAPFYSQDSVFFFTQECFEYNYGNAIFMKKITAIGRNEFSEELISKIEPLKGSYNEGIHTINFSDNYIVIDSKKLKFNLFSFFIKLIYKIKVKLRQSYCIGERS

SEQ ID NO: 6986 - protein, 367 aa, Xenorhabdus bovienii
  Coding DNA sequence: Name=SeqID_878
  Gene classification: Gene name=Gmd; Function=GDP-D-mannose dehydratase; Function class=M Cell envelope biogenesis, outer membrane
  Homolog annotation: Query=2..366bp; Hit=3..372bp; Blast score=582; Percent Identity=72.0; E value=1e-166; Homolog= gmd COG1089
MKIALITGITGQDGSYLAELLLEKGYTVHGLIRRSSSFNTTRIDSFCKNEKLKLHYGDLTDSSNIIRLIKHIEPDEIYNLGAMSHVAVSFESPEYVADVDALGTLRLLEAIRINRLEKKTRFYQASTSELYGLVQEVPQKETTPFYPRSPYAVAKMYAYWITINYRESYGIYACNGLLFNHESPRRGETFVTRKITRSLANIAQGIETCLELGNLDSLRDWGHAKDYVRMQWMMLQQKQAEDFVIATGKQISVREFVRMSAKELGITLEFSGNGINEIAKVISVSGENAPIVNIGDIIVRVNPKYFRPAEVETLLGDPSKAKEKLGWVPEITVEQMCAEMVFSDLEQARQYAILKQHGFDVSVSLEH

SEQ ID NO: 6987 - protein, 321 aa, Xenorhabdus bovienii
  Coding DNA sequence: Name=SeqID_879
  Gene classification: Gene name=WcaG; Function=Nucleoside-diphosphate -sugar epimerases; Function class=M Cell envelope biogenesis, outer membrane
  Homolog annotation: Query=1..320bp; Hit=1..320bp; Blast score=477; Percent Identity=66.0; E value=1e-135; Homolog= wcaG COG0451
MIKKRIYVAGHRGMVGSAICRHLEKRNNIELIVRSKNDLDLTNQAAVENFFRSEKIDEVYLAAAKVGGIHANNIYPADFIYQNLMIECNVIHSAHNTNIQRLLFLGSSCIYPRLASQPMKENALLTGVLESTNEPYAVAKIAGIKLCESYNRQYGRDYRSVMPTNLYGENDNFHVENSHVIPALLRRFHEAKLHNKEKIVVWGSGTPMREFLYVDDMAAASVFVMELDYKTYTANTSDMLSHINIGTGIDCSIKELAETMANVVGFNGKIIFDDTKLDGAPRKLMNIERLLNIGWRYSFNLKEGLEKTYQWFLKNQNSFRT

SEQ ID NO: 6988 - protein, 56 aa, Xenorhabdus bovienii
  Coding DNA sequence: Name=SeqID_880
MMTGNSISFHLVKKIVFRYIRRYINIIEIHCEILFSDEKIVYYLYKLRCRNNSISL

SEQ ID NO: 6989 - protein, 468 aa, Xenorhabdus bovienii
  Coding DNA sequence: Name=SeqID_881
  Gene classification: Gene name=CpsB; Function=Mannose-1-phosphate guanylyltransferase; Function class=M Cell envelope biogenesis, outer membrane
  Homolog annotation: Query=2..330bp; Hit=6..340bp; Blast score=404; Percent Identity=59.0; E value=1e-112; Homolog= ZcpsB_1 COG0836
MLLPVIMAGGSGTRLWPLSRTLYPKQFLSLTTEMTMLQDTLQRLIFIEHQSPIIICNEEHRFIVAEQLRKAELEHSGIILEPIGKNTAPAVALAALQASSQGNDPLLLVLAADHVIRNITAFTDAVNKATEYAKSGHLVTFGIVPDKPETGYGYIKKGKNISTDAFIVEHFIEKPDILTAIEYISKGDYLWNSGMFLFKASVYIAELKKYRPDILHACETSMSSAKLDLDFIRPNKNSFMMCPDESIDYAVMEKVDSAIAIPLDASWSDVGSWAALWEVSDKDSDNNAIRGDVLIEETEGSYIYSQDRLVTTVGIKDLVVVETKDAVLVAQKNKVQGVKNIVKRLKEKNRLEHIQHREIYRPWGSHDAIADGARYHVKRVIVKPGQKTAMQVHHHRAEHWIIVSGTAKVFCDDKEFLITENESTYIPIGSPHSIENPGKIPLEIIEVRSGVYLAEDDVVRVSTSGVGY

SEQ ID NO: 6990 - protein, 248 aa, Xenorhabdus bovienii
  Coding DNA sequence: Name=SeqID_882
  Gene classification: Gene name=WcaA; Function=Glycosyltransferases involved in cell wall biogenesis; Function class=M Cell envelope biogenesis, outer membrane
  Homolog annotation: Query=1..228bp; Hit=2..229bp; Blast score=203; Percent Identity=41.0; E value=2e-52; Homolog= jhp0094 COG0463
MRISIITATYNSEKTLRDTLISLENQNYNNVEYIIVDGASKDKTINLITSTSTKVSKIICEPDKGIYDALNKGINAATGDVIGFLHSDDLLAYNDVLKDVAEKFVSTGCDAVYGDLEYVSQNDIAKRIRLWKSGEFSRTKLQFGWMPPHPSFYMKRSCYQEHGNFSLDYRISADYDSLLRYILQKGITVSYIPKILVKMRVGGISNRSVSSMFSKSLEDIRVMKQNGIVWPLALIYKNLSKISQFIKK

SEQ ID NO: 6991 - protein, 500 aa, Xenorhabdus bovienii
  Coding DNA sequence: Name=SeqID_883
  Gene classification: Gene name=CpsG; Function=Phosphomannomutase; Function class=G Carbohydrate transport and metabolism
  Homolog annotation: Query=40..493bp; Hit=3..462bp; Blast score=350; Percent Identity=44.0; E value=2e-96; Homolog= mlr5801 COG1109
MVLFGHLPSFIKTYQRFLSLSKNKIMMNIKSTIDQSNIAFGTSGARGLVVDFTPDVCSAFTHAFLNVTKQNFKFDKVAVAIDNRPSSYIIAQACADAIQKQGLTLVYYGVIPTPALAYKAMQDNIPCIMVTGSHIPFDRNGLKFYRPDGEISKEDEHAILNCDYPFESPSPSTLSELKVSTDAAEAYTLRYSSLFDSSLLAGKRIGIYEHSSAGRDLYANILASLGAEVISLGRSDKFVPIDTEAVSAEDRTQAKQWSKQYHLDAIFSTDGDGDRPLIADEQGNWLRGDILGLLCAEALKIDAVAVPVSCNTAIELSNKFKKVKKTKIGSPYVIEAFDGLSQDYRTIAGFEANGGFLLGTDVSVNGKHLAALPTRDAVLPALMVLSAARFNTIAELVDQLPKRFTFSDRLKNFPGEESKTIQQQAVQDPAAFLVDVGFAGRTVKSIDQTDGVRFLMDNGDIIHLRPSGNAPELRCYAEAETESQAQEYVERTLALLASMS

SEQ ID NO: 6992 - protein, 95 aa, Xenorhabdus bovienii
  Coding DNA sequence: Name=SeqID_884
  Gene classification: Function=Transposase; Function class=L DNA replication, recombination and repair
  Homolog annotation: Query=4..85bp; Hit=3..84bp; Blast score=80; Percent Identity=41.0; E value=3e-16; Homolog= insA_g5 COG3677
MTVTIEVTCRYCDRAEPVRKHGTGKAGFPRYYCKGCQKTFQLNYRYNGHKPGMKEKIVDMAMNGSGVRDTGRVLSIGINTVMRTLNLWSPPFLQP

SEQ ID NO: 6993 - protein, 57 aa, Xenorhabdus bovienii
  Coding DNA sequence: Name=SeqID_885
MAYRSREFFQDYRVRNSLWRGNFSPYRRQIDLGKSTCVKIRVAKTGETIDLKYALPY

SEQ ID NO: 6994 - protein, 334 aa, Xenorhabdus bovienii
  Coding DNA sequence: Name=SeqID_886
  Gene classification: Function=Transposase; Function class=L DNA replication, recombination and repair
  Homolog annotation: Query=7..329bp; Hit=6..332bp; Blast score=239; Percent Identity=40.0; E value=3e-63; Homolog= PA2319 COG3547
MNRTTLIGIDLGKHSFHLHGQDKNGKALYHKKMTRTKLLEFLAVTPNATVVMEACAGAHFMARKIAALGHETKLISPQFVRPFVKSNKNDFIDAEAICEAASRPSMRFVQPRTESQQTMRALHRVRESLVRDKVKTTNQMHAFLLEFGISMPKGIAVIRQLSEVIAENDLPSYLVQLLQRLHAHYLYLVEQISEIEQELVLTIKQDEGAQRLLTIPSIGPITASVLASGLGDGKQYSHSREFAASTGLVPKQYSTGGRNTLLGISKRGNKQLRKLLVLCARVYIQKLDHPSGKLAEWVKKQLTRKHSCVVACALANKLARIAWAIITKKGVFNQ

SEQ ID NO: 6995 - protein, 63 aa, Xenorhabdus bovienii
  Coding DNA sequence: Name=SeqID_887
MGDDLFPFRIKSIPKPMTLFFIAYKRPLLIQFTDKCDIVISGLSRCYLFWREFNEMVSPTLLQ

SEQ ID NO: 6996 - protein, 82 aa, Xenorhabdus bovienii
  Coding DNA sequence: Name=SeqID_888
  Gene classification: Gene name=InsB; Function=Insertion element IS1 protein InsB, putative transposase; Function class=L DNA replication, recombination and repair
  Homolog annotation: Query=1..78bp; Hit=7..84bp; Blast score=94; Percent Identity=57.0; E value=2e-20; Homolog= Z1562 COG1662
LDEQGSFVGNKKQRHWLWYAFDTKRKQVIAHVFGPRTDATCRKLLNLLAPFNIRFITTDNWGSYTREVAPEKHLIGKILPNV

SEQ ID NO: 6997 - protein, 39 aa, Xenorhabdus bovienii
  Coding DNA sequence: Name=SeqID_889
MEIHEKLIGAYIEKHHYNPLGSCSNLYRQSRKNMKIIFY

SEQ ID NO: 6998 - protein, 249 aa, Xenorhabdus bovienii
  Coding DNA sequence: Name=SeqID_890
  Homolog annotation: Query=1..238bp; Hit=46..283bp; Blast score=300; Percent Identity=61.0; E value=2e-80; Homolog= ref|NP_927686.1|
MTLLILFHMSHYRDFKTFYIQHVKHYLKADFPRLVSYTRMLTLKHRALIPLCAFFSSRKAETQGIAFIDSTKIAVCHNLRIPRHRVFEGVAQRGKTSTGWFYGFKLHLVINDCGELLAVKLTSGNKDDRHPVKARVQGLTGCLYGDKGYLSQALCDELEAEGITLITHVRSNMKAKALSLWDKLMLRKRFLIETVVDQLKNISQIEHSRHRSQLGFLLEIVAGLIAYTFQPKKPSLNLRDCDIAIFKRS

SEQ ID NO: 6999 - protein, 41 aa, Xenorhabdus bovienii
  Coding DNA sequence: Name=SeqID_891
VPEARSKFLSKKTKSWRSSGMSNLEELYCCVDDFCQKFIPL

SEQ ID NO: 7000 - protein, 167 aa, Xenorhabdus bovienii
  Coding DNA sequence: Name=SeqID_892
  Gene classification: Gene name=CspR (BS); Function=Predicted rRNA methylase (SpoU class); Function class=J Translation, ribosomal structure and biogenesis
  Homolog annotation: Query=1..167bp; Hit=1..157bp; Blast score=263; Percent Identity=76.0; E value=5e-71; Homolog= ZyibK COG0219
MLNIVLFEPEIPPNTGNIIRLCANTGCQLHLIQPLGFTWDDKRLRRAGLDYHEFANIKQHHDFHAFLESEGLSPVNSQSPTRVRLFALTTKGTPAHSNVSYRDGDYLMFGPETRGLPAYVLDNMPTEQKIRIPMLSDSRSMNLSNSVAVVVFEAWRQLGYSGALLRD

SEQ ID NO: 7001 - protein, 278 aa, Xenorhabdus bovienii
  Coding DNA sequence: Name=SeqID_893
  Gene classification: Gene name=CysE; Function=Serine acetyltransferase; Function class=E Amino acid transport and metabolism
  Homolog annotation: Query=6..278bp; Hit=1..273bp; Blast score=476; Percent Identity=84.0; E value=1e-135; Homolog= cysE COG1045
MRMIAMSREELNEVWKNIKNEARVLADCEPMLASFFHATLLKHENLGSALSYMLANKLATPIMPAIAVREVVEDAYRSDPEMIGSAARDIKAVRLRDPAVDKYSTPLLYLKGFHALQAYRIAHWLWKQERQALAIYMQNQISVSFGVDIHPAAKIGCGIMLDHATGIVIGETAVVENDVSILQSVTLGGTGKAGGDRHPKVREGVMIGAGSKILGNIEIGRGAKIGAGSVVLRPVPPHTTVAGVPARIVGKPESDKPSLDMNQHFNGISNGFEYGDGI

SEQ ID NO: 7002 - protein, 339 aa, Xenorhabdus bovienii
  Coding DNA sequence: Name=SeqID_894
  Gene classification: Gene name=GpsA; Function=Glycerol 3-phosphate dehydrogenase; Function class=C Energy production and conversion
  Homolog annotation: Query=4..336bp; Hit=6..338bp; Blast score=535; Percent Identity=79.0; E value=1e-152; Homolog= gpsA COG0240
MNTASMTVIGAGSYGTALAITLARNGHEVVLWGHNPQHVHALQQARCNQAFLPDISFPDNLLLEADLKNAVSTSSNILIVVPSHVFGDVLQQIKPHLQPDSRIVWATKGLEAETGRLLQDVAREILGNEIPLAVVSGPTFAKELAAGLPTAIAVSATTPEFGEELQQLFHCGKSFRVYKNPDFIGVQLGGAIKNVIAIGAGISDGMGFGANARTALITRGLAEMSRLGIALGADPSTFMGMAGLGDLVLTCTDNQSRNRRFGMMLGQGISVDDAQHEIGQVVEGYRNTKEARALAERAGVEMPITEQIYQILYCNKNVIEAAQTLLGRATRDEGESLNS

SEQ ID NO: 7003 - protein, 154 aa, Xenorhabdus bovienii
  Coding DNA sequence: Name=SeqID_895
  Gene classification: Gene name=SecB; Function=Preprotein translocase subunit SecB; Function class=N Cell motility and secretion
  Homolog annotation: Query=1..154bp; Hit=1..155bp; Blast score=255; Percent Identity=83.0; E value=1e-68; Homolog= secB COG1952
MSEQNNTEMAFQIQRIYTKDVSFEAPKAPQIFQLEWQPEVKLDLDTASNELVQGVYEVVLRVTVTAALGEETAFLCEVQQAGIFSIDGIDGTQLAHCLGAYCPNILFPYARECITSLVGRGTFPQLNLAPVNFDALFMNYLQQQSEPSEATQEA

SEQ ID NO: 7004 - protein, 145 aa, Xenorhabdus bovienii
  Coding DNA sequence: Name=SeqID_896
  Gene classification: Gene name=PspE; Function=Rhodanese-related sulfurtransferases; Function class=P Inorganic ion transport and metabolism
  Homolog annotation: Query=2..144bp; Hit=1..143bp; Blast score=191; Percent Identity=65.0; E value=3e-49; Homolog= yibN COG0607
MLQEIMQFISRNTILSLAWIALLVAVIVMTAKSVFSKSKEITRAQAIHFINKEDAIVVDLRSRDDFRRGHIIGSVNLTPSEIKENNLGEFEKHKKQLVIVVSANGLESRTPAEHLIRAGFEQVYSLKEGITGWSGENLPLARGKK

SEQ ID NO: 7005 - protein, 441 aa, Xenorhabdus bovienii
  Coding DNA sequence: Name=SeqID_897
  Gene classification: Gene name=NlpD; Function=Membrane proteins related to metalloendopeptidases; Function class=M Cell envelope biogenesis, outer membrane
  Homolog annotation: Query=52..441bp; Hit=42..427bp; Blast score=364; Percent Identity=60.0; E value=1e-100; Homolog= yibP COG0739
MVGKVLNKMADSKDLKSRNHRQKQDQWQSRGLVLCILLFAFFSTDTFANQISENKDQLKDIQQDIAEKEKSVKQQQKKRTNLLSQLKEQESTISEVGLSLHGTQTHLNKLGNEITSLNANIKRLQTQQKEQRRLLAKQLDSAFRQGNHQGLELLFNGQETQRKERILAYYSYLNQARQETINKLQKTTKQLNQQKKLQLEKQNEQKTILSSQKQQKQKMEVVHIARQKTLTELESSLQKDQQSLTELRQNETQLRNKIVKAEREAKARAEREAREAARVRAQVAAKQKQAQQKGSRYKPTEEERSLMARTDGLGRPAGQAIWPVRGRVIHSFGEAIQGELRWKGIVIAAADNTEVKAISDGRVLLADWLQGYGLVVVVQHGKGDMSIYGYNKTTLVSVGQQVRAGQPIALVGSSGGQQQPSLYFEIRRQGRAVNPLPWLGK

SEQ ID NO: 7006 - protein, 348 aa, Xenorhabdus bovienii
  Coding DNA sequence: Name=SeqID_898
  Gene classification: Function=Uncharacterized BCR; Function class=S Function unknown
  Homolog annotation: Query=54..305bp; Hit=1..249bp; Blast score=257; Percent Identity=57.0; E value=1e-68; Homolog= ZyibQ COG2861
MVKSRLIRRVIPFTLLSWMLLFCLSLLFTLNAHAARLAIVIDDFGYRVQHENKILQMPTAVSIAILPDSPHGREMAQKAHKQGREILIHLPMAPLSKQPLEKNTLYPSMSREEIGRIIHDAIQKVPHATGMNNHMGSAMTSSLSGMEKVMQVLSSYRHLYFLDSVTIGKTQVTKAAMGTPVQVLRRHVFLDNVQTEAETRHQLNRAIALARKQGSAIAIGHPYPTTVRALQQALTTLPDDIELVTPSRLLNPTSASQNDYQIARKCAKPHEPETVPATKLDYLKRVGNALTHNAIVETLSQHIDKLLGKTSKQQEVLHHAGKTASPQKDKTVQGSTDARTTTDACADF

SEQ ID NO: 7007 - protein, 341 aa, Xenorhabdus bovienii
  Coding DNA sequence: Name=SeqID_899
  Gene classification: Gene name=Tdh; Function=Threonine dehydrogenase and related Zn-dependent dehydrogenases; Function class=E Amino acid transport and metabolism
  Homolog annotation: Query=1..341bp; Hit=1..341bp; Blast score=642; Percent Identity=90.0; E value=0; Homolog= tdh COG1063
MKSLSKLKPEEGIWMADVPTPELGHNDVMIKIRKTAICGTDVHIYNWDDWSQKTISVPMVVGHEYVGEVVAIGQEVKGFNIGDRVSGEGHITCGHCRNCRGGRTHLCRNTTGVGVNRAGAFAEYLVIPAFNAFKIPDNIPDELAAIFDPFGNAVHTALSFDLVGEDVLVSGAGPIGIMAAAVCKHVGARHVVITDVNEYRLDLARKMGVTRAVNVSKENLTDVMKELGMTEGFDIGLEMSGAPQAFRTLLSTMNHGGRIALLGIPPSDMAIDWNQVIFKGLFIKGIYGREMFETWYKMAALIQSGLDLTPIITHQFSIDDFQKGFDIMRSGQSGKVILNWD

SEQ ID NO: 7008 - protein, 398 aa, Xenorhabdus bovienii
  Coding DNA sequence: Name=SeqID_900
  Gene classification: Gene name=BioF; Function=7-keto-8 -aminopelargonate synthetase and related enzymes; Function class=H Coenzyme metabolism
  Homolog annotation: Query=1..398bp; Hit=1..398bp; Blast score=653; Percent Identity=83.0; E value=0; Homolog= kbl COG0156
MSASFYQRINEQLEQTRTEGLFKHERIITSAQNADISVADGSQVINFCANNYLGLANHPDLIAAAKAGLDSHGFGMASVRFICGTQDSHKELENKIAEFLGMEDAILYSSCFDANGGLFETLFGPEDAIISDSLNHASIIDGIRLCKAKRYRYANNDMQELRAQLEKAKADGAENILVATDGVFSMDGVIADLKSVCDLADEFDALVMVDDSHAVGFVGKGGRGTHEYCDVMGRVDIITGTLGKALGGASGGYTAARKEVVEWLRQRSRPYLFSNSLAPSIVAASIKVLGMLKHGDELRDRLWRNANLFRAKMTAAGFTLAGADHAIIPVMLGDAKLAQEFAAELLKEGIYVVGFFYPVVPKDQARIRTQISAAHTEEQIEHAVAAFIRIGKQLNVIA

SEQ ID NO: 7009 - protein, 76 aa, Xenorhabdus bovienii
  Coding DNA sequence: Name=SeqID_901
LKRIIALNITDDSSLNRGKSCDLAVHQPPSRDRLYKVDIIFLTVSSLAGSISKIHHAFHLFRYSGEKNVSVFLSKN

SEQ ID NO: 7010 - protein, 312 aa, Xenorhabdus bovienii
  Coding DNA sequence: Name=SeqID_902
  Gene classification: Gene name=WcaG; Function=Nucleoside-diphosphate -sugar epimerases; Function class=M Cell envelope biogenesis, outer membrane
  Homolog annotation: Query=1..311bp; Hit=1..309bp; Blast score=517; Percent Identity=80.0; E value=1e-147; Homolog= rfaD COG0451
MIIVTGGAGFIGSNIVKALNDEGYKDILVVDNLKDGTKFVNLVDLDITDYVDKEDFIASIVAGDDFGDIDAIFHEGACSSTTEWDGKYMMDNNYQYSKDILHYCLERQIPFLYASSAATYGGRSENFIEERQYEKPLNVYGYSKFLFDQYVRDILPQADSQICGFRYFNVYGPREGHKGSMASVAYHLNNQIHQGQNPKLFAGSEHFRRDFISVGDVAAVNLWFWKNSVSGIFNCGTGRAESFQAVADAVTEFHTEKSPVVEYIEFPKKLKGRYQSFTQADLTKLRAAGYDKPFKTVAEGVTEYMQWLNQDN

SEQ ID NO: 7011 - protein, 350 aa, Xenorhabdus bovienii
  Coding DNA sequence: Name=SeqID_903
  Gene classification: Gene name=RfaF; Function=ADP-heptose; Function class=M Cell envelope biogenesis, outer membrane
  Homolog annotation: Query=1..347bp; Hit=1..346bp; Blast score=534; Percent Identity=75.0; E value=1e-152; Homolog= ZrfaF COG0859
MKILVIGPSWVGDMMMSQSLYRTLKALYPNAEIDVMAPAWCRPLLAKMPEVNQALAMPLGHGTLGLGERRRLGIALRESTYDRAYVLPNSFKSALVPFFANIPLRTGWRGEMRYGLLNDIRVLNKSAFPLMVQRYVALAYDGKMMSGAEDLPQPLLWPQLDVSDEDIAESTAAFNIADHRPIIGFCPGAEFGPAKRWPHYHYAALAEQLITQKGYQILLFGSAKDHEAGEDIRALLSENAREDCLNLAGQTSLEQAVNIIAACDAIITNDSGLMHVAAALNRPLVALYGPSSPDFTPPLSNKAEVIRLITGYHKVRKGDSAGGYHQSLIDIQPEQVLASLEKLLQVENQN

SEQ ID NO: 7012 - protein, 315 aa, Xenorhabdus bovienii
  Coding DNA sequence: Name=SeqID_904
  Gene classification: Gene name=RfaF; Function=ADP-heptose; Function class=M Cell envelope biogenesis, outer membrane
  Homolog annotation: Query=1..309bp; Hit=11..316bp; Blast score=419; Percent Identity=67.0; E value=1e-117; Homolog= ZrfaC COG0859
MGDVLHTLPALTDAKQHFPDIQFDWAVEEGFAQIPTWHSAVENVIPVAIRRWRKNWFRKDIREERARFRETLRQSQYDAIIDAQGLLKSAFLVTRLAHGSKHGYDSKSIREPLASFFYDHRHTISKQQHAVERIRALFADSLGYQKPTEQGDYAIARHFLNSQIKGQSDYLVFLHATTRDEKHWSENHWRQLIAEIQPTGMRIRLPWGAEHEHQRALRLAEGFAHVDVLPKLTLAEVAQVLAGAKAVVSVDTGLSHLTAALDRPNITLFGPTDPGLIGGYGKEQFPLKSVDNTMQSIAPLKVMQLLQNVLKYNLA

SEQ ID NO: 7013 - protein, 294 aa, Xenorhabdus bovienii
  Coding DNA sequence: Name=SeqID_905
  Homolog annotation: Query=1..294bp; Hit=9..306bp; Blast score=363; Percent Identity=58.0; E value=2e-99; Homolog= ref|NP_927852.1|
MAKIKPFLLGWKRCNFERYKEAYTLLGGSVSTHPNIVSFLNEKLDNELFFYIKEHSSSIVGAYFTCVNNKLAASLQKKYPFLYDEIIFPISKDVKIIFPEKSKRLSLLHKGNIVNASYTLFNKRKICLIKDSFSYKTRRNRSNEINKFKRAGGEIRPSSEFSAEELVNIYVDLYQKRWDYNHSAEQRKHLLEMYTELREHIFGYVLLINGNPCAYDFVLRADSPKWISFDAINGGYDPEYADLSVGSILMWVNTQEAKAQCQEADKTMRYSLGNPTFEYKNRWCVTLPLGKVIF

SEQ ID NO: 7014 - protein, 317 aa, Xenorhabdus bovienii
  Coding DNA sequence: Name=SeqID_906
  Homolog annotation: Query=1..317bp; Hit=1..317bp; Blast score=546; Percent Identity=81.0; E value=1e-154; Homolog= ref|NP_932004.1|
MTKPAFIITIDTEGDNLWQNSDKISTENTRYLPRFQNLCERFGFKPVWLTNYEMAMDDSYIEFAKDVIARNTGEIGMHLHAWNSPPIIPLTVDDMGYKPYLIEYPKDQIKAKVDFMTHLLEEKLQTKMLSHRAGRWAFNEYYAQLLVEYGYQVDCSVTPKVNWHFTKGDPNGDGGTDYSRFPAHAYFMDLQDIAKEGDSSLLQVPMSIQYKHSPVMNFIKQKYDHLRGKHRSSSVNWLRPKGGNLEQMKKVVQQTLADGNDYVEFMLHSSEFMPSGSPTFKDEEQIEQLYQDLEELFNFLNSLVQGMTLSEYYNYKK

SEQ ID NO: 7015 - protein, 189 aa, Xenorhabdus bovienii
  Coding DNA sequence: Name=SeqID_907
  Gene classification: Gene name=RfaF; Function=ADP-heptose; Function class=M Cell envelope biogenesis, outer membrane
  Homolog annotation: Query=5..158bp; Hit=181..330bp; Blast score=78; Percent Identity=30.0; E value=5e-15; Homolog= rfaK COG0859
MNNIGIDNYNMQYDIHIHQVIKDKVCDFYTGLSGNITVVINPFAADEKRDLSKEQLIGIMSHLNCLDQSINIILVGKLEKLNALSYLSGCVVNPFGDFLSAVEIIKHADLVISPDTSIVHVAAAYEKNTVALYGNDKHGCFINNDVWGPGNKNAVQLVQNKNNSKISEMPLEIIVEQIDAFFSTLAKKI

SEQ ID NO: 7016 - protein, 160 aa, Xenorhabdus bovienii
  Coding DNA sequence: Name=SeqID_908
  Gene classification: Gene name=RfaF; Function=ADP-heptose; Function class=M Cell envelope biogenesis, outer membrane
  Homolog annotation: Query=23..125bp; Hit=10..115bp; Blast score=62; Percent Identity=39.0; E value=1e-10; Homolog= PM1144 COG0859
MTEKKFKKLREINRNKNYFFKKLRFNLAKIFIDKWSKKQFHLGDINKILFLRDDNKIGDMIVFTPVLRELSLNGFKLHVLSGPSNYCVIENNPYIDKVYFYPRKNIDILNLGLKLKQEKYDLVIDMGDQTPVIYLLFIRLINAKILLALIKMTLIFTIKV

SEQ ID NO: 7017 - protein, 366 aa, Xenorhabdus bovienii
  Coding DNA sequence: Name=SeqID_909
  Gene classification: Gene name=RfaG; Function=Predicted glycosyltransferases; Function class=M Cell envelope biogenesis, outer membrane
  Homolog annotation: Query=9..313bp; Hit=8..304bp; Blast score=88; Percent Identity=26.0; E value=1e-17; Homolog= Cj1127c COG0438
MKGHILFIIDGLPGGGAENVTVRLCGGLQKKGFDITLLSLSDKCEYPIPDHVELIVDTDEYAGPFRRQTEIYRRAKSMDTVLEKVFLQKGTPVLVISNLHKTDRIVAKSKILADLNVWFCIHGVFSKSYLENKTGLARWIKKWKIQRVYRDRNLICVSDAVGLDLKENVSLAPKRIVTIYNPFNLAEIKANSLENNPYSGEDYFLHLGRFHGVKRHDRLLEAFARANLPCKLLIAGQGDEKTTNEIKQKIVSLGLQSKVTLIGFLVNPLPVIRGAKAVVLSSDSEGLGNVLIEALICHTPIASTNCPGGVSEIMVGELEQYTSELTSESLAEKIRLVYQRPPVITADLYKKFDLEVVLDKYLSLIE

SEQ ID NO: 7018 - protein, 377 aa, Xenorhabdus bovienii
  Coding DNA sequence: Name=SeqID_910
  Gene classification: Gene name=RfaG; Function=Predicted glycosyltransferases; Function class=M Cell envelope biogenesis, outer membrane
  Homolog annotation: Query=7..346bp; Hit=3..346bp; Blast score=93; Percent Identity=27.0; E value=3e-19; Homolog= PA5010 COG0438
MMKSVRLAIVRQKYRPDGGAERFISRALEALDNENLELNVITRSWQGSMNPNWHVHLANPFKWGRISREKGFANAAREIWQKEGFDIVQSHERIAGCDVYRAGDGVHQRWLQQRARILPSWKSKLLFASRYHRYVMDAEKKMYSAPELKKVICNSQMVKQEVMEDFDLSEEKIAVIYNAIDPSQFFPAGEEERIELRQKYSIPAQAKCFVYVGSGFERKGLKAAIEAISMTEAYLIVIGQDKEESKYKQLASALGCHERIRFLGVQKKTLPFYQMADGLLLPTLYDPFPNVILEAMACGLPVITSKTCGGAEFIVSGENGFVCDALDIQALAESISLIPADHLTSRISMLSKEKIANYTPAYLSQQLTELYSKVLSL

SEQ ID NO: 7019 - protein, 353 aa, Xenorhabdus bovienii
  Coding DNA sequence: Name=SeqID_911
  Gene classification: Gene name=RfaF; Function=ADP-heptose; Function class=M Cell envelope biogenesis, outer membrane
  Homolog annotation: Query=16..353bp; Hit=1..331bp; Blast score=296; Percent Identity=46.0; E value=3e-80; Homolog= rfaQ COG0859
MGKITTRFEKILIIKLRHHGDMLLITPVVNTLKENFPDAEIDVLLYKETKPMLMNFASIAHIFPIDRQWKKEGAKAYVAHHWRLLKQLRNRNYDLVINLADQWYSALVSQLISAPARIGFDFPKRQNLIWKACFTDLVSTEGEENLHVVEQNLSALKPLNLSDINIDVTMSYSEEDRQKVSDLLHSSGINEKYIVIHPASRWFFKCWDEEKISETINALQADGHAIVLTSGTEAREKEMVAKILSACSQENIVSLAGQITLPQLGALIDHAKLFIGVDSVPMHMAAALKTPCIALFGPSKLVFWRPWNANGEVIWAGNYGKLPDPDGIDTKTDIRYLDLIPVDVVIEAARRYL

SEQ ID NO: 7020 - protein, 60 aa, Xenorhabdus bovienii
  Coding DNA sequence: Name=SeqID_912
MFIKLYSKDNKISLLSLHIELVNLNKKFTPLSFWERGEQHIRILHTFFRPMWYYSRSLCQ

SEQ ID NO: 7021 - protein, 425 aa, Xenorhabdus bovienii
  Coding DNA sequence: Name=SeqID_913
  Gene classification: Gene name=KdtA; Function=3-Deoxy-D-manno -octulosonic-acid transferase; Function class=M Cell envelope biogenesis, outer membrane
  Homolog annotation: Query=1..425bp; Hit=1..425bp; Blast score=639; Percent Identity=74.0; E value=0; Homolog= kdtA COG1519
MLLRLYQVLLYLIQPLIWLRLLLRSRKSPAYRKRWGERYGFCAKKVAKGGILLHSVSVGETLAAIPLVRILRHHYPFLPITVTTMTPTGSERVLSALGTDVNHVYLPYDLPGSMSRFLDNVNPKLVIIMETELWPNLITQLNQREIPLVIANARLSTRSAAGYQKISNFIKTILNKITLIAAQNQEDGERFIELGLKRSQLAVTGSLKFDISVTPELAAKAVTLRRQWAPHRPVWIATSTHDGEETIILDAHCKLIQQFPDLLLILVPRHPERFTKAAELTQKAGLNSILRSSDTIPDANVQVVIGDTMGELMLLYGIADLAFVGGSLVERGGHNPLEAAAHAIPVIMGPHTFNFKDICAKLDKANGLIAVTDSHSLSAAINSLLTDEDYRLYYGRHAAEVLHENQGALQRLLKLLEPYLPPRGH

SEQ ID NO: 7022 - protein, 258 aa, Xenorhabdus bovienii
  Coding DNA sequence: Name=SeqID_914
  Gene classification: Gene name=WcaA; Function=Glycosyltransferases involved in cell wall biogenesis; Function class=M Cell envelope biogenesis, outer membrane
  Homolog annotation: Query=7..254bp; Hit=4..253bp; Blast score=242; Percent Identity=48.0; E value=2e-64; Homolog= PM1306 COG0463
MSKRKRLSVVMIAKNSADLIADCLLSVDWADEIIVLDAGSTDATCQIASEMGAKVYINTQWPGFGRQRQLAQSYASGDYIFMIDTDERVTPELRTSIEQVLADPDDDKVYDCARLNLFMGRFMKHSGWYPDKVIRLYCRERYQYNDNQVHESLNTQGARIVTLKGDLRHLTCRNLMEFQQKQLNYARDWAKYRHEQGKTARYFSIFSHTLGAFFKTWLLRAGFLDGKQGLVLAMVNAQYTFNKYAALWELTQTESKKR

SEQ ID NO: 7023 - protein, 163 aa, Xenorhabdus bovienii
  Coding DNA sequence: Name=SeqID_915
MITPLFTLSYLPNFFSIACATDSGRNDETSPSWRATSLIKDDDTKDRFCEGNKKTLSSSGIKCRFMLASCHSYSKSETERTPRIKMVACCFLAKLAISSLNPTTSTLSRWVVTSFASAIRSSRLNMGFFLSLLAMASKTWSNMFAARVTISRWPWVIGSKVPG

SEQ ID NO: 7024 - protein, 269 aa, Xenorhabdus bovienii
  Coding DNA sequence: Name=SeqID_916
  Gene classification: Gene name=Nei; Function=Formamidopyrimidine-DNA glycosylase; Function class=L DNA replication, recombination and repair
  Homolog annotation: Query=1..268bp; Hit=1..268bp; Blast score=407; Percent Identity=73.0; E value=1e-114; Homolog= ZmutM COG0266
MPELPEVETSRRGIEPHLTGNVIQYSEVRNSRLRWPVSEQIMKLADQPVLSVRRRAKYLLLELPEGWIIIHLGMSGSLRILLNESPPEKHDHVDLIMADGKILRYTDPRRFGAWLWSDNLDECSVLAHLGPEPLSDTFDGEYLYTLSRNKKTVIKPWLMDNKVVVGVGNIYANEALYVAHILPERPVNSLTQEEAYLLADTIKQILHRSIEQGGTTLKDFLQSDGKPGYFAQELFVYGKKGELCPKCGEKIESIKLGQRSTFFCRQCQH

SEQ ID NO: 7025 - protein, 429 aa, Xenorhabdus bovienii
  Coding DNA sequence: Name=SeqID_917
  Gene classification: Gene name=RfaL; Function=Lipid A core - O -antigen ligase and related enzymes; Function class=M Cell envelope biogenesis, outer membrane
  Homolog annotation: Query=36..423bp; Hit=18..399bp; Blast score=234; Percent Identity=38.0; E value=1e-61; Homolog= ZwaaL COG3307
MYHLQPNLVGIVERIEITMLDIKNRFNIGNNKKSLWNLSIIGLFIILVYLPDITRYKNLVMILICATALCYLVKDFRQVVNSLRSSLFLSILLFVLAIFYSIGISIDPALSFKEMNKPILNGLLLFSMTFPIVLYQEKKQHIAKMILIAFIIGMSLISLTDIAKYIINYYATGEMPFMNYNHREFSYGFLFYFPVLLCTWALWKKHSLLSWLLLIIASAIGLFLLLGTLSRGAWVAIVVATVFIIVINKEWKLTLAATICLGLLAGAIHWSAVSNPATKLLLHKLTQTDSSHRYSNGTQGSAWSLIMENPVKGYGFGNKVYHQVYNSRVADYPDWAFRTSIGPHNVFLSLWFAGGLFGLIATLLMTLSALFTGSQIIRQHSGIIRQAGLILLTAFIGLFIVRGAFENAYINEIGLLLGLMITLYKQKDD

SEQ ID NO: 7026 - protein, 36 aa, Xenorhabdus bovienii
  Coding DNA sequence: Name=SeqID_918
MPAYTTQIGRAGLQAISAIAYLDRFSAITCMISFAR

SEQ ID NO: 7027 - protein, 392 aa, Xenorhabdus bovienii
  Coding DNA sequence: Name=SeqID_919
  Gene classification: Gene name=RfaG; Function=Predicted glycosyltransferases; Function class=M Cell envelope biogenesis, outer membrane
  Homolog annotation: Query=183..385bp; Hit=165..351bp; Blast score=69; Percent Identity=27.0; E value=7e-12; Homolog= AF1728 COG0438
MKIAYIDPYSVPDYRVASLQILQNVDAFARQGHSVYLITPEGQKRVEEIIGRALPPSAELIALRNMRRKWYFPLNTQKLFYFQVSRWLKDHQIDAIFTRNIKMANYLLRKHPDIPHFFESHEVFAQSFKESHNLDKRKNRRKYHKLRNTEQQVYHHSKVVFVLTSLLSEDIYKEYSVKTPIIVAPDGVDMLAVESTKIASSGRREKLGETTQVLYLGSLHRWKGVPTVMKAMCYLDNAVLNIAGGDSVQIERLKCTAQQIGVSDKVNFLGFIQPKKRFQVIAESDICVLPLTKTSIGSRYTSPLKLFEYMAMGKPVVISDFPSIRDAVDEKAVNFADSENAESFAEQIQSLIDNPAEMMAKVGYSQRLVAERFNWDQRAKLIMQVIAENLSK

SEQ ID NO: 7028 - protein, 367 aa, Xenorhabdus bovienii
  Coding DNA sequence: Name=SeqID_920
  Gene classification: Gene name=RfaG; Function=Predicted glycosyltransferases; Function class=M Cell envelope biogenesis, outer membrane
  Homolog annotation: Query=157..354bp; Hit=168..363bp; Blast score =123; Percent Identity=36.0; E value=3e-28; Homolog= PH1844 COG0438
MKIGFIDVTVTMSYGGIQTAVWELAKALTDAGHEIHIFGGTGDVRPVLGERNIHIHTFPFTPRERVINIGRRFQRIVERYSFARHARERVIAENFDWVILTKPFDFFWPRMMPKTSCTKFCYMSGGTSFFKGDRALGNKISAWVACSHFNAWQIQHHFKQFPNVIYNGVDIDKFKPVNSDLRNRLDINENTFLLTFAGRLVGWKGMKVAIDAMALLRDKDVRLLIIGAGDDLKLLKKKVSELNLEKTVIFHPPVGHDQLPEFYAAGDAGIFPSIGDEAFGITIAEAMACGRPVIASYIGGIPEVVGNENHAGILVAPGNAAAIADAVNHLLSLPDRGKAMGKQARQRIETMYTWEHSASRLLGAIKK

SEQ ID NO: 7029 - protein, 329 aa, Xenorhabdus bovienii
  Coding DNA sequence: Name=SeqID_921
  Gene classification: Gene name=RfaF; Function=ADP-heptose; Function class=M Cell envelope biogenesis, outer membrane
  Homolog annotation: Query=6..327bp; Hit=3..337bp; Blast score=75; Percent Identity=27.0; E value=7e-14; Homolog= ZrfaF COG0859
MQPKNILVIIIARFGDTLLITPVIRALKLRWPEANIYVLAHKKTKEILENISEINSITAFSKGQAKWRGWFSRRRYDLALVYGHDKPLLQYAKRKSDLTIYFSETSCHKSNELAVVKPRAFTQAQQERALLINALDIGVSDWRLQYCVSQNEEKYACDFLRQQGLEQRLRIGFQLQSFPAKSYRDWPQEHFYELAQRIYCHYPHAHILLLGSKDGEASAQILSERLGTQRCTSLAGKTTMRQNAAIMSQLNLYVGVDTGTTHLAGALGIPMVAMYHSFHPGRFLAPQQHPKLAVIEHPIDYQQATRQDAMSAISVEQVWSSVQNLLKNT

SEQ ID NO: 7030 - protein, 371 aa, Xenorhabdus bovienii
  Coding DNA sequence: Name=SeqID_922
  Gene classification: Gene name=RfaG; Function=Predicted glycosyltransferases; Function class=M Cell envelope biogenesis, outer membrane
  Homolog annotation: Query=6..352bp; Hit=1..355bp; Blast score=121; Percent Identity=29.0; E value=1e-27; Homolog= XF1470 COG0438
MTKKTLNILHTESSCGWGGQEIRILTESQGMIQRGHQVVIVCCPASTIYHEAHSYGVPVVALPIEKKRLPCLRAMRRWLKAEGRQFDVINTHSSTDSWLVAAACATLKGMPPIVRTRHVSTNVSTSVATRWLYLKSCQHIVTTGEKLRQYLHTNNGYPLPHMTSVPTGIDLTHFHPENKQLCRQRIGIADKPTLGIVATMRTWKGHRYLLDSWKILHQRYPDWQLLFVGDGPQRKNLEPWVKHEGLTESVIFLGNRQDVPDCLNAMDVFALPSFGNEGVPQGIMQAMACGLPVVSTSVGAITEAVIDGDTGYIIEPRCVEQLTERLDILMKSAELRLQMGNASLERAADLFSMDNMLEKMEFIFYGSMERK

SEQ ID NO: 7031 - protein, 36 aa, Xenorhabdus bovienii
  Coding DNA sequence: Name=SeqID_923
MLRPWITYLQPGYPCILAGIKKPSIRWVFSQSTKII

SEQ ID NO: 7032 - protein, 55 aa, Xenorhabdus bovienii
  Coding DNA sequence: Name=SeqID_924
  Gene classification: Gene name=RpmG; Function=Ribosomal protein L33; Function class=J Translation, ribosomal structure and biogenesis
  Homolog annotation: Query=1..55bp; Hit=1..55bp; Blast score=79; Percent Identity=89.0; E value=6e-16; Homolog= rpmG COG0267
MAKGIRDKIKLVSSAGTGHFYTTTKNKRTMPEKLELRKFDPVIRQYVVYKEAKIK

SEQ ID NO: 7033 - protein, 78 aa, Xenorhabdus bovienii
  Coding DNA sequence: Name=SeqID_925
  Gene classification: Gene name=RpmB; Function=Ribosomal protein L28; Function class=J Translation, ribosomal structure and biogenesis
  Homolog annotation: Query=1..78bp; Hit=1..78bp; Blast score=135; Percent Identity=96.0; E value=9e-33; Homolog= rpmB COG0227
MSRVCQVTGKRPVSGNNRSHALNATKRRFLPNLHSHRFWVESEKRFVTLRVTAKGMRVIDKKGIDVVLAELRARGEKY

SEQ ID NO: 7034 - protein, 75 aa, Xenorhabdus bovienii
  Coding DNA sequence: Name=SeqID_926
MSILQKSNQLELYIGYDRLVRLRSPSQHIFITEKTHIIPIKKLTEIGSSRQTQDPQRWRSIRPHSLMLKSRTTKI

SEQ ID NO: 7035 - protein, 230 aa, Xenorhabdus bovienii
  Coding DNA sequence: Name=SeqID_927
  Gene classification: Gene name=RadC; Function=DNA repair proteins; Function class=L DNA replication, recombination and repair
  Homolog annotation: Query=16..230bp; Hit=10..224bp; Blast score=248; Percent Identity=52.0; E value=3e-66; Homolog= ZradC COG2003
MDVTVMEISDELHSNLAPREKLLAYGAVSLTDAELLAIFLRTGTRGVPVVQMAEHLLKSFGSLYHLLSADYADFCSHKGMGLCKYVQLQAVSELAKRFFSSQFIHEDVMSSPVATQNYLQDLLSWQDREVFVVLFLTNQNKVICHDEMFKGTINKVEVHPREIVKQAVKVNAASIILAHNHPSGNPEPSLADKLVTEKIIDACELVGVKVLDHIVIGKQHCVSFVERGWI

SEQ ID NO: 7036 - protein, 44 aa, Xenorhabdus bovienii
  Coding DNA sequence: Name=SeqID_928
MQFIAYFHHSNIHILPLIPFHPVASRRQYPMMKKAPPAPFSWLA

SEQ ID NO: 7037 - protein, 414 aa, Xenorhabdus bovienii
  Coding DNA sequence: Name=SeqID_929
  Gene classification: Gene name=Dfp; Function =Phosphopantothenoylcysteinesynthetase/decarboxylase; Function class =H Coenzyme metabolism
  Homolog annotation: Query=14..414bp; Hit=27..430bp; Blast score=563; Percent Identity=72.0; E value=1e-160; Homolog= dfp COG0452
MWIIRMAGFSSKQLSGKHIVLGISGGIAAYKTAELVRRLRDRGAEVRVAMTPAAEAFITPLTLQAVSGHPVSDDLLDPAAEAAMGHIELAKWADLIILAPATADLLARLTAGMANDLVTTICLASAAPIAVAPAMNQQMYRAQATQHNLSVLKERGVLIWGPDEGSQACGDVGPGRMLEPMAMVELATQHFNTNQDFAGLCITITAGPTHEALDPVRFITNHSSGKMGFSIAQAAAERGADVTLIAGPVNLPTPPGVKRIDVTSALEMHEHVQVTAASQHIFIGCAAVADYRFKQIATEKIKKQGDEVTFTLVKNPDIVASVAAMETNRPFVVGFAAETQNVEEYARGKLKQKHLDLICANNVSLAEHGFNSDTNALHLFWHDGSVNLPHSSKLQLGHCLLDEILKRYDEKNRR

SEQ ID NO: 7038 - protein, 152 aa, Xenorhabdus bovienii
  Coding DNA sequence: Name=SeqID_930
  Gene classification: Gene name=Dut; Function=dUTPase; Function class =F Nucleotide transport and metabolism
  Homolog annotation: Query=3..152bp; Hit=2..151bp; Blast score=256; Percent Identity=82.0; E value=5e-69; Homolog= Zdut COG0756
MTKKIDVKILDPRIGQEFPLPTYATPGSAGLDLRACLDNTVELAPGQTELLPTGIAIHIADEQLAAVILPRSGLGHKHGVVLGNLVGLIDSDYQGQLMVSVWNRGDKMFIIEPGERIAQMVFVPVVQAEFNLVEDFETSKRGSGGFGHSGRQ

SEQ ID NO: 7039 - protein, 48 aa, Xenorhabdus bovienii
  Coding DNA sequence: Name=SeqID_931
MCASACKISSRLFFFFVRSFSAMCDKTPAKTAKQIQLFFAHHDHGQKI

SEQ ID NO: 7040 - protein, 199 aa, Xenorhabdus bovienii
  Coding DNA sequence: Name=SeqID_932
  Gene classification: Gene name=AcrR; Function=Transcriptional regulator; Function class=K Transcription
  Homolog annotation: Query=1..199bp; Hit=15..212bp; Blast score=285; Percent Identity=81.0; E value=2e-77; Homolog= ttk COG1309
MAEKERTKKKNRREEILQALAHMLESSDGSQRITTAKLAANVGVSEAALYRHFPSKTRMFDSLIEFIEDTLISRINLILQDEKDTITRIRLILTLLLGFAEKNPGLTRIMTGHALMFEQDRLQNRINQLFERIEAQLRQILKEKKIRDGQGFDYDETVLASQLLAFCEGMLSRFVRSEFRYRPTQEFEIRWPLILTQLQ

SEQ ID NO: 7041 - protein, 78 aa, Xenorhabdus bovienii
  Coding DNA sequence: Name=SeqID_933
MPLLSYFIVNSTRRCMLTQFNEKTARYHSQHERGNFTVQAQLLQLSQYQWPAYFKLLGRAIAEFRTNKPGKHPFTKRQ

SEQ ID NO: 7042 - protein, 34 aa, Xenorhabdus bovienii
  Coding DNA sequence: Name=SeqID_934
MASLPYYMRDVISTTHPARPLGEGFFLSQLFLLS

SEQ ID NO: 7043 - protein, 213 aa, Xenorhabdus bovienii
  Coding DNA sequence: Name=SeqID_935
  Gene classification: Gene name=PyrE; Function=Orotate phosphoribosyltransferase; Function class=F Nucleotide transport and metabolism
  Homolog annotation: Query=1..213bp; Hit=1..213bp; Blast score=352; Percent Identity=80.0; E value=2e-97; Homolog= pyrE COG0461
MKAYQREFIELALKKQVLKFGEFTLKSGRQSPYFFNAGLFNTGRDLALIGRFYAAALLDSGISCDLLFGPAYKGIPIATTTAVALAEHHDIDMPYCFNRKEAKDHGEGGSLVGSPLQGNVVVVDDVITAGTAIRESMEIIKQHGATLSGVILCLDRQERGRETLSAIQEVERDYHCKVFSIITLNDLISYLRENPDMQPYLAAVEAYRREYGI

SEQ ID NO: 7044 - protein, 242 aa, Xenorhabdus bovienii
  Coding DNA sequence: Name=SeqID_936
  Gene classification: Gene name=Rph; Function=RNase PH; Function class= J Translation, ribosomal structure and biogenesis
  Homolog annotation: Query=7..241bp; Hit=2..236bp; Blast score=355; Percent Identity=80.0; E value=2e-98; Homolog= Zrph COG0689
MSPVGKRPAGRTAGQVRPIKMTRHYTKHAEGSVLVEFGDTKVLCNASVEEGIPRFLKGQGQGWITAEYGMLPRATNSRNAREAARGKQTGRTMEIQRLIARSLRAAVDLKKLGEYTITLDCDVIQADGGTRTAAISGACVALVDALNKLVTDGKLKKSPMKSMVAAVSVGIVKGEGLCDLEYVEDSAAETDMNIVMMDDGRMIEVQGTAEGEPFSHDELLSLLSLAKEGLETIFAAQRDALK

SEQ ID NO: 7045 - protein, 44 aa, Xenorhabdus bovienii
  Coding DNA sequence: Name=SeqID_937
VFSPLLKHYWGRIIRPNEANAYPASTRGVIIRSSFYKLETNYDP

SEQ ID NO: 7046 - protein, 287 aa, Xenorhabdus bovienii
  Coding DNA sequence: Name=SeqID_938
  Gene classification: Function=Uncharacterized stress-induced protein; Function class=S Function unknown
  Homolog annotation: Query=1..287bp; Hit=1..287bp; Blast score=378; Percent Identity=81.0; E value=1e-105; Homolog= yicC COG1561
MIRSMTAFARRDIKADWGNAAWELRSVNQRYLETYIRLPEQFRSLEPVIRERIRSRLTRGKVECNLRFDLDTRTQGTLMLNENLAKQLVEAANWVKQQSNQGEINPVDILRWPGVMSAEEQDLDAISIQLLAELDLALDAFIQSRETEGQALKTLIEQRLDAVTEEASKVRQQMPEILQWQRERLQTKLEEAQIQLENNRLEQELLLMAQRIDVAEELDRLDAHVKETRNILKKKEAVGRRLDFMMQEFNRESNTLASKSINADVTNSAIELKVLIEQMREQIQNIE

SEQ ID NO: 7047 - protein, 50 aa, Xenorhabdus bovienii
  Coding DNA sequence: Name=SeqID_939
MKKLGGVPKMVFLMCYGYTFGYTPIMRYCDLLCNALIVKKPDITKYILAL

SEQ ID NO: 7048 - protein, 158 aa, Xenorhabdus bovienii
  Coding DNA sequence: Name=SeqID_940
  Homolog annotation: Query=1..134bp; Hit=1..134bp; Blast score=190; Percent Identity=70.0; E value=6e-48; Homolog= ref|NP_903521.1|
MPKLTDKEIRAWIKSGERFEGKADGNGLYLRFREIDRIPSWRFRYKLAGKSRTMNLGTYADLSLAKARELTRELSARVALGYDVAGEKQQRKAEALAKIEAEKNAIKVSDLAAEYFERQILPRWKHPDILRRRILTGLLSLVVIYLMMATSAQRFSSP

SEQ ID NO: 7049 - protein, 50 aa, Xenorhabdus bovienii
  Coding DNA sequence: Name=SeqID_941
MTFLYRNGIKIRDNDNTLENLTVEAATGEKTVNQLAQHLRELVDNIASIS

SEQ ID NO: 7050 - protein, 470 aa, Xenorhabdus bovienii
  Coding DNA sequence: Name=SeqID_942
  Gene classification: Gene name=ProP; Function=77 Permeases of the major facilitator superfamily; Function class=G Carbohydrate transport and metabolism
  Homolog annotation: Query=4..460bp; Hit=6..462bp; Blast score=188; Percent Identity=35.0; E value=9e-48; Homolog= Rv1634 COG0477
MIVTEENSWSDLFSSKNAANAMALSLGVALVAINSLIAITILPSVVNDIGGLNLYAWNTTLFVVTSIIGAILSARLLRALGARKSYLIAALVFFVGSLFCTLAPTMEVMLIGRTIQGFGGGLLFALSYSMVNLVFPQSLWPRAMALISGMWGVATLAGPAIGGIFAEMDTWRYAFGIMLPITLLYALFTYLILPKKNAQNETKAALPIVQLFLLSAAVMAVSAGSLSQDVKANIIGIIAAVVLIVLFIIHERRTLVKLLPQNALSLRSPHLVLFTTMLLLVIGLSADVFVPYFLQVLHGQSPLVSGYMIAAAAVGWTIAEILSAGWQGAKMRFSIVSGPIFMLLGMVLLIVMLPRSSSGQWQTILPLILGLGLFGFGVGFGWPHIVTRILQVSADSDKDIAGASITIVQLSASAFGSALAGMTVNVFGFYQPGGVSGASSSSYWLFLFFAITPLLALFTAWKSAKIPAGK

SEQ ID NO: 7051 - protein, 218 aa, Xenorhabdus bovienii
  Coding DNA sequence: Name=SeqID_943
  Gene classification: Function=Predicted transcriptional regulator; Function class=K Transcription
  Homolog annotation: Query=18..214bp; Hit=5..202bp; Blast score=147; Percent Identity=41.0; E value=1e-35; Homolog= VC2666 COG2345
MSSIDLENNIITAQTVSERLLMLLKTRGAMQASDAGKILGTSGEAARQQFVKLAKEGLVEAESETRGVGRPTQLWHLTDKGHARFPNTHAELTVQLLTIIRSQLGETAMDLIINTREQKTSASYKIAMENAEGLQEKIERLVAIRNQEGYMAQYSVQEDGAILFIENHCPICAAATVCQGFCRAELKLFQEILQAEVERTEYILNGARRCAYRITPLK

SEQ ID NO: 7052 - protein, 307 aa, Xenorhabdus bovienii
  Coding DNA sequence: Name=SeqID_944
  Gene classification: Gene name=RbsK; Function=Sugar kinases, ribokinase family; Function class=G Carbohydrate transport and metabolism
  Homolog annotation: Query=7..302bp; Hit=18..315bp; Blast score=191; Percent Identity=39.0; E value=1e-48; Homolog= Z3263 COG0524
MKVPLLPVVVMGSATGDIVLRLSELPHSGEYWEAEEVDRQVGGCAFNVVRALCRLQIPVINGIFVGNGVWGERVTEEMEMLGLTVTLRHPKRDNSWCIAMMTPDDERIYVSVPGCDDSWNADILATIPLPKPGYVYFSGYELANPKAGALREWLLASPSGLTLVLDFGPRLPDIDREFIQALPAERTILSLNLDETAMLCGAGDPVVQAGRYVNERGFTAIVRLGAEGAWICQPGCEPEYIPAYQVNVEDTIGAGDAHCGGMLAGLSQGMSLRDAVELGNRVAAVTVSRSGPDGAPTQDELMDFVFG

SEQ ID NO: 7053 - protein, 471 aa, Xenorhabdus bovienii
  Coding DNA sequence: Name=SeqID_945
  Gene classification: Gene name=CodB; Function=Purine-cytosine permease and related proteins; Function class=F Nucleotide transport and metabolism
  Homolog annotation: Query=17..438bp; Hit=2..415bp; Blast score=108; Percent Identity=28.0; E value=8e-24; Homolog= BS_yxlA COG1457
MMENVMGTQQNNQGFWKVEHTGIDIVPPSERTGTPMDLFWIWSAANIGILGIIYGAIIVSFKLSFLQSALAVLIGLSSFALVGYLSFSGKLGRTSTLTLSRNIFGIRGNIAPTMIFWGISLGWESINIVTGTLTLSALFQACGLAESTLLTVISMILFAGLSIGVTLLGKEMLIAMQRWIIHVFGAMTLVVVFYILFTTEWEAVLAMPSGSWLTGFLPAVSVVAAGTGIAWAATGADYSRYQSESSSKLKIFTAVTAGGMIPLVLLLFAGILLSVQLPNLPTSENPIAQIGSILPDWMVIPYLMTATAGIVTMAVLSLYSASLNFLTLGIKVKQIHAVTIDSIIVLTLAIYLLFVTGDFMGPFVSFLLFCGVFLAPWEAVFLLDYIIVRRKQGYCTDSLYNDIGPNGGIKWIPVLCWLLGAFVGFLVTKNDFISGPWAVGIFANSSLGLFLSFFVSFICYGLYLMLGRYTR

SEQ ID NO: 7054 - protein, 34 aa, Xenorhabdus bovienii
  Coding DNA sequence: Name=SeqID_946
MRHLKNQRLCWLRQELIESVRSALVIVRFFMVLR

SEQ ID NO: 7055 - protein, 260 aa, Xenorhabdus bovienii
  Coding DNA sequence: Name=SeqID_947
  Gene classification: Gene name=PhnF; Function=Transcriptional regulators; Function class=K Transcription
  Homolog annotation: Query=9..239bp; Hit=12..242bp; Blast score=142; Percent Identity=31.0; E value=4e-34; Homolog= yegW COG2188
MPNHFVDWVREELKKKSSSPRYIQLQQTIEIAIKKQLINEDDFLPPERRLAELLNISRVTVSKAMQLLEEKGVIIRQQGVGTQVAKPGGGSLNQAVGFTSQIVKEGGTVSNYWLSRRIIPAPEDIAKKLSINIGEKIAELRRIRLANGTPVSLENTYIPREYLPNPELLEGSLYAHWEEQGIHLTNVNHKIKAIACSMELAILLNIAEKSPLLQIHQISQNNQNEIIEFSEILCRGDIYGLDFNAPQNIDIKYNKKSRHQ

SEQ ID NO: 7056 - protein, 38 aa, Xenorhabdus bovienii
  Coding DNA sequence: Name=SeqID_948
MDEMYTYIKNNRVIDPQLWGNVPIRRTDFFIVRRIHDQ

SEQ ID NO: 7057 - protein, 125 aa, Xenorhabdus bovienii
  Coding DNA sequence: Name=SeqID_949
  Homolog annotation: Query=7..124bp; Hit=1..117bp; Blast score=135; Percent Identity=55.0; E value=2e-31; Homolog= ref|NP_631635.1|
MQGTTIMSQSQHFTPALTVFMLVKTTPEWLGFSIDQRFKHFAEIFTPIIKKHAAGVSLRFYDVEFYSTRVTDIWVWDAKDHESYQLLVEELRETPLWDRYFDIVEILTGVENAYAKNYGRDVVSA

SEQ ID NO: 7058 - protein, 37 aa, Xenorhabdus bovienii
  Coding DNA sequence: Name=SeqID_950
MGGMRVVNISNSSHYRGLNNECKERQSCLNHNILPPL

SEQ ID NO: 7059 - protein, 215 aa, Xenorhabdus bovienii
  Coding DNA sequence: Name=SeqID_951
  Gene classification: Gene name=AcrR; Function=Transcriptional regulator; Function class=K Transcription
  Homolog annotation: Query=2..119bp; Hit=6..125bp; Blast score=72; Percent Identity=40.0; E value=3e-13; Homolog= CC1664 COG1309
MTTLSNQERPRLRKQPKQARSLAMVEAIIEATARILERHSHEGFSTNAVAELAGVSIGSLYQYFPCKDALMGALIVRESARLITEAQKAVTKTSGRAGISAFIKSCVDHQLRRPTLARLLDFEEARLPFDSDVQRANTQLRSIITELLITPDIPSQTDIQVATRDVMAIIKSMVDTAGEYGESAKSGLTERVERAVFGYLSFRFIPFCQTSDRKG

SEQ ID NO: 7060 - protein, 575 aa, Xenorhabdus bovienii
  Coding DNA sequence: Name=SeqID_952
  Gene classification: Gene name=MdoB; Function=Phosphoglycerol transferase and related proteins, alkaline phosphatase superfamily; Function class=M Cell envelope biogenesis, outer membrane
  Homolog annotation: Query=31..572bp; Hit=1..549bp; Blast score=329; Percent Identity=35.0; E value=5e-90; Homolog= NMA0408 COG1368
MHGISGNHAIFIGRCKTELNCGTEWRMKKKIISGIYLGVLLIASWIIVFEKSSDIYPALVSVGVFGVIFGLTFLVSARWLFSAAFTGTVFIIIKFINQIKVHYYKEHLMFSDLNVMLDPSNQETLRHYWLAGVAMAAMLVWLIFNMVLSWRKADPVRGIKWRVASVVLVAAGVCVVNLTTNAYYTTWQGELPKGRGTMTNMMMSAKDTEYQPPQFGESADYFLQQAKSVTLPEPQSDVKPDVVLLLQESTVNPHIYQLPANAQLPDLYMFQRDVGVSAQSPLRVQTFGGGTWLSEFSVLTGLNTDDFGSRKNAVFYFVVDHLQNSLFRAMKDNGYYTVVLTPFNKSAYHAGHAYKTMGVDRIIQPQELGYPASLEENLWTIPTQDMLSYVKTILAKETDKPIFIFSLTMYEHGPYDEGHSDDYGLTDKLEGSSAVGKFSHYMEKIKASDPAIKDFSEFVATRDKPTLFLYFGDHQPSIHFGNYDSPLADPAHITQFTMRDNLAQGTAITTGKLTDISFLGGMILERARLTAPPFYQANMTMRHLCDGALNDCQDKALVDSYKHYIYQQLNSAGKE

SEQ ID NO: 7061 - protein, 624 aa, Xenorhabdus bovienii
  Coding DNA sequence: Name=SeqID_953
  Gene classification: Gene name=SelB; Function=Selenocysteine-specific translation elongation factor; Function class=J Translation, ribosomal structure and biogenesis
  Homolog annotation: Query=1..624bp; Hit=1..611bp; Blast score=716; Percent Identity=60.0; E value=0; Homolog= selB COG3276
MIFATAGHVDHGKTMLIQAITGVETTHLPEEKKRGMTIDLGYAYWPQRDGTAVGFVDVPGHEKFLSNMLAGVGGIDHILLVVACDDGVMAQTREHLAILRLIGRPAVTVVLTKADCVEQARIDEIQQQARQLLMTQGWQSALLFVTAAATGDGIAEFRQHLIAIHQQHQQHEKLNQRFRLAIDRAFTVKGAGLVVTGTALAGSINVGDMLWLTNSDQIDREQIVRVRGLHAQNQTTQSAQAGQRIALNIAGDISKVQISRGDWLLSQKPLSATEKVLVEVETDEPLQNWQSLHIHHAASHITGRISLLTPLLETPVLAELVLDHPLWLTENDRLILRDISARRTLAGARVINLNPPRRGKRQPEFLNWLAQLAQSSSHTENLALHLPRGALSLSHFAWARQLTEKTLNRLLIDVKAIIADGMMLSQPNAMLAEQKLLQILTEYHEKHPDQLGLGKARLKRMTLPALDDALVYTLIHLLLERKALKQTHGWLHLPEHGLAFTEEQASLWSTAEPYFKDEAWWVRDLAAEMGKEEETIRYLLRKAAQLGLITAIVSDRYYHRRRIQQFADVIRKYNQDNGGITAVDFRNALGVGRKLAIQILEFFDRTGFTRRKSDWHILRDEGMF

SEQ ID NO: 7062 - protein, 469 aa, Xenorhabdus bovienii
  Coding DNA sequence: Name=SeqID_954
  Gene classification: Gene name=SelA; Function=Selenocysteine synthase [seryl-tRNASer selenium transferase]; Function class=E Amino acid transport and metabolism
  Homolog annotation: Query=1..462bp; Hit=1..462bp; Blast score=563; Percent Identity=67.0; E value=1e-160; Homolog= selA COG1921
MTQEIYGLYRQLPAIDSLLREPDIFQLTDLHGQVRVVNTLREMQEQARFDIREHQALPAWSDNWANALCQRLTQDQSSALKPVFNLSGTVLHTNLGRAVLAESAIEAVTNVMRSPVTLEYSLDGAGRGHRDRALADLLCSLTGAEDACIVNNNAAAVLLVLATVAQGKQVVVSRGELVEIGGAFRIPDVMVQAGCHLVEVGTTNRTHLKYYQQAINPETGLLMKVHTSNYSIEGFTAEVSGAELAKLGMTSQVATAVDLGSGSMVDMTQYGLPAEPIPRDYLDHGIDLVTFSGDKLLGGPQAGIIVGKKLWIEAIQRHPLKRALRADKMTLAALEATLRLYQHPEQLCQKLPTLRLLTRPQAEIRDMAHQLLPHIQAYYGETFIARDEPCYSQIGSGSLPVDRLPSWALTFTAIDGRGSTLEKLAHQWRNLEKPVIGRLYDGRLWLDLRCLEDGNALLQTLLLQESLQK

SEQ ID NO: 7063 - protein, 307 aa, Xenorhabdus bovienii
  Coding DNA sequence: Name=SeqID_955
  Gene classification: Gene name=FdhE; Function=Uncharacterized protein involved in formate dehydrogenase formation; Function class=O Posttranslational modification, protein turnover, chaperones
  Homolog annotation: Query=1..307bp; Hit=1..307bp; Blast score=413; Percent Identity=64.0; E value=1e-115; Homolog= ZfdhE COG3058
MSIRIVPKDQLGKERVNERGAGFIPPLLFANLKNLYQRRAERLKALATDNHPFSSYLNFAAEIVQAQQKALYDNPLNMELDDILLQTNSVPLDCKTIPRTQHWHNILYSLIAELLPTMPEHVKPTLENLAKNSVQELEEVASALLTTEFAKVSPDQAVFVWAALSVYWAQMASLIPGKARAEYGEHRQFCPVCGSMPVASVVQIGSSQGLRYLHCHLCESEWHVVRIKCSNCEQTGDLNYWSLESEQAAIKAESCGDCGSYLKILYQEKDPNVDAVADDLASLILDAKMEEEGFARSSLNPFLFPNE

SEQ ID NO: 7064 - protein, 47 aa, Xenorhabdus bovienii
  Coding DNA sequence: Name=SeqID_956
MRILITFLPFIFLARWSIVVPSFVSSNPLLRANLYYWTLSFHLNDGK

SEQ ID NO: 7065 - protein, 263 aa, Xenorhabdus bovienii
  Coding DNA sequence: Name=SeqID_957
  Gene classification: Gene name=MhpC; Function=Predicted hydrolases or acyltransferases (alpha/beta hydrolase superfamily); Function class=R General function prediction only
  Homolog annotation: Query=15..219bp; Hit=19..220bp; Blast score=66; Percent Identity=26.0; E value=3e-11; Homolog= AF1706 COG0596
MIQNKKSVQLSHSVVHYYCVGEGDGIVFLHGTHSDGESSFGHIVSEFAKDNTVIIPDYAGCGNSTLPQGEITVDQLAEQIAAMIKDSAKSPVTLVGTSLGAVIAAVVAANYPELISKLVLTAPWARGQDARHQLMFQTWLALEQNAPDSATAFGLSHVLSPVFLTSLGSEKIKQICSKASAKDTDKRIQLGLNIDINESLSMIKQPTLVIGLEFDTLIPLYQVKTVHQKITQSQYSEIASGHAVQLENPQDWISCIKNFLQRK

SEQ ID NO: 7066 - protein, 49 aa, Xenorhabdus bovienii
  Coding DNA sequence: Name=SeqID_958
LSHLSFVLLSHLYFSDVFLKAIDHRNSKWRGKAGHTKLFNVECSPHGRG

SEQ ID NO: 7067 - protein, 30 aa, Xenorhabdus bovienii
  Coding DNA sequence: Name=SeqID_959
MSINQKKITHTRLTNCSTYNSHSAAISVIY

SEQ ID NO: 7068 - protein, 181 aa, Xenorhabdus bovienii
  Coding DNA sequence: Name=SeqID_960
  Homolog annotation: Query=8..179bp; Hit=3..181bp; Blast score=156; Percent Identity=48.0; E value=2e-37; Homolog= ref|NP_927674.1|
MSVKWKLIKNKKVIFSIVIIAIVSIYYIASYKWDVKDAITSYVDNNCEWRNECLVDFRNVIPFEWDRAYIFQPGDAPENINIAIGMKYSFVDVGLKFIFIKGNEIVYSEEYFPDPEFEEKAHIYPKFNNEGRNFPDYYYITKENSKIFIQNTSTTYGARQSYVVRPSNEYQSEKNNSYKIN

SEQ ID NO: 7069 - protein, 30 aa, Xenorhabdus bovienii
  Coding DNA sequence: Name=SeqID_961
MSDSIEFRIIGDTIGQRANVWRVSKFLFVQ

SEQ ID NO: 7070 - protein, 41 aa, Xenorhabdus bovienii
  Coding DNA sequence: Name=SeqID_962
MRSEHVRSLGWVRVKLLKNELGPRSHYRTMIRMHHLVKIKP

SEQ ID NO: 7071 - protein, 156 aa, Xenorhabdus bovienii
  Coding DNA sequence: Name=SeqID_963
  Homolog annotation: Query=1..156bp; Hit=1..156bp; Blast score=185; Percent Identity=60.0; E value=2e-46; Homolog= ref|NP_746270.1|
MQHSPYPAVLDACVLYPARLRDLLMHLGLAGLYQPKWSDTIQDEWKRNLLKQRSDIKPEVLEQTTTLMNTALPDANVTGFELLIEGLRLPDEDDRHVLATAIRANAEVIVTMNLKDFPPKILAEFDIEALHPDEFISDLFDLNHAAALEAVRQQHI

SEQ ID NO: 7072 - protein, 154 aa, Xenorhabdus bovienii
  Coding DNA sequence: Name=SeqID_964
  Homolog annotation: Query=1..152bp; Hit=1..152bp; Blast score=193; Percent Identity=71.0; E value=6e-49; Homolog= ref|NP_929525.1|
MNNTTLTSLNLPAQHEIEIAMRGQRELATFLSTKSETQQIIINGADNVSHQIELPTSVLTMLMNILGELAVGNAVQIVPVHAELTTQEAANIMNVSRPHMVKLLEDGKLPHHKTGRHRRVLFADLMEYKKKRDADSIAAMQELAAQAQELNLGY

SEQ ID NO: 7073 - protein, 172 aa, Xenorhabdus bovienii
  Coding DNA sequence: Name=SeqID_965
  Homolog annotation: Query=1..171bp; Hit=470..630bp; Blast score=87; Percent Identity=35.0; E value=1e-16; Homolog= ref|NP_046924.1|
VRQGTKQIVETYPNDLVTSSQLRTLGFNIPLTKRYLEFAADALEQEIGENGRYQRVDNSPNIIIQDDEDEELETDIIDNESIEDDEIEINDDTAENGSEPEQEPEPNSEFEEKLEQIEQPESAERPRFSAPHRRNDGQWIVRFEYSGQNYAWVGQADNLKDAMIQAWLAYFD

SEQ ID NO: 7074 - protein, 213 aa, Xenorhabdus bovienii
  Coding DNA sequence: Name=SeqID_966
  Gene classification: Gene name=FdnI; Function=Cytochrome b subunit of formate dehydrogenase; Function class=C Energy production and conversion
  Homolog annotation: Query=3..210bp; Hit=2..209bp; Blast score=255; Percent Identity=60.0; E value=3e-68; Homolog= fdoI COG2864
MKKRNDIIIRHSPIERINHWAVVIVFLFTAISGLGFFFPSLNWMMNIFGTPQLSRILHPFAGSVMFFLFVFMFFRYFKHNLLDRDDIEWAKHVHNVLRNEETGDTGQYNLGQQGIYWSVSVCLLLLLVSGIIIWRLYFAEYFPIPLIRIALLVHSLSAISLILTIIVHAYAAFWVKGSVRAMVEGWVTRGWAKKHHPRWYREILKAEQQKEKE

SEQ ID NO: 7075 - protein, 202 aa, Xenorhabdus bovienii
  Coding DNA sequence: Name=SeqID_967
  Gene classification: Gene name=HybA; Function=Fe-S-cluster-containing hydrogenase components 1; Function class=C Energy production and conversion
  Homolog annotation: Query=1..184bp; Hit=101..288bp; Blast score=337; Percent Identity=83.0; E value=4e-93; Homolog= fdoH COG0437
MHCADPGCLTACPAEGAIIQYANGIVDFQSEHCIGCGYCIAGCPFDVPRINKEDNRAYKCTLCVDRVGVGQEPACVKTCPTGAIHFGSKQDMKALAAERVEELNGRGYDNAGLYDPEGVGGTHVMYVLHHANKPKLYHGLPDNPTISPTVTFWKGIWKPLAAIGFAASIFHYVGIGPNRVSEEEEESARKDVESSANEEEQQ

SEQ ID NO: 7076 - protein, 92 aa, Xenorhabdus bovienii
  Coding DNA sequence: Name=SeqID_968
  Gene classification: Gene name=HybA; Function=Fe-S-cluster-containing hydrogenase components 1; Function class=C Energy production and conversion
  Homolog annotation: Query=1..92bp; Hit=1..92bp; Blast score=160; Percent Identity=79.0; E value=2e-40; Homolog= ZfdnH COG0437
MSLQTQDIIRRSATSSLTPAPRVRDHQQEVAKLIDVTTCIGCKACQVACSEWNDIRDEVGHNVGVYDNPADLTAKSWTVMRFSEVEEYGRLE

SEQ ID NO: 7077 - protein, 803 aa, Xenorhabdus bovienii
  Coding DNA sequence: Name=SeqID_969
  Gene classification: Gene name=BisC; Function=Anaerobic dehydrogenases, typically selenocysteine-containing; Function class =C Energy production and conversion
  Homolog annotation: Query=1..803bp; Hit=213..1016bp; Blast score =1443; Percent Identity=83.0; E value=0; Homolog= fdoG COG0243
MTNHWVDIKNANLIVVMGGNAAEAHPVGFRWAMEAKIHNNARLIVIDPRFTRTASVADFYTPIRSGTDITFLSGVILYLMNNEKINREYVEAYTSASLIVREDFSFDDGLFSGYDAENRRYDKTTWNYALDENGFAKRDKTLSHPRCVWNLLKEHVSRYTPDVVTDICGTPKEDFLKVCEYLAETSVKDKTATFLYALGWTQHSVGAQNIRTMAIIQLLLGNMGMAGGGINALRGHSNIQGLTDLGLLSQSLPGYLSLPSEKQTDLQTYLQANTPKSTVPGQVNYWGNYPRFFVSLMKSFYGDHAHKENDWGFDLLPKWDKPYDVLQYFEMMSQGEVNGYICQGFNPIASFPHKNKVVAALSKLKFLVTVDPLSTETASFWQNHGEFNDVDPSSIQTEVFRLPSCCFAEENGSIVNSARWLQWHWKGADAPGEAISDGEILSGIFKRMRDMYLEEGGAFPEQVLNMTWDYFDADNPTPEEVAQESNGRALVDLLDANGNVLVKKGQQLSSFAQLRDDGTTASGCWIFAGSWTPEGNQMARRDNADPSGIGNTLGWAWAWPLNRRILYNRASADPQGKPWDAKRQLIAWEGDKWSGVDIPDYSNAAPGTDVGPFIMQPEGMGRLFAIDKMAEGPFPEHYEPFETPLGTNPLHPNVISNPAARIFKSDFESLGKADKFPYVGTTYRLTEHFHFWTKHALLNAIAQPEQFVEIGERLAAEKGIKQGDTVKVSSNRGYIKAKAVVTKRIRTLNVHGRQVDTIGIPIHWGFEGAAKKGFLANTLTPFVGDANTQTPEFKAFLVNVEKV

SEQ ID NO: 7078 - protein, 195 aa, Xenorhabdus bovienii
  Coding DNA sequence: Name=SeqID_970
  Gene classification: Gene name=BisC; Function=Anaerobic dehydrogenases, typically selenocysteine-containing; Function class =C Energy production and conversion
  Homolog annotation: Query=1..195bp; Hit=1..195bp; Blast score=365; Percent Identity=86.0; E value=1e-101; Homolog= fdoG COG0243
MQVSRRQFFKICAGGMAGTTAAALGFIPTAALAQTRNYKLLRARETRNTCTYCSVGCGLLMYSLGDGAKNAKATIFHIEGDPDHPVNRGALCPKGAGLVDFVHSKNRLHYPEYRAPGSNQWQRISWHDAFDRIAKLMKQDRDANFIKTNNDGVEVNRWLTTGMLCASAASNETGYLTQKFTRALGMLAVDNQARV

SEQ ID NO: 7079 - protein, 52 aa, Xenorhabdus bovienii
  Coding DNA sequence: Name=SeqID_971
MILFVWINRERREFTRFKRMMLLTDRIQNEKKNIHKSRPKIAYLRVFRQGMC

SEQ ID NO: 7080 - protein, 276 aa, Xenorhabdus bovienii
  Coding DNA sequence: Name=SeqID_972
  Gene classification: Gene name=FdhD; Function=Uncharacterized protein required for formate dehydrogenase activity; Function class=C Energy production and conversion
  Homolog annotation: Query=12..274bp; Hit=12..275bp; Blast score=367; Percent Identity=68.0; E value=1e-102; Homolog= ZfdhD COG1526
MDNANSGNRLIIDEICGATRINVQQKNHLNSPKPDWVAEEVPIALVYNGISHVVMMASPKDLDHFAMGFSLSESIITSPQEIHGIDTVISCHGGIELHIELSSRRFAELKERRRNMAGRTGCGICGTEQIAEIFRPIPSLPFTQTFSLDYLDQALAQLPRLQEIGAATGCTHAAGWIDAKGVLLGGSEDVGRHVALDKLLGMRAKTGWRQGAVLVSSRASYEMVQKSAMCGVEILFAVSAATSLAIEVAEKCNLTLVGFCKLGRATVYTHPRRLVD

SEQ ID NO: 7081 - protein, 254 aa, Xenorhabdus bovienii
  Coding DNA sequence: Name=SeqID_973
  Homolog annotation: Query=1..253bp; Hit=1..253bp; Blast score=343; Percent Identity=65.0; E value=1e-93; Homolog= ref|NP_932037.1|
MDAKIIIQSAEERADLDEQIYDLVRHLWPFFMNQDPVAQQHWEKLYEPDFSRFQKFAILQQGQEERLIGLLNAIPFPWEPHALDQLPDEGWDAVYCAGMAAKGKQQPTLLSALSVTVAPEFRGHNVPALLINSVKQTAREAGLQGFVVPVRPSLKCSYPLQDFVQYCEWKNEKGEPFDPWIRTHWRLGAKIIKPALRSMDIYGTVAEWQEWTGMKFPQSGEYIIPGGLVPLLVDVEKQMGYYIEPNLWMFHSLD

SEQ ID NO: 7082 - protein, 249 aa, Xenorhabdus bovienii
  Coding DNA sequence: Name=SeqID_974
  Homolog annotation: Query=5..248bp; Hit=1..246bp; Blast score=238; Percent Identity=60.0; E value=8e-62; Homolog= ref|NP_930732.1|
MRIMMKKINVLVAALGALGFMAQAQASVGFGQSQEDTTPHIKVGATKASSSPHGGSGDEPGIGVSSVRDGMLIGFSGLTRMAPADSNGIHNISMAGAPGSHGGMGVFHFSKVANADVYFGEWSETGNATDTTHTVYYAGKDITTNMPTDGTATYVVNGINQYSGDNALSGTLTADFGEKTLIGSIENTAMTVSIDADIQSDAQFSGLATTGDLEGETQGHFFGDGASSLAGYATFDDKSKDTAFGGSKQ

SEQ ID NO: 7083 - protein, 492 aa, Xenorhabdus bovienii
  Coding DNA sequence: Name=SeqID_975
  Gene classification: Gene name=OmpU; Function=Predicted outer membrane protein; Function class=M Cell envelope biogenesis, outer membrane
  Homolog annotation: Query=19..492bp; Hit=20..488bp; Blast score=100; Percent Identity=24.0; E value=5e-21; Homolog= NMB0313 COG3699
MSDNITTPILLTALMALCLSLPVYADEDTNRKIWQEAQHNQQENEADLITPEPIFIEDGASSIVINGQTFQVENNLNNIGQALYLATNHRQWPDVRRFLTAYQKLSGHDVMLVSFAQGGLARFEGDLDLAAYHYQKLLNQQPDFTRIKLELARVYFENHKNREAEQLFAGLSEQTPLPETVLKNINSYLKAIALRSDWRGSFSVGYAYNDNVNMSPDQEPTCLTYNPDGSCYEKLHIPKAIKKWGMSYDATLSRRYQLSGHHGIFGRGLIYGENYRDYHAENENTVLLVSGYNYKSRNHDFSFGPLLEYKQRAGDTYYRATGVKTEWRQTFSPKTALNIELEHKQLRHQQRYHWKNGDLSSSYLTLSHAISKEFVVFGGGDWVYRNNPQPADRYQQWGIRAGISGQIYPGINGSLSATLRERRFGAYSPILHARRQDDEQIYTAVIKVPAAEILGMTPSITFRHRRNHSSVNWRYNYNYNKNEVLLRLEKYF

SEQ ID NO: 7084 - protein, 977 aa, Xenorhabdus bovienii
  Coding DNA sequence: Name=SeqID_976
  Gene classification: Gene name=CirA; Function=Outer membrane receptor proteins, mostly Fe transport; Function class=P Inorganic ion transport and metabolism
  Homolog annotation: Query=27..561bp; Hit=144..625bp; Blast score=231; Percent Identity=31.0; E value=2e-60; Homolog= PA4897 COG1629
MAYRVKIQLTPITIALSLVFSLTAPPLFAEPKSTVTSPSKQTDLGKIRVTDNSDKDEASHDAVYDKDISNIYIGKEQIERYKGASPADLIKGAVGVYSGDARNSGALDINIRGIQGQGRIPVTIDGTEQAITVGRGYNGANNRNYIDPNLINSIEIEKGPSLNRNVKGSIGGAVVIKTLTIDDVVPKGETFGINTKLETSSNSVRERKPSLALGQDYRDVPDFIQNGVEADPELKITPHSSKDNKFPGFKDNAFRVALGTRQEYFDLMLAYSYRRQGNYFAGKGGAHRYDEPITAADTELMNGYKTTLDPYLPFAAHIYRPGNEVPNTSSEMRSVLIKNTWRLTDDQALQLGFRNTHMEFGDIMPSRLGWVKAEDNAVPQWPLANVHQQAVNLTYKWQAADNPYIDFDMNLWTTRTTSNTNTAGGYPRTPVERDYSWDNGSGVKASHIDGSLIDTAKTNAQNNRWGVDISNKFTLASSLDLTLMGNFQREHLDSNDGYNPLNMYFFQSPARKGQRQEINLAFNFDWRPTSWLALSAGAKRVSYWSKDDFLNERRAARDARYRNNSETTGHQISYYRTMTEREAYIKQKKLSKMSREERTEYFKVKTGDITSRDGQQRKMVRQEVDWLYNSSNGQLNKSDNPYFNGQLDMQEKIIDPMTGKEGYKYEYGSGVDANGIRREIPDADPWEPASKRKDHAWAPTFSATAYITDDFRIYTRYAEAVRMPSIFEDTVGFSGNKSNRVGQKFKPERAKTTEVGFVYDFSQLVDAERHADIKMSYYNTVIENVFDRDNTYEFSQMDKQKLAGLELQARYDNGSFFTDMGLTYNLKNKVCDNNSSLRMNSLNRYDIPECIDGGFAGGYLRTSIQPRYSANLTVGGRLFDEKLELGSRMFYHSKAENKDEKWLMETLPDVYKGQSNNPMRWNPVLTVDAYVSYQITPTLSMELTGTNLTNRYYLDPLTRSMIPAPGRTFKLSITSQF

SEQ ID NO: 7085 - protein, 266 aa, Xenorhabdus bovienii
  Coding DNA sequence: Name=SeqID_977
  Gene classification: Gene name=TonB; Function=Periplasmic protein TonB, links inner and outer membranes; Function class=M Cell envelope biogenesis, outer membrane
  Homolog annotation: Query=20..265bp; Hit=5..269bp; Blast score=73; Percent Identity=29.0; E value=2e-13; Homolog= HI0251 COG0810
MTNTAILESPANHFPLLPGKQLLVGILIAILLHISLIWLFNRHASYDDSAHHVNQSSPLTGLSITMVAASSWANEPESVSPPPPLITAPESPTKPKIALDKAVQPESRLEKPLESVKPQKHQKPQEKAEKKSALSPQVQDSNEELETSGTDQINSQSSMSRAATTQPLVGQGNSALDNYPSRLKQEVESHKRYPRKAKRMKQQGTVTIGFTLLNDGSFTAARVINSSGNSVLDDAALDAIARASSVGPKPADLAPDVTLEIDFELD

SEQ ID NO: 7086 - protein, 188 aa, Xenorhabdus bovienii
  Coding DNA sequence: Name=SeqID_978
  Gene classification: Gene name=MdaB; Function=Putative NADPH-quinone reductase (modulator of drug activity B); Function class=R General function prediction only
  Homolog annotation: Query=1..186bp; Hit=1..186bp; Blast score=118; Percent Identity=36.0; E value=4e-27; Homolog= BH2748 COG2249
MKHMIIYAHPNPKSFNHAIKEKIISEIGNKGEEYSFISLYDEKFNPVLASSDFEALHRGEVLPDVAKSQSMIKEADHLIFIYPIWWFGQPAILKGWIDRVFSNGFAYYEDDKIFTPFLTDKSATVYVTLGTAKEVLVQNDMEIDNFMRDMTLGTLGLVGIYPVNVVPFYAIPTISDAERNSMLESIVI

SEQ ID NO: 7087 - protein, 247 aa, Xenorhabdus bovienii
  Coding DNA sequence: Name=SeqID_979
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=5..242bp; Hit=9..243bp; Blast score=107; Percent Identity=32.0; E value=1e-23; Homolog= TM1724 COG1028
MLTFIVTGAASGIGYVVCQKLVVAGYYVIAIDIEHDGLNQLVEQSPEYIKAIQIDLTDENAIINEVFPLIKSGNLQGIVISHGKDNSNDIGQSDIWDSILATNLYSTQRLLSHVVPEILLGGRVVVISSILGKAGKKHNSAYSASKHALLGLTKSLALDLAERQITVNAVLPSWVDTPMLVKGLEPQAKLLGCSTSALLKRIEKRIPLRRLVSPQDVANTVMFFISHDASMITAQGLVIDGGDSCGA

SEQ ID NO: 7088 - protein, 254 aa, Xenorhabdus bovienii
  Coding DNA sequence: Name=SeqID_980
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=14..253bp; Hit=5..246bp; Blast score=168; Percent Identity=40.0; E value=4e-42; Homolog= BH2491 COG1028
MSENTQVGQDAVKKCAIVTGGSKGIGRAIVLSLLEKGYRVAFCYRNEMPQTADFIAEVTHDYPDVLPIRADLAKAEDVSTFINTVSEAFGRIDLLVNNAGITRDGLLATMETKDIELLINNNLLSYILCSREVLKVMIPQRSGHIINISSISAKRPNKGQSIYAATKGGIESLTRALAVEVAAKNIRVNAVAPGIIQTEMSESLLNTHKELINNKVLLKRVGTVREITSSVHFLIENNYITGEVINVNGGIALS

SEQ ID NO: 7089 - protein, 952 aa, Xenorhabdus bovienii
  Coding DNA sequence: Name=SeqID_981
  Gene classification: Gene name=ArgD; Function=PLP-dependent aminotransferases; Function class=E Amino acid transport and metabolism
  Homolog annotation: Query=191..438bp; Hit=145..368bp; Blast score =101; Percent Identity=29.0; E value=4e-21; Homolog= YOL140w COG0160
MENYARFCKPLLTRALVSIGLDKTYHRASGNFLYYKDEQDQEIPVLDLLGGYGATLLGHNSLLIRERIKHYLDEEIPVHNQFSIRKPAAVLAERLNELLKEETATSGDFVFCFTSTGAESMEVALKSVEFTRNAELVALEQEVAQATAKINGGSVIALTDEQCQQLQLEEKASAQDIQRALTAFNQSRLDSKPTFLALEHAFHGKMIVTANCTHGTMYRDYLKRLKINTYFLSTEKLSEFVEMGEKANDILNGWLWLPQEENDRIILTKKKFRTVAALLIEPVQGEGGVYPLSAEQVSGVNQLKQIIRCPIIADEVQAGSGRCGFLVASSDVGIHADYYVLSKALGGGYAKIGVVAIRQESFTPGFDLIQSSTFGEDDFSCRVALDYINLLHADQRQLLKQVTQLGEEFKVRLHALKEDYPDIIRDVRGKGLIWGVEFHDVDDSDSYILQNIAVQGSLGYIISGYLLCGSHIRVAPSGSASNVIRMEPSVFLELRDIVRFVDELAKVCLAIRHANAGFIVAPILGKLNQSTPADYRSREVGQQNGSSANYKAAFINHLISADWLREVDPSFSIFSDEELESFVESTSFNLATKPFKPARISSVNGQSVDFTLYPIPVTSKMIKAALAQNDLARLRHEIDVRIAQAVESGNTVVGLGMFTSIITNNGKSVKNNQIGITTGNALTVGIGIEALQRSTSHRDITQMRLAVIGGAGNIGRVYAEILGPQYQEMVLIGSNNQGSVRKLNEVKYHIYQYIYEQFIVNKQPLMGGLAQRIVDCLALMPDDDFISQFNEGKTSIGEAIDHYLVQHYPDQVFIHISQSISDIEHSDVIVCAANASEAFISVDQIKRDAIVCDISVPHNLSDDDLRNRPDIKILRGGIVQTPHHDSLDPRVRAYLGEGQLYACMTETILLALEQHKDNFSYGNISTHQVLDIMAIARKHHFTLSDIKENSSL

SEQ ID NO: 7090 - protein, 258 aa, Xenorhabdus bovienii
  Coding DNA sequence: Name=SeqID_982
  Homolog annotation: Query=24..175bp; Hit=99..251bp; Blast score=81; Percent Identity=34.0; E value=2e-14; Homolog= ref|NP_744925.1|
VINRGVKLISYNVTSHHPSLNSLNHENNGGELIKNDKLRRFYSIGTEKGIISARRALMLSGLDIADPNKRFGLYTTQYGYLHPMPSELNPEQEEHGAENEHEIYQTIWNSVQVSPFLITLSLSNNLLGVLSQELSLQCDCASFLRGNIGLLSAFSEAELFLSNGMIDYALVVASGMGNITHDAQSDGEEDFVEFGVTFILAKGERPTLQDYPTIDISSLSRMYREGNHCAEAVLFINEIADYMSACVRTETASPSLKP

SEQ ID NO: 7091 - protein, 441 aa, Xenorhabdus bovienii
  Coding DNA sequence: Name=SeqID_983
  Gene classification: Gene name=FabB; Function=3-oxoacyl-(acyl-carrier- protein) synthase; Function class=I Lipid metabolism
  Homolog annotation: Query=22..434bp; Hit=3..409bp; Blast score=270; Percent Identity=41.0; E value=2e-72; Homolog= aq_1717 COG0304
MHCHFASHGDAQRGGVVMVSDRRVVVTGMGIVSAFGTHIDVFWQKLCDGESAVKPLAFADNGALPIKYAAQIDFDSLIANHSAYLPESGMTDRRGVMGIIAAAKALEDAGLHPAQLAGKRIGIYGCSGVSSTLEDDRNLCRHSHEPVMQSLLQQRNNLGTYSGIRCSNDGMVTEIARQLALAGPVVNVNAACAGATHAIGLACQSIRRGEATMMLAGGADSVISLRTLVGLNLLGATATTEKWGDRFCRPFDKNRSGLVAGEGGAFLVLESEESALSRGAKIYAEITGYGASLDAYKLTAPHPDGIGAENVIRKAIRDSGLEPHQIDYVNAHGTSTPLNDELETAVIKRIFGSQPPLISSIKSMLGHWIAAAGAVETVATVLTVKNKFIPPTINLETPDPLCDLDYVPQKGRPFPVKNAITNSFGFGGINSCLVIGDYGDK

SEQ ID NO: 7092 - protein, 366 aa, Xenorhabdus bovienii
  Coding DNA sequence: Name=SeqID_984
MGIYIASGVSLLPDGLNMDNLIQGNIAAAERSDSSLHLPNIVGERLISDKAFVMPRMDKIVRRVANAQSRWVLYSGIKTWESSTGDKISPEQRGLFIGLGTSDADDDILPIAFDAQDDESYVSRALVETPPLMGLALLNTSTASHLSQHLNIQGDNGFFSPHVDAGGNAFLEGYYSIKEKRSQWVLCGGGSQKISPWYYLAYERLIKNTPWLPAEAAAFITLHEDVHNADGEILRFERSFLHNTAFHNNNPYQRFLTELTEENLSPCQIIHVGKATDGFIALASDTFPDAIQFYLDKTMGYSGPAAPFIAINLAIDMHKKGISVDNVNRNFIRPLPPSLVLVVVHGLENQCIAILLRMGMPKEGEL

SEQ ID NO: 7093 - protein, 420 aa, Xenorhabdus bovienii
  Coding DNA sequence: Name=SeqID_985
  Gene classification: Gene name=FabB; Function=3-oxoacyl-(acyl-carrier- protein) synthase; Function class=I Lipid metabolism
  Homolog annotation: Query=171..417bp; Hit=171..420bp; Blast score =157; Percent Identity=39.0; E value=2e-38; Homolog= PA1373 COG0304
MTGISTDNIAVTGYGLIVRNHDCPSDLFNSLSEGKSLICEDELLKEYGITHIPSAKLSSKDIDRLRSQFSCTGQLSNNRVFLMACGAASNSLQMAGLTQTELNQSQCELFFANNKMFVDGEALSRYFNSGISPSKYIDIEQFGALMRPYEIAEELANSLNISTLPKIYSDACTAGMVALYSAYQHLKSGRLDIALVGASEEATHPIMQLLFKKVRALYDGKFTDMSESSRAFDKDRSGCVLADASAFLVVERCSHAIARKANIIAEIAGMSRQSEGYKMTSTDLSGRYYRDCMSAALQDAGLSAEDIEHINSHGTSTVNNDLAESKAINALFPHNPLVISTKSAMGHSLAVSGLLEAILSIETLKNELILPSLNFSEAGKTDGVVNVNSTAKVKRVNHILSNSFGFGGENSSLILKRHEG

SEQ ID NO: 7094 - protein, 153 aa, Xenorhabdus bovienii
  Coding DNA sequence: Name=SeqID_986
  Homolog annotation: Query=5..124bp; Hit=11..128bp; Blast score=94; Percent Identity=39.0; E value=5e-19; Homolog= ref|NP_744921.1|
MKKYVSAVCEELSSILFVEENTIHENSSLINDLGADSLDVIDLSFNLGKKFKITMPTKSVFAHAYEVLSEEVLNRLLAEDTLTQEGKGLLVYSCYDYTPEQLNTIHTLGDVFGETNVHNWASLCKATYESNGKNADEIILEEIEKYCSEMLIK

SEQ ID NO: 7095 - protein, 42 aa, Xenorhabdus bovienii
  Coding DNA sequence: Name=SeqID_987
MNKKTIITNCYFIHFILNNNKLIILTQNITMEFNLLLIINMI

SEQ ID NO: 7096 - protein, 79 aa, Xenorhabdus bovienii
  Coding DNA sequence: Name=SeqID_988
MGKKYRVTFTEAYQMYILMSFARIGLCSFSDKLSTLFCIFKINYHCISKRKLMLSRTVRVHRNICTSIFFRCTSAIALT

SEQ ID NO: 7097 - protein, 454 aa, Xenorhabdus bovienii
  Coding DNA sequence: Name=SeqID_989
  Gene classification: Gene name=ThdF; Function=Predicted GTPase; Function class=R General function prediction only
  Homolog annotation: Query=1..454bp; Hit=1..454bp; Blast score=749; Percent Identity=84.0; E value=0; Homolog= ZthdF COG0486
MNTTDTIVAQATPPGRGGVGILRISGPKAAEVAEVVLGKLPKPRYADYLPFRDVDGTVLDQGIALYFPGPNSFTGEDVLELQGHGGPVILDLLLKRILTISAVRIANPGEFSERAFLNDKLDLAQAEAIADLIDASSEQAARSAMNSLQGTFSHHVHQMVEALTNLRIYVEAAIDFPDEEIDFLSDGKIEAKLDEVIAELGHVRSQARQGSLLREGMKVVIAGRPNAGKSSLLNALAGREAAIVTDIAGTTRDVLREHIHVDGMPLHIIDTAGLREASDEVERIGIERAWQEIEQADRVLFMVDSTTTDAVEPAKIWPEFMAKLPASLPVTVIRNKTDMTGEETGVLEVSGYSLIRLSAREGKGIDLLRDHLKEAMGFNSNTEGGFLARRRHLQALNTAAEHLQEGHQQLVFARSGELLAEELRLAQQVLCEITGEFTSDDLLGRIFSSFCIGK

SEQ ID NO: 7098 - protein, 537 aa, Xenorhabdus bovienii
  Coding DNA sequence: Name=SeqID_990
  Gene classification: Gene name=YidC (BS); Function=Preprotein translocase subunit YidC; Function class=N Cell motility and secretion
  Homolog annotation: Query=1..537bp; Hit=1..546bp; Blast score=773; Percent Identity=72.0; E value=0; Homolog= ZyidC COG0706
MDSQRNLLFIALLFVSFLVWQAWEKDQNPQPTAQITQQANTPSSEASSGQGKLITVKTDVLSLHINTRGGDIEEADLLAYPDTLGSNKPFKLLESTPEFIYQAQSGLTGTNGPDNQAERPFYHTTQDSYVLADGQNELRIPMTYTAPDGVVYVKTFILKRGNYAVSVDYNIDNVTDKPLQMAFFGQLKQSVELPKSRDTGSSNFALHTYRGAAYSSAEAKYEKYKFGDIEDKALAVTTNGGWVAMLQQYFATAWVPGANSTSTFYTIDQKSQKMAIIGYKGETVNIAPNSKQNISSTLWVGPEIQDKMAEVAPHLDLTVDYGWLWFISQPLFKLLKFLHEFIGNWGFSIIAITFIVRGIMYPLTKAQYTSMAKMRLLQPKITAMRERHGDDRQRMSQEMMALYKTEKVNPLGGCLPLVIQMPIFLALYYMLMGSVELRHAPFIGWIEDLSAQDPYYILPLLMGATMFVIQKLSPTTVTDPMQQKIMTYMPVMFTVFFLWFPSGLVLYYIVSNLVTIIQQQVIFRSLEKRGLHTREKK

SEQ ID NO: 7099 - protein, 86 aa, Xenorhabdus bovienii
  Coding DNA sequence: Name=SeqID_991
  Gene classification: Function=Uncharacterized ACR; Function class=S Function unknown
  Homolog annotation: Query=1..86bp; Hit=1..85bp; Blast score=125; Percent Identity=77.0; E value=9e-30; Homolog= yidD COG0759
MASSLSLGSRLLIAIIRGYQLVISPLLGPRCRFHPTCSQYGIEALRRFGMIKGSWLTVKRILKCHPLHEGGDDPVPPKKNEDNREH

SEQ ID NO: 7100 - protein, 119 aa, Xenorhabdus bovienii
  Coding DNA sequence: Name=SeqID_992
  Gene classification: Gene name=RnpA; Function=RNase P protein component; Function class=J Translation, ribosomal structure and biogenesis
  Homolog annotation: Query=1..119bp; Hit=1..119bp; Blast score=174; Percent Identity=81.0; E value=1e-44; Homolog= rnpA COG0594
VVKLAFPRELRLLTPEHFTYVFQQPQRASSAEITILGRLNELGHPRIGLTVAKKNVKRAHERNRIKRLARESFRLNQHKLPSMDFVVLVRKGVAELDNRELTEALGKLWRRHCRLVRGS

SEQ ID NO: 7101 - protein, 46 aa, Xenorhabdus bovienii
  Coding DNA sequence: Name=SeqID_993
MKRTFQPSVLKRNRTHGFRSRMATKNGRQVLARRRAKGRTRLTVSK

SEQ ID NO: 7102 - protein, 44 aa, Xenorhabdus bovienii
  Coding DNA sequence: Name=SeqID_994
MILALYYTVRIILHPACYANDFFRLWLVKFWVSTSGSKSLVMSG

SEQ ID NO: 7103 - protein, 37 aa, Xenorhabdus bovienii
  Coding DNA sequence: Name=SeqID_995
MEFAIYHDYTTVSSTSLIFSECQSVAISLWIKSVKAV

SEQ ID NO: 7104 - protein, 522 aa, Xenorhabdus bovienii
  Coding DNA sequence: Name=SeqID_996
  Gene classification: Gene name=DnaA; Function=ATPase involved in DNA replication initiation; Function class=L DNA replication, recombination and repair
  Homolog annotation: Query=61..522bp; Hit=1..467bp; Blast score=816; Percent Identity=89.0; E value=0; Homolog= dnaA COG0593
LRYDHRSRSHYTDRWGSDDSKNRHKVHATFLIIGGMTLYTQYNVSIIPISFIGLVLGEFAVSLSLWQQCLARLQDELPATEFSMWIRPLQAELSDNTLALYAPNRFVLDWVREKYINNINLLLNDFCGPEVPLLRFEVGNKPVSPNQSTSQKIIANMPIATAPSSLSVRPSWDNAKAQPELSYRSNVNPKHTFDNFVEGKSNQLARAAARQVADNPGGAYNPLFLYGGTGLGKTHLLHAVGNSIMARKANAKVVYMHSERFVQDMVKALQNNAIEEFKRYYRSVDALLIDDIQFFANKERSQEEFFHTFNALLEGNQQIILTSDRYPKEINGVEDRLKSRFGWGLTVAIEPPELETRVAFLMKKADENQIQLRGEVAFFIAKRLRSNVRELEGALNRVIANANFTGRAITIDFVREALRDLLALQEKLVTIDNIQKTVAEYYKIKVADLLSKRRSRSVARPRQMAMALAKELTNHSLPEIGDAFGGRDHTTVLHACRKIEQLREESHDIKEDFSNLIRTLSS

SEQ ID NO: 7105 - protein, 366 aa, Xenorhabdus bovienii
  Coding DNA sequence: Name=SeqID_997
  Gene classification: Gene name=DnaN; Function=DNA polymerase sliding clamp subunit (PCNA homolog); Function class=L DNA replication, recombination and repair
  Homolog annotation: Query=1..366bp; Hit=1..366bp; Blast score=640; Percent Identity=85.0; E value=0; Homolog= dnaN COG0592
MKFIIEREQLLKPLQQVSSPLGGRPTLPILGNLLLQVTEGSLLLTGTDLEMEMKARVALSQPHEQGATTIPARKFFDIWRGLPDGAEISVELDGDRILVRSGRSRFSLSTLPASDFPNLDDWQSEVEFSLPQATLKRLIESTQFSMAHQDVRYYLNGMLFETEEEELRTVATDGHRLAVCSMNIGQNLPSHSVIVPRKGVIELMRLLDGGDSPLQLQIGSNNIRAHVGDFVFTSKLVDGRFPDYRRVLPKNPDKTLEANCDVLKQAFSRAAILSNEKFRGVRIYLSENQLRITANNPEQEEAEEIVDVSYQGTEMEIGFNVSYVLDVLNALKCEQVSLLLTDATSSVKIENSASQAATYVVMPMRL

SEQ ID NO: 7106 - protein, 404 aa, Xenorhabdus bovienii
  Coding DNA sequence: Name=SeqID_998
  Gene classification: Gene name=RecF; Function=Recombinational DNA repair ATPase (RecF pathway); Function class=L DNA replication, recombination and repair
  Homolog annotation: Query=42..398bp; Hit=1..355bp; Blast score=547; Percent Identity=76.0; E value=1e-156; Homolog= recF COG1195
MRAGKSLADGCHLQCENREFSQSGRDLCRDAYAPVTTLTHFMILSRLLIRDFRNIANADLTLATGFNFLVGPNGSGKTSILEAIYTLGHGRAFRSIQAGRVIRHDCEEFILHGRLEQQFHERILAVGLSKNRLGDSKVRIDGSDGHKIAELAKMLPMQLITPEGFTLLNGGPKYRRAFIDWGCFHNEPRFFTAWVNLKRLLKQRNAALRQVTCYSQIQHWDRELAPLATEISQWRAEYIAGIAEDIEKTCKQFLPEFTLSISFQQGWDKESEYAELLARQFERDRTLTYTASGPHKADLRIRVDGTPVEDMLSRGQLKLLMCALRLAQGEYFTRQSGQKCLYLLDDFASELDAGRRQLLAERLKSTQAQVFVSAITLGQVTDMIDVNSRMFRVEHGKIEVQPQD

SEQ ID NO: 7107 - protein, 804 aa, Xenorhabdus bovienii
  Coding DNA sequence: Name=SeqID_999
  Gene classification: Gene name=GyrB; Function=DNA gyrase (topoisomerase II) B subunit; Function class=L DNA replication, recombination and repair
  Homolog annotation: Query=1..804bp; Hit=1..804bp; Blast score=1374; Percent Identity=84.0; E value=0; Homolog= gyrB COG0187
MSNTYDSSSIKVLKGLDAVRKRPGMYIGDTDDGTGLHHMVFEVVDNAIDEALAGHCDKILVTIHTDNSVSVQDDGRGIPTGIHEEEGVSAAEVIMTVLHAGGKFDDNSYKVSGGLHGVGVSVVNALSEKLELTIRRDGKVHEQTYQHGVPQAPLKMVGDTEQTGTTVRFWPSMDTFKLNTEFEYDILAKRLRELSFLNSGVSIRLVDRRTNAEDHFHYEGGIKAFVEFLSRNKTPIHPNVFYFSTEKDGIGVEISMQWNDGFQENIYCFTNNIPQRDGGAHLVGFRAAMTRTLNSYMDKEGYNKKSKVSATGDDAREGLIAVISVKVPDPKFSSQTKDKLVSSEVKTAVETQMNEKLVEYLLENPNDAKTVVGKIIDAARAREAARKAREMTRRKGALDLAGLPGKLADCQERDPALSELYLVEGDSAGGSAKQGRNRKNQAILPLKGKILNVEKARFDKMLSSQEVATLITALGCGIGRDEYNPDKLRYHSIIIMTDADVDGSHIRTLLLTFFYRQMPEIIERGYVYIAQPPLYKVKKGKQEQYIKDDDAMEAYQMSIALDGASLYTNQHAPALKGEALEKLVTEFNASNKIIKRMERLYPQALLNNLIYHPTLTEDALNDQAKVEEWVSTLAIRLNDKEQHGSTYSYQIHENRERQIYEPVLCIRTHGVDTNYNLDFDFIHGGEYRRITKLGELIGNLIEEDAYIERGERRQPVSNFEQALEWLSKESRRGLSIQRYKGLGEMNPDQLWETTMNPETRRMMRVTVKDAIATDLLFTTLMGDAVEPRRAFIEENALKAANIDI

SEQ ID NO: 7108 - protein, 274 aa, Xenorhabdus bovienii
  Coding DNA sequence: Name=SeqID_1000
MTQALMPTVGQKSGFSMSLGALLPRAFKTQNLTLKEQAEAGARYFDIRVAQRKDGSFGFFHGPSVAGGDATADVKALLEHAGKDTNNFYVLKMVFKGEGKKKATSRTSASDTFLQDVLTTHRNNLITPDDTSSLGEATVDLLSKGKNIGLMVHGYDGTESHWKYKEQVHTQWANRASATETAEFLSEYHATPAPDSQLNVIQTNIPFASPGRGQLTSGVKRYLSKNKGILADAVDKIPHAGIISGDYIGSEHGASSRFMKTIELHNQSLMSTHL

SEQ ID NO: 7109 - protein, 64 aa, Xenorhabdus bovienii
  Coding DNA sequence: Name=SeqID_1001
MVRNNPITLFDPTGNLPINHNELPADTKLSQIAMLGSHDAGTYAYSRAKKRILNEFRSTIAPSI

SEQ ID NO: 7110 - protein, 393 aa, Xenorhabdus bovienii
  Coding DNA sequence: Name=SeqID_1002
  Homolog annotation: Query=33..379bp; Hit=281..636bp; Blast score=378; Percent Identity=57.0; E value=1e-103; Homolog= gb|AAC38630.1|
MINKNLQVHHKTPVVTVQDNRMLTVRDIHYHCHPDQPDHIDDRITRYRFNAPGSLSTSIDPRLAELQQSNQAINPNFTYLSSLTGDVLRTDSVDADATRFWRNQKVDAKAIYVLRQPVSIGQQTNQLPTPIIPLDTDSSTYTNYTRTYTYDRGNNLTQIRHSAPATGHNYTTAITVSERNNHAVLSTLTDIPSKVDTFFDKAGSQLQLMPGQRLDWTMRGELQQVTRVNRLSGQPDRESYLYDGSNQRVVKVSTQQTGGSQQQQRVLYLPELELRTTKNGDVEKEVLQIIKVGEAGRAQVRVLHWESGKPDALSNNQIRYSYDNLVGSSGLEVGGDGQIISLEEYYPYGGTAVWTARSQTEADYKTIRYSGKERDATGLYYYGYRSNRGQRVG

SEQ ID NO: 7111 - protein, 48 aa, Xenorhabdus bovienii
  Coding DNA sequence: Name=SeqID_1003
LPEDLHDEVSFDKNFARASDTEFPSEVKFRWLSINHTTFLTTPSHDKT

SEQ ID NO: 7112 - protein, 368 aa, Xenorhabdus bovienii
  Coding DNA sequence: Name=SeqID_1004
  Gene classification: Gene name=Asd; Function=Aspartate-semialdehyde dehydrogenase; Function class=E Amino acid transport and metabolism
  Homolog annotation: Query=1..367bp; Hit=1..366bp; Blast score=621; Percent Identity=81.0; E value=1e-178; Homolog= asd COG0136
MKNVGLIGWRGMVGSVLMQRMVEERDFDQINPVFFTTSQHGQPAPDFTGKAGILQDAFDIEALNALDIIISCQGGDYTNEIYPKLKETGWQGYWIDAASALRMSDDAIIILDPVNHQHIQDSLNKGIKTFVGGNCTVSLMLMSLGGLFANNLVEWASVATYQAASGGGARHMRELLVQMGMLHNQVESELQNPASAILDIEKRVTDFTRSGALSTDQFGVPLAGSLIPWIDKQLDNGQSREEWKGQAETNKILNTGNNIIPVDGLCVRIGALRCHSQAFTLKLKKDISIHEIETLLASHNDWVRVIPNDRELSMRELTPAAVTGTLNAPVGRLRKLNMGPEYLSAFTVGDQLLWGAAEPLRRMLRILL

SEQ ID NO: 7113 - protein, 37 aa, Xenorhabdus bovienii
  Coding DNA sequence: Name=SeqID_1005
MIKGASKFICYGNRISAKIRLPFTGKISVKYSWNGLS

SEQ ID NO: 7114 - protein, 64 aa, Xenorhabdus bovienii
  Coding DNA sequence: Name=SeqID_1006
MGHCCHQVYQHVANCRYYSFCYGGIFEGYSVAVTQAGQIVYLFNQQDDSPSVTDSAQAVPAVFH

SEQ ID NO: 7115 - protein, 30 aa, Xenorhabdus bovienii
  Coding DNA sequence: Name=SeqID_1007
MIDTVKRLFYFTCFHYTKTRMYCFFIYSGQ

SEQ ID NO: 7116 - protein, 219 aa, Xenorhabdus bovienii
  Coding DNA sequence: Name=SeqID_1008
  Gene classification: Gene name=HemK; Function=Predicted rRNA or tRNA methylase; Function class=J Translation, ribosomal structure and biogenesis
  Homolog annotation: Query=28..148bp; Hit=3..116bp; Blast score=84; Percent Identity=41.0; E value=1e-16; Homolog= MJ0928 COG2890
MNKNCKRYTEWWLEQEKLRTNDETPVKITLAGIKLSVIPQVFLPSPLQTHSTPLLIKNIIDHDFTGKKVLDIGTGSGILAIYSALNGASLVVATDINDNILHHAKSNAYLNKVTDIHFINSNIFESIDGKYDYIFANGPISPESWSEKTLSGHTISSYGETIFSQYRNYLINEGVMFMTFAEFGSTEIFYKTLQKNSVMHREKRETKFGVWWSFHEIKK

SEQ ID NO: 7117 - protein, 84 aa, Xenorhabdus bovienii
  Coding DNA sequence: Name=SeqID_1009
MVEFSRNKKIKLMRSPNSTPTYLEVFILLTFTTVIFICNFLLLIPIQTINNVTTIKTKYSNNNNQYITNRFYNSSTNNRISTAL

SEQ ID NO: 7118 - protein, 46 aa, Xenorhabdus bovienii
  Coding DNA sequence: Name=SeqID_1010
MEWVISNVLSINNAGRLLNKCFQLPCRNGDSGIPIRPWKYLGMIPK

SEQ ID NO: 7119 - protein, 122 aa, Xenorhabdus bovienii
  Coding DNA sequence: Name=SeqID_1011
MFLPVCLLSLWKGHWSGYLAEHLFILVPAAGFLGCGDYCWPMLSSRGEQKISSLPFWSLCITVGSPLACYHGKKMFQRKGIFLALLRGWFFLGSPRNGLSRTVKHRKPSSSARVSQKDGGRH

SEQ ID NO: 7120 - protein, 482 aa, Xenorhabdus bovienii
  Coding DNA sequence: Name=SeqID_1012
  Gene classification: Gene name=TrkA (BS); Function=Predicted flavoprotein involved in K+ transport; Function class=P Inorganic ion transport and metabolism
  Homolog annotation: Query=1..481bp; Hit=1..485bp; Blast score=572; Percent Identity=53.0; E value=1e-163; Homolog= Rv3083 COG2072
MSNQYDVLIMGAGVAGIGMACHLTRECPDKKVIILERRHAIGGTWDLFRYPGIRSDSDMMTFGYKFRPWSETSVFADGESIKNYVNKTAKEYGIDKKIQFGLKITHADWSGTTNQWSITAVEETSGETRTFTCNYLVAATGYYNYDEAYLPEFPGIEDFKGPVIHPQYWPEGLDYKGKRVVVIGSGATAATLVPTMANIAEHVTMLQRSPSYYLSVPGTDKIAEFLSKFIPKRWVYSFSRNRNIFMHRLLYKTSRHLPTLLKSFLLSSARKRVGPSFNMNHLTPKYMPWDERLCVIPNGNFLKSLKEGKSSIVTDQVKRFTENGILLQSGKELPADIIVSATGLKLRSLGGVEISIDEQKLQGNNRMLYKGTLIQDIPNFAYLFGYINSSWTLKVDLSADYVCRLLKEMDRRGAKSVTAYAQPDEMLKHENIFGELQSGYVRRGDEGLPRQGRSPNWHVPHDYKKDKEVLGQPVDDTALRWE

SEQ ID NO: 7121 - protein, 44 aa, Xenorhabdus bovienii
  Coding DNA sequence: Name=SeqID_1013
MYFKNSSHFTGYIQVALAMRLVGSNNSLSLTMIPLSHKYKWLSY

SEQ ID NO: 7122 - protein, 413 aa, Xenorhabdus bovienii
  Coding DNA sequence: Name=SeqID_1014
  Homolog annotation: Query=311..410bp; Hit=4..103bp; Blast score=75; Percent Identity=42.0; E value=2e-12; Homolog= ref|ZP_00132330.1|
MNLMKKYSVTNFVIYQVSDVLFTISIKTIGMLFTWIMLNQLGLVVELGYFLFISWALQVITLLAFGLYGDKFSTKFYLISFCILSLLIISSLYFIESKNYFYWGIFFIVTSLFSILTQPIGNSIISRILHNTNTDLAFRARGLVSSLNVVSGPAISGILISYLAYGHILVIVFCSVVISFLGFLWVSMMPSEKKADTSKVSLKILKNNPTELRLGAISGVFNFVIVPLVSYFIPFLIINTMKLGAFDLGVAEFFFGAGMFLGSSVLVKFFNQMLGKGYASLTGTILVSLGIFGVSISQSNIHINISMLIAGIGVVIYNINTTSIRMTATPSSQRHSMESVFLSLCIIPIPLGMLFSTYSIQFLSVNSILLGMSLILLFCSILIIKTPNFMHLCKMSSESLDGYYEKLYPRSVG

SEQ ID NO: 7123 - protein, 75 aa, Xenorhabdus bovienii
  Coding DNA sequence: Name=SeqID_1015
MFSNKNKKKFNYDWLKDLFLDCSEEFFWIFIIAIVILVLFVTLLIIFTDILVGIIFFAVIFILCIFVLYIISIII

SEQ ID NO: 7124 - protein, 31 aa, Xenorhabdus bovienii
  Coding DNA sequence: Name=SeqID_1016
MLIVFIILLIRLTSFNKTIQYKLKKYSFNIK

SEQ ID NO: 7125 - protein, 609 aa, Xenorhabdus bovienii
  Coding DNA sequence: Name=SeqID_1017
  Gene classification: Gene name=GlmS; Function=Glucosamine 6-phosphate synthetase, contains amidotransferase and phosphosugar isomerase domains; Function class=M Cell envelope biogenesis, outer membrane
  Homolog annotation: Query=1..609bp; Hit=1..609bp; Blast score=1018; Percent Identity=84.0; E value=0; Homolog= glmS COG0449
MCGIVGAVAQRDIAEILIEGLRRLEYRGYDSAGLAVVDSENRMTCLREVGKVQVLADEADKQLVIGGTGIAHTRWATHGEPNERNAHPHVSEHIAVVHNGIIENHEALRELLKERGYTFFSDTDTETIAHLIHWEQKQGGALLEVVQRVIPQLRGAYGTVIMDSRHPDVLVAARSGSPLVIGLGVGENFLASDQLALLPVTRRFIYLEEGDIVEITRRTVRIFDVTGAAVEREQIESNVQYDAGDKGIYRHYMQKEIYEQPMAIKSTLEGRLSHGQIDLSELGANAAELLSQVEHIQIVACGTSYNAGMVSRYWFESLAGIPCDVEIASEFRYRKPARRKGSLLITLSQSGETADTLAALRLSKELGYLTSLVICNVAGSSLVRESDFALMTKAGAEIGVASTKAFTTQLTVLLMLVAYMGRLKGADAALEQDVVHALQALPSRIESMLSKDKVIEALAEDFSEKHHALFLGRGDQYPIAVEGALKLKEISYIHAEAYAAGELKHGPLALIDADMPVIIVAPNNELLEKLKSNIEEVRARGGQLYVFADQDAGFTNSENMKIISLPHVEDLIAPIFYTVPLQLLSYHVALIKGTDVDQPRNLAKSVTVE

SEQ ID NO: 7126 - protein, 42 aa, Xenorhabdus bovienii
  Coding DNA sequence: Name=SeqID_1018
MCFIPKNRADKSPFYVANLIVFRLCRSPSFVEVGIIFIFIFS

SEQ ID NO: 7127 - protein, 459 aa, Xenorhabdus bovienii
  Coding DNA sequence: Name=SeqID_1019
  Gene classification: Gene name=GlmU; Function=N-acetylglucosamine-1 -phosphate uridyltransferase (contains nucleotidyltransferase and I -patch acetyltransferase domains); Function class=M Cell envelope biogenesis, outer membrane
  Homolog annotation: Query=6..459bp; Hit=3..456bp; Blast score=721; Percent Identity=78.0; E value=0; Homolog= ZglmU COG1207
MSISANSAKSVVILAAGKGTRMYSALPKVLHSLAGKPMVQHVIDTAMALGTQNVHLVYGHGGDLMKQTLSNQNLNWVLQAEQLGTGHAMQQAAPHFADDEDILMLYGDVPLIAQDTLERLVEIKPEGGIGLLTAILNNPAGYGRIIRENGEVAGIIEQKDATDEQRKINEINTGILVANGGDLKRWLSQLDNNNAQGEYYITDIIALAHKEGRQIKAVHPSRLSEMEGVNNRLQLSTLERIYQSERAEKLLLAGVMLLDPARFDLRGTLEHGRDVVIDTNVIIEGHVALGNNVHIGSGCILKNCVIGDGTVISPYTVIENAEIATECTVGPFARLRPGSKLAEKAHVGNFVEMKKTSLGKGSKAGHLTYLGDSEIGNNVNIGAGTITCNYDGANKFKTIIGDDVFVGSDTQLVAPVTVAKGATIGAGTTVTKNVAENELVISRVKQTHIQDWQRPVKKK

SEQ ID NO: 7128 - protein, 213 aa, Xenorhabdus bovienii
  Coding DNA sequence: Name=SeqID_1020
  Homolog annotation: Query=1..162bp; Hit=19..179bp; Blast score=105; Percent Identity=40.0; E value=6e-22; Homolog= ref|NP_756514.1|
MQKSQLAFTNWLFILLPILHPLFCQFDYTKFCNRFRQFSRCLSIINIAVRITNVFFSLALRFKRLGFVQILTTDRCIGQYDNAVWLNFKNSTGQVDKFFFTKLLNNTYHARFYGSKQWCVLRINTQLTFTASHLNFLYQPFKQSFFSADYVQEERHCSHINLPSAVLHLLRFFYSFVDGTNHVERLFWQVVIITVQDALKATNGFFQRDELTW

SEQ ID NO: 7129 - protein, 460 aa, Xenorhabdus bovienii
  Coding DNA sequence: Name=SeqID_1021
  Gene classification: Gene name=AtpD; Function=F0F1-type ATP synthase beta subunit; Function class=C Energy production and conversion
  Homolog annotation: Query=1..460bp; Hit=1..460bp; Blast score=850; Percent Identity=93.0; E value=0; Homolog= atpD COG0055
MATGKIIQVIGAVVDVEFPQDSVPKVYNALEVKNSEEKLVLEVQQQLGGGIVRCIAMGTSDGLRRGLDAIDLGHPIEVPVGKATLGRIMNVLGDPIDMKGEIGEEERWSIHRTAPSYEELSSSQELLETGIKVMDLICPFAKGGKVGLFGGAGVGKTVNMMELIRNIAIEHSGYSVFAGVGERTREGNDFYHEMTDSNVLDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDVARGVQSILQRYQELKDIIAILGMDELSEEDKLVVARARKIQRFLSQPFFVAEVFTGSPGKFVSLKETIRGFKGILDGDYDHLPEQAFYMVGTIDEAVEKAKKM

SEQ ID NO: 7130 - protein, 287 aa, Xenorhabdus bovienii
  Coding DNA sequence: Name=SeqID_1022
  Gene classification: Gene name=AtpG; Function=F0F1-type ATP synthase gamma subunit; Function class=C Energy production and conversion
  Homolog annotation: Query=1..287bp; Hit=1..287bp; Blast score=506; Percent Identity=88.0; E value=1e-143; Homolog= atpG COG0224
MAGAKEIRTKIASVQNTQKITKAMEMVAASKMRKTQDRMAASRPYAETIRSVIGHLALGNLEYRHPYLDEREVKRVGYLVVSTDRGLCGGLNINLFKKLLIEMKGWSDKGVQVDLALVGSKAVSFFSSVGGNIVAQVTGMGDNPSLSELIGPVNVMMQAYDAGRLDKLYIVTNRFINTMSQVPTMTQLLPLPAGDDETLKKKSWDYLYEPDPKALLDTLLRRYIESQVYQGVVENLASEQAARMVAMKAATDNGGNLIKELQLVYNKARQASITQELTEIVSGASAV

SEQ ID NO: 7131 - protein, 513 aa, Xenorhabdus bovienii
  Coding DNA sequence: Name=SeqID_1023
  Gene classification: Gene name=AtpA; Function=F0F1-type ATP synthase alpha subunit; Function class=C Energy production and conversion
  Homolog annotation: Query=1..513bp; Hit=1..513bp; Blast score=909; Percent Identity=90.0; E value=0; Homolog= atpA COG0056
MQLNSTEISELIKQRIAQFNVVSEAHNEGTIVSVNDGIIRIHGLADVMQGEMISLPGNRYAIALNLERDSVGAVVMGPYADLAEGMKVKCTGRILEVPVGRGLLGRVVNTLGEPIDGKGALENDGFSPVEVIAPGVIDRQSVDQPVQTGYKSVDAMIPIGRGQRELVIGDRQTGKTALAIDAIINQRDSGIKCIYVAIGQKASTISNVVRKLEEHNALANTIVVVASASESAALQYLAPYSGCAMGEYFRDRGEDALIVYDDLSKQAVAYRQVSLLLRRPPGREAFPGDVFYLHSRLLERAARVNADYVEKFTNGEVKGKTGSLTALPIIETQAGDVSAFVPTNVISITDGQIFLESALFNAGIRPAVNPGISVSRVGGAAQTKIIKKLSGGIRTALAQYRELAAFSQFASDLDDATRKQLDHGQKVTELLKQKQYQPMSVAQQALSLFAAERGYLEDVEIAKVVSFESALLAYANREHADLLKEIDQSGDYNGEIEAKLTALLDSFKATQSW

SEQ ID NO: 7132 - protein, 177 aa, Xenorhabdus bovienii
  Coding DNA sequence: Name=SeqID_1024
  Gene classification: Gene name=AtpH; Function=F0F1-type ATP synthase delta subunit (mitochondrial oligomycin sensitivity protein); Function class=C Energy production and conversion
  Homolog annotation: Query=1..177bp; Hit=1..177bp; Blast score=253; Percent Identity=77.0; E value=6e-68; Homolog= atpH COG0712
MSEFATVARPYAKAAFDFAVEHQSLEHWQNMLAFVAEVTRNEQVGELLSGSLAPETLANTFITLCGEQVDEHAQNFIRVMAENGRLLVLPEVFQQFTQLRASLESTINVEVISASELNEQQQAKISAAMEKRLSRKVKLNCKIDKSVIAGVVIRAGDMVIDGSIRGRLDRLTDVLQS

SEQ ID NO: 7133 - protein, 156 aa, Xenorhabdus bovienii
  Coding DNA sequence: Name=SeqID_1025
  Gene classification: Gene name=AtpF; Function=F0F1-type ATP synthase b subunit; Function class=C Energy production and conversion
  Homolog annotation: Query=1..156bp; Hit=1..156bp; Blast score=186; Percent Identity=86.0; E value=1e-47; Homolog= atpF COG0711
LNINATILGQAIAFVLFVLFCMKYVWPPIMAAIEKRQKEITDGLASAERAKKNLDLAQANATDQLKKAKADAQAIIEQANKQKAQIIDDAKTEAELERNKIVAQAQAEINAERKRAREELRKQVAMLAIAGAEKIIERSVDEAANSDIVDKLVAEL

SEQ ID NO: 7134 - protein, 81 aa, Xenorhabdus bovienii
  Coding DNA sequence: Name=SeqID_1026
  Gene classification: Gene name=AtpE; Function=F0F1-type ATP synthase c subunit/Archaeal/vacuolar-type H+-ATPase subunit K; Function class= C Energy production and conversion
  Homolog annotation: Query=1..78bp; Hit=1..78bp; Blast score=93; Percent Identity=84.0; E value=3e-20; Homolog= BU003 COG0636
MENLNMDLLYMAAAILMGLAAIGAAIGIGILGGKFLEGAARQPDLIPLLRTQFFIVMGLVDAIPMIAVGLGLFMMFAVGGK

SEQ ID NO: 7135 - protein, 275 aa, Xenorhabdus bovienii
  Coding DNA sequence: Name=SeqID_1027
  Gene classification: Gene name=AtpB; Function=F0F1-type ATP synthase a subunit; Function class=C Energy production and conversion
  Homolog annotation: Query=4..275bp; Hit=2..271bp; Blast score=352; Percent Identity=76.0; E value=2e-97; Homolog= atpB COG0356
MSASGEVLTSQEYISHHLKHLQLDLRTFELVNPHASGYETTFWTLNIDSLFFSVILGILFLFVFRRVAVRATDGVPGKLQTAVEMVFGFVDNTVRDMYHGKSKVIAPLALTVFVWVLLMNALDLLPIDLIPLIGERYFGLPALRIVPTADVSVTLSMALGVFVLILFYSIKMKGIRGFAKELTLQPFNHPLFIPINLILEGVSLLSKPISLALRLFGNMYAGELIFILIAALLPFWSQWLLSLPWAIFHILIITLQAFIFMVLTVVYLSMASEEH

SEQ ID NO: 7136 - protein, 125 aa, Xenorhabdus bovienii
  Coding DNA sequence: Name=SeqID_1028
  Gene classification: Gene name=AtpI; Function=F0F1-type ATP synthase I subunit; Function class=C Energy production and conversion
  Homolog annotation: Query=1..124bp; Hit=5..127bp; Blast score=57; Percent Identity=46.0; E value=2e-09; Homolog= atpI COG3312
MSVSLYSGRIALKLLLLQLMTFVILSVAFCTRSIEWGASAFAGGLACWLPNAIFMLLTRFQKAKEEDVPVRIAWFFAIGEVAKVIITIAVLIVALGVFKAAFAPLGVAYLAVLIVQIIAPAVMNG

SEQ ID NO: 7137 - protein, 206 aa, Xenorhabdus bovienii
  Coding DNA sequence: Name=SeqID_1029
  Gene classification: Gene name=GidB; Function=Predicted S -adenosylmethionine-dependent methyltransferase involved in bacterial cell division; Function class=M Cell envelope biogenesis, outer membrane
  Homolog annotation: Query=1..206bp; Hit=1..205bp; Blast score=297; Percent Identity=73.0; E value=6e-81; Homolog= gidB COG0357
LLNKLESLLAKTDIVLSLAQKQQLVAYVDMLNKWNKAYNLTSVRAPEQMLVRHIMDSIVVNPFLHGTRFIDVGTGPGLPGIPLAIVRPDSHFTLLDSLGKRVRFLRQVQHELGLGNIDPVQSRVEEFIPEPPFDGVISRAFASLQDMLSWCRHLPKPAEGRFYALKGVLPENELTQLPSGITLDTVVSLQVPELDGERHLVVLKSN

SEQ ID NO: 7138 - protein, 629 aa, Xenorhabdus bovienii
  Coding DNA sequence: Name=SeqID_1030
  Gene classification: Gene name=GidA; Function=NAD/FAD-utilizing enzyme apparently involved in cell division; Function class=D Cell division and chromosome partitioning
  Homolog annotation: Query=1..629bp; Hit=1..629bp; Blast score=1079; Percent Identity=84.0; E value=0; Homolog= gidA COG0445
MFYPEHFDVIIIGGGHAGTEAAMAAARMGRQTLLLTHNIDTLGQMSCNPAIGGIGKGHLVKEIDALGGLMAQATDQAGIQFRTLNVSKGPAVRATRAQADRVLYRQAVRTALENQPNLMIFQQSVEDLIVENNTITGVVTRMGLKFKAKSVVLTVGTFLDGKIHIGLENYSGGRAGDPPAIALSHRLRELPLRVARLKTGTPPRIDARTIDFSQLEQQLGDNPIPVFSFMGNVDQHPLQIPCYITHTNEKTHEVIRNNLDRSPMYAGIIEGIGPRYCPSIEDKVMRFADRNAHQIFLEPEGLTSNEIYPNGISTSLPFDVQMQIVHSMKGMEKARIVRPGYAIEYDFFDPRDLKQTLESKFINGLFFAGQINGTTGYEEAAAQGLLAGLNAARYAADENGWFPRRDQAYIGVLVDDLCTLGTKEPYRMFTSRAEYRLMLREDNADLRLTEKGRELGLVDDQRWEHYCRKVEMIEQERQRLRNIWVHPHSDSLDEINQMLKAPLSKEANGEDLLRRPEMNYELLTSLPRFTPGLTEPQAADQVEIQVKYEGYIARQQEEIEKQLRNENAALPLDLDYKQVNGLSNEVIAKLNDHKPSSIGQASRISGITPAAISILLVWLKKQGLLRRSA

SEQ ID NO: 7139 - protein, 53 aa, Xenorhabdus bovienii
  Coding DNA sequence: Name=SeqID_1031
VYNYAFRSQLILTWITDHSQQMILYSAMIFLWKNHLSTDDRDPNNRSNKEIFK

SEQ ID NO: 7140 - protein, 147 aa, Xenorhabdus bovienii
  Coding DNA sequence: Name=SeqID_1032
  Gene classification: Gene name=FldA; Function=Flavodoxins; Function class=C Energy production and conversion
  Homolog annotation: Query=2..147bp; Hit=1..146bp; Blast score=183; Percent Identity=59.0; E value=6e-47; Homolog= mioC COG0716
MMSTITLISGSTMGSAEYVAEHMAEILENHGFSTEVLHGPSLDDLRLGGLWLVVTSTHGAGDLPENLQPLADTIAQEQPDLSNVTFGSVGIGSSEYDIFCGAIKSFEHLLKDRGAKRIGDRLEIDIQKYEIPEDPAEDWVKEWAKLL

SEQ ID NO: 7141 - protein, 153 aa, Xenorhabdus bovienii
  Coding DNA sequence: Name=SeqID_1033
  Gene classification: Gene name=Lrp; Function=Transcriptional regulators; Function class=K Transcription
  Homolog annotation: Query=3..153bp; Hit=2..152bp; Blast score=239; Percent Identity=82.0; E value=7e-64; Homolog= asnC COG1522
MAEIYQIDNLDRDILHALMDNARTPYAELAKKFAVSPGTIHVRVEKMKQAGIITGTRVDISAKQLGFDVCCFIGIILKSAKDYPAALKKLDMLDEVVEVYYTTGHYSIFTKVMCRSIESLQDVLINKIQTIDEIQSTETLISLQNPIIRTIKP

SEQ ID NO: 7142 - protein, 330 aa, Xenorhabdus bovienii
  Coding DNA sequence: Name=SeqID_1034
  Gene classification: Gene name=AsnA; Function=Asparagine synthetase A; Function class=E Amino acid transport and metabolism
  Homolog annotation: Query=1..330bp; Hit=1..330bp; Blast score=503; Percent Identity=74.0; E value=1e-143; Homolog= ZasnA COG2502
MKTSFIEKQQQISFVKSYFSRLLEKQLGLIEVQGPILSRLGDGTQDNLSGHEKAVQVKVKTLPDATFEVVHSLAKWKRKTLGRFGFQAEQGLYTHMKALRPDEDRLTPIHSVFVDQWDWEKVMGEGHRSLGYLKQTVGKIYEAIKETQKAVSKEFGLAPFLPDQIHFLHSEELLKRYPDLDAKSRECEAAKEFGAIFLMGIGGKLSDGQSHDVRAPDYDDWTTPNSDGFFGLNGDIIVWNPVLQDAFEISSMGIRVDAEALQRQLELTCDEDRLQYDWHQALVKGDMPQSIGGGIGQSRLVMLLLQMAHIGQVQCGVWSPEIIESVEGVL

SEQ ID NO: 7143 - protein, 485 aa, Xenorhabdus bovienii
  Coding DNA sequence: Name=SeqID_1035
  Gene classification: Function=Uncharacterized ACR; Function class=S Function unknown
  Homolog annotation: Query=9..475bp; Hit=1..465bp; Blast score=530; Percent Identity=59.0; E value=1e-150; Homolog= ZyieM COG2425
MLTLATLDLLLSINEGELIEEIILALLSTPQLAIFFEKFPRFKRALLKDVPAWQQTLQQRIKDTLIPASLAEEFQLYQQLLTANTTEFYQQLSDLAEKLEQIKSPFTHDAHTLREALSEHTHAGQILFIQRWRTSLILQVTTFHKQLLEQEKEQLLAEIQKRLVLSGNLDPIFDENDRAAGRLWDMSKGRLHLTSHNTALFTQYAEFLRQQPELEKLAQLLGRSQAAKSIPEDSDTLEPFTQIERMPDTVPEQVSGIQQGDDILRLLPTELAMLGIEDLEYEFYRRLVEKKLLTYRLQGDNWQPRTILKPVTHHDHAEQPRGPFIVCVDTSGSMGGFNEHCAKAFCLALMRIALADNRHCHIILFSTELIHYDLTSQDGLTQAVHFLGQTFKGGTDLAFCLNAIIEKMQENIWKDADAVVISDFIAQRLPDVLIHQIQNLQQRQQHRFHAVSLSHYGKPGIMRIFDHIWRFDTGITSRLLRRWRH

SEQ ID NO: 7144 - protein, 500 aa, Xenorhabdus bovienii
  Coding DNA sequence: Name=SeqID_1036
  Gene classification: Function=MoxR-like ATPases; Function class=R General function prediction only
  Homolog annotation: Query=3..494bp; Hit=15..502bp; Blast score=524; Percent Identity=55.0; E value=1e-149; Homolog= yieN COG0714
MQLVEKISQLSQHLESGLYERRQAIRLCLLAALCGESVFLLGPPGIAKSLIARRLKFAFQNAHAFEYLMTRFSTPEEIFGPLSIQALKDEGRYQRLTEGYLPEAEVVFLDEIWKAGPAILNTLLTAINEKKFRNGNQEENLPMRLLVTASNELPDADSSLEALYDRMLIRIWLNNIQEKKNFRALLTDRNNGNDNPVPTHFQITDEEFHQWQCKIKHVSLPGYIFELIYQLRQQLNASENLPYVSDRRWKKAIRLLQASAFFSGKNTISPLDLVLLKDCLWHDLSALKLLPQFLHDLLTEQAYQQRFLLQKMDGVYQQWIQTSRDETHLHPLQLTTNSSLFGRKTHYSFPKTINDEKLTLFLYPALHLHDIEVNFIEIDRKVLENVLKNSSGEVLACLNGIGFPLKISAEINEKHQLEVLDMSRNSAILCQAEAKQLTIEKTNNEWNEKLISISDAIQHQRQLFGQHQPCLFIEEYWIANIEQSFLQLIEKLKQLRSKMG

SEQ ID NO: 7145 - protein, 42 aa, Xenorhabdus bovienii
  Coding DNA sequence: Name=SeqID_1037
MITFSYQACCLCYRALYDDGLAKRFAFAKELIKNEKRRFIAF

SEQ ID NO: 7146 - protein, 139 aa, Xenorhabdus bovienii
  Coding DNA sequence: Name=SeqID_1038
  Gene classification: Gene name=RbsD; Function=Uncharacterized components of ribose/xylose transport systems; Function class=G Carbohydrate transport and metabolism
  Homolog annotation: Query=1..139bp; Hit=13..151bp; Blast score=174; Percent Identity=61.0; E value=3e-44; Homolog= rbsD COG1869
MKKGVLLHSDISAVISRLGHTDQITISDAGLPIPLSTQRIDLALTQGIPDLMSVFDVVVQEMQVEAAILAAEMIDHNPQIHEQIIKRIAELETKQGNAIAIEYVSHNILKEKTEKSKAIIRTGECSPYANILLCSGVTF

SEQ ID NO: 7147 - protein, 505 aa, Xenorhabdus bovienii
  Coding DNA sequence: Name=SeqID_1039
  Gene classification: Gene name=MglA; Function=ABC-type sugar (aldose) transport system, ATPase component; Function class=G Carbohydrate transport and metabolism
  Homolog annotation: Query=1..494bp; Hit=1..494bp; Blast score=767; Percent Identity=79.0; E value=0; Homolog= rbsA COG1129
MEPLLELKEIDKAFPGVKALSGAVLRVYPGKVMALVGENGAGKSTMMKVLTGIYTKDAGSIYYLGKNVVFSDPKSSQEAGIGIIHQELNLIPQLTIAENVFLGREFVNKLGIINWQKMYEEADNLLKRLNIRYSSRRLVSELSIGDQQMVEIAKVLSFQSKVIIMDEPTDALTDTETESLFHVIRELKAQGCGIVYISHRLKEIFKICDDVTVFRDGQFIGEQPVTALQEDTLIEMMVGRKLEDQYPRLDLPRGEKRLEIENLSGAGIKNVSFSLFGGEILGISGLMGAGRTELMKVIYGALPKTKGRILLDGKPLTIRNPQDGLANGIVYISEDRKRDGLVLGMSVKENMSLTALRYFSQKPYRLNHSAEQKAVTDFIKLFNIKTPSMEQSIGLLSGGNQQKVAIARGLMTRPKVLILDEPTRGVDVGAKKEIYQLINQFKKEGLSIILVSSEMPEVMGMSDRILVMHEGGISGEFSADNASQEALMVAAVGKQYGAVKGNDQG

SEQ ID NO: 7148 - protein, 323 aa, Xenorhabdus bovienii
  Coding DNA sequence: Name=SeqID_1040
  Gene classification: Gene name=AraH; Function =Ribose/xylose/arabinose/galactoside ABC-type transport systems, permease components; Function class=G Carbohydrate transport and metabolism
  Homolog annotation: Query=8..320bp; Hit=7..319bp; Blast score=417; Percent Identity=88.0; E value=1e-116; Homolog= rbsC COG1172
MNSNTAPTSRRLLTKAWLMEQKSLIALLILIVVVSFLSPNFFTLNNLFNILQQTSVNAIMAVGMTLVILTSGIDLSVGSLLALTGAVAASMVGTDVNALVAVVAALALGAAIGACTGVIVAKGKVQAFIATLVMMLLLRGVTRVYTDGSPINTGFSDNAELFGWFGIGRPLGVPAPVWIMLLVFAAAWYILHHTRLGRYIYALGGNESATRLSGINVDKIKIIVYSLCGLLAALGSIIEVARLSSAQPMAGSGYELDAIAAVVLGGTSLAGGKGRIVGTLFGALILGFLNNGLNLLGISSNYQMIVKAVVILLAVLVDNKSSK

SEQ ID NO: 7149 - protein, 296 aa, Xenorhabdus bovienii
  Coding DNA sequence: Name=SeqID_1041
  Gene classification: Gene name=RbsB; Function=Periplasmic sugar -binding proteins; Function class=G Carbohydrate transport and metabolism
  Homolog annotation: Query=1..296bp; Hit=1..296bp; Blast score=418; Percent Identity=80.0; E value=1e-117; Homolog= ZrbsB COG1879
MKMKKLATILSAVALSATMSANALAKDSIALVISTLNNPFFVTMKDSAQKEADKLGYDLIVLDSQDNPAKELANVQDLTVRGTKLMLINPTDSDAVGNAVIMANKANIPVITLDRTANKGNVVSHIASDNRLGGKMAGDFIAEKLGNNAKIIQLEGISGTSGARERSEGFFQAAKNHQFNMLASQPADFDRTKGLNVMQNLLTAHPSVQAVFAQNDEMALGALRALQTANKKDVLVVGFDGTDDGVKAVRSGKLSATIAQRPDQIGIIGVQTADKVLKGEKVDATIPVELELVIKK

SEQ ID NO: 7150 - protein, 307 aa, Xenorhabdus bovienii
  Coding DNA sequence: Name=SeqID_1042
  Gene classification: Gene name=RbsK; Function=Sugar kinases, ribokinase family; Function class=G Carbohydrate transport and metabolism
  Homolog annotation: Query=4..306bp; Hit=7..308bp; Blast score=353; Percent Identity=67.0; E value=1e-97; Homolog= rbsK COG0524
MAKLAVMGSINADHILNLESFPQPGETVMGKQYQVAFGGKGANQAVAAGRCGADITFIACVGQDDIGERIRQQLAKDNINTSAIGVIEGETTGVALIFVNQQGENVIGISAGANGALTSEYFHHHEQVVKEADVLLLQLETPLETVQLAAETARKHNTKVILNPAPAQKLSEQLLSLVDIITPNETEAEYLTGIAVKDDVGAEKAAQDLHNKGIEIVIITLGSRGVWLSENGKQGKIVPGFKVKAIDTIAAGDTFNGALVTGLLEGKEIVSAIRFAHAAAAIAVTRQGAQPAVPWRHEINAFLAEQD

SEQ ID NO: 7151 - protein, 330 aa, Xenorhabdus bovienii
  Coding DNA sequence: Name=SeqID_1043
  Gene classification: Gene name=PurR; Function=Transcriptional regulators; Function class=K Transcription
  Homolog annotation: Query=1..326bp; Hit=4..329bp; Blast score=442; Percent Identity=65.0; E value=1e-124; Homolog= rbsR COG1609
MKDVARLAGVSTSTVSYVINDNRYVSERVKKKVNAAIDELNYAPSALARSLKIKQTKTIGMLVTTSNNPFYAEIVRGVERNCYERGYSLILCNTEGDVTRLIRSMETLLQKRVDGLLIMCSENAVLPNDFLLRYPLIPMVTMDWSPFYVSSDVIKDNSLLGGELATSYLISRGFRKIACIAGPQDKTPARQRLAGYRKAMKDAQLEIPEGYEIHSDFEFAGGLSSMEQLLQLSKPPEAVFAGNDAMAIGAYQALHRAGLSVPDDISVIGYDDISMAPYMTPPLTTIHQPKDELGKLAIDTLLYRMGNPGSEPKQLILKPKLIERNSVARR

SEQ ID NO: 7152 - protein, 460 aa, Xenorhabdus bovienii
  Coding DNA sequence: Name=SeqID_1044
  Gene classification: Gene name=ProP; Function=77 Permeases of the major facilitator superfamily; Function class=G Carbohydrate transport and metabolism
  Homolog annotation: Query=3..460bp; Hit=4..461bp; Blast score=567; Percent Identity=70.0; E value=1e-162; Homolog= yieO COG0477
MVKSARSMSGLPWIAAIAFFMQSLDATILNTALPAIAESLNHHPLAMQPAIVSYTLTVAMLIPVSGWLADRFGTQRIFIYAVSLFSLGSLACALSSSFSFLVAARVIQGIGGAMMMPVARLALLRAYPRSELLPVLNFVTMPGLLGPILGPMLGGLLVTYATWHWIFIINIPIGLLGIIYARKHMPNFTMPKCPFDFLGFMLFSVGLVMLSVSFDLFGNNTLPNYVPVAVMAGSIIMLSGYIFHAKRHPNPLIDLQLFQTRTFSVGITSNIATRLSTGSLSFLIPLMLQVGFGYSAIIAGIMMAPNAIGAILAKSFVTKLLTRFGYRNTLIWVTVIIGVMIAQFSLQTPEISLVFLIIPLFILGMAMSTQFTSMNTITLGDLNNNNASAGNSLLAVTQQLSISLGVTVSAAILRFYESAEYGSTVDHFHYTFITIGVITLASSFVFLLLKKEDGRNLIKK

SEQ ID NO: 7153 - protein, 49 aa, Xenorhabdus bovienii
  Coding DNA sequence: Name=SeqID_1045
MPILLKKNTNGKKIQKNYCQAAKSPYNAPPLTDAERRHAAADSERTARK

SEQ ID NO: 7154 - protein, 209 aa, Xenorhabdus bovienii
  Coding DNA sequence: Name=SeqID_1046
  Homolog annotation: Query=5..207bp; Hit=1..200bp; Blast score=263; Percent Identity=63.0; E value=1e-69; Homolog= ref|NP_929067.1|
MIALMKINLTDAQKEALELMHDTTRDGRVRDRIKAVLLASEGWTAQMIAQALRIHESTVSRHLKDYFSEEKLAPENGGSESRLSAEQTTALVEYLMANLMHTTAQIVAYVRARWQVTFTVAGMTKWLHRQGFSYKKPMGAPHKFDADKQQQFIETYNALKEECGQNTPILFIDAVHPTLSTKLSYGWMKSGRKHVKVVETTGSRTRLTS

SEQ ID NO: 7155 - protein, 93 aa, Xenorhabdus bovienii
  Coding DNA sequence: Name=SeqID_1047
  Homolog annotation: Query=1..92bp; Hit=1..92bp; Blast score=123; Percent Identity=59.0; E value=5e-28; Homolog= ref|NP_753162.1|
MIALMKINLTDAQKEALELMHDTTRDGRVRDRIKAVLLASEGWTAQMIAQALRIHESTVSRHLKDYFSEEKLAPENGGSESRLSAEQTTALVE

SEQ ID NO: 7156 - protein, 274 aa, Xenorhabdus bovienii
  Coding DNA sequence: Name=SeqID_1048
  Homolog annotation: Query=159..273bp; Hit=1..115bp; Blast score=204; Percent Identity=86.0; E value=1e-51; Homolog= gb|AAL79614.1|
MKELVDVFSDFPDPRCQGKVKHRVIDILVIAVCAVIAGANAWTDIEQYGQLKKDWLSSFLPLKGGIPSHDTFRRCFSLLNPSLFEHHFYQWVSRDLSSEKRAIIAIDGKSLRHSFDKKIDQSALHMVSAFTVEKGLSLCQCAVDGKSNEIKAIPALLSMLSLKGHLVTMDAMGCQRTIAQQLRESEADYILSLKGNQGKTFSEAVNYFQQQQITQKPYLKPDHDEFDDGHGRTVRRRGWVLPLTSETKHLRSWPDIQALLVTETIRQEHYSDTS

SEQ ID NO: 7157 - protein, 122 aa, Xenorhabdus bovienii
  Coding DNA sequence: Name=SeqID_1049
  Gene classification: Function=Predicted transposase; Function class=L DNA replication, recombination and repair
  Homolog annotation: Query=1..119bp; Hit=128..247bp; Blast score=89; Percent Identity=41.0; E value=4e-19; Homolog= mll8100 COG3293
VDAHGMPIRALITSGPTADCSQAEALIDGIDAEHLLADRGYDSNTVVEQAEKQGMAAQIPGRKNRKVKREYDRELYRLRHLVENAFLHLKRWRGIATRYAKNSASFLATVQIRCLALWLNVL

SEQ ID NO: 7158 - protein, 315 aa, Xenorhabdus bovienii
  Coding DNA sequence: Name=SeqID_1050
  Gene classification: Gene name=GapA; Function=Glyceraldehyde-3 -phosphate dehydrogenase/erythrose-4-phosphate dehydrogenase; Function class=G Carbohydrate transport and metabolism
  Homolog annotation: Query=1..315bp; Hit=17..331bp; Blast score=546; Percent Identity=87.0; E value=1e-156; Homolog= gapA COG0057
VFRAAQERSDIEIVAINDLLDAEYMAYMLKYDSTHGRFNGTVEVKDGQLVVNGKTIRVTSERDPANLKWNEVGVDVVAEATGIFLTDETARKHIAAGAKKVVLTGPSKDDTPMFVMGVNHNAYAGQEIVSNASCTTNCLAPLAKVINDKFGIVEGLMTTVHATTATQKTVDGPSAKDWRGGRGAAQNIIPSSTGAAKAVGKVIPELNGKLTGMSFRVPTPNVSVVDLTARLAKPATYKEICDAIKEASEGELKGILGYTEDDVVSTDFNGEKLTSVFDAKAGIALNDNFVKLVSWYDNETGYSNKVLDLVAHISK

SEQ ID NO: 7159 - protein, 290 aa, Xenorhabdus bovienii
  Coding DNA sequence: Name=SeqID_1051
  Gene classification: Function=Uncharacterized enzymes related to aldose 1-epimerase; Function class=G Carbohydrate transport and metabolism
  Homolog annotation: Query=1..288bp; Hit=8..300bp; Blast score=333; Percent Identity=51.0; E value=1e-91; Homolog= yeaD COG0676
MLDKIFSLPVVEQISPYISQRNIEGFPLIVVSHPKVRGAISIQGAHLITWQPSGEKPVLWLSDNTEFNTGTAIRGGIPICWPWFGSTSAPSHGFARILPWEFRAHHENENGVILTFTLQDNADTHKLWSHEFTLIARFKLGETCEIELESHGEYQATCALHSYFNISDVNQICVSGLGAHFIDTVADKKQYVHEDLTFKGRIDRIYTEPEDFSLLSDTPWKRTIEIHHYHHSDVVCWNPGAELSSSMKDMSKEGYKNMVCIETARINSPQLSRNNNPARLSVVIRCRKNP

SEQ ID NO: 7160 - protein, 248 aa, Xenorhabdus bovienii
  Coding DNA sequence: Name=SeqID_1052
  Gene classification: Function=Outer membrane protein V; Function class=M Cell envelope biogenesis, outer membrane
  Homolog annotation: Query=4..248bp; Hit=5..248bp; Blast score=209; Percent Identity=44.0; E value=3e-54; Homolog= yeaF COG3713
MTNKVFIAVVGLCLSSSVAYAGEWSIGLSALYEAKPYNGLKKKDKILPVPMVSYESENFYFQTLAAGYYLWNQPKDKLSVDLFYSPQAFHPKDSTDEQMKKLDRRRDTVMGGFTYKHHEDWGVLRASLAADILGESNGISADFAYLYSFQQSGWLLEPGVGVVWDSKKQNRYSYGIKKSESVRSGLAEYTPGDSWSPYLELSGYYTFDKNWTAFMMGRVEHLPSEVKNSPMTNRSYSGTIWSGITYTF

SEQ ID NO: 7161 - protein, 355 aa, Xenorhabdus bovienii
  Coding DNA sequence: Name=SeqID_1053
  Gene classification: Gene name=Alr; Function=Alanine racemase; Function class=M Cell envelope biogenesis, outer membrane
  Homolog annotation: Query=1..353bp; Hit=1..354bp; Blast score=452; Percent Identity=59.0; E value=1e-127; Homolog= ZdadX COG0787
MPRPILATIHLDAFRHNLAVIRQKVGDSKIWSVVKANAYGHGLDRIWQSLMQTDGFALLDMNEAIYLREHGWQGPILLLEGFFKLSDLQLIDQYGLTTTVHSYWQLKAIEEARLNNPIDIYLKLNSGMNRLGFTPEEYSQVVSMANRIKNINSVTLMTHFANSDNEIGIDGQFAVVECLQMGSLPRCLANSGAVLWHPKTHGDWVRPGIILYGASPSGKWRDIADVGLKSAMSLHSEIIAVHDLPKGAKIGYGSRYTTQYPTRVGTVACGYADGYPRHAPTGTPILVDGVRTQLLGAISMDMMTVDLTPCPQTEIGSTVELWGENLPVDEVAESAGTIGYELLCALAIRVPVVVN

SEQ ID NO: 7162 - protein, 433 aa, Xenorhabdus bovienii
  Coding DNA sequence: Name=SeqID_1054
  Gene classification: Gene name=DadA; Function=Glycine/D-amino acid oxidases (deaminating); Function class=E Amino acid transport and metabolism
  Homolog annotation: Query=1..419bp; Hit=1..419bp; Blast score=648; Percent Identity=72.0; E value=0; Homolog= dadA COG0665
MKVLILGGGVIGVTSAWYLAQEGHEVTVVDRQNSAAEETSAGNAGQISPGYATPWGAPGIPLKAVKWMFQRHAPLAIRPDGSLFQLRWMWQMLRNCDADHYAMNKSRMVRLAEYSRDCIKRLRADTGMQYEGRQGGTLQLFRTAKQFDNAANDIAVLEQEGVPYQLLTAEQLASVEPALAHVSHKLAGGLQLPNDETGDCQIFTKALAKMAEEAGVKFVFSNQVKQILVDGNKITGVQCDDGIMTADNYVVAMGSYSTDMLKEFVKIPVYPLKGYSLTMPIMDEARAPTSTVLDETYKIAITRFDNRIRVGGMAEMVGFNMNVPNNRCETLKMVVQDLYHSGGNIAEATFWTGLRPMTPDGTPIVGPTKYSNLYLNTGHGTLGWTMACGSGKLLSDLISGKTPEIAADDLSVFRYINGFNTKVLRVKHRLHTA

SEQ ID NO: 7163 - protein, 240 aa, Xenorhabdus bovienii
  Coding DNA sequence: Name=SeqID_1055
  Gene classification: Gene name=FadR; Function=Transcriptional regulators; Function class=K Transcription
  Homolog annotation: Query=1..234bp; Hit=1..234bp; Blast score=380; Percent Identity=76.0; E value=1e-106; Homolog= fadR COG2186
MVIKAQSPAGFAEEYIIESIWNNRFPPGSMLPAERELSELIGVTRTTLREVLQRLARDGWLTIQHGKPTKVNNFWETSGLNILETLARLDHDRVPQLIDNLLAVRTNIAAIFIRTAFRHNPEKSLEVLAEKENVEDTAESFSAVDYDIFRGLAFASGNPIYGLIINGLRGLYTRVGRYYFSNPDARMLALNFYQQLSTMCREQSYDKIMDCVRSYGKESGIIWHGMQSVMLNDLTEARHS

SEQ ID NO: 7164 - protein, 516 aa, Xenorhabdus bovienii
  Coding DNA sequence: Name=SeqID_1056
  Gene classification: Gene name=NhaB; Function=Na+/H+ antiporter; Function class=P Inorganic ion transport and metabolism
  Homolog annotation: Query=1..513bp; Hit=1..510bp; Blast score=633; Percent Identity=72.0; E value=0; Homolog= nhaB COG3067
MEISIRHAVVKNFLGNSPDWYKLAIIVFLIINPLVFFFVNPFVAGWMLVVEFIFTLAMALKCYPLQPGGLLAIEAVIIGMTSPKQISHEISNNLEVILLLIFMVAGIYFMKQLLLFVFTKLLLTIRSKKMLALAFCLASAFLSAFLDALTVIAVVISVSVGFYSIYHHFLSSSQNDNSDLNDDQFIDSEDKKQTLEQFRAFLRSLMMHAGIGTALGGVMTMVGEPQNLIIAKHVGWDFVTFFVRMSPVTIPVFVCGLLVCLLVEHFKLFGYGAELPDHVRSVLEDYDKKTSEKRTRQEKTQLAVQALIGIWLILALAFHLAEVGLIGLSVIILATAFCGITEEHALGKAFEEALPFTALLTVFFSVVAVIIDQQLFTPFIQYVLQSSPASQLSLFYLFNGLLSAVSDNVFVGTVYINEALIALKNGLISQQQYEFLAVAINTGTNLPSVATPNGQAAFLFLLTSTLSPLIRLSYGRMVMMALPYTIVMTLVGLLSVEFWLVPATEYLIKLGLITPF

SEQ ID NO: 7165 - protein, 75 aa, Xenorhabdus bovienii
  Coding DNA sequence: Name=SeqID_1057
MVNFIFLWFLKRQNEPSFIVKFKRWEKQKNVSIFKTEFPRAKRMVTDGVNSSYIRIDSTLFSTCDEVTALCDVYL

SEQ ID NO: 7166 - protein, 155 aa, Xenorhabdus bovienii
  Coding DNA sequence: Name=SeqID_1058
  Gene classification: Gene name=DsbB; Function=Disulfide bond formation protein DsbB; Function class=O Posttranslational modification, protein turnover, chaperones
  Homolog annotation: Query=1..155bp; Hit=18..172bp; Blast score=197; Percent Identity=65.0; E value=5e-51; Homolog= dsbB COG1495
MALTALILELTALYFQHVMKLQPCVMCIYERIALFGIFGAALLGAITPKTPLRWLAILLWLYSGWQGLQLAWDHTMMQLHPSPFNTCEFFVRFPSWLPLNEWLPSVFQATGDCSMKQWSFLTLDMPQWLIGIFAAYLVMGVLVLISQFFTVRGKN

SEQ ID NO: 7167 - protein, 82 aa, Xenorhabdus bovienii
  Coding DNA sequence: Name=SeqID_1059
  Homolog annotation: Query=4..81bp; Hit=23..104bp; Blast score=75; Percent Identity=53.0; E value=3e-13; Homolog= ref|NP_929801.1|
MGWVLAGCSGQQTDHSSKRHKNYQYSDLRINLSENASMTCFDAGGILVLAIQLNGNQTPVCQLANGRRCDERALLDGGCTSI

SEQ ID NO: 7168 - protein, 251 aa, Xenorhabdus bovienii
  Coding DNA sequence: Name=SeqID_1060
MKKLLILLAGIVLLSGCAEFERIDTLLAEKKAATTDVQKYNYLMQVSKGQTYIYEHSSRKPETFESIRDRYFQEAGLTEEPKIVKRDLIYKCFNKKTYPYEDFECVYKFYSKEIDIEKATRTAENQTDRLHQIRMEDAHNIAKTVTEEGGAEFTEVNIGRFCRASSRVVATAYASVVNTYHIYDLEADKIMLLGLTDKAFVRLKKKVTSDKRGIAMVRNNPQDQKIVYEAYDMLCNSNPKSYILNYKKIFR

SEQ ID NO: 7169 - protein, 141 aa, Xenorhabdus bovienii
  Coding DNA sequence: Name=SeqID_1061
  Homolog annotation: Query=4..140bp; Hit=10..147bp; Blast score=126; Percent Identity=49.0; E value=5e-29; Homolog= ref|NP_931542.1|
MDYYYYSPSEDVFYPEVLKQGYIDAGTWPQDGMKVDESVYIEFTQNTPKGKRRVAGSDGLPTWGDIFPLSSEALQRQAEYEKRNLIKEIREKIEPLQDAVYLDVATEEEKTALTAWHRYRLALYQLDLSTAPSIDWPAKPE

SEQ ID NO: 7170 - protein, 261 aa, Xenorhabdus bovienii
  Coding DNA sequence: Name=SeqID_1062
  Gene classification: Function=Transposase; Function class=L DNA replication, recombination and repair
  Homolog annotation: Query=3..260bp; Hit=2..263bp; Blast score=189; Percent Identity=42.0; E value=2e-48; Homolog= PA2319 COG3547
MQNVTLIGIDLGKHSFHVHCQDKSGKALLRKKFTRTKLMQFLAECPSSVVVMEACAGAHFMARRITDLGHETKLISPQFVRPFVKSNKNDFVDAEAICEAASRPSMRFVQPRTEAQQAMRVLHRVRESLVRDKVKTTNQMHAFLLEFGISMPTGTAVIKRLSTVLAENELPPYLTQLLMRLHAHYLYLIEQIAELETALEQELSRDETGQRLQTIPGVGPITASVLSSQLGDGKQYGCSRDFAASTGLVLRQYTTGGKIRF

SEQ ID NO: 7171 - protein, 155 aa, Xenorhabdus bovienii
  Coding DNA sequence: Name=SeqID_1063
  Homolog annotation: Query=19..155bp; Hit=125..256bp; Blast score=107; Percent Identity=46.0; E value=7e-23; Homolog= ref|NP_929775.1|
MTTASKLYSTLLQAGTQPSKFDDKKGQDWGYLNNKGWLGPSQPTFGILTEIHNKTDIKNILMFYWGEKESSNTYKGLYLRVSSNEGNYQTVVELLKKSLDITVDNATHNFGTTPPKKEGNTDYIYTVQYVNDEARKLGSILKQVDQTKHFCFNWR

SEQ ID NO: 7172 - protein, 122 aa, Xenorhabdus bovienii
  Coding DNA sequence: Name=SeqID_1064
  Gene classification: Function=Predicted transposase; Function class=L DNA replication, recombination and repair
  Homolog annotation: Query=1..120bp; Hit=128..248bp; Blast score=89; Percent Identity=41.0; E value=5e-19; Homolog= mll8100 COG3293
VDAHGMPVRIVITSGTTADCSQAETLIKGLDAEHLLADRGYDSNAIVEKAEQQGMQVHIPSRKNRKAAREYDRELYRFRHLVENAFLHLKRWRGIATRYAKNSASFLAAVQIRCLVLWLKIS

SEQ ID NO: 7173 - protein, 158 aa, Xenorhabdus bovienii
  Coding DNA sequence: Name=SeqID_1065
  Gene classification: Function=Predicted transposase; Function class=L DNA replication, recombination and repair
  Homolog annotation: Query=11..115bp; Hit=6..110bp; Blast score=103; Percent Identity=45.0; E value=6e-23; Homolog= CC0928 COG3293
MSTPAHRRHDISDRVWSLLEPHLPGRQGAWGRVAEDNRRFINGVFWILRTGAPWRDLHTDYGDWKNTHRRFCRWRDKGIWEKLLEQLVNDPDFEWLMIDASHIKVHPDAAGAKGGNQDMGLTKGGSIPRYIWPWMRMVCRSELLLQAVPQQIVHKRRP

SEQ ID NO: 7174 - protein, 105 aa, Xenorhabdus bovienii
  Coding DNA sequence: Name=SeqID_1066
  Homolog annotation: Query=2..105bp; Hit=8..111bp; Blast score=126; Percent Identity=68.0; E value=8e-29; Homolog= ref|NP_929776.1|
VGQAHESRAAIPLLDGIGIQRKNGFMKRRGKAVLADKGYSGGKLCGYLRKLRIKSVIPYKINEKGRADGRTQFDEQAYRDRNVVERCFGFLKGNRRIATRYEKTA

SEQ ID NO: 7175 - protein, 269 aa, Xenorhabdus bovienii
  Coding DNA sequence: Name=SeqID_1067
  Homolog annotation: Query=8..243bp; Hit=12..246bp; Blast score=229; Percent Identity=51.0; E value=3e-59; Homolog= ref|NP_821845.1|
MPSPAKIWEQALQALHTRLAPLFHSTGSRQRSLAYLRGLLSDVERKNSWQLAEWVGESTPDGIQYLLERADWDVDMARDILRDYVTEHLGDEQGVLILDETGFIKKGTHSAGVQRQYSGTAGRVENSQIGVFLCYAGNGGHAFVDRALYLPRQWTDARSRCEAAGIPASVTFATKPPLARQMLERTWDAGVPCRWVTADEVYGRDRRLRVWLESRYPPFVLAIPCNIPLWWRGPEYIRADRIADTLTAAGEIIGLQSNYGCSTRLCPLM

SEQ ID NO: 7176 - protein, 114 aa, Xenorhabdus bovienii
  Coding DNA sequence: Name=SeqID_1068
  Gene classification: Function=Predicted transposase; Function class=L DNA replication, recombination and repair
  Homolog annotation: Query=21..110bp; Hit=163..248bp; Blast score=62; Percent Identity=41.0; E value=7e-11; Homolog= mll8100 COG3293
LLDGIGIQRKNGFMKRRGKAVLADKGYSGGKLRGYLRKLRIKSIIPYKINEKGSTDGRTQFDEQAYRDRNVVERCFGFLKGNRRIATRYEKTARNYLSRVKLGCIRLFYRRLSN

SEQ ID NO: 7177 - protein, 152 aa, Xenorhabdus bovienii
  Coding DNA sequence: Name=SeqID_1069
  Gene classification: Function=Predicted transposase; Function class=L DNA replication, recombination and repair
  Homolog annotation: Query=1..126bp; Hit=1..117bp; Blast score=106; Percent Identity=46.0; E value=7e-24; Homolog= mll8100 COG3293
MARYDIPDDAWIVIKPCLPPVHSERAGRPHVEHRRVMNGMFWVLCSGAPWRDLPERYGPWKTVYNRFNRGSKSGIINKIFNRLLSILDEKGLIDWAEICLDGSNIRASKDAAGAKKNLPISLTIMRWVAHAVVMAPKSIWQPTDGVFPSTCF

SEQ ID NO: 7178 - protein, 122 aa, Xenorhabdus bovienii
  Coding DNA sequence: Name=SeqID_1070
  Homolog annotation: Query=1..118bp; Hit=1..118bp; Blast score=158; Percent Identity=65.0; E value=1e-38; Homolog= ref|NP_927753.1|
MRNLVNLYCHVDDFCQIFMPQWQKYLIESGERQRLRQGRMSTSEIMTIIIAFHMSHQRDFKNFYLGFIYLYHRKAFPTLLSYTRFLEVMPMVLIPLSSFFTHLKGKPTGIEFIDSTRLCPLM

SEQ ID NO: 7179 - protein, 295 aa, Xenorhabdus bovienii
  Coding DNA sequence: Name=SeqID_1071
  Homolog annotation: Query=1..291bp; Hit=746..1040bp; Blast score=282; Percent Identity=67.0; E value=5e-75; Homolog= gb|AAC38630.1|
LGVAATGFGIGALLGFNVGRILEKAGGLLARFLQGRSTLLQAAAGAASAASYGATTQGTAVATAAGTATGTIGALINNADSGMGGAIGAGTAVGTIDTMMGSSVTLTHEVGAAVGGAAGGMLTGTSGSTRAGINAGTGTYYGSWVGFGLDVASNPSGHLLRYGSGYLAGRGAEMAMSHLFGGGLLGRLLGRLTAPLATGLARQAVQFGISRPFFEPIFSFLGGLAGGIGTGLQRRLGREHTLSRMIETIGSGIDQLAGMIGKRFRGQVLWQTGLANLRDYGMSALNAGRRMLMPD

SEQ ID NO: 7180 - protein, 136 aa, Xenorhabdus bovienii
  Coding DNA sequence: Name=SeqID_1072
MKILKPIETATNQDITIELRDVYVVRGSGKTYLSEKGALNKLAYVRAQKQFNADERPSNFPAEEVIQEDGTSALRRGKMRPEFIERHAQVLEELKADVRREREKIALRKKYSKAMNKINSLHETISELEIQIAELE

SEQ ID NO: 7181 - protein, 70 aa, Xenorhabdus bovienii
  Coding DNA sequence: Name=SeqID_1073
MKNIYKHTRVSNIRISDMDDSDLQLLVSSSEDVIYSITRGMKSIANLASAAVNSEEYSQDDAMTDLDRLS

SEQ ID NO: 7182 - protein, 63 aa, Xenorhabdus bovienii
  Coding DNA sequence: Name=SeqID_1074
MSDNQAFDELEGVGSEIENLRTYVSLLVDTDKSLSGAELLSITLVAIFNIGKELARVRGVEYQ

SEQ ID NO: 7183 - protein, 43 aa, Xenorhabdus bovienii
  Coding DNA sequence: Name=SeqID_1075
MNNKLQAAVEIAEEIEASIFPVVTATQNGAEQDTYLMCRGVHR

SEQ ID NO: 7184 - protein, 54 aa, Xenorhabdus bovienii
  Coding DNA sequence: Name=SeqID_1076
MFNNITSKEDYFDLHIVLETVMILEKMENSRANNIAKQLIELLSAKAKEANDEQ

SEQ ID NO: 7185 - protein, 54 aa, Xenorhabdus bovienii
  Coding DNA sequence: Name=SeqID_1077
VLTTPMKFVAEHKEKFERYRQWAISEAPRSEIRRRLAKLCWVERKYYREWAALS

SEQ ID NO: 7186 - protein, 81 aa, Xenorhabdus bovienii
  Coding DNA sequence: Name=SeqID_1078
  Homolog annotation: Query=2..75bp; Hit=42..115bp; Blast score=100; Percent Identity=62.0; E value=4e-21; Homolog= ref|NP_459879.1|
VDAYLWVLAVIKTNEPAHLEAAEEALKKLKITPKAAQQKYSDYLMKSGAHPFQIAFGTLSMDNPQGYITSAKEQLNYHLLK

SEQ ID NO: 7187 - protein, 167 aa, Xenorhabdus bovienii
  Coding DNA sequence: Name=SeqID_1079
  Homolog annotation: Query=1..163bp; Hit=121..283bp; Blast score=127; Percent Identity=44.0; E value=9e-29; Homolog= ref|NP_459879.1|
VRASFASYEATLELTEPEKLMLVGELADIYEPFYYWSETEQAEGCMRGDRINETDKLRQATAKGFAEQLPEPHTLSDVVREFLYWDWLYQMRNVADKELDPGGYGDGDRYYIYDRQDYLEGKLATIQAVNRQEAIDVCKWVLEEERFHDRELTDKIILNLVGESADA

SEQ ID NO: 7188 - protein, 134 aa, Xenorhabdus bovienii
  Coding DNA sequence: Name=SeqID_1080
  Homolog annotation: Query=1..121bp; Hit=2..121bp; Blast score=126; Percent Identity=52.0; E value=8e-29; Homolog= ref|NP_461182.1|
MRDIQMVLECWGGWAASGHSSINYSSIAAGFKGLLPSTSKSRLSCCDNDGIAVDSAVGRLIKSGRTDEFELIELHYIHDISKSEIARKKKCSEGKIRQNLMVAETFIEACLIMAEVTLEMDAWTHKETPTEKVA

SEQ ID NO: 7189 - protein, 254 aa, Xenorhabdus bovienii
  Coding DNA sequence: Name=SeqID_1081
  Homolog annotation: Query=1..254bp; Hit=1..256bp; Blast score=156; Percent Identity=38.0; E value=4e-37; Homolog= ref|NP_929775.1|
MSEINKLDNKQCPFDPDQYKYNKKIDIEVDNVAPTGSLPWALIQVYLGKEVHRSGWNAPIEHMRLTHKSEVGNTDDGAAYIEKSDKGGYWSRWQPTQEDLMACDWSLLKSEPKPDNCMLEFDLKIGTDQYQYGGGTAQDWGYMTKAGDISVGESTFGVLADLQSIIGVGSISTFRLFENPIGTFYNILLEVDTQNQPDLESKALEVTANGSTYNLGSTSNYTTDFSYTSDGAKQLGDLLKQNVGNTLHFCFNWK

SEQ ID NO: 7190 - protein, 53 aa, Xenorhabdus bovienii
  Coding DNA sequence: Name=SeqID_1082
MNISMWQIEEMAEEIISGLFADGKTPMEQFGINWKQAERLDSRNEAQLSGNSS

SEQ ID NO: 7191 - protein, 62 aa, Xenorhabdus bovienii
  Coding DNA sequence: Name=SeqID_1083
MMIENQIPPMLIEHRVQTNQLSSSQSLFRMYCLALQLEAVMGEIEKRAKIMRAENTLPPQSK

SEQ ID NO: 7192 - protein, 72 aa, Xenorhabdus bovienii
  Coding DNA sequence: Name=SeqID_1084
MKFVVKNISYLSNYMPPEDIEVELRIFTDENSRNFFTAWVEFPYSDNLSLGEIKEKAVEKAKEKFKTVFSQI

SEQ ID NO: 7193 - protein, 46 aa, Xenorhabdus bovienii
  Coding DNA sequence: Name=SeqID_1085
MTEPNPNYEAIGHCKILKEKIAELSIQRVRRIEKLNDEIMRLQGYP

SEQ ID NO: 7194 - protein, 66 aa, Xenorhabdus bovienii
  Coding DNA sequence: Name=SeqID_1086
  Homolog annotation: Query=1..66bp; Hit=226..291bp; Blast score=100; Percent Identity=74.0; E value=5e-21; Homolog= ref|NP_716636.1|
MLAKRFIIETINDQLKNVTQIEHSRHRSLHGFMLNLLGGLIAYCLKPKKPSLNITSAEKTGLRVMA

SEQ ID NO: 7195 - protein, 375 aa, Xenorhabdus bovienii
  Coding DNA sequence: Name=SeqID_1087
  Gene classification: Gene name=Rnd; Function=Ribonuclease D; Function class=J Translation, ribosomal structure and biogenesis
  Homolog annotation: Query=1..374bp; Hit=1..374bp; Blast score=479; Percent Identity=63.0; E value=1e-135; Homolog= rnd COG0349
LNYQLITSDAQLQSICERAKKHATIALDTEFVRTRTYYPQLGLIQLFDGEQLSLIDPLDISEWQPFRELLTDPDVLKFIHAGSEDLEVFWNSFQCLPTPMIDTQVLAAFIGHPMSCGFATLVAQYLHVELDKSESRTDWLARPLSGKQCEYAAADVYYLLPLADILVAATKQAGYMDAAQDESYLIAQRRKEILMPECAYKDIGNAWQLRPKQLACLKKLAGWRLNQARERDLAINFVIREENLWQVARYMPTSLGELDALGLSGQEIRCHGRRLLVMVAESRDIPDEACPALITNLIDYPGYRTAFKEIKSLVTQVSESQQFSVELLASRRQINQLLSSHWKLKSPDYQPELLRGWRGELLAEPVAEILANYPA

SEQ ID NO: 7196 - protein, 565 aa, Xenorhabdus bovienii
  Coding DNA sequence: Name=SeqID_1088
  Gene classification: Gene name=CaiC; Function=Acyl-CoA synthetases (AMP-forming)/AMP-acid ligases II; Function class=I Lipid metabolism
  Homolog annotation: Query=1..561bp; Hit=1..561bp; Blast score=911; Percent Identity=78.0; E value=0; Homolog= fadD COG0318
LEKVWLKHYPADVPAEIDPDRYLSLIEMFENAVARYADQVAFINMGEVITFRKLEERSRAFAAYLQNGLGLKKGDRVALMMPNLLQYPVALFGVLRAGMVVVNVNPLYTPRELEHQLTDSGTSSIVIVSNFAHTLEKIVFNTPVKHVILTRMGDQLSRPKGTLVDFVVKYVKRLVPKYHLPDAISFRSVIHKGYRMQYVKPDVDGDALAFLQYTGGTTGVAKGAMLTHRNMLANLEQGKANYAPLMAPGQELVVTALPLYHIFALTVNCLLFIELGGQNLLITNPRDINGTVKELSRYSFTALSGVNTLFNAWLNNPEFQKLDFSSLRLSVGGGMAVQRIVAEKWQNLTGCHLLEGYGLTECAPLVSGNPYNLTHYSGSIGFPVPSTEIKLVSDDGNEVPLGQAGEMWVHGPQVMKGYWNRPEATAEVLKDGWLATGDIANVDESGFLHIVDRKKDMILVSGFNVYPNEVEDVVSSHPKVLESAAIGVPNDNSGETVKIFVVRKDQSLTENELKTHCRRYLTGYKVPKLIEFRDELPKSNVGKILRKELRNEELAKANNAATAAN

SEQ ID NO: 7197 - protein, 63 aa, Xenorhabdus bovienii
  Coding DNA sequence: Name=SeqID_1089
MIKSVYNQSVIHPSVGYLINSLINNKKIRQQKLPYFLAETYSIKLVMYIANLNNVSFQTGTLS

SEQ ID NO: 7198 - protein, 197 aa, Xenorhabdus bovienii
  Coding DNA sequence: Name=SeqID_1090
  Gene classification: Gene name=Slp; Function=Starvation-inducible outer membrane lipoprotein; Function class=M Cell envelope biogenesis, outer membrane
  Homolog annotation: Query=20..165bp; Hit=12..157bp; Blast score=174; Percent Identity=54.0; E value=7e-44; Homolog= yeaY COG3065
MEELMLKGTHYRVMLQVVALAGAIAMILTGCVSVPDAIKGTTKTPVENLLSVKNTPELYIGHEGRFGGKVLSVLNEKDRTRLEILALPLASNAAPLLNKPSLGRVYAYVNGFLEPNDFKDHYVTVVGSITDLEKGMVGNSPYNYVVMNVVGFKRWYESERVDLPPVGNSVFWNYYGTPYFSDWGQIVSMKDALAERY

SEQ ID NO: 7199 - protein, 231 aa, Xenorhabdus bovienii
  Coding DNA sequence: Name=SeqID_1091
  Gene classification: Function=Inactive homologs of metal-dependent proteases, putative molecular chaperones; Function class=O Posttranslational modification, protein turnover, chaperones
  Homolog annotation: Query=4..231bp; Hit=2..230bp; Blast score=294; Percent Identity=65.0; E value=5e-80; Homolog= ZyeaZ COG1214
MSTRILAIDTATEACSVALWNESVIEAQFEISPREHTQRILPMVQAVLSQGNLSLQQLDALAFGRGPGSFTGVRIGIGIAQGLALGAELPMLGVSSLKTMAQGAFRLKGAQNVLVAIDARMGEVYWGQYTRNSQGEWQGDETEAVLKPEQAQAVMNALTGVWAIAGTGWEAYPQLLDTHLDLVKSDITLPHAEDMLPLAVQMWKAGEATVVEHAEPVYLRNEVTWKKLPGR

SEQ ID NO: 7200 - protein, 638 aa, Xenorhabdus bovienii
  Coding DNA sequence: Name=SeqID_1092
  Gene classification: Gene name=DinG; Function=Rad3-related DNA helicases; Function class=L DNA replication, recombination and repair
  Homolog annotation: Query=1..630bp; Hit=1..630bp; Blast score=964; Percent Identity=74.0; E value=0; Homolog= Z2851 COG1199
VSDDFAKNGVLAKAIQGFKPRDAQREMALAISAAIKKQQQLVVEAGTGTGKTFAYLVPALRSGKKVIISTGSKALQDQLYNRDLPTVADALKFTGSLALLKGRSNYLCLERLEQQSLGSSQLEPEMLAEVVRLRSWSSQTEDGDISTCHQIAEDSTVWPLVTSTNDNCLGSDCPRYQECFVLKARRKAMESDVVIVNHHLFMADMVVKDTGFGELIPRADVVIFDEAHQLPDIASQYFGQQLSSRQLMDLSRDIIMAYRTEVRDQAQLQKSADRLSQSAQDFRLSLGENSYRGNLREALQQPQIQRMLVRLDDALELCYDVMKLSLGRSAMLDAAFERATVYRNRLKRLIDVTIPNYSYWFESYGRHFLLALTPLSVSDKFSDMIREQSGCWIFTSATLSVNEQLEHFTARLGLKQAQTLLLPSPFDYQRQMLLCVPRHLPSPNQNGGAKWLARMLKPLIESNKGRCFFLCTSHQMMRGLAEEFRASLTLPVLVQGETSKGQLLSQFISAGNALLVATGSFWEGVDVRGDALSCVIIDKLPFTAPDDPLLKARIEDCQLKGGDAFSEVQIPDAVISLKQGVGRLIRDIDDYGVVVICDNRLVMRPYGEIFLNSLPPARRTRDLSKAVAFLKSRPTESE

SEQ ID NO: 7201 - protein, 114 aa, Xenorhabdus bovienii
  Coding DNA sequence: Name=SeqID_1093
  Gene classification: Gene name=TdcF; Function=Putative translation initiation inhibitor; Function class=J Translation, ribosomal structure and biogenesis
  Homolog annotation: Query=1..114bp; Hit=17..130bp; Blast score=160; Percent Identity=71.0; E value=1e-40; Homolog= yoaB COG0251
MTIERIDPDTRWSEAVIHNDTIYYTSVPEKLDGNITEQTADTLAAIDLMLQRLGSDKSKIIDATIFLADKSDFAGMNAAWDTWVIAGSAPVRCTVQAELMNPKYKVEIKIIAAL

SEQ ID NO: 7202 - protein, 110 aa, Xenorhabdus bovienii
  Coding DNA sequence: Name=SeqID_1094
  Gene classification: Gene name=EmrE; Function=Membrane transporters of cations and cationic drugs; Function class=P Inorganic ion transport and metabolism
  Homolog annotation: Query=2..110bp; Hit=1..109bp; Blast score=97; Percent Identity=69.0; E value=1e-21; Homolog= ydgE COG2076
MLTPFEWWHAAFLVLAVLLEIVANILLKLSNGFQRFWIGVLSLVAVLAAFSALAQAVKGIELSIAYALWGAFGIIATVAAGWIMFNQRLNVKGWGGIVLLLIGIIMIKMA

SEQ ID NO: 7203 - protein, 116 aa, Xenorhabdus bovienii
  Coding DNA sequence: Name=SeqID_1095
  Gene classification: Gene name=EmrE; Function=Membrane transporters of cations and cationic drugs; Function class=P Inorganic ion transport and metabolism
  Homolog annotation: Query=2..114bp; Hit=3..115bp; Blast score=110; Percent Identity=68.0; E value=3e-25; Homolog= ydgF COG2076
MIYWIFLALAILTEVIGTLSMKQASVSGDFTGMIVMYTMITTSYILLAIAVKKVALGVAYALWEGIGILFITAFSVLWFNESLSPMKIGGLALLIAGIALIKSGTKKASNYQMKEA

SEQ ID NO: 7204 - protein, 491 aa, Xenorhabdus bovienii
  Coding DNA sequence: Name=SeqID_1096
  Gene classification: Gene name=Zwf; Function=Glucose-6-phosphate 1 -dehydrogenase; Function class=G Carbohydrate transport and metabolism
  Homolog annotation: Query=1..491bp; Hit=1..491bp; Blast score=841; Percent Identity=81.0; E value=0; Homolog= zwf COG0364
MAVTSVAQACDLVIFGAKGDLARRKLMPSLYQLEKAGYIHPDTRIIGVGRADWDKKAYTKVVEEALATFMSEKLDPELWKKLSTRLEFCNLDVNETEHFTRLAKILKQDSLPAIHYFAMPPNTFGSVCHGLGAAGLNKEPNRVVMEKPLGTDLASSRAINDEVAKYFNESQIYRIDHYLGKETVLNLLALRFANSLFANNWDHRTIDHVQITVAEEVGIEGRWGYFDQAGQMRDMIQNHLLQILTMIAMSPPSDLTADRIRDEKVKILRSLRRIDQTNVREKTVRGQYTAGFVHGKKVPGYLEEEGANKVSKTETFVSIRVDIDDWRWSGVPFYLRTGKRLPAKCSEVVVYFKEPSLNLFANSYQQLPQNKLTIRLQPDEGIDIEVLNKAPGLDHKHRLQTTKLDLSFSQTFSQTHLADAYERLLLEAMRGIQALFVRRDEVEEAWKWVDSIMDAWEADNEPPKPYQAGTWGPVASIAMITRDGCSWNEFE

SEQ ID NO: 7205 - protein, 294 aa, Xenorhabdus bovienii
  Coding DNA sequence: Name=SeqID_1097
  Gene classification: Gene name=RpiR; Function=Transcriptional regulators; Function class=K Transcription
  Homolog annotation: Query=13..292bp; Hit=1..280bp; Blast score=428; Percent Identity=79.0; E value=1e-120; Homolog= ZyebK COG1737
MKSLKPKVELRLMNTLERLQNSLDILSKSEKKVAQVILASPHTAIHSSIATLAKLANVSEPTVNRFCRRLNTKGFPDFKLHLAQSLANGTPYVNRNVEESDSVMSYTSKIFESVMANLETVKNNLDIAAINRAVDLLTQARKISFFGLGASAAVAHDAMNKFFRFNIPITYFDDIVMQRMSCINSAEGDVVVLISHTGRTKNLVEIARLARENDATVIAITSTGSPLAHEATLPILLDVPEDTDIYMPMVSRIAQLTIIDVLATGFTLRRGSKFRDNLKRVKEALRNSRFDKYE

SEQ ID NO: 7206 - protein, 480 aa, Xenorhabdus bovienii
  Coding DNA sequence: Name=SeqID_1098
  Gene classification: Gene name=PykF; Function=Pyruvate kinase; Function class=G Carbohydrate transport and metabolism
  Homolog annotation: Query=1..480bp; Hit=1..480bp; Blast score=775; Percent Identity=86.0; E value=0; Homolog= pykA COG0469
MSRRLRRTKIVTTLGPATDRDDNLEKVINAGANVVRLNFSHGTAEDHVQRANKVREIAARLGYHVAILGDLQGPKIRVSTFKEGKIFLNIGDKFLLDANLGKGEGDKEKVGIDYKGLPSDVTTGDILLLDDGRVQLRVLDVQGMKVFTEVTVGGPLSNNKGINKQGGGLSAEALTEKDKQDIITAAKIGVDYLAVSFPRSGEDLNYARRLARDAGCETQIVAKVERAEAVSSGDIIDEIILASDVVMVARGDLGVEIGDPELVGVQKKLIRRARQLNRVVITATQMMESMITNPMPTRAEVMDVANAVLDGTDAVMLSAETAAGQYPAETVAAMAQVCLGAEKMPSINVSKHRLDITFDSIEEAISMSTMYAANHLKGVKAIIAMTESGRTARMMSRISSGLPIFSMSRHESTLNRTALYRGVTPVYCSTHTDGISAANEAVNRLRDKGYLTSGDVVLVTQGDQMGTIGSTNTCRVLEVE

SEQ ID NO: 7207 - protein, 322 aa, Xenorhabdus bovienii
  Coding DNA sequence: Name=SeqID_1099
  Gene classification: Gene name=HtrB; Function=Lauroyl/myristoyl acyltransferase involved in lipid A biosynthesis; Function class=N Cell motility and secretion
  Homolog annotation: Query=13..322bp; Hit=10..319bp; Blast score=425; Percent Identity=64.0; E value=1e-119; Homolog= msbB COG1560
MNKEKDTDSKLGYVPTFHLSYLHPRYWGLWTGVGVLAGLAYVPVKWRDPLLAKMGIWAGKKAKSARRRAKINLVYCFPELQEQQREALIDKMFATAPQSFVMLAELCLKGAESTLQRTRWHGEEILHSLKAQGKNVILLVPHGWAIDIPAMLLAARDQKVAGMFHHQSNPVADYLWNKVRTHFGGRLHSREAGIKPFIASIRQGHLGYYLPDQDHGEEHSEFVDFFATYKATLPAIGRLMKVSRAAVVPLFPVYNCQTHQLDIYIRPPMDDIEGQNDTYIARRMNQELEELVRPNPEQYTWILKLLKTRKVGDIEPYKRKDL

SEQ ID NO: 7208 - protein, 416 aa, Xenorhabdus bovienii
  Coding DNA sequence: Name=SeqID_1100
  Gene classification: Gene name=NlpD; Function=Membrane proteins related to metalloendopeptidases; Function class=M Cell envelope biogenesis, outer membrane
  Homolog annotation: Query=1..416bp; Hit=1..419bp; Blast score=514; Percent Identity=61.0; E value=1e-146; Homolog= yebA COG0739
MLGSLTLVTLAVAVWRPVAYHEQEERTGSIILSTPNNISDATDDSIGDIDEQLPDEGIGDDEGGSDTTVNFPHQYVVSGGDTLSSILTQFGIDSSDVALLANQYKSLRDLNIGQSLSWTIDDNGNLKTLTWGISRRETRIYTREGDVFKETSAFQKGEWKNTIVKGKIDGSFSGSALSAGLTSGEARDITKALQWQIDFRKLRKGDRFSVLMSREMLDGKSEQSQLMGVRLHSGGNDYYAFRADDGRFYDSNASGLERGFLRFPTMKQFRLSSSFNPHRLNPVTGRITAHKGVDFAMPVGTPVLAVGDGEVIVSKFDGAAGNFIAIRHGRQYTTRYMHLRKLLVKPGQKVKRGERIALSGNTGRSTGPHLHFEFWNNQQPVNPLTAKLPRSGGLNGKERSEYIAKVRDIKPQLLLD

SEQ ID NO: 7209 - protein, 232 aa, Xenorhabdus bovienii
  Coding DNA sequence: Name=SeqID_1101
  Gene classification: Gene name=ZnuA; Function=ABC-type Mn/Zn transport system, periplasmic Mn/Zn-binding (lipo)protein (surface adhesin A); Function class=P Inorganic ion transport and metabolism
  Homolog annotation: Query=1..231bp; Hit=99..325bp; Blast score=291; Percent Identity=59.0; E value=3e-79; Homolog= ZyebL COG0803
IGPDMETFLAKPITKIAQNKQLALAQLSTIKPLLLKNNEDENDLEESSQPKHDADHEHHHHGEYNMHIWLSPEIAKQVAQAIYIQLVEQYPQQKRQLEVNLRKFNGQLVQTDKNVASILRPVQGKGYFVFHDAYGYFEKHYKLAPLGVFTVNPEIQPGAQKLHYIRTQLVEQKATCIFAEPQFRPAVIHTVAKGTDVRTGTLDPLGSGIVLNKDSYMKFITQLSEQYASCLN

SEQ ID NO: 7210 - protein, 131 aa, Xenorhabdus bovienii
  Coding DNA sequence: Name=SeqID_1102
VICSLSNRIAFKNVIYIRSCACPGSRAVLVFVLFWLNGAIHQRINRRCQLDTFSCRVIRPRYERFTCIAQQSEALRAAPLSRFIFLCEFYNHHSIVTLCVADFGHRTEIGVFRRNRRNFRKAKTWNKITCT

SEQ ID NO: 7211 - protein, 39 aa, Xenorhabdus bovienii
  Coding DNA sequence: Name=SeqID_1103
MWISLFLVLYNQLFLLRPDFILVLSGFFGGTRGRARART

SEQ ID NO: 7212 - protein, 236 aa, Xenorhabdus bovienii
  Coding DNA sequence: Name=SeqID_1104
MAYTDALKRLEFLVSEAKGADRELLDKANQMISQSLELQKEAFSVIGKAYDSACNDNQELEDDILSQFMFMNDFDEIEKESQKEEEKKEHERECELLKISRLDPSCFTETNKALHDCAGEIVKKARALFKSEPVIAQVWSYRYGGYDMISCDLFSADRTLSMPVTISAVARQMLEYFDEPEVFDMAEAVHLAGLITKAIDAKVIVGLGRNEVNSDVLAKPLGEGHTNGEINLWKQE

SEQ ID NO: 7213 - protein, 38 aa, Xenorhabdus bovienii
  Coding DNA sequence: Name=SeqID_1105
MSVFSEFAGKLGVSLENGNHCTFMWDITILSHHIWRDD

SEQ ID NO: 7214 - protein, 31 aa, Xenorhabdus bovienii
  Coding DNA sequence: Name=SeqID_1106
MTELGLTLKVYRIGDCSTEPLYGCAGYRHSL

SEQ ID NO: 7215 - protein, 54 aa, Xenorhabdus bovienii
  Coding DNA sequence: Name=SeqID_1107
MDALDIDIRYNTSVADSSVIESISKTLEKVLLKVMNELLEGHQHSSHLTDNSEG

SEQ ID NO: 7216 - protein, 195 aa, Xenorhabdus bovienii
  Coding DNA sequence: Name=SeqID_1108
  Gene classification: Gene name=PdxH; Function=Pyridoxamine phosphate oxidase; Function class=H Coenzyme metabolism
  Homolog annotation: Query=3..195bp; Hit=33..222bp; Blast score=123; Percent Identity=39.0; E value=1e-28; Homolog= CC0918 COG0259
MSEEPMAKFHQWWSEYKRDVAPAHPGAVCVSTVSKNGAPSARFVGLKSADDNGFVFCTWFDSPKGQNLASNPHIALTFWWEEKGRQVRVEGTVEHVSEQESKEEWASRSRDAQLATLCFKQSQPLDSENDLHANYSHTQADTAGWPIEKPARWGGYRVIPTSIEFLTFRENRMHLREYFRRNDPLSGWEKTLLQP

SEQ ID NO: 7217 - protein, 40 aa, Xenorhabdus bovienii
  Coding DNA sequence: Name=SeqID_1109
MTRFLAGKRHYFNRELNYISRIETLFKILFNRHFRLNVTA

SEQ ID NO: 7218 - protein, 345 aa, Xenorhabdus bovienii
  Coding DNA sequence: Name=SeqID_1110
  Gene classification: Function=Transposase; Function class=L DNA replication, recombination and repair
  Homolog annotation: Query=32..340bp; Hit=3..313bp; Blast score=159; Percent Identity=34.0; E value=3e-39; Homolog= NMB1750 COG3547
LCLEHLFYKSNHGDISCVSDKEDNLMSDNIVVGIDIAKHKFDVAVWAGENHYKRKHFPNDLKGFDAFINWLKPASNYHFCMEATGIYGDPLALYLSDKGLLISVVNPVQIHAFGKAELLRNKTDKIDAKLIARYCASQHPPAWQPAPLCECQLLALVRHRNKLNEMLLTEENRLSVADEVVCDSHAKIITLLKQELKDTELKLKKHIDDSPSLKKNKGLLESIPGIGERLSATLLAYIGDGSRFHHSGQVVAYAGLNPKLHESGQLKGRAHLSKQGSAELRKALYMPALAAISCNKVVKKQWEQLTARHKGGKVGVCAVMRKLLRLAYGVMKSGTLFNAEIPLAV

SEQ ID NO: 7219 - protein, 33 aa, Xenorhabdus bovienii
  Coding DNA sequence: Name=SeqID_1111
LTKTLIVPQALSSLLKQTSDTVSVIKLQAVFLR

SEQ ID NO: 7220 - protein, 282 aa, Xenorhabdus bovienii
  Coding DNA sequence: Name=SeqID_1112
  Homolog annotation: Query=1..281bp; Hit=1..281bp; Blast score=338; Percent Identity=58.0; E value=7e-92; Homolog= ref|NP_927686.1|
MSNLEELYCCVDDFCQKFIPLWHQQLIENGLLKRRREASLSLSEVMTLLILFHMSHYRDFKTFYIQHVKHYLKADFPRLVSYTRMLTLKQRALIPLCAFFSSRKAETQGIAFIDSTKIAVCHNLRIPRHRVFKGVAQRGKTSTGWFYGFKLHLVINDCGELLAVNLTSGNKDDRHPVKARVQGLTGCLYGDKGYLSQALCDELEAEGITLITHVRSNMKAKALSLWDKLMLRKRFLIETVVDQLKNISQIAHSRHRSQLGFLLEIVAGLIAYTFQPKKPSLN

SEQ ID NO: 7221 - protein, 361 aa, Xenorhabdus bovienii
  Coding DNA sequence: Name=SeqID_1113
  Gene classification: Gene name=Pgk; Function=3-phosphoglycerate kinase; Function class=G Carbohydrate transport and metabolism
  Homolog annotation: Query=58..345bp; Hit=72..382bp; Blast score=89; Percent Identity=31.0; E value=6e-18; Homolog= CC3249 COG0126
MSGASVILFSAGINISSGVRSHPRIDEDAESILPLINGRETIIIYNHQGDYFKGTAESTPWLASLLSERLQQHVSYFPECVGAAAQEFIARLPRGGIALMGNTRCYAQEQQNDSTFAGELARPGDRLVIGGFSKLHRKNASNCAIKSLIPWCYSQGVMTQLQELERIHSVLYSNRPTILLLGGNKKEKLQFLFHHPRLRHVDRVIAGGAVLNSLLKARGVRVGKSDCFPLPANASLQLPLYIPETVIVADVGGRMVRRPLPQIRDSDRIVDFIFQKEFLADITTPSACSFFAAGPLSLPQSQYAHAAYRELSRQGIEGLFMGGDTLTEIEIFSFKSSGGGAVLHFFSSGYDDIIFQETYGR

SEQ ID NO: 7222 - protein, 432 aa, Xenorhabdus bovienii
  Coding DNA sequence: Name=SeqID_1114
  Gene classification: Gene name=BioA; Function=Adenosylmethionine-8 -amino-7-oxononanoateaminotransferase; Function class=H Coenzyme metabolism
  Homolog annotation: Query=14..429bp; Hit=15..435bp; Blast score=250; Percent Identity=33.0; E value=2e-66; Homolog= BS_yodT COG0161
MYMYPFTGYQPDVPKVTHGKGIWLFDENGKGYIDSTSGPMTVNLGHCHPDIIAAMQDQIKRLHFAYRFHFRSDEAERLAARLVALSDDNKGYAFFMNSGSEASEAAYRIAMDYFRIKGNNKKTLALGRRISNHGNTIQSLTYGDDRARKVNLLNKVIDPAVSDLRLPPYYDLHKPASCSSDEWLRVCLSETFETIDRVGAEHIACIFAEPITASSGGVLIPHPDYFRELKAGLRARDILLIADEIVTGLGRTGEWFNMRTWETESDITIIGKGLGAGFTPISGVMISKQIGDSLASLSPPHFVGHTYSGNPLSAGVALAVLDTLENKIGMASIRARGSYFGRLLQEMLGDADIIADIRGQGLLWAVETTLGRQRAEEFVQAGHQQGINLYPCRLSGKDGDALTFLFTPPLVISESEMDELVGRFSRVLSRMA

SEQ ID NO: 7223 - protein, 717 aa, Xenorhabdus bovienii
  Coding DNA sequence: Name=SeqID_1115
  Homolog annotation: Query=2..342bp; Hit=1..330bp; Blast score=93; Percent Identity=27.0; E value=1e-17; Homolog= ref|ZP_00069216.1|
MIKIAIVGGGPNGMYFLNGLHSVFKELNVRDNVSVTLYDRHGYFGSGWPHSPAQAKTSMLNRIVGQLSFAPDKTNTSSHFFSKSTRVTFSEWLEKKYQATHSERYKLNADDFPTRELYGESLVEICDALVNEVRQAGIGVTLIKDTIKRISKSHGKYQLTGEFYPEPAEFDMVLLATGHQESKDNFYLAESLKKITEYYNFAYPLFDVPDWQHKSIAVIGMGLTAIDTLLYYTENKGGRFHRDKGKLRYEASGNEPKKLYALSRSGYFTYSRPHNAKEVDLAKYEHQGYFFTRSLIDQMRQQLGEPAHPDSSPENHALQLDFDVHVFPLLMLELQLCYYRILFGPEVLALMKAESCPLVEQFIAGNRAVNLQKESAINWLTQATERLACEAIFLVRRFLNDGITSSFHGVPVETIVKRYVYVISAQEAGPELNLQRFSLSALSAPSPWAHKADPEAHLFNWDMVVDPIRNMDFSPETPWRERLLAFMHWDRRQSEQGNLYNPYKGACDDVFRDLRQTVVYAIDFGGISPASYNNMLKDFYAVHNRAANGNCIALMEKMEALIEADVVDVTYAQSNIQIQDDQVWLHSLSHAGKYTRVDAMIDAKLHNFSVKKAKNSLFRDLIDAGIASYWVHKDRRGVECAASGFNITRNFQFINRDGKRELFFCVGQPSEGIMFFQNGSIRPNVNHHVANDLLACMTAVKSELQVLLLQEDATLTH

SEQ ID NO: 7224 - protein, 288 aa, Xenorhabdus bovienii
  Coding DNA sequence: Name=SeqID_1116
  Gene classification: Gene name=PrpB; Function=PEP phosphonomutase and related enzymes; Function class=G Carbohydrate transport and metabolism
  Homolog annotation: Query=7..286bp; Hit=20..299bp; Blast score=302; Percent Identity=50.0; E value=3e-82; Homolog= mlr9115 COG2513
MQEVTMSIQQRLARGEYTQFMEAHNGLSAKIVEHAGFEAIWASGLSISAAMGLSDRNEASWSQVINALEQMADNTNIPILVDGDSGFGNYLNVMRFVKKLKQINIYAMCIEDKMFPKVNSFIGENQALAPVSEFCNKIRAAKDTGGDDFTVVARIEALISGHPMEEALERAEAYKEAGADAILIHSKKSDAGEVFTFSERWRGKLPLFAVPTKYYNTEYQEFVNHGISNLIWANHLIRSSVRSMKETADRIYREKSLINVEKNVSSLDELFSLTTERYMDELEAKYNQ

SEQ ID NO: 7225 - protein, 322 aa, Xenorhabdus bovienii
  Coding DNA sequence: Name=SeqID_1117
  Gene classification: Gene name=SerA; Function=Phosphoglycerate dehydrogenase and related dehydrogenases; Function class=E Amino acid transport and metabolism
  Homolog annotation: Query=6..313bp; Hit=3..308bp; Blast score=199; Percent Identity=35.0; E value=2e-51; Homolog= MJ1018 COG0111
MESKDKLLIVDPVHEKLLSFLKRNYDVTVKHPISREELISQIGQYDILVLRSGAQVDMELLNKAKKIHTIIRAGTGTDNIDLEKVNEKGILFYNTPSTNARAVAELSFSMMHCLYRHIFRAGNEIRENIWDKKSLLGFELSYKKLGLVGFGSIGKEIADIASGYHMDVHCTVSEYSCDRVKELSNQNITLHSNLSTMFSHCNIIVVCCPYNQYTRDLIGAEELSHLGQRAVLINVARGGVVNETDLYNVLKERFFFGAASDVFEHERQPSPLFTLNNFIGTPHIGAMSHESQEKIADLIIDYLERQLSGNGSEISRNREFII

SEQ ID NO: 7226 - protein, 355 aa, Xenorhabdus bovienii
  Coding DNA sequence: Name=SeqID_1118
  Gene classification: Gene name=ArgC; Function=Acetylglutamate semialdehyde dehydrogenase; Function class=E Amino acid transport and metabolism
  Homolog annotation: Query=7..351bp; Hit=6..338bp; Blast score=213; Percent Identity=36.0; E value=4e-55; Homolog= PA0662 COG0002
MKLIAYVIGATGWTGAEIIRLLAYHPEIGEIYSISREADIPLETIHPNLTGVNKNTWSLESLPGICPDVVFISLPSGKAQEVAARFAGGKTRIIDLGADFRFADPEQFGRIYGKPHLAPALQRKFQYGYPEEFRENISTSHYIANPGCYVNAALCALLPLIKRNILKTQNIFISAVNGTSGAGSSSKRELLHYNMTNNMLAYSLNGHRHTQEIEEIIKIVTDKNADVSLITSHGNFARGIFMVIAAKLEEDIPTDRENILNILSEYYSDNPFVSIIGQEKGSVGIEKDYGIYPQLSKVIGSNACHISVDIVSEKRELRIVSVIDNLIKGAAGTAIQNMNIMMGFDEETGLSRYGI

SEQ ID NO: 7227 - protein, 164 aa, Xenorhabdus bovienii
  Coding DNA sequence: Name=SeqID_1119
MGLLSAIFCREEKDISEVTLIDKTPSRCEFARTLGFRAETDMSDIADSDVDILVIAGGEALNIDNYIALLRPGAQVVLISYFDTHVNIDMNMLVRKEITLRGSFLSDRRDLAKAIQIIQQSTTTKDSALKKIITDVITFAELRDFMLNKTSKGKVLINEPGVLS

SEQ ID NO: 7228 - protein, 156 aa, Xenorhabdus bovienii
  Coding DNA sequence: Name=SeqID_1120
  Gene classification: Gene name=Tdh; Function=Threonine dehydrogenase and related Zn-dependent dehydrogenases; Function class=E Amino acid transport and metabolism
  Homolog annotation: Query=20..135bp; Hit=24..142bp; Blast score=66; Percent Identity=29.0; E value=1e-11; Homolog= mlr8299 COG1063
MFYSLMCHGKRNQAYEPEVIPQMPPGFLQVEIVKAAICGSDHMVLNQTHPYKQYPAILGHEFIGRVTNAAGISAFHEGQWVTGLSYGACGSCPNCKRELSNHCLNKVTYNTAGSSGAFTRTMTVHHSSVLPLPQNRTAEDNEYVLSEPLSIGGSCS

SEQ ID NO: 7229 - protein, 384 aa, Xenorhabdus bovienii
  Coding DNA sequence: Name=SeqID_1121
  Gene classification: Gene name=EutG; Function=Alcohol dehydrogenase IV; Function class=C Energy production and conversion
  Homolog annotation: Query=14..298bp; Hit=5..290bp; Blast score=108; Percent Identity=29.0; E value=1e-23; Homolog= TM0111 COG1454
MAGESALSVLDNFSFALPVRIIFEKGALRRLTEYLSAADKSNTLLVMSKSASERFCVMKNLIEERGGLVKYTPWILESDFKATTESLCAIQNHLRNGNYDSIVSIGGGNIIDFTKVAAICLDNSVDISDAVGKTFDKVIKKIFHIAVPTTFGTGSEVTKGAIIFDKKKNIKDGVRGDSIFPDVALIDPSLGSTMPDAVLRETLFDSFTHAIEALHSVKFNPVTESLAVESLKRINANIERYAAGELDEHFYTEAAYSALLGGICVCHNSTCLPHRFEQAFAPFYSFSHGRGLAAIYPYWVRALMTYGKVSPQLVQITEDLSASEYVAYVIRKLKLDSAAQQLASLKLSGEDIRKRVTGNIVNDPLVSESDHDIIATLLTEITGA

SEQ ID NO: 7230 - protein, 54 aa, Xenorhabdus bovienii
  Coding DNA sequence: Name=SeqID_1122
VYSWLINSYDGMVGHYYCTKFLMTTPSRVMTKNVRSRPVLEVTHTLIATISFIM

SEQ ID NO: 7231 - protein, 158 aa, Xenorhabdus bovienii; identical to SEQ ID NO: 7173
  Coding DNA sequence: Name=SeqID_1123
  Gene classification: Function=Predicted transposase; Function class=L DNA replication, recombination and repair
  Homolog annotation: Query=11..115bp; Hit=6..110bp; Blast score=103; Percent Identity=45.0; E value=6e-23; Homolog= CC0928 COG3293

SEQ ID NO: 7232 - protein, 117 aa, Xenorhabdus bovienii
  Coding DNA sequence: Name=SeqID_1124
  Gene classification: Function=Predicted transposase; Function class=L DNA replication, recombination and repair
  Homolog annotation: Query=1..115bp; Hit=133..248bp; Blast score=81; Percent Identity=39.0; E value=1e-16; Homolog= mll8100 COG3293
MPVRIVITSGTTADCSQAETLIKGLDAEHLLADRGYDSNAIVEKAEQQGMQVHIPSRKNRKAAREYDRELYRFRHLVENAFLHLKRWRGIATRYAKNSASFLAAVQIRCLVLWLKIS

SEQ ID NO: 7233 - protein, 77 aa, Xenorhabdus bovienii
  Coding DNA sequence: Name=SeqID_1125
MQSWRFCGYRRKKTPVGRVPLSVAELRKLLSKRMEKAGKTIEQVLHWSDWRRWHQYRAQQCHYRRRANHRLTEQLRL

SEQ ID NO: 7234 - protein, 195 aa, Xenorhabdus bovienii
  Coding DNA sequence: Name=SeqID_1126
  Homolog annotation: Query=2..187bp; Hit=194..374bp; Blast score=103; Percent Identity=40.0; E value=2e-21; Homolog= ref|NP_821845.1|
MGCRCALSLGDRRLRVWLESRYQPFVLAIPCNTPLWWQGPKYLRAERIADTLTAADWKTRSAGTGTKGEREYDWAVVPLWRLQISEEDRRYGHYLLVRRSRDNRQERTYYVVYALREQADLNTLVQVAGCRWEIESGFEETKGECGRDHYEVRRWQSWHRHITLSLLAHAVLAVLRIQEKKNTGRPSSAQCSGTA

SEQ ID NO: 7235 - protein, 124 aa, Xenorhabdus bovienii
  Coding DNA sequence: Name=SeqID_1127
  Homolog annotation: Query=3..123bp; Hit=27..147bp; Blast score=157; Percent Identity=66.0; E value=4e-38; Homolog= ref|NP_898791.1|
MARDILRDYVTEHLGDEQGVLILDETGLIKKGTHSAGVQRQYSGTAGRVENSQIGVFLCYAGHGGHAFIDRALYLPRQWTDDRARCEAAGIPASVTFATKPQLARQMLERTWDAGVPCRWVTAV

SEQ ID NO: 7236 - protein, 84 aa, Xenorhabdus bovienii
  Coding DNA sequence: Name=SeqID_1128
  Homolog annotation: Query=12..72bp; Hit=10..70bp; Blast score=67; Percent Identity=52.0; E value=7e-11; Homolog= ref|NP_898794.1|
MPSPAKIWEQALQALHARLAPLFHSTGPRQRSLAYLRGLLSDVERKNSWQLAEWLGESTPDGIQYLLERADWMSRWPAISCGIM

SEQ ID NO: 7237 - protein, 35 aa, Xenorhabdus bovienii
  Coding DNA sequence: Name=SeqID_1129
MPVAPVPRFWQGMACDIFFDLRKKSPIMAQYVLQP

SEQ ID NO: 7238 - protein, 40 aa, Xenorhabdus bovienii
  Coding DNA sequence: Name=SeqID_1130
MLRNKIKQLNKFSVSFCFYFMMTALCVRGQMKSITENDRV

SEQ ID NO: 7239 - protein, 63 aa, Xenorhabdus bovienii
  Coding DNA sequence: Name=SeqID_1131
LFDFVSEHTNSPLQKLSWPCKIRAMPEAVFRKAESMVRQQVVLISLAGNEKILKRYYANNSIK

SEQ ID NO: 7240 - protein, 200 aa, Xenorhabdus bovienii
  Coding DNA sequence: Name=SeqID_1132
  Gene classification: Gene name=RhtB; Function=Putative threonine efflux protein; Function class=E Amino acid transport and metabolism
  Homolog annotation: Query=13..158bp; Hit=10..166bp; Blast score=69; Percent Identity=31.0; E value=2e-12; Homolog= BH2932 COG1280
MDIDILSFMPALLPVALSPGASFTLVMSSALAGGRSGLLRTLAGTAVGIYSHALLIGLGITAIIISLPGVYNVLEVVGTIYLLWLGFMLIRSGIKSKPDNTVSSPHSITAVDAFITNILNPKAIIFYLTVVSRFAGQQGGVGSYLVLASVHVVVMSLWLVIVSHILIFSAKSSNPVLLKKYVNISGGLLLCVFSLCSLFK

SEQ ID NO: 7241 - protein, 69 aa, Xenorhabdus bovienii
  Coding DNA sequence: Name=SeqID_1133
VQSFQITRTIRFCRINCNGSQSKTVGLAFIRFFGSRSLQMKTVTDSHYLQMSLHLSFPARIPFHPAHNN

SEQ ID NO: 7242 - protein, 146 aa, Xenorhabdus bovienii
  Coding DNA sequence: Name=SeqID_1134
  Homolog annotation: Query=1..146bp; Hit=196..341bp; Blast score=265; Percent Identity=95.0; E value=1e-70; Homolog= ref|NP_490533.1|
MEEIGYRTDIFTLDGITGSQREYIQWLLKTSMGKGKTQDILTTDAIDLLAMKLRTPLQVQLHLTLAMEAGYQTGEKPITATLIESVLSRQLDDLEPTLTRHGYRLKDMVEQFDAKPAEIRALFNNQLDPVRTAELRDRMLAVGLPI

SEQ ID NO: 7243 - protein, 34 aa, Xenorhabdus bovienii
  Coding DNA sequence: Name=SeqID_1135
MARMIQRVRPKRHYPRKSMKPRTRWNSFDAPIRI

SEQ ID NO: 7244 - protein, 39 aa, Xenorhabdus bovienii
  Coding DNA sequence: Name=SeqID_1136
MFFILPCISRGRCLTIKNKQFFEFSFCFLPRLGTKRTAS

SEQ ID NO: 7245 - protein, 198 aa, Xenorhabdus bovienii
  Coding DNA sequence: Name=SeqID_1137
  Gene classification: Gene name=PinR; Function=Site-specific recombinases, DNA invertase Pin homologs; Function class=L DNA replication, recombination and repair
  Homolog annotation: Query=1..195bp; Hit=1..195bp; Blast score=274; Percent Identity=73.0; E value=5e-74; Homolog= pinR COG1961
MSRVFAYCRVSTLEQNTENQRREIEAAGFAIRPQRLIEEYVSGSVAAGERPGFTRLLDRMENGDVLIVTKLDRLGRNAMDIRKTVELLADSEIRVHCLALGGVDLTSPAGKMTMQVISAVAEFERDLLLERTHAGIARAKASGKRFGRPPILSDEQKKTVFLRINEGKSISAIAREFSTTRQTILRVKAAMEDIDAPT

SEQ ID NO: 7246 - protein, 56 aa, Xenorhabdus bovienii
  Coding DNA sequence: Name=SeqID_1138
VYENDVLIIAYVRNKKHLLSYSVAAGCPKPTVLVHDIWAYINVTFRLLIFESWIYI

SEQ ID NO: 7247 - protein, 207 aa, Xenorhabdus bovienii
  Coding DNA sequence: Name=SeqID_1139
MNESFLSHLKEVYQDRERDLVTLSVRVSVEENAAIQDLVDSVGCNRQDLLYELIKKYALSEWEVMRNEELDAELSGGGASGDNHTKTYFLLNTNKANSAKDHQFMIENGFAAAFEEGYIQKIEKIHEGDTVFLYESGVGIVAYGSATGRVLKTDHLGVKNKTYYQKLDGFHVLDKPLPAKKICTLLKRKIPFVQTLIRLKDGEKLLK

SEQ ID NO: 7248 - protein, 44 aa, Xenorhabdus bovienii
  Coding DNA sequence: Name=SeqID_1140
MSEPERFEDSPEFEEWVEGTGERGEEKSGYYNDWHRRVLKVLSH

SEQ ID NO: 7249 - protein, 42 aa, Xenorhabdus bovienii
  Coding DNA sequence: Name=SeqID_1141
LNRLTQSPTLAPTTPFRSLRQNLHYYEWNNLGINHNVRARAF

SEQ ID NO: 7250 - protein, 453 aa, Xenorhabdus bovienii
  Coding DNA sequence: Name=SeqID_1142
  Gene classification: Gene name=AlkA; Function=3-Methyladenine DNA glycosylase; Function class=L DNA replication, recombination and repair
  Homolog annotation: Query=199..451bp; Hit=7..253bp; Blast score=155; Percent Identity=34.0; E value=1e-37; Homolog= VCA1018_2 COG0122
MKSLYQQARMSRDARFDGKFFICVKTTKIFCRTICPAKLPLEKNVIYVTDREQAIGLGFRPCLRCKPEFAPNYSEISKGSLLYNKASQKIISGEWLSLFIPEIAKKLNTSQRNLNKIFRSSTGMSAKEYQNNHKSILAKALLQNSNLSLTDIASTCGYSSLSSFYYLINKYLRVNMKSIKTNKQDCSVKKVITYPLSHPYDWDHFLSFQQKRLVEGMEWIRGETYGRTFNTLNCKGHFEVCPAKSGLSISIQTNNMGSFGCIYQRIIKMFDLDVNLTYIEDFLSNKYPEIKISKGLRIPGVFSEFEAGLRAICGQQVTVSAATKLFNQVVHNFGCTDTNGLVYMPLPIDIVDDSNLAILKTVNSKKNTILALATWFAENSPESPEYDISHILSIKGIGPWTLDYIKLRANKDPNIWMGSDLGIKKAIKKYNNFDHVKSHPWSSYLSIQLWNIT

SEQ ID NO: 7251 - protein, 170 aa, Xenorhabdus bovienii
  Coding DNA sequence: Name=SeqID_1143
MSEFSYLSAPKSSRDRLGIYRFWYDVYHEEMKRKITDLDHSKKIIYDYFEPESDIFVIESNNKVIGSVRLSTRSHFFKTPYAPMLGNISQFDFYFLSKVIIQKEYRKTGLATNLLNIAVEHVKSKSCDRILLDCSDYMIPYFIKKGFNLLLDETTQSIHYGDVYLMYKEL

SEQ ID NO: 7252 - protein, 310 aa, Xenorhabdus bovienii
  Coding DNA sequence: Name=SeqID_1144
  Gene classification: Gene name=ThiF; Function=Dinucleotide-utilizing enzymes involved in molybdopterin and thiamine biosynthesis family 2; Function class=H Coenzyme metabolism
  Homolog annotation: Query=36..152bp; Hit=37..153bp; Blast score=95; Percent Identity=41.0; E value=8e-20; Homolog= Rv2338c_1 COG0476
MSIKLAAEINNSLYEKRINRTMPFLGVDEVEQKIAQEKLAGSTIGIAGAGGIGGAMAVRLARFGVKKIKIADPDTFDYSNINRQLGANIPNIGKNKAQVVAEMAFDIGQDVEIEVFTDGITRENASEFVSGCDLVLDQVDFSLIGEKYALHRAFRNEPKCRCILACSVIGWSAHLYKFTKDSLPIEEWYGIEDETSIASLADEISKTEKLLNLWSPRFPLFPSKESLLKWISDNDTLPIFAGSPPVAEGLLTQRAILCLIDKEHPPYAATLPPIPNIYIYDAAQLSGSVYFSDGEIKNKLEIENFNNLNK

SEQ ID NO: 7253 - protein, 296 aa, Xenorhabdus bovienii
  Coding DNA sequence: Name=SeqID_1145
  Gene classification: Function=O-Methyltransferase involved in polyketide biosynthesis; Function class=Q Secondary metabolites biosynthesis, transport and catabolism
  Homolog annotation: Query=94..273bp; Hit=95..269bp; Blast score=63; Percent Identity=25.0; E value=2e-10; Homolog= Rv2751 COG3315
MRNDKTHQDIIESASITSLMRYLLSSDDEAVPNPDNYGKYFVNGKWEGYLKDVDSAKLELQRKLPGCMYYHLIRTLKFDDSLIKWASNEKNSQIVILGAGFDSRAMRYSKLLDEHNVSVYEIDLSAMLDFKKEVIAKYKLQHCVGYHHIPCNFNDKNLSGCMLDGGISKNKNTLVLWEGVTYFLPDEIIQSTIVELRELFKEKLQITLDYAFRDYIEGDLNFYGAKELHDVLVEISEPHFFGLNFNESEKYFANLGFKTTENLTALMLESKYLRDGFGKSAGLPHVFNAMTDIVRG

SEQ ID NO: 7254 - protein, 261 aa, Xenorhabdus bovienii
  Coding DNA sequence: Name=SeqID_1146
  Gene classification: Gene name=PrpB; Function=PEP phosphonomutase and related enzymes; Function class=G Carbohydrate transport and metabolism
  Homolog annotation: Query=5..251bp; Hit=5..246bp; Blast score=134; Percent Identity=32.0; E value=1e-31; Homolog= mll5340 COG2513
VKYSKLFKDLHSKSNFFVLPNAWDVPSAKFYESLGYKAVGTSSAALSYLNGKSDGENIPFSAVLSHAKKLLSEIKVPLSIDIEKGYASSAKEIAVNVLKLAELGCSGVNIEDSLKSGDLLPASDFAKILESIKSELIASGYSDFVLNARTDTYLSGSVGEKIRETIKRENVYRNCGADCLFVPGLVSIEEMQDISKVTELPLNVMNMPSIANISALAESGVNRFSLGNSVFDDVYSYFQSVASRSLKDGNFSAHYNHPALN

SEQ ID NO: 7255 - protein, 31 aa, Xenorhabdus bovienii
  Coding DNA sequence: Name=SeqID_1147
LSSVIALTVTTKKRYLHKMVYRLSQVPKSGL

SEQ ID NO: 7256 - protein, 234 aa, Xenorhabdus bovienii
  Coding DNA sequence: Name=SeqID_1148
  Gene classification: Function=Predicted transposase; Function class=L DNA replication, recombination and repair
  Homolog annotation: Query=1..234bp; Hit=60..293bp; Blast score=420; Percent Identity=88.0; E value=1e-118; Homolog= Z2082 COG3328
VLKVRQDNRVINKSVFLTLGINIEGQKELLGIWLAENEGAKFWLNVLTELKNRGLNDILIACVDGLKGFPDAINAVYPETRIQLCIVHMVRNSLRFVAWKDYKAVTRDLKTIYQAPTEEAALQALEAFSETWDHRYPQISRSWQANGNNLSTFFEYPTEIRKVIYTTNAIESLNSVIRHAIKKRKVFLTDDSVKKVIWLAIQAASKKWTMPLQDWRMAMSRFIIEFGDRIDGHY

SEQ ID NO: 7257 - protein, 153 aa, Xenorhabdus bovienii
  Coding DNA sequence: Name=SeqID_1149
  Gene classification: Function=Putative transposase; Function class=L DNA replication, recombination and repair
  Homolog annotation: Query=1..153bp; Hit=73..232bp; Blast score=128; Percent Identity=46.0; E value=3e-30; Homolog= mll9070 COG3316
MDETYIKVKGQWKYLYRAVDTDGQTIDCLLTARHDATAARRFFRKTIRQHGRPAVVTLDKSGANTAALTLLNAEGEPQQGIEIRQNKYLNNRIEQDPRHVKRRIRPMLGFKSFRRAQTILARIERVSMRRKGQYLQSEDKTLAPAEKFYRLTA

SEQ ID NO: 7258 - protein, 49 aa, Xenorhabdus bovienii
  Coding DNA sequence: Name=SeqID_1150
LLCWEQHFLKRNCKGFCRINKESLYGGGNDDYLCSQSIKLLCRCQCLIF

SEQ ID NO: 7259 - protein, 68 aa, Xenorhabdus bovienii
  Coding DNA sequence: Name=SeqID_1151
MTLSLWRWAIAMVCVLPFAWKPMCRDYRLYLTHKWLIIRLSLFGVVAFNSLVYVGLHQTSASNALLLN

SEQ ID NO: 7260 - protein, 72 aa, Xenorhabdus bovienii
  Coding DNA sequence: Name=SeqID_1152
MDPRARKPFISPALLLILLPPLFWAGNFITGRAVHNIAPHDAFTLAMGHCNGLCFAIRLETYVPGLSAVSDP

SEQ ID NO: 7261 - protein, 261 aa, Xenorhabdus bovienii
  Coding DNA sequence: Name=SeqID_1153
  Gene classification: Gene name=IlvA; Function=Threonine dehydratase; Function class=E Amino acid transport and metabolism
  Homolog annotation: Query=33..257bp; Hit=80..327bp; Blast score=157; Percent Identity=37.0; E value=9e-39; Homolog= YCL064c COG1171
MPASSITPVVPARFIFFFWAEMQDWPLLMPDTKLGVPVSVVVPESTSERTRHLLGLEGADVKVHGKTWAEANELALSLLNDNDAFIHPFDDPLLWEGHASMIDEVVAEGLRPDAVILSVGGGGLLAGVDEGLRRNDLNIPVFVVETEGMSSFHAALLAGHPVSLPELTGVATSLGARQVCQQAFNLASEREIISLTVSDKQAVGACLAFLDDHRTLVEPACGASLAVLYDQKIDASGMKNVLVIVCGGSTATTTSLQGFRG

SEQ ID NO: 7262 - protein, 30 aa, Xenorhabdus bovienii
  Coding DNA sequence: Name=SeqID_1154
MSRRVALPPSSSRRGYYSGDPVAVTPAGEY

SEQ ID NO: 7263 - protein, 104 aa, Xenorhabdus bovienii
  Coding DNA sequence: Name=SeqID_1155
  Gene classification: Gene name=TdcF; Function=Putative translation initiation inhibitor; Function class=J Translation, ribosomal structure and biogenesis
  Homolog annotation: Query=8..73bp; Hit=5..70bp; Blast score=74; Percent Identity=48.0; E value=2e-14; Homolog= PA3123 COG0251
MHPPEKPMKKYASSIPFPFSRAVEANGFLFLSGQLSMNDKREPVQGSVEEQTHLVLQHVDAALKTCGSSFDKIRSGCPKWVISRRLITHIVLIFLTDFRRVQPS

SEQ ID NO: 7264 - protein, 240 aa, Xenorhabdus bovienii
  Coding DNA sequence: Name=SeqID_1156
  Gene classification: Function=Uncharacterized BCR; Function class=S Function unknown
  Homolog annotation: Query=11..239bp; Hit=25..238bp; Blast score=78; Percent Identity=27.0; E value=6e-15; Homolog= yheO COG2964
MFNVGHVMNVFDEQNYAEDMINMLSATVRALGSVLAGNAEIVLHDLRDPTFSIAEIVNTGVTGRKKGDSVLAGMRTDRAFISAMENRNEPVSLLLDYETLTRDGKALRSSTALYRDHTGKPYAALCINVDNSGIDEALRLLQSLAGIRPDVQPATQEDASSEASHDNIEDLMRDIISTTTALSSGSSRTDTKRANLMAVKNMQEKGLFLIKGGVEKAAAALGVTRYTIYNYLDELKSGDE

SEQ ID NO: 7265 - protein, 35 aa, Xenorhabdus bovienii
  Coding DNA sequence: Name=SeqID_1157
MLLNNNISTRPLNQQSVDHEMTAISKRTAIDGDCL

SEQ ID NO: 7266 - protein, 44 aa, Xenorhabdus bovienii
  Coding DNA sequence: Name=SeqID_1158
VTESPNVKLEKPRITRKAHPKVVELRGQCRVNGGKLAKVVLPVI

SEQ ID NO: 7267 - protein, 102 aa, Xenorhabdus bovienii
  Coding DNA sequence: Name=SeqID_1159
MLILPFAYHVNQFDAGQERLCPAKQFEPQHLSYPTFDTTVILLNQVIQILALPEGDVFLFRFVGIERGQSRSIGAAFIDRHPFRFAVVRPSGSEATKCDIWL

SEQ ID NO: 7268 - protein, 144 aa, Xenorhabdus bovienii
  Coding DNA sequence: Name=SeqID_1160
  Gene classification: Gene name=PinR; Function=Site-specific recombinases, DNA invertase Pin homologs; Function class=L DNA replication, recombination and repair
  Homolog annotation: Query=1..122bp; Hit=72..197bp; Blast score=87; Percent Identity=39.0; E value=5e-18; Homolog= TVN1478 COG1961
VVSRLDRLARSTRDLLELADIFQHGNVGLRSLAEPWADTTSPSGKMVFTIFAGIAEFERALISERTRAGRHAAKMKGVRFGRPTKLSIEQIALGRRLISEGSSVRDTARILNCHHATLYRSLNNAAGLLDDELENEKIFGNTKS

SEQ ID NO: 7269 - protein, 113 aa, Xenorhabdus bovienii
  Coding DNA sequence: Name=SeqID_1161
MTMLIGYARVSTDDQHLDGQRAALRAAGANSFMKKRYQELNENVQSSRAYLSIYVKEMSLWSVGWIGWRGRLETYWNWPTFFNMAMWVCVPWLNPGLIPHHHPARWYSRYLQA

SEQ ID NO: 7270 - protein, 35 aa, Xenorhabdus bovienii
  Coding DNA sequence: Name=SeqID_1162
LAQKYGAKVYINNTYLRQIYLRYDDADRLRTRFNR

SEQ ID NO: 7271 - protein, 234 aa, Xenorhabdus bovienii
  Coding DNA sequence: Name=SeqID_1163
  Homolog annotation: Query=18..233bp; Hit=19..234bp; Blast score=248; Percent Identity=55.0; E value=7e-65; Homolog= gb|AAB71813.1|
VGNRFVTKTALLGSDVNFEVTILQAESAARCVLFVTGLGGNPLRHLGLLQTFAEHGISVVAPHFEMLASSIPTKAELLERSRRLTLAAKTYCSPGISIAGVGHSIGTVILLMQVGAEASTLAGDRLKLGRELTLDRLVLFTPPTDFFRRPGSLTSVNVPIQVWAAGKDAITPPAQTVFLKETIGDQTQIDVHLVEDAGHFTFMNELPPYVTDPHPDRSAFLLSLGDEVSRFLTT

SEQ ID NO: 7272 - protein, 35 aa, Xenorhabdus bovienii
  Coding DNA sequence: Name=SeqID_1164
MTLPLWTKQVSHNLGFMRKWMTQHTFTHFASDIRR

SEQ ID NO: 7273 - protein, 128 aa, Xenorhabdus bovienii
  Coding DNA sequence: Name=SeqID_1165
  Homolog annotation: Query=1..128bp; Hit=853..980bp; Blast score=225; Percent Identity=80.0; E value=8e-59; Homolog= gb|AAO92366.1|
LAELGKAIKTIFLCRYLHDESLRCEINAGLNVVENWNSANDFIFYGEHSEFTTNRTEDQELSMLSLHLLQISLVYINTLLIQSVLSEPTWRSRMTEEDWRGLTPLIYQHINPYGRIELDMNQRLALTA

SEQ ID NO: 7274 - protein, 65 aa, Xenorhabdus bovienii
  Coding DNA sequence: Name=SeqID_1166
MKLSNIQSHSGLVRLNPRPYYGVSLVTMHNIQHIRHWQSWAKPLRLSSFVVICTMSPCVVKLMPD

SEQ ID NO: 7275 - protein, 741 aa, Xenorhabdus bovienii
  Coding DNA sequence: Name=SeqID_1167
  Homolog annotation: Query=3..741bp; Hit=74..812bp; Blast score=999; Percent Identity=66.0; E value=0; Homolog= gb|AAO92366.1|
VPFSSLDIYPLQGRQAQRHRQSIRHYLKVRLPNKTDTARLTHWLVEFTLPLNPQALHGRDIVTDWCHEQLIEPPAFDHLDRIIRSVVRRFEAEQQEIIFNRLSMDSKIAINHLLSGEGSGSAKTSSVSFSGLKADPGKPSLENVLTVISQLKFLDDMSLQPNTFQGIPHKFIMQFQQRCVSESIRELRRHPSAIRYSMVAMFCWRCRQQLIDALIEMLMVLIHNLGARAQKKVDKKQFAAYKKVRGKARLLFRMAEVTVDQPNGVIKDVVYPVVAQKTLQNLVNEFKTLGVNTEHEVHESIRSSYGSHYRRMLMPVLDRLEFKSGNTLYRPVINAIQVIKAQRDSNQYFYDVGDVPVDGIIQKTWRDIVIVKNKLGEERVNRINYEICVLRALRKSLRNKEIWVEGADRYRDPAEDLPADFAINREHYYSMLQVPTNASTFIGHIKDTMRQWLSTLNNGLPENAKLRLREQGKNRIHLTSLDKQVEPPNTSALKREIGQRWADLELIDILKEVDLRENFSSLFRTSASREVLEPKILQRRMLLCLFGLGTNVGLKRVTSQQPSVSYDELRYVKRRFIQKDALRNAISHIVNGTFHIRHPAIWGNATTSCAADSRKFGAYDQNLMTEWHAHYGGRGVMIYWHVDTHSTCIYSQLRRCSSSEVSAMMEGVLRHCTDMEINHQYVDSHGQSEVAFAFSYVLDFDLLPRLKGTARQKLNLCGKEDAALYPNLTPILTRVIDWELI

SEQ ID NO: 7276 - protein, 31 aa, Xenorhabdus bovienii
  Coding DNA sequence: Name=SeqID_1168
MRMALRLVQRYIEQCLGVFRLLTLGIGLISV

SEQ ID NO: 7277 - protein, 44 aa, Xenorhabdus bovienii
  Coding DNA sequence: Name=SeqID_1169
MASLGEPLGNRDIWTLLDDELFLLPRMTDKGRLGFAIQLKFRQI

SEQ ID NO: 7278 - protein, 35 aa, Xenorhabdus bovienii
  Coding DNA sequence: Name=SeqID_1170
VAWSTPMPRSAIISSRLAQWERSYKMRYLAFLTCV

SEQ ID NO: 7279 - protein, 91 aa, Xenorhabdus bovienii
  Coding DNA sequence: Name=SeqID_1171
  Gene classification: Function=Putative transposase; Function class=L DNA replication, recombination and repair
  Homolog annotation: Query=1..68bp; Hit=58..125bp; Blast score=115; Percent Identity=77.0; E value=1e-26; Homolog= XF2303 COG3316
MMAERGIGVDHATIPRWVLRLVPLLGKAFRPRKKLVGSRWRMDETYIKVKGQWKYLYRAVDTDGQTIDLTCGRLTPSSKCGKVNLSPPGGG

SEQ ID NO: 7280 - protein, 43 aa, Xenorhabdus bovienii
  Coding DNA sequence: Name=SeqID_1172
MQSIDKISLPVTMSYLRVVSIALYPASKRALSPLKSFGSGETI

SEQ ID NO: 7281 - protein, 210 aa, Xenorhabdus bovienii
  Coding DNA sequence: Name=SeqID_1173
  Gene classification: Gene name=RhtB; Function=Putative threonine efflux protein; Function class=E Amino acid transport and metabolism
  Homolog annotation: Query=12..208bp; Hit=26..220bp; Blast score=88; Percent Identity=29.0; E value=4e-18; Homolog= ZyahN COG1280
MLISSLMAIAAVLIMGVISPGPSFIYVARNAVAYSRLHGLVTALGTGVGAAVFSLVAMLGLQKLLNAVPELFIGLKVAGGVYLLWLAFKIFKSASHPLTLALHGQKGSEKTLWMTFRDGLLTQLSNPKTAIIFASIFSALLPENIPVAFYFAVPLMSFLIDAGWYSLVSLLLSAEKPRQIYLRIKCAADRASATVLGVLGIKLIYSSIGK

SEQ ID NO: 7282 - protein, 39 aa, Xenorhabdus bovienii
  Coding DNA sequence: Name=SeqID_1174
LLLSQTPYVTFPRVASAHRSRTSAAEYHRLLHYLMQVGK

SEQ ID NO: 7283 - protein, 237 aa, Xenorhabdus bovienii
  Coding DNA sequence: Name=SeqID_1175
  Gene classification: Gene name=RimL; Function=Acetyltransferases, including N-acetylases of ribosomal proteins; Function class=J Translation, ribosomal structure and biogenesis
  Homolog annotation: Query=6..228bp; Hit=5..223bp; Blast score=204; Percent Identity=44.0; E value=6e-53; Homolog= YIR042c COG1670
MELFKNEFGQLIGFSVSDWHGADLPDGNTLTGEYCQLIPMDINNHGDELYKCFCEPFNFSDWTYLPGPAKPFKDKMEFISYLRNISNGVDPYQFSIIDIRSGKAVGSIAMMRIDKDNGVIEIGYVIFSNFLKKTRMATESVYLLIKYAFEDLGYRRVEWKCNNLNEASKRSALRFGFTFEGVFRQAAVIKGHNRDTAWFSMLDHEFMKIKPNFEAWLSVENFYPDGKQIASLDTKKK

SEQ ID NO: 7284 - protein, 49 aa, Xenorhabdus bovienii
  Coding DNA sequence: Name=SeqID_1176
VEEPSKMTSDVPVCFYGLLNPSGVVRQNGYYGKYMWIYLNRKSENYGII

SEQ ID NO: 7285 - protein, 58 aa, Xenorhabdus bovienii
  Coding DNA sequence: Name=SeqID_1177
MKSGQSQYLSFFAGISPQLKGLFIGNRRKGSQRERRVSDSDLLTVLEGACGRTLENDE

SEQ ID NO: 7286 - protein, 44 aa, Xenorhabdus bovienii
  Coding DNA sequence: Name=SeqID_1178
LRICVNFIDCSSDSSDFEAQPLRLVLSGRVAASGFTIRGGRDKP

SEQ ID NO: 7287 - protein, 259 aa, Xenorhabdus bovienii
  Coding DNA sequence: Name=SeqID_1179
  Gene classification: Function=Predicted Zn-dependent hydrolases of the beta-lactamase fold; Function class=R General function prediction only
  Homolog annotation: Query=1..259bp; Hit=1..258bp; Blast score=275; Percent Identity=53.0; E value=2e-74; Homolog= Z0443 COG2220
MKLTQIRNATLVLEYAGKKFLIDPMLAEKEVWDGFAGNARPHLRNPMVALPVSVEDLLAVDAVILTHTHTDHWDEAAQQAVPKDMLIYTQDESDAALIRSQGFLNIRVLKEENHFVDGLTIYKTDGQHGSNELYADAQWGELLGDACGLVFTHHDEKTLYIAGDTVWVKPYARSLQRFKPEIVVLNTGYAVNDLYGPIIMGKEDTLRTLKMLPNATIVASHMESINHCLLTRAELHEFSLEHGIEDKVLIPADGETIAF

SEQ ID NO: 7288 - protein, 39 aa, Xenorhabdus bovienii
  Coding DNA sequence: Name=SeqID_1180
VKRAESGRGNHGDRQCRHNVNLTVKKSHRTTGGKIVNIN

SEQ ID NO: 7289 - protein, 324 aa, Xenorhabdus bovienii
  Coding DNA sequence: Name=SeqID_1181
  Gene classification: Gene name=ThiJ; Function=Putative intracellular protease/amidase; Function class=R General function prediction only
  Homolog annotation: Query=1..180bp; Hit=1..180bp; Blast score=210; Percent Identity=56.0; E value=1e-54; Homolog= Z0442_1 COG0693
MSALTVAVIATAGFSPFHFSVPCIIFGQSMPQPDLFCVEICAEKSGVVLSDIGLSINVEHDLKLLETADIVIVPYWNHPEERPSQALLDALIGAWQRGAEVVGLCLGAYVLAYSGLLDQHRAATHWEFEQDFIERFPAVRLDSNSLYTSDERLITSAGTAAGIDCCLNIIRDHYGSAVANRVARRMVVPPYREGGQAQFIERPVPVSTRDNKMNELIEYLRRNLDKPHDLDSLAGFVSMSRRTLTRHFFKATGTTLGDWLNAERLQRSQELLETTDSSIESVSDMAGFQSPISFRQSFKAKFSVSPSEWRRAFRGPVPVDHEKA

SEQ ID NO: 7290 - protein, 127 aa, Xenorhabdus bovienii
  Coding DNA sequence: Name=SeqID_1182
  Homolog annotation: Query=7..115bp; Hit=72..180bp; Blast score=156; Percent Identity=76.0; E value=7e-38; Homolog= ref|NP_758755.1|
MRAATPNTADMIHIVDACFKKGIAIRFLENGLSTEGTMGKMVIQILAAVAEAERERILERTNDGRLIAMAAGVKFGRKPHSKSVIALQFIHQKMTAEAVMNKTGISRATYYRLKKVALNPFEIDVKE

SEQ ID NO: 7291 - protein, 61 aa, Xenorhabdus bovienii
  Coding DNA sequence: Name=SeqID_1183
  Homolog annotation: Query=1..61bp; Hit=258..318bp; Blast score=114; Percent Identity=96.0; E value=4e-25; Homolog= ref|NP_073272.1|
VLSRQLDDLEPTLTRHGYRLKDMVEQFDAKPAEIRALFNNQLDPVRTTELRDRMLAVGLPI

SEQ ID NO: 7292 - protein, 132 aa, Xenorhabdus bovienii
  Coding DNA sequence: Name=SeqID_1184
  Homolog annotation: Query=1..129bp; Hit=145..273bp; Blast score=229; Percent Identity=92.0; E value=7e-60; Homolog= ref|NP_490533.1|
VALFVDEAHDLNGHILTGLKRLMEVVEDGGGRLSVVLAGHPKLRNDLRRPTMEEIGYRTDIFTLDGITGRRREYIHWLLKTSMGKGKTEDILTTDALDLLTMKLRTPLQVQLHLTLAMEAGYQTGEKPIMSN

SEQ ID NO: 7293 - protein, 31 aa, Xenorhabdus bovienii
  Coding DNA sequence: Name=SeqID_1185
MGLPHKDNAMRQFLCLIRVVFVSSTCYVSFI

SEQ ID NO: 7294 - protein, 81 aa, Xenorhabdus bovienii
  Coding DNA sequence: Name=SeqID_1186
MWAKKADKCKPDRFRLRAVTFRMTEIPEYRQSPGAVFVPLSGALGKAALIGHDSKALTWYSYAFLRGSQNDGDDRSCLPVL

SEQ ID NO: 7295 - protein, 92 aa, Xenorhabdus bovienii
  Coding DNA sequence: Name=SeqID_1187
  Gene classification: Function=Transposase; Function class=L DNA replication, recombination and repair
  Homolog annotation: Query=4..92bp; Hit=3..91bp; Blast score=80; Percent Identity=42.0; E value=2e-16; Homolog= insA_g5 COG3677
MTVTIEVACRYCNQTEPVRKHGAGKAGFPRYYCKGCQKTFQLNSRYNGHKPGMKEKIVDMAMNGSGVRDTGRVLSIGINTVMRTLKNCRQNR

SEQ ID NO: 7296 - protein, 44 aa, Xenorhabdus bovienii
  Coding DNA sequence: Name=SeqID_1188
MGYDLLPFCIKSISKPMTLFFVAHKRPLFIQFTNEGDIIISNLP

SEQ ID NO: 7297 - protein, 38 aa, Xenorhabdus bovienii
  Coding DNA sequence: Name=SeqID_1189
MPFDTLGQNFSHQMLFWLDFSGVTSPTIGRDETNMKRG

SEQ ID NO: 7298 - protein, 55 aa, Xenorhabdus bovienii
  Coding DNA sequence: Name=SeqID_1190
  Gene classification: Gene name=InsB; Function=Insertion element IS1 protein InsB, putative transposase; Function class=L DNA replication, recombination and repair
  Homolog annotation: Query=1..50bp; Hit=117..166bp; Blast score=61; Percent Identity=56.0; E value=2e-10; Homolog= insB_g4 COG1662
VGKILTQRIERHNLNLRIHIKRLARRTLCYSRSIEIHEKLIGTYIEKYHYNALES

SEQ ID NO: 7299 - protein, 42 aa, Xenorhabdus bovienii
  Coding DNA sequence: Name=SeqID_1191
MTTSSITLFRLIRRTLLANFIVFFRSCGRALLFLHICACTRF

SEQ ID NO: 7300 - protein, 138 aa, Xenorhabdus bovienii
  Coding DNA sequence: Name=SeqID_1192
MNDTQKITAEDVSQFLNQFTRRKKVLRGMTADQINILISDAKAVLEDVIADEDIKKRQEAERQTKIRETAKLLKNEGIGLDDLEKHMVGRRSPTVEPKIYLINGKKIIYKGSGRMNKALKTIVDKEGHDALEQYLVRE

SEQ ID NO: 7301 - protein, 142 aa, Xenorhabdus bovienii
  Coding DNA sequence: Name=SeqID_1193
MSKIKSKQEEQKKNKIVNLLTGFSRVKSDIAKITAEHVVDDIPAPEFGDGKITTQIYRNKNIFAKIDNKIKQVLPYYTALYAIVIGTNSEPVPVLISQEPNDISDGFPLVDAKTFQRLRVEDCDFYVLQGDDFVPIAKPFSK

SEQ ID NO: 7302 - protein, 43 aa, Xenorhabdus bovienii
  Coding DNA sequence: Name=SeqID_1194
LTILFFFCSSCFDLILLIAHLPKPSLVNFDTVFLCHQIACMLI

SEQ ID NO: 7303 - protein, 209 aa, Xenorhabdus bovienii
  Coding DNA sequence: Name=SeqID_1195
  Gene classification: Gene name=MltE; Function=Soluble lytic murein transglycosylase and related regulatory proteins (some contain LysM/invasin domains); Function class=M Cell envelope biogenesis, outer membrane
  Homolog annotation: Query=12..149bp; Hit=15..156bp; Blast score=72; Percent Identity=32.0; E value=3e-13; Homolog= Z4175 COG0741
MRKLILASLFSSFFIPLPSYSFMGCFISAGQQYGVSPLLIQAIAEGESKYNNRAINLKNSDGTTDATMMQINSWWHDKPVFIKNKLSRQKLMKDPCLSINFGAWVLAGNFSIGGVNWNSVGAYNAGWDKGKATARQNYVNRIKLIYERLKRESGVSPSSSEMNDSNLGTLTAELSFPSPMHDKSTPSTELVTKSFFHSRNSDMKLVGDM

SEQ ID NO: 7304 - protein, 134 aa, Xenorhabdus bovienii
  Coding DNA sequence: Name=SeqID_1196
MNDKSLLLYFAFPIVVSLNKIFGLITIPTGLLIFLNLVNVVLLHFILRRIFVTTWKFGIYLHLCTLLLLAATLTIQTNGSDSSLLLKSFWFEFTIFSGAWLLLFYSLFTEPEIKTKMSIDLVHAQKHDKGNNDE

SEQ ID NO: 7305 - protein, 101 aa, Xenorhabdus bovienii
  Coding DNA sequence: Name=SeqID_1197
MHKNMIKVTTMNSIFLGFLLIACGAGFLALIGYFVNSKDQVSKGSKNIRTSLLPPDLEKKRMIEREQTASLVSVPEEPYVPTTHSADSASDTGTTPDSIPD

SEQ ID NO: 7306 - protein, 67 aa, Xenorhabdus bovienii
  Coding DNA sequence: Name=SeqID_1198
MKLNVSISVACEPLQIPVKQAIISMDRHLYSFYICAVLWIFTFMIIFRVTKEFRGRHIKTHGSYNHG

SEQ ID NO: 7307 - protein, 175 aa, Xenorhabdus bovienii
  Coding DNA sequence: Name=SeqID_1199
  Homolog annotation: Query=18..173bp; Hit=17..173bp; Blast score=148; Percent Identity=47.0; E value=5e-35; Homolog= ref|NP_511181.1|
MAVIIMGDTSTLKFMVIAFIVIFVVIFKRKKFNRHKVKIDSAKTVINKLFTFSNDGQRMAYLKKIDPYVFEELVLFGFEYQGHTIERNKRYSGDGGVDGRIWIGRQLYLIQAKRYTGAIQKQHVIDFISLVNSHGCKGVFCHTGTTPDSVKKIVKESDCIELISGSHLLNLISIS

SEQ ID NO: 7308 - protein, 597 aa, Xenorhabdus bovienii
  Coding DNA sequence: Name=SeqID_1200
  Homolog annotation: Query=59..507bp; Hit=412..827bp; Blast score=79; Percent Identity=22.0; E value=2e-13; Homolog= ref|ZP_00111530.1|
MALDHGVLNIPLHKRGNIDRDIDKWKAEQTKEKRKRLDEINYQREQERKEAGRLFKLVDRKLMWAEANTGHKNLLRTVGKSIAEHQEYKVHAFSTNNTGIKQMKEDGMKNAMSIFFHMDRIEKSIAKGEPLKGRRQLWYVENVSTLGAEETLRLQRLARFSGARLIMVADKNENALSWGAVPTLLNHHGMHTVNFNAVVMAHNPEINKASDALVKGQIEDSLTALSPMVHEIDSRITAEAKTARIGVVKDTYLNLSIEEREQTAIILPDHHIRHAVNSMIRDGLKAEKSLVDDGIETTVYRQVMLDPFEKKEARFYKADMVLEAESTTQNGIKGDKFTIVDVDKKNNTLELKSLSDDKSLIIKTKDIPTSKGNGFISYAVESREIVKGEKIRLTRAFPLPKKKGANKGGYLPKNAEAIVKDINISTGDLTLTLKNGQQITLNTQQWKHYEWGYTHNHYQVKDSAYKQVITIMESWKKHFATQNALHNTLTRSTHNLTIITDNKEKLFDTLRTNTGFQKMALDNKKVSVTKTDIKKFDELWGKSLNPFEKSITRLELAVNKAVSKFVDITAKKEINTPEYPNNNQQIEQSKPTKQRSL

SEQ ID NO: 7309 - protein, 44 aa, Xenorhabdus bovienii
  Coding DNA sequence: Name=SeqID_1201
MSLSIFPRLWSGIFKTPWSNAIFTPSLLLLFIFCCFFGKLTNQL

SEQ ID NO: 7310 - protein, 102 aa, Xenorhabdus bovienii
  Coding DNA sequence: Name=SeqID_1202
  Homolog annotation: Query=24..98bp; Hit=12..86bp; Blast score=64; Percent Identity=42.0; E value=4e-10; Homolog= ref|NP_775004.1|
MSIKKKNQSFHVIDKLSLSRQRITVIVCELNAGLGFHFCNHYLLSGNNNDLWWPLSEREKLFTEIEKAMVMNHVAYNVTFINKLRHCNKATDYEVIYNMIEK

SEQ ID NO: 7311 - protein, 79 aa, Xenorhabdus bovienii
  Coding DNA sequence: Name=SeqID_1203
LRCVLVQLRFSRAEEGLWDYLLVPLFASSDNVRVPSETITCLLLCATRIKTQTPQCLSQANFRMFRDCLKIAKGTVMSR

SEQ ID NO: 7312 - protein, 51 aa, Xenorhabdus bovienii
  Coding DNA sequence: Name=SeqID_1204
MRYQKKEIPHLAQCKNHKSARIKTSLHRGLMSPLFFIVVKELKKYILNTKI

SEQ ID NO: 7313 - protein, 30 aa, Xenorhabdus bovienii
  Coding DNA sequence: Name=SeqID_1205
MSQLSEEVGMSREGLYHALSEKGNPPFSAM

SEQ ID NO: 7314 - protein, 42 aa, Xenorhabdus bovienii
  Coding DNA sequence: Name=SeqID_1206
LALAISPNAESPKAGSPSSKISLRYICILSSLFKCSANIVFF

SEQ ID NO: 7315 - protein, 115 aa, Xenorhabdus bovienii
  Coding DNA sequence: Name=SeqID_1207
  Gene classification: Function=Uncharacterized BCR; Function class=S Function unknown
  Homolog annotation: Query=2..96bp; Hit=3..97bp; Blast score=112; Percent Identity=61.0; E value=8e-26; Homolog= HI1419 COG3657
MVTVLTTDIFDDWIDALKDLRAKTKIQARIRRMKNGNFGDIEPVGDGFSEIRIHEGKGYRVYLKIKNNVIVILLCGGDKTTQQKDINKAKLIYKEIEGGIMKMKLKEYDIGGAFK

SEQ ID NO: 7316 - protein, 60 aa, Xenorhabdus bovienii
  Coding DNA sequence: Name=SeqID_1208
VIFCRSSFAKSIKIFKSFTCINGKVNFFPFANALAAAIIFSDINFTSRNLVSWCWVVGAT

SEQ ID NO: 7317 - protein, 35 aa, Xenorhabdus bovienii
  Coding DNA sequence: Name=SeqID_1209
VLGCWSNLTPHLTVNFTSLLLTHRSPLGNELELII

SEQ ID NO: 7318 - protein, 61 aa, Xenorhabdus bovienii
  Coding DNA sequence: Name=SeqID_1210
MNEQQKHAIQSVINLYGRIWKSKLLNHWMNSKYPYSLSSVSGTLQQIRNELGPSWLSKFKV

SEQ ID NO: 7319 - protein, 205 aa, Xenorhabdus bovienii
  Coding DNA sequence: Name=SeqID_1211
GSIVRSRWKPIDQVISLKEISQRKKDIEQTKQLAELLIRKSPEFAELETYQAGENKQVLAVRNISKILKLHFNGVKFSVKRRSHDSVYVSWEDGPMQEEIKAIIGRFQNGCLDKTTNSYEYGYKSFNDVFGGIKFIYIERNYSDKLITEVISMLSQEYEEDIISHEHTPEAYRKGDLLAVGKDIFINGLQGEISRRVQQLNKYYK

SEQ ID NO: 7320 - protein, 436 aa, Xenorhabdus bovienii
  Coding DNA sequence: Name=SeqID_1212
  Gene classification: Gene name=CyoB; Function=Heme/copper-type cytochrome/quinol oxidases, subunit 1; Function class=C Energy production and conversion
  Homolog annotation: Query=1..436bp; Hit=225..660bp; Blast score=688; Percent Identity=82.0; E value=0; Homolog= cyoB COG0843
MPVFSWTVLCTNVLIIAAFPILTATVALLTLDRYMGTHFFTNDMGGNMMMYINLIWAWGHPEVYILVLPVFGIFSEVTATFAKKRLFGYTSLVWATIVITILSFVVWLHHFFTMGSGANVNAFFGIATMIISIPTGVKIFNWLFTMYRGRIEFKTPMLWTVGFLVTFSIGGMTGVLLAVPGANFVLHNSLFLIAHFHNVIIGGVVFGCFAGTAYWFPKAFGFTLNEKWGIRAFWFWITGFFVAFMPLYALGFMGMTRRLSQDIDPAFHTMLVVAAGGVVLIALGILCQVIQFYVSIRDREQNRDLTGDPWGGRTLEWSTSSPPPFYNFAEVPHIQTRDAWWDMKEKDTAHKRPAKYEEIHMPKNTSAGIIISAFLLVFGFAMIWDIWWLAIASFAGTIITWIVKSFDEDVDYYVPVAEVEKTENQHYEELRKAGVK

SEQ ID NO: 7321 - protein, 203 aa, Xenorhabdus bovienii
  Coding DNA sequence: Name=SeqID_1213
  Gene classification: Gene name=CyoC; Function=Heme/copper-type cytochrome/quinol oxidase, subunit 3; Function class=C Energy production and conversion
  Homolog annotation: Query=1..203bp; Hit=1..204bp; Blast score=268; Percent Identity=74.0; E value=2e-72; Homolog= cyoC COG1845
MSTQTLNNTAAHEHHGHHDVGSMKIFGFWIYLMSDLVLFASLFATYAVLANGTAGGPSGKDIFELPFVLVETFLLLFSSITYGFAMLSMNKGKTGQVNLWLFITFLFGLGFVSMEIYEFHKLISEGFGPDRSAFLSSFFALVATHGIHVTCGLIWIIIMMVQVARRGLTEVNRTRLSCLSLFWHFLDVVWICVFTVVYLMGAM

SEQ ID NO: 7322 - protein, 125 aa, Xenorhabdus bovienii
  Coding DNA sequence: Name=SeqID_1214
  Gene classification: Gene name=CyoD; Function=Heme/copper-type cytochrome/quinol oxidase, subunit 4; Function class=C Energy production and conversion
  Homolog annotation: Query=16..124bp; Hit=1..108bp; Blast score=120; Percent Identity=68.0; E value=2e-28; Homolog= cyoD COG3125
MDLCIYCRLSDGSYVMSHPNTSHSGADHGSFKTYMIGFILSVILTVIPFWMVMDGSASQSTILLTVIGMAVIQIFVHFVCFLHMNTSSEERWNLVALIFTLLVIAIVVVGSLWIMYNLNINMMVD

SEQ ID NO: 7323 - protein, 294 aa, Xenorhabdus bovienii
  Coding DNA sequence: Name=SeqID_1215
  Gene classification: Gene name=CyoE; Function=Polyprenyltransferase (cytochrome oxidase assembly factor); Function class=H Coenzyme metabolism
  Homolog annotation: Query=1..281bp; Hit=2..282bp; Blast score=408; Percent Identity=83.0; E value=1e-114; Homolog= cyoE COG0109
MIKQYLQVTKPGIIFGNLISVVGGFLLASKGVIDYPLFFATMLGVSLVVASGCVFNNYIDRDIDRIMERTKNRVLVKGLIDPKISLIYASVLGIAGIVLLYVAANALAMQLALIGFVIYVGVYSLYMKRKSVYGTLVGSLSGAAPPVIGYCAVTGQFDTGALILLLIFSLWQMPHSYAIAIFRFKDYQAANIPVLPVIKGISVAKNHITLYILAFMVATLMLTISGYAGYKYLIVAAAVSIWWLGMALSGYKTANDRIWARKLFMFSIVAIMSLSVMMSVDSTASPETLLTYVR

SEQ ID NO: 7324 - protein, 455 aa, Xenorhabdus bovienii
  Coding DNA sequence: Name=SeqID_1216
  Gene classification: Gene name=ProP; Function=77 Permeases of the major facilitator superfamily; Function class=G Carbohydrate transport and metabolism
  Homolog annotation: Query=1..451bp; Hit=3..453bp; Blast score=556; Percent Identity=66.0; E value=1e-158; Homolog= yajR COG0477
MNDNKMTPLELRATWGLGSVFSLRMLGMFMVLPVLTTYGLELRGSSETLIGIAIGIYGLTQAIFQIPFGLLSDRIGRKPLIIGGLLIFVLGSIIAALSDSIWGIIIGRALQGAGAISAAIMALLSDLTREQNRTKAMAFIGISFGITFAFAIVVGPIITHQIGLNGLFGAITILASCGILITLFAVPSAHKHILNRESGIARGSFRRVLSDPQLLKLNFGILSLHTLLMSSFIALPLIMEKAGFPPQKHWKVYLITTLISFIAVLPFIIYAEKKRRMKQVFLLCIGLLFIAELVLWSVGSHLWGIFAGIQVFFLAFNIMEAILPSLISKEAPAGYKGTAMGVYSTSQFLGVALGGFLGGMLYEQQGASLVFMGGIVLTALWFIISLTLRQPPYVSSIRIVLPEQLNNPDILEKKILSQAGVKDIVIALEELSAYVKVDTKQTNREQLEQLVLSHK

SEQ ID NO: 7325 - protein, 498 aa, Xenorhabdus bovienii
  Coding DNA sequence: Name=SeqID_1217
  Gene classification: Gene name=ChiA; Function=Chitinase; Function class=G Carbohydrate transport and metabolism
  Homolog annotation: Query=124..477bp; Hit=108..446bp; Blast score =127; Percent Identity=28.0; E value=2e-29; Homolog= BH0916 COG3325
MSKLTQLDPLSEESYRLDHFIPATETTKFSYTSGRVALPVYNKYNVKNKPKVIGYYTDWSQYDSRLQGNQTPSARGRGIDLQHLLDNPFAYDKLIIGFCGIVGDQGEKKALISRAAPKFGRYNNGEVTFTDEWGDCQSYVNCTFPRWQDVQMPRDFNQDKSMGVLGGLAKIQDAARAQGHELVMSFSVGGWTMSNGFYNMVRDSQLKSKFISSLIDIFKRFPMFTEVDIDWEYPGAKGNDNPHDSEDGKYYIDLIRDLSSAFKNAGRSDIKISIACSAVPDIMEKSKIPELLKVGLYGINVMTYDFFGTPWADKLRHHTNLRRYPGSENSVEKAVEYLLSVGVPSQAINIGYAGYSRNGKNTNITSYSPLSGSYSPGTGTTTGTFESGSTEWYDTIYNYLNLESRQDRNGFTLYTDEVADADYLYNQNSKLFISLDTPRTVKAKAKYALEKNLGGVFTWTADQDRGPLVNAAREGLGCPLLIKKIDMEPFYYKGKTNK

SEQ ID NO: 7326 - protein, 163 aa, Xenorhabdus bovienii
  Coding DNA sequence: Name=SeqID_1218
  Gene classification: Function=Uncharacterized BCR; Function class=S Function unknown
  Homolog annotation: Query=1..163bp; Hit=1..163bp; Blast score=217; Percent Identity=73.0; E value=4e-57; Homolog= PM1656 COG1666
MPSFDIVSEVDMQEVRNAVENAQRELTNRWDFRNVNASFELNEKNESVKIASESDFQVNQLVDILREKFAKRGIDGSVLNVAENMVHSGKTYSVEATFLQGIDTPLAKKIVKLIKDSKLKVQAQIQGEQVRVTGKARDDLQSVMTLVRGAELGQPFQFTNFRD

SEQ ID NO: 7327 - protein, 396 aa, Xenorhabdus bovienii
  Coding DNA sequence: Name=SeqID_1219
  Gene classification: Gene name=ApbA; Function=Ketopantoate reductase; Function class=H Coenzyme metabolism
  Homolog annotation: Query=93..392bp; Hit=1..300bp; Blast score=352; Percent Identity=55.0; E value=4e-97; Homolog= apbA COG1893
VRSLLRYALPAYQLLKQYQMMALPVTSCLSISWHDNRFPLLAKDLYSGGSAIFWHLRYFLRSFDLRSFDLRPFEISIVSRFSIKAPLISRKYMKITVLGCGAIGKLWLVALSQQNHDIQAWIRVPQPFVSVRIDNFNGKVFDQQFSANDEKHLAESELLLVCLKAWQVSDAINNLAPKLSPHCPILLLHNGMGSQEEFLPLPNPILLGVTTHGSYQENGIVYHKSQGITHIGSATANADKFSFLADVLHYALPDVAWHNEIHTISWLKLAVNCIINPLTVIYDCKNGNLLQHTAQIDLLCDEIHQVMERDNLHTTKQMLVDYVMNVIEQTSENYSSMLQDIRAQRHTEIDYITGFLLRRARAYGLSIKETTIIYQCIKRKEEEYERLSPHLPGSRQ

SEQ ID NO: 7328 - protein, 219 aa, Xenorhabdus bovienii
  Coding DNA sequence: Name=SeqID_1220
  Gene classification: Gene name=ThiJ; Function=Putative intracellular protease/amidase; Function class=R General function prediction only
  Homolog annotation: Query=21..215bp; Hit=2..196bp; Blast score=260; Percent Identity=64.0; E value=6e-70; Homolog= thiJ COG0693
MDCPSKKLLLFINVLNERRRNMNASALICLAHGSEETEAVITIDLLVRAEIDVTVASAATDGALILTCSRGVKIVADTPLVNVVDEDFDAIILSGGIKGAECFRDSPLVVEKIRTAHSQGKIIAAICASPAIVLEYHQLFPIGNMTGYPSMRDKIAPEKWIDRRVYFDERVNLLTSQGPATTFDFALKLIELLKGKEKAAEVAAQLVLPPGVNNYQHQQ

SEQ ID NO: 7329 - protein, 482 aa, Xenorhabdus bovienii
  Coding DNA sequence: Name=SeqID_1221
  Gene classification: Gene name=ThiI; Function=Thiamine biosynthesis ATP pyrophosphatase; Function class=H Coenzyme metabolism
  Homolog annotation: Query=1..385bp; Hit=1..385bp; Blast score=634; Percent Identity=82.0; E value=0; Homolog= thiI_1 COG0301
MKFIIKLFPEITIKSQTVRLRFIKILASNIRNVLKTLSEEIAVVRHWDNIEVRAKNDNLGAEICDALTRIPGIHHILQVEERDFRDLHHIFEQTYEAYGHLLHGKTFCVRVKRRGKHSFTSNEVERYVGGGLNQHIESAKVKLTHPDVTVNLEIEQDILILVKARHEGIGGFPIGTQEDVLSLISGGFDSGVSSYMLMRRGCRVHYCFFNLGGAAHEIGVKQVAHYLWNRFGSSHKVRFVAVDFEPVVAEILEKVDDGQMGVVLKRMMVRASSRIAERYGVQAIVTGEALGQVSSQTLTNLRLIDNASDTLILRPLISHDKEHIIKLAREIGTEDFARTMPEFCGVISKSPTVKAVKAKIEAEEANFDFEILDRVVSEAQNLDIRQIAQQACEQVVEVETVTEFSTSDVLLDIRAPDEQDDRPLSVDGIEIQSLPFYKLGTQFGDLPKEKNYLLYCERGVMSRLQALYLREQGFENVKIYRP

SEQ ID NO: 7330 - protein, 35 aa, Xenorhabdus bovienii
  Coding DNA sequence: Name=SeqID_1222
VRLVLYSTPYLTEHLRTIIDIDCDSSTLNDYYILL

SEQ ID NO: 7331 - protein, 33 aa, Xenorhabdus bovienii
  Coding DNA sequence: Name=SeqID_1223
MIYFFQCSRVLCNSVANLLDCNSLNNHTLNHYV

SEQ ID NO: 7332 - protein, 85 aa, Xenorhabdus bovienii
  Coding DNA sequence: Name=SeqID_1224
  Gene classification: Gene name=XseB; Function=Exonuclease VII small subunit; Function class=L DNA replication, recombination and repair
  Homolog annotation: Query=11..85bp; Hit=6..80bp; Blast score=74; Percent Identity=68.0; E value=2e-14; Homolog= xseB COG1722
MSKANQTSEIEQTPAFETSLKELEEIVTRLESGKLPLESALNEFERGIQLARQGQKTLQQAEQRVQILLNHDAQSPLDEFSPDAE

SEQ ID NO: 7333 - protein, 321 aa, Xenorhabdus bovienii
  Coding DNA sequence: Name=SeqID_1225
  Gene classification: Gene name=IspA; Function=Geranylgeranyl pyrophosphate synthase; Function class=H Coenzyme metabolism
  Homolog annotation: Query=25..320bp; Hit=3..298bp; Blast score=365; Percent Identity=66.0; E value=1e-101; Homolog= ispA COG0142
MHNRHLMNFRLTLSKFMSEQYKTPFEEQLSACQQHVNDKLIATFSSLPFLDSPLATAMLHGAVLGGKRLRPFLVYSVGEMFGLSRESLDAPALALECIHAYSLIHDDLPAMDNDDLRRGQPTCHIKFGESLAILAGDALQSLAFEILAKQDMPNIALSDRLAMVAELATASGLAGMCRGQSLDLEAEGKQIDLAALEQIHRHKTGALIRTAVRLGAYSAGQRGREVLPLLDQYAQAIGLAFQVHDDILDVIGNTDVIGKRQGNDQQLGKSTYPALLGLEQAKKKARDLYEEALAALTELEKQSYNTVILKKLAGFIIERNS

SEQ ID NO: 7334 - protein, 621 aa, Xenorhabdus bovienii
  Coding DNA sequence: Name=SeqID_1226
  Gene classification: Gene name=Dxs; Function=Deoxyxylulose-5 -phosphate synthase; Function class=H Coenzyme metabolism
  Homolog annotation: Query=1..620bp; Hit=1..620bp; Blast score=1065; Percent Identity=81.0; E value=0; Homolog= dxs COG1154
MSIDIAKYPTLALAETPEELRLLPKDTLPKLCDELRQFLLNSVSRSSGHFASGLGTVELTVALHYVYKTPFDNLVWDVGHQAYPHKILTGRRDHINTIRQKNGLHPFPWRDESEYDTLCVGHSSTSISAGLGMAIAAKHEDKGRKTVCVIGDGAITAGMAFEAMNHAGDIDPDMLVILNDNEMSISENVGALNNHLAHLLSGKLYTTLREGGKKVFSNLPPIKELLKKTEEHLKGMVVPGTLFEELGFNYIGPVDGHDVLALTQTLKNMRELKGPQFLHIMTKKGRGYAPAEKDPIGWHAVPKFDPATGSLPKSSDTRPTFSKIFGDWLCEEAAHDKKLMAITPAMREGSGMVRFSREYPEQYFDVAIAEQHSVTFAAGLAIGGYKPIVAIYSTFLQRAYDQVIHDVAIQNLPVLFAIDRGGIVGSDGQTHQGAFDLSFLRCIPNMVIMAPSDENECRQMLHTGHHYQNGPAAVRYPRGTGTGAELQPLEALPIGKGIVRRQGERIAILNFGTLLPDALQSAEALNVTVVDMRFIKPLDNQLVLEIAASHDMLVTLEENAIMGGAGSGVNELLMQTGQPVPVLNLGLPDHFIPQGTQEEIRADLGLDATGIQHAIEKYLAK

SEQ ID NO: 7335 - protein, 38 aa, Xenorhabdus bovienii
  Coding DNA sequence: Name=SeqID_1227
LKNFEVEKERAEEKRMRCCKEHTSFFEDYLARYFSIAC

SEQ ID NO: 7336 - protein, 44 aa, Xenorhabdus bovienii
  Coding DNA sequence: Name=SeqID_1228
LQQRILFSSALSFSTSKFFKKLISYINLQYNHFTTVFSFLKSLH

SEQ ID NO: 7337 - protein, 389 aa, Xenorhabdus bovienii
  Coding DNA sequence: Name=SeqID_1229
  Gene classification: Gene name=KamA; Function=Lysine 2,3-aminomutase; Function class=E Amino acid transport and metabolism
  Homolog annotation: Query=17..355bp; Hit=40..366bp; Blast score=163; Percent Identity=29.0; E value=2e-40; Homolog= DRA0027 COG1509
MNNSNALPHSQQFLFNPNENWLDWRWQQKNALRDEAALRSACGGWSEEIALRIQQNLQGQKMQITPYYLRQILATNQSDDITANPLWRQVVPFWSEEELNGYDGETENWELNDEMKTPICQHKYDNRVILRMVNACNSYCQFCFEALRTLKVDSGKSNAGRSSFQQSLEYIKNTPSVEEVILSGGDPLMLTDNKLDESLAAIREIRDDLLIRIHSRALTFNPYRITDALIETLKKYRINAFGVHVCHPFELSEEFQTAVRRIQSAVPIVFSNMPFLRGINDNEETLHKLFIDLYRMGVKPYYLYHFMPFSPGSSEYKASINDAIAIMSKLKRRISNIALPEYVLPHMKGKFTVPLFTHPQEMPYFETLNGKRYYRFINWQNEQCEWLDN

SEQ ID NO: 7338 - protein, 457 aa, Xenorhabdus bovienii
  Coding DNA sequence: Name=SeqID_1230
  Gene classification: Gene name=AccC; Function=Biotin carboxylase; Function class=I Lipid metabolism
  Homolog annotation: Query=28..325bp; Hit=21..282bp; Blast score=111; Percent Identity=29.0; E value=1e-24; Homolog= mlr6296 COG0439
MKPNAILFVDIDDAEITRYTYREPHFAAAKEMGLLCLTAALQGRQHTERLFADSDEAFYVESMTLDALRDLVSTLLDTYNLRAILCHAGHASASGQVGCIVAEICQEIELPHSSSRAIATCNNKFLMRQTLQQHGVRSIRHALCNNEEELCSQANLIGYPLIAKPPFGACSVFIKRCNNWAELLAHYQAFTAHYAHSNYTDFMGNQQECVTPKGEKYVSIPGKSLLLEEYIDGIEGTIECAINQHTIYPVLINEKLILTEKSNTVLENLLITPPVSFSPSEQEQIKNYAIACLNAVGLNNAIAHLEFRMTSEGPVIIEINPRLGGLFVNSAFRDLAGLNPYQLYLSILIQDQEVDFQLTQACKQAEQATQHYSMIVMYPDTNGHFKGIENLHYLKNQPCILECVSYTNDCYINAEIEEHYLIKCWAKVEGASHAHTLHSNMLENVKPIIIPESDLTS

SEQ ID NO: 7339 - protein, 117 aa, Xenorhabdus bovienii
  Coding DNA sequence: Name=SeqID_1231
MNITNISANLINEHYCHIPHFSELISCDSEATKTFKGHWDNLVLDQNFKDYTHRERRILRYHYRPGTEISFQLNQDTEYRSSVTYDIEYKKGANQLSYAEDTFIFPYERFKTTVFRR

SEQ ID NO: 7340 - protein, 70 aa, Xenorhabdus bovienii
  Coding DNA sequence: Name=SeqID_1232
MTLNTKKVPINSVMLKIHLFFHMKGLKPRSLDGDFDFNSLTYARLRGAWFDDFQSSAPKCANPPTSVGGS

SEQ ID NO: 7341 - protein, 133 aa, Xenorhabdus bovienii
  Coding DNA sequence: Name=SeqID_1233
  Homolog annotation: Query=1..127bp; Hit=183..307bp; Blast score=63; Percent Identity=32.0; E value=7e-10; Homolog= ref|NP_902978.1|
MQHILSMDIAILGDRLIKGCHYSIDIHQFRVKAFAGKESPTTSGIHQDGQDWIFMHFIQGHNIAPVISEVHATADEAPPLLHTAMEQFLETLAINDRQLYHRASNVGQISPTITAFRDLLLVTFRQRPEQQES

SEQ ID NO: 7342 - protein, 408 aa, Xenorhabdus bovienii
  Coding DNA sequence: Name=SeqID_1234
  Gene classification: Gene name=ProP; Function=77 Permeases of the major facilitator superfamily; Function class=G Carbohydrate transport and metabolism
  Homolog annotation: Query=16..391bp; Hit=4..400bp; Blast score=68; Percent Identity=23.0; E value=1e-11; Homolog= PAB0724 COG0477
MSSQEISLNLRWSGLNALLIVSARFVSDFGAFLNMVALSTYVYLLSDSVMHVSIFLACRVAGGIIASLIGTPFFRRFAGRWPLVCFDLLRVILLSLLLVIPASQQLLILPMIAFGIGLGNSMFAIGLNSQLPYWVHASQRISTNSWLTSVAATGAVLGSLVSGLLVASSGYEIVFIVNIITYLLAAFLIIPLRFLTHPEQKTSRERGNEWRELIRGLRGTPMLAGMLFLSLADTLGSAAHNVGFPVISKLLTPDNASTTMGLLLATWAVGKFSGARLTSYLLRNRNLLKMEKLFFLGVALISTGFILTFQQTSQLWLLVFAVWAGIGDGIAEVSLISRAQSEPESLRLPIFSLLTLMQMTGFGIGMLLVAPFYVWLPPSVVILIFHGLPLTVLVIILIWMRRFTTSKA

SEQ ID NO: 7343 - protein, 40 aa, Xenorhabdus bovienii
  Coding DNA sequence: Name=SeqID_1235
MFWWMYLSSSYKGILFYYKFRWIYIISATLLYGIGDFTRI

SEQ ID NO: 7344 - protein, 247 aa, Xenorhabdus bovienii
  Coding DNA sequence: Name=SeqID_1236
  Gene classification: Function=Predicted membrane protein; Function class=S Function unknown
  Homolog annotation: Query=15..240bp; Hit=6..229bp; Blast score=184; Percent Identity=44.0; E value=8e-47; Homolog= Cj0552 COG3819
MGEQSMQQAINFWPLIGIAVIMIGFILRFNPVLVVTVAGLVTGLAAHMPITEILEKLGSGFLNTLNLLLTILFPLVIVGLLERHGLKERAQRSIAHIKTATTGRLLIVYLFIRETSAALGLTSLGGHPQMVRPLLAPMAEGAAENQYGHLPDHVRHRIRAMSAATDNTGLFFGEDIFVAFGAIIFMHNFMLESGGIQTEPLHIALWGIPTAICAFLIHSVRLYRLDYHLAREITSLNHMKLTSKEAK

SEQ ID NO: 7345 - protein, 338 aa, Xenorhabdus bovienii
  Coding DNA sequence: Name=SeqID_1237
  Gene classification: Function=Predicted membrane protein; Function class=S Function unknown
  Homolog annotation: Query=1..337bp; Hit=1..316bp; Blast score=218; Percent Identity=43.0; E value=9e-57; Homolog= CC1199 COG3817
MFQLQYLYYLAGFILLIVAVMSWRDRANPRRLTTGLFWGLYGLIFLIGNWSYQLMAIWISDEAQAQKIVHISVGVLVIIIALLAGFGGVRVGNYHQPTTEQKQKSAERLGNRLFLPALLIPVVTMVGVLLFNHIPGLQQTVFGAGNHSTLVTLFSITFGCLAGLIIALHMTRENIMQPIQETRRLLDSIGSVFILPQILATLGLLFTAAGVGTVISHLTENYLAVDNRFIAVIAYVLGMALLTMIMGNAFAAFPIVTAGIGIPILILQHGGNPAVMAAIGMFSGYCGTLMTPMAANFNLVPAALLELPDRNAVIKAQIPTGCTLLITNVFLLYFLMFL

SEQ ID NO: 7346 - protein, 215 aa, Xenorhabdus bovienii
  Coding DNA sequence: Name=SeqID_1238
  Gene classification: Gene name=Pcp (BS); Function=Pyrrolidone -carboxylate peptidase (N-terminal pyroglutamyl peptidase); Function class=O Posttranslational modification, protein turnover, chaperones
  Homolog annotation: Query=2..215bp; Hit=3..215bp; Blast score=222; Percent Identity=50.0; E value=2e-58; Homolog= BS_pcp COG2039
MKTILVTAFDPFGGEAINPSWEAIKPLQGSQVSGANIEICQLPCIFDTSLEHLYAAIDKYQPELVISVGQAGGRTNITVERVAININDARIPDNAGNQPIDTPVIVDGPAAYFSRLPIKTMVNALNTAGIPASVSQTAGTFVCNHVMYGLLHYLAQNTSSVRGGFIHVPYLPEQAAKYANQPSMTLELMTLALKTAIETAWKNTSDIAVTGGATH

SEQ ID NO: 7347 - protein, 170 aa, Xenorhabdus bovienii
  Coding DNA sequence: Name=SeqID_1239
  Gene classification: Gene name=PgpA; Function =Phosphatidlglycerophosphatase A and related proteins; Function class= I Lipid metabolism
  Homolog annotation: Query=9..162bp; Hit=9..162bp; Blast score=174; Percent Identity=62.0; E value=3e-44; Homolog= pgpA COG1267
MIRRRELMDDAKRRLRMRNPWHLLATGFGSGLSPIMPGTMGSLAAIPFWLLLVQLPEWGIWLVILLGTVIGCVICQKAADAMQVEDPGCVVWDEFIGIWITLMAIPVLNWQWVLVAFVVFRIFDMWKPWPIRWFDRYVKGGIGIMLDDIIAAIFAVIVIWLLNFCPLLPF

SEQ ID NO: 7348 - protein, 360 aa, Xenorhabdus bovienii
  Coding DNA sequence: Name=SeqID_1240
  Gene classification: Gene name=ThiL; Function=Thiamine monophosphate kinase; Function class=H Coenzyme metabolism
  Homolog annotation: Query=13..336bp; Hit=1..324bp; Blast score=469; Percent Identity=69.0; E value=1e-132; Homolog= ZthiL COG0611
MCSSSVTFWNSIMACGEFDLIARYFNRHVIRRRDVNLGIGDDCALMTVAEKQELAVTTDTLVAGVHFLPDISPEDLAYKALAVNISDLAAVGADPAWASLALTLPDVNEDWLKRFSDSLFEQLNYYGMQLIGGDTTKGPMSLTLTVHGLVPAGRALRRAGAKNGDWIYVTGTLGDSAAGLALLQDRFAVEDSAIHNWLVKRHLRPQPRVLQGQALRNLASSAIDLSDGLISDLSHILTTSQCGARINLDALPYSEAVQKYATPEQALTWALGGGEDYELCFTVPELNRGALNMALAHTGASFRCVGQIRPESEGIRYFNNNEEIELDLKGFDHFKTEKKPIEDCQALQQAQNDQTEGTHG

SEQ ID NO: 7349 - protein, 36 aa, Xenorhabdus bovienii
  Coding DNA sequence: Name=SeqID_1241
LPGVPHYNSMISYMRPVSRPHVLIVSHFLEFYYGMW

SEQ ID NO: 7350 - protein, 138 aa, Xenorhabdus bovienii
  Coding DNA sequence: Name=SeqID_1242
  Gene classification: Gene name=NusB; Function=Transcription termination factor; Function class=K Transcription
  Homolog annotation: Query=1..138bp; Hit=1..138bp; Blast score=198; Percent Identity=78.0; E value=1e-51; Homolog= nusB COG0781
VKPAARRRARECAVQAIYSWQLSKNDIADIEFQFLSEQDVTGVDITYFRELLTGVAVNAAKLDALMAPYLSRQLEELGQVEKAILRVAMFELSFRDDVPYKVAINEGIELAKTFGAEDSHKFVNGVLDKAGPAARKKK

SEQ ID NO: 7351 - protein, 156 aa, Xenorhabdus bovienii
  Coding DNA sequence: Name=SeqID_1243
  Gene classification: Gene name=RibH; Function=Riboflavin synthase beta-chain; Function class=H Coenzyme metabolism
  Homolog annotation: Query=1..155bp; Hit=1..155bp; Blast score=219; Percent Identity=81.0; E value=7e-58; Homolog= ribH COG0054
MNVIKGVVAAPEARIAIAIARFNNFINDSLLEGAVDALERIGQVSSDNITVVWVPGAYELPLTVKALTETQKYDAVIALGTVIRGGTAHFEYVAGECSSGLSSVAMSSDIPVAFGVLTTESIEQAIERAGTKAGNKGAEAALTALEMINVIKAIKG

SEQ ID NO: 7352 - protein, 54 aa, Xenorhabdus bovienii
  Coding DNA sequence: Name=SeqID_1244
MKLLKRAIAMAMRASGAATTPLITFIAFLIPYSYPQGRGSYHILFLCVLIYVQT

SEQ ID NO: 7353 - protein, 369 aa, Xenorhabdus bovienii
  Coding DNA sequence: Name=SeqID_1245
  Gene classification: Gene name=RibD; Function=Pyrimidine reductase, riboflavin biosynthesis; Function class=H Coenzyme metabolism
  Homolog annotation: Query=145..365bp; Hit=1..221bp; Blast score=307; Percent Identity=66.0; E value=9e-84; Homolog= ZribD_2 COG1985
MTLDEKYMSRALELAIQGRFTTSPNPNVGCVIVQGDHIVGEGFHLCAGEPHAEVHALRMAGDKAKGATAYVTLEPCSHHGKTPPCADALIAAGISRVVAAMQDPNPQVAGRGLYKLQQAGIAVEHGVLMAQAEALNKGFLKRMRTGFPYLQLKMGASLDGRTALASGESKWITSPEARQDVQQLRAQCSAILSSSATVLADDPSLTVRWHELEAEIQAIYPQEQVRQPIRIIVDSQNRVTPQHQVVQQAGQCWLARTHTDEQQWPGNVDHIILPAYGGGVDLVLLMMQLGKRQINSVWAECGPVLAGALLSLGLVDELILYMAPKVLGNTARGLFALPELQKLSDAPEFTLFDVRQIGPDVRLRLRPAY

SEQ ID NO: 7354 - protein, 149 aa, Xenorhabdus bovienii
  Coding DNA sequence: Name=SeqID_1246
  Gene classification: Function=Predicted transcriptional regulator, consists of a Zn-ribbon and ATP-cone domains; Function class=K Transcription
  Homolog annotation: Query=1..149bp; Hit=1..149bp; Blast score=238; Percent Identity=85.0; E value=2e-63; Homolog= ybaD COG1327
MHCPFCAAVDTKVIDSRLVGDGSQVRRRRQCLECHERFTTFEIAELVMPRVIKSDDIREPFDEEKLRRGMLKALEKRPVSSDDVETAIIHIKSQVRATGEREIPSKMIGNFVMDALKKLDKVAYIRFASVYRSFEDVREFGEEIARLQD

SEQ ID NO: 7355 - protein, 36 aa, Xenorhabdus bovienii
  Coding DNA sequence: Name=SeqID_1247
VSTYLQGVFHYHFKVNCLPVRLTVRKQYALPILRSR

SEQ ID NO: 7356 - protein, 303 aa, Xenorhabdus bovienii
  Coding DNA sequence: Name=SeqID_1248
  Gene classification: Gene name=SecF; Function=Preprotein translocase subunit SecF; Function class=N Cell motility and secretion
  Homolog annotation: Query=1..303bp; Hit=20..323bp; Blast score=453; Percent Identity=78.0; E value=1e-127; Homolog= secF COG0341
MRWDNVAFGISLLLLVASIITMGVRGFNWGLDFTGGTVIEINLSKPADLDKMRESLTKNGFADPLLQNFGSSRDVMVRMPPVTGNAGQELGNKIISVINANIDKDAVVKRVEFVGPSVGGELAQTGAMALLAALISILIYVGFRFEWRLALGAVIALAHDVIITLGVLSLFHIEVDLTIVASLMSVIGYSLNDSIVVSDRIRENFRKIRRGTSYEIMNVSLTQTLSRTIMTSATTLLVVLMLYIFGGEMLKGFSLAMLIGVSIGTISSIYVASALALKLGMKREHMIQQKVEKEGADQPSILP

SEQ ID NO: 7357 - protein, 604 aa, Xenorhabdus bovienii
  Coding DNA sequence: Name=SeqID_1249
  Gene classification: Gene name=SecD; Function=Preprotein translocase subunit SecD; Function class=N Cell motility and secretion
  Homolog annotation: Query=1..604bp; Hit=12..615bp; Blast score=929; Percent Identity=80.0; E value=0; Homolog= secD COG0342
MLIAAILIGLLYALPNLYGEDPAVQITGARGIAASEKTLDQVRNVLEKEQIKSKSIALENGAILARFNNSDVQLRAREALVSALGEQYVVALNLAPATPLWLSKVGAEPMKLGLDLRGGVHFLMEVDMETALSKLQEQNIDSLRSELRDQGILYSSVRKLDNYGVEVRFRDNDARSKAESYLEPRHRDLVFSTGANSTLKVVMSDDRLREARTYAVQQNITILRNRVNQLGVAEPLVQRQGADRIVVELPGIQDTARAKEILGATATLEFRLVNSNVDQNAAISGRIPGDSELKYTRDSNPVVLYKRVILTGDHITDSTSSTDEYGNPQVNISLDGAGGSAMSNFTKDNLQKPMATLFVEYKDSGKKDANGRSVLVKQEEVINIATIQSRLGNSFRITGIGNPNEARQLALLLRAGALIAPIQIVEERTIGPTLGLQNIEQGLEACLWGLISSILFMVIYYRKFGLIASSALLANLVLIVGVMSLLPGATLTMPGIAGIVLTLAVAVDANVLINERIKEELRNGRTVQQAIHEGYKGAFSSIIDANLTTLITAVILYAVGTGSIKGFAITTSIGVATSMFTAIVGTRAVVNLLYGGKRINKLSI

SEQ ID NO: 7358 - protein, 145 aa, Xenorhabdus bovienii
  Coding DNA sequence: Name=SeqID_1250
  Gene classification: Gene name=YajC; Function=Preprotein translocase subunit YajC; Function class=N Cell motility and secretion
  Homolog annotation: Query=34..145bp; Hit=1..110bp; Blast score=182; Percent Identity=83.0; E value=9e-47; Homolog= yajC COG1862
MCSISGWFLIEPLSIFDNNIFDNNVFDNNEGNLMSFFISEAAASAGAPAQSQGSPYSLIIMLVVFGLIFYFMILRPQQKRTKEHKKLMDSIAKGDEVLTSGGLVGRVSKVSETGYVVIALNDTTEITVKRDFVAAILPKGTMKAI

SEQ ID NO: 7359 - protein, 374 aa, Xenorhabdus bovienii
  Coding DNA sequence: Name=SeqID_1251
  Gene classification: Gene name=Tgt; Function=Queuine/archaeosine tRNA- ribosyltransferase; Function class=J Translation, ribosomal structure and biogenesis
  Homolog annotation: Query=1..374bp; Hit=1..374bp; Blast score=709; Percent Identity=88.0; E value=0; Homolog= tgt COG0343
VKFELQKTDGNARRGRLIFDRGVVETPAFMPVGTYGTVKGMTPEEVKETGAQILLGNTFHLWLRPGQEIMKLHGDLHDFMQWHGPILTDSGGFQVFSLGAMRKIKEEGVHFRNPINGTPVFLSPEKSMEIQYDLGSDIVMIFDECTPYPADWDYAKRSMEMSLRWAARSRQRFNELGNKNALFGIIQGSVYEDLRDVSVKGLVEIGFDGYAVGGLAVGEPKEDMHRILEHVCPQIPQDKPRYLMGVGKPEDLVEGVRRGIDMFDCVMPTRNARNGHLFVTEGVIKIRNAKHKEDTSTLDEHCDCYTCRHYSRAYLHHLDRCNEILGARLNTIHNLRYYQRLMAGIRKAIEENKLEQFVEEFYQRIGKPVPPLNI

SEQ ID NO: 7360 - protein, 355 aa, Xenorhabdus bovienii
  Coding DNA sequence: Name=SeqID_1252
  Gene classification: Gene name=QueA; Function=S-adenosylmethionine; Function class=J Translation, ribosomal structure and biogenesis
  Homolog annotation: Query=1..354bp; Hit=1..354bp; Blast score=584; Percent Identity=81.0; E value=1e-167; Homolog= queA COG0809
MRVADFTFELPEELIAHYPQPQRSGCRLLALDGETGGLTHGIFTDVLDKLEAGDLLVFNNTRVIPARLFGRKATGGKLEVLVERMLDNKRVLAHVRASKALKEGAELLLGEDESIRATMLARHDTLFEIRFDDDRDVLTILDEIGHMPLPPYIARPDEESDRELYQTVYSERPGAVAAPTAGLHFDEPLLAALREKGIDMAFVTLHVGAGTFQPVRVETIEDHIMHAEYAEVPQNVVDAVLACKARGNKVVAVGTTSVRSLESAARASQNGLISPFFDDTQIFIYPGFEYQVVDALITNFHLPESTLIMLVSAFAGYKNTMNAYKKAVAEKYRFFSYGDAMFINRNPMAAKEKVS

SEQ ID NO: 7361 - protein, 30 aa, Xenorhabdus bovienii
  Coding DNA sequence: Name=SeqID_1253
MKMCEKIHSESIPEIVKLICFFLAPLRVRH

SEQ ID NO: 7362 - protein, 207 aa, Xenorhabdus bovienii
  Coding DNA sequence: Name=SeqID_1254
  Gene classification: Function=Uncharacterized BCR; Function class=S Function unknown
  Homolog annotation: Query=1..193bp; Hit=1..193bp; Blast score=207; Percent Identity=60.0; E value=9e-54; Homolog= ZyajB COG3124
MNFLAHLHLAALSESSLLGNLMADFVRGSPKGLFSPDIVEGIRLHRRIDSLTDSHPLVTEARTLFRSEYRRVASITLDIIWDHFLSLHWDKLEKNYSLPEFVHLARSQIEPHLTVTPEKFQELNKYLWSENLLIRYADMSCIANVLKGMAHRRPKLSALAGSYQDIEMHYLDFEALFWKFYPHMMALATNKRLLEQDISPEPCTFSK

SEQ ID NO: 7363 - protein, 60 aa, Xenorhabdus bovienii
  Coding DNA sequence: Name=SeqID_1255
LSKIFRQNLALFPNSFILSRLKGIKSKLLIGKTYYINWYFILYCFTLIPYAVTRFYIPPF

SEQ ID NO: 7364 - protein, 200 aa, Xenorhabdus bovienii
  Coding DNA sequence: Name=SeqID_1256
  Gene classification: Gene name=AhpC; Function=Peroxiredoxin; Function class=O Posttranslational modification, protein turnover, chaperones
  Homolog annotation: Query=1..200bp; Hit=1..200bp; Blast score=351; Percent Identity=82.0; E value=2e-97; Homolog= PM0795 COG0450
MVLVTRQAPDFTAAAVLGNGEIVGNFNLKKHLNGRPAVIFFWPMDFTFVCPSELIAFDHRYEEFQKRGVEVIGISFDSEFVHNAWRKTPISEGGIGEVKYPMVADIKRDIMKSYGIEHPEAGVALRGSFLIDKNGVVRHQVVNDLPLGRNIDEMLRMVDALQFHEEHGEVCPAQWAKGQEGMGASPEGVAKYLTKNADKL

SEQ ID NO: 7365 - protein, 587 aa, Xenorhabdus bovienii
  Coding DNA sequence: Name=SeqID_1257
  Gene classification: Gene name=Ggt; Function=Gamma -glutamyltranspeptidase; Function class=E Amino acid transport and metabolism
  Homolog annotation: Query=10..587bp; Hit=15..579bp; Blast score=581; Percent Identity=51.0; E value=1e-166; Homolog= mlr5711 COG0405
MLKAWKIPFVAVSLLVSSSLYAAYEPAVEAKQGVVVSSQYLASQVGVDILKMGGNAIDAAVAVGYAQAVVNPCCGNIGGGGFMTIHLANGKDTFINFRETAPAAASANMYLDKDGNVIKGASLYGYKSIGVPGTVMGLDAALHKYGSMTREQVMAPAIKLARKGYILTRGDTDILDTTVKRFTQDPEAARIFLRKDGTPFQPGDKLVQTDLANTLELIAKKGPDVFYHGKIPQLVEESSKKSGGIITAADFANYNITETTPVTCSYRGYKFISSPPPSSGGVTLCEILNIVEGYDLKSMGFNSAAYIHTLTEAMRHAYMDRNTYLGDPEFIKNPLDRLLSKSYAESIRKEIEPNKATPSKNVQPGVGPHEKPETTHYSVVDKDGNAVSTTYTINGRFGAVVIAPGTGFFLNDEMDDFTTKIGEKNLYGLVQGATNSIAPGKRPLSSMSPTLVTKDNKIFLVLGSPGGSRIISITLQTALNILDFGMPPQEAVNSPRIHHQWLPNEVYYEQRGLSKDTLNVLEKMDYKMVEQTPWGAAELIMIGLPGAVGVSPTNSSGNDSAVSGVVREGYIYGSNDVRRPAGAAIGY

SEQ ID NO: 7366 - protein, 446 aa, Xenorhabdus bovienii
  Coding DNA sequence: Name=SeqID_1258
  Gene classification: Gene name=BrnQ; Function=Branched-chain amino acid permeases; Function class=E Amino acid transport and metabolism
  Homolog annotation: Query=1..432bp; Hit=1..431bp; Blast score=532; Percent Identity=70.0; E value=1e-151; Homolog= brnQ COG1114
MAYRLSSKDIWALGFMTFALFVGAGNIIFPPMVGLQAGENVWIAALGFLLTAVGLPVITVIALAKVGGGIEALSSPIGKTAGLILATVCYMAVGPLFAIPRTATVSFEVGIAPLMGSGRLPLFIYSVVYFSLVILVSLYPGKLLDSVGRVLAPIKILALGILGIAAVLWPASDPIPAIQTYKEIPFSNGFVNGYLTMDTLGAMVFGIVIVNAARSRGIESSSLLTRYTMWAGLIAGLGLVLVYLSLFKLGESSGTLVPKAENGAVILHAYVQNVFGGYGSFFLAVLIFVACMVTAVGLTCACAEFFSRYLSLSYRALVFILGTFSMLVSNLGLDHLIKFSIPVLTAIYPPCIVLILLSFTIRWWNNYTRILAPAMVVSLLFGVLDAAKSSEYLSHLLPAWTIHLPLAEQGLAWLLPTVVAVVVCALYDLIVGESKVPKHKVQQDQG

SEQ ID NO: 7367 - protein, 70 aa, Xenorhabdus bovienii
  Coding DNA sequence: Name=SeqID_1259
MLAFWRYKSFTCGQLLAILAVITTIILYFPITSDYYVDHLLSNQNPVSPVKIQVFAILTIAHAILLTTIY

SEQ ID NO: 7368 - protein, 437 aa, Xenorhabdus bovienii
  Coding DNA sequence: Name=SeqID_1260
  Gene classification: Gene name=BaeS; Function=Signal transduction histidine kinase; Function class=T Signal transduction mechanisms
  Homolog annotation: Query=1..426bp; Hit=1..426bp; Blast score=541; Percent Identity=65.0; E value=1e-154; Homolog= phoR COG0642
VLERLSWKKLVLGLVLFCLPAVILSFFIGYLPWLLVIALFLALVWHGYNLLKLSDWLWLDRSMLPPAGRGGWEPIFYGIYQLQQRNRKRRRELALLIKRFRSGAESLPDVIVMMTTEGNIFWCNRLAQHLLGFRWPEDNGQHIFNLLRYPDFSRYVTAGHFSRPLSIELNNGRMVEFRVMPYSEELLLMVARDITQKRLLENARRDFFANVSHELRTPLTVLQGYLEMMQEQELNDRANQKVLSTMQEQVRRMNGLVKQLLHLSRIEAGPQVDMNEVVDVPDLLVLLQQEALALANNQQDIVFNIDEKLKVFGNEEQLRSAMSNLVYNAVNHTPPGTRIEVSWSKSSQGAGFKVQDNGLGISAEHLPRLTERFYRVDRARSRQTGGSGLGLAIVKHALHHYNTQLEVSSTVGKGSTFSFLLAPGLIVSAKPNLIKKQ

SEQ ID NO: 7369 - protein, 233 aa, Xenorhabdus bovienii
  Coding DNA sequence: Name=SeqID_1261
  Gene classification: Gene name=OmpR; Function=Response regulators consisting of a CheY-like receiver domain and a winged-helix DNA -binding domain; Function class=T Signal transduction mechanisms
  Homolog annotation: Query=5..233bp; Hit=1..229bp; Blast score=372; Percent Identity=81.0; E value=1e-103; Homolog= phoB COG0745
MGLTMAKRILVVEDEVQIREMVCLVLEQNGYQTVEAEDYDVAVGRLSEPYPDLVLLDWMLPGGSGIQLIKQMKRDSSTRDIPVMMVTARGEEEDRVRGLDVGADDYITKPFSPKELVARIKAVLRRTSPMSAEDIINMDGLILDSSSHRVSSQGQNVEMGPTEFKLLHFFMTHPERVYSREQLLNYVWGTNVYVEDRTVDVHIRRLRKALEVGRHDRMVQTVRGTGYRFSTRY

SEQ ID NO: 7370 - protein, 40 aa, Xenorhabdus bovienii
  Coding DNA sequence: Name=SeqID_1262
LHRIYECFVIFHYDCEPARKFVNKVRISHDRPQTLIIISA

SEQ ID NO: 7371 - protein, 404 aa, Xenorhabdus bovienii
  Coding DNA sequence: Name=SeqID_1263
  Gene classification: Gene name=SbcD; Function=DNA repair exonuclease; Function class=L DNA replication, recombination and repair
  Homolog annotation: Query=1..402bp; Hit=1..395bp; Blast score=473; Percent Identity=60.0; E value=1e-133; Homolog= sbcD COG0420
MRIIHTSDWHLGQYFFTKNRAAEHQHFLQWLIEQIIRHQVDALVIAGDIFDTGSPPSYARELYNQFVVELQPTGCQLVILGGNHDSVATLNESKSLFSCLNTTVIASAGTDIQQQIKVLNHQNGEAGAILCAIPYLRPRDIMTSQAGQSATQKQQALQNAITEHYHQLYQQADTLREQLGQPLPIIATGHLTTVGASTSDSVRDIYIGTLDAFPAQAFPPADYIALGHIHRPQIIAKSDHIRYSGSPIPLSFDEVGQEKSVCLVDFKEDKFDNVTLLPIPNYQPMQLIRGNLQQIEAQLQTFKTYQGERPVWLDIEVATQDYLPDIQKRIQTMTANLPVEIILLRRRKAARQISLSETNKETLNELSVHEVFERRLALAEIEDQPQKQRLTTLFKQTLDDISQQ

SEQ ID NO: 7372 - protein, 1226 aa, Xenorhabdus bovienii
  Coding DNA sequence: Name=SeqID_1264
  Gene classification: Gene name=SbcC; Function=ATPase involved in DNA repair; Function class=L DNA replication, recombination and repair
  Homolog annotation: Query=1..1211bp; Hit=1..1199bp; Blast score=300; Percent Identity=29.0; E value=7e-81; Homolog= PA4282 COG0419
MKILSLRLKNINSLQGEWKIDFTAEPFASNGLFAITGPTGAGKTTLLDAICLALYHETPRLGTISATQNELITRHTAECLAEVEFEVKGVAYRAFWSQHRARNQADGKLQPPKGELVDKKTGKILADKIPDKKEKIAEITGLDFKRFTKSILLSQGDFAAFLNADDKDRADLLEELTGTEIYGILSQEIYQRHKQAQTELNIQQATASGIELLTPEQIEKYQNEQQQLIATETQLSQQIKAFQSAEQWLTRQDELQQSITSSTALLQQTERTIQDAQPQLQQLAASEPAEKIRSLWDTQNRAFSEKQRVTEQRIKIEHDRQQQLSLLQPVQQQLTDLEKTQGEHQQKQVQQEKLITEQIMPLDHKIDTQSKDLLTLEKEITGQNRELAEISTQYQVAQNRKDTLHNEQKTLETYYDQHPYCRNLDSKLPEWKQLFSRQKEKQIQIAKFTQKTQQISTELARITHHLSTLNTELAKQTEQNQLLHDNLILTEKQLTDLQKSHPPEQLQKQLSNYQQQLKSQNQLEILLPQIRQLQTTISINQTQSAQYQALLEPLPMQISVLDQQLTEKQQHYEDLTDRIRLEQRITSLEQERSQLKEGEACPLCGSTQHPLVAEYQNIALSQSEERLKSLRHQIEQLQTNRSALQQKQQIQQQNNQQLQQNTAQLTEKLTETTQQWKHHCQQLQAAELPMETEPVNNFIGQRQSAAQQHQRQYEALLQAEKAHQAAEKALSANREQHKASEQTIELEKVKLDSHQKQLAENTADLRQSETEYTTTTELLVSDLQHTPFALPSLQEVTIWLQQRETELKTYHDSRERWQQLQQEQAALQSQSNELEKQKTKLTVHLHALNRKQQQQKQLLEQTTQERHHLFGEQSVSTVRQTLQQKTNELNIACKQATSHLQQRQSVMNQLTGAASEIERNSNTAETQCKLAASAFQSGLEQQGFADQSAFEQVLLEPEQREKLQQLQEQLTQHHLQAKTRHHESETALQRHTETQPQLLEQYEPTQVSVILANISEELKHNNQQQGEVKTILNSDAMRRQKQQTLLAQISHLQQNYDDWSYLNNLIGSADGAKFRRFAQGLTLDHLIHLANIRLEKLHGRYDLQRKDDGGLELQIVDTWQADAVRDTKTLSGGESFLVSLALALALSDLVSNKTQIESLFLDEGFGTLDPETLNIALDALDHLNASGKTIGVISHVEAMKERIPVQIKVEKVNGLGVSRLASEFRV

SEQ ID NO: 7373 - protein, 50 aa, Xenorhabdus bovienii
  Coding DNA sequence: Name=SeqID_1265
MLIFSNHIVIYAFGNLYTHHRAATRNPLGMDDSPSLKRLAFKPEILMPVY

SEQ ID NO: 7374 - protein, 540 aa, Xenorhabdus bovienii
  Coding DNA sequence: Name=SeqID_1266
  Gene classification: Gene name=OppA; Function=ABC-type dipeptide/oligopeptide/nickel transport systems, periplasmic components; Function class=E Amino acid transport and metabolism
  Homolog annotation: Query=18..540bp; Hit=17..543bp; Blast score=522; Percent Identity=47.0; E value=1e-148; Homolog= ZoppA COG0747
MNKITINKKIKILSCAIAMMLGNIALSHAAVVPDGIKLASKQEVVRNHASEPASLDVHKVSSNVEFNIIHDFFDGLVYTDRKGNIEPKLAERWETRDNKIWVFHLRKDIKWSDGTPITANDIVFSWRRLVDPDIVSPYGSYLENAAIVNANDVLRGKKKGEELGVKALDDMTLEVSLDKPMGDFLQILTHPVMVPLNEKVIKKYGNKWTRPESFVGSGPFKLSEWMVNEKIIGIRNSHYWDDKNTVINKVTYLVIGSEKAALNRYLAGEVDFTETIPLDSFESLKKTINDQIYISPQTGVYFYEINNKKPPFDNMKVRQALNLAVDREVIANKILGQGQKPAYTIVPPNVGGFKFTEPDYASWTQAQRIEKAKTLLNEAGFNQSNPLRFNLLYNTSEAHKKIAIAVSSMWKKNLGVDATLQNQEWKVMLDNMHQGKFDVIRRAWIADYNSPMTFLSMFMSGQIKNTSLYENDNYDALIKKAGETNDRSYYQQGLDVITTDSPVIPIYYYVNAKMVKPYVGGFYVNPMGYISTKDLYIIQH

SEQ ID NO: 7375 - protein, 548 aa, Xenorhabdus bovienii
  Coding DNA sequence: Name=SeqID_1267
  Gene classification: Gene name=OppA; Function=ABC-type dipeptide/oligopeptide/nickel transport systems, periplasmic components; Function class=E Amino acid transport and metabolism
  Homolog annotation: Query=13..548bp; Hit=4..543bp; Blast score=530; Percent Identity=48.0; E value=1e-150; Homolog= ZoppA COG0747
MVNNMKKNKIELITKKAIKLLSCSISIIMGSIVLSHAAVVPPGTQLADKQEIVRNNGSEPASLDVHKVESDIEFNIIHDFFDGLVYTNNKGDIIPKLATSWETKDNQTWIFHLRKGAKWSDGSSITAYDVVFSWQRLLNPKMGSPYGSYLVNANVVNANDILTGKKPAEDLGIKALDDFTLEVKLDRPVGDFLQMLAHPIMVIVSEKTIKKYGDKWTKPEYFVGSGPFKLSEWVVNEKVIGVRNPQYWDDKNTVINKVTYLPLSSDKADLNRYFAGEIDITLTIPLESFTSLKKNSGEQIYISPRLGVYYYEFNTQKPPFNDVRVRQALSLAVDRDIIANKVLGQGQRPAYTLLPPKTGGFDFQQPDYASWTQKQRIEKAKSLLNEAGFNQNNPLRFNLLYNTSEAHKKIAIAVSSMWKKNLGVDAVLQNQEWKVMLDNKYQGKFDVARYGWIGDYNSPMSFLNIFMSDSTQNSSKYSNQNFDKLVLKAGETNKKDYYQQAVDIFTDDSPVITIYYYVNAKMVKPYLGGVYIDPRGYVSTKDLYIIKY

SEQ ID NO: 7376 - protein, 549 aa, Xenorhabdus bovienii
  Coding DNA sequence: Name=SeqID_1268
  Gene classification: Gene name=OppA; Function=ABC-type dipeptide/oligopeptide/nickel transport systems, periplasmic components; Function class=E Amino acid transport and metabolism
  Homolog annotation: Query=27..549bp; Hit=17..543bp; Blast score=520; Percent Identity=49.0; E value=1e-147; Homolog= oppA COG0747
MEMVKMKNIIAKFIKNKTTKILTCSIAIILANIAQSHAAVVPPGTQLADKQEIVRNNGSFPASLDVHKVESNVELNIIHDFFDGLVYTDSTGNIVPRLAESWETKDNQIWIFHIRKGSKWSDGSPITAHDVVFSWQRLLDPEIGSPYSSYLGSAFVVNANDILSGKKKKQELGVKATDDLTLEVKLEKPVAYLLQMLTHPILVPISEKAVKKYGDKWMQPDVFVSSGAFKLSEWKVNENVVGVRNPQYWDDKNTVINKVTYLSLVSEKADLNRYLADEIDITQSTALDSFASLKKKLGDQVHIAPMLSTYYYVFNTKKPPFDDVRVRQALSLAVDRDVIANKVLGQGQRPAYDIIPPNTGGFNLIPPEAASWTQEQRIKKARALLNEAGFNQDNPLQFNLLYNTREAHKKIAIAVTSMWKKHLGVQANLQNQEWKVMLDNMHQNKFDVVRYAWTADYNSPMSFLDTFITGSSHNVPLYENSDFDQMVIKAGETNDIIYYQKAMNIFTNDMPIIPIYYYVSNKLVKPYVGGLYINPMDYISTKDLYIIKH

SEQ ID NO: 7377 - protein, 549 aa, Xenorhabdus bovienii
  Coding DNA sequence: Name=SeqID_1269
  Gene classification: Gene name=OppA; Function=ABC-type dipeptide/oligopeptide/nickel transport systems, periplasmic components; Function class=E Amino acid transport and metabolism
  Homolog annotation: Query=13..546bp; Hit=1..540bp; Blast score=491; Percent Identity=45.0; E value=1e-139; Homolog= VC1091 COG0747
MENINMQNFMVSLIKNKIAKVLTCIVSLILGSVTYSYAAVIPSGTQLADKQEITRNNFSEPVSLDPHKSDSSSEFDILRDFFERMVAIDKKDKIIPALAERWETNDNKTWVFHLRKGIKWSDGSPITAHDVVFSWRRMVTPDTISPYGSYLVQATVVNAYDVLSGKKKPEELGVKALDDATIEVTLERPKADLLQMVAHPAMSPISEKVVKKYGNKWTQPEFFVSNGPFKLSEWIVNEKIVGVRNPYYWDDKHTVINKVTYLPLSDYKADLNRYMAGELDISNGGPSDFFPTLKKKFGDQFHISPIMSVYYYLFNTQKPPFNDVRVRQALTLALDRAIITDKVLGNGQKPAFDVVYPGSGGIYLKHPDYASWTQEQRVAKAKALLNEAGFNENNPLKFTLLYNTSDGHKKIAIAASSMWKKNLGVEVVLQNQESKSLYDTMSQGNFEVVRYAWNADYNSPTSFLDIFTTGNTNNIPQYSNKEFDQWVLKADETNNKIYYQRTLDILTQDSPAIPVYYYVRTKLVKPYVGGVHISPLGDIPTKDLYIIKH

SEQ ID NO: 7378 - protein, 543 aa, Xenorhabdus bovienii
  Coding DNA sequence: Name=SeqID_1270
  Gene classification: Gene name=UshA; Function=5'-nucleotidase/2',3' -cyclic phosphodiesterase and related esterases; Function class=F Nucleotide transport and metabolism
  Homolog annotation: Query=6..540bp; Hit=5..567bp; Blast score=385; Percent Identity=41.0; E value=1e-107; Homolog= DR0505 COG0737
MRFFKLLPIVLALTAAGCATKPADDTANRVDVRVLALNDFHGALKAPGPNQPGGIEHMATLLKELKQENPNNIVVAAGDMIGASPLLSSMFHDEPSIEALSLAGLEATSVGNHEFDKGKDELLRKQNGGCHPVTGCQGPTPFKGAEFQYLSANVTVDKTGKTLFPEYVIKEFDGIPVAFIGLTLEGTPAIVTPQGTEGLSFANEVKTINALVPELQKKGVKAIGVLIHEGAAQKREGGRIDVNACNDVTGKVLDIVNHLDKEVDFVISGHTHQAYNCVINGKSVTSAESNGALITRLDLKLDKTTKDVVDFKAKNIWVDNRKYAKDPQITNLLAAYEKIATPLANRVIGKLESNLTQQTTHGGESSLGKVIADAHLFTTAPKKAGGAQLAFVNGGGIRAPMDAGDVTYNAIYTVQPFSNMLVTKTLTGEQIKRLLEQQWDRSRPQILAISHSFEYAWDSSKPVGERVMVSSMKINGKPVDLKAKYRVAANEYLATGGSNFSVFKEGTDPVYSVPDIEAVVNYFAKKSPIIYPKQDRIVDINRK

SEQ ID NO: 7379 - protein, 650 aa, Xenorhabdus bovienii
  Coding DNA sequence: Name=SeqID_1271
  Gene classification: Gene name=UshA; Function=5'-nucleotidase/2',3' -cyclic phosphodiesterase and related esterases; Function class=F Nucleotide transport and metabolism
  Homolog annotation: Query=10..648bp; Hit=9..647bp; Blast score=923; Percent Identity=68.0; E value=0; Homolog= cpdB COG0737
MKNVLKISTLAMLVAFNVNAATVDLRVMETSDIHSNLIDFDYFKDKPTEQFGLVRTANLIKAAKAEATNAVLVDNGDLIQGSPLADYMAAKGLKKGDVHPAHKLMNTMGYTVGNFGNHEFNFGLDYLKQAIAGAKFPYINANIMDAKTGKNYFTPYIIVDTPVKDREGKEHTIKIGYIGFVPPQISIWDKANLDGKVVVNDITETAKKFVPQMKKEGADLVVAIPHSGFSQEPYKAMAENSVYYLSEVSGINAIMFGHAHGVFPSKEYAGIKGVDVANGTVNGIPAVMPGQWGDHLGVVDLVINNDSGEWKTESAKAEARPIYDKAHKKARVERDNKLAAIIEKENEGTRKFVGKLIGKASANMYSYLALIQSDPTVQIVNDAQIDYTKRFIQGDPDLADLPVLAAAAPFKVGGRKNAPADFVEVEKGDLTFRNAADLYLYPNTLVVVKASGADVVQWLECSAGIYNQIDPNSAKPQNLLNWDGFRTYNFDTISGVDYKIDLTQPAKYDVECQLINKEANRIKEVTYQGKPIDPKATFLIATNNYRGYGGKFAGTGDNHIAFASPDENRTILASYISRITKEKGIVSTQAENNWSFLPIKTDKKLDVRFETSPTEKAAIFIKSHAQYPVKYLKNDDVGFAIYQIDLTEKK

SEQ ID NO: 7380 - protein, 383 aa, Xenorhabdus bovienii
  Coding DNA sequence: Name=SeqID_1272
  Gene classification: Gene name=OmpC; Function=Outer membrane protein (porin); Function class=M Cell envelope biogenesis, outer membrane
  Homolog annotation: Query=19..383bp; Hit=17..350bp; Blast score=64; Percent Identity=24.0; E value=2e-10; Homolog= PM0389 COG3203
MKSMKPLAALMGLLVISGSANSATVYNDKGTQMELSGQFRLKAQVTSQDRDIRMRDDGSRIGISGSHELTRAIKAFGKMEWGSDTQKTNSDNFETGFDMFNRVGYLGFSHRDYGQIQFGRTYIPIDWVKKSSYGYGNTGAFYFSDVLGRATGNEKNGVGRNNFMTRLPQTIFVETNRYEGFKVAATYSGKSGSDKERKPGDIRHAYSVVGFYKSDFGLEFDGGYSAATGESQGDSAKSPQDSLLAFGMEYYFPGCEFSIGLDYGIARSKNSGLIYKQGGAEALKSNSVKGDWKANLYGLGVKWHWDKIESGMYAGYYLRDGDTNTFNYQKQTYAVGVDKRFAVSKYNNLRLFVEMAYDDARSDNPVYKDKKQTILETGARLYF

SEQ ID NO: 7381 - protein, 59 aa, Xenorhabdus bovienii
  Coding DNA sequence: Name=SeqID_1273
MLDHFLTPRTARSKRASSAKYITIMKRHLFKKLILAIYNESSKSVRRYRMHGVFYGFNN

SEQ ID NO: 7382 - protein, 302 aa, Xenorhabdus bovienii
  Coding DNA sequence: Name=SeqID_1274
  Gene classification: Gene name=NagC; Function=Transcriptional regulators; Function class=K Transcription
  Homolog annotation: Query=1..302bp; Hit=47..348bp; Blast score=452; Percent Identity=71.0; E value=1e-127; Homolog= ZyajF COG1940
MRIGIDLGGTKIEVIALGDQGEALFRKRVDTPRNDYQQTLAAIAGLIADAEQVTGQRGTVGIGIPGAISPFTGKVKNANSVWMNGQILDKDLSALLGREVRVANDANCLAVSEATDGAAAGKPMVFAVIIGTGCGSGIAFDGKIHAGGNGLAGEWGHNPLPWMDEEDRAYQEEVRCFCGKPGCTEMFVSGTGFMTDYFRLSGVRKKGHEIMEALVQGDEIAELAIRRYERRLARALAQVINLLDPDVIVLGGGMSNVDRLYQTLPGLVQEWVFGGECATPIKKALHGDSSGVRGAAWLWPHK

SEQ ID NO: 7383 - protein, 323 aa, Xenorhabdus bovienii
  Coding DNA sequence: Name=SeqID_1275
  Gene classification: Gene name=RdgC; Function=DNA recombination -dependent growth factor C; Function class=L DNA replication, recombination and repair
  Homolog annotation: Query=21..323bp; Hit=1..303bp; Blast score=464; Percent Identity=75.0; E value=1e-131; Homolog= ZyaiD COG2974
MPPYVLRCSLSRCAKIWGSCMLWFKNLMIYRLNREISLSADELEKQLSSLAFTPCGSQDMMKTGWVPPMGAHGEALTHATGNQILICARKEEKMLPSPVIKQELQAKIARLEGEQHRKLKKTEKDSLKDEVIHTLLPRAFSRFNQTYIWIDTVNNLIIVDAASAKRAEDNLALLRKTLGSLPVVPLTFTDPIELTLTEWVRSGDLPAGYALMDEAELKAILEEGGVIRCKKQALVSDEIATHIESGKFVTKLALDWEERIQFMLSDDGSFKRIKFSETLRDQNDDIDREDVAQRFDADFILMTGELSALIKNTIDALGGEAER

SEQ ID NO: 7384 - protein, 381 aa, Xenorhabdus bovienii
  Coding DNA sequence: Name=SeqID_1276
  Gene classification: Gene name=OmpC; Function=Outer membrane protein (porin); Function class=M Cell envelope biogenesis, outer membrane
  Homolog annotation: Query=6..364bp; Hit=27..368bp; Blast score=336; Percent Identity=55.0; E value=3e-92; Homolog= nmpC COG3203
MIKHNAIAMVIPALLIAGTVNAAEIYNKDGNKIDLYGKADVQHYFAKSGNKKNGDNSVARLGIKGETQITDQLTGFGRWEYNMGASGSETEGAKNNRTRLAFAGLKFGKYGSLDYGRNYGVVYDTNAWTDELPFFGGDSIAATDNFWMGRSTGLLTYRNTDFFGLVDGLKFALQYQTKNDSSTINGRDDILRQNGDGFGLSSSYDFGNGISMAASYGNSNRTSAQKNGTDQTKVVAKGSNTEAWLMSVKYDKNNVYLAAMYGEGRNLTRFGKLDNYVLFANKTQNIELTAQYQFDFGLRPSIGYVYSKGKDLAGDSETNVLAAKSSEDLVNYVSVGAFYNFNKNMGTYAEYKINLMKDNDFTKKVNINTDNVLGVGLVYRF

SEQ ID NO: 7385 - protein, 64 aa, Xenorhabdus bovienii
  Coding DNA sequence: Name=SeqID_1277
VILLKTNITYLHKNELKSNLTSYRTYSQLSMMSKMITTESIVISNEKIDLLMIEITFCYFLYYF

SEQ ID NO: 7386 - protein, 49 aa, Xenorhabdus bovienii
  Coding DNA sequence: Name=SeqID_1278
MNFLAYFLFRNCGATSWAWIFFSILAPYELLIFVLYWRDPIKNKHYLFT

SEQ ID NO: 7387 - protein, 172 aa, Xenorhabdus bovienii
  Coding DNA sequence: Name=SeqID_1279
  Homolog annotation: Query=1..165bp; Hit=41..203bp; Blast score=116; Percent Identity=42.0; E value=1e-25; Homolog= ref|ZP_00015886.1|
MDVVAQKAGIAKKTLYRFVKNREDLLEQIVLRWTDSCTPTFEKDASSFKQAMKLLEKHLREIAQKLLSTDAVGLFKLLQSNFPFREVLLEKYQKSVFERDKIILANWLERQYQKGLLRKLNYNIISELVLSMVIAEPLRQMALGITPPLPETDITPHLAAAITLLELSLVKK

SEQ ID NO: 7388 - protein, 40 aa, Xenorhabdus bovienii
  Coding DNA sequence: Name=SeqID_1280
MVIVAGSSLVCLIPFHQKMQVGWEMGAESIDISAPMVLLP

SEQ ID NO: 7389 - protein, 302 aa, Xenorhabdus bovienii
  Coding DNA sequence: Name=SeqID_1281
  Gene classification: Gene name=HypB; Function=Ni2+-binding GTPase involved in regulation of expression and maturation of urease and hydrogenase; Function class=O Posttranslational modification, protein turnover, chaperones
  Homolog annotation: Query=62..302bp; Hit=56..290bp; Blast score=295; Percent Identity=59.0; E value=4e-80; Homolog= hypB COG0378
MSIYGYGERGEPAHSYPEQGTDSQSGDYAAVADKKPRQFHADIPQNSSQPIIVHHHYYHHNGDVHHHYHGNEQMPEFDVPVSDRCQKQMLQIELDVLSQNNHIAECNRRYFTLHHILALNLISSPGSGKTTLLMATLNRLRDKVACAAIEGDQQTSHDADRIRAVGIQAVQVNTGKGCYLDAEMVREATRQLKPAEHSLLFIENVGNLVCPASFDLGEQHKIVMLSVTEGEDKPLKYPMMFAEAELMIINKVDLLPYLNIELEACIQAARCINPDIDVIALSASTGEGIDQWLSWLEARLSA

SEQ ID NO: 7390 - protein, 53 aa, Xenorhabdus bovienii
  Coding DNA sequence: Name=SeqID_1282
MTNKKRFSNNKNKTSRKLTCCLFTFMINKMIISLWHHINYVKKKSLINIRKTK

SEQ ID NO: 7391 - protein, 809 aa, Xenorhabdus bovienii
  Coding DNA sequence: Name=SeqID_1283
  Gene classification: Gene name=Chb; Function=N-acetyl-beta -hexosaminidase; Function class=G Carbohydrate transport and metabolism
  Homolog annotation: Query=4..423bp; Hit=5..424bp; Blast score=258; Percent Identity=38.0; E value=2e-68; Homolog= CC0447 COG3525
MKFPLRHLLLLTTLTCSFSSMAVSTKNLPLMPWPQQISVQQGRFDLSGQLNIEITGDDMQDAISLWRGRIEAQTGWILPPNNRLPSIRAVHSVASSFPTIKIIITNKMPPIPQPDSDERYQLIIDNRGATLQAESRFGAMRGMETLLQLLQNDARGTYLPLVNITDNPRFSWRGVMLDSARHFLPVDAIKRQLDGMAAAKVNVFHWHLTDDQGWRFASDYYPKLQQLASDGMFYSKTQMRDVVAHAARLGIRVVPEIDFPGHASAIAVAYPELISADGPYQMQRQWGVHKPTLDPSNPQVHQFADRLIAEVADIFPDPYIHIGGDEVNASQWQASTKIQAFMQEKGLKDPHALHAWFNQALEKILEKHGRKMVGWDEIYHPALPHIIVIQSWQGQDSLGKTADDGYQGILSTGFYLDQPQSTAYHYRNEILPQVLRIDERVKKEETAQSWSFNMPRLKGNPITGSFTLIEDGQGQWRGFIDFTGKSRRAVNDIVWQGNVVRFTLDSWMGETTPVMDLNQKQKTADGYILVGNVRYPVTGEKLDSVPTGQLPVVPESRHQTNILGAEATLWSENVTAEVLDIKLWPRTFAIAERLWSAKNITDEKNMYQRLQAIDTWTTVSVGLQQQANSQRLMTRLTNSTDITPLQILAEAVEPAQYYSRHHAKFQAGNYHQYEPIYRFADALGPESHTVREIDTLIDRLLANKQDQQAELALRDHWVRWQNNHDSVMKIVKSNYMMRDLVPVANDVSAIAGLGLLMLDHLKAGKTLTLKQRQDARNLLAQGAQMRDEVIIRAVYPLEKLLNYLDRQTD

SEQ ID NO: 7392 - protein, 49 aa, Xenorhabdus bovienii
  Coding DNA sequence: Name=SeqID_1284
MKKAEKPCSQPCFYRLMKKYFLFQHLLLQHIVLRCQIIKKIQLAVDQAG

SEQ ID NO: 7393 - protein, 350 aa, Xenorhabdus bovienii
  Coding DNA sequence: Name=SeqID_1285
  Homolog annotation: Query=1..342bp; Hit=1..338bp; Blast score=328; Percent Identity=59.0; E value=1e-88; Homolog= ref|NP_929228.1|
MSENIISQKEIVYPEINIKALNQAVNNIWRLAQRQTSGIAIIEEKTKRISLYCRDFDEAVRSSLSQLEPTLRQLATQEYFQTITEIDEALADPDLNDDDRSALLEEREQLIQNLAKDIDHVISNFRDETNQLTGKINDIRNMVISERLGDLLAQAQSQKKELQSAIEQKAAEQNKLDADRAKIIESQDVIRQNNIADMFKDFIPSGNDIDKLDFTQPKKEAIKQAIKQGVEIARKILGKVSEGLKYAELADARVKLSEQIDQLTKESDTLKTTLQETEQRLSGITDTIQIDEERTILLAEAVKLEQAWNLFANQLRNLSGSQINQKDLTSLINSQLDFLDNLASQYNMLK

SEQ ID NO: 7394 - protein, 408 aa, Xenorhabdus bovienii
  Coding DNA sequence: Name=SeqID_1286
  Homolog annotation: Query=1..404bp; Hit=1..404bp; Blast score=509; Percent Identity=67.0; E value=1e-143; Homolog= ref|NP_930307.1|
MENDMSLSQFSAESTINGAELPAITLKLLTSQIDGAARPGGIFTKEDLISIKLYVKHSLSLPFTLETVKSYIGYNDIDIAGLKPADITDLFKEIHNHALSWSGVEENVQQQSINLESAGKQITGTGEDIISIINEMPIIQRVKTKLGDLTEKQLAEITYTNDDKEISVELGNILNSMAKDIESQQVKTQQVKTAVSDFKRTLIGGTLSNGKKADGLQPQVNNKKKLMEDNNLSITIKDLNKKITEKNNEIDQLKKDYDKYVGLSFSGAPGGIIGLAITGGIFGDKAEKARKRKNALIDEVSGLQDQVKGKSALQTSIQNLVLQFGDIDIRMLDAEVALNHLDFMWSNMLTQINTSKDKFAEINDALKLTSFVTAFKQVISPWKEVQGSAAQLVKTFDEALAEYKKLNS

SEQ ID NO: 7395 - protein, 60 aa, Xenorhabdus bovienii
  Coding DNA sequence: Name=SeqID_1287
MSIYVAVNAKRQSFYPQIYFNLVVLFYLSLLSKHININKIRFIYYFLNRNYWFILLTHNF

SEQ ID NO: 7396 - protein, 37 aa, Xenorhabdus bovienii
  Coding DNA sequence: Name=SeqID_1288
VHQFEGFFLGICQSNFHGRDLDLIRMKNQVSSITMGI

SEQ ID NO: 7397 - protein, 345 aa, Xenorhabdus bovienii
  Coding DNA sequence: Name=SeqID_1289
  Gene classification: Function=Predicted transposase; Function class=L DNA replication, recombination and repair
  Homolog annotation: Query=165..332bp; Hit=20..184bp; Blast score=76; Percent Identity=29.0; E value=4e-14; Homolog= BH2520 COG3335
MKITLTDAQKEALELMHDTTRDGRVRDRIKAVLLASEGWTAQMIAQALRIHESTVSRHLKDYVSEEKLAPENGGSESRLSAEQTTELVEYLTANLMHTTAQIVACVWARWQVTFTVAGMTKWLHRQGFSYKKPMGTPHKSDVYKQQHFIKTYNALKAECGQNAPILFIDAMHPTQSTKLSYGWMRRGREHVKVVETTGSRTRLNIMGALNLQRIEETIIREYPTINAKNVVLFFGSIRETYPLSQKIHLILDGAGYHRAEIVQFFAEVLNIELHYLPPYSPNLNPIERLWKYANEQVRNNIYFSEAKTFRETLHHFFHVTLPEKAKELTTRLTDNFQTLIPASSS

SEQ ID NO: 7398 - protein, 46 aa, Xenorhabdus bovienii
  Coding DNA sequence: Name=SeqID_1290
MELNNSLLEKLFYILISRYYFTPYLYYTHFNYMEIVSYNPYYTQLT

SEQ ID NO: 7399 - protein, 39 aa, Xenorhabdus bovienii
  Coding DNA sequence: Name=SeqID_1291
MKLNCPNSDIGQFNFFIQNSEFRLSHHDFYIIKIYWLLN

SEQ ID NO: 7400 - protein, 141 aa, Xenorhabdus bovienii
  Coding DNA sequence: Name=SeqID_1292
  Gene classification: Gene name=ExbD; Function=Biopolymer transport protein; Function class=N Cell motility and secretion
  Homolog annotation: Query=1..141bp; Hit=1..141bp; Blast score=186; Percent Identity=67.0; E value=5e-48; Homolog= exbD COG0848
MAIRLNEDLDDSGELHEINVTPFIDVMLVLLIIFMVAAPLATVDIKVNLPASSAKPQPRPEKPVFLTVKADHQLYVGEQLIERDKLSSVLDQTTQSNKETTIFFQADKTVDYETLMSVMDSLRKAGYLKVGLVGMETVAAQ

SEQ ID NO: 7401 - protein, 330 aa, Xenorhabdus bovienii
  Coding DNA sequence: Name=SeqID_1293
  Gene classification: Gene name=TolQ; Function=Biopolymer transport proteins; Function class=N Cell motility and secretion
  Homolog annotation: Query=101..324bp; Hit=8..231bp; Blast score=295; Percent Identity=70.0; E value=4e-80; Homolog= exbB COG0811
MRNLTASILLALGLTGSAWADTVPVTTAISPENQAAVQVAAPATPAPALSTAPQVDVPKTEAQQTGEPKTDAQKADAQPATETKSTEPVDESESLSGGFATDLSVWGMYQNADAVVKTVMLGLVIASVITWALFFSKGTELLIARRRLRKEQWALADAANLDVAAKIASDFGKQSISRLLLSEAQSERALSAASTDKSGTKERTSFRMERAVAAISRHMGRGNGYLATIGAISPFVGLFGTVWGIMNSFIGIAHSQTTNLAVVAPGIAEALLATALGLVAAIPAVVIYNVFARVISSYRGQVGDMAAQAILLLGRDLDLADSKAEKAEAR

SEQ ID NO: 7402 - protein, 33 aa, Xenorhabdus bovienii
  Coding DNA sequence: Name=SeqID_1294
MSDIICVGLFPLVMRSLIQGILGLARCVNAIHC

SEQ ID NO: 7403 - protein, 42 aa, Xenorhabdus bovienii
  Coding DNA sequence: Name=SeqID_1295
METEEHFDEIIPLIITFLLNSNDNYYQIAQCLISFASDFFPS

SEQ ID NO: 7404 - protein, 397 aa, Xenorhabdus bovienii
  Coding DNA sequence: Name=SeqID_1296
  Gene classification: Gene name=MetC; Function=Cystathionine beta -lyases/cystathionine gamma-synthases; Function class=E Amino acid transport and metabolism
  Homolog annotation: Query=1..394bp; Hit=1..394bp; Blast score=553; Percent Identity=63.0; E value=1e-157; Homolog= metC COG0626
MTEKKLETLLVSAGRKKKYTQGAVNPLIQRTSSIIFDTVEDLKHALKNRAKGELFYGRRGTLTHFAFQEAMAELEGGAGCALYPSGAAAITHAILAFVATGDHVLLTGSAYEPTQDFCNHILKKMGISTDYFDPMIGEGIASLIKPNTTVVFLESPGSLTMEVQDIPAIVRAIRQINPEIVIIIDNTWAAGILFKALDFGIDISIQSATKYIIGHSDGMLGTAVANARCWDQLRESSYLLGQIADPDTVYTATRGLRTLAIRLKHHEESSLHIAKWLAQRPEVAEVYHPALPSCPGHHYFQRDFTGASGLFSFLLKVELTPQQFAEYLDNLHHFKMAFSWGGFESLILGIQPDMLTALRRYNPLKKTGTLFRVHIGLENPQDLIDDLSAGFARIAPL

SEQ ID NO: 7405 - protein, 37 aa, Xenorhabdus bovienii
  Coding DNA sequence: Name=SeqID_1297
MICQPVLPVLHLFSPKRPYSRNLYKNHGCLSIADSHG

SEQ ID NO: 7406 - protein, 44 aa, Xenorhabdus bovienii
  Coding DNA sequence: Name=SeqID_1298
MLNQINSPSAFLRYTGWHVFLMTRRNYRINNGKVKRDHACTLAT

SEQ ID NO: 7407 - protein, 223 aa, Xenorhabdus bovienii
  Coding DNA sequence: Name=SeqID_1299
  Gene classification: Gene name=DedA; Function=Uncharacterized membrane-associated protein; Function class=S Function unknown
  Homolog annotation: Query=1..197bp; Hit=1..197bp; Blast score=251; Percent Identity=66.0; E value=5e-67; Homolog= yghB COG0586
MEKLSEIMHALWQHDFTQLANPEVIWIIYGVLFVTLVLENGLLPAAFLPGDTLLVLSGALIAKGVMSFIPTVILLTIAASLGCWLGYLQGRWLGHTRIVKNWLAQLPVQYRERAHVLFAKHGLAALLIGRFLAFVRTLLPTFAGISGLNSKRFQFFNWLSGFLWVMIIVSFGYILNQIPFVKAHQDLVMNILMILPVILLFSGLFASLLMYWRHKKTSSKKSK

SEQ ID NO: 7408 - protein, 36 aa, Xenorhabdus bovienii
  Coding DNA sequence: Name=SeqID_1300
MMTDNRNMVSEIGKFFGYIDSILNRGKRQVCLLTFF

SEQ ID NO: 7409 - protein, 279 aa, Xenorhabdus bovienii
  Coding DNA sequence: Name=SeqID_1301
  Gene classification: Gene name=ARA1; Function=Aldo/keto reductases, related to diketogulonate reductase; Function class=R General function prediction only
  Homolog annotation: Query=40..275bp; Hit=1..236bp; Blast score=350; Percent Identity=70.0; E value=1e-96; Homolog= yqhE COG0656
MDQQTIIKLVDGNLMPQLGLGVWQASNDQVVKAVRTALEVGYRSIDTAAIYHNESGVGKALKEIDIPREEIFVTTKLWNDRHQDAKAALEESLDKLQLDYIDLYLLHWPVPHQDQYVEAWKQLIELKESGLARSIGVCNFHIEHLQKLMSETSVVPAINQIELHPLMQQRQLHSWNATHHITTESWSPLSQGGKGVFDNPLVQHLAIKYQKTPAQIVIRWHLDCGMIAIPKSVTPSRIKENFDVFDFRLEKEDLTAMAELDIGKRMGPNPDTYTGDHVK

SEQ ID NO: 7410 - protein, 99 aa, Xenorhabdus bovienii
  Coding DNA sequence: Name=SeqID_1302
MTYIIISLLMLIPFFFLVKRFLLSNHVHHNVSGIILTVVAIAIHMYIFRFDRVPIVSVSIPNIVAYGSIVIALLHGMIYSVCFRLYFDKGSYDEHSRSD

SEQ ID NO: 7411 - protein, 1074 aa, Xenorhabdus bovienii
  Coding DNA sequence: Name=SeqID_1303
  Gene classification: Gene name=CarB; Function=Carbamoylphosphate synthase large subunit (split gene in MJ); Function class=E Amino acid transport and metabolism
  Homolog annotation: Query=1..1072bp; Hit=1..1072bp; Blast score=1972; Percent Identity=91.0; E value=0; Homolog= ZcarB COG0458
MAKRTDIKSILILGAGPIVIGQACEFDYSGAQACKALREEGYRVILVNSNPATIMTDPEMADATYIEPIHWEVVRKIIEKERPDAILPTMGGQTALNCALELERQGVLTEFGVTMIGATADAIDKAEDRQRFDKAMKKIGLDTARSGIAHTMEEALAVAEDVGFPCIIRPSFTMGGSGGGIAYNREEFEEICERGLDLSPTNELLIDESLIGWKEYEMEVVRDKNDNCIIICAIENFDPMGIHTGDSITVAPAQTLTDKEYQIMRNASMAVLREIGVETGGSNVQFSVNPKNGRLIVIEMNPRVSRSSALASKATGFPIAKIAAKLAVGYTLDELMNDITGGRTPASFEPSIDYVVTKIPRFNFEKFVGSNDRLTTQMKSVGEVMAIGRTFQESLQKALRGLEVGVTGFDPKVNLDDPQSLTKIRSELKSAGAERIWYVADAFRAGMSVDGVFNLTNIDRWFLVQIEELVRLEEQVEEQGINGLTFDFLRHLKRKGFADAHLAKLVGVSGKEIRKLRHDYSLYPVYKRVDTCAAEFSTDTAYMYSTYEDECESNPNHDKPKIMVLGGGPNRIGQGIEFDYCCVHASLALREDGYETIMVNCNPETVSTDYDTSDRLYFEPVTLEDVLEIVRVEKPTGVIVQYGGQTPLKLARELEAAGVPIIGTSPDAIDRAEDRERFQQAVNRLGLKQPANATVSTIEQAVEKGNGLGYPLVVRPSYVLGGRAMEIVYDETDLRRYFQNAVSVSNDAPVLLDRFLDDAVEVDVDAICDGERVLIGGIMEHIEQAGVHSGDSACSLPAYTLSQEIQDVMRQQVEKLAFELRVRGLMNVQFAVKNNEVYLIEVNPRAARTVPFVSKATGLPLAKVAARVMAGQSLLKQGVTKEIIPPYYSVKEVVLPFNKFLGVDPILGPEMRSTGEVMGVGRTFAEAFSKAMLGSSSTMGKNGRALLSVREEDKARVVDLAAKLLKQGFELDATHGTAIVLGEAGINPRLVNKVHEGRPHIQDRIKNGEYNYIVNTTAGRQAIEDSKLLRRSALQYKVHYDTTLNGGFATTMALSADPTEQVISVQEMHAKITG

SEQ ID NO: 7412 - protein, 424 aa, Xenorhabdus bovienii
  Coding DNA sequence: Name=SeqID_1304
  Gene classification: Gene name=CarA; Function=Carbamoylphosphate synthase small subunit; Function class=E Amino acid transport and metabolism
  Homolog annotation: Query=39..417bp; Hit=1..379bp; Blast score=684; Percent Identity=85.0; E value=0; Homolog= carA COG0505
MRAICQNFDKNHQLALIQWIISALICIGCDLLFILEGVLIKLAILVLEDGTQFHGRAIGAEGVAVGEVVFNTSITGYQEILTDPSYSRQIVTLTYPHIGNTGINAADEESPAIQAQGLVIRDLPLVTSNFRSEENLSDYLKRHNIVAIADIDTRKLTRLLREKGAQNGCIIAGNEADAQVALEKAKAFPGLKGMDLAKEVTTAQSYSWLQGSWTLADGLPEARKEQELPYHIVAYDFGVKRNILRMLVDRGCRVTVVPAQTPADEVLKMAPDGIFLSNGPGDPEPCDYAIEAIQAFLNTEIPVFGICLGHQLLALASGAKTVKMKFGHHGGNHPVKDLENNVVMITAQNHGFAVDESTLPANLRVTHKSLFDGTLQGIHRTDKPAFSFQGHPEASPGPHEAASLFDHFIELIEQHRQNHVQNTK

SEQ ID NO: 7413 - protein, 49 aa, Xenorhabdus bovienii
  Coding DNA sequence: Name=SeqID_1305
LFFLGVFTQCRAEICKKANKKGVFCRQAPLSSLECAQFAKILTKIINWH

SEQ ID NO: 7414 - protein, 273 aa, Xenorhabdus bovienii
  Coding DNA sequence: Name=SeqID_1306
  Gene classification: Gene name=DapB; Function=Dihydrodipicolinate reductase; Function class=E Amino acid transport and metabolism
  Homolog annotation: Query=1..273bp; Hit=1..273bp; Blast score=373; Percent Identity=74.0; E value=1e-103; Homolog= ZdapB COG0289
MADTDIRVAVVGASGRMGRHLIQAVQQLDGATLGAALERSGSSLVGTDAGELAGIGKNGITISDDLHGVIEHFDVLIDFTRPEGTLAYLAICRQYRKAMVIGTTGFDDAGKQAIEDASRDIPIVFAANFSVGVNLVLKLLEKAATVMGEYTDIEIIEAHHRHKVDAPSGTALAMGESIAHALGRDLKTCGVYAREGHTGERDPKSIGFATVRAGDIVGEHTAIFADIGERVEISHKASSRMTFANGAIKAAIWLNAKNNDLYDMKDVLNLENL

SEQ ID NO: 7415 - protein, 32 aa, Xenorhabdus bovienii
  Coding DNA sequence: Name=SeqID_1307
MTNWLILVILLFYWDSDREYSEKRLKRYHLRV

SEQ ID NO: 7416 - protein, 462 aa, Xenorhabdus bovienii
  Coding DNA sequence: Name=SeqID_1308
  Homolog annotation: Query=1..462bp; Hit=45..506bp; Blast score=800; Percent Identity=86.0; E value=0; Homolog= ref|NP_931662.1|
MSNRYKTVVVLGAGPIGLFSAFKILENNFSENVLILDKRLNSAHTLKGWAERSMVVQFHRKLFSLSYLPEIMQKCPHGVLKEDYEDNRKKYSDLDHMSIKNIQSTILENIEKNYKNRFFMMGLKDISTDNDIISISISSDDYESNQILSNLSPELIVDATGYHSILMNKTIGVHFESEYEYGSALKITWPEHEMTHIENKETEFHDCHENTLFFSEGNSSVAEFSYPSDKFSRFFEECGYSINHMSTKLPFLKFDTTPFSIKLPPFLEKITSLKKNDFLYKRAVDLFNTIRKNKLAGINGLEFINYLQGFNWSEADNLALVIRRIIDKRVTVENTYTDLEENFLDLTKIRVTFVPSRAERWLSTNKVTTKINLIFSNDNGKLHNQVCSVTACAVGDSLANTDFRHGLGINRGFHTATRLFQDKTDPESVRLELIKNSYSMLDVINDNSIFSRAISCRDWLTL

SEQ ID NO: 7417 - protein, 264 aa, Xenorhabdus bovienii
  Coding DNA sequence: Name=SeqID_1309
  Gene classification: Function=Predicted permeases; Function class=R General function prediction only
  Homolog annotation: Query=5..262bp; Hit=7..262bp; Blast score=79; Percent Identity=27.0; E value=5e-15; Homolog= PM0081 COG0730
MYIDILIIISAFVGSILSGLFGGGAGLIFTPTIYLFLSYTNPNSSYIMQTSITTMIASLMISGLVAIVKHHKYKHIDWNVLKWSAPLIIMGSILGCFTITVASSQSVIYIFSLATIILAIRSTRKLISNNPQNNTNRDLGWSFRYIGGFLLGLISTLSGSASFAVPYYESIGLNIKKSIGTTTVVVWLYSVFVLIFMISLGLNKNNLPPGNIGFLNYNYLWLFIIPTIPGALLGAKLANVLPERKLRISFTALLYFIGLSMLFS

SEQ ID NO: 7418 - protein, 30 aa, Xenorhabdus bovienii
  Coding DNA sequence: Name=SeqID_1310
MTKNIHSHLVAIIYRFANAQAYRLSKVDAL

SEQ ID NO: 7419 - protein, 189 aa, Xenorhabdus bovienii
  Coding DNA sequence: Name=SeqID_1311
MYNSYKLSEINFLNDKHYALYQVGKPRQTWDCELNWKLVANDLIPERLRDTAVTVASLSDNVEILGMENAAGLLLQSNDFFLKIGLAQAVNDEARHSELFAKYAILANGKIKDLSRTRDIYLEHFAELKTFEDIDVFIIARIGEKSAYFFSFMLISHIDINQNSKLVRCQELLNHNNFRVGVYVYQYLI

SEQ ID NO: 7420 - protein, 361 aa, Xenorhabdus bovienii
  Coding DNA sequence: Name=SeqID_1312
LNAEPLQLGILGACFSLPFLFSSYLFGEAFDRYEIRQFRILLFAVNVCVMPSIGLGHSILVLYAAAFIKTAARCGINISNTKLNKNDEETSRFYEIYGYLINFSRIIIPLIVVGTYGLWGIWFVIGLSVILNLLAALSSFFDQTQYHCSEISQITKQSESYSFLEMILKKQKLSILVTAYTISNLAFYLSNDMLGIFFKAIGQNENSIGVIISLMGLGGFAGTKLASFLIKKIMAKSVLLSSIFTNVVAFTCFGFLSSNTTSVLVFYVAIVLVGISSGITFFAVRYGVRNMVGYENVGKATGIIQMLSAVVAIIMPITGGFIANYYGIDTTFRITSIILGITLVYFILFNKKNNKRKHRYV

SEQ ID NO: 7421 - protein, 46 aa, Xenorhabdus bovienii
  Coding DNA sequence: Name=SeqID_1313
MHQEFLTEEVRHSINSNNIKYCIVQICVKFISAYANIFYHFWISII

SEQ ID NO: 7422 - protein, 33 aa, Xenorhabdus bovienii
  Coding DNA sequence: Name=SeqID_1314
MSCLYYNLPCKKIIILLSLDRREDIIDCQPLCA

SEQ ID NO: 7423 - protein, 258 aa, Xenorhabdus bovienii
  Coding DNA sequence: Name=SeqID_1315
MRVFTVNYISKLNDQWREIDYIIDLADEHIYNHIDTYNSLCRSAMVLCVSHMENFYKELVKNFISDIEKMDFKLLPNAMKRQFCRNFIGYEENEENNKKVEILIKELEQHGNFKLSYDAFLPSKNKNPKPRIIESICDNLGTKKIFKQLNGTIFDNVFSMTDKEIEKFGKIIDISVKKRLSKQEKLDTFALTKKTQLIQSKDRSLWESFFDNINRKRHDIAHGNVFENSTSTSELRVIKNKCKIFQKICIIIIFSNLN

SEQ ID NO: 7424 - protein, 33 aa, Xenorhabdus bovienii
  Coding DNA sequence: Name=SeqID_1316
LFNDPGYVDACSGSYNDISKLRTRMIKATELYK

SEQ ID NO: 7425 - protein, 209 aa, Xenorhabdus bovienii
  Coding DNA sequence: Name=SeqID_1317
  Homolog annotation: Query=3..160bp; Hit=119..279bp; Blast score=90; Percent Identity=34.0; E value=2e-17; Homolog= ref|ZP_00072634.1|
MKNKYPLSGLEVLSSLNDAYYKDLPAFLIRRLEERTIKCLRIDSTIDSQVKYDIFERLNTGALKLESQELRNAIYRGPFKDLLIELCSNSDFKNTTNLSDKKIAKMDDQEIILRFFSLHYKDGYKEYKGGFKKFLNDKMEVFNGLSENDLKEMKSKFEETFKRIANSNIEKPFSNWGNKKTIGEVKKKSNFNVAVYDTVCKIYFLGDKK

SEQ ID NO: 7426 - protein, 72 aa, Xenorhabdus bovienii
  Coding DNA sequence: Name=SeqID_1318
  Gene classification: Function=Uncharacterized BCR; Function class=S Function unknown
  Homolog annotation: Query=1..60bp; Hit=1..60bp; Blast score=63; Percent Identity=51.0; E value=4e-11; Homolog= XFa0045 COG3657
MNTIKHYLTSDNRDLYIELLKGIRDSIAKSKISSRVNRMVTGNFGDHKPCRERVWELRVDQAIECLKDYLKR

SEQ ID NO: 7427 - protein, 122 aa, Xenorhabdus bovienii
  Coding DNA sequence: Name=SeqID_1319
  Gene classification: Function=Predicted transcriptional regulator; Function class=K Transcription
  Homolog annotation: Query=13..95bp; Hit=2..80bp; Blast score=70; Percent Identity=43.0; E value=3e-13; Homolog= XFa0046 COG3636
MSEGLFEEVIMTKARLHDDTMVQLLREDTEFAQHYLHQAFVDMDEEGGQEALLMALRHVVEARGGMAQIADKAGVSRETLYRTLSPKGNPTLKTLRNWDSDPSYVRAEEVKIYSYSICFIHD

SEQ ID NO: 7428 - protein, 61 aa, Xenorhabdus bovienii
  Coding DNA sequence: Name=SeqID_1320
MFLVRTTKSYKARITSQHPDYFIVENVDLNKHTFTQRTKADLIMDKTDRIRIYFNFFCSDV

SEQ ID NO: 7429 - protein, 40 aa, Xenorhabdus bovienii
  Coding DNA sequence: Name=SeqID_1321
MFENLTAAASELIPGNIDSYVTGSGEHSQLRRNLKDEGHT

SEQ ID NO: 7430 - protein, 280 aa, Xenorhabdus bovienii
  Coding DNA sequence: Name=SeqID_1322
  Gene classification: Gene name=AraC; Function=AraC-type DNA-binding domain-containing proteins; Function class=K Transcription
  Homolog annotation: Query=7..275bp; Hit=9..276bp; Blast score=261; Percent Identity=49.0; E value=7e-70; Homolog= VCA1001 COG2207
MAKQENVKEYTNFFHLKEFGGLEMLKASYHKQVFSRHVHETFCIGVIEEGAQRFHRTGTEHIAPKGDIILVNADEIHTGSSAGVAGWSYQAIYPPPDLLLSLSRDLKHADGAIPWFPSAVVRDPGLAEQLRMTFDILAQNSNMLLKETMLLSSLSWLIMRHSQTRITTQELPSAERQIFMTKKYIDAYAENDISLSQLAEMAQLSQWHFLRQFKKTIGVTPHVYLIFARLRMARRLLLAGHSILNTAIRCGFSDQSHFNRHFKHALGITPGIFVRSLQTP

SEQ ID NO: 7431 - protein, 51 aa, Xenorhabdus bovienii
  Coding DNA sequence: Name=SeqID_1323
MHWVLLPAYLYAPCKHLSQHLLLTYLVSILPYPDNIFFYRNFIQYSCTLYS

SEQ ID NO: 7432 - protein, 244 aa, Xenorhabdus bovienii
  Coding DNA sequence: Name=SeqID_1324
  Gene classification: Gene name=AzlC (BS); Function=Predicted branched- chain amino acid permease (azaleucine resistance); Function class=E Amino acid transport and metabolism
  Homolog annotation: Query=20..243bp; Hit=25..247bp; Blast score=179; Percent Identity=44.0; E value=2e-45; Homolog= PA2039 COG1296
MEKSLTDTETVVQPAIPSWRSFLSGMYHMLPLCLSVIPWGILAGSVAVQSGLTLGQSIGMSAILFAGAAQLVTLGLLASGASVFTIIISVFFITAQHFLYGLTLREYVAILKARYRLPIGFLLTDELFALSCAQQNKSSLTPSYLIGAGLCFYLCWNLFSLLGIVMASTIPDLAKYHLDFSIVATFITIVIPMIKKISIFCGVCFSLTLSMLLSYLHVEGAIIIAGVSGMFFSVLIAKLAKEST

SEQ ID NO: 7433 - protein, 108 aa, Xenorhabdus bovienii
  Coding DNA sequence: Name=SeqID_1325
  Homolog annotation: Query=1..93bp; Hit=1..93bp; Blast score=108; Percent Identity=62.0; E value=2e-23; Homolog= ref|NP_900374.1|
MSWTLIFVLASIVFFNRYIFLEPKMPVKLPRILNESLKYSAPCLLIAICGPIILMEQGELREFTNNPYLWGALLTTIFAFFIRNLVVCVIISLIGVLYLIRYFIDRRT

SEQ ID NO: 7434 - protein, 385 aa, Xenorhabdus bovienii
  Coding DNA sequence: Name=SeqID_1326
  Homolog annotation: Query=49..385bp; Hit=1..337bp; Blast score=380; Percent Identity=56.0; E value=1e-104; Homolog= ref|ZP_00034556.1|
MKTGIDFYSESTTIRNTYKILPFQGLWSWLTGKDIPNRKSLWKSSSIEMICWSISWVVVGTLVIYFALNSELKLPVKIIIYLIGVLFSTSGARYIVATIIHQGVHGNLLSTQTRNKIICEILSTILITQPYSSYRQFHIYEHHGKDFSTIEDKDLAAIYKLGFTPGKSKKQLYLNLLLTLFSPYFHLSYLYGRIKSNLIGVPVYRFIMTITQFLFLGYLAWFIGIIPFVLFIIVPYVIVYQIASLLHLITEHVWLLRQKKETVRDSHINNSLGRFCGSPCPKSFALRYWLSWIIWAIKHLFYHLPVRMLVLQGSLICHDWHHRTSSIKEWYDYTVLREANAEKLAKEGKYDYIEFWGFHNCLNYVLTMISNAEPVEVSNLKYRLN

SEQ ID NO: 7435 - protein, 317 aa, Xenorhabdus bovienii
  Coding DNA sequence: Name=SeqID_1327
  Gene classification: Gene name=LytB; Function=Penicillin tolerance protein; Function class=I Lipid metabolism
  Homolog annotation: Query=1..317bp; Hit=1..316bp; Blast score=508; Percent Identity=81.0; E value=1e-144; Homolog= lytB COG0761
MQILLANPRGFCAGVDRAISIVERALELYGAPIYVRHEVVHNRYVVDNLRERGAIFIEDIAEVPDGAILIFSAHGVSQAIRAEARSRNLTMLFDATCPLVTKVHMEVARASRKGKEAILIGHAGHPEVEGTMGQYNNPEGGMYLVESPADVWKLQVKDENNLCFMTQTTLSVDDTSEVIDALNARFPNIVGPRKDDICYATTNRQEAVRDLASGADVVLVVGSKNSSNSNRLAELAQRVGKPAYLIDSADDIKSEWIKGVNAIGVTAGASAPDILVQQVIERLKAFGADTVTELHGREENIVFEVPKELRVEVKEVN

SEQ ID NO: 7436 - protein, 156 aa, Xenorhabdus bovienii
  Coding DNA sequence: Name=SeqID_1328
  Gene classification: Gene name=SlpA; Function=FKBP-type peptidyl -prolyl cis-trans isomerases 2; Function class=O Posttranslational modification, protein turnover, chaperones
  Homolog annotation: Query=1..148bp; Hit=1..148bp; Blast score=202; Percent Identity=70.0; E value=8e-53; Homolog= slpA COG1047
MSTQVQVHSAVLLHFTLKLDDGSTADSTYSQGKPALFRLGDGSLSEPLEQQLLGLKVGDKHQFTLAGEAIFGKPNPDLVQYFTPRDFADAGIPEVGTIMLFTAMNGSEMPGLVKEVAEGSIIVDFNHPLADQNITFDIEVLEIDPQLEENHANIAG

SEQ ID NO: 7437 - protein, 39 aa, Xenorhabdus bovienii
  Coding DNA sequence: Name=SeqID_1329
MTRKQHRNHNKKSAPVNGTGADNFIYTQSVSTGICAIIF

SEQ ID NO: 7438 - protein, 169 aa, Xenorhabdus bovienii
  Coding DNA sequence: Name=SeqID_1330
  Gene classification: Gene name=LspA; Function=Lipoprotein signal peptidase; Function class=N Cell motility and secretion
  Homolog annotation: Query=1..163bp; Hit=1..163bp; Blast score=222; Percent Identity=71.0; E value=1e-58; Homolog= ZlspA COG0597
MNKPICSTGLRWLWLVVVVLILDLGSKQLVLQHFTLYESTPLIPYFNLTYAQNPGAAFSFLADKGGWQRWFFALVAIIISAVLLVMMYRSSAKQKLSNAAYALVIGGALGNLFDRLVHGFVVDFIDFYVGEWHWPTFNIADSAICIGAAFIIIESFISPDDKKTASKSQ

SEQ ID NO: 7439 - protein, 937 aa, Xenorhabdus bovienii
  Coding DNA sequence: Name=SeqID_1331
  Gene classification: Gene name=IleS; Function=Isoleucyl-tRNA synthetase; Function class=J Translation, ribosomal structure and biogenesis
  Homolog annotation: Query=1..937bp; Hit=1..938bp; Blast score=1576; Percent Identity=79.0; E value=0; Homolog= ileS COG0060
MSDYKDTLNLPETGFPMRGDLAKREPDMLKRWYKEGLYQAIRKAKSGKKTFILHDGPPYANGDIHIGHSVNKILKDIVIKSKGLSGYDSPYIPGWDCHGLPIELKVEQIIGKPGEKFSAAEFRAECRKYAMSQVEVQRAGFMRLGVLGDWDKPYLTMDFKTEADIIRALGRIIGNGHLLKGVKPVHWCTDCGSSLAEAEVEYYDRTSPSIDVRFKAVDADAVYAKFDIQSLGLPISLVIWTTTPWTLPANRAISLNAEITYQLVKIEDECLILAAELVESVMQRAGMTSWQVLSDCTGADLELLRFNHPFMGFDVPAILGDHVTLEAGTGAVHTAGGHGPDDYSISLKYGLEIANPVGPNGCYISGTYPSLDGVFVFKANDIIVELLQEKGALLNVAKLQHSYPCCWRHKKPIIFRATPQWFISMDQNGLREQSLKEIKGVEWIPGWGQARIESMVENRPDWCISRQRTWGVPMSLFLHKETQELHPRTQELIEEVAKRVEVDGIQAWWDLDTAELLGADAADYMKAPDTLDVWFDSGSTHSSVVDARPEFHGNSADIYLEGSDQHRGWFMSSLMLSTAIKGKAPYRQVLTHGFTVDEQGRKMSKSIGNTVSPQDVMNKLGADILRLWVASTDYSGEIAVSDEILKRSADAYRRIRNTARFLLANLNGFDPEQHMVKAEDMVALDRWAVGRAQAAQADILKCYDEYDFHSVVQRLMQFCSVEMGSFYLDIIKDRQYTAKSDGLARRSCQSALYHIAEALVRWMAPILSFTADEVWNELPGNRAQYVFTEEWYDGLFGLEDGADMNDTFWAELLEVRGEVNKVLEQARADKHIRSSLEAAVTLYADEALAGKLNKLSDELRFVLLTSQVEVATYAAAGDDAQQSELKGLKVAFRKADGEKCPRCWHYAKNVGLVAEHAELCGRCVTNVAGNGEERKFA

SEQ ID NO: 7440 - protein, 314 aa, Xenorhabdus bovienii
  Coding DNA sequence: Name=SeqID_1332
  Gene classification: Gene name=RibF; Function=FAD synthase; Function class=H Coenzyme metabolism
  Homolog annotation: Query=1..305bp; Hit=1..306bp; Blast score=444; Percent Identity=71.0; E value=1e-125; Homolog= ribF COG0196
MELIRGVHNIRARHHGCVLTIGNFDGVHRGHQALLKHLKQEGLRSGLPTMVMIFEPQPLEVFAVDKAPARLTRLRDKIRYLSQYGVDYLLCVKFDRNFATNSPEAFVSRLLVEKLGVKFLAIGDDFRFGKNRLGDFHYLQQAGKQYGFDVASTDSFCDSGLRISSTAIRQALQDDDLALAETLLGHPYSISGRVVHGNRLGRTIGFPTANLPLKRLVAPVKGVYAVEVYGLGDKPLPGVANIGNRPTVSGLGQQLEVHLIDTQMDLYGRHIDVVLRKKLRDEQRFASLDALKQQIANDVVAARDYLLQRSESCI

SEQ ID NO: 7441 - protein, 45 aa, Xenorhabdus bovienii
  Coding DNA sequence: Name=SeqID_1333
VEIAGLYLVQRTRLTHDHKGFLINNLILTIKTGQMPEKYLIYLTS

SEQ ID NO: 7442 - protein, 38 aa, Xenorhabdus bovienii
  Coding DNA sequence: Name=SeqID_1334
LYSDADYVVMGQDFISLLKGNTVFRNKKLNESLRSEIN

SEQ ID NO: 7443 - protein, 61 aa, Xenorhabdus bovienii
  Coding DNA sequence: Name=SeqID_1335
MTCCFIFVDQTFAGMTINNWLHVIECFLCSFFIARSDSYVYFLDKSTHHRTTACIVLTAFL

SEQ ID NO: 7444 - protein, 304 aa, Xenorhabdus bovienii
  Coding DNA sequence: Name=SeqID_1336
  Gene classification: Gene name=LysR; Function=Transcriptional regulator; Function class=K Transcription
  Homolog annotation: Query=1..301bp; Hit=1..301bp; Blast score=493; Percent Identity=78.0; E value=1e-139; Homolog= nhaR COG0583
MRVSHLNFNHLYYFWHVCKEGSVVGAAEALYLTPQTITGQIKALEERLSGKLFKRQGRGLVPSELGQLVFRYADKMFMLSHEMLDIVTYSRESNLLFDVGVADALSKRLVSKVLETTVVEHEKIHLRCFESTHEMLLEQLSQHKLDMILSDCPVDSSQQEGLFSVKLGECSVSFYCRQPIPEKPFPECLEERRLLIPGRRSMLGRKLLTWIRNKNLQVEVLGEFDDAALMKAFGMYHNAIFIAPSFYASDIFVDSDIVEIGRLDAVQEEYYVIFAERMIQHPAVQRVCNKDFSALFSAPLKKYH

SEQ ID NO: 7445 - protein, 398 aa, Xenorhabdus bovienii
  Coding DNA sequence: Name=SeqID_1337
  Gene classification: Gene name=NhaA; Function=Na+/H+ antiporter; Function class=P Inorganic ion transport and metabolism
  Homolog annotation: Query=1..388bp; Hit=1..381bp; Blast score=392; Percent Identity=62.0; E value=1e-109; Homolog= VC1627 COG3004
MTAIIRQFLKLEAAGGIILIIAAIVALVLANTPLQGIYHQFLNLPVAVQFAALEINKPLLLWINDGLMAVFFLIVGLEVKRELMEGSLAGRDKAVFPAIAAVGGMIAPALVYLLFNGGDEITRQGWAIPAATDIAFALGVMALLGKRVPTALKVFLLALAIMDDLGVIIIIALFYTKTVSLTALGLAGAMIALLVWMNWRGIAKTSAYLMVGAVLWVCILKSGVHATLAGVIVGFMIPLRCKKGHSPSESLEHGLHPWVAYLILPLFAFAKAGVSLQGVTLNGLTGMLPVGIALGLFIGKPLGIFLFSWISVKLGVAKLPEKIDLRQIFAVSVLCGIGFTMSIFISGLAFEGLNDAFSTYSRLGILIGSTAAAVIGYGLLNILLPKRKHRQTQMNRLI

SEQ ID NO: 7446 - protein, 33 aa, Xenorhabdus bovienii
  Coding DNA sequence: Name=SeqID_1338
MIKTAFDTYINIPITEKMLLSQCYNSIIPIHIA

SEQ ID NO: 7447 - protein, 281 aa, Xenorhabdus bovienii
  Coding DNA sequence: Name=SeqID_1339
  Gene classification: Gene name=RhaT; Function=7 Permeases of the drug/metabolite transporter (DMT) superfamily; Function class=G Carbohydrate transport and metabolism
  Homolog annotation: Query=1..281bp; Hit=1..281bp; Blast score=160; Percent Identity=42.0; E value=1e-39; Homolog= mll3062 COG0697
MTTFLLLSVLAAALLHASWNALVKISADRFLGISIIVFFAGLISTSGLFWVGLPTPASLPWLILSSILHIGYCLFLSRSYATGDLSQVYPIARGCAPLITILLSWIILQEVLPPFARLGVGLIIAGVILIAFPHGKKSIRMDRRTLIAALTTSIFTACYTLSDGIGSRASDNALTYILWLFAIHGWSMGVIIYFKYRKTAGQNVRQYWKQGLLGGLMQLLSYGIVIWAMSHASIVIVAALRETSVLFAVLLSVFILQEPFSKIRLLACVVIVAGIICTKLG

SEQ ID NO: 7448 - protein, 378 aa, Xenorhabdus bovienii
  Coding DNA sequence: Name=SeqID_1340
  Gene classification: Gene name=DnaJ; Function=Molecular chaperones (contain C-terminal Zn finger domain); Function class=O Posttranslational modification, protein turnover, chaperones
  Homolog annotation: Query=1..378bp; Hit=1..376bp; Blast score=603; Percent Identity=83.0; E value=1e-173; Homolog= ZdnaJ COG0484
MAKKDYYEVLGISKTTEEKEIKKAYKRLAMKYHPDRNQGDKEAESKFKEIKEAYEILTDAQKRAAYDQYGHAAFEQGGMGGGAGGFGGGADFSDVFGDVFGDIFGGGRRQQRPSRGSDLRYNMDLTLEEAVRGVTKEIRIPTLESCDTCHGSGAKAGTSPETCSTCQGAGQVHMRQGFFTVQQPCPQCHGRGKVIKTPCGKCHGHGRVEKYKTLSVKIPAGVDTGDRIRLGGEGEAGEHGAPAGDLYVQVQVKAHHIFERDGSNLYCEVPINFAIAALGGEIEVPTLDGRVSLKIPAETQTGKLFRMKGKGVKSVRGGAQGDLLCRVVVETPVKLNDEQKDLLRKLGESLGGKSGEANSPRSKSFIDGVKKFFDDLTK

SEQ ID NO: 7449 - protein, 634 aa, Xenorhabdus bovienii
  Coding DNA sequence: Name=SeqID_1341
  Gene classification: Gene name=DnaK; Function=Molecular chaperone; Function class=O Posttranslational modification, protein turnover, chaperones
  Homolog annotation: Query=1..634bp; Hit=1..638bp; Blast score=1020; Percent Identity=88.0; E value=0; Homolog= dnaK COG0443
MGKIIGIDLGTTNSCVAIMDGTTARVLENSEGDRTTPSIIAYTQDGETLVGQPAKRQAVTNPQNTLFAIKRLIGRRFQDEEVQRDVSIMPYKIIGADNGDAWLEVKDQKIAPPQISAEVLKKMKKTAEDYLGEPVTEAVITVPAYFNDAQRQATKDAGRIAGLEVKRIINEPTAAALAYGMDKEVGNRTIAVYDLGGGTFDISIIEIDEVDGEKTYEVLATNGDTHLGGEDFDSRLINYLVDEFKKEQGFDLRNDPLAMQRLKEAAEKAKIELSSAQQTDVNLPYITADATGPKHMNVKVTRAKLESLVEDLVKRSMEPLKVALNDAGLSVSDIQDVILVGGQTRMPMVQKTVADFFGKEPRKDVNPDEAVAMGAAVQGGVLSGEVKDVLLLDVTPLSLGIETMGGVMTALITKNTTIPTKHSQVFSTAEDNQSAVTIHVLQGERKRSGDNKSLGQFNLDGIQPAPRGMPQVEVTFDIDADGILHVSAKDKNSGREQKITIKASSGLNEEEIQQMVRDAEANAEADRKFEELVQIRNQADQLIHGTRKQVEEAGDKLTADDKAGIEKAVSELEVAVKGEDKAETEAKIQALVEASKKLLEIAQQQAQEGAAEAGTAKKDDDVVDAEFEEVKDKK

SEQ ID NO: 7450 - protein, 32 aa, Xenorhabdus bovienii
  Coding DNA sequence: Name=SeqID_1342
MRRPLRFIGAVRCHKAFLISCFICFFQRKYAF

SEQ ID NO: 7451 - protein, 190 aa, Xenorhabdus bovienii
  Coding DNA sequence: Name=SeqID_1343
  Gene classification: Function=Predicted membrane protein; Function class=R General function prediction only
  Homolog annotation: Query=1..186bp; Hit=1..186bp; Blast score=217; Percent Identity=72.0; E value=5e-57; Homolog= yaaH COG1584
MHSNQLANPGPLGLMGFGMTTILLNLHNAGFFPLASAILSMGIFYGGLAQVLAGIIEYKKGNTFAATAFTSYGMFWLSLIGLLFLPAMGLAGATSHEFLGVYLALWGIFTLFMFFGTLKANRVLQFVFGSLTLLFALLAIGNITGNASLLTFAGYEGIVCGASAFYLAMAEVLNEQYGRTVLPIGEVKHA

SEQ ID NO: 7452 - protein, 423 aa, Xenorhabdus bovienii
  Coding DNA sequence: Name=SeqID_1344
  Gene classification: Gene name=ProP; Function=77 Permeases of the major facilitator superfamily; Function class=G Carbohydrate transport and metabolism
  Homolog annotation: Query=7..423bp; Hit=13..429bp; Blast score=509; Percent Identity=66.0; E value=1e-144; Homolog= PA5370 COG0477
MSQHHNRALNKQDYKTLSLAALGGALEFYDFIIFVFFAVVLGELFFPADIPVWLRQLQTFGIFAAGYLARPLGGIIMAHFGDLIGRKKMFSLSILLMALPTLIIGGLPTYDTIGIAAPVLLLLMRIMQGAAIGGEVPGAWVFVAEHVPHKRIGFACGTLTAGLTIGILLGSLVATIITSIYTRQEVLDWAWRLPFFIGGAFGLCAMYLRRWLQETPVFREMQERKALAEGLPLKSVILNHKHAIIVSMLLTWLLSAGIVVVILMAPTYMQTVFHLEQSLTLKANSLAIIMLAIGCILAGHLCDKWGASLVLVAGCALLAVASWFFYHNISDEPGRLFSAYAVAGFSVGVLGAVPFVMVQSYPPEVRFSGISFSYNMSYAIFGGLTPIFVTLLQAYTQFAPAYYVLVLSAVGILLGLHLRVRKK

SEQ ID NO: 7453 - protein, 41 aa, Xenorhabdus bovienii
  Coding DNA sequence: Name=SeqID_1345
MTLRIKTNMNSCVIRIKSMTSLRINILKYRISLIFICFKVW

SEQ ID NO: 7454 - protein, 191 aa, Xenorhabdus bovienii
  Coding DNA sequence: Name=SeqID_1346
  Gene classification: Gene name=Dfp; Function =Phosphopantothenoylcysteinesynthetase/decarboxylase; Function class =H Coenzyme metabolism
  Homolog annotation: Query=14..182bp; Hit=3..166bp; Blast score=65; Percent Identity=31.0; E value=3e-11; Homolog= aq_815 COG0452
MKYDETNQKIKPRILIGATGSVDIVLLPRYLSAIKAAIDCTLTVLMTSSAIPFLPAETVALYADRVISGEKPQDWPTDKPSRIVADHDLMAVLPATANTMASAAHGATPNRLTTVILASTFPVLFFPVMGSVMWEKNATRRNISQLNDDGYHVIEPVWHENFDASLQKMVGHPSLPDIETVISLLKQYLPK

SEQ ID NO: 7455 - protein, 280 aa, Xenorhabdus bovienii
  Coding DNA sequence: Name=SeqID_1347
  Homolog annotation: Query=2..260bp; Hit=15..272bp; Blast score=259; Percent Identity=49.0; E value=4e-68; Homolog= gb|AAL15596.1|AF322256_17
MLLAVSDLHVSHAANRAIVDSFRPSTPDDWLLLVGDIAEQESDFTWVISTLSQRFAQVIWTPGNHELWCSPRDPVKLPGVLRYEHLVNICRQHNVLTPEDEFHRYPMGDGTFVTIAPIFTLYDYSFRNAIDYTADQAIERARRCGIISSDEFFLKTYPHKNIIEWCRERIQYTEKRLNHIQDGEGIVLMSHFPIIRKPTESLRNTEFSIWCGSEKTRQWASRKGVHMVVYGHLHIPNIEYIHGVAHVEVSLGYPREWQERGRHFCLVALDEWLEYASEYR

SEQ ID NO: 7456 - protein, 167 aa, Xenorhabdus bovienii
  Coding DNA sequence: Name=SeqID_1348
  Gene classification: Function=Hemoglobin-like proteins; Function class=R General function prediction only
  Homolog annotation: Query=14..167bp; Hit=1..153bp; Blast score=145; Percent Identity=47.0; E value=2e-35; Homolog= mlr0267 COG2346
MTTSFMYSYERYVMANEKPTLFEWMGGREKLMHLMEVFYAKVEKDELLEPLFKNMKADHPGHVGMWLEEVLGGESRYTDERGGFKVMLSRHRGRSIQPEQRTRWVELLMKSADEIGLPSDPEFRSAFAAYIEWGSRRAEANSQPDAAPSRRETVPKWGWGEAPPGTP

SEQ ID NO: 7457 - protein, 306 aa, Xenorhabdus bovienii
  Coding DNA sequence: Name=SeqID_1349
  Gene classification: Gene name=WecD; Function=Histone acetyltransferase HPA2 and related acetyltransferases; Function class=K Transcription
  Homolog annotation: Query=22..306bp; Hit=3..285bp; Blast score=134; Percent Identity=31.0; E value=8e-32; Homolog= sll1469 COG0454
MFVSAFIPQYCWKDILDMSEKSNNKCVFKRVTASEWRSTIFHWANTEQWNMVESDISRFFNVDPHGFFITYRNGMPISSMSMVNYSDTYTHAGHYIVPPEFRNHVCAGKIWKSSIAYAEHRTISCDGNSHISSLYEKRGFVPHYRTFRMSGVIIQPVIQPAEALPITQANIADVIKYDAECTGVCRGRLLTDWFWGEGRYGFCTRSDTGVTGIIGIRKSTDGYRLGPFHADNVDVLETLFRAALAQVPAGEAVTFDAPETDNNQFIPLAKEYGLRELFYTFRMYKGNVIPKGHLEKLRAIASLELG

SEQ ID NO: 7458 - protein, 39 aa, Xenorhabdus bovienii
  Coding DNA sequence: Name=SeqID_1350
MGHHSNNEHLVNEYTDARVDKRCSSPHLYRNIVGRIYWI

SEQ ID NO: 7459 - protein, 378 aa, Xenorhabdus bovienii
  Coding DNA sequence: Name=SeqID_1351
  Gene classification: Gene name=CaiA; Function=Acyl-CoA dehydrogenases; Function class=I Lipid metabolism
  Homolog annotation: Query=11..378bp; Hit=19..386bp; Blast score=367; Percent Identity=47.0; E value=1e-101; Homolog= Rv2724c COG1960
MRIEIDNFDDYRKSCREFLEREIVPEHQAWEDNGLMERSFWEKLGQSGLLGISVSPEYGGLGKHDYRFAVILTEELIRAGVTVPGIVAHNDIIASYIFALGSGEQKQKWLPELCLGKRVAAIAMTEPSGGSNTADIKTVAKRQGDHYLVNGGKTYITNGINADLIVVAVKTEQGQQGQGISLLVIERDMAGFSRGEPMKKIGWNGSDTAELFFHDCKVPVTNLIGRENLGNYYFMSAMPRERLSISAVAVASAEHILQSTLAYVKERKAFDQPIGSFQYNRFILAQLDTEVKIARVYLDNAVEQFSKGLFSLVDAARIKWWTTELQMKVADRCLQLHGGAGYMRDSVAGKNWLNSRAQTIYGGTSEVLQEMISKSMGL

SEQ ID NO: 7460 - protein, 245 aa, Xenorhabdus bovienii
  Coding DNA sequence: Name=SeqID_1352
  Gene classification: Gene name=GrsT; Function=Predicted thioesterase involved in non-ribosomal peptide biosynthesis; Function class=Q Secondary metabolites biosynthesis, transport and catabolism
  Homolog annotation: Query=9..226bp; Hit=9..219bp; Blast score=78; Percent Identity=25.0; E value=7e-15; Homolog= PA2425 COG3208
MNINCRRVIYAFPHAGATTAIYRPWLNDLAATKAAILQPVAIPGRGYLAKEPEVHELGPLIDRLASDIWADFQQKQVQGITEWITFGHSFGGVLSVAVGQVLHERYGLTPQFGVVSCSVPPQLQPYDERHEWTDEQLIQKTREDQGTPEAILNEPALIKPIIRQLRNDYLIRSQFPQLGNIQVDYPLVLVSASQDIHVGLADMQAWKNHTSHKTSLIRIEGDHFAVYRHWDVIKQILLSDSGTQQ

SEQ ID NO: 7461 - protein, 543 aa, Xenorhabdus bovienii
  Coding DNA sequence: Name=SeqID_1353
  Gene classification: Gene name=BetA; Function=Choline dehydrogenase and related flavoproteins; Function class=N Cell motility and secretion
  Homolog annotation: Query=5..537bp; Hit=3..533bp; Blast score=229; Percent Identity=32.0; E value=6e-60; Homolog= mll3225 COG2303
MTKTYDYIVVGGGSAGCVAASRLSENGTKSVLLLEAGHASDVNDPASPLRDASRLVLEGYNWDYEANVRSEDRFADLISPSHYLQEEKKQERKHRGRKPFNYRVGKVLGGSSAVNGAIAFRGFPSDFEQWVKMGCPRWSWEQVLPWFKHLENDVDRTGDDNHGSLGPMCLRRPQHEEIHPLDMAFARACEQSGVPYVDDLNAGEAPAVGPVPANVINGAERVDVYRSYLEPVLHRKNLHVMTDVLVAQIIFNGTAASGVKVIQAGEEQVYHTEHIVLCAGAIGSATLLQRSGVGDPEHLRALGIPVIAELPAVGRNLTDHASVVLWSLPKTGVCTTGLPWRQIAARISSGYDTKVDVQIGLLNNVASETVPGFKDRVAYPMLVGASVMLMRPQALGRVFISTADPTVLPQIDLPLTRNPADIARLVGGVRKIWEALRHPEVDAFLDGIQFWSHSMIYNDEIMNSAIKNLVNPGWHASGTLRMGAGSDPDCATQEDGQVHGITGVTVADASLFPTIPSMPTNLTTIMTAERIVSFLIARRENEH

SEQ ID NO: 7462 - protein, 337 aa, Xenorhabdus bovienii
  Coding DNA sequence: Name=SeqID_1354
  Gene classification: Gene name=EntF; Function=Non-ribosomal peptide synthetase modules and related proteins; Function class=Q Secondary metabolites biosynthesis, transport and catabolism
  Homolog annotation: Query=21..335bp; Hit=688..989bp; Blast score=204; Percent Identity=35.0; E value=1e-52; Homolog= BS_srfAA_2 COG1020
VTGSLSICLSGFRENLPNTAIISLGGATEGSIWSICYPIEDIDKNWKSIPYGKPLANQKFHVLNNWLSPCPNWVTGELYIGGEGVTLGYLGDLEKTAQRFITHPVTSERLYKTGDLGRYMANGLIEILGREDNQVKINGYRIELGEIEACLLTHENAGHVVMDAPVHAKTGQRHIVAYVVPSAADTSEEPTHFQEQLREIARNTLPSYMVPSYYVLLAHMPLTSNGKIDRKALPLPWADSEEHTAIAVDPANEIETKILQLWQAQLQHDDFDVTDGFFDIGGDSLHAVGLLSALRQEFNITPAGEQDIIEGLFMNSNIQAFSRIIGTIMQSQAVSDL

SEQ ID NO: 7463 - protein, 838 aa, Xenorhabdus bovienii
  Coding DNA sequence: Name=SeqID_1355
  Gene classification: Gene name=EntF; Function=Non-ribosomal peptide synthetase modules and related proteins; Function class=Q Secondary metabolites biosynthesis, transport and catabolism
  Homolog annotation: Query=69..826bp; Hit=69..792bp; Blast score=359; Percent Identity=32.0; E value=8e-99; Homolog= PA4225_1 COG1020
MQHFLRALQESGLQVSLSSSELAELENKNTEAGISHLTQQIHEMLCSVLPLNMTIPKTLFTKESTTDDFPLTDIQYAYLIGRNPGLELGGRTSCLYTEWDVKSLDIKALNDALNKVVEYHPMLRTALSSDGQQRVLSESLTYTISIQDGRAWPASEKDKQLADIRQKMETQLLPVDKIPSFDIRATILSDEIIRLHLYFDLMFMDLHSVRLVLRDWGRVYQGCELPELDDEANFQNYIKAERYLQGQPQGQYDKAYWEQQFDNLPPSPELPLKNAPELISPPMFKRYSRKIATETLSALKKKAEQQKLTLETLLLGAYAEVLRQWSKRQTFTLTITQLGRRPYFAEVENIVGNFLQPTLLAIQGTEDDSFNDRLVQLQTDLLMNRWHSSYNGVQVLRELTRRSHGSRAVSAPVVFSNTLTANLDDVVTDMDWAGTVQVYSSNQTPQVWLENQIVRLDGIVQINWNTVNELFPDGMVEAMLDSYMALLIACAEDDSVWGKTGSLVKLPASDMAERAKANATDIDLAPQLLHEMILQAAEKFPHSIALVQGEKHFTYAEMVKGASEVAKSLRASVQIHPNDIVAVSLPQGPALVLGVLGILMSGAAYVAIDPQLPAERRMNLLRRCSTKGIVTESSLFNEGELADLFRINLDECLMSEAMDTEQKVSAHFSSVQALDDLAYVIFTSGSTGEPKGVMASHRNAANTVLDINRKFHVTEKDTVLSVAPAGFDLSVYDYFGVLGAGGKVVFSTSETANDPKIWFETLVKHQITIWNSVPAPVKVLVDRNGADLAQTQVRLILMSGDWIPIDLPERIPGKSAQYGDHQSWWRNRRFYLVDMLSN

SEQ ID NO: 7464 - protein, 165 aa, Xenorhabdus bovienii
  Coding DNA sequence: Name=SeqID_1356
  Homolog annotation: Query=9..158bp; Hit=7..156bp; Blast score=141; Percent Identity=49.0; E value=4e-33; Homolog= ref|NP_800296.1|
MNEGLELIVRSVLIGAGATVVMDLWAVFIKRSFGVPSLNYSMVGRWIGHIPKGIFVHKSIVQAEPVKGETGIGWFAHYLIGIIFAGLLLLIWGLDWAKNPTLIPALIVGVVTVVAPYFIMQPGMGMGIAASKTPTPNIARLRSLMAHTSYGVGLYLAALFLTLFS

SEQ ID NO: 7465 - protein, 40 aa, Xenorhabdus bovienii
  Coding DNA sequence: Name=SeqID_1357
LNHLSDTRSVQKTLILLHSMNLLNVIILEAKCQCLINNSR

SEQ ID NO: 7466 - protein, 68 aa, Xenorhabdus bovienii
  Coding DNA sequence: Name=SeqID_1358
LRCCRCWEVLATDRPDKSDRRSTDCSVSAKHSSSVRRWVFPSTLAISAISTRVVYQTLTFGFQYYYIQ

SEQ ID NO: 7467 - protein, 183 aa, Xenorhabdus bovienii
  Coding DNA sequence: Name=SeqID_1359
  Gene classification: Gene name=PspE; Function=Rhodanese-related sulfurtransferases; Function class=P Inorganic ion transport and metabolism
  Homolog annotation: Query=77..181bp; Hit=1..105bp; Blast score=109; Percent Identity=49.0; E value=2e-24; Homolog= Rv1674c_2 COG0607
LADTEQSVERLSDLSGLSVANTSQHLQHLKRVGLLQSRKEGKHVLYRQGEGPITDIISALLQYAEFNRTEMRRLIDDTNNQESISWEELLDRIKEKSMTLLDVRPKEEFEQGHLPNAINIPVDELGNRLDELSASQELIAYCRGPYCVLSANALELLRAKGVRARRFKKGFSGWKDAGMRIEV

SEQ ID NO: 7468 - protein, 33 aa, Xenorhabdus bovienii
  Coding DNA sequence: Name=SeqID_1360
MTLVSNHVPINTTVISPNEYEGHLFLWRERCLQ

SEQ ID NO: 7469 - protein, 57 aa, Xenorhabdus bovienii
  Coding DNA sequence: Name=SeqID_1361
MTVVLIGTWLDTNVIADTSFPLRKYLVDYLILSILIRQTTQISNTNHYTYLNPHIKL

SEQ ID NO: 7470 - protein, 273 aa, Xenorhabdus bovienii
  Coding DNA sequence: Name=SeqID_1362
  Homolog annotation: Query=3..273bp; Hit=12..277bp; Blast score=256; Percent Identity=46.0; E value=2e-67; Homolog= ref|NP_931592.1|
MKNERRHFLKQAGVTGAVFSLLPLLPAGALASSPSQLKKEDGIGIGICEMTPEEMSGPYFINNKLLRRNITEDEQGIPLLLTMKVTDSVTCKPLDDILIDIWHCNAMGKYSGWKYINPDLEAPSDNIGTISRTDESTFLRGAQRTDKEGIVRFTTIFPGFYAGRAIHIHLSARSANVQKRQEDKFYFVGQLYFPEDISKEVMINDMYSPREINRLKNEDDSIFSGVKNRAAILTVKKIGDNPLDGLHGKIVLSINKDHVSKKITPKDLAKYTV

SEQ ID NO: 7471 - protein, 30 aa, Xenorhabdus bovienii
  Coding DNA sequence: Name=SeqID_1363
MRLCFSASKAVLNIEFLLFLEHKVFFRYRL

SEQ ID NO: 7472 - protein, 80 aa, Xenorhabdus bovienii
  Coding DNA sequence: Name=SeqID_1364
  Gene classification: Function=Putative transposase; Function class=L DNA replication, recombination and repair
  Homolog annotation: Query=11..55bp; Hit=30..74bp; Blast score=77; Percent Identity=77.0; E value=3e-15; Homolog= XF2303 COG3316
MMSLTREALKRLHYPVDIIAQCVCWYLAYALSLRNLEEILAERGIAVDHSTLSCWSCIQYVYCKFYCVEQIAAYNTKITL

SEQ ID NO: 7473 - protein, 44 aa, Xenorhabdus bovienii
  Coding DNA sequence: Name=SeqID_1365
MILIVDNAGIAKFNILNTQPKNEILKMTCQSKSEISHVMFYIKI

SEQ ID NO: 7474 - protein, 52 aa, Xenorhabdus bovienii
  Coding DNA sequence: Name=SeqID_1366
MILVLYTKHRLLNKPIQIMKNLGMQLRWYLGVLKKASMLLIYLSTMISRLNL

SEQ ID NO: 7475 - protein, 288 aa, Xenorhabdus bovienii
  Coding DNA sequence: Name=SeqID_1367
MEKKDKAIKTHSVFDSDKSTLSEEENIHHGENPISLSPNESDVILIDDAESLENDTSPHASYFIKDTHGRTLCIDDRDKKVLYFEVDEKPAFMGSEDYSANFIMLQLRDKKIPENSIKMIGEYNDKKYVMYAYDNSIDLTSTKLYWHTRNPSIDDRQISFNKEYVKTEKGLKQYRLVWNNQGTEMFLYSHSHDESRSLLTENHKKYSLFTLHADFIKEKLIQPLVKKTWPNIKLRLSTFRILDPFYKLVSDEKVKKIYKESGLKNFKYRKNSFDCDDFSFVYKAQASK

SEQ ID NO: 7476 - protein, 40 aa, Xenorhabdus bovienii
  Coding DNA sequence: Name=SeqID_1368
MLIQNWHLAMSRFMIEFTEEKQLTPSFTDSFQTQNPFFEY

SEQ ID NO: 7477 - protein, 206 aa, Xenorhabdus bovienii
  Coding DNA sequence: Name=SeqID_1369
  Gene classification: Gene name=MoaB; Function=Molybdopterin biosynthesis enzymes; Function class=H Coenzyme metabolism
  Homolog annotation: Query=16..206bp; Hit=1..191bp; Blast score=321; Percent Identity=84.0; E value=3e-88; Homolog= mog COG0521
MSDIFSLFFLLIEVRMNVLRIGLVSVSDRASNGVYQDKGLPALETWLEKAITTPFSVETRLIPDEQILIEQTLCELVDERGCHLVLTTGGTGPARRDVTPDATLAIADREMPGFGEQMRQISLQFVPTAILSRQVGVIRHQALILNLPGQPKAIAETLEGLKDASGKVLVSGVFASVPYCIQLLDGPYVETDEKVVAAFRPKSARR

SEQ ID NO: 7478 - protein, 317 aa, Xenorhabdus bovienii
  Coding DNA sequence: Name=SeqID_1370
  Gene classification: Gene name=MipB; Function=Transaldolase; Function class=G Carbohydrate transport and metabolism
  Homolog annotation: Query=1..317bp; Hit=1..317bp; Blast score=540; Percent Identity=84.0; E value=1e-153; Homolog= talB COG0176
MTDKLTSLRKLTTVVADTGDIAAMKLYQPQDATTNPSLILNAAQIPEYRQLINEAIEWARGQSDSREQQIIDAGDKLAVNIGLEILKLIPGRISTEVDARLSYDTEASVAKAKRLIKLYNEAGISNDRILIKLASTWQGIRAAEQLEKEGINCNLTLLFSFAQARACAEAGVYLISPFVGRILDWYKANGDKKEFAPHEDPGVISVAEIYQYYKEHGYNTVVMGASFRNSGEILELAGCDRLTISPALLKELSETAGEVECKLGYEGEIKVRPARLTEAEFYWEHHQDAMATEKLAEGIRKFAVDQGKLESMIADLL

SEQ ID NO: 7479 - protein, 43 aa, Xenorhabdus bovienii
  Coding DNA sequence: Name=SeqID_1371
MILFRYDFVSNRFPHNAGFLNFSKNKLKRANNSDKIFLPYSSA

SEQ ID NO: 7480 - protein, 278 aa, Xenorhabdus bovienii
  Coding DNA sequence: Name=SeqID_1372
  Gene classification: Function=Uncharacterized BCR; Function class=S Function unknown
  Homolog annotation: Query=21..277bp; Hit=1..257bp; Blast score=387; Percent Identity=75.0; E value=1e-107; Homolog= ZyaaA COG3022
LRKPALWGKRFETKSYRNKIMLITISPAKTLDYESPLATEKYSQPALLEESKQLIDVCRTLTPAQIGSLMGISDKLAGLNAARFGEWQPNFTPENARQAILAFKGDVYTGMQAETFSDADFGFAQTHLRMLSGLYGVLRPLDLMRPYRLEMGIRLENPRGKDLYKFWGDLITENLNAALEQQGDDVLVNLASDEYFKSVNTKKLAAQIIKPIFLDEKNGKYKVISFYAKKARGLMSRFIIQNQLTDPARLVEFNLEGYAFDESLSKGSERVFKRPEQH

SEQ ID NO: 7481 - protein, 430 aa, Xenorhabdus bovienii
  Coding DNA sequence: Name=SeqID_1373
  Gene classification: Gene name=ThrC; Function=Threonine synthase; Function class=E Amino acid transport and metabolism
  Homolog annotation: Query=1..425bp; Hit=1..425bp; Blast score=666; Percent Identity=80.0; E value=0; Homolog= thrC COG0498
MKLYNLKDSSEQVSFSQAVKQGLGRQQGLFFPQDLPEFSRDEIDELLKLDFVSRSQRILSAFIGDEIPAEQLVARVKNAFAFPAPVTGVEDDIASLELYHGPTLAFKDFGGRFMAQILAQIAGEQPVTILTATSGDTGAAVAHAFYGLDNVQVVILYPEGKISPLQEKLFCTLGGNIHTVAIKGDFDACQALVKQAFDDEELKRALYLNSANSINISRLLAQICYYFEAVAQIPAEKREQLVISVPSGNFGNLTAGLLAKSLGLPVKRFIAATNVNDTVPRYLSEGAWQPHQTVATLSNAMDVSQPNNWPRIEELFQRKGWSLSELANGVVDDSTTQATMQELAAKGYISEPHAAVAYRVLRDQLQAGEYGLFLGTAHPAKFKESVEVILGQPLPLPQELAERTDLALLSHFLPADFASLREFLMERAPK

SEQ ID NO: 7482 - protein, 316 aa, Xenorhabdus bovienii
  Coding DNA sequence: Name=SeqID_1374
  Gene classification: Gene name=ThrB; Function=Homoserine kinase; Function class=E Amino acid transport and metabolism
  Homolog annotation: Query=8..313bp; Hit=1..306bp; Blast score=447; Percent Identity=68.0; E value=1e-126; Homolog= ZthrB COG0083
MEIGGLMVVRIYAPASIGNVGVGFDVLGAAVSPVDGSLLGDCVSVCEAERFSLSNEGRFAGKLPADPKHNIVYQCWQLFCQRLGKKLPVAMTLEKNMPIGSGLGSSACSVVAALVALNEYAGCPFDSNQLLDMMGELEGRVSGGVHYDNVAPCYLGGLQLLLAQENAVCQSVPIFDDWLWVMAYPGIKVSTSEARAILPANYSRGDMINHGRYFAGFIHACHTQQSELAAKLMKDVVAEPYRTQLLPGFANARNGVKKLGALVCSISGSGPTLFAICDDMAVAKEVAQWLQQHYVQNDEGFVHICRLDLAGARQVG

SEQ ID NO: 7483 - protein, 819 aa, Xenorhabdus bovienii
  Coding DNA sequence: Name=SeqID_1375
  Gene classification: Gene name=LysC; Function=Aspartokinases; Function class=E Amino acid transport and metabolism
  Homolog annotation: Query=1..460bp; Hit=1..460bp; Blast score=707; Percent Identity=76.0; E value=0; Homolog= thrA_1 COG0527
MRVLKFGGTSVANYQRILSVADIAESELSLGQVALVLSAPAKITNHLVAMIDKTVAGQDIVSNMSDVSQIFADLLSGLKEHQPNFDYEYLKGIVERELAYLKQTLHGISLLKQCPDSINAALICCGEKLSIAIMGAVLQARGHKVTVIDPVKNLLSHGHYLESTVDIHESSKRIAALNIPAEHIILMAGFTAGNDNGELVVLGRNGSDYSAAVLAACLRADCCEIWTDVDGVYTCDPRAVPDARLLKSLSYQEAMELSYFGAKVLHPRTIAPIAQFQIPCLIKNTANPDAPGTFIGEGHKDENLPVKGITNLNNMAMINVSGPGMKGMVGMAARVFSVMSRKGISVVLITQSSSEYSISFCVPQKELTKAQKALTEEFYLELKDGVLDPIDVIDNLSIISVVGDGMRTQRGISARFFSALTRANINIIAIAQGSSERSISAVIDNDTATTAVRLCHQMLFNTAQVVEVFVVGVGGVGSALIEQIRRQQSWLKQKHIDLRVCGIANSRAMLTDMQGIGLDNWQQSLSEATEPFSLSRLIRLEKEYHLLNPVIVDCTSNQSIAEQYASFLGDGFNIVTPNKKANTLSMAYYRQIRQAAEKSKRKFLYDTNVGAGLPVIENLQNLLNAGDELVQFNGILSGSLSYIFGMLDEGMTLSQATLLAKEKGFTEPDPRDDLSGMDVARKLLILARESGYELELENIHVEPVLPAAFDASGDVGSFLQRLPQLDQEFTHRVADAAEQGKVLRYVGIIEQGRCRVKIAAVDGNDPLYKVKNGENALAFYTRYYQPIPLVLRGYGAGNDVTAAGVFADILRTLSWKLGV

SEQ ID NO: 7484 - protein, 71 aa, Xenorhabdus bovienii
  Coding DNA sequence: Name=SeqID_1376
VPPNFSTRISISLLIYVQKKARILWDTGFLLFYVYASARPVTHSSGGNRRSGFCSNLIFRADMAHDFLSVF

SEQ ID NO: 7485 - protein, 38 aa, Xenorhabdus bovienii
  Coding DNA sequence: Name=SeqID_1377
LLPKIAKKNRICMTQAVIIKRKYADLVLNYRKRSSCPK

SEQ ID NO: 7486 - protein, 238 aa, Xenorhabdus bovienii
  Coding DNA sequence: Name=SeqID_1378
  Gene classification: Gene name=OmpR; Function=Response regulators consisting of a CheY-like receiver domain and a winged-helix DNA -binding domain; Function class=T Signal transduction mechanisms
  Homolog annotation: Query=1..238bp; Hit=1..238bp; Blast score=433; Percent Identity=92.0; E value=1e-122; Homolog= arcA COG0745
MQTPHILIVEDEIVTRNTLKSIFEAEGYVVYEATDGSEMHNILSDNDINLVIMDINLPGKNGLLLARELREQANVALMFLTGRDNEVDKILGLEIGADDYITKPFNPRELTIRARNLLSRTMNLSHSGEERRQVESYKFNEWELDINSRSLVSPMGDQYKLPRSEFRAMLHFCENPGKIQTRAELLKKMTGRELKPHDRTVDVTIRRIRKHFESTPDTPEIIATIHGEGYRFCGDLED

SEQ ID NO: 7487 - protein, 158 aa, Xenorhabdus bovienii
  Coding DNA sequence: Name=SeqID_1379
  Gene classification: Gene name=CreA; Function=Uncharacterized BCR; Function class=S Function unknown
  Homolog annotation: Query=5..158bp; Hit=4..157bp; Blast score=231; Percent Identity=75.0; E value=2e-61; Homolog= creA COG3045
MVTIKKIVIAAALIFSPVILHAEEIGSVDTVFKLFGPDNKIVIEAFDDPDVKNVTCYLSRAKTGGIKGGLGLAEDTSDAAISCQQVGPIELSDKIKTPPKKGQVVFQKRTSLVFKKLQVVRFYDPERSSLIYLTYSDKVIDGSPKNAISAVPIMPWKE

SEQ ID NO: 7488 - protein, 36 aa, Xenorhabdus bovienii
  Coding DNA sequence: Name=SeqID_1380
MVVKMNIVIPIVNEFNKITLDKLSIKLLIYSKKILV

SEQ ID NO: 7489 - protein, 38 aa, Xenorhabdus bovienii
  Coding DNA sequence: Name=SeqID_1381
MFFYLLGMVGVNSRPNCITVAFRKTFWFFKIVSCCTFV

SEQ ID NO: 7490 - protein, 293 aa, Xenorhabdus bovienii
  Coding DNA sequence: Name=SeqID_1382
  Gene classification: Gene name=AraC; Function=AraC-type DNA-binding domain-containing proteins; Function class=K Transcription
  Homolog annotation: Query=1..293bp; Hit=1..289bp; Blast score=338; Percent Identity=59.0; E value=6e-93; Homolog= rob COG2207
MDQTNIIRDLLHWMDNNLDRPLSLDNVAAKAGYSKWHLQRMFKDVTGQAIGSYIRARRLSKAAVALRLTSRPILDIALQYRFDSQQTFTRAFKKQFNRTPASYRRSDEWCATGICPPIMLDNKPLPAHKYVTLEDQLLIGTEHTCSYTLEQWSSACTEMRHGFWVNYLQHAKTLPPRLYGLHHSDLSAEHEDEQTVFYTTAIEPEYATFDTQDNRPVVLPGGDYISFSYFGGKEQLKEFLFTVYGICLPKLNITRRKGYDVERYYLTNLEWKNLEDESQSHVVEFEYLIPIER

SEQ ID NO: 7491 - protein, 215 aa, Xenorhabdus bovienii
  Coding DNA sequence: Name=SeqID_1383
  Gene classification: Gene name=GpmB; Function=Fructose-2,6 -bisphosphatase; Function class=G Carbohydrate transport and metabolism
  Homolog annotation: Query=1..214bp; Hit=1..214bp; Blast score=312; Percent Identity=74.0; E value=1e-85; Homolog= ZgpmB COG0406
MLQVYLVRHGETEWNVARRIQGQTDSPLTEIGLRQARLVAQRVKSQNITHVITSDLGRTRQTAEIIAKACGCEVLLEPRLRELNMGVLENRELNSLTPEEESWRKSLVDGTPNGKIPEGESMNELSARMRAALESCLGLPAGSRPLLVSHGMALVCLVSSILGLPANSERRLRLRNCSISRVDYQDSPWLASGWIVETAGDITHLDMPALDELQG

SEQ ID NO: 7492 - protein, 177 aa, Xenorhabdus bovienii
  Coding DNA sequence: Name=SeqID_1384
  Gene classification: Function=Uncharacterized ACR; Function class=S Function unknown
  Homolog annotation: Query=1..170bp; Hit=4..173bp; Blast score=196; Percent Identity=57.0; E value=1e-50; Homolog= yjjX COG1986
MYHVIAATTNPAKIKAISLAFDDVFGPGTYRIEDVNVDSSVPQQPIGNTETRTGARHRVMAARQVRPEADFWVGVEAGIEDDMTFAWMVIEYKQIRGESRSASLMLPEKVLEGIREGRELGHEMAYLTGVDNIKQEGGAIGFFTNGILTRTSVYHQALILALVPIHHEIYKELNNQP

SEQ ID NO: 7493 - protein, 110 aa, Xenorhabdus bovienii
  Coding DNA sequence: Name=SeqID_1385
  Gene classification: Gene name=TrpR; Function=Trp operon repressor; Function class=K Transcription
  Homolog annotation: Query=10..108bp; Hit=10..108bp; Blast score=106; Percent Identity=60.0; E value=4e-24; Homolog= trpR COG2973
MIPNHLIDPALTPEDSDDWLTFVGLLQSAFEQNLQHPILQLLLTPDERTALSTRIRIIQELMRGQMSQRELKNELNVGIATITRGSNSLKAAPAPVKAWLEAQLLKDNND

SEQ ID NO: 7494 - protein, 639 aa, Xenorhabdus bovienii
  Coding DNA sequence: Name=SeqID_1386
  Gene classification: Gene name=MltE; Function=Soluble lytic murein transglycosylase and related regulatory proteins (some contain LysM/invasin domains); Function class=M Cell envelope biogenesis, outer membrane
  Homolog annotation: Query=4..639bp; Hit=18..654bp; Blast score=661; Percent Identity=52.0; E value=0; Homolog= slt COG0741
MNKWRHFTMAVGLVFVAGAAHADSLDAQRERYQTVKLAWEAKNMAEVERLMPTLKDYPLYPYLEYRQLTQDLDIATPQQIRHFIDTYPTLPSARSLTSKYINSLASNGDWSGILAFTPNAPKAAMTRCNYYFAKWATGNQQVAWKGAQELWLSGNTLPGSCDKLFDVWEQAGYLSANLILQRMELAIKSNNTQLVNYLIKRLPLSYRSLSENLLKLQSDPAFIEHFAQTSTSTDFTRSVIMTTFSRFARKDAEVARHSIPAIVRVQKMNDSEHQLLKDAVAWNLMSNVTPEQAKWRDDVIRDSQSTNLLERRVRLTLQDGDEKGLVQWLSLLPKSILQKKEEWQYWSAIVLLNEGKQAEGEAILHNLKEKRGFYSMVAAQKLNITYPLMIDRAEKPDDSIAKMREIKRIHELIYWHMDNLANSEWNNFVSSQSPLKQQQLARYALEQHWPALSVQATITGNMWDHLEERFPLAWQKEFANFTADKNISQSYAMAIARRESAWNPQARSGKGASGLMQIMPKTAEHTVKEQKIQGYSSSSQLMEPAMNIKVGTAYLDLVYQRFGNNRVLASAAYNAGPRNVDRWLANSADRIDAIAFIESIPFGETRDYVKNVLAYDMYYHNFMGIHSNALTNAEWQRRY

SEQ ID NO: 7495 - protein, 61 aa, Xenorhabdus bovienii
  Coding DNA sequence: Name=SeqID_1387
MCCPSNKNQTHSHRKMPPFIHCYMLLQRTKRITTNTKMLFNYNHIIDMIDYNSEFITIRFL

SEQ ID NO: 7496 - protein, 51 aa, Xenorhabdus bovienii
  Coding DNA sequence: Name=SeqID_1388
LRLWGLDGAFYPKFYVSCCYLISISSSIQLPQPVKIICAERVFMSTGLVPV

SEQ ID NO: 7497 - protein, 548 aa, Xenorhabdus bovienii
  Coding DNA sequence: Name=SeqID_1389
  Gene classification: Gene name=Uup; Function=ATPase components of ABC transporters with duplicated ATPase domains; Function class=R General function prediction only
  Homolog annotation: Query=1..548bp; Hit=9..556bp; Blast score=999; Percent Identity=88.0; E value=0; Homolog= PM0425 COG0488
MHRVGKIVPPKRHILKNISLSFFPGAKIGVLGLNGAGKSTLLRIMAGIDKDIEGEARPQPGIKIGYLPQEPKLNLEHTVREAVEEAVGEVKNALMRLDEVYAAYADPDADFDKLAKEQGQLEAIIQSHDGHNLDNQLERAADALRLPAWDAKIEHLSGGERRRVAICRLLLEKPDMLLLDEPTNHLDAESVAWLERFLHDYEGTVVAITHDRYFLDNVAGWILELDRGEGIPWEGNYSSWLEQKDARLAQEASSEAARRKSIEKELEWIRQNPKGRQAKGKARLARFEELNNVDYQKRNETSELFIPPGPRLGDKVLEVTNLTKSYGDRVLIDNLNFSLPKGAIVGIIGPNGAGKSTLFRMLSGQEQPDSGTVSLGETVTLASVEQFRDSMDDKKTVWEEVSGGQDIMRIGNFEIPSRAYVGRFNFKGVDQGKRVGELSGGERGRLHLAKLLQVGGNMLLLDEPTNDLDIETLRALENALLEFPGCAMVISHDRWFLDRIATHIIDYQDEGNVAFFEGNFSEYEDYKKRTMGAAALEPHRIKYKKISK

SEQ ID NO: 7498 - protein, 70 aa, Xenorhabdus bovienii
  Coding DNA sequence: Name=SeqID_1390
LKETSANTKIIKSGQWGLLHWSHTALNIKKSVNKPDSENGLISGRFSELTYPLHLSSCCFVGCNLKFIGI

SEQ ID NO: 7499 - protein, 241 aa, Xenorhabdus bovienii
  Coding DNA sequence: Name=SeqID_1391
  Gene classification: Gene name=PhnL; Function=ABC-type transport systems, involved in lipoprotein release, ATPase components; Function class=R General function prediction only
  Homolog annotation: Query=26..228bp; Hit=31..233bp; Blast score=122; Percent Identity=34.0; E value=3e-28; Homolog= CC2091 COG1136
MNLNQFKSIEVINISYGLTDNSVNHEMISDITFSIIPGEITLITGPKASTNSTLLSIASGMLQPDQGDVLINNNKLKLMNDIELGKFHYESSGFIFHDFNLSNKLTLLDNLLLSTSYGLTLSSEQATKIAQKSLDIVKLGHKSRYYPGELSENEKQLAAMARAIVRRPEYLFADDPTRNLGHKEFQMFVDIFKFIAHEQKGTVVIASQDNRLVQYADSMITLERGKVVKTYESFQEKRVMV

SEQ ID NO: 7500 - protein, 39 aa, Xenorhabdus bovienii
  Coding DNA sequence: Name=SeqID_1392
MSISLSGCFTYKLFLFVQCLIDISSITNESRQHMLRKKL

SEQ ID NO: 7501 - protein, 408 aa, Xenorhabdus bovienii
  Coding DNA sequence: Name=SeqID_1393
  Gene classification: Gene name=NadR; Function=Predicted ATPase/kinase involved in NAD metabolism; Function class=H Coenzyme metabolism
  Homolog annotation: Query=224..406bp; Hit=1..183bp; Blast score=324; Percent Identity=84.0; E value=9e-89; Homolog= nadR_3 COG3172
MGQFDYLKEAIKQASYTLQQVADACGMTKGYLSQLINGKIKSPSAQKLASIHQYLGLAYPMEKKTVGVVFGKFYPLHTGHIYLIQRASSQVDELHVVLCYDELRDRELFINSSMSQQPTVSDRLRWLLQTFKYQKNIHIHVFDEHGMEPYPNGWEVWSRGVKAFMAEKSINPEYIYSSEAQDVACYKEYFDIETILIDPQRSFMNISGSQIRQAPFRYWEYIPTEVKPFFVRTVAILGGESSGKSTLVNKLANMFNTTSVWEYGREYVFSHLGGDEMALQYSDYDKIALGHAQYIDFSVKYANKVAFIDTDFVTTQAFCKRYEGKEHPFVQAMIDEYRFDLVILLENNTPWVADGLRSLGSERERKEFQQLLESLLKKNNVDYVCVNSADYDQRFLRCIELVQHMLMA

SEQ ID NO: 7502 - protein, 34 aa, Xenorhabdus bovienii
  Coding DNA sequence: Name=SeqID_1394
MNKNITQNFAYLFESDVKTEFPKNQDIRKKWDSY

SEQ ID NO: 7503 - protein, 476 aa, Xenorhabdus bovienii
  Coding DNA sequence: Name=SeqID_1395
  Gene classification: Gene name=Sms; Function=Predicted ATP-dependent serine protease; Function class=O Posttranslational modification, protein turnover, chaperones
  Homolog annotation: Query=16..474bp; Hit=1..460bp; Blast score=827; Percent Identity=90.0; E value=0; Homolog= sms COG1066
VSFLAAKGSHIREYRVAKAVKRAFVCNECGADYPRWQGQCTACHAWNTITEVRLAAASSSRSERFSGYAGEVSISKVQKLAEISLEELPRFSTGFKEFDRVLGGGVVPGSAILIGGNPGAGKSTLLLQTMCQLSEQMKTLYVTGEESLQQVAMRAHRLGLPTDKLNMLSETSIEQICLIAEQEQPKLMVIDSIQVMHMADIQSSPGSVAQVRETAAYLTRFAKTRGVAIIMVGHVTKDGSLAGPKVLEHCIDCSVMLDGEADSRFRTLRSHKNRFGAVNELGVFAMTEQGLREVSNPSAIFLSRGDEVTSGSSVMVVWEGTRPLLVEVQALVDHSMLSNPRRVAVGLEQNRLAILLAVLHRHGGLQMADQDVFVNVVGGVKVTETSADLALLLSLVSSFRDRPLPRDLVVFGEVGLAGEIRPVPSGQERISEAAKHGFKRAIVPHANMPKKALPEMRVFGVKKLADALSVLDELDD

SEQ ID NO: 7504 - protein, 327 aa, Xenorhabdus bovienii
  Coding DNA sequence: Name=SeqID_1396
  Gene classification: Gene name=SerB; Function=Phosphoserine phosphatase; Function class=E Amino acid transport and metabolism
  Homolog annotation: Query=6..325bp; Hit=3..322bp; Blast score=444; Percent Identity=69.0; E value=1e-125; Homolog= serB COG0560
MFMSNNLAYRYLPDEIHKWPGLPLSLSGDEVMPLDYRAGDSGWLLYGRGLDKQRISDFQHRLGIAIVVVSSWRIDNYQVVRIAGSPSPRIKRLADECSLDVVPLGQIPRLRSPGLLVMDMDSTAIQIECIDEIARLAGVGDKVAAITERAMQGELDFSESLHERVAQLAGADASILQQVMETLPLMPGLTSLVRKLQSLDWHVAIASGGFTFFADNLRQQLRLFAAVANQLEVKDDKLTGKVKGPIVDAKYKATTLVRLAKELGIPLSQTVAIGDGANDLKMIRKAGLGIAYHAKPKVYTQAKVGIRHADLMGVLCVLSGGLKHEER

SEQ ID NO: 7505 - protein, 220 aa, Xenorhabdus bovienii
  Coding DNA sequence: Name=SeqID_1397
  Gene classification: Function=Uncharacterized membrane protein affecting hemolysin expression; Function class=T Signal transduction mechanisms
  Homolog annotation: Query=1..203bp; Hit=1..201bp; Blast score=217; Percent Identity=60.0; E value=7e-57; Homolog= Z5988_1 COG3726
MIKAKLKFRLHKTAIILICIALLVLLLQGVSYFSRSQQQAQVNQFEDLAKTLAKQVAYSLSDYMENGSKDLNNKKIVASLNYLTSKSRILDASVYLENGTQIARSGEPISVRDRLSLDGKKSGSYFNQQLVVPIPGKNEPKGFLRLTLDSHRLETEAKQVDNTTNLLRIMILLALAIGFVLAHNLLQLTPSRWQQSPYLLTANTKSSDEDRENKSDTSRR

SEQ ID NO: 7506 - protein, 69 aa, Xenorhabdus bovienii
  Coding DNA sequence: Name=SeqID_1398
MRIEKIKATPLDANLLPQFIISSEFSITTEFRWSSFLFFLHNPLFSQINDYVFLSSHHLLLNPDVAVCE

SEQ ID NO: 7507 - protein, 34 aa, Xenorhabdus bovienii
  Coding DNA sequence: Name=SeqID_1399
MMFDTVFDSLRLSKMPNMILADYSQTATSGFSNK

SEQ ID NO: 7508 - protein, 47 aa, Xenorhabdus bovienii
  Coding DNA sequence: Name=SeqID_1400
MQKSNYLTHSEIEILLKELGKHPHAERNICMIFMGFIHGSGFLNCLD

SEQ ID NO: 7509 - protein, 151 aa, Xenorhabdus bovienii
  Coding DNA sequence: Name=SeqID_1401
  Gene classification: Gene name=XerC; Function=Integrase; Function class=L DNA replication, recombination and repair
  Homolog annotation: Query=27..136bp; Hit=87..196bp; Blast score=130; Percent Identity=59.0; E value=4e-31; Homolog= fimB COG0582
MHDIYGLYSWFRVSELLGLKLSDAGGQLIRQWLAQRQKYKNSEQNDWLFLSRTGVRMSRQQFYKIIRQTSLQANLAVCANPHMLRHSCGYALADNGVDTRLIQDYLGHRNIRHTVRYTASNAGRFGTIWQERGKRKLSTISTKLLTEDDWS

SEQ ID NO: 7510 - protein, 55 aa, Xenorhabdus bovienii
  Coding DNA sequence: Name=SeqID_1402
MAFFCQKYPSDNTWPKYGIWLTISTKLLTRQLSYFLQSVYSHFIRKNQSNRLITM

SEQ ID NO: 7511 - protein, 33 aa, Xenorhabdus bovienii
  Coding DNA sequence: Name=SeqID_1403
MNKSRSQSHSCSEWLFFARNTHQIIRGLNTVFG

SEQ ID NO: 7512 - protein, 92 aa, Xenorhabdus bovienii
  Coding DNA sequence: Name=SeqID_1404
  Gene classification: Gene name=HipB; Function=Predicted transcriptional regulators; Function class=K Transcription
  Homolog annotation: Query=3..67bp; Hit=13..77bp; Blast score=57; Percent Identity=36.0; E value=3e-09; Homolog= CC2330 COG1396
MRVSMLVGKRIQMKRKEAGMTVAELADRISVSQQQLSRYERGTNKISLEHLVDVSIALKTPADWFLEDCFNKTQVHVKSQYAFVAETILDLY

SEQ ID NO: 7513 - protein, 278 aa, Xenorhabdus bovienii
  Coding DNA sequence: Name=SeqID_1405
  Homolog annotation: Query=1..278bp; Hit=1..277bp; Blast score=298; Percent Identity=57.0; E value=8e-80; Homolog= gb|AAM91935.1|AF525420_6
MRHIKKSLMKFVALLFFLSASYAYGGAYVMAVDTQPLGNQAVTTMEIIAWTEEEGIPNPCYGSSQCYVGPDVFYNNGNKPGMYGSCLGAGACLDDANRYLTTADVMRAYKRKLGIPFRTRFTIMSKEADCVGLFYSYGTSPGYGSAEKFPNSTCGKLPPPNQNCSISVPSEIAYGALKASDVNNATRSITGQVKCALEGSFRLEGFSTNREAKIYLDSNRQMYTTLQINGREAMEGMNLKAKGRNQPENFTLTSILRTSTPPKAGKYEGIAVVLLSYN

SEQ ID NO: 7514 - protein, 187 aa, Xenorhabdus bovienii
  Coding DNA sequence: Name=SeqID_1406
  Gene classification: Gene name=FimA; Function=Pilin; Function class=N Cell motility and secretion
  Homolog annotation: Query=36..186bp; Hit=25..172bp; Blast score=61; Percent Identity=26.0; E value=4e-10; Homolog= Z3596 COG3539
MSPLNMKLSKYVLPALFIFGIGGQKSAYAQDSLRQNVKITLTVLAAPCVIKTEDKAMEVYLGRILNRDLYQNHRTSGQHFELHLEECDPRVAQSLKIRFMGPESRALPGLLAFGADSRASGAAIGMESIDGKPLPFNKVSKFPLSRTSSSNVIPFRAYVQAEPRAIQQNRIGAGAFNAIATFEVSYE

SEQ ID NO: 7515 - protein, 252 aa, Xenorhabdus bovienii
  Coding DNA sequence: Name=SeqID_1407
  Gene classification: Gene name=FimC; Function=PapD-like chaperone involved in fimbrial biogenesis; Function class=N Cell motility and secretion
  Homolog annotation: Query=10..244bp; Hit=10..242bp; Blast score=231; Percent Identity=49.0; E value=6e-61; Homolog= ZyfcS COG3121
MKMKKILMVTAITVTSLMPAYQAMAAMALDRTRVIFNGDVKSVSLNIENQHVDLPYLAQAWIEDDKGNKINGPLVVVPPVQRVEAGAKSQVKIQTLPTIAELPQDRESLFYFNLREIPPRSNKPNVLQIALQTRVKLFYRPEAVIARRIDLDNPWQEKLTLTRQANQYLVSNPTSYYITISEASNKVNGKNIDGFQPLMLAPRSSEKLGGDLSALGNAPVLTYVNDYGGRPQLTFSCNGDICTVAKTTVEEN

SEQ ID NO: 7516 - protein, 886 aa, Xenorhabdus bovienii
  Coding DNA sequence: Name=SeqID_1408
  Gene classification: Gene name=FimD; Function=PapC-like porin protein involved in fimbrial biogenesis; Function class=N Cell motility and secretion
  Homolog annotation: Query=50..879bp; Hit=8..843bp; Blast score=840; Percent Identity=49.0; E value=0; Homolog= Z3600 COG3188
MALFSNSMNHHFSAINIKNNINKENVANKKIIDNKAKVVNRIKAVRLKNRIKPLSALVLFALAGMQTAYSNPSIEFNIDALDVGERANIDLDKFSRAGYIMPGNYIMGVRMNKNEFPDMYSIDFTPQPDDPKSSEACISPELVKQIALKQEWAEKLGWQNDGKCLDLGSLPGMSARGDLATYTLYLIVPQIYLEYDLPDWDPPSRWDNGVPGVLFDYNVNAQTSKPTHGSSNQQVSANGTAGMNAGAWRFRADWQANYNRTKKKDNKQGASGERERDWDWSRYYLYRAIPRLQAQLTFGEDYLNSNIFDSFRYTGVSLVTDDNMLPPNLRGYAPEVSGVARTNAKVTVRQQGRVLYETQVAPGPFRIQDLSDAVTGNLDVRVEEQDGGIQEFQVNTATVPYLTRPGRVQYKLVGGQSTNDKHRREGPAFGLGEFSWGINNGWSLYGGLLGAGDYNALSLGIGRDLMMFGALSFDITESRARLPKENKTFTGGSYRLSYSKRFEQYNSQVTFAGYRFSERNFMSMAQYIDRRYRDVNSDSGKELYTLIFSKQFKDLGLNAHLNYSHQTYWNRPTNDRYNISLSKYLDIGRYKNINVNLSAYRNNFDNKKDDGVYLNLSIPWGESGTLSYNGLANRQGNSHMAGYFNRIDERNNYRISAGSSIGGKAAADGYYTHYGDKTLLSASASYQDGGYTSAALGLQGGVTVTANGAALHRINLPGATRLMVDTEGVSDVPVRGFGSVVHTNHFGKAVLVDVNHYYRNSANIDLDNLPDNVEALRSVQQATLTEGAIGYRKFQVMSGFKAMTIIRLPDGSFPPFGASVMNTAQREIGIVSDDGYAYLSGMNAGEKLQVHWNGGAQCEITVPQEISEASLTSFLLPCQFLKGEHQ

SEQ ID NO: 7517 - protein, 44 aa, Xenorhabdus bovienii
  Coding DNA sequence: Name=SeqID_1409
MSCLSVISHAFSSLCFTDFTVQREVEEKCHYRYAIKITLKWLKA

SEQ ID NO: 7518 - protein, 181 aa, Xenorhabdus bovienii
  Coding DNA sequence: Name=SeqID_1410
  Gene classification: Gene name=FimA; Function=Pilin; Function class=N Cell motility and secretion
  Homolog annotation: Query=14..155bp; Hit=15..167bp; Blast score=67; Percent Identity=31.0; E value=6e-12; Homolog= Z4971 COG3539
MKLNKLAMVLGFGVALTAGAASAVNQGSGTVKFSGSIIDAPCSIKNTNIDVNLGAVSSNILKGGGRSESKAFKIELQNCTAKTQNGVKTTFTGAEADEKGLLGIEGPGSGAAIAITNAGGKIIPLGTESDKFSLHEGSNALNFAAHLKGLTTAQGVDGKNQHSEIKPGTFTAIANFTLNYL

SEQ ID NO: 7519 - protein, 238 aa, Xenorhabdus bovienii
  Coding DNA sequence: Name=SeqID_1411
  Gene classification: Gene name=DeoD; Function=Purine-nucleoside phosphorylase; Function class=F Nucleotide transport and metabolism
  Homolog annotation: Query=1..237bp; Hit=1..237bp; Blast score=417; Percent Identity=89.0; E value=1e-117; Homolog= deoD COG0813
MATPHINAEMGDFADVVLMPGDPLRAKYIAETFLEDARQVNDVRGMLGFTGTYKGRKISVMGHGMGIPSCSIYAKELITEFGVKKIIRIGSCGAVSHDVKIRDVVIGMGACTDSKVNRMRFKDHDFAAIADFDLVRNAVDAAKAKNINARVGNIFSVDLFYTPDPQMFDVMEKYGVLGVEMEAAGIYGVAAEFGAKALAICTVSDHIRTGEQTSAEERQTTFNDMIEIALESILLGDN

SEQ ID NO: 7520 - protein, 407 aa, Xenorhabdus bovienii
  Coding DNA sequence: Name=SeqID_1412
  Gene classification: Gene name=DeoB; Function=Phosphopentomutase; Function class=G Carbohydrate transport and metabolism
  Homolog annotation: Query=1..407bp; Hit=1..407bp; Blast score=711; Percent Identity=83.0; E value=0; Homolog= deoB COG1015
MKRTFIMVLDSFGIGASADAEKFGDKGSNTLGHIAEQCACGEADIGRKGPLQLPNLSRLGLGKATEESSGIFPIGLDQDAEIIGAYGYASELSSGKDTPSGHWEIAGVPVLFDWGYFQELDNSFPQELLDKLVERANLPGYLGNCHSSGTVILDNLGEEHMKTGKPIFYTSADSVFQIACHEETFGLDRLYELCEIAREELNLGDYNIGRVIARPFVGDKAGDFQRTGNRHDLAVEPPAPTVLKKLVDEKQGEVVSIGKIADIYANVGITKKVKATGIDALFDASLVEMEQAGDNTIVFTNFVDFDSSYGHRRDVAGYAAALELFDRRLPEMLKMVKEDDILILTADHGCDPTWPGTEHTREHIPVLVYGLKVKPGSLGHRETFADIGQTVAKYFDLTPMDYGKVMF

SEQ ID NO: 7521 - protein, 39 aa, Xenorhabdus bovienii
  Coding DNA sequence: Name=SeqID_1413
MPKESNTMMNVRFIIFSCVSQFTLSMRKLSAVKIYFHYS

SEQ ID NO: 7522 - protein, 401 aa, Xenorhabdus bovienii
  Coding DNA sequence: Name=SeqID_1414
  Gene classification: Gene name=DeoA; Function=Thymidine phosphorylase; Function class=F Nucleotide transport and metabolism
  Homolog annotation: Query=1..399bp; Hit=44..438bp; Blast score=593; Percent Identity=77.0; E value=1e-169; Homolog= deoA COG0213
MTIYFHDMTMEERVALTLAMCDSGTVLDWKKLNLHGPIVDKHSTGGVGDVTSLMLGPMVAACGGYIPMISGRGLGHTGGTLDKLESIPGFDIFPDEQRFRDIIRDVGVAIIGQTNSLAPADKRFYATRDITATVDSIPLITASILGKKLAEGLDALVMDVKVGSGAFMPTYEQSEQLAESIVSVANGAGCKTTALLTDMNQVLASSAGNALEVREAVQFLTGEYRNPRLFEVTMALSAEMLVSGNLAADRAEARRKLQAVLDNGKAAETFERMVAAQKGPIDFVENYARYLPAASFSKPVFAGQNGIITEMDTRALGMSVVALGGGRHKATDPINYSVGLSDIVALGAEVNADTPLAMIYANNENDWQEAAEVVRKSIVLGIDVSTETKAATPMVYRHIDG

SEQ ID NO: 7523 - protein, 57 aa, Xenorhabdus bovienii
  Coding DNA sequence: Name=SeqID_1415
MEINGHRQCCDLPFRNGIITNSVNKETDLFFTQPVTVTFFADNFLCQKQSDLPIIII

SEQ ID NO: 7524 - protein, 259 aa, Xenorhabdus bovienii
  Coding DNA sequence: Name=SeqID_1416
  Gene classification: Gene name=DeoC; Function=Deoxyribose-phosphate aldolase; Function class=F Nucleotide transport and metabolism
  Homolog annotation: Query=1..259bp; Hit=1..259bp; Blast score=367; Percent Identity=79.0; E value=1e-102; Homolog= deoC COG0274
MTDLTAAAQHALSLMDLTTLNDDDTDEKVAILCHQAKSPVGHTAAICIYPRFIPAARKVLREQGTPDIRIATVTNFPHGNDDIDIALAETRAAIAYGADEVDVVFPYRALMAGNEQIGFDLVKACKDACVASGVWLKVIIETGELKEENLIRKASEISINAGADFIKTSTGKVPVNATLESAEIMLSVIRDMGVGETVGFKPAGGVRTAEEAAQYLALSARIMGDKWADPRHFRFGASSLLGNLLTVLGHQGQKQSSGY

SEQ ID NO: 7525 - protein, 65 aa, Xenorhabdus bovienii
  Coding DNA sequence: Name=SeqID_1417
LNDCFERLVSSFVGERTWFLEDVAIVMHNSNSRVPSLRTILSSAFTAPAGTNLIHEALAHHYLNM

SEQ ID NO: 7526 - protein, 425 aa, Xenorhabdus bovienii
  Coding DNA sequence: Name=SeqID_1418
  Gene classification: Gene name=NupC; Function=Nucleoside permease; Function class=F Nucleotide transport and metabolism
  Homolog annotation: Query=1..424bp; Hit=1..417bp; Blast score=479; Percent Identity=70.0; E value=1e-135; Homolog= VC2352 COG1972
MQLIMSLIGMVVLIFIAVLFSSNYRAIKIRTVLGAFLIQVAIGAFVLYVPAGKDVLIGMSKGVSNVIGYGQKGTDFIFGGLVSDKMFELFGGSGFIFALRVLPVIVFFSSLIAVLYYIGVMQIVIKIIGGGLQKLLGTSRTESLSATANIFVGHTEAPLVVRPYISSMTQSELFAVMCGGLASVAGSVLAGYASMGVPLEYLIAASFMAAPGGLLFAKLLVPETEKTRDTDDVMSLIAAEDRPANIIDAAASGAASGMQLALNVGAMLLAFTALIALLNGMLGGIGGWFSYPQLSMELILGWMFSPIAYLIGVPWNEATIAGSFIGQKVVVNEFVAFMNFGEYLKPNEVVQAAGLQVLSDHTKAIISFALCGFANLSSVAILLGGLGGMAPNRRGDIARFGLKAVLAGSLSNLMSATIAGFFLAL

SEQ ID NO: 7527 - protein, 33 aa, Xenorhabdus bovienii
  Coding DNA sequence: Name=SeqID_1419
MKKYASYIVSSYRHCARPIIPSSKKEQATNITN

SEQ ID NO: 7528 - protein, 35 aa, Xenorhabdus bovienii
  Coding DNA sequence: Name=SeqID_1420
MSKEDQLRIINIYLIRMLTSCYPKKTYYFCGYKSA

SEQ ID NO: 7529 - protein, 256 aa, Xenorhabdus bovienii
  Coding DNA sequence: Name=SeqID_1421
  Gene classification: Gene name=TatD; Function=Mg-dependent DNase; Function class=L DNA replication, recombination and repair
  Homolog annotation: Query=2..253bp; Hit=5..256bp; Blast score=322; Percent Identity=62.0; E value=3e-88; Homolog= yjjVm COG0084
MFIDTHCHFDFPPFAGNEQTSLKQARQAGVDTIIVPTVSQMNFQRVATLAYDYPSIYAAFGLHPLYINEHQASHLDELAQKLKEKNPKCVAVGEIGLDLYMPEPQFEKQKRVLEAQLALAKRHDLPVILHSRKSHDQLATILRRHDLPRTGVIHGFAGSLPQAQVFIRLGFYIGVGGTMTYARAQKTRSTISQLPLSSLVLETDAPDMPLSGYQGQPNRPERVAQVFSVLCELRRESPDEMADQIYHNSMALFALS

SEQ ID NO: 7530 - protein, 371 aa, Xenorhabdus bovienii
  Coding DNA sequence: Name=SeqID_1422
  Gene classification: Gene name=RssA; Function=Predicted esterase of the alpha-beta hydrolase superfamily; Function class=R General function prediction only
  Homolog annotation: Query=1..303bp; Hit=1..302bp; Blast score=432; Percent Identity=65.0; E value=1e-121; Homolog= ZyjjU COG1752
VGKHIPITLGNIEPLAYKSQIKPGKIALVCEGGGQRGIFTAGVLDEFLRLGFNPFELFLGTSAGAQNISPYICGQRGYARRVINRYTTAPTFFNPLRFVRGGHLIDLDWYIDTISEQLPLNTSVAMHQFDAGREFYMCACRADNFEPDYFHPNEHNWMEILKASSAIPGFYRNGVTLGDTVYQDGGICDAIPVQEAYRRGADTIVVIRTVPSQLYYTPQWFKRMERWLEASSLQKMVKMINLHAKSYSRTQQFIENPPDDVQVFEIYPPAPLATMALGSRISALNQDYHLGRRCGRYFLATIGHTFVGGKFGLEKRKSYGVCRSGLNNDEVNHDGFRRYSLLDSINRPVIEVQEEGMTPLTGAIMLDDVDK

SEQ ID NO: 7531 - protein, 60 aa, Xenorhabdus bovienii
  Coding DNA sequence: Name=SeqID_1423
VGKRFLRGILLSFFHNIASVFVVRSIFHYLTKILQTYCLNNNILIDSHYSDYSMTLSLIF

SEQ ID NO: 7532 - protein, 34 aa, Xenorhabdus bovienii
  Coding DNA sequence: Name=SeqID_1424
VKCKVPKCSYTRTGLYIPKSILPVIKVLNQVAVA

SEQ ID NO: 7533 - protein, 39 aa, Xenorhabdus bovienii
  Coding DNA sequence: Name=SeqID_1425
MFFSHRRYKFIDVTLIFLEFIVLKIIFGKCLLFFFFLSL

SEQ ID NO: 7534 - protein, 56 aa, Xenorhabdus bovienii
  Coding DNA sequence: Name=SeqID_1426
LTGWLLIGHSFYCYCFISIRNLFIFSASELNLHLSINNINIGRIFGIKLRIKIRNL

SEQ ID NO: 7535 - protein, 128 aa, Xenorhabdus bovienii
  Coding DNA sequence: Name=SeqID_1427
  Gene classification: Gene name=OsmY; Function=Predicted periplasmic or secreted lipoprotein; Function class=R General function prediction only
  Homolog annotation: Query=7..127bp; Hit=3..122bp; Blast score=67; Percent Identity=39.0; E value=2e-12; Homolog= ZosmY COG2823
MTEGDRMKHIKFTHSLLAIVLGSVLISSNALAALTSPASTLESVSSKVDNSLKHADAYVSDSSITAQVKADLLKTKGLDSNDISVKTEKGIVHLSGFVKNTYQAKQVAKIVHKVHGVKSVKNTLKVKK

SEQ ID NO: 7536 - protein, 529 aa, Xenorhabdus bovienii
  Coding DNA sequence: Name=SeqID_1428
  Gene classification: Gene name=FusA; Function=Translation elongation and release factors (GTPases); Function class=J Translation, ribosomal structure and biogenesis
  Homolog annotation: Query=1..529bp; Hit=1..529bp; Blast score=965; Percent Identity=87.0; E value=0; Homolog= prfC COG0480
MSNFPFQQEVAKRRTFAIISHPDAGKTTITEKVLLFGQAIQKAGTVKGRGSNQHAKSDWMEMEKQRGISITTSVMQFPYDDCLVNLLDTPGHEDFSEDTYRTLTAVDCCLMVIDAAKGVEDRTRKLMEVTRLRDTPILTFMNKLDRDIRDPMEVMDEVENELKIACSPITWPIGCGKSFKGVYHLYLDEIYLYQSGQGHTIQEVRAIKGLNNPELDAVVGEELANQLREELELVKGASHEFDQEAFLQGELTPVFFGTALGNFGVDHMLDGLVKWAPMPMPRLTDAREVTAEEEKFTGFVFKIQANMDPKHRDRVAFLRVVSGKYEKGMKLRQVRLKKDVVISDALTFMAGDRSHIDHAYAGDIIGLHNHGTIQIGDTFTQGEELKFTGIPNFAPELFRRIRLRDPLKQKQLLKGLVQLSEEGAVQVFRPLANNDLIVGAVGVLQFDVVVARLKSEYNVEALYESVNVSTARWVECNDAKKLEEFKRKNELNLALDGGDNLTYIAPTMVNLNLTSERYPEISFRKTREH

SEQ ID NO: 7537 - protein, 44 aa, Xenorhabdus bovienii
  Coding DNA sequence: Name=SeqID_1429
MIIWLSAIIFFTHGAANSFNDFRSDRPLGQTGKVAYFLTTQSKR

SEQ ID NO: 7538 - protein, 168 aa, Xenorhabdus bovienii
  Coding DNA sequence: Name=SeqID_1430
  Gene classification: Gene name=RimI; Function=Acetyltransferases; Function class=R General function prediction only
  Homolog annotation: Query=20..165bp; Hit=1..146bp; Blast score=196; Percent Identity=64.0; E value=1e-50; Homolog= rimI COG0456
MTYPLTGMQNALFGNKFTIMKNISLLTPADLPAAFQIEQFSHAFPWSEKTFYSNQGERYLNYKITLNDQIIGFAIIQCVVDEATLFNIVIHSEHQSQGNGRALLTHLINVLPEKQINTLWLEVRSSNTSAIGLYEDLGFNEVSIRKNYYPTATGKEDAIIMALPLFAG

SEQ ID NO: 7539 - protein, 136 aa, Xenorhabdus bovienii
  Coding DNA sequence: Name=SeqID_1431
  Gene classification: Gene name=HolD; Function=DNA polymerase III, psi subunit; Function class=L DNA replication, recombination and repair
  Homolog annotation: Query=2..131bp; Hit=3..132bp; Blast score=105; Percent Identity=40.0; E value=1e-23; Homolog= holD COG3050
MTKRDRLLAQLGITQWVVRSPRALQGELSVLIPDSTRLLIITHDHIDLSHSLFADIFTAMGIDASSVYCITTKDVELLSESIHCPCWLLGVDITLSIQGISLRSPALNDLSLDGNAKRSLWQQIYHYEEYFSINSR

SEQ ID NO: 7540 - protein, 32 aa, Xenorhabdus bovienii
  Coding DNA sequence: Name=SeqID_1432
LPSDVYTWIKIYKELYIDVSINPGQRSYPAPP

SEQ ID NO: 7541 - protein, 304 aa, Xenorhabdus bovienii
  Coding DNA sequence: Name=SeqID_1433
  Gene classification: Gene name=RsmC; Function=16S RNA G1207 methylase RsmC; Function class=J Translation, ribosomal structure and biogenesis
  Homolog annotation: Query=1..304bp; Hit=1..304bp; Blast score=358; Percent Identity=55.0; E value=5e-99; Homolog= rsmC COG2813
MSVLTPASEVILRHHEQFINHHLLLAGDLQDNLATEIEAGSVRVHTNQYHHWQSLIRQLGDNASFGLVADSAFVKGCDTLIYYWPKSKHEARFQLRSLFSILPPGTGVFVVGENRTGVRSVDKLMEGIVTFQKVDTARRCSLFYGQLENQVQFDQNNWWNSYQVGDVTVNTLPGVFSQDDLDVGSRLLLSTFDGPVSGSLLDIACGSGVLAAVLGKKNPDLTLTLSDVNAAAITSSKATLKANKLEGNVVTSNVYSAIEEKFDWIISNPPFHDGLKTNLAAADDLIRMAPNYLKSGGKLRIVAN

SEQ ID NO: 7542 - protein, 45 aa, Xenorhabdus bovienii
  Coding DNA sequence: Name=SeqID_1434
VLLFGVMRVWGVIGQVAALGIGVVLVAVLEWCAAASSVVCMVVSR

SEQ ID NO: 7543 - protein, 94 aa, Xenorhabdus bovienii
  Coding DNA sequence: Name=SeqID_1435
  Homolog annotation: Query=12..75bp; Hit=75..138bp; Blast score=114; Percent Identity=82.0; E value=5e-25; Homolog= ref|NP_681031.1|
MRHKPCALISRRDKGVWEELLEELIFEPDFEWLMIDASHIKVHPHAAGAAGGNQDMGRTKGGSIQRYIWPWMRMVSDQSAYSSGPQRMLQAEAL

SEQ ID NO: 7544 - protein, 106 aa, Xenorhabdus bovienii
  Coding DNA sequence: Name=SeqID_1436
MTGRYTPGGLEMRQEMFRVGGVGREGARGDLGEGAEVWGRGFGGGCRGGRVDGGGDGGRGTKGGRETGRTPGGGGEQEGGGEGGGGGALALKRACQAGTRPDVSLY

SEQ ID NO: 7545 - protein, 94 aa, Xenorhabdus bovienii
  Coding DNA sequence: Name=SeqID_1437
  Homolog annotation: Query=1..89bp; Hit=1..89bp; Blast score=125; Percent Identity=67.0; E value=1e-28; Homolog= ref|NP_841562.1|
VDAHGMPIRALITSGPTADCSQAEALIDGIDAEHLLADRGYDSNTVVEQAEKQGMAAQIPGRKNRKVKREYDRELSGLTRLAGNAILPLFACEV

SEQ ID NO: 7546 - protein, 163 aa, Xenorhabdus bovienii
  Coding DNA sequence: Name=SeqID_1438
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293
MDDLTMSTPVHRRHDISDHIWSLLEPHLPGRKGAWGRVAYDNRLFINAVFWILRTGAPWRDLPPDYGDWKNTHRRFCRWRDKGVWEELLEELIFEPDFEWLMIDASHIKVHPHAAGAAGGNQDMGRTKGGSIQRYIWPWMRMVCRSERLLQAVPQRIAHKLRP

SEQ ID NO: 7547 - protein, 104 aa, Xenorhabdus bovienii
  Coding DNA sequence: Name=SeqID_1439
  Homolog annotation: Query=3..74bp; Hit=93..164bp; Blast score=90; Percent Identity=51.0; E value=4e-18; Homolog= ref|NP_831648.1|
MCPIGTERISKDGYVYIKVDRPNIWRLKHRMIWEEHHGKLPAGAIVIFKDGNQKNYQIDNLLMVTRRENVILNKFYPNTPAEYKQTTTYLARIMIAINNKERVI

SEQ ID NO: 7548 - protein, 61 aa, Xenorhabdus bovienii
  Coding DNA sequence: Name=SeqID_1440
MKVTIEVPNKKDLDMAFGLVTDFLKQKDRKVNESAFFTINNERSGRIRESHKGNITCRIHD

SEQ ID NO: 7549 - protein, 732 aa, Xenorhabdus bovienii
  Coding DNA sequence: Name=SeqID_1441
  Gene classification: Gene name=RhsA; Function=Rhs family protein; Function class=M Cell envelope biogenesis, outer membrane
  Homolog annotation: Query=79..648bp; Hit=544..1168bp; Blast score =160; Percent Identity=28.0; E value=6e-39; Homolog= PA2684 COG3209
MDCYCIFDCYLNPLHISFYKFFRNRCDDGISVGAEASHSVGNPINCLAIIGWYDSNFLICSLVGFPFIPNVCTHHQRNENSPYSWEYNALGQAVCITDRMQRQNRYQYNSEGHLVQIENANGGRYLLNRDAEGRLIEEIRPDDTLIQYEYNMAGLLSVEKRMGDRVFRQPVHSIYFHYDAAGNLIKRETSTDSYQYQWDKMGRLLKASRDPNTAGKQLGLLPNTISFEYDELGRVIREQNDKNVLQFNHDEMDNLTELTLPQGDTLRWLYYGSGHLSAVRYNQQIITEFERDNLHREISRTQCKLFQFREYDPLGRRISQYSVRDKSASIGQGKPWRAWHYDGQDELSLMEDHYRGWVEYLYDSESRLKKVTSVDSFEEMLWYDRADNLLERPQSMIEHESKESKHLTPQGDRLIQWNQWSYKHDEHGNVIMRGTSRGNRQTYRYDGDNRLTLSEGGGMKAIYHYDALGRRIRKVVTTWPTGIPQQEQTEFVWHGQKLLQEHNVNIGKTHTYCYESHESYTPLACIVASGSIREYFWYHADINGAPLEVTDEERKIAWSGKYDAFGAVNSTTMAYFTDTERSSKSFDQNFRYSGQYFDKETGLHFNTYRYYAPEIGRFITPDPVGLSGGLNLYVYAPNPMSWIDPWGLAKDKTYTVTRNMNATEAEKTKNAGGLVPGETNGKPDRRAKWVSIDGANYDRTTTPRPTHQATIEVTKDGYDMLNNKDIVEAGQE

SEQ ID NO: 7550 - protein, 90 aa, Xenorhabdus bovienii
  Coding DNA sequence: Name=SeqID_1442
MAWEVDDSRATWKQIPPAAERKYEEWVRTITASNRHPRDAAEDVGGCNFKMLGGTSSGIEQYTIRLSKDHRVLFTIEGEIVNVRQVGGHT

SEQ ID NO: 7551 - protein, 84 aa, Xenorhabdus bovienii
  Coding DNA sequence: Name=SeqID_1443
MSNNLIEKINTTLESAEEFKSEGASIITLDLDVYITILKRLAEYENMEPIAIYNLADGEIYKSINDIGDGKSVFAVNLYPHPNK

SEQ ID NO: 7552 - protein, 32 aa, Xenorhabdus bovienii
  Coding DNA sequence: Name=SeqID_1444
MDIIDTANDAVELTVDKEYLFDIGNEKLRKIA

SEQ ID NO: 7553 - protein, 74 aa, Xenorhabdus bovienii
  Coding DNA sequence: Name=SeqID_1445
MKNKLEDLNNHLFVQLERLSDENILNEQLEKEFRRAKSISDIAIQIVNNGKLALDVKKAIGNQDVDSLPKFLGG

SEQ ID NO: 7554 - protein, 193 aa, Xenorhabdus bovienii
  Coding DNA sequence: Name=SeqID_1446
  Homolog annotation: Query=5..185bp; Hit=8..197bp; Blast score=137; Percent Identity=40.0; E value=1e-31; Homolog= ref|NP_759080.1|
MAQFKYTDKMKNWMRIYYGLPVQELTAKFNEHFSVNYSSKSIHGFRRRLGLRTGRTGQYPKGHISHNAGTKGLMKRNSGSFKSGSSPHNMCPIGTERISKDGYVYIKVDRPNIWRLKHRMIWEEHHGKLPAGAIVIFKDGNQKNYQIDNLLMVTRRENVILNKFYPNTPAEYKQTTTYLARIMIAINNKERVI

SEQ ID NO: 7555 - protein, 101 aa, Xenorhabdus bovienii
  Coding DNA sequence: Name=SeqID_1447
MNLRSLLLTMNARDESGNHIKAISRVASMTNEFENGRRQVARECRSELFKIKKRTDQQTATILTQYLPRFETAMSPHQKSKFLPVMWLRYYVDMIDKEMKQ

SEQ ID NO: 7556 - protein, 133 aa, Xenorhabdus bovienii
  Coding DNA sequence: Name=SeqID_1448
  Homolog annotation: Query=8..132bp; Hit=3..125bp; Blast score=109; Percent Identity=51.0; E value=7e-24; Homolog= ref|NP_051001.1|
MRLITDNNEIESITLSRKKAAALIGIDVDTLSLWCQIGKIAYTKKNPTKPNSPYLFTRAACIAAINNPIQTVLVSAVDATEKGDKQCQSSVEEIRGMGTTRRQAAKELRNLLGQRTKSKLRSCTTEERPSYGA

SEQ ID NO: 7557 - protein, 385 aa, Xenorhabdus bovienii
  Coding DNA sequence: Name=SeqID_1449
  Gene classification: Gene name=XerC; Function=Integrase; Function class=L DNA replication, recombination and repair
  Homolog annotation: Query=1..378bp; Hit=1..378bp; Blast score=569; Percent Identity=75.0; E value=1e-162; Homolog= intD COG0582
MSIFRRGNTWYGNYTTPSGKRIKESLGTTDKKQAQELHDRRKAELWRIERLGDFPDVTFDEACLRWIEEKADKKSLDDDKGRMAFWLEYFEGVRLKDITEARIYTAISKMRNRKTKQRWESRVKAAQKKGKEVPAYTEVSVSVATKAKHLALMKSLLRAAERDWKWLEKAPVIKVPAVRDKRVRWLESHEAQRLVDECPEPLQSIVKFALATGLRRSNIINLEWSQIDMQRQVAWIHPDQSKSDRAIGVSLNETACRVLRAQIGNHNKWVFVHTKPSTNPDGMVMPNIRKMRVDDNTAWNSALRRAGIEDFRFHDLRHTWASWLIQSGVPLSALQEMGGWESIEMVRRYAHLAPNHLSEHARKIDELFGNLVPNPSHSGKIVVAK

SEQ ID NO: 7558 - protein, 30 aa, Xenorhabdus bovienii
  Coding DNA sequence: Name=SeqID_1450
MQSLLAMMRAENNQANRGKIIRGYNRGCSS

SEQ ID NO: 7559 - protein, 33 aa, Xenorhabdus bovienii
  Coding DNA sequence: Name=SeqID_1451
MIKERIGYLEVIIAFLAIFISLMIFLQCKACLQ

SEQ ID NO: 7560 - protein, 327 aa, Xenorhabdus bovienii
  Coding DNA sequence: Name=SeqID_1452
  Gene classification: Gene name=Tra8; Function=Transposase, IS30 family; Function class=L DNA replication, recombination and repair
  Homolog annotation: Query=1..312bp; Hit=1..312bp; Blast score=292; Percent Identity=52.0; E value=4e-79; Homolog= NMB0443 COG2826
MTYKQLTETERYQIFSLKEAGFSQREISTSLNRNPSTISRELRRNREAKKYAPEQAQLKAVVRRHCATKAVKVKPEIEMWIKQLIWQDLSPEQTVGYLKRENIISLHHETVYRLIYKDKLNGGDLWQHLRIAKKPYRKRYGSYERRGKIKNRVSIDKRPKLVDKKQRIGDWEGDTIVGKDHKSALLTLVERKSLFTIIIKLEDKTAEGVAKAATRHLSLIKHKIKTMTFDNGLEFAEHELISKNLETKIYFAHPYSPWERGINENTNGLIRDYFPKGTDFNKVSELEINLVANRLNNRPRKTRDYQTPNELFKGIPTHLLRSLRCCA

SEQ ID NO: 7561 - protein, 87 aa, Xenorhabdus bovienii
  Coding DNA sequence: Name=SeqID_1453
LKRCQRSPAFSEIKKEIKKYAKDMNKWWGNLQHYSIAEWSLIIGIGCWGIPNKNAQMITFLLSLMFFFDKLFSISYKSWIHILSATP

SEQ ID NO: 7562 - protein, 93 aa, Xenorhabdus bovienii
  Coding DNA sequence: Name=SeqID_1454
  Gene classification: Gene name=Nlp; Function=Predicted transcriptional regulator; Function class=K Transcription
  Homolog annotation: Query=13..77bp; Hit=7..71bp; Blast score=93; Percent Identity=73.0; E value=3e-20; Homolog= sfsB COG3423
MEGVAVMNNVKNDWHQADIIAALRKRGTTLAAVSREAGLSSSTLANAFSRPWPKGEWIIADYLGIHPSEIWPSRYFDMYGQLIERKVRKVSTE

SEQ ID NO: 7563 - protein, 57 aa, Xenorhabdus bovienii
  Coding DNA sequence: Name=SeqID_1455
MINPLVGNFYQCACYRPFNGGSGREGIALPEWLISGPRTLSESPPSILINGRGSSNE

SEQ ID NO: 7564 - protein, 48 aa, Xenorhabdus bovienii
  Coding DNA sequence: Name=SeqID_1456
LSKLKQSVKVIPPLAKSNGQGVAALNDQPTGRKFLPVCLLSPFQWWFR

SEQ ID NO: 7565 - protein, 299 aa, Xenorhabdus bovienii
  Coding DNA sequence: Name=SeqID_1457
  Homolog annotation: Query=11..299bp; Hit=4..292bp; Blast score=362; Percent Identity=65.0; E value=6e-99; Homolog= ref|NP_404706.1|
MLSGISKGKPMSRLIKELKFFACQGGGSHKTCHDRIRIAGRLGALLLSLNIQVKSLSHLKAKHVEHYVDTRLSQGVAKRTVQNEMSALRNIFRMAGREKLETSPRLSNQALGLSGASRAGTKQAIPDATFQVVYQKALKRDAGFAVTLKLARLMGLRSQEAVQCSASLKSWRKQLEQPEPKLHVVFGTKGGRPRQTRVLNVAAVKEAVDQAIAIAEQRGGRLIEKPDLKQAMNYWRTHTTRIGLVGCHSPHSLRYAWAQDALNFYQQNGFSRQEARALVSMDLGHGDGRGRYVERVYSR

SEQ ID NO: 7566 - protein, 30 aa, Xenorhabdus bovienii
  Coding DNA sequence: Name=SeqID_1458
MRSLARDRTDKTGNACFVLDGYLCARVNAG

SEQ ID NO: 7567 - protein, 59 aa, Xenorhabdus bovienii
  Coding DNA sequence: Name=SeqID_1459
VRLIRREPVRVVLSFGCGVTFSGKPAKSDALSPVNSQQTLCTLKYHQLQQNAARFSVKR

SEQ ID NO: 7568 - protein, 69 aa, Xenorhabdus bovienii
  Coding DNA sequence: Name=SeqID_1460
MFTTLDWQYKNTFWVYFFSLRNLHHQTRGLCLAIPTSKGAQVYRNACSPFQATGVLFRHPKASLTGDGS

SEQ ID NO: 7569 - protein, 157 aa, Xenorhabdus bovienii
  Coding DNA sequence: Name=SeqID_1461
  Gene classification: Function=DNA G; Function class=L DNA replication, recombination and repair
  Homolog annotation: Query=1..153bp; Hit=1..153bp; Blast score=186; Percent Identity=54.0; E value=6e-48; Homolog= vsr COG3727
MADVHSPTVRSNNMKAIRNQGTTIEVKLAAILDNLGLEFSKQVKELAGKPDFVIDKYRKIIFTNGCFWHQHQCYLFKVPATRTEFWIEKTRQNALRDKNVHKKLKNDGWNIMVVWECAMRGKFKLSIQELSERIEEWVCAGDYFAEIDTRGIHSENA

SEQ ID NO: 7570 - protein, 44 aa, Xenorhabdus bovienii
  Coding DNA sequence: Name=SeqID_1462
MIYFILINTIKIVLIKQLVTSIFHPNYGLITTSTGIVNDSYGTS

SEQ ID NO: 7571 - protein, 501 aa, Xenorhabdus bovienii
  Coding DNA sequence: Name=SeqID_1463
  Homolog annotation: Query=14..454bp; Hit=5..437bp; Blast score=292; Percent Identity=37.0; E value=1e-77; Homolog= ref|NP_691095.1|
MDFLSLSKLTTRIIDVIPHAASLIEGHRDFGYNLETALADIIDNSISSGATCINLYIDVTTEKPWIALSDDGCGMTEPELIEAMRLGTKNPTDERAAKELGRFGLGLKSASFSQCRCLTVLTRRHNIISCARWDLDRIANLNSWTLELPGDVEKISGYELLPGTGTVVIWQKLDRLSDGYMDDIAKRITHMNAEFSRAERHLRLVFHRFIEGSKPKLRLLLNGRQLRPLDPMVSFHPSTQRAPEDIISLPKGNVRIRCYTLPHHRKMAKDEWEEIGGPEGHLKSQGLYVYRENRLIIAGSWLGLTKQTELTKLCRIAIDIPNSMDSEWKIDVKKSSTQLPSIVRERLKRVIERFIGTSKRTYRSRGQKLVDTTLYPIWNRIQKNDQIIFRPNLEHPLFLSYLEKLPEGLHEGFKSCLRLVGSGLPIETLHAELVGNPESVISDSAMESDLKQAVNDLAKVLIANGVAIDKLSDSMQSYHLFRTNWNLVKKLINDFVKEQVT

SEQ ID NO: 7572 - protein, 918 aa, Xenorhabdus bovienii
  Coding DNA sequence: Name=SeqID_1464
  Homolog annotation: Query=51..909bp; Hit=60..880bp; Blast score=461; Percent Identity=35.0; E value=1e-128; Homolog= ref|NP_691096.1|
MINIERVKNCVMNMVETALFNIPSKKTEEELRTFIRNVASITPLEAGERKLAEQEIEQIAREIETKQGIKAGLGAFIDKEDFEPWLDNAKSHIEPFYWNRYRQLLLQTGLPKDVVIATDTVTDKILSRLGDPNKQTPWDRRGMVVGHVQSGKTANYIGLICKAADAGYRLIIVIAGIHSNLRNQTQARIDEGFIGRDTGKSQKKKRGEAKNSIGVGLFDSNKTPVSLTNTLRDFNKGTASTNTSEIDSYNVPVVLVIKKNHRTLTNLLEWLKDNSARGDREMIDQPMLLIDDEADNASINTKYNKKLVTTINRQIRELLNTFHRSCYIGYTATPFANIFIDPDQEDEMYNEDLFPRDFIIGLDAPSNYFGPSKIFVRDLQGEGESTWLRNITDNEDILPIIHENYREIHTLPNSLINALRTFLIARAIRNLRGQIKSHCSMLVNASRFTAVQGKIRNRLYEVLEHIQNAVRINASRKAEALKDPEIAALYSVWEQEYSDAEPDWFKIQAILLDTIASAKVVEVNSRINDLDYTSSDERGQTVIAVGGFSLSRGLTLEGLTVTWFLRNTKMYDTLMQMGRWFGYRNNYEDLCRIWMPPEGISWYSFIAAAAEELHDELRTLEQAKATPKMFGLAVRKHPATLLVTARNKMGSGRPVTMQVGLSRKFIETSRVSANLKDLNMNKELAKRLIQNLSIGNFEETKPSAGTCVMHVPFEMVEQFLSGWGNAEQSITTDPDLVLKYIRAKKNDHDELEYWDILISGRQSGEVNHELGREIIPIRRSVEPSDLLNNFISFNGQRMRIADASFEKAGLSEDEISIAEAGYSINGKQKNYPGHIYRSVRKRPLLIIMLVETFPMKGEEQKLGAELIPLEPIIAWGISFPESKRPNESVEYIVNTVRYQEIFGTEDEDDDQEEELCEQ

SEQ ID NO: 7573 - protein, 318 aa, Xenorhabdus bovienii
  Coding DNA sequence: Name=SeqID_1465
  Homolog annotation: Query=2..306bp; Hit=4..310bp; Blast score=127; Percent Identity=30.0; E value=2e-28; Homolog= ref|NP_691097.1|
VSSNPWNKLGIDNARRINSEGHFDFFWVVLEAGIPGLMLKLPVVSQPIFRLPKLKNLIASFRPVANGWAFVLGLKERSQIELFEILCRDVVAAGEAAESCEDSLARTIQRTQRWHHLLRGGRSGGLSVEEQQGLVGELAFLRELVSAFGEKTAIESWTGPMGAAKDFEFIGCYIEVKTRRIAAKPFIAISSDEQLAAIDNSRLFLRVINIASAVLPKGMSLHEHVRITAELFEKSGDVFDVWEDALYSTGYDPENGYDGKCWQLSSITDYEVIEGFPRISPPLPVGVQNVRYSISLDACSPFELETDLIDSIRENLDV

SEQ ID NO: 7574 - protein, 696 aa, Xenorhabdus bovienii
  Coding DNA sequence: Name=SeqID_1466
  Homolog annotation: Query=1..687bp; Hit=1..677bp; Blast score=387; Percent Identity=35.0; E value=1e-106; Homolog= ref|NP_691098.1|
MNELFEFHQHLIADVQGDADALGLVTVEAFFEKVGELLTEAGEIDGASRAYLEGNYSRATLQLDGYGGDPRDSDGILSLILCDFDSNKGLRELHKKHIQKLSQRLYNFLSSSLKSDFRDQLEETSPGFGVADLICSTWNAIDKIKLIIVTNAIFRTRTDSVNVEELYGKSVTVSVWDLERLKRFMEQGQSRANPVIDFEQDFGGAIPCLPASRGDKALESYLVVIPGKQLAAIYDKWGPRLLEANVRSFLQIRGKVNKGIRDTIRDEPHMFFSYNNGLSATADSIEINQTSTGLYLTRADNLQIVNGGQTTASLHAARKIFAEQLTQVYVQLKLTIAPREQSEIVVPRISECANSQNKVNTADFFANHPFHIRTEELSRRILTPAGNDNYRETKWFYERARGQYADERNRRTQAERKKFDAEFPRSQFFTKTDLAKYENTWACLPHIVSLGAQKNFAEFAKTIGRRWGSDGVSFDDLWFKRMIAKVLIFRATEKLVSNADWYEGGYRANIVTYAIAKLVSDAGAYEMLIDLDSVWRYQKVSDELKTALLMAGHEAQNVITNPPNGIRNFSEWAKKQTCWQSLSERKLPYTKTFTQMLISPELAEEKVRETQANKALQNSVEAELKVFQLGASFWSDARNWARERGLLSPKEISIIEACAAIPHKMPSSKQCSIAISALKKLQSEGFSATEIFKDSN

SEQ ID NO: 7575 - protein, 49 aa, Xenorhabdus bovienii
  Coding DNA sequence: Name=SeqID_1467
MLNSAHINMYELIQTILTNMVNFIFRFIVTLKKLGLAYILQQAQFIFRE

SEQ ID NO: 7576 - protein, 511 aa, Xenorhabdus bovienii
  Coding DNA sequence: Name=SeqID_1468
  Gene classification: Gene name=Dcm; Function=Site-specific DNA methylase; Function class=L DNA replication, recombination and repair
  Homolog annotation: Query=5..502bp; Hit=3..401bp; Blast score=186; Percent Identity=32.0; E value=4e-47; Homolog= MTH495 COG0270
MKTGEILVIDLFAGPGGLGEGISFCRHKNGNYPFKIGVSVEKESSAHKTLTTRAFYRKIKDNPSSLKDYFLYLEGELSRRELFQRYPTEASKAHNETLDKPRALGEDNILIHERIRELTEKHKGPKVVIGGPPCQAYSLAGRTRNAGIKDYRAENDHRNFLYKEYLEVLSIAQPDVFVMENVRGILSAKVNGELIFPKILDDLREPGKITNRLGVKGYKIYSLVKEDRDLINPNYTDFDDFIIKSEQYGIPQARHRVILLGVRDDIKQVPQILTPVEKMVTVEQVLSDLPPLRSGFSKRKDDEREWRNIVEANAQKVQEYLEDVFGWNAVSTLEIKPFKGLKRSEKEKTTNLSSNIPEYLQEWYLKNVPRIVLNHETRGHMEGDLVRYAFSSAYTYLNNGVSPKSRDFPKNLAPAHENWNTGTHTDRFRTQAANKCATTVTSHISKDGHYFIHYDPRQCRSLTVREAARLQTFPDNYVFEGNRTQQYVQVGNAVPPYLARQIGEIVLNLLE

SEQ ID NO: 7577 - protein, 44 aa, Xenorhabdus bovienii
  Coding DNA sequence: Name=SeqID_1469
MQRKWNYLWFLCVRTRTICFILKSLSRKSSLVLCLYWLMVSVEI

SEQ ID NO: 7578 - protein, 50 aa, Xenorhabdus bovienii
  Coding DNA sequence: Name=SeqID_1470
MEVIDEPTVYCPVGGLARCIGLGWCTVERRGRHDESGRGTSQTISRGAGK

SEQ ID NO: 7579 - protein, 294 aa, Xenorhabdus bovienii
  Coding DNA sequence: Name=SeqID_1471
  Homolog annotation: Query=1..283bp; Hit=1..283bp; Blast score=353; Percent Identity=60.0; E value=2e-96; Homolog= ref|NP_927686.1|
MYNLEELYCCVDDFCQKFIPLWHQQLIENGLRKRHREASLSLSEVMMILILFHMSHYRDFKTFYIEHVKQYLTADFPGLVSYTRILTLKKRALIPLCAFLSSRKAQTQGIAFIDSTKIAVCHNLRIPRHRVFEGMAQRGKTSTGWFYGFKLHLVINDCGELLAVKLTAGNQDDRQPVRALTKGLTGCLYGDKGYLSQALCDELEAEGVTLITNVRSNMKTKALSLWDRLMLRRRFLIETVVDQLKNISQIAHSRHRSQLGFLLEVAAGLIAYTFQPKKPSLNLRDNEIAIFKRS

SEQ ID NO: 7580 - protein, 812 aa, Xenorhabdus bovienii
  Coding DNA sequence: Name=SeqID_1472
  Gene classification: Function=Predicted ATPase; Function class=R General function prediction only
  Homolog annotation: Query=404..803bp; Hit=2..401bp; Blast score=450; Percent Identity=53.0; E value=1e-126; Homolog= Z0339_2 COG3378
MADTQSNQTHPKFTHSDNTGSQNPLDLIQTVKKSAMYHWENLLPACSIDIPAKGKHGACPVCGGTDRFHFIDDHHHGNWHCRQCDAPNYGDGLDLVARTKGISTTEAAKVIADALALPLPEPKPARETIQTTQSIAEKVASLMAQAVAGQSPYLAAKGLDFPNQRLLFNNSTLLPMATLDKKVTGAQIIKPDGTKKLLSGSQKKGAFIPVSELEDQSDPVVITEGYATALTVNLLYKGTVLAALDAGNLYSVAKAVRERWSDTKIIFAADNDWHHPDELDKHGKPKVNIGRVLAEKAALAVNGWVTLPPTEYKTDWDDYRQQHGVEMAKLAFSQGLYQPVSTKKKSAIQPNNNELSKLTLCQMGASQRGEVLLARYDGDLALDGASETVHHYDGIVWRPVSDRDLKREMVAAFMEEKLPYSPHGISSAVDALKLQLPMMQPPERHLIGFSNGVFDLKTCQFRPHRKNDWLLLANDVEFNSPISGETLKDHAPQFWQWLNRATANCENKFDRVLAALFMVLANRYDWQLFLEITGAGGSGKSIFAEICSMLAGKGNTVSASMAALENPRERALIVGYSLIILPDQTRYVGDGSGIKAITGGDGVAIDPKHKQPYSTRIPAVVLAVNNNAMSFSDRSGGVSRRRVIFNFSEVVPENERDPLLRDKIAAELPVIIRHLLYRFADPQAARSLLAEQQKSAEALDIKRGTDPLVDFCGYLIASNETDGLLIGNAEIMPFNPHKYLYHAYLAYMKGNNLNKPVSVTRFGMDMPGALAEYSQHYLRKKSKYGIRSNLNLNIDTAIEWMPKLTRNDQPEE

SEQ ID NO: 7581 - protein, 54 aa, Xenorhabdus bovienii
  Coding DNA sequence: Name=SeqID_1473
MCKFRVSLVRLCISHIVSLLYVVVRRLKRVRAHWGVVFLCYVSYVMLFSMLCRS

SEQ ID NO: 7582 - protein, 66 aa, Xenorhabdus bovienii
  Coding DNA sequence: Name=SeqID_1474
  Gene classification: Gene name=AlpA; Function=Predicted transcriptional regulator; Function class=K Transcription
  Homolog annotation: Query=1..64bp; Hit=1..64bp; Blast score=77; Percent Identity=59.0; E value=3e-15; Homolog= Z3946 COG3311
MTAPKENLIRLPEVQRRTGYSKAWIYKLISAGEFPKQVKLGSRSIAFIESEIDNWIAQRIAESRAA

SEQ ID NO: 7583 - protein, 64 aa, Xenorhabdus bovienii
  Coding DNA sequence: Name=SeqID_1475
MNSVNCFSDLLNLFFWNLYLFIGILYKNHTLLAVPTKYEKSPLLYALLPNFPISTFSPRSSISI

SEQ ID NO: 7584 - protein, 404 aa, Xenorhabdus bovienii
  Coding DNA sequence: Name=SeqID_1476
  Gene classification: Gene name=XerC; Function=Integrase; Function class=L DNA replication, recombination and repair
  Homolog annotation: Query=1..389bp; Hit=1..389bp; Blast score=498; Percent Identity=60.0; E value=1e-141; Homolog= ZintL COG0582
MKLTARQVDTAKPKEKPYKLADGGGLYLLVNPNGSRYWRLKYRIVGKEKLLALGVYPEISLAEARAKRNDARRTLSSGNDPIEEKKAEKAAKVFAVSNSFESIAIEWHEYKRPNWSQGYAEDILEYLKKDIFPYIGKRAVTEIKPAEMLAVLRKMEQRGVLDKLKKTRQACRQIFTYAVITGRAEFNPVTDLASALKAPKQKHFPHLLADQLHDFLIALSGYSGSQVTQSATRMLMLTGVRTIELRESEWAEFDFDNDLWQIPAERMKMRRLHIVPLSNQVKAILIKLHEITGRGKYVFPGRNDAGKPMSEAAINQVIKRIGYDGRATGHGFRHTMSTILHEQGYNTAWIETQLAHVDKNSIRGTYNHAQYLDGRLEMLQWYADHMEMLERGENVLIGKFGKRA

SEQ ID NO: 7585 - protein, 34 aa, Xenorhabdus bovienii
  Coding DNA sequence: Name=SeqID_1477
MVRPTGFEPVTYGLEGQKPLISLYFLQFHLVSLF

SEQ ID NO: 7586 - protein, 405 aa, Xenorhabdus bovienii
  Coding DNA sequence: Name=SeqID_1478
  Gene classification: Gene name=XerC; Function=Integrase; Function class=L DNA replication, recombination and repair
  Homolog annotation: Query=30..405bp; Hit=50..422bp; Blast score=157; Percent Identity=32.0; E value=3e-38; Homolog= CC2681 COG0582
MASTLLTDSKIRGLKPKNSAYYTWQAAATRGTGRLGVKTYPSGRKVFVYRYFKNGKEKFINLGDFPALSLAEALSKSRDAAANVSAPEKAIINHATIEQLFSDYIADQKRRGKRSYDKTQYRLNQVLDSQHIERNTPAKDITPEHIKRVLAEFISRGAVAGSNKVRANLHAVFNFGLFADNDPAKLNEKVIYGLDRNPVTIVPRQEGADKALDRFLSWDEMKEILKLFRISSTVFPIHPDYGRLILLCIFTGGQRPWEIMTNTKDNWDKKNNTLTVPPHISKNGDYHVIPLCESATEILECQAKQYPGSEFLFPGETKEGHLLTAEYAKQIRKFCARYDFEKFTPRDIRRTFKTLAGEMGISSEMRDRLQNHKKPGVSTKHYDRYDYLKEKREIIAQWESKLLSL

SEQ ID NO: 7587 - protein, 77 aa, Xenorhabdus bovienii
  Coding DNA sequence: Name=SeqID_1479
VVRYTNHIRYLRILFFNSNYFNFLRCYCRMSFFISLYLIWPLLLRYLLLPSFYLSRISRYIRTTKSLQIIAKQPIAS

SEQ ID NO: 7588 - protein, 71 aa, Xenorhabdus bovienii
  Coding DNA sequence: Name=SeqID_1480
MFFFIDMMCLPEMMERYVIGIPPDNNAGHNIRVQDLNLTHIVSDKLVNSGRNRLFCDNLKRLCCPNISADP

SEQ ID NO: 7589 - protein, 728 aa, Xenorhabdus bovienii
  Coding DNA sequence: Name=SeqID_1481
  Gene classification: Gene name=VgrG; Function=Uncharacterized BCR; Function class=S Function unknown
  Homolog annotation: Query=109..683bp; Hit=15..582bp; Blast score=543; Percent Identity=48.0; E value=1e-154; Homolog= ZvgrE COG3501
MSIKKNINKLKKGQALVQQGQEAVQKAKQVAGKLGGGITGTAGLLPGGGFTGGIGGNSGSSMSGTAGLIPGGGFTGGKGLAERAAGGQNAATKALEKAAQMLMGGRDPSGLQFTLTAGGLPPQTFVVTNFTLNESFSQPFSLSVGLASADPAIDFPAVLDRTATLTILQNGIEQRSITGIVSRFEQGNTGLHQTTYQMTIRPDLWRTTLRQNSRIFQQQDIATILTTLLKEHNIRDVIFSLRHPHPAREFCVQYQESDFAFLQRLTAEEGIFYFFECSNGRNTLVFADDCGSVPPGIVIPYQPGEVSTGGEPAISSLTCSAQVRPAQVQLKDYTFKNPAWPAEFHQQMRDENLQQLYYEHYDYPGRFKDEAHGKDFTRYRLEALRSDAMMGQGSGNAITLQPGKLFILDNHPRADLNQSWQTVSTSHSGSQPGALETKTGDSGTTLHSHFYFIRQNQNWRPAPLPKPVVDGPQIAKVVGPAGEEIFCDQYGRVRLQFPWDRYGRSDDQSSCWIRVSQPWAGQGWGMLAIPRIGQEVVVDFLHSDPDQPIVTGRTYHASNIPPGTLPGSKTQMAFRSKTHKGQGYNELLFEDAKGSELLSLHAQKDMYTKVLNNRDTHVLANHSETVEKNQTIKVNENKEETVTLNSTETVKEVRKLITGKDYIIEVGAHKAETITNTLAINVGDVIELRCGLSVLRMDSAGRITLQGSEFKFEASGAVQITGKDIDLN

SEQ ID NO: 7590 - protein, 408 aa, Xenorhabdus bovienii
  Coding DNA sequence: Name=SeqID_1482
  Homolog annotation: Query=1..368bp; Hit=96..409bp; Blast score=137; Percent Identity=31.0; E value=5e-31; Homolog= ref|ZP_00005220.1|
MEFRNLTPFAVMNYSMLDVDDTEHHVAVMKIGYQLLPTGPGEYSAELLPAPPLCLQDEYRRAMNASPILQESDLAPFKPRCDVIVNGTAYAPEGKPCTEFPVRLQVQSKQGQTLIDKTLTVIGEREFIRDAGGNWQLTEPKPFATLPLDYRYAFGGQCKIYADEEASQHLQERDRLTPEQRQQHPDGENAPVAHATCETNPLGTGFITPWYANAKQLTRYPAPRIIRPDAEFTAQHFAAQLGGTLSADTPACQPQGMGFIGRPWLPRRQLAGTYDADWLAHRHPYLPKDFDFRYWNGAPTDQQIDWPDTDTSLSLQGMTPSGNLHVTLPGHRPFILLRMHEGGLLPVPMRLDTLILDSDALTLHITCRLNFKTSLPVRVAEARFEIDPDAPLLKLAPPEPEKETAHGG

SEQ ID NO: 7591 - protein, 135 aa, Xenorhabdus bovienii
  Coding DNA sequence: Name=SeqID_1483
  Homolog annotation: Query=18..134bp; Hit=1..117bp; Blast score=97; Percent Identity=44.0; E value=4e-20; Homolog= ref|ZP_00031153.1|
MLRYSNSPPLNLKRRPPMADNYIARTAGEWLIVGILPDVCKTPMGASTPPIPYPVIAKLAGSDVPVKSVRANGQPVVVFAQSFVPQTLGDQPGVANGVKSGTVGAKCHPKAHTQTVRAGNKLVLRHGDEFWMNGA

SEQ ID NO: 7592 - protein, 1553 aa, Xenorhabdus bovienii
  Coding DNA sequence: Name=SeqID_1484
  Gene classification: Gene name=RhsA; Function=Rhs family protein; Function class=M Cell envelope biogenesis, outer membrane
  Homolog annotation: Query=342..1416bp; Hit=393..1491bp; Blast score =348; Percent Identity=29.0; E value=3e-95; Homolog= Z0705 COG3209
MGETISITGGRDEKVFCEAYNIRTLAEAEAIQKHIPALIQQETMDNSLLTAGDIEYITEAEGRLAVKVIDKFKSGEFPLEEWKHTPPEPNEPLPAKSRDDSPSGTGNTIGKIVGQAPQAAQPPQEANTAVTPETEQEKGFLDQAGELWNKTKEGVTKWGEEAGEKLSAAWDNPGKAAIGAAKGVWNTVPDVGEFVFRTTAGMPAAMMSSSGTVLKYAGADALGDTALAAADAWNKQVVDKAVELSHVDAIRFDITDKAEQGGALIFDGVSLATGVGGLIRGAARQGTKATAKATKPAPGAKVKEKPQDAPDAKPQKVPPKDDATPSNKKDGNDNGLSTKEGDPVDMATGDFLQVWPVLAIPGLLPISLNRTYRSTADLHGLFGPKWADDWSRQLVIGHGEVHYTHADGVVYDFATPDNRVLSRNRHLPHCLLTGDLMGALCLTDRRAQLTYHFSPSSGSAQKLSAITDRRQNRIDFSYDKHARLIEVTRNDGLRLSLHYRDRQLHTLNMHETRDDQSIKQRLLTCHYDPQGYLNECDAFQHNHLWHEYDIQGRMIRWHDTDQTDLMISYDDRGRVLSTTSPSGYWHDRFRYDDNSRITTYLDGEGGETRYHYDSNGLVIREVDPLGRVTRRQWRHSLLMWESDPSGQMTTFDYNADGELTEVVLPTGETFVYAYDEHGQLTESHLPTGERWQWHYDEQGNLTALTNPLGHREEYQYGLHGELRQRLLPDGQTWHYAYDEHQRLAAVMMPNGETTGLELDSLGRLRRFTDALKQETRYRYRPDHASLIHGSLSEITLADGITQKLDYDSERRVVAVTDGEGRTTRYTYGAFDLLNQVTRPDGTILLFGYDRLTRLNSVTTSTGETYRYKRDAAGQIIRETDFTGRTLAYQYDKLGRRIQTSYPDGQQLRWCYSTAGLLVKQESWQPEENQLVLKDITTYEYNKRYQLVKATNADAIVEYEYDKTTGLPTCERINGREITREWDNLTGRPVSESVDGNTLHFGYNLPGSLNHFQLNQHAPLTFQHDALGREMMRESANGFILASRYTATGLLTHQSAGQATQFFRETLAQNDPHFPPQASAVNRSWQYDRAHNVRVIDDSRWGQTRYRYNANDQILHTLFEGARPHEEQFSYDTNGNLSQHLPTDARGAVEQIIQRQKAGRVVQQGNIRYAYDDNGRLVEKTEQRDGFRPQIWRYRWDTQNQLTHFETPDGSRWHYRYDAFGRRIRKLKVHDGKLAAANLQLWLSGKPDLAPRADAIMGQDYLWSGDQLIEETPVYADGTPAEGQRVRWLYEPGSLTPSARLEKGKLHYIVSDHQGTPREMLSEEGVLVWAQRLTTWGKSERFQVIASNNPDYHVGCNLRFMGQFEDEESGLFYNRFRYYSPETGQYISPDPIGLQGGFNPYSYVHNPTKWVDPYGLAGGVGNKGEPIQKSPSDFARSWQGQGDYPGVDRFRDITVKKGTILMAGAPGQGSFYTTVRAVERSGYSKEGVFKGLQVIPHKDFGYRPGMTAYRVLEDTPAAFGIVRANPHAGPGGLPQIVIEKYDGILEPLYSVKLK

SEQ ID NO: 7593 - protein, 142 aa, Xenorhabdus bovienii
  Coding DNA sequence: Name=SeqID_1485
MIYANGNVNLNGIIINPLIKKDIFLEKTSELNPEKIYIFENRIRYSIDNVLFLNLKYIVSAVFQDEFLIYIELLPFDKEIENKINVFTNENQMRNKLINDDLLKSLFGSSEKLYFPWGSIESIADTRSGMSYISISYKNSNH

SEQ ID NO: 7594 - protein, 125 aa, Xenorhabdus bovienii
  Coding DNA sequence: Name=SeqID_1486
LQGKFFKFTFVEPSIWWPFFIPHEVFKIRGFSGCLTICQNGCSRWVGICNVLQQNDKASAPSTIHLKGQWIKALHSPSKLWMAVCADPRQDQLTEVKLRIRELIGGYHKKPEDHEDLPGYSYLTQ

SEQ ID NO: 7595 - protein, 119 aa, Xenorhabdus bovienii
  Coding DNA sequence: Name=SeqID_1487
  Homolog annotation: Query=6..107bp; Hit=243..343bp; Blast score=119; Percent Identity=50.0; E value=8e-27; Homolog= ref|ZP_00061855.1|
MWYKEWPPNRGFYEGKFEKLTLQPDTRLDRYSTDYGTFVSPEGIPYSARALKPGSDGRPYTVFVVKKPITADAGEIAPWFGYPGRGTQYDLPAKVKELIDNGSLEKVSKTLKGKPIPLD

SEQ ID NO: 7596 - protein, 80 aa, Xenorhabdus bovienii
  Coding DNA sequence: Name=SeqID_1488
MNKEELRKRLKENKISSSYYSLEGGAPDDRICLSYEDGYWLVYHAERGARSWVESFEKEGDACQRFWEYVSDIKRCMDKT

SEQ ID NO: 7597 - protein, 37 aa, Xenorhabdus bovienii
  Coding DNA sequence: Name=SeqID_1489
MKSYLSPSCINTGFFLIIHHLPSPYVTEFIKASKGRE

SEQ ID NO: 7598 - protein, 37 aa, Xenorhabdus bovienii
  Coding DNA sequence: Name=SeqID_1490
MHDGDKYDFIYKKNHINCPICRSDIFLVYTTPMILIS

SEQ ID NO: 7599 - protein, 75 aa, Xenorhabdus bovienii
  Coding DNA sequence: Name=SeqID_1491
LQDNLAKNVACLVKNENECGHRYTYKRLALRINYTKCELGGHDFAVIFTFGEIQNTRYGSHLLGVFQVTKEKLDQ

SEQ ID NO: 7600 - protein, 126 aa, Xenorhabdus bovienii
  Coding DNA sequence: Name=SeqID_1492
MNFKMNNLKKKEMIYDGLEDGFYELNHTIQCPYCDEKITVSVSSLKNLSELDEHLRVAIKDRITGIKEFPLSTIMIHNYDDLSAMYGIYDCKIQNVKLLAIFAVGERQPARYQVILLGIFKYPEMN

SEQ ID NO: 7601 - protein, 46 aa, Xenorhabdus bovienii
  Coding DNA sequence: Name=SeqID_1493
MIFQVVQAHVPDRIANAAYARANLDNIGNAQYIKTTDLNKAQFKPK

SEQ ID NO: 7602 - protein, 103 aa, Xenorhabdus bovienii
  Coding DNA sequence: Name=SeqID_1494
MERLIVNVKVNWVSEDQDGKSNLPLNILYYVITEPMKGKIGEPTYWSLVLDIKSNSYDAGEEERVGLGKAYFLVDDAPDFLLTQGFTLNVYEGPKFVAVVEVL

SEQ ID NO: 7603 - protein, 42 aa, Xenorhabdus bovienii
  Coding DNA sequence: Name=SeqID_1495
LLINSNWLIFYLNSNRKNYASFQFGLSLISILPRNYQLILAS

SEQ ID NO: 7604 - protein, 41 aa, Xenorhabdus bovienii
  Coding DNA sequence: Name=SeqID_1496
MEIWVTIIVYTNLTPRCRLVMIIYSIKSVLYEFLIMHLQVC

SEQ ID NO: 7605 - protein, 137 aa, Xenorhabdus bovienii
  Coding DNA sequence: Name=SeqID_1497
  Homolog annotation: Query=32..135bp; Hit=31..136bp; Blast score=65; Percent Identity=35.0; E value=2e-10; Homolog= gb|AAP32758.1|
MDVNERKIKIIINGKMEEAELHLITSPDRHCCLKIFHNNNQLAESNDTDYFSCFIDLRNQLKDIVFLCKGAKINVFPSAMQRDMGLGIGAYETKLGQYGLPENQVHIFDFEDKDVDVSPEEQRKFHYQWFESLRKNN

SEQ ID NO: 7606 - protein, 54 aa, Xenorhabdus bovienii
  Coding DNA sequence: Name=SeqID_1498
VIFRLIAIHWAQSHKGDIRSWTQFINFTTLSAIEKSYTAQAGLRSDSVINIILP

SEQ ID NO: 7607 - protein, 117 aa, Xenorhabdus bovienii
  Coding DNA sequence: Name=SeqID_1499
MELKFSTEDAAKPECVLSGDDMQQMGFTPNTLFLIQQYNNGLMLTLAKPDDDPATLFHAVEDDPKQGIDWVRDNGELYLAGDWLTETGLLDNPVQVVFGYGKIMLMTESDLRPACAV

SEQ ID NO: 7608 - protein, 109 aa, Xenorhabdus bovienii
  Coding DNA sequence: Name=SeqID_1500
  Homolog annotation: Query=12..103bp; Hit=9..91bp; Blast score=82; Percent Identity=46.0; E value=1e-15; Homolog= ref|NP_930598.1|
MADTHSTAGTRIYKISQPERYQKVVYRPKGVNRTIPAINLSGKWLLEAGFSISDPLKIRVMPGCLIITAQNFHELWHCLKSLNEGEWDDIAVARWLQQFPGKLSKKLPG

SEQ ID NO: 7609 - protein, 30 aa, Xenorhabdus bovienii
  Coding DNA sequence: Name=SeqID_1501
MRVPAVECVSAIITTSLVVVVSGFIVFLAR

SEQ ID NO: 7610 - protein, 53 aa, Xenorhabdus bovienii
  Coding DNA sequence: Name=SeqID_1502
MYSISIDYRLGIAASCRASKRGKPNSRITRRHLGKWKSEQTLHYYSYCSNVPI

SEQ ID NO: 7611 - protein, 84 aa, Xenorhabdus bovienii
  Coding DNA sequence: Name=SeqID_1503
  Homolog annotation: Query=4..84bp; Hit=3..83bp; Blast score=97; Percent Identity=66.0; E value=5e-20; Homolog= ref|NP_791823.1|
MTITTLSSRELNQDVTRAKKATKNGPVFITDRGKPAHVLLSIEEYRLLTKQHRNIADSLAMPGVADIEFEPQRMTIGTRPADFS

SEQ ID NO: 7612 - protein, 143 aa, Xenorhabdus bovienii
  Coding DNA sequence: Name=SeqID_1504
  Gene classification: Gene name=VapC; Function=Predicted nucleic acid -binding protein, contains PIN domain; Function class=R General function prediction only
  Homolog annotation: Query=2..139bp; Hit=1..137bp; Blast score=71; Percent Identity=36.0; E value=3e-13; Homolog= XF1589 COG1487
MMYILDTNVVSELRKIRAGKADPNVAKWTENINAADLFVSAITIMELELGVLLIERKDATQGAMLRAWLEQHVLPEFSERTLPVDTAVAQRCARLHVPDRCSERDALIAATALVHGMTVVTRNVADFQSTGVTILNPWESNPS

SEQ ID NO: 7613 - protein, 876 aa, Xenorhabdus bovienii
  Coding DNA sequence: Name=SeqID_1505
  Homolog annotation: Query=1..829bp; Hit=1..827bp; Blast score=971; Percent Identity=56.0; E value=0; Homolog= ref|NP_405679.1|
MEKQPIQGNKGGSQHPRIPVEAPDSLQSTSYTKILLALGEGEFAGELDGRRIFLDNTPLIGADGTPNFEGVKWEFRPGTPHQAYIPGMPAVENARTVSAELVSSWVTTVTNTQLSAVRLRLSWPQLQRQKDNGDTVGYRIEYAIDLATDGGAFKEILKTAVDGKTTTKYERSHRVDLPTAYSGWQVRLRRLTPKENSNRIADAMVVEAITEVIDAKLSYPETALLFVQFDAKQFRNIPQITCEPKMRIIRVPANYNPDSRRYYGSWDGTFKWAWSDNPAWVLYDLMINDRFSIGTRVKTENLNLAKWDLYSIAQYCDQTVSDGEGGEEPRFTCNVYIQSQEDAWAVLRDIAGIFRGMTFWANNNMNVLADMPRDMDYLFTGANVRDGKFTYSSASEKTHYSTAMVSWSDPQNGYQDAIEPVFEHRLIRRYGIRQADFTAIGCTRQSEAIRRGKWVLHTNEHDRTVTFTVGLEGHIPLPGYLIGVSDNLLSGSGMSGRIQAMRLRYIILDRVPSAKVGDWLVINLPSGKAERDLITAINGQEISVSNRGYAYSDPPEVGAVWAIESSYVAEQPFRVMGIKAGEDGVSFDITAVEHNPDKYALIDKDTRIDERPVTVIPPSVQPAPKNVLIDSYYSLNQGIISTTLRITWDAADSAVAYEVEWRKDNGNWITAPRTTARSLEVPNVDDGRYQARVRATNAAAISSIWMNTQDTLLGSRKEAPSAPQSLRTTSLLFGIRLDWDFANPTDVLLKTEIGYNKNGEDDDTLQFADIAYPQRTHTLQGLAVGEKLYFRARLVDKSGNASAWTSLVSGTASNDTGWIVEASQDHFLDAGTGRCLQEQLNEQAKADARHKQSIAENTQAIERLNDMLKDLKRRIQ

SEQ ID NO: 7614 - protein, 191 aa, Xenorhabdus bovienii
  Coding DNA sequence: Name=SeqID_1506
  Homolog annotation: Query=4..190bp; Hit=9..199bp; Blast score=197; Percent Identity=57.0; E value=8e-50; Homolog= ref|ZP_00141097.1|
MNTLRTVRLYGVLGAQFGRVHKLAVSTPQEAIRALSVLIKGFERFLLTAKEQGLTFAVFNGKRNISREELVFSGQDDIRIAPMIIGSKNAGVFQTILGAVLVVAGAFLWATPFGAPMVMSGVGMMLGGVVQMLSPMPGGLARREDPDNKPSYAFGGPVNTVAQGNPVPIGYGRRRIGGAIISAGIYAEDQQ

SEQ ID NO: 7615 - protein, 248 aa, Xenorhabdus bovienii
  Coding DNA sequence: Name=SeqID_1507
  Gene classification: Function=Uncharacterized ACR, PAD1/JAB1-related; Function class=S Function unknown
  Homolog annotation: Query=4..127bp; Hit=3..126bp; Blast score=127; Percent Identity=49.0; E value=2e-29; Homolog= PA0639_1 COG1310
MKILRKSTTCAIMAHAQAAYPDECCGLIIQQRHRQHYLPCRNTASLPTEQFRIHPEDYAAAEDQGAIVAIVHSHPDATTQPSQLDIAQCDLSQIPWVIVSWPGGDIRTLMPIAGIKPLIGRPFVHGIWDCYAIVRDWYKLEQAIELPGFERTDGWWNRGENLYMKHYAAAGFVVCRGELQAGDVIIMQVQANEPNHASVYLGNGLMLHHLYGQLSKREPYYGYWQERTITTLRHSSASADFLFRGVTS

SEQ ID NO: 7616 - protein, 245 aa, Xenorhabdus bovienii
  Coding DNA sequence: Name=SeqID_1508
  Homolog annotation: Query=1..245bp; Hit=1..250bp; Blast score=328; Percent Identity=60.0; E value=6e-89; Homolog= ref|NP_405670.1|
MTINATLQRLEPGSKIVLFVVDGSVFGGPVLYFHNHPIPYTGAELENTGNLPVKSLWWQGVEYKPWPVSIEGLEVTGDGRAVTPTLNVANLDGTLSALCLAYQNMVQARVTIRMTFAHYLDARNFLDGNPQADPTQEKIDVFYIDSKTQEDNESIQFSLSSPADLQGIKIPTRQIHSLCTWCIRGQYRQSPCGYIGTRYFNERGKPTDDPASDACGGLMSDCKKRFGDTEQLPFGGFPGSALLRR

SEQ ID NO: 7617 - protein, 110 aa, Xenorhabdus bovienii
  Coding DNA sequence: Name=SeqID_1509
  Homolog annotation: Query=1..110bp; Hit=1..111bp; Blast score=82; Percent Identity=39.0; E value=1e-15; Homolog= ref|NP_718521.1|
MIKTFDFPARVGAVGEFEPIVRSVQFGDGYKQTSGDGINTQRESWPLSFVGALSDIQPIIAFLREHQGWRPFKWRNPLFELGLYQAGKFNIQANGAYFTLSVTFTLIYHP

SEQ ID NO: 7618 - protein, 1111 aa, Xenorhabdus bovienii
  Coding DNA sequence: Name=SeqID_1510
  Homolog annotation: Query=1..946bp; Hit=1..941bp; Blast score=710; Percent Identity=47.0; E value=0; Homolog= ref|NP_892060.1|
MANLSTLTVGLLVNATSFKSRIMDAYRYAGRESERFTDKAGSDAKKLKKTYSSLASHIKSVSGQLALLAGTGFSLNTVISHTRKYGQALSDLSAITGATGEQLKKLDGNAQRIGRTTEFGATRIAEAFKLMASAKPELLKSTEALTLATEKAVILAQASGIDLPDATRALALSLNQFGASAEQADRFINVLAAGAKYGSSEINETAQAIKNGGTAAAQAGISFEELGAVIQILAERGIKGGEAGTAIRNVILALERSTDKNLKPSVVGLSSALGSLTGKNLSTAQAVKLFGRANVSAASNLVTGREKLEELTQALTGTQVAYEQVSARANNLGADLDVLMSAFEGMALKIGQSADGSLRTGVQGATNAINALSENFNLVASVALHTLIPVMATKLTAGLRENITAWRATEKAARDVAKQQAETAKQTIEQANATLRSTEAQGRHIQYLERTNRLHGLSVNYAKEKRTLIRQETEALKLQTQATGQLEAANRRLSYSYRALSAAGGVTRGALAMIGGPFGAAMLAGSALYGLYNHSVQAREGLRHLKDETVDTVAELQRLSRIKVEIELDKTDDDINHLKEELKQIDSQLERYSQTRIKRLQNRQKGFLNFLYEEPKEVEKQGRVLLSRREDILKGIENKTARKKNLQATSVAGIFDQPPPELSKPEGNGTGNPWTGQDPIKEEKQGKQSLNLYQQLRKEIEQTHATSLDRIRFREKEMLGKIYEVGKSGMASESELQRLKILNAENHQKQRLELADKYSPAAALIRQEKEASEELKALYSERLLSEQEYLSASRTLYQTSVKDKLAEQAKQISTPHLDMAGEVDPFVQLQNQLTEQAALYDTYYRNGLISKERHEQLMIAAAYRSKDAQFAAAKNLYASQGDFQKMQMGLLDVVEQRTGNALTGMLTGTKSFSESMRELSASLAQSIIQDLVRIAVQALITKALSGFFGGAMGSMGASSLSSAGGGLSSMGSGTAMTPDVWKSPIMNAKGGVYQSADLNQYSGQIVSQPTLFAFAKGGGVMGEAGPEAILPLKRGADGKLGVQTTGSTGNQTFNTVHIVIYSDGNHDTKTSRGAESAGQDIAKFVDQRFKFLLHKSLSQGGELSAAIRGGR

SEQ ID NO: 7619 - protein, 50 aa, Xenorhabdus bovienii
  Coding DNA sequence: Name=SeqID_1511
LSLPASTLNEWQAYYRLKNRQQPDSPPAASVSAPCDTVRAQCDAVMKLLG

SEQ ID NO: 7620 - protein, 115 aa, Xenorhabdus bovienii
  Coding DNA sequence: Name=SeqID_1512
  Homolog annotation: Query=1..115bp; Hit=9..123bp; Blast score=91; Percent Identity=43.0; E value=3e-18; Homolog= ref|NP_892059.1|
MKALKAALLTPHPQIKAVELFGTQINLRRMTALELLELEEKAEKLSEEGDGRGASRLNVQMVLDCLVDDKGKSIPADYLPTAEELMIVHDNATLIEAIQTVKRHSIGTLEEAEKN

SEQ ID NO: 7621 - protein, 153 aa, Xenorhabdus bovienii
  Coding DNA sequence: Name=SeqID_1513
  Homolog annotation: Query=3..143bp; Hit=5..145bp; Blast score=205; Percent Identity=71.0; E value=2e-52; Homolog= ref|NP_892057.1|
MATSPEYAVLPVGTLVKFGKPGDSVEQMKPLINCKALGATGLTGSFVDCTTLIDTNKQFISDMPEGPEKSLGFIDDPANEDFVSFLNAAEKRETVQFYIALPNKRTATMVLALSGWEMNDINAPASEVIQLTVKGKQNNLVWGIADIKTGVIQ

SEQ ID NO: 7622 - protein, 134 aa, Xenorhabdus bovienii
  Coding DNA sequence: Name=SeqID_1514
  Homolog annotation: Query=4..134bp; Hit=5..135bp; Blast score=122; Percent Identity=49.0; E value=2e-27; Homolog= ref|NP_892056.1|
MITVQTTGWAELGSKLQELDVALQTDIMRKAGKAAMQIVQEDMQVHAGYDKKSNAVHLRDNIPIRTAKSTKYQGGVMITVGPVKTHRIKALAQETGTIKQVAKPFIRPALDYNKQVVLKVLAQEIRAALSAYSK

SEQ ID NO: 7623 - protein, 132 aa, Xenorhabdus bovienii
  Coding DNA sequence: Name=SeqID_1515
  Homolog annotation: Query=4..129bp; Hit=15..140bp; Blast score=132; Percent Identity=51.0; E value=1e-30; Homolog= ref|NP_892055.1|
MCVMIEPELKADLERLTSLPVYPLILPSTVLEGVTYQRISDPRFNTGLAASLLIEARFQISIMVLNDYTKALRLEAKIRSAWESVQHGLLGGYPVQTVSRGILHQEAEELTENRKRYRITRDFIITYTENPV

SEQ ID NO: 7624 - protein, 106 aa, Xenorhabdus bovienii
  Coding DNA sequence: Name=SeqID_1516
  Homolog annotation: Query=1..106bp; Hit=6..113bp; Blast score=72; Percent Identity=44.0; E value=2e-12; Homolog= ref|NP_892054.1|
MKAGELRYRIRLLRPVISRDELGSEMISHHYVATVWAKAEAMSNRKIRTADQQQVIEVQQFTVRSRRDIEPGWLIGHQQRRFTVRAVDRNLVDCTIITTEADVRHD

SEQ ID NO: 7625 - protein, 100 aa, Xenorhabdus bovienii
  Coding DNA sequence: Name=SeqID_1517
  Homolog annotation: Query=9..100bp; Hit=8..107bp; Blast score=75; Percent Identity=41.0; E value=2e-13; Homolog= ref|NP_543093.1|
MPFPTLDLLRQQCRIDSDNSAEDDLLNTYSRAAIKRAESYLNRRLYENEVPKDDPDGLLVTDDVALAIMLIVGFWYDNREAQSLPMGFQALLEPYRFIPL

SEQ ID NO: 7626 - protein, 403 aa, Xenorhabdus bovienii
  Coding DNA sequence: Name=SeqID_1518
  Homolog annotation: Query=1..399bp; Hit=1..399bp; Blast score=516; Percent Identity=65.0; E value=1e-145; Homolog= ref|NP_700379.1|
MAIEVKDVQQVAQEIQQRFDEFRQKNDQRIEAIEAQKGKLSEQVDTLNGKLSELDSLKSALEEELVGLKRPAGGSNTPAVSEHKAAFAQFIRKGKEDRLAELEQKAMQTTADPEGGYAVPEELDRNIISALKEEVVMRAECHVVSVGSPNFKRLVNQGGVNSGWVGETDERPETKTPKLMPIEPTWGEIYGNPAATQTMLDDAFFDVEAFISSELTQEFAEQEESAFTHGDGKNKPKGLLAYGSDVQEDKDRKWGKLQHLLLKKPTEVTADEVMQLIYTLRKPYRTGAKFMMNNKMLFQVRTLKDSQGNYLWQPGLQLGQPSSLLGYGIAENEQFTDLSTGAVPIAFGNFKRCYTILDRLGVRMLRDPYTHKPFIHFYTTKRVGSLLVDSNAVKLLKVAEGKA

SEQ ID NO: 7627 - protein, 218 aa, Xenorhabdus bovienii
  Coding DNA sequence: Name=SeqID_1519
  Gene classification: Function=Phage head maturation protease; Function class=R General function prediction only
  Homolog annotation: Query=23..158bp; Hit=6..134bp; Blast score=80; Percent Identity=38.0; E value=1e-15; Homolog= CC2786 COG3740
MPMITKQRLDMPLRIKSVSDSGEFEGYGSVFGLKDSADDIVLPGAFANTLKQWGEKGGLPALLWQHRMDEPIGIYTEMKEDETGLYLKGRLLIDDDLLAKRAHAHMKAGSLSGLSIGYILKDWEYDRTKEAFLLKDLDLWEVSLVTFPANEDARVSNVKSAFARGDIPNPSRIERVLRDVGLSRSQARAFMEEGYGALSLRDAETVSALTALESLHFN

SEQ ID NO: 7628 - protein, 410 aa, Xenorhabdus bovienii
  Coding DNA sequence: Name=SeqID_1520
  Homolog annotation: Query=1..410bp; Hit=1..412bp; Blast score=634; Percent Identity=72.0; E value=0; Homolog= ref|NP_543090.1|
MFFPGLFRKSADSMTSRDLSELIGLSYDTYSGRRVSPQLAMQLTAVFSCVRVLAESVGMLPCSLYEQLDRGNKRTTRERLHKLLSVKPNNYMTPQEFWELLIACLCLRGNFYVYKVKALGEVVELLPLDPGSVSSKLTRDWQPEYQVTFPNGESRTLTQDDLWHVRIFTLDGQTGLSPIAYARQAIGLGLATEEHGSRLFGNGAVTSGVLQTDQALKDEAYHRLKTDFEARHQGLVNAHKPMILEMGLKWHQISLSAEDAQFLETRKFQLEEICRIFRVPLHMVQNTDRATFNNIENLGIGFINYSLVPYLTRIEQRINAGLVKTAKQGRFYAKFNTGALLRGDMKSRFEAYATGINWGIYAPNECRELEELNPREGGDIYLTPMNMTTKPEQAPTKEEEPHADDNQATA

SEQ ID NO: 7629 - protein, 58 aa, Xenorhabdus bovienii
  Coding DNA sequence: Name=SeqID_1521
MKRLMIAALLVGLAGGTLLSYGAWLLLSAAGFMVAGSLCLGWSYLVSRMLSQKPDKET

SEQ ID NO: 7630 - protein, 576 aa, Xenorhabdus bovienii
  Coding DNA sequence: Name=SeqID_1522
  Homolog annotation: Query=1..576bp; Hit=1..577bp; Blast score=1026; Percent Identity=82.0; E value=0; Homolog= ref|NP_700375.1|
MSRKSYLNVNAASQYARDVVRGKIDAGRHVKDACRRHLDNLSQEKATAFKYRFDKDRAEQAAKFIQLLPHTKGEWAFKRMPITLEPWQLFIVCSVFGWVHKGSRLRRFREVYTEIPRKNGKSAISAGVALYCFTCDDEFGAEVYSGATTEKQAWEVFRPARLMCKRTPLLLEAFGIEVNASNMNRPADGARFEPLIGNPGDGQSPSCAIVDEYHEHDTDDLYTTMLTGMGARRQPLMWAITTAGYNIEGPCYDKRREVIEMLSGNVPNEELFGVIYTVDEGDDWTSPEVLRKANPNMGVSVYADFLLSQQQRALNNPRLASVFKTKHLNIWVSAREAYFNMVNWKQCEDTSLTLEQFEGQPCFLAFDLARKLDMNSMARLFVREIDGKRHFYSIAPRFWVPYDTVYSVEQNENRRSAERFQKWVEMDLLTVTEGAEVDYRYILEEAKLACHLNPVNEAPIDPFGATGLSHSLADEGINPIIITQNFTHMSDPMKELEAAIQSGRFHHDGNPIMSWCIGNVVGKTMGGNDDIVRPIKEHKDSKIDGAVALIMAMGRAILHEEPSLSDHLISHGVRSL

SEQ ID NO: 7631 - protein, 164 aa, Xenorhabdus bovienii
  Coding DNA sequence: Name=SeqID_1523
  Gene classification: Function=Uncharacterized phage protein; Function class=S Function unknown
  Homolog annotation: Query=55..144bp; Hit=14..103bp; Blast score=68; Percent Identity=38.0; E value=4e-12; Homolog= Z1853 COG3747
MAGTAGRSGRRPKPTARKELAGNPGKRKLNRDEPAFTPLTGVSPPDWFVEHEMPLAVVMWELTSKELCAQGLLCVTDLTVLERWCVAYQFWRKAVINIAQQGNTVTGATGGPIKNPELTAKKEQQSEMDTTGSLLGLDPSSRQRLMGAAGKAKTDNPFMRMISS

SEQ ID NO: 7632 - protein, 30 aa, Xenorhabdus bovienii
  Coding DNA sequence: Name=SeqID_1524
LGLFSYPRKMKFKSGGFLSLWPCFFEYGRF

SEQ ID NO: 7633 - protein, 35 aa, Xenorhabdus bovienii
  Coding DNA sequence: Name=SeqID_1525
MKKDPRRQSLGAREVAICPAPPSITMACAMIAIRN

SEQ ID NO: 7634 - protein, 116 aa, Xenorhabdus bovienii
  Coding DNA sequence: Name=SeqID_1526
  Homolog annotation: Query=1..115bp; Hit=1..115bp; Blast score=166; Percent Identity=81.0; E value=8e-41; Homolog= emb|CAB58450.1|
MPPRIPRACRKQGCSKTTSDRSGYCADHLHTGWQYHQQGKSRHVRGYGSQWDKLSTRVKQRDNHLCQHCLRQGRVVTGTTVDHIQPKAHGGTDVLSNLQLLCEACHRQKTATERLR

SEQ ID NO: 7635 - protein, 50 aa, Xenorhabdus bovienii
  Coding DNA sequence: Name=SeqID_1527
VVLYLDFTQSESLISSPSLYQIITLIFICNKLSLSIGISYDMSPFHRAYR

SEQ ID NO: 7636 - protein, 233 aa, Xenorhabdus bovienii
  Coding DNA sequence: Name=SeqID_1528
  Gene classification: Gene name=PTC1; Function=Protein serine/threonine phosphatases; Function class=T Signal transduction mechanisms
  Homolog annotation: Query=31..198bp; Hit=50..219bp; Blast score=62; Percent Identity=29.0; E value=4e-10; Homolog= aq_933 COG0631
MSCFSAAAKGKAVNEDYFLPPTCDNDSNIVFAVADGVGSTEQADLASKYAIQAIQKALTEPNFSIEKAFSQAKKAIDNFDFSVATTLTIVHVVDTKVYIGHVGDCRLYFKNGNKLVQLTKDHTKFQELLDSGEHSMRNLKNHKERLSTILTSALSNDIELHFDIIVKDIKDISSGNDVILALMSDGAYKHWESRPKFSERTMALPSAFSASLRRRIEKDIIDDYTFLGVKLKI

SEQ ID NO: 7637 - protein, 259 aa, Xenorhabdus bovienii
  Coding DNA sequence: Name=SeqID_1529
  Gene classification: Gene name=SPS1; Function=Serine/threonine protein kinases; Function class=T Signal transduction mechanisms
  Homolog annotation: Query=13..238bp; Hit=12..221bp; Blast score=88; Percent Identity=30.0; E value=6e-18; Homolog= PA0074 COG0515
VDRCGNYFIEDLKRLGRGGFGEVYEVNVYNLTKTHSRRYARKYFSPSPENNKTAIKEIADLRERFLVEIKTQCTLNLIDYDSIAPIVLFSTAGDKPYFIMEKAEDNLLESIKSGMSAEEKIMAVRQIIKGVKTIHDNSYVHRDLKPANILKYSDGRYKISDFGLVKDLNLVRAEVKTKFQPNGMGSDGYRAPEITESGLFSNQSDIFAIGQVISDVYSKDLPHKLKKVISTCRAHWPEDRYADANELLIDFYKAMGVTP

SEQ ID NO: 7638 - protein, 33 aa, Xenorhabdus bovienii
  Coding DNA sequence: Name=SeqID_1530
MRAISIQSYKQSEKIIFMNCSFILLGLVSVKNN

SEQ ID NO: 7639 - protein, 150 aa, Xenorhabdus bovienii
  Coding DNA sequence: Name=SeqID_1531
  Homolog annotation: Query=1..148bp; Hit=1..148bp; Blast score=129; Percent Identity=47.0; E value=2e-29; Homolog= ref|NP_930139.1|
MKLNFTSGVVIALIISSAAAFLYRSGYKRQLGINSDQITEIQQLTDTITYQNTHIEILYELDTKHTQEIANAKTEIDILRADVAAGHRKLRIQATCPVSETTASGSVVDATTVELTGEAGSTILDIREGVINDRAKLRYLQEYIRTECLR

SEQ ID NO: 7640 - protein, 144 aa, Xenorhabdus bovienii
  Coding DNA sequence: Name=SeqID_1532
  Gene classification: Function=Phage-related lysozyme (muraminidase); Function class=R General function prediction only
  Homolog annotation: Query=3..142bp; Hit=42..181bp; Blast score=99; Percent Identity=42.0; E value=7e-22; Homolog= XF1669 COG3772
MEISDKGLECIKQYEGLKLKAYPDPATGGIPWTIGYGHTKGVKKGDVITEQQAEAFLHDDLQPIYTTLRQLIKVSLNQGQFDALCSFIFNCGSGNFSGSTLLKKLNQSDYTGVAGEFSRWNKAAGKVMRGLDNRRASERQMFLS

SEQ ID NO: 7641 - protein, 148 aa, Xenorhabdus bovienii
  Coding DNA sequence: Name=SeqID_1533
  Homolog annotation: Query=39..140bp; Hit=4..105bp; Blast score=117; Percent Identity=60.0; E value=3e-26; Homolog= gb|AAO18060.1|
MNNQSRLIIQLFLLPNSQGGTYFTPPRIPIALIGWNMKMKENPDIWVHLGDWLVSIKEQGIGAVLAGTMAFLRGRYNGSGWLKVSIDAFICAMFAWFIRDVLNLFGLNPDLAYIGSVVIGYLGTDFIGQLLSKAAKKRAGTSSDGNQR

SEQ ID NO: 7642 - protein, 76 aa, Xenorhabdus bovienii
  Coding DNA sequence: Name=SeqID_1534
MTIFSKCPVCDTPLDPLPKKGGAEEYSCTNHGSIKISDTVIDIYNRSDEKIRDEYRKKIASKIENGEGGNITSYDL

SEQ ID NO: 7643 - protein, 31 aa, Xenorhabdus bovienii
  Coding DNA sequence: Name=SeqID_1535
MCLIKIFKLCMVFENARLTIEPQVMMRLFVL

SEQ ID NO: 7644 - protein, 344 aa, Xenorhabdus bovienii
  Coding DNA sequence: Name=SeqID_1536
  Gene classification: Function=DNA modification methylase; Function class=L DNA replication, recombination and repair
  Homolog annotation: Query=3..339bp; Hit=7..344bp; Blast score=467; Percent Identity=65.0; E value=1e-132; Homolog= Z2060 COG0863
MDLRSVTLVKDDSLKFIKTLPDNCIDLIATDPPYFRVKDCSWDNQWQDVTAYLAWLDELLAEFWRVLKPNGSLYMFCGSRLASDTELLVRERFNVLNHIIWAKPSGPWRRQNKESLRMYFPATERIIFAEHYQGPYHPKGDGYFKQCRELKQSVFKPLVDYFRDARKALGITAKDIHKATGKQMASHWFSDSQWQLPSETDYQKLQGLFDRIAKEKHQRGELNTPYPELVASHLTLSRQYDELRQEYGLMRRSFTVTADVPYTDVWHFAPVQYYPGKHPCEKPADLMAHIIQSSSREGDLVADFFMGSGATLKAALKLNRRVLGVELEEERFKQTEQEIMVTTE

SEQ ID NO: 7645 - protein, 30 aa, Xenorhabdus bovienii
  Coding DNA sequence: Name=SeqID_1537
LTKVTERKSIRFFPLDAGCSQESHNTKGRH

SEQ ID NO: 7646 - protein, 66 aa, Xenorhabdus bovienii
  Coding DNA sequence: Name=SeqID_1538
  Homolog annotation: Query=1..64bp; Hit=1..64bp; Blast score=93; Percent Identity=75.0; E value=7e-19; Homolog= ref|NP_930681.1|
MLKHEDMTITAACVLDAVPLYTWFSVSEVSKLMGLPEPRCQLLLTQFRLAGLMESRDDDTFFKRSP

SEQ ID NO: 7647 - protein, 31 aa, Xenorhabdus bovienii
  Coding DNA sequence: Name=SeqID_1539
MINLILRSVFVHKHTCNSDPSQQQVLCLFQA

SEQ ID NO: 7648 - protein, 46 aa, Xenorhabdus bovienii
  Coding DNA sequence: Name=SeqID_1540
MWLLVKINLYDRKSGAIVINVIVKSQGLLIPDILNLAPCKVFLRLK

SEQ ID NO: 7649 - protein, 134 aa, Xenorhabdus bovienii
  Coding DNA sequence: Name=SeqID_1541
  Homolog annotation: Query=1..126bp; Hit=1..126bp; Blast score=193; Percent Identity=70.0; E value=5e-49; Homolog= ref|NP_405643.1|
MRDIQLVMERWGAWAADNRDGVYWSSIAVGFKGLIPNRVKSRVQCCDDDAMIIASCMAKLNQKHSDAHDLLFDYYVFGKTFMQLSRDHHCSDTHIGKRLQKAEGVIEGMLMMLDISLEMDKDIPLEQHPLCGCL

SEQ ID NO: 7650 - protein, 453 aa, Xenorhabdus bovienii
  Coding DNA sequence: Name=SeqID_1542
  Gene classification: Gene name=DnaB; Function=Replicative DNA helicase; Function class=L DNA replication, recombination and repair
  Homolog annotation: Query=5..423bp; Hit=29..454bp; Blast score=206; Percent Identity=35.0; E value=4e-53; Homolog= VC0371 COG0305
MNVYDLEMAVISGLLSGGATPDAYDVLAILPDDAFSSVHLRRVYGEIKKQALSSAIIDPFFIADSMGEERGILANLLELAKTPVWQANLKGYAEKVMSYWRVRQVTDLINRYQKEIQACGNHTQAEALIEVFASQFNELSQSDSSLQPVVIGTLLDRYVETLEARNQGKTGMILTGIEPLDELTGGFNPTDLILLGGRPGMGKTELALCMIDGMTRDGGGALLFSMEMAAQQIAERMVAGSAAMPVSKLRNCELYDDDWGRIGNALGSLIDRDIHVLDASDLSVEQICAISETHKRRHPNLKGIFVDYLGLIRKPRADRHDLAVAEISKALKGLAKRLHTPVTALSQLSREVDKRPLHQRRPIAADLRDSGSLEQDADRILFTYRDAVYNPLSSASQYAEIILEKNRHGQTGTIYQAFRHGHYLPTDQISAAEVCRMQRQTKQKERRYADRAL

SEQ ID NO: 7651 - protein, 194 aa, Xenorhabdus bovienii
  Coding DNA sequence: Name=SeqID_1543
  Gene classification: Gene name=DnaC; Function=DNA replication protein; Function class=L DNA replication, recombination and repair
  Homolog annotation: Query=11..193bp; Hit=62..240bp; Blast score=94; Percent Identity=32.0; E value=9e-20; Homolog= dnaC COG1484
METIDLGILKIVPRFAQASFATYLPQSLMAETNLKTCQGYVQTWEERKRAGEGMILCGRQGTGKTHLAVALCREIATGGDEAVFITTASRIIRAFRRSWNSEGEMSEFDTLKFYSELDLLVIDEIGVQYGTESERNILFEVLNNRYEDLLPTILISNLPVTELAQFLGDRTLDRLLQGGTVLAFDWESYRREIA

SEQ ID NO: 7652 - protein, 247 aa, Xenorhabdus bovienii
  Coding DNA sequence: Name=SeqID_1544
  Homolog annotation: Query=1..247bp; Hit=6..249bp; Blast score=237; Percent Identity=52.0; E value=2e-61; Homolog= ref|NP_930690.1|
MVKAMSIRVGNPLRKLVLIKLADNANDKGECWPSYQHIADHCECSKSAVRSHIDALIKMGLLIKENRLGNHNGKGNASNVYYLNLSADPVSPKSIPPMPPAGSSVSSAGTPMPPDDIPPMPSDGTRTSHSFEPVKEPVKEPIKPKGAGQFDPLTAKPENVSAETWADWVKFRQEIRKPLTETSCRQQAKQLAGCTNPDEVICTSIANSWQGLFPDKPRSGRPPQTNTHTGFKHKRYESHGANWTKNL

SEQ ID NO: 7653 - protein, 55 aa, Xenorhabdus bovienii
  Coding DNA sequence: Name=SeqID_1545
LPLPSDSYSCCFSLLPYIKPHPHVHPGRTSNTRHHPPPVVIGNLFRGFVQVAGKQ

SEQ ID NO: 7654 - protein, 76 aa, Xenorhabdus bovienii
  Coding DNA sequence: Name=SeqID_1546
MKNSVIKKVIDIAGSQAKLAQVLGCAQSLISAWLYRKKRVSVSRVPDIVVFSNGAVQAHELRPDLPTVFPPPEQNP

SEQ ID NO: 7655 - protein, 221 aa, Xenorhabdus bovienii
  Coding DNA sequence: Name=SeqID_1547
  Gene classification: Function=Predicted transcriptional regulator; Function class=K Transcription
  Homolog annotation: Query=20..83bp; Hit=11..74bp; Blast score=58; Percent Identity=46.0; E value=4e-09; Homolog= PA0611 COG2932
LGLSPVFHVNTGTTHEALMTLADRLKEAMADKGLTQSALAKKTGMAQSMIWKLLSGNAVKTGRLVDLAKALDVRPEWLSDGSGHKSQSGDTDFAVRYDNRYAPVKIYEAEQETPEFFMVPAFSEQQTSFESCRAYRITQNTGCSEAPEGTVIVVDTQEEIANDDLVYTRIGEHYSVYRYKQGGAANFLSVDDSRIPLITLSPAMEIVGVIVYLFRNMKRKR

SEQ ID NO: 7656 - protein, 43 aa, Xenorhabdus bovienii
  Coding DNA sequence: Name=SeqID_1548
MVIAFFCFVAGFLMMAEMKVRINPLADYSSDYSYHFDAANIIT

SEQ ID NO: 7657 - protein, 132 aa, Xenorhabdus bovienii
  Coding DNA sequence: Name=SeqID_1549
MRTFISAIIKKPATKQKNAITINGIVANIAQTNSLHTGTTHITFLADQYHQGKTQNHGMDIQNKDEFKHHILTTYRVSPKHTEPVPCYNLELIVDYGYALYKRRGRYMHLIDIIPLIKADKKTQPIIKIATQ

SEQ ID NO: 7658 - protein, 67 aa, Xenorhabdus bovienii
  Coding DNA sequence: Name=SeqID_1550
MFHSKFRIVTYKKRTRKKSVIWKLQIKWLKWSQKNIILHLYIGHKQNTEQCISVIKTTRDTPCWYYR

SEQ ID NO: 7659 - protein, 59 aa, Xenorhabdus bovienii; identical to SEQ ID NO: 6178
  Coding DNA sequence: Name=SeqID_1551
  Homolog annotation: Query=1..59bp; Hit=1..59bp; Blast score=70; Percent Identity=66.0; E value=7e-12; Homolog= ref|NP_406333.1|

SEQ ID NO: 7660 - protein, 291 aa, Xenorhabdus bovienii
  Coding DNA sequence: Name=SeqID_1552
  Gene classification: Gene name=FolD; Function=5,10-methylene -tetrahydrofolate dehydrogenase/Methenyl tetrahydrofolate cyclohydrolase; Function class=H Coenzyme metabolism
  Homolog annotation: Query=1..284bp; Hit=1..284bp; Blast score=490; Percent Identity=84.0; E value=1e-139; Homolog= folD COG0190
MSAKIIDGKTIAQTIRSEVAEKVRQRVAAGRRAPGLAVVLVGENPASQIYVASKRRACEEVGFTSRSYDLPDITSEAELLSLIDNLNEDPEIDGILVQLPLPAGIDNVKVLERIHPDKDVDGFHPYNIGRLCQRAPKLRPCTPRGIVTLLERCNINTYGLHAVIIGASNIVGRPMSLELLLAGCTTTVTHRFTKNLRQHVEQADLLVVAVGKPNFIPGEWIKPSAIVIDVGINRLENGKVIGDVDFDSASERASWISPVPGGVGPMTVATLIQNTLQACEEYHDVDKTKGY

SEQ ID NO: 7661 - protein, 70 aa, Xenorhabdus bovienii
  Coding DNA sequence: Name=SeqID_1553
  Gene classification: Function=Uncharacterized ACR; Function class=S Function unknown
  Homolog annotation: Query=1..70bp; Hit=8..77bp; Blast score=92; Percent Identity=68.0; E value=1e-19; Homolog= ybcJ COG2501
MEIFCLDGHPYVELCDLLKLQGWCESGAAAKAMIAEGLVKVDDQVETRKRCKIIAGKAVAFNGQSVRVEA

SEQ ID NO: 7662 - protein, 31 aa, Xenorhabdus bovienii
  Coding DNA sequence: Name=SeqID_1554
MYKTLRVQFFRRALTVMQYHEITLQRAPIGR

SEQ ID NO: 7663 - protein, 32 aa, Xenorhabdus bovienii
  Coding DNA sequence: Name=SeqID_1555
MNLLFPRLILLWYLFLILYFLGFLFYLFWILI

SEQ ID NO: 7664 - protein, 78 aa, Xenorhabdus bovienii
  Coding DNA sequence: Name=SeqID_1556
MLSNRAARRLLGMPHKLSNSKRKVIISLLNLTTSDSKHQIPEHLRHSSFVCMKKDAYSGIITYHPGNTFYSEHLNTRR

SEQ ID NO: 7665 - protein, 460 aa, Xenorhabdus bovienii
  Coding DNA sequence: Name=SeqID_1557
  Gene classification: Gene name=CysS; Function=Cysteinyl-tRNA synthetase; Function class=J Translation, ribosomal structure and biogenesis
  Homolog annotation: Query=1..460bp; Hit=1..461bp; Blast score=766; Percent Identity=80.0; E value=0; Homolog= ZcysS COG0215
MLKIFNTLSRQKEEFKPIHEGKVGMYVCGITIYDLCHIGHGRTFVAFDVIARYLRYLGYDLTYVRNVTDVDDKIIKRATENNESCDALTTRMLSEMHSDFDALNIQRPDLEPRATQHMPEIIQITEELIKRGHAYVAANGDVLFSIDTNSDYGLLSRQDLEQLQAGARVEIADVKRNPMDFVLWKMSKPGEPSWESPWGAGRPGWHIECSAMNGKQLGHHFDIHGGGSDLMFPHHENEIAQSTCAHDGPYVNYWMHSGMVMVDKEKMSKSLSNFFTIRDVLEYYDAETVRYFLLSGHYRSQLNYTEENLKQARTALERLYTALRGTDKSAQPAGGEAFEARFTEAMNDDFNTPEAYSILFDIAREINCLKTENLAAANGLAAELRKLAGILGLLEQEPEQFLQGGAHVDDDVAQIEALIKQRNDARTNKEWALADAARDQLNAMRIELEDGPQGTTWRRK

SEQ ID NO: 7666 - protein, 53 aa, Xenorhabdus bovienii
  Coding DNA sequence: Name=SeqID_1558
MPTFPSWIGLNSSFWRLRVLKIFSIGGFSVKSDVRVIKANESADYRLLYQRYK

SEQ ID NO: 7667 - protein, 55 aa, Xenorhabdus bovienii
  Coding DNA sequence: Name=SeqID_1559
MKSQMRYFTLICNALQAPRATLFTDACRVLTRDHRYDITADVPNTLENRVNQNYY

SEQ ID NO: 7668 - protein, 164 aa, Xenorhabdus bovienii
  Coding DNA sequence: Name=SeqID_1560
  Gene classification: Gene name=PpiB; Function=Peptidyl-prolyl cis -trans isomerase (rotamase) - cyclophilin family; Function class=O Posttranslational modification, protein turnover, chaperones
  Homolog annotation: Query=1..164bp; Hit=1..164bp; Blast score=280; Percent Identity=85.0; E value=4e-76; Homolog= ZppiB COG0652
MVTFHTNFGDVVINTFADKAPVTVENFLNYCREGFYDNTIFHRVINGFMIQGGGFEPGMKQKTVKAPIQNEANNGLKNTRGTLAMARTNDPHSATAQFFINVVDNDFLNFRSERPDGWGYCVFAEVVEGMDVVEKIKGVSTGRSGMHQDVPNEDVIVERVTVSE

SEQ ID NO: 7669 - protein, 240 aa, Xenorhabdus bovienii
  Coding DNA sequence: Name=SeqID_1561
  Gene classification: Function=Uncharacterized BCR; Function class=S Function unknown
  Homolog annotation: Query=1..240bp; Hit=1..240bp; Blast score=338; Percent Identity=65.0; E value=2e-93; Homolog= ybbF COG2908
MCTLFIADLHLSEQEPAITAGFLRFLREEAIYAESLYILGDFFDYWIGDDDPNSLHNEIAQALNELKQKGISCYFIHGNRDFLLGSRFARESGLILLPQEKVLELYGKRILILHGDTLCTDDTGYQQYRKRVHTPWIQRLFLLLPLFIRLKIAAKMRAGSQYANSQKSESIMDVNQQAVIEHFEKYQVDWMIHGHTHRPAIHDIQIADKTVHRGVLGAWHHQGSMFKVTETSIELMFFPF

SEQ ID NO: 7670 - protein, 181 aa, Xenorhabdus bovienii
  Coding DNA sequence: Name=SeqID_1562
  Gene classification: Gene name=PurE; Function =Phosphoribosylcarboxyaminoimidazole (NCAIR) mutase; Function class=F Nucleotide transport and metabolism
  Homolog annotation: Query=16..178bp; Hit=1..163bp; Blast score=213; Percent Identity=75.0; E value=7e-56; Homolog= HI1615 COG0041
MTTRPDPATAISATSMQHHAKIAIVMGSKSDWATMQHAADILTSLDIPFHVEIVSAHRTPDKLFHFAEQAKENGYDVIIAGAGGAAHLPGMLAAKTLVPVFGVPVQSAALSGVDSLYSIVQMPTGIPVGTLAIGKAGAANAALLAAQVLALHDDVLFQRLSDWRSAQTQDVLNNPDPREDA

SEQ ID NO: 7671 - protein, 355 aa, Xenorhabdus bovienii
  Coding DNA sequence: Name=SeqID_1563
  Gene classification: Gene name=PurK; Function =Phosphoribosylaminoimidazole carboxylase (NCAIR synthetase); Function class=F Nucleotide transport and metabolism
  Homolog annotation: Query=1..353bp; Hit=1..353bp; Blast score=518; Percent Identity=73.0; E value=1e-147; Homolog= ZpurK COG0026
MKPVCVLGNGQLGRMLRQAGEPLGIAVYPVGLDAEPESVPYQSSVITAEIERWPETALTRELAHHKAFINRDIFPQLADRLPQKQLMDSLGLATAPWRLLSDPSQWPQLFAELGDFIIVKRRTGGYDGRGQWRIRPGDEAELPAEIYGECIVEQGIPFSGEVSLVGARNAQGQSVFYTLTHNLHQEGILRTSVALPNADNQLQQQAEKMLSAIMDHLNYIGVMAMECFIVDDNLLINELAPRVHNSGHWTQNGASISQFELHLRAILDLPMPQPEIMAPSVMINLIGTELNPEWFGLPLVHLHWYEKEVRPVRKVGHLNLSHADKGALQTTLQALISLLPAEYQSGLEWAKIKLS

SEQ ID NO: 7672 - protein, 203 aa, Xenorhabdus bovienii
  Coding DNA sequence: Name=SeqID_1564
  Gene classification: Gene name=RibC; Function=Riboflavin synthase alpha chain; Function class=H Coenzyme metabolism
  Homolog annotation: Query=1..203bp; Hit=16..217bp; Blast score=135; Percent Identity=38.0; E value=3e-32; Homolog= NMA1416 COG0307
MYTGIVQGKESVLSLNKNNGFSTLTVSNYHRFFAGVSVGTSVAIDGTCLTVTEFTDDRVSFDISDFTAESTTLKLLTVGDEVNVERSHQMNQENGGHSLYGHVEGMAEVIEFTPTGETYRLVIRIPQDNIKYFFLKGFIGLHGCSLTINGIDEENKTVALNLIPETLRMTNFNKIKAGDFLNYEIDQMTRTIVDTLARTLLKK

SEQ ID NO: 7673 - protein, 44 aa, Xenorhabdus bovienii
  Coding DNA sequence: Name=SeqID_1565
MLLLRLFSNVGFYILYLIHGIHKNIYLIRIDINNIIKFKYFHIL

SEQ ID NO: 7674 - protein, 270 aa, Xenorhabdus bovienii
  Coding DNA sequence: Name=SeqID_1566
  Gene classification: Gene name=Tsx; Function=Nucleoside-binding outer membrane protein; Function class=M Cell envelope biogenesis, outer membrane
  Homolog annotation: Query=52..269bp; Hit=47..278bp; Blast score=96; Percent Identity=31.0; E value=2e-20; Homolog= PA0165 COG3248
VPFLRKREANNILKPMTATTVGLSAISLFFLFTVPAQASDFVNFQSIDTSLYLQFENKVAPQKTISPIVEAFGDYKIGDMYVYSIWQNSLQHDYQGDKNTYYYKFVPRLSASKITRYDLSYGPLKDVLFAQWIAKTKNVKYDYFPGISLDWQVPGFSWLRTLFYFENNAKGNWNDQRIHIDYAIPFNNQLGDFRIVGTLDYTLGLHDNPEMLEFKPELHYDLGKKLGYQSGHLWTGLVLNTTKNKYKIKDTPYYRTNQFSYGVFIRYSFF

SEQ ID NO: 7675 - protein, 425 aa, Xenorhabdus bovienii
  Coding DNA sequence: Name=SeqID_1567
  Homolog annotation: Query=1..415bp; Hit=1..415bp; Blast score=519; Percent Identity=72.0; E value=1e-146; Homolog= ref|NP_931018.1|
MSIQHDKFGRTYQWFLLVLLGMVYFLSTATTFTSLGVVLPSMINELGWNWTSAGLGFSLLGLTCGLSSFLPTLFIRKIGVRFTLFIGLLIFLAGFYHLYNTHVISSYFIGTALLGVGFTFLATVPGTYVISRLYEKQSLAFGFYFTIGGLGGVIGPWIYFLATRVWGTWRMHWMISAIVLTVFVLLTIFILQEGKREVAHAKAVNQKHNSQNPLKIYRTKQRWTARRALRTWQFYAIAATYTAFLWCGITVNSFAVAHIIENGFSEAIAAGLLSSMAFINAFSRLAGGAVGEWLDPKKLLIGSLTVIIIGLIALSIASSWPFLIGFTLFVGMGYGMTFLASSVLLANYFGRKPYLELFSVMNLISTLACLAPFFAGAIKDYSGSFTSAFLIIAIPVCVVLVVTLMMKPPAQKMKKRLVDNSPFTE

SEQ ID NO: 7676 - protein, 351 aa, Xenorhabdus bovienii
  Coding DNA sequence: Name=SeqID_1568
  Gene classification: Function=Coenzyme F420-dependent N5,N10 -methylene tetrahydromethanopterin reductase and related flavin -dependent oxidoreductases; Function class=C Energy production and conversion
  Homolog annotation: Query=4..350bp; Hit=10..354bp; Blast score=434; Percent Identity=58.0; E value=1e-122; Homolog= CC1169 COG2141
MSKKEFGVFLPIAKGGWIISKNTPPLDASYQQNREAAILADQIGLDFIMSMGKWRGFGGETDHWGSSLESVTMMAGIAEVTHRAKLIATVHAGLHNPAVTAKMIATLDHISQGRAGLNIVSGSFKDEFEQMGEWDGSLDHDQRYAMTEEWTQLIKRLWREKHVDHEGTYFHLKQCVSEPKPLSLPRPYLVCAGQSERGLHFSVRHTDVCFIGGKDEAETRKISLTAKRIASECNTTTKTFCMCTVICAETDAYAETLAQFYRQGLDVEAVRNMMHSFGVDVDGKNNAMVERSQNAFMTHTAIGTPDTCYKQLSDLLRTCELDGVMLIFPDYIKGLKIFGDQILPKLRAEFG

SEQ ID NO: 7677 - protein, 810 aa, Xenorhabdus bovienii
  Coding DNA sequence: Name=SeqID_1569
  Gene classification: Function=Uncharacterized membrane protein; Function class=S Function unknown
  Homolog annotation: Query=1..807bp; Hit=1..801bp; Blast score=865; Percent Identity=58.0; E value=0; Homolog= ybbP COG3127
MIWRWFWREWRTPSLLIIWLSLTLAVACVLALGSISDRIDQSVHYQSRDFLAGDLVLQASYPVDESWLKQAEERGLTLSRQISFSTMTYAGDVPQLVQVKAADEHYPLYGELETSPQGLKPEKGSVLVAPRLLVLMGIKVGDSLDVGDAVLKIRGELLQEPDSGFNPFQLSPRILINIEDAKATGAIQPGSRLTYRYMFSGSSESIQAFQQLIDPQLKADQRWLTLKQDSGALAQSIDRAQQFLLLSALLTLLLAAAAVAVSMTHYCRSRHNLIAILKTLGAGRWALRQWIVGQWLVILLAAIVVGSILGLVFESALIRILAAMLPKMLPEAGMWPWMWAIGSLLGIALLVGIRPYRQLMATQPSRVLRSDVTAAIWPLRYYLPTVALIMTGGLVLLAGTKPLLWSLLAGVPMVALLLAILGWGGLWLLRRMTFRQLSLRLAVNRLLCRPFQTMTQLAAFSLSFMLLALLVMARGDLLSRWQQQLPPDSPNYFLINMTQAQIPPVNDLLAKYQVKPTEFYPVVLARLTEVNGQSAIEWADERHPKSTTVRRELNLTWKAELPPFNTLVEGTWPPKPKEVSIEQGVAEQLHINVGDKLTFTGNTQIFQVSVSSIRKVDWESLHPNFFFIFSKETLDNQPQTWLTSFHYEGDGQLLTEINRHFPTISMLDIGTMLKQIQGILQQISQALEIMVVLVMICGALLLLAQIQVGMSQRQLELVVYRTLGASKKLLRRTLWSEFALLGFMAGLAAAFGAEVALWLLQTKVFEFPWQPQWQMWFLLPIISSLLLSLCGSWLGIRLLRGKGLHRRLPE

SEQ ID NO: 7678 - protein, 228 aa, Xenorhabdus bovienii
  Coding DNA sequence: Name=SeqID_1570
  Gene classification: Gene name=PhnL; Function=ABC-type transport systems, involved in lipoprotein release, ATPase components; Function class=R General function prediction only
  Homolog annotation: Query=1..227bp; Hit=1..227bp; Blast score=310; Percent Identity=74.0; E value=1e-84; Homolog= ybbA COG1136
MAVESILKVHHLTKHVGQGEQVINILQGVELVVEPAQTIALIGESGSGKSTLLGIIAGLDDGSGGEVHLLGQNISRMNEEQRAQLRAENVGFVFQSFMLIPTLNALENVQLPALLRGESENQSRQNAIELLKQLGLGQRLKHMPAQLSGGEQQRVALARAFSTRPKILFADEPTGNLDRQTGDRIADLLFSLNHDYATTLILVTHDSQLAARCQRRLRLVDGILQEEV

SEQ ID NO: 7679 - protein, 215 aa, Xenorhabdus bovienii
  Coding DNA sequence: Name=SeqID_1571
  Gene classification: Gene name=TesA; Function=Lysophospholipase L1 and related esterases; Function class=E Amino acid transport and metabolism
  Homolog annotation: Query=5..212bp; Hit=1..204bp; Blast score=253; Percent Identity=60.0; E value=9e-68; Homolog= tesA COG2755
MFSEMMNFKNTFYSHVCFLLLLVLCSARATAADTLLILGDSLSAGYRLPVEQSWPTLMAKEWQQSGNKTAIVNGSISGNTTAQSLERLPELLKQHNPKWVLVELGGNDGLRGFSVQQIEQDLQKIITLIKQANAQPLLMQIRISPNYGKRYTQSFAKIYPSLSERNQIPLLPFFMEHVAIKPEWIQDDGLHPNQLAQPFITHWMSDQLSAYIPFK

SEQ ID NO: 7680 - protein, 258 aa, Xenorhabdus bovienii
  Coding DNA sequence: Name=SeqID_1572
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=1..255bp; Hit=14..268bp; Blast score=326; Percent Identity=62.0; E value=1e-89; Homolog= ybbO COG1028
MQKAVLITGCSSGIGLVAAKILHQRGYRVFAACRKPADLAHMRELGLEPIELDLDDKESVERAAEQVIQLTHGRLFGLFNNGGFGVYGPLESVSRELMEKQFSTNLFGTHQLTSLLLPAIRAYGKGRIVQTSSVLGLISTPGRGAYAASKFALEAWSDALRIELADTGIKVSLIEPGSITTRFTENVNQTQRDHPVENPSLANRFRLTPEDVVTKLIHALEAPNPKLRYPVTLLSHAMTILRRILPAILIDKIVKWQS

SEQ ID NO: 7681 - protein, 292 aa, Xenorhabdus bovienii
  Coding DNA sequence: Name=SeqID_1573
  Gene classification: Function=Thioredoxin domain-containing protein; Function class=O Posttranslational modification, protein turnover, chaperones
  Homolog annotation: Query=13..292bp; Hit=17..296bp; Blast score=253; Percent Identity=51.0; E value=2e-67; Homolog= ZybbN COG3118
MESITNTNNHTAHIIHINESNIAPMIQHSLTQLVVFYFWSPQNLHCHELEETLDKLAHEYAGQFALAKVDCDQLPNIAAQFGVRTAPTVIFVQEARPVHGFEGIQTDETIRKMFSQFLTQQKKSLLEQANERLAEGKNQEALSLLKEAHQTEPKEIEITLLLAQVYISLNHLEDAQNILDTLPLEEQDQRYNDLLAILESQKQAANSPEIQQLQQALEIQPENAELAVQLATKLHEVGRNEEALELLFSFLKKDLSTADGAVKKMLMDIISTLETGDTLASKYRRHVYSLLY

SEQ ID NO: 7682 - protein, 309 aa, Xenorhabdus bovienii
  Coding DNA sequence: Name=SeqID_1574
  Gene classification: Gene name=HflC; Function=Membrane protease subunits, stomatin/prohibitin homologs; Function class=O Posttranslational modification, protein turnover, chaperones
  Homolog annotation: Query=9..306bp; Hit=5..302bp; Blast score=449; Percent Identity=81.0; E value=1e-126; Homolog= ybbK COG0330
MDLLSLGTVPILIIIAVVIVFTCVKTVSQGYQWTVERFGRYTRTLTPGLHIIMPFVDRIGRKINVMEQVLDIPSQEVISRDNANVTIDAVCFIQVVDPVRAAYEVSNLELAIINLTMTNFRTVLGAMELDEMLSQRDLINSRLLTIVDEATNPWGVKITRIEIRDVRPPKELVSAMNAQMKAERTKRADILEAEGIRQAAILKAEGEKQSQILKAEGERQSAFLQAEARERAAEAEARATKMVSDAISDGNIQAINYFVAQKYTDALTRIGAADNSKVIMMPLEASNLMGAIGGIAELIGESKKSKQDK

SEQ ID NO: 7683 - protein, 153 aa, Xenorhabdus bovienii
  Coding DNA sequence: Name=SeqID_1575
  Gene classification: Function=Membrane protein implicated in regulation of membrane protease activity; Function class=N Cell motility and secretion
  Homolog annotation: Query=1..149bp; Hit=1..150bp; Blast score=114; Percent Identity=50.0; E value=4e-26; Homolog= ZybbJ COG1585
MIEQIATQPVWFWLCFGGLLLIAELLGTGGYLLWTGTAAVVVALITWIFPEMSWKLQGILFAVLTLLSAIAWRSWLRYRPRKNSDEMLNQKNQQLIGFHARLTSATENGYGRVKLADGSWRVHCDRELPANMEVEVIAVDGITLKVKPVANQP

SEQ ID NO: 7684 - protein, 134 aa, Xenorhabdus bovienii
  Coding DNA sequence: Name=SeqID_1576
  Gene classification: Gene name=SoxR; Function=Predicted transcriptional regulators; Function class=K Transcription
  Homolog annotation: Query=1..132bp; Hit=1..132bp; Blast score=179; Percent Identity=66.0; E value=6e-46; Homolog= ybbI COG0789
MNISEIAQKTGLTSKAIRFYEEKDLISAPKRGDNGYRYYQHKHIDELTLLRQAKEVGFTLEECRELLRLFHNPRRHSADVKTATLQKVAEIENTMVKLQKIRGKLLALAAECPGDDGADCPIIEQLSGCCTHHG

SEQ ID NO: 7685 - protein, 915 aa, Xenorhabdus bovienii
  Coding DNA sequence: Name=SeqID_1577
  Gene classification: Gene name=ZntA; Function=Cation transport ATPases; Function class=P Inorganic ion transport and metabolism
  Homolog annotation: Query=71..914bp; Hit=5..833bp; Blast score=1083; Percent Identity=70.0; E value=0; Homolog= ZybaR COG2217
MSTTTILALQGLTCMHCVGSVKKALENVSGVEQTDVTLDYAKVIGNVSPTVLITAITDAGYEAVVATQPDIELQLSGLSCMKCAGKTQKALEAVEGVITAKVDTQIAKIYGKVESNTLVKAVEQAGYHAELAAGITFPKTEPLTISSLQVPEFLAAAGNATPVRNPENTVLHDTPNNDNDSIQLLLDGMTCASCVSKVQKALQSVDGVENARVNLAERSALVTGIASPNALVDAVIKAGYGAEVIQDETERRERQQQVAQANMRRFRWQSAFALVVGVPVMVWGMLGDNMVLTPSNHAIWLTIGLVTLAVMVLAGSHFYRNAWQSLKNGSATMDTLVALGTGVAWLYSISVNLWPEIFPPQARHLYYEASAMIIGLINLGHALEQRARQRSSKALERLLDLTPPTARVITEKGEKTLPLADVKPNMILRLTTGDRVPVDGEIIQGTVWLDEAMLTGEPIPQQKSTGEGIHAGTVVQDGTVLFRAAAVGSQTTLARIIKLVRQAQSSKPEIGQLADKISSIFVPVVVAIALIAGAIWYFIGPAPQVMYSLVIITTVLIIACPCALGLATPMSIISGVGRAAELGVLVRDADALQQASQLDTLVFDKTGTLTEGMPQVTEIHTFNGFTEEQVLLWAGALESGSNHPLAKAIALKVEGQKLPEVQQFRTLAGLGIRGEVGDTTLLLGNQSLLEQNQVETAELKTLMSAQAEKGITPVILAADGKIAALFSIRDPLRQDTFSALQRLHHQGYRLVMLTGDNPVTANAIAKEAGIDQVIAGVLPDGKAAAIQTLQSEGRKVAMIGDGINDAPALAQADVGIAMGGGSDIAIETAAITLMRHSLHGVADAVALSRGTLRNMKQNLFGAFVYNTLGIPIAAGILYPFTETLLNPVVAGAAMALSSITVVSNANRLLRFKPKH

SEQ ID NO: 7686 - protein, 35 aa, Xenorhabdus bovienii
  Coding DNA sequence: Name=SeqID_1578
LNFRIKSTKAYYSAHDKLNRTEFSFSSITIFPLSC

SEQ ID NO: 7687 - protein, 270 aa, Xenorhabdus bovienii
  Coding DNA sequence: Name=SeqID_1579
  Gene classification: Function=Uncharacterized BCR; Function class=S Function unknown
  Homolog annotation: Query=19..265bp; Hit=18..263bp; Blast score=246; Percent Identity=52.0; E value=2e-65; Homolog= ybaP COG3735
MGKLMTYLNNVLGLNSQRHYPYPAFDITLPQNRHLHIVGSIHMGTENMFPLSEILLEQLEQCDALIVEADITQPGSPFKEKFPEQVALSLRLSPEHFDRLTHYCHEIQHPLKALDSLPSWQIALILQAAQAQYLGLRPQYGIDCQLLDSAKAIDKTIIELEGTDTQVNLLTSLPNGGLSLLEDTLIHWHTNARALQTMISWWMNYKPAQPNQTLPQTFCEEIHQTLMAGRNHQWSEQLHALPAGKYLVAVGALHLHGENNLLQMMERPQG

SEQ ID NO: 7688 - protein, 158 aa, Xenorhabdus bovienii
  Coding DNA sequence: Name=SeqID_1580
  Gene classification: Gene name=EbsC; Function=Uncharacterized ACR; Function class=S Function unknown
  Homolog annotation: Query=1..157bp; Hit=1..157bp; Blast score=215; Percent Identity=71.0; E value=2e-56; Homolog= ybaK COG2606
MTPAVILLEKHQINFRLHPYEHDTNEHSFGDEVVKKLGLDAKQVFKTLLVSLNGDPKNLAVAVTPVAGQLDLKKVAKVFKAKKAEMADPQLAQKVTGYLVGGISPLGQKKRLPTIIDSQAQTLPTLFISGGKRGLDIELVPTDLCQLLNCSFADIAKV

SEQ ID NO: 7689 - protein, 86 aa, Xenorhabdus bovienii
  Coding DNA sequence: Name=SeqID_1581
MTICLKNDEVAIFISFYLNLLNYINKLYEIVNNMTSGLRTVYRHSRIEQYRTKLCFQENRASSKNSMVIAVCFQTLAISAKEQLSS

SEQ ID NO: 7690 - protein, 55 aa, Xenorhabdus bovienii
  Coding DNA sequence: Name=SeqID_1582
MATSSFFRQIVITDPKAIKMLRKANKRKPKENFKKIDIEAEQIEAIEILKRKFSL

SEQ ID NO: 7691 - protein, 66 aa, Xenorhabdus bovienii
  Coding DNA sequence: Name=SeqID_1583
VTSANSNLIDFKCKNDSTSWFDGQEKDSKYSFVLSLPRTDNTFPRVRIFVLIFLLPRFVLLQYLFF

SEQ ID NO: 7692 - protein, 135 aa, Xenorhabdus bovienii
  Coding DNA sequence: Name=SeqID_1584
LADVTRTYPILNEKGVILAYFSLTYKELSTQNFSISKTKIKKLDGISKSANTIKVYLIGQVAKNFSLVINSINFREIFLYIKNIITTVKTLIGGRIIALECKNNLKLIELYMKHGLKKLPTKGEINPLITMIFNN

SEQ ID NO: 7693 - protein, 552 aa, Xenorhabdus bovienii
  Coding DNA sequence: Name=SeqID_1585
  Gene classification: Gene name=UshA; Function=5'-nucleotidase/2',3' -cyclic phosphodiesterase and related esterases; Function class=F Nucleotide transport and metabolism
  Homolog annotation: Query=1..549bp; Hit=1..547bp; Blast score=834; Percent Identity=71.0; E value=0; Homolog= ZushA COG0737
MKFSFKTPACALVVSLSLLPISATAWEKNKTYDITILHTNDHHGHFWQNDHGEYGLAAQKTLVDSIRQEVAKKGGSVLLLSGGDINTGVPESDMQDAEPDFKGMNLVGYDAMALGNHEFDKPLNVLHQQEKWANFPFLSANIYQTSTGKRLFKPYVMFDEQGVKIAVIGLTTDDTAKVGNPANFPDVEFRVPAEEAKKVIDELKKNEKPDVIIAATHMGHYNDGHHGSNAPGDVEMARSLPAGYLNMIVGGHSQDPVCMSTENKNYKQVDYVPGTPCSPDRQNGTWIVQAHEWGKYVGRADFQFRNGEFKLVHYQLIPINLQKKVKNEDGSTGSAYYTHQITQHPEMLKLLTPYQDKGSRKLNVQVGAVDGKLEGDRSKVRFVQTNMAHLVLAAQMERTNADFAVMSGGGIRDSIEAGDITYKDVLKVHPFANQLVYVDFKGREVLPYLTAVANMETDSGAYGQFYNVSFVVDGKKISDVKIGGKPLDPNKTYRMATLNFNAIGGDGYPRVDNLPGYVDTGFVDAEVLKGYIETHSPLKVADYEPKGEIVHK

SEQ ID NO: 7694 - protein, 36 aa, Xenorhabdus bovienii
  Coding DNA sequence: Name=SeqID_1586
LIGKYILAPRCHHSILVLDSSLFRQRHCCINIAVEK

SEQ ID NO: 7695 - protein, 43 aa, Xenorhabdus bovienii
  Coding DNA sequence: Name=SeqID_1587
VLLCSLILVVSSIQPVLYGVELLFNCYTLIHIRPLIKFLLTLI

SEQ ID NO: 7696 - protein, 409 aa, Xenorhabdus bovienii
  Coding DNA sequence: Name=SeqID_1588
  Gene classification: Gene name=ProP; Function=77 Permeases of the major facilitator superfamily; Function class=G Carbohydrate transport and metabolism
  Homolog annotation: Query=1..404bp; Hit=3..405bp; Blast score=499; Percent Identity=74.0; E value=1e-141; Homolog= Zfsr COG0477
MSEQSNTEQLPDSSRKTHQTVFSILGAISLSHLLNDMIQSLILAIYPLLQSEFTLSFIQVGMITLVYQVTASLLQPLIGLYTDKYPQPYSLPIGMGFTLSGLLLLAYAESFPIILLAAALVGTGSSVFHPESSRVARMASGGRHGLAQSLFQVGGNLGSSLGPLLAAIFIAPYGKGNLGWFSLAALLAIVILLQVSQWYKMQHRASKSLSSTHISQPNFPRKMIVRSFAILLILIFSKYFYLTSISSYYTFYLIQKFDLSVQNAQIHLFIFLFAVAAGTMIGGPIGDKIGRKYVIWGSILGVAPFTLLLPYTSLFWTGPLTVVIGLILASAFSAILVYAQELIPGKTGMIAGLFFGLAFGMGGIGAAVLGYVADKTSIELVYKICAFLPLLGIFTLFLPNIERKPHEKP

SEQ ID NO: 7697 - protein, 566 aa, Xenorhabdus bovienii
  Coding DNA sequence: Name=SeqID_1589
  Gene classification: Gene name=KefB; Function=Kef-type K+ transport systems, membrane components; Function class=P Inorganic ion transport and metabolism
  Homolog annotation: Query=1..409bp; Hit=1..409bp; Blast score=507; Percent Identity=78.0; E value=1e-143; Homolog= ybaL_1 COG0475
MEHSTPLITTIVGGFVLAYLLGMLAQRLKISPLVGYLAAGVLAGPFTPGFVADTSLAPELSEIGVILLMFGVGLHFSLKDLLAVKSIAIPGAIAQIAVATLLGVGLSTLLGWGLFTGIVFGLCLSTASTVVLLRALEERQLIDSQRGQIAIGWLIVEDLAMVLALVLLPAAAGILDSQNANIGQLLLELAMTIGKVVAFILLMVFVGRRLIPWILAKTASTGSRELFTLAVLAIALGVAYGAVKLFDASFALGAFFAGMVLNESELSHRAAQDTLPLRDAFAVLFFVSVGMLFDPMVLFQQPLAILGTLVIIIIGKSLAAMLLVKMFGHSRRTALTISVSLAQIGEFAFILAGLGVTLGLLDGEARNLVLAGAIVSIMLNPILFSLLDRYLEKTETIEEQLLEETLEEETQIPVDICGHAIIVGYGRVGRLLCQRLQERNFPLVVLEDTRARFEELGEMGISAVMGNAASKDIMALARLDCACTLFLTIPNGYEAGEIVANAREIRPDINIIARAHYDDEVTYIMERGTNHIIIGEHEIARAMADALSMYEPTCPIEPPPSFSTAS

SEQ ID NO: 7698 - protein, 47 aa, Xenorhabdus bovienii
  Coding DNA sequence: Name=SeqID_1590
MVYPADFRGILQNKPYQRCCIVNVVSAFPVRFFQTIFFLWQPTHQAR

SEQ ID NO: 7699 - protein, 436 aa, Xenorhabdus bovienii
  Coding DNA sequence: Name=SeqID_1591
  Gene classification: Gene name=RbsK; Function=Sugar kinases, ribokinase family; Function class=G Carbohydrate transport and metabolism
  Homolog annotation: Query=1..436bp; Hit=1..434bp; Blast score=740; Percent Identity=79.0; E value=0; Homolog= gsk COG0524
MKFPGKRKSKHYFPVSLRDPLLQPIKEMIDTENNRAYIVGIDQTLVDIEAKVDESFIQRYNLSQGHSLVIEDDVAEALYKELTDNNLISHEFAGGTIGNTLHNYSVLADDKSVLLGTMCNNIQIGSYAYCYLCNTSSRMDLNHLQGVDGPIGRCFTLVTENGERTFAISPGLMNQLRPENIPEHIIAEASALVITAYLVRCKSGDPMPEATMKAIEYAKKHNVPVVLTLGTKYVIADDPQWWRDFLAENVSVVAMNEDEAQELTGFSDPLLAADMALNWVDLVLCTAGPAGLYMAGYTEEEHKRQTSHPLLPGAIAEFNLYEFSRVLCKADCQNPMRVYSHIEPYMGGPEKIMNTNGAGDGALSALLHDITANSYHRMNVPNSSKHMRSYLTYSSLAQVCKYANRVSYQVLSQHSPRLMRGLPEKEDSLEESYWER

SEQ ID NO: 7700 - protein, 31 aa, Xenorhabdus bovienii
  Coding DNA sequence: Name=SeqID_1592
MALRFLFCYGIALHRIVLTCRIFWLYSINQL

SEQ ID NO: 7701 - protein, 37 aa, Xenorhabdus bovienii
  Coding DNA sequence: Name=SeqID_1593
VLYSLTFDSQCSNSIGCQTLWRYVFCFATVLRYTVLC

SEQ ID NO: 7702 - protein, 368 aa, Xenorhabdus bovienii
  Coding DNA sequence: Name=SeqID_1594
  Gene classification: Function=Chain length determinant protein; Function class=M Cell envelope biogenesis, outer membrane
  Homolog annotation: Query=25..368bp; Hit=25..370bp; Blast score=219; Percent Identity=36.0; E value=4e-57; Homolog= ZfepE COG3765
MSNKPIKHPDFYEENSNYYHPKQEDEIDLFELFSVIFRSKYLIIAISFVFAVIGFGIASFLPQKWTSTAAVVKPTLEQFQPLKNALTDLQVLSLDPKVTEASLYQRFVENYNSRVLREDYLVSTDYFKALLAKMDDGAIQGKRKLIEQVVNKNISISLPKKDNEGDDESVLSFSAGTAEDSYNLLTGYINFVSSVVRDQVKDELNDMVHQKLVFSQKSYEIDLARIRNMRGVDIERLKYAISIANSAGVKKPVSNGGAMIKDDPDYSIALGADALQRKLQITEEITDPTQIDADLRNRLLYIENLKLVNIDKIDFEPFRYMQQPYEPTAKDSPKRLLILIGAGFIGFILSVIFVLVRHMARSRQKQEA

SEQ ID NO: 7703 - protein, 321 aa, Xenorhabdus bovienii
  Coding DNA sequence: Name=SeqID_1595
  Gene classification: Gene name=HemH; Function=Protoheme ferro-lyase (ferrochelatase); Function class=H Coenzyme metabolism
  Homolog annotation: Query=1..316bp; Hit=1..316bp; Blast score=375; Percent Identity=59.0; E value=1e-104; Homolog= hemH COG0276
MSSNKYGVLLVNLGTPDEPTPVAIRRYLAKFLSDRRVVDIPPFIWKPLLYGIILPFRSSRVAKLYQGIWTEEGSPLLVYSQRQQTLLNERLTDIPVVLGMSYGFPSLPQAVGNLLQQGIDHLIVLPLYPQYSSTTSAAVFDSISKILKGYRTIPHLHFIRSYATHPAYIAALKATIEQSFEKHGLPDRLLLSYHGIPERLATIGDIYPQDCRATTELLIQALDYPADKIMMTFQSRFGRLPWLTPYTDKTMALLPEQGVEHVQVLCPGFSSDCLETLEEIQQQNQAIFLHAGGKKFEYISALNDNEAHISLLEQLVNNAMK

SEQ ID NO: 7704 - protein, 214 aa, Xenorhabdus bovienii
  Coding DNA sequence: Name=SeqID_1596
  Gene classification: Gene name=Adk; Function=Adenylate kinase and related kinases; Function class=F Nucleotide transport and metabolism
  Homolog annotation: Query=1..214bp; Hit=1..214bp; Blast score=339; Percent Identity=81.0; E value=1e-93; Homolog= adk COG0563
MRIILLGAPGAGKGTQAQFIMEKYGIPQISTGDMLRAAVKAGSELGLKAKELMDNGKLVTDELVIALVKERIKQDDCRSGFLLDGFPRTIPQADAMKEAGIKVDYVLEFAVSDAIIVERIIGRRVHTPSGRVYHIKFNQPKVENRDDVTGEELSIRKDDQEDTVRKRLVEYHAQTAPLVSYYQNEAQAGNTKYFKLDGTRQVAEVSEELVGILG

SEQ ID NO: 7705 - protein, 40 aa, Xenorhabdus bovienii
  Coding DNA sequence: Name=SeqID_1597
MIIDHASTENWAWFIFRSIRKRLPVFLSHTPFKWYGGLFY

SEQ ID NO: 7706 - protein, 625 aa, Xenorhabdus bovienii
  Coding DNA sequence: Name=SeqID_1598
  Gene classification: Gene name=HtpG; Function=Molecular chaperone, HSP90 family; Function class=O Posttranslational modification, protein turnover, chaperones
  Homolog annotation: Query=1..622bp; Hit=1..624bp; Blast score=1020; Percent Identity=83.0; E value=0; Homolog= htpG COG0326
MKGQETRGFQSEVKQLLQLMIHSLYSNKEIFLRELISNASDAADKLRFRALSKPELYENDGELRVRLAFDNEHKTITISDNGIGMSRDEVIDNLGTIAKSGTKSFLESVGSDQVKDSQLIGQFGVGFYSAFIVADKVTVRTRAAGTAADQGVFWESTGEGDYTIADLEKTERGTEITLHLREGEDEFLNDWRLRSIIGKYSDHIALPVEIETKNEEDDTVTWEKINKAQALWTRGKAEISDEEYQEFYKHISHDFADPLSWSHNRVEGKQEYTSLLYIPAQAPWDMWNREHKHGLKLYVQRVFIMDDAEQFMPNYLRFMRGLIDSNDLPLNVSREILQDSTITRNLRNALTKRVLQMLDKLAKDDAEKYQTFWQQFGLVLKEGPAEDGSNKEAIAKLLRFATTHNDGSAQTVSLEDYLSRMTEGQEKIYYITADSYAAAKNSPHLELFRKKGIEVLLLSDRIDEWMMSYLTEFDGKSFQSVSKTDESLDKLADENKAEQEEEDKKLEPFIERVKTLLGDRVKEVKLTHRLTDTPAIVTTNANEMSTQMAKLFAAAGQSAPEVSYNFELNPEHNLVKKAADIHDEAQFADWIELLLDQALFAERGTLDDPNQFIRRMNQLLLAEKA

SEQ ID NO: 7707 - protein, 42 aa, Xenorhabdus bovienii
  Coding DNA sequence: Name=SeqID_1599
MGITPNNFKLGQSEEYKIGLMNVQISCGWWRYPQHHPLEFPI

SEQ ID NO: 7708 - protein, 41 aa, Xenorhabdus bovienii
  Coding DNA sequence: Name=SeqID_1600
MAQRCPIHLRVAKESLICDRLPNFKWEIPMDGAADNATIHS

SEQ ID NO: 7709 - protein, 192 aa, Xenorhabdus bovienii
  Coding DNA sequence: Name=SeqID_1601
  Gene classification: Gene name=RecR; Function=Recombinational DNA repair protein (RecF pathway); Function class=L DNA replication, recombination and repair
  Homolog annotation: Query=1..189bp; Hit=11..199bp; Blast score=324; Percent Identity=86.0; E value=4e-89; Homolog= recR COG0353
MESLRCLPGVGPKSAQRMAFHLLQRDRSGGMRLAQALTRAMSEIGHCQDCRTFTEQEQCTICGNPRRQQNGQICVVETPADIHAIEQTGQFAGRYFVLMGRLSPLDGIGPMDIGLDRLEERLSSETLSEIILATNPTVEGEATANYIAEMCSQYGVIASRIAHGVPVGSELEMVDGTTLSHSLAGRQRITDL

SEQ ID NO: 7710 - protein, 38 aa, Xenorhabdus bovienii
  Coding DNA sequence: Name=SeqID_1602
MPFAGLIWGLRRVNSVMTPSGIQEEGWFASEWHLKARR

SEQ ID NO: 7711 - protein, 115 aa, Xenorhabdus bovienii
  Coding DNA sequence: Name=SeqID_1603
MPLETPDIFSFWVSSMRRAASLNAAAIRSSSISLSSSIKLGSISTRRQLCAPLIVTFTRPAPDSPVTSRFAISSCTFCIFSCICWACFIKLPKPPLPNIIISLRYSHSLNIYCSG

SEQ ID NO: 7712 - protein, 658 aa, Xenorhabdus bovienii
  Coding DNA sequence: Name=SeqID_1604
  Gene classification: Gene name=DnaX; Function=DNA polymerase III, gamma/tau subunits; Function class=L DNA replication, recombination and repair
  Homolog annotation: Query=1..658bp; Hit=1..643bp; Blast score=760; Percent Identity=64.0; E value=0; Homolog= ZdnaX COG2812
MSYQVLARKWRPQIFSDVIGQQHVLTALANGLEHQRLHHAYLFSGTRGVGKTTIARLLAKGLNCETGITKTPCGQCANCLEIEQGRFVDLIEIDAASRTKVEDTRELLDNVQYAPARGRFKVYLIDEVHMLSRHSFNALLKTLEEPPEHVKFLLATTDPQKLPVTILSRCLQFHLKALNVDQISGQLEHVLNAEQIESDSRARHLLARAADGSMRDALSLTDQAIALGGGKLTADIVSQMLGTLDNDQPLEMIEWLVRADGQQLMALVEQIASRGVDWEHLLVEILSLLHRIAMLQLLPQQPDNDPSSTEGRLRLLARSISPADLQLFYQALLVGRKDLPYAPERRMGVEMALLRALAFHPKTIIEETPASGGEIPVAPQVSAPAQRHPVSPVQNHAAGERSEKGSEHSSPQSMSTEPVVSSPTAKLLQARHSLTRQGNTPPKKSEPAEPVKAKSASSALERLAAVAEQRPQSYIPKAREPKPIKQEAYRWRTTNTSVEEKQVCVTTPKAIKAALEHEKTPELAEKLAVESKQRDSWSAEIDKLNIPKLVQQVALNAFKEQIDESRLCLHLRSKQRHLNSASAQQMLSEALSELHGKPIDLRIIEDDNPAVKTPLEWRQAIYEEKLAQARQSIISDRTIQTLQQLFDAELDEESIRPV

SEQ ID NO: 7713 - protein, 30 aa, Xenorhabdus bovienii
  Coding DNA sequence: Name=SeqID_1605
VGATYGRVLDSSLIPRKLNMTVYHASTASP

SEQ ID NO: 7714 - protein, 183 aa, Xenorhabdus bovienii
  Coding DNA sequence: Name=SeqID_1606
  Gene classification: Gene name=Apt; Function=Adenine/guanine phosphoribosyltransferases and related PRPP-binding proteins; Function class=F Nucleotide transport and metabolism
  Homolog annotation: Query=1..183bp; Hit=1..183bp; Blast score=269; Percent Identity=74.0; E value=1e-72; Homolog= apt COG0503
MTANAQKLQFIKDSIETIPDYPKVGVLFRDITTLLDNPVAYQATIDLLVEHYQEKGITKIVGTEARGFLFGAPVALRLGVGFIPVRKKGKLPRATLSETYDLEYGTDTLEIHKNSIKEGDKVLVVDDLLATGGTIEATVSLIRRLGGEVSEAAFIIGLPDLGGTERLKKQGIESYTLIEFPGH

SEQ ID NO: 7715 - protein, 35 aa, Xenorhabdus bovienii
  Coding DNA sequence: Name=SeqID_1607
MLNYFVTIMFDVIGAKLDQNQQKQAAICFAVAFFR

SEQ ID NO: 7716 - protein, 182 aa, Xenorhabdus bovienii
  Coding DNA sequence: Name=SeqID_1608
  Homolog annotation: Query=3..182bp; Hit=1..180bp; Blast score=192; Percent Identity=67.0; E value=2e-48; Homolog= ref|NP_931048.1|
MLMSIQNLLGALEKQISMLETELESLPKTPFSVARFDQALFHQHSNKLGGYLNEIKKNMSQLKTCVKDNRTEQVRFLSERLVTQIEALKREISTQPLRKQEEKFEHQSQERDFYHRLAEHQDYERRLMAMINDRELQLNKQVILTNQYKLQKEIAALAGRLARCRQALMRIERAIEKQENSD

SEQ ID NO: 7717 - protein, 54 aa, Xenorhabdus bovienii
  Coding DNA sequence: Name=SeqID_1609
  Homolog annotation: Query=1..54bp; Hit=1..54bp; Blast score=68; Percent Identity=75.0; E value=2e-11; Homolog= ref|NP_931049.1|
MDLEQAPPEVQLAVDLIYLLECNEISPDIALAALEIVKDDFQGKLKKQAQQPKE

SEQ ID NO: 7718 - protein, 1152 aa, Xenorhabdus bovienii
  Coding DNA sequence: Name=SeqID_1610
  Gene classification: Function=Small-conductance mechanosensitive channel; Function class=M Cell envelope biogenesis, outer membrane
  Homolog annotation: Query=31..1134bp; Hit=18..1112bp; Blast score =1037; Percent Identity=50.0; E value=0; Homolog= aefA COG3264
MVPFNRYLGIFLNKRVLCDKRPDTLYFRFVFTASLFFLLLFFFSPAMAAFSSETPTRNDIQNQLKILTERKEHTVEEKTSIADLEKALYFFDKIDQVKLDSDLLKKNLQDSPQKSRQITAGLENLKNNAQQDENDYKQTLETLSLKQLESKLNSTLNSLQRAQENLASYNSQLIGLQTQPERAQNLLFHNVQRLQQIRNQLNNELTELPESRYPQLDLLRVEQSFLMQQNELQRASLQANTQLQTLLQQQRDYTSFQIDQLERYVQFIQNVVSGKRLIVSEETAKEAQNSDDTNSHIQSNPLVKEEIQTNRELSERLIAETRESNQLVQKNIRVKNFLDRAIQSERNLKEQVKVLRGSLLLSRILFQEQLKVPQNVLTKDLPIKIADLRLEQFEINQQRDKLYQLNDYANQLLNLHSDEIKHESKEAVGEIRNAIEQILEIRRELLNQLNNQLGNQITHAINLQMDQQQLLDVTQSLEQTLVQQIFWVNSNKPMNLAWLKSLPDLIQEELSHLNIHLTLSGLATGLKNSIHFVIPLLLVGLFLRWQTKGINEQLKKISDEVGQLRRDSQLHTPLALILTLVKTLPLALLILAIGYWYSKSGDDLGDLIWSFSRQLALFWIMYRCSYQILAKDGIGEHHFSLNRADYTLFRKNLVRLSIVLLPILFWITLGVKHPLRLSDDVIGQCTVLICLLFVFIFIFPFCRQVWRVKSSHMIRTMVVTALTFAPLVLMVLMVSGYFYTTLRLAERWLYSLYLLFLWHICYQACLRGLGIAARRIAYRRAIARRQAQAKEGAEGDVVEEPPMELERINQQSLRLTTMVLFLIFLGAFYWVWSDLVTVFSYLDGINLWQYSTTTELGNVLQQVTLKDLGISMAMLVISWVMMRNLPGLLEVLVLSRLQLQQGSSYAIKTTLTYLIIGVGGISALGTLGLSWNKLQWLAAALSVGLGFGLQEIFANFVSGLIILFERPVRIGDTVTIGTYSGSVSKIRIRATTITDFDRKEVIIPNRAFVTERLINWTLSDTITRIIIKVGVAYGSDLDKVKEVLLKAAKDNPRVMNEPIPQVYFMSFGASTLDHELRLYVKELGDRSHTVDEVNRNIDKLCRENNINIAFNQLEVYLHNGQGNSLQEVQKALNGGSHHSDGQVSPGDQPLLP

SEQ ID NO: 7719 - protein, 48 aa, Xenorhabdus bovienii
  Coding DNA sequence: Name=SeqID_1611
MVLLIHSNIATTCDVTRKISFKSQEQMSMESILSVIILKLTLSGRSEP

SEQ ID NO: 7720 - protein, 232 aa, Xenorhabdus bovienii
  Coding DNA sequence: Name=SeqID_1612
  Gene classification: Gene name=AcrR; Function=Transcriptional regulator; Function class=K Transcription
  Homolog annotation: Query=17..207bp; Hit=1..191bp; Blast score=219; Percent Identity=53.0; E value=2e-57; Homolog= acrR COG1309
MYVNQPQVKNKVYGTKMARKTKQQAKETRQQIIEAAIKVFSERGVSATSLSDIAIAAGVTRGAIYWHFKNKIDLLSAVCKMHENKIDELEKEYQAKYPNNPLLALRSLLIFLLKMMIDDSRNRLLMEIFFHKCEFVGEMILLAEKLRGLCISDYKKIENILGACIQSGELPHDLDLRRSAIMLKALMTGVLENWSFAPDSFNIQEQSTYLVDGLIDTLKYSHHLRCNEENKF

SEQ ID NO: 7721 - protein, 399 aa, Xenorhabdus bovienii
  Coding DNA sequence: Name=SeqID_1613
  Gene classification: Gene name=AcrA; Function=Membrane-fusion protein; Function class=Q Secondary metabolites biosynthesis, transport and catabolism
  Homolog annotation: Query=1..384bp; Hit=1..381bp; Blast score=458; Percent Identity=66.0; E value=1e-129; Homolog= acrA COG0845
MRKNRGVLPLATLLVLSGSFILSGCNDNKNSQQGAAGEHASEVGIVTLKAEPLTVITELPGRTSAYRVAEVRPQVSGIILKRNYKEGSDIAAGESLYQIDPATYQADYNKALANLSRVQANEKVSRSTVDRYKSLLGTQYVSKQEFDKANSEHAQAAAEVLSTKAALESTKINLAYTKVTSPISGRAGKSTVTEGALVSGGQPTALTTVQQLDPIYVDITQSSDDYLRLKNEIAKGTVHKEGGKTKTRLITDTGKEYSQEGYLEFSDITVDETTGSITMRAVFPNPNEELLPGMFVRTKLEEGVRQNAILVPQQAITRTPRGQATTLIVDKDNKVELRNINAVQAIGNKWLVTEGLKAGDRVIVTGLQKIAPGVTVKPTETDLDAKLTANQTEPAKKPQ

SEQ ID NO: 7722 - protein, 1049 aa, Xenorhabdus bovienii
  Coding DNA sequence: Name=SeqID_1614
  Gene classification: Gene name=AcrB; Function=Cation/multidrug efflux pump; Function class=Q Secondary metabolites biosynthesis, transport and catabolism
  Homolog annotation: Query=1..1049bp; Hit=1..1049bp; Blast score=1545; Percent Identity=75.0; E value=0; Homolog= ZacrB COG0841
MPKFFIDRPIFAWVIAIITMLSGLLAIMKLPVEQYPAIAPPSISISAVYPGADATTVQNTVTQVIEQNMNGIDNLVYMASNSDSAGRMSITLTFEANTDPDIAQVQVQNKLQLAMPLLPREVQQQGISVDKTTNSFLMVAGFISEDGSMTQDDIADYVGASVKDPLSRVSGVGETMLFGNQYAMRIWLDPDKLLNYKMTTQDVITAIKAQNNQVAAGQLGGTPPVPGQRLNASIIAQTRLNSPEEFSNILLRMKRDGSHIRLKDVAVVELGAESYSIIGRFNGNSAAGIGIKLATGANALDTSKAVKKALAEMAPFFPHGLTVVYPYDTTPFVKISIFEVVKTLAEAILLVFVVMYLFLQNFRATLIPTIAVPVVLLGTFAILAAFGYSINTLTMFAMVLAIGLLVDDAIVVVENVERVMQEEGLPPKEATRKSMGQIQSALVGIALVLSAVFVPMAFFGGATGAIYRQFSITIVSAMVLSVLVALILTPALCATMLKPVAKGSHGIQTGFFGWFNRLFEKSTHHYTDSVGRMLRGTGRYLLIYIVLIAGMAFMFTRMPSSFLPEEDQGVLLAMVQLPPGSTQDQTQKVLDEINDYFHTKETEIVKSVFTINGFSFSGQGQNSGLVFVSLKDWDERKDYKNKVPAIVGRANAHFSQIKEGIVFAFNIPSIVELGSASGFDFQLIDKGNLGHEALTQARNQLLGMVQSHPDMLTSVRPNGQNDTPQYRIHIDKEKAEALGVSTENINSTLSTMFGGAYVNDFIDRGRVKKVYIQSDALHRMLPGDISKLYVRNHHGEMVPFSAFIDISKDPWVYGSPRLERYNGLPSMEIVGEAAKGKSTGDAMAFMEQLASQLPSGIGYDWTGMSYQERLSGNQAPALYTLSLIVVFLCLAALYESWSIPFSVMLVVPLGIVGALLATSIRGLDNDVYFKVGLLTTIGLSAKNAILIVEFAKDLIEKEGKGLIEATLDAVKMRLRPILMTSLAFMLGVMPLVLSNGAGSGAQNAVGTGVLGGMIAATSLAIYFVPVFFVVIKRRFSKKSEDVEHISTHH

SEQ ID NO: 7723 - protein, 122 aa, Xenorhabdus bovienii
  Coding DNA sequence: Name=SeqID_1615
  Homolog annotation: Query=1..122bp; Hit=1..122bp; Blast score=125; Percent Identity=54.0; E value=2e-28; Homolog= ref|NP_406612.1|
MDEYSPRRHDIVELKYLCENLIHEAFSVLNRADNHWINDLTSEKSLKLNELIEHIAAFVWSFKIKYADNYNLSTLIDEYLDETYNLFGSDKISFFELTKWQKTNEHLTNILLHDLNACLSKT

SEQ ID NO: 7724 - protein, 67 aa, Xenorhabdus bovienii
  Coding DNA sequence: Name=SeqID_1616
  Homolog annotation: Query=1..67bp; Hit=73..139bp; Blast score=115; Percent Identity=86.0; E value=2e-25; Homolog= gb|AAB40215.1|
MTKTDYLMRLRKCTSIETLERVIEKNKYELSDDELELFYSAADHRLAELTMNKLYDKIPSSVWKFVR

SEQ ID NO: 7725 - protein, 43 aa, Xenorhabdus bovienii
  Coding DNA sequence: Name=SeqID_1617
MNSKRVRALPATPRHTHPLLWLLLSRSDQVNKLALRENQQSPH

SEQ ID NO: 7726 - protein, 42 aa, Xenorhabdus bovienii
  Coding DNA sequence: Name=SeqID_1618
MLFFCLSVLYSISSTSLRTHDNPATMANQTHSIRTINRQKYK

SEQ ID NO: 7727 - protein, 33 aa, Xenorhabdus bovienii
  Coding DNA sequence: Name=SeqID_1619
MILLLFFVIDFYAYFLFFWFMEGRLYDLYVLVF

SEQ ID NO: 7728 - protein, 38 aa, Xenorhabdus bovienii
  Coding DNA sequence: Name=SeqID_1620
MKIYYLLLFLNVLLLFYTFLTAITKAKAHYESGITKFN

SEQ ID NO: 7729 - protein, 91 aa, Xenorhabdus bovienii; identical to SEQ ID NO: 6528
  Coding DNA sequence: Name=SeqID_1621
  Gene classification: Function=Transposase; Function class=L DNA replication, recombination and repair
  Homolog annotation: Query=1..86bp; Hit=1..86bp; Blast score=87; Percent Identity=50.0; E value=2e-18; Homolog= insA_g5 COG3677

SEQ ID NO: 7730 - protein, 83 aa, Xenorhabdus bovienii; identical to SEQ ID NO: 6529
  Coding DNA sequence: Name=SeqID_1622

SEQ ID NO: 7731 - protein, 84 aa, Xenorhabdus bovienii; identical to SEQ ID NO: 6530
  Coding DNA sequence: Name=SeqID_1623
  Gene classification: Gene name=InsB; Function=Insertion element IS1 protein InsB, putative transposase; Function class=L DNA replication, recombination and repair
  Homolog annotation: Query=1..79bp; Hit=87..166bp; Blast score=67; Percent Identity=41.0; E value=2e-12; Homolog= insB_g3 COG1662

SEQ ID NO: 7732 - protein, 36 aa, Xenorhabdus bovienii
  Coding DNA sequence: Name=SeqID_1624
VFKTFFRSLKRGCHVENRLTILYCTDSASAETSPIT

SEQ ID NO: 7733 - protein, 183 aa, Xenorhabdus bovienii
  Coding DNA sequence: Name=SeqID_1625
  Gene classification: Gene name=TesB; Function=Acyl-CoA thioesterase; Function class=I Lipid metabolism
  Homolog annotation: Query=1..180bp; Hit=104..283bp; Blast score=234; Percent Identity=62.0; E value=4e-62; Homolog= tesB COG1946
MTASFQTPEESFEHQCSMPEVPPPEELASQQEIAKNIFHLLPSKLKDAFSVLPPLEVKPIKFYSPFNKSPEEPVRYVWFRSNGKMPEDPFIHHCLLGYASDLNFLPTSLQPHGIGFMEKDIQIATIDHSMWYHRPFKMDDWLLYSIESPSASGARGFVRGHIYTREGVLIASAVQEGVIRKRK

SEQ ID NO: 7734 - protein, 430 aa, Xenorhabdus bovienii
  Coding DNA sequence: Name=SeqID_1626
  Gene classification: Gene name=AmtB; Function=Ammonia permeases; Function class=P Inorganic ion transport and metabolism
  Homolog annotation: Query=6..430bp; Hit=1..427bp; Blast score=509; Percent Identity=68.0; E value=1e-144; Homolog= amtB COG0004
MKKQLLSITSIIAGIIASAPSFAFAAGSTFDKADTVFMLVNTVLVLFMTIPGIALFYGGLLRRKNVLSLMSQVIVSFSLVCVLWVVYGYSMTFGTGNRFWGGFEQVMLKNISITDLNGSFYQLIHVVFQGAFACITVALVVGALCERVRFSALLIFSVLWLTASYIPMAHMVWGGGWLAQDGALDFAGGTVVHINAAVAGLVGAYLLGRRSGFGKEAFKPHNLPMTFIGTAILYIGWFGFNVGSAGAVNAIAALALINTMAATAGAVLSWVFSEWLFRDKPSLLGACSGCIAGLVAITPAAATVGIGGALIIGLIAGVAGLWGVVVLKRWLRVDDVCDVFGVHGVCGIVGCLLTSIFTASALGGTGFPEDMTMLRQIGVQIISILVCIVWSAVAAYLSFKIADLVVGLRISVESEREGLDITSHGESAYN

SEQ ID NO: 7735 - protein, 124 aa, Xenorhabdus bovienii
  Coding DNA sequence: Name=SeqID_1627
  Gene classification: Gene name=GlnK; Function=Nitrogen regulatory protein PII; Function class=E Amino acid transport and metabolism
  Homolog annotation: Query=13..124bp; Hit=1..112bp; Blast score=166; Percent Identity=74.0; E value=3e-42; Homolog= glnK COG0347
MFLANTAKSGGSMKLITTIIKPFKLEEVREALSDIGIQGVTVTEVKGFGRQKGHSELYRGAEYSVNFLPKVKIDIATHDERVEEVIHVIQQSAFTGKMGDGKIFIFELQHAVRIRTGETNDAAL

SEQ ID NO: 7736 - protein, 32 aa, Xenorhabdus bovienii
  Coding DNA sequence: Name=SeqID_1628
MNLCTLSVHKRSDYSSHSFFTFLSQLFSLITN

SEQ ID NO: 7737 - protein, 630 aa, Xenorhabdus bovienii
  Coding DNA sequence: Name=SeqID_1629
  Gene classification: Gene name=MdlB; Function=ABC-type multidrug/protein/lipid transport system, ATPase component; Function class=Q Secondary metabolites biosynthesis, transport and catabolism
  Homolog annotation: Query=46..628bp; Hit=3..585bp; Blast score=782; Percent Identity=71.0; E value=0; Homolog= mdlB COG1132
MARLRSKARTNNLLHNPVGILICTIISNLKPNWMVNMTNHDMHKPSVRKLWPSLKRLLSYSKNYRKPILLAVLMSWVAALAEVSGPLLVSYFIDNMVATGNLPLDVVSGLAVTFLVLQFVAAALHYFQFLLFNQASVGIVQKLRTDVMNSALRQPLSTFDSQPVGQLISRVTNDTEAIKDLFVNVIPTVFRCISLIGAMLIAMFILDWRMACVALTIFPAVLLVMIIYQHFSTPIIRRVRSYLADINDGFNETINGMTVIQQFRQQARFGEKMLATNREHYQSRMQALRLDGILLRPLLSLFSAAILCGLLLLFGFKGTEVIGVGVLYAFVNYLGRLNEPLIELTAQQSLLQQAVVSGERVFELMDSPQQQYGTDQQALTSGRIDIENLTFAYRNDKVVLSDINLHVPTHGFVALVGHTGSGKSTLTNLIMGYYPWQDGEIYLDGRPVSSLSHAVLRNGVAIVQQDPVVLAASFFDNITLGRDISEDKIWQVLEMVQLAESVRRLPDGLNSVLGEQGNTLSAGQKQLLAMARVLVQTPQILILDEATANIDSGTEQSVQQALRMIRKQTTLVVIAHRLSTIVEADSILVLHRGAIVEQGQHQQLLAKRGRYYQMYQLQQVGETLNESMHA

SEQ ID NO: 7738 - protein, 582 aa, Xenorhabdus bovienii
  Coding DNA sequence: Name=SeqID_1630
  Gene classification: Gene name=MdlB; Function=ABC-type multidrug/protein/lipid transport system, ATPase component; Function class=Q Secondary metabolites biosynthesis, transport and catabolism
  Homolog annotation: Query=1..578bp; Hit=1..578bp; Blast score=831; Percent Identity=72.0; E value=0; Homolog= mdlA COG1132
VRLFSQLSWYFLSEWRRYFGAIIFLVMIAMLQLIPPRLVGIIVDGISAKTMSSSQLLMWLGIMLLIALAIYGLRYVWRVWLFGASYRLAVKLRSDFYQKLSSQNPEFYLRHRTGDLMARATNDVDRVVFAAGEGVLTLVDSLVMGCAVLIVMSVEISWQLTLLSLLPMPIMALVIKRYGEQLHHRFKSAQGAFSALNNHAQESLTSIRMIKAFGLEDLQSSQFEEVATDAGRKNMHVARVDARFDPTIFIAIGVANLLAIGGGSWMVVHGSMTLGELTSFVMYLGLLIWPMLALAWMFNIVERGSAAYTRIRSLLQEPLVIDDGSQSLLVERGTLQANINTFIYPANDRSVLHDVRFQLSPGQLLGVCGPTGAGKSTLLALLQRQFDVTDGEILFQSRHVSTLRLEEWRSRLAIVNQTPFLFSDTVAGNIALGRPDATQEQIEEVARLANMHDDILRLPQGYQTEVGERGVMLSGGQKQRISIARALLLDTEILILDDALSAVDGQTEHQIMKNLSQWRQQRTVIISAHRLSALTEADNILVIQHGTVAQQGPHKQLITQSGWYSDMYHYQQLEAELDGEHD

SEQ ID NO: 7739 - protein, 153 aa, Xenorhabdus bovienii
  Coding DNA sequence: Name=SeqID_1631
  Gene classification: Gene name=Lrp; Function=Transcriptional regulators; Function class=K Transcription
  Homolog annotation: Query=1..151bp; Hit=30..180bp; Blast score=233; Percent Identity=75.0; E value=5e-62; Homolog= ybaO COG1522
MLDKIDRKLLDLLQQDCSRSLNALAEAVNLTSTPCWKRLKRLEDDGYIVGKVALLNGTKLGLSLTVIVMIKTQQHSSEWYEQFVAFIKEMPEVLTFYRMAGEYDYLMHVEVVDMKSYDRFYKRMVNGVSGLIDVTSNFAMEKIKYTTALPIPD

SEQ ID NO: 7740 - protein, 350 aa, Xenorhabdus bovienii
  Coding DNA sequence: Name=SeqID_1632
  Gene classification: Gene name=CysK; Function=Cysteine synthase; Function class=E Amino acid transport and metabolism
  Homolog annotation: Query=5..343bp; Hit=7..345bp; Blast score=523; Percent Identity=71.0; E value=1e-148; Homolog= VC1061 COG0031
MSSSWATNAIKAIQADYQRSADTHLIRLNLPVFSGIHLYLKDESTHPTGSLKHRLARSLFLYALSNGWIKEGTPIIEASSGSTAVSEAYFARLLGLPFIAVMPSCTAKRKVQEIEFYGGKCHFVEHSALIYDESERLAKKLNGHYMDQFTYAERATDWRGNNNIAESIFRQMQLEPFPEPNYIVMSAGTGGTSATLGRYIRYQGYNTKLIVVDPENSVFYDCYHQNRRDIRGITSSKIEGIGRPRAEPSFIPTVINDMLQVPDCATIATIYWLEKLIGRKTGASTGTNVWGALQLAKQMHENNQQGAIVTLLCDSGERYLDTYYNPEWVRNNIGDITLYLTQLPKLDGYE

SEQ ID NO: 7741 - protein, 232 aa, Xenorhabdus bovienii
  Coding DNA sequence: Name=SeqID_1633
  Gene classification: Function=Predicted ATPase (PP-loop superfamily), confers aluminum resistance; Function class=R General function prediction only
  Homolog annotation: Query=1..231bp; Hit=1..230bp; Blast score=386; Percent Identity=80.0; E value=1e-107; Homolog= ZybaX COG0603
MKRAVVVFSGGQDSTTCLIQALRQYDEVHCVTFDYGQRHRAEIDVACRISKELGAAAHKVLDVTLLSELAISSLTRDNIPVPDFSESEKSGLPNTFVPGRNILFLTLAAIYAYQVEAEAVITGVCETDFSGYPDCRDEFVKALNKAVCLGIARDIRFETPLMWLNKAETWALADYYQKLNFVRTQTLTCYNGIQGDGCSECAACHLRANGLNLYLNNTQSTMEDMKSKTHLS

SEQ ID NO: 7742 - protein, 132 aa, Xenorhabdus bovienii
  Coding DNA sequence: Name=SeqID_1634
  Gene classification: Gene name=FcbC; Function=Predicted thioesterase; Function class=R General function prediction only
  Homolog annotation: Query=1..128bp; Hit=1..128bp; Blast score=158; Percent Identity=60.0; E value=1e-39; Homolog= ZybaW COG0824
MRTIIKVRGYHIDLFQHVNNARYLEFMEEARWDLLTESDTLTWLKTNNVGFAVVNININYRLPAVFGDELEVRSSLKELRNKSGVFFQEIIRRSDNKVLTDALTTFACIDLKTQKALTLEGDIQERLEAFKV

SEQ ID NO: 7743 - protein, 30 aa, Xenorhabdus bovienii
  Coding DNA sequence: Name=SeqID_1635
MLIASRVKRAVILIKNNSLNTIVIKMFCYC

SEQ ID NO: 7744 - protein, 191 aa, Xenorhabdus bovienii
  Coding DNA sequence: Name=SeqID_1636
  Gene classification: Gene name=ComEA (BS); Function=DNA uptake protein and related DNA-binding proteins; Function class=L DNA replication, recombination and repair
  Homolog annotation: Query=65..191bp; Hit=1..112bp; Blast score=80; Percent Identity=40.0; E value=8e-16; Homolog= HI1008 COG1555
MMPRLRWGRLNKIAKLLATIFAKQQLKKATFVAFRIFEPFLLSRNSVMASFPPSTKHGGIYMKYLRTLFNSLVMVFCISIPLSHAIAADESPDKAVKQSTNQHKAVIETSDVKEGKELVSEKEIQGKGSININTANAEQLVKELNGVGAKKAQAIIEYREKYGQFTAIEQLQEVQGIGPALIEKNRDKLTY

SEQ ID NO: 7745 - protein, 623 aa, Xenorhabdus bovienii
  Coding DNA sequence: Name=SeqID_1637
  Gene classification: Gene name=SurA; Function=Parvulin-like peptidyl -prolyl isomerase; Function class=O Posttranslational modification, protein turnover, chaperones
  Homolog annotation: Query=1..620bp; Hit=1..617bp; Blast score=546; Percent Identity=48.0; E value=1e-155; Homolog= ybaU COG0760
MMDNLRTAANGPVLKIVLALIILTFVLTGVTGYLSSEGGNYAAKVNGQTISRAQLEQAFQQDKIALQDRLGDQFSTLLSDEQKVQQIRRNSLDRLITVVLSDQYARKLGLSASDEQVKEEIRNLPFFQTDGKFDNNKYLTLLTGANRSPDSFAEQVRQDLINRQLMSILTGSEIALPTEIKQETALAFQERTVRFATLELKSIEAQQKVTDKELKNYYDVNSKSFTVPEKVKVSYIKMDAADELKSVTVSDADIEKYYKNNLPQYTQIEQKKYSLVQLVSDAEAKSVLDELKKGADFSKLAAEKSTDKFSAQKGGDLGWMEESSLPDEIKSANLIEKGQLSGVIKLSGGYAIFRLDDIKPQIIKSLVDVRSEIEKIVKQEKAVDAFYALQRKVSDAATNDNESLAAAEKAAGYKAVTTDWFDRDHIPTEINFDSVVQTIFSGNLIDDKGASGTNSDVISVDGDRAFIVRVDDIKPETIQPYEQAKTQIAELVKRQKAEKQLQLESEKLLAVLKEGKGEQALKAAGIQFGVSTVIKHLSQTNQATNVAFTLPHPKDGKSEYGLAQDGLGNAVLIQLDKVVPGSVSEEQVKQYIAEYQYQIGTFMLESLMINLRDDAEIKMGQIE

SEQ ID NO: 7746 - protein, 32 aa, Xenorhabdus bovienii
  Coding DNA sequence: Name=SeqID_1638
MRLYSNLSTPPRQFKFNCNGQSEGGCFIFITH

SEQ ID NO: 7747 - protein, 102 aa, Xenorhabdus bovienii
  Coding DNA sequence: Name=SeqID_1639
MFHIHYSLTASFSPFPARKAGTFAAAILISLPVWGLRPVRAARSRTVKVPNPTKTTSSPSFNASDTEEMNASTTRPAAALEIFTSAAILSISCDLFTLIIPI

SEQ ID NO: 7748 - protein, 37 aa, Xenorhabdus bovienii
  Coding DNA sequence: Name=SeqID_1640
LLFHDFLLILEGIDITAWLSRYPLEIGICYDSETKWG

SEQ ID NO: 7749 - protein, 175 aa, Xenorhabdus bovienii
  Coding DNA sequence: Name=SeqID_1641
  Gene classification: Gene name=Lon; Function=ATP-dependent Lon protease, bacterial type; Function class=O Posttranslational modification, protein turnover, chaperones
  Homolog annotation: Query=1..175bp; Hit=625..799bp; Blast score=297; Percent Identity=86.0; E value=5e-81; Homolog= Zlon COG0466
MLTIETASVPGKGKLTYTGSLGEVMQESIQAALTVVRARADKLGISSDFHEKRDIHVHVPEGATPKDGPSAGIAMCTALVSCLTGNPVRADVAMTGEITLRGLVLPIGGLKEKLLAAHRGGIKTVLIPDENKRDLEEIPQNIIQDLEIHPVKRIEDVLSIALQSPAFGAEAVSLK

SEQ ID NO: 7750 - protein, 55 aa, Xenorhabdus bovienii
  Coding DNA sequence: Name=SeqID_1642
  Homolog annotation: Query=1..55bp; Hit=398..452bp; Blast score=67; Percent Identity=85.0; E value=4e-11; Homolog= ref|NP_928582.1|
MQEQRTLELDCIRTHTKIINDYQELESIQLYPVKVRKLIRRLRRIRVDRLISRIL

SEQ ID NO: 7751 - protein, 346 aa, Xenorhabdus bovienii
  Coding DNA sequence: Name=SeqID_1643
  Gene classification: Gene name=MurB; Function=UDP-N-acetylmuramate dehydrogenase; Function class=M Cell envelope biogenesis, outer membrane
  Homolog annotation: Query=9..346bp; Hit=5..342bp; Blast score=423; Percent Identity=58.0; E value=1e-118; Homolog= murB COG0812
MSACQFIQLKAFNTFGISVCADHISTVTSVESLLSAWQEAEEKEHPILLLGGGSNVLFTENFKGTVILNRILGVDIQESDTAWHIHVGAGENWHQLIVHLLHQQIYGLENLALIPGNVGSAPIQNIGAYGIEFKHVCEYVDLIELKTGKLIHLMANECQFAYRDSIFKHQYKDGYAITAVGLQLNKVWKPILTYGGLTQFSCEDVTPERIFNAVCEMRQSKLPDPVIIGNAGSFFKNPIVPIELAQKIKFDYPECPQYHHNEHNVKIAAGWLIDQCHLKGYCIGDAAIHMKQALVLINKGNATGQDITALATYVRKKVAEKFNIFLEPEVRFIGSEGEIDAVECIS

SEQ ID NO: 7752 - protein, 319 aa, Xenorhabdus bovienii
  Coding DNA sequence: Name=SeqID_1644
  Gene classification: Gene name=BirA; Function=Biotin-(acetyl-CoA carboxylase) ligase; Function class=H Coenzyme metabolism
  Homolog annotation: Query=84..317bp; Hit=1..234bp; Blast score=321; Percent Identity=67.0; E value=5e-88; Homolog= ZbirA_2 COG0340
MKDISIPLKLIKVLSDGEVHSGQQLGQELGMSRAGINKHIQTIREWGVEILTIPGKGYRFPASMNLLDKELIAGYLPNDRLEVIPVIDSTNQYLLEKLSELDSGDACVAEYQYAGRGRRGRQWISAFGRNLYLSMYWRLEQGPAAAIGLSLVVGIVIAEVLNRQGAERVKVKWPNDLYLDDKKLAGILVELIGKMGDAAQIVIGIGMNISMSSEQQKLINQQWTNLQQAGIVVERNKLISEIILELKKALIQFENEGLSPFLFRWLKLDHFMNRSVKLIIGNQEVYGTARGIDQQGALLLDINGVITPYIGGEISLRGC

SEQ ID NO: 7753 - protein, 309 aa, Xenorhabdus bovienii
  Coding DNA sequence: Name=SeqID_1645
  Gene classification: Gene name=CoaA; Function=Panthothenate kinase; Function class=H Coenzyme metabolism
  Homolog annotation: Query=1..309bp; Hit=8..316bp; Blast score=510; Percent Identity=79.0; E value=1e-145; Homolog= coaA COG1072
LTTPYLQFDREHWATLRDSVPLTLTAEEIAALKGINEEISIEEVVQIYLPLSRLLNFYISSNLRRQAVLEQFLGTGGQKIPYIIGIAGSVAVGKSTTARLLQALLSRWPEHRRVKLVTTDGFLHSNNVLNERGLMKKKGFPESYDMRNLVKFVADIKSGAEKVTAPVYSHLSYDIVPNEQLIIERPDILILEGLNVLQSGMDYPHEPHHVFVSDFVDFSIYVDASEELLEQWYINRFLKFRQGAFSDPDSYFHNYSKLTTEAAIKVASDIWLEINGLNLQQNILPTRERASLIMTKGANHAIESVRLRK

SEQ ID NO: 7754 - protein, 253 aa, Xenorhabdus bovienii
  Coding DNA sequence: Name=SeqID_1646
  Homolog annotation: Query=131..250bp; Hit=1..120bp; Blast score=212; Percent Identity=86.0; E value=5e-54; Homolog= gb|AAL79614.1|
VIAVCAVIAGANAWTDIEQYGQLKKDWLSSFLPLKEGIPSHDTFRRCFSLLNPSLFEHHFYQWVSRDLSSEKRAIIAIDGKSLRHSFDKKIDQSALHMVSAFTVEKGLSLCQCAVDGKSNEIKAIPALLSMLSLKGHLVTMDAMGCQRTIAQQLRESEADYILSLKGNQGKTFSEAVNYFQQQQITQKPYLKPDHDEFDDGHGRTVRRRGWVLPLTSETKHLRSWPDIQALLVTETIRQEHYSDTVTSDYLAS

SEQ ID NO: 7755 - protein, 300 aa, Xenorhabdus bovienii
  Coding DNA sequence: Name=SeqID_1647
  Gene classification: Function=Predicted transposase; Function class=L DNA replication, recombination and repair
  Homolog annotation: Query=123..274bp; Hit=20..169bp; Blast score=75; Percent Identity=30.0; E value=6e-14; Homolog= BH2520 COG3335
MIAQALRIHESTVSRHLKDYVSEEKLAPENGGSESRLSAEQTTELVEYLTANLMHTTAQIVACVWARWQVTFTVAGMTKWLHRQGFSYKKPMGTPHKSDAGKQQHFIETYNALKAECGQNAPILFIDAMHPTQSTKLSYGWMRRGREHVKVVETTGSRTRLNIMGALNLQRIEETIIREYPTINAKNVVLFFGSIRETYPLSQKIHLILDGAGYHRAEIVQFFAEVLNIELHYLPPYSPNLNPIERLWKYANEQVRNNIYFSEAKTFRETLHHFFHVTLPEKAKELTTREMQACRHAQQL

SEQ ID NO: 7756 - protein, 62 aa, Xenorhabdus bovienii
  Coding DNA sequence: Name=SeqID_1648
  Homolog annotation: Query=3..47bp; Hit=70..115bp; Blast score=84; Percent Identity=89.0; E value=3e-16; Homolog= ref|NP_667667.1|
VSGSALLSHGETPHYHRRYGVSLLSSAWDQVGPPRYGRQTNSVFNPEQAAVFHLKLRLSLTS

SEQ ID NO: 7757 - protein, 548 aa, Xenorhabdus bovienii
  Coding DNA sequence: Name=SeqID_1649
  Gene classification: Gene name=PutP; Function=1 Na+/proline, Na+/panthothenate symporters and related permeases; Function class=E Amino acid transport and metabolism
  Homolog annotation: Query=22..546bp; Hit=20..544bp; Blast score=765; Percent Identity=83.0; E value=0; Homolog= PA3234 COG0591
MKKIVLSAMLLFSTLFHNLAQADAISGNVEEQPLNIQAIVMFLLFVGFTLCITYWASKRTQSRSDYYTAGGRITGFQNGMAIAGDYMSAASFLGISALVYTSGYDGLIYSIGFLVGWPIILFLIAERLRNLGRYTFADVASYRLKQRPIRTLSATGSLVVVALYLIAQMVGAGKLIELLFGLNYHIAVILVGILMVLYVLFGGMLATTWVQIIKAILLLAGATFMALMVMKAVNFNFNTLFKEAIAVHSRGQAIMSPGGLVSDPISALSLGLALMFGTAGLPHIVMRFFTVSDAKEARKSVFYATGFIGYFYILTFIIGFGAILLVSPSPAFKDVTGALIGGTNMSAVHLADAVGGNFFLGFISAVAFATILAVVAGLTLAGASAVSHDLYANVIKQGQANERDELRVSKITVIILGFVAIGLGILFEKQNIAFMVGLAFSIAASCNFPIILLSMYWNKLTTRGALIGGWLGLITAVVLMILGPTIWVSILGHEKPIYPYEYPALFSMFVAFIGTWLFSITDGSQQGQQERKMFRNQFIRSQTGIGIE

SEQ ID NO: 7758 - protein, 103 aa, Xenorhabdus bovienii
  Coding DNA sequence: Name=SeqID_1650
  Gene classification: Function=Uncharacterized membrane protein; Function class=S Function unknown
  Homolog annotation: Query=1..102bp; Hit=1..102bp; Blast score=131; Percent Identity=65.0; E value=1e-31; Homolog= ZyjcH COG3162
MNPNIYQEIENNPRFKELVKKRGRFAWLLSTIMLVIYVSFIFLIAFSPEWLGTPLYEGSSMTRGIPVGVGIIFISFILTGIYVVRANGEFDRLTSTILNEVKK

SEQ ID NO: 7759 - protein, 32 aa, Xenorhabdus bovienii
  Coding DNA sequence: Name=SeqID_1651
MSSHGFLYPAFGCLQRIKVYRSKSKRRRSDES

SEQ ID NO: 7760 - protein, 651 aa, Xenorhabdus bovienii
  Coding DNA sequence: Name=SeqID_1652
  Gene classification: Gene name=Acs; Function=Acyl-coenzyme A synthetases/AMP-(fatty) acid ligases; Function class=I Lipid metabolism
  Homolog annotation: Query=1..648bp; Hit=1..648bp; Blast score=1137; Percent Identity=81.0; E value=0; Homolog= acs COG0365
MTQIIKHLIPADIAETALISKQQYLQDYQWSLQDPESFWGEKGKIVDWIKPYTRVKNTSFDPGHVSIRWFEDGTLNLSANCLDRHLQERGEQTAIIWEGDNPAESRHVTYRELYHDVCQFANVLKKLGVKKGDVVAIYMPMVPEAAVAMLACARVGAIHSVIFGGFSPDAIAGRVIDSNAKLVITADEGIRAGRVIPLKKNVDEALSNPAVTDVANVVVFKRTGNTKNWQEGRDLWWHELIENVSTDCPAEEMNAEDPLFILYTSGSTGKPKGVLHTTGGYLVYASLTFKYTFDYRPGEIYWCTADVGWVTGHSYLLYGPLSCGATSLMFEGVPNYPDVNRLCQVVDKHQVNILYTAPTAIRALMAEGDKAIEGTKRTSLRIMGSVGEPINPEAWEWYYRKIGNSQCPIVDTWWQTETGGFMITPLPGAVDLKPGSATLPFFGISPALVGNSGEPLTGECEGNLVITDSWPGQARTLYGDHERFEQTYFSTFKGMYFSGDGARRDEDGYYWITGRVDDVLNISGHRLGTAEIESALVSHPKIAEAAVVGIPHHIKGQAIYAYVTLNHGEEPSPDLYTEVRNWVRKEIGPIATPDILHWTDSLPKTRSGKIMRRILRKIASGDTSNLGDTSTLADPGVVEKLLEEKQSMNLS

SEQ ID NO: 7761 - protein, 208 aa, Xenorhabdus bovienii
  Coding DNA sequence: Name=SeqID_1653
  Gene classification: Gene name=SodA; Function=Superoxide dismutase; Function class=P Inorganic ion transport and metabolism
  Homolog annotation: Query=1..206bp; Hit=1..205bp; Blast score=335; Percent Identity=77.0; E value=2e-92; Homolog= ZsodA COG0605
MSYSLPALPYSYDALEPHFDKQTMEIHYTKHHQTYVTNTNTALEAFPELAKLPIDELIQQLDKIPADKRTFIRNNAGGHSNHSLFWKGLKLGTVLGGTLKTAIERDLGSIEIFKEKFEQAAATRFGSGWAWLVLKADGKLAVVSTANQDSPLMGEEIAGASGYPILGLDVWEHAYYLKYQNRRPDYIKAFWHVVDWDEAAKRYEEKIK

SEQ ID NO: 7762 - protein, 344 aa, Xenorhabdus bovienii
  Coding DNA sequence: Name=SeqID_1654
  Gene classification: Gene name=TrpS; Function=Tryptophanyl-tRNA synthetase; Function class=J Translation, ribosomal structure and biogenesis
  Homolog annotation: Query=13..342bp; Hit=3..332bp; Blast score=561; Percent Identity=78.0; E value=1e-160; Homolog= PM1621 COG0180
MNEPTVMKPNSQKPIVFSGAQPSGELTIGNYMGALRQWVKMQDEYDCIYCIVNQHAITVRQDPNELKKRTLDTLALYLACGIDPKKSTIFVQSHVPQHSQLSWVLNCYTYFGELGRMTQFKDKSASHAENINAGLFSYPVLMAADILLYQANQIPVGIDQKQHLELSRDLAQRFNAIYGDIFTVPEPFIPTGGAKVMSLQDPAKKMSKSDDNRNNVIALLEDPKSAAKKIKRAITDSEEPPRVRYDLENKPGVSNLLDILAGVTGKTIPQLEAEFEGQMYGHLKGAVAEAVSGMLTDLQERFHHFRNDEALLNQIMAEGAAKAQARAQATLDKVYEAVGFIAHP

SEQ ID NO: 7763 - protein, 234 aa, Xenorhabdus bovienii
  Coding DNA sequence: Name=SeqID_1655
  Gene classification: Gene name=Gph; Function=Predicted phosphatases; Function class=R General function prediction only
  Homolog annotation: Query=7..234bp; Hit=5..249bp; Blast score=263; Percent Identity=55.0; E value=2e-70; Homolog= gph COG0546
MVTSIKKNLRAIAFDLDGTLVDSASGLAEALDQALIAKGLPAAGKERVAIWIGNGADVMVERALKWAGVESTPELHCETRKLFDGFYETTVTTGSQLFPHVKETLATLAQHNLPMAIVTNKPTPFIAPLLESLGISEYFSLVLGGDDVKEKKPHPAPLYLTMGMFGIHKEELLFVGDSRNDILAAQAAGCPCVGLTYGYNYGESIALSHPDYILDHFPDLLPAIGLSTLKLQEA

SEQ ID NO: 7764 - protein, 224 aa, Xenorhabdus bovienii
  Coding DNA sequence: Name=SeqID_1656
  Gene classification: Gene name=Rpe; Function=Pentose-5-phosphate-3 -epimerase; Function class=G Carbohydrate transport and metabolism
  Homolog annotation: Query=3..224bp; Hit=2..223bp; Blast score=380; Percent Identity=86.0; E value=1e-106; Homolog= rpe COG0036
MKKDFLIAPSILSADFARLGEDTAKVLAAGADVVHFDVMDNHYVPNLTIGPMVCQALRDYGITAPIDVHLMVKPVDRIIPDFAKAGATYITFHPEASEHVDRTLQLIKEHGCKAGLVFNPATPLSYLDYVLDKLDVILLMSVNPGFSGQSFIPETLNKLRQVRKIIDDSGYDIRLEVDGGIKANNIREAAQAGADMFVAGSAIFSQPDYKTVIDEMRRELSKVA

SEQ ID NO: 7765 - protein, 272 aa, Xenorhabdus bovienii
  Coding DNA sequence: Name=SeqID_1657
  Gene classification: Gene name=Dam; Function=Site-specific DNA methylase; Function class=L DNA replication, recombination and repair
  Homolog annotation: Query=1..269bp; Hit=1..268bp; Blast score=371; Percent Identity=69.0; E value=1e-103; Homolog= dam COG0338
MKKKRAFLKWAGGKYPLVDDIRRHLPEGERLIEPFVGAGSVFLNTDYDSYILSDINSDLINLYDTVKSRPEEFINHARPLFSQEFNTAEDFYRLREEFNKSQEPLYRSLLFLYLNRHCYNGLCRYNSRGEFNVPFGRYKKPYFPEDELYWFAEKAQKASFVCQHYQITLDNAPQGSVIYCDPPYAPLSATANFTAYHTNSFNLLDQENLARMAYHLSSQQGIPVLISNHDTPMTREWYHQASLHIVKARRTISRNILARSKVDELLALYCRK

SEQ ID NO: 7766 - protein, 321 aa, Xenorhabdus bovienii
  Coding DNA sequence: Name=SeqID_1658
  Gene classification: Gene name=DamX; Function=Uncharacterized BCR; Function class=S Function unknown
  Homolog annotation: Query=3..320bp; Hit=66..428bp; Blast score=114; Percent Identity=34.0; E value=2e-25; Homolog= ZdamX COG3266
MDELKSENKQKTENEFKPDTSDRRPPRSRSQSNQPKLAVSRQQLMIGVGILVLLLLIIAISSALKSPTDHEKQQSQNTAEKNIDLSGSSSLSTNNQSSSPENPSAPASHGSQEISMPPISNTPSKDLSPTPEASSHNQRIELPGDISDALNQQQGNINDTVQKNLTPSQSNSMQQTVIPPVEQNKTEKVAPPKIEKTEKVAKSENHAKSTDKPAISHHQASKKGVTDTRGDLLKASANRFTLQLSSASRSDTLIAFAKNNNLSNYTVYEAKREGKAWFILIHGSYGSVSDAKSAISSLPAEVQAKKPWVRKLQQVQQDLKK

SEQ ID NO: 7767 - protein, 36 aa, Xenorhabdus bovienii
  Coding DNA sequence: Name=SeqID_1659
MSAIDQLNTRLSEYGKIPSENKSLNNESFSGCYAIK

SEQ ID NO: 7768 - protein, 365 aa, Xenorhabdus bovienii
  Coding DNA sequence: Name=SeqID_1660
  Gene classification: Gene name=AroB; Function=3-dehydroquinate synthetase; Function class=E Amino acid transport and metabolism
  Homolog annotation: Query=1..360bp; Hit=1..359bp; Blast score=516; Percent Identity=71.0; E value=1e-146; Homolog= aroB COG0337
MEQVTVTLGERSYPITIAQGLFSSDEAFKPLQAGQQVMIVTNETLAHLYLEQVKSTLQGMGLRVDEVILPDGEQYKSLFVVNDIFSALLENNHGRDTTLIALGGGIIGDMTGFAAACYQRGIRFIQVPTTLLSQVDSSVGGKTGVNHPLGKNMIGAFYQPASVIIDINCLKTLPAQELHAGLAEVIKYGIILDGEFFNWLESNIEKLLALDNQTMSYCIRRCCELKAWVVAADEQERNGMRALLNLGHTFGHAIEAEMGYGVWLHGQAVAAGMVMAARASELVGTFSRQDTQRIISLLERAKLPVNGPVEMSPEIYLPHMMRDKKVSAGKLHLVLPTAIGKAELRSDIGSDVILDAVRLCLPSTS

SEQ ID NO: 7769 - protein, 173 aa, Xenorhabdus bovienii
  Coding DNA sequence: Name=SeqID_1661
  Gene classification: Gene name=AroK; Function=Shikimate kinase; Function class=E Amino acid transport and metabolism
  Homolog annotation: Query=1..173bp; Hit=68..240bp; Blast score=297; Percent Identity=91.0; E value=3e-81; Homolog= ZaroK COG0703
MAEKRNIFLVGPMGAGKSTIGRQLAQQLNMEFYDSDQEIERRTGADVGWVFDVEGEEGFRDREEKIINELTEKQGIVLATGGGSVKSKETRNRLSARGVVVYLETTIEKQLARTQRDKKRPLLQVDAPAREVLENLADERNPLYEEIADLTIRTDEQSAKVVANQIIELLEKN

SEQ ID NO: 7770 - protein, 83 aa, Xenorhabdus bovienii
  Coding DNA sequence: Name=SeqID_1662
MGKLSQHINLYCNYIYLARTVVVWFMLCWLTVSLLYVYWGRLLLVMLDPLTQLDNPCMLNYSQRQIHKQVRPRKIVENLVKKT

SEQ ID NO: 7771 - protein, 361 aa, Xenorhabdus bovienii
  Coding DNA sequence: Name=SeqID_1663
  Gene classification: Gene name=GspD; Function=General secretory pathway protein D; Function class=N Cell motility and secretion
  Homolog annotation: Query=59..358bp; Hit=110..408bp; Blast score=256; Percent Identity=49.0; E value=2e-68; Homolog= hofQ COG1450
MNNHFFILLACLFLLLPTLSSAEEINAWKETESEIAVRNPFQPPKNELDEQLEFSPAERDEQEQEIEYQAITLQYADAGQIAEQLQKNIPALLTKWGKVEHDPLTNSLILEDKFDAITRIKGWLKEVDTPQQQVQITAHIVTSSREALHELGIHWGMAADPLNRSIGLNRLNLHQSAGNQSHRLVLNTARIHASLLEMELSALEQENQLDIIASPRLTASHQQPASIKQGSDIPYLVQDKDKTTIQFKEAVLGMEVTPHILRKGKIRLALKISQNAPGLPISQGGNENLAIDKQEIVTQVTVRNGETLILGGIFQQKKGASLQKVPYLSDLPLLGALFNQKGEQHSRRELVIFITPQLTDI

SEQ ID NO: 7772 - protein, 183 aa, Xenorhabdus bovienii
  Coding DNA sequence: Name=SeqID_1664
  Homolog annotation: Query=1..182bp; Hit=2..177bp; Blast score=112; Percent Identity=38.0; E value=2e-24; Homolog= ref|NP_927462.1|
MKSNYLVWFHRPAWQLFLLQQLLVIPLILSFYFWVWQENEYAIHDLQLNITEQKHNSALSEKRIAELPNLPDIRQQIQQLTAELSQGSNILPNNIPQKNATVLKRLHQPLTSSGSQLMEWKSHKEGNQIFWHIMLLLSYDQLLHFLNEIQQVQPVLLIKHLTIIPVDNDLTVRMVLSDALHEG

SEQ ID NO: 7773 - protein, 183 aa, Xenorhabdus bovienii
  Coding DNA sequence: Name=SeqID_1665
  Homolog annotation: Query=1..183bp; Hit=1..183bp; Blast score=129; Percent Identity=48.0; E value=3e-29; Homolog= ref|NP_927463.1|
MMYQVNFLPWRQARLKRLCREWGLLLCLQLMLCVSILTFISVQQKNKLAQYTNQLTEISHQLVQLQQNIKENEQAVQHHHQLTLQLRKKQTFMEQNQRYLQLFRQLPHLLPEKSWLTAFSDDTGQLVFAASSQNYDDVSDLLDNLTDNASLNNVQLKKMSTTEEHLKIFTIDANWLMGAPDEK

SEQ ID NO: 7774 - protein, 275 aa, Xenorhabdus bovienii
  Coding DNA sequence: Name=SeqID_1666
  Homolog annotation: Query=1..275bp; Hit=1..276bp; Blast score=307; Percent Identity=59.0; E value=1e-82; Homolog= ref|NP_927464.1|
MYLSKWYIGLDVHEHYINALAAIKRRDGWQLRHCWQYRLSSDIISGGRLQHPEKLGHILMQWRQKLPKKISLRLTLPVQQTLQKQIALPTHTLLQEPELGWFVHANAEKQFPVSDLALDYRVRGQQICISATRQKDLNLWLKLLADIDLSPDAIDISPCALRYIAKLAGVPDDGWLIHKRIADWLWVAPASGPFSYGLISMQAHPHLAQIISQLPVSPDIASPEIYYSDEQHAMPTEPVHVWNMLTAFRHYQLPLPEKTNAFIIAAGLALRPDDR

SEQ ID NO: 7775 - protein, 842 aa, Xenorhabdus bovienii
  Coding DNA sequence: Name=SeqID_1667
  Gene classification: Gene name=MrcA; Function=Membrane carboxypeptidase (penicillin-binding protein); Function class=M Cell envelope biogenesis, outer membrane
  Homolog annotation: Query=1..842bp; Hit=9..858bp; Blast score=1269; Percent Identity=72.0; E value=0; Homolog= ZmrcA COG0744
VKFIKYFLILVVVCILLGAASIFGLYKYIEPQLPDVATLKDVRLQTQMQVYSADGELMAQYGEKRRLPLTLSEMPPLMVKAFIATEDSRFYEHHGVDPIGVIRAVSVMMTSGHASQGASTITQQLARNFFLSREKTLIRKAKEAFLAIKIEQLLTKNEILELYLNKIYLGNRAYGVGAAANVYFGKNANELTLSEMAMIAGLPKAPSTFNPLYSYERAVGRRNVVLGRMLEEGYITQQQYNEARSEKLVARYHSPQIVFSAPYLTEMVRQEMINRYGENAYTDGYKIYTTITRKVQLAAVDAVRANVIDYDVRHGYRGAQEVLWTVSQSAWSQGQIVDKLKTLPKYGPLLPAVVTKSSATQAEAMLVDGSKVELTMAGVRWARQFKSDSLQGAAPRSVNEVIRAGEQIWVRKVNDTWWLAQLPQVNAALVSLNPMNGEVEALVGGFDFELSKFNRVTQSLRQVGSNIKPFLYTAAMDKGLTLASMFNDVPISRWDAGAGTDWRPKNSPPTYDGPIRLRQGLGQSKNVVMVRAMRAMGVDYAADYLRRFGLPGENVVRTESMALGSPSFTPMQMVRGYAVMANGGYLVDPYFITKIENDEGKVLFEAKPKLACPQCENIPVIYGDTARSIELSEDSIENVTHSNVTQNSTQPQSELERAPVNTNNDDQQYAPHVISTPLAFLIHDALNTNVFGEPGWMATGWRSARDLKRRDIGGKTGTTNSSKDAWFSGYGPDMVATVWIGFDEHSRALGRTPALKGEGGAKSAQPIWNDFMKVALEGVPVKVMEPPAGIVSVTIDRATGKLSNGGGNTRKEYFIEGTQPTEYAVPEAGTTVTENGESQELF

SEQ ID NO: 7776 - protein, 1531 aa, Xenorhabdus bovienii
  Coding DNA sequence: Name=SeqID_1668
  Homolog annotation: Query=29..1514bp; Hit=910..2375bp; Blast score =480; Percent Identity=28.0; E value=1e-133; Homolog= ref|NP_065276.1|
MRVKVLAEKSDISAQPLLDVAKLSNQSDYDHWQQVSSALFAACTQEEQTKLEGSLNELWRDALIEYLLGQWAPSDDNLSDITTVEDLSNYFLTDLQVATEVSTSRVAFAIASLQRYLFRLFSRLETGYGVQTISDERIEHWNRNLSQYGHWQAWQKQRNFPENFIDPARRLRKTRAFADLENDLGQSRLNNNMIQTAILRYLTEFERISNLQLVSGYIDGTDPENDYYHFIGKNNAKPVEYYWRTLDIKMRDDNDRISPLAWSEWEKITLSLSGTLLALRPIVISGRQYTIWVEREASPLMSADQKPSDYRAINVKFTYKQSNGEWSAPNTLFRLDGTDSKGEYPTKDGKRVPDNENPYLKDEKYKPGLIAMVDIQREGDPWMGVLLYDTTKTDSSVWKKNQDYFLELRDLLLVDKKALNNQDENTLISSWYKIFKNSDTLQHHYVGTEKFIEYKASEDNKNLILKLDAKLSGDKTKLILTGTNTLIKRNPKGYGTKFKIFNNIEFLSKLPTEDFDGTIKVDNSDKESIKIHIPASQTSLKTFHLTWQGDQAPTSTFTVSYGSIILFTVSPNEWKDNTVTKLAELNWLNGIVSQRSETWKPDTSALVVTTKNKGSRGRRTFDVLYNWEYTKSKLTLTLDTPSGTAPTIKEVILNGSATTEEITIPIRANIDEYSFTLSATLETEYSGANQPLDYTGTVSNKYQIIVRESDRIPVITLSRNTKQAQYLDITSLGFRSTAIRLNTLFGKQLVARATQSIEQVLSWDTQSLLEPTLDDSTSSTPIDFSGANGIYFWELFFHLPFLVTYRLSEEQRFYDARRWLLNYLFDPYGSMRMWNSRPIIENGSNLPPSVKEDDSDTIAYSLPVYYQKTLFHFQITLWIQEGDNLYRQLTRDSLNEASLCYQQALQLLGTLPEGLDVTLEQIKADFEPDVRVVDGRPFVSPFNNQLIEYQKTLNSRLYNLRHGLTLDGKVLTLPLYAGADDDNLLIQRHTGSSISQWNNLRQQVPPYRFPAMLKRANDAVKQLIQMGHRLFSAIESEVNAEQEVLEQSQALRLSAFAIELQQEAVQIAQLGKSTLEESKKMAQERYDHYHNLYEENLSALEISALTIKTSSEVVKATAAPFYAAGAALDVVPNIFGLAVGGGKYSAPIRNAAIISELVSEGLSLIADRLQDSADYERRRQEWEIEYKQAQSEINIIDRQLQEQEVLIKSANTALREAHAQQTAARELYEFMTTGFLVVPTYQWLMGRLAALYAPAYDAVLSLCLMAETSWRYEVGDYQRRSFIKTTAWNASYRGLLAGESLQLDLLQMENAWLQRNERRMNIKKTISLSELLTAHELQNQIEKKQVVSFTLNPKLFDTNYPGHYLRQIKRISVSISLSTLSVTPILSPEISAVLTQTGSSTLTSADIEGINWLYDPSRKAGNNKNIVTNLRAQQQIALSSLSEDDGSVAKENWLYTLMFDDDRYLPFEGTGAISTWTLAFPDKQVINKIFRDPLLPLASWRLKDINIHVHYTAVDGGKQFTKAVKDKVGNK

SEQ ID NO: 7777 - protein, 938 aa, Xenorhabdus bovienii
  Coding DNA sequence: Name=SeqID_1669
  Homolog annotation: Query=5..809bp; Hit=107..893bp; Blast score=307; Percent Identity=28.0; E value=5e-82; Homolog= ref|NP_928150.1|
MANILESRTSYKTLFNDNQDLYCLPGLPETNDGPLAYLVDLYQQTRLFESEADKDSVRFLSQRRPDIETLLLDSTNLNKTSSLLPLIIEALAQKVKAHINKNQPLTNSLAEIHYPLALPFHFPLKQTIAVLAEKELPLFELIQQADRQYPNFIDNNLSSDSLQTAMMVSSSLAPKLQTLLQEKSQSDQKDFFAKYYGVKGDAAEAALSLSRLTVFTQQTNLSSQEAERLFAINGLSDNKITHSIVTYSSNVAKPTNAGKQFPSGANYAASFINAGTEPAIYLAKTVDPKTAKDVVLLKEISNDNFDRIQRFLHIQKALKLTSEQLDLLLVTARQAEKQQDFAITEATLRALGVFLHFQQEYSTTAEQFAAFIGQITPYSLENKLSFFDRLFNASGLSQQAASSSVLVLDNQEFDPSTIEGLDALTVNQLCAGLKIDDATCQILLSLIMQAQTLTKPKRSLDVVSALYRLVELPRLLKLPVKEGLGLLLLLNNDNPNYLQQLAGVPVLSKNAEDIDILDVMVRVMNAAQWIKRHELSTLSLNLLLTPYQPDANGVTSEDIENIDWLKKVISILPDQQYALLSEDKIAAAMMGFQAKQIPVNWMKSFSELVDENMGIIQGDLVSADNSAEKALSEKVGKILQELAEEEAWKAQGDTWTQILTVLIRDAFIAQQDLVIKAISHAFNLDETLSLPLLLWTGNNQATFLRDSISLATPAGDPQLKAKAVATWYDLNRYTAIVKSFKLTAKTIQALIGNPDWFGLHLPDDKLRDLDLTFLHRLSRYGDWLDLLANHKTEDDVLYYLSQANQIGQTPPLDNIWTTEVGRAKKSNRSQMASSITWHKMLSASARLCASKYWPRKVTSLPSPCWMLPSYRTNPTMITGNKSAAHCLPPAHRKNKPNWKVLSMNCGVMPLLSICWDNGRHRMIIYPISPPLKTYQITS

SEQ ID NO: 7778 - protein, 46 aa, Xenorhabdus bovienii
  Coding DNA sequence: Name=SeqID_1670
MFFGRLVGLHYGLSMIAIQPKIYFGSDRFLKKHLISIGWIKCFINQ

SEQ ID NO: 7779 - protein, 53 aa, Xenorhabdus bovienii
  Coding DNA sequence: Name=SeqID_1671
MERVKTYPNRQVCAFKFLLLLAAFTPQSHGYLYAWEFTHLSSRYNLKSICDKK

SEQ ID NO: 7780 - protein, 187 aa, Xenorhabdus bovienii
  Coding DNA sequence: Name=SeqID_1672
  Gene classification: Gene name=MutT; Function=NTP pyrophosphohydrolases including oxidative damage repair enzymes; Function class=L DNA replication, recombination and repair
  Homolog annotation: Query=5..180bp; Hit=6..181bp; Blast score=260; Percent Identity=72.0; E value=6e-70; Homolog= ZyrfE COG0494
MIDQKKPKILNINDVAHSRLFNIQSVNLEFSNGVKRLYERMKPSNREAVLIIPVIGDELLLIREYAVGIEQYELGFPKGAIDAGESPLEAANRELKEEVGFGAAKLELLTKLTMAPSYFSSRMNIVIAQDLYPERLEGDEPEPLVQVRWPIADMMSLLEHPDFNEARNVSALFFAQRYLQASSNGTR

SEQ ID NO: 7781 - protein, 64 aa, Xenorhabdus bovienii
  Coding DNA sequence: Name=SeqID_1673
MHPITERLLVNSIFVMKLDTHPNFALIWPIMPVNDSDYRLYVFLLLSCCCIKGFILRNGVIKFI

SEQ ID NO: 7782 - protein, 38 aa, Xenorhabdus bovienii
  Coding DNA sequence: Name=SeqID_1674
LLIKLKIEGKNRNSLNLRILLGCYSASLFIAVMGVEKK

SEQ ID NO: 7783 - protein, 702 aa, Xenorhabdus bovienii
  Coding DNA sequence: Name=SeqID_1675
  Homolog annotation: Query=1..700bp; Hit=1..706bp; Blast score=793; Percent Identity=57.0; E value=0; Homolog= ref|NP_927467.1|
MSSLVIILAIFITSLIIMASFLTFRWKRPDNARYLPSIAKTAHRKLNTDEYQAIDSYLQNVLPLMQPDRSHRSGQPALPVKNDTVYTINHTINRFSAATDESQHWRYYVDEIEIHLPALLESFIKQQNTIEIVQTTSMPLVIAVNGHFLKDYQQDLSIAPIVKQTAQASIQKNGNSSANFLYIRKETPEENRLRHSTGILEGILMCIGLSFWFLALFMPTPILPWLMLAAVLFLIASFWPIFRPSSSRNLLNISCFSGIPKRWGIFSESEPEQRRNISLGGIDLLYPSHWEPYVVHELDRNTEVDIYTNCHVVRQGRYLSLHEEEKHYPYQRHRKNLILVVFSIFALLVLYFYQPVSLSMRLSFAWLHGSNTQVITSVTELQNMPLKEGDVLRVKGIGMCYTPPRLNDNPSGIKHIFAAFDCTGIYWNNDSPLPMPESDIIENASTLITTVNEQLHPIERSRKTNPGLNEAIAKSGMTLLDNFSQVILKTHNLCMDEIDCIRLKSALVNLSNAEDWDDLLKQAERGKLNGTKVLLRSVSADALEKLVNTTTASFIYREIDKISMLLNSPSPGGVLLISEEGNQLVELPYSSFLAYEYSALDQWRELQRLADILLSAPFEAVGIVTKLSEDANGTRRITLHSEPDSVTLIRYLGSSFFLAILMAILSINAILMISKRQRNKVRLQRIGQYYDNCFNSKQPPMD

SEQ ID NO: 7784 - protein, 161 aa, Xenorhabdus bovienii
  Coding DNA sequence: Name=SeqID_1676
  Gene classification: Function=Ribosome-associated heat shock protein implicated in the recycling of the 50S subunit (S4 paralog); Function class=J Translation, ribosomal structure and biogenesis
  Homolog annotation: Query=29..154bp; Hit=9..134bp; Blast score=167; Percent Identity=71.0; E value=3e-42; Homolog= PM1546 COG1188
MSLRAVLPSIRFLPASIRHLGETTMPNSDTDQTVRLDKWLWAARFYKTRSIAREMIDGGKVHYNGQRSKPSKLVELNAEIKLRQGNEEKIVTVLALNSHRRSATEAQQLYQETEKSIINREKTALARKMNVLTMPHPDRRPDKKERRTLIKFKNTKLNESE

SEQ ID NO: 7785 - protein, 290 aa, Xenorhabdus bovienii
  Coding DNA sequence: Name=SeqID_1677
  Gene classification: Function=Disulfide bond chaperones of the HSP33 family; Function class=O Posttranslational modification, protein turnover, chaperones
  Homolog annotation: Query=1..282bp; Hit=3..283bp; Blast score=389; Percent Identity=66.0; E value=1e-108; Homolog= yrfI COG1281
MTKHDQLHRFLFESHSVRGELVSVSETYQRMMEKHHYPLPVQQLLGELLVATSLLTATLKFNGDITVQIQGDGPVRLAVINGNNQQQMRGTARIDGDVDAASSLRDMVGNGYMVITVTPTEGERYQGVVALEGETLAECLDAYFKQSEQLPTRLFIRTGMLDGKMAAGGMLLQILPGAQEGSEDLLDHLVQLTATIKGEELFTLDVKEILHRLYHEEDVTLYEPQQVEFRCTCSHQRCADTLVTLPDADLQEILLKDGKIDMECEFCGMHYIFNDKDISEIKIVKKESLH

SEQ ID NO: 7786 - protein, 539 aa, Xenorhabdus bovienii
  Coding DNA sequence: Name=SeqID_1678
  Gene classification: Gene name=PckA; Function=Phosphoenolpyruvate carboxykinase (ATP); Function class=C Energy production and conversion
  Homolog annotation: Query=5..539bp; Hit=6..540bp; Blast score=973; Percent Identity=86.0; E value=0; Homolog= pckA COG1866
MSVKGITAQELAVYGICDVSEIVYNPSYELLFSEETQPSLQGYERGTLTHLGAVAVDTGIFTGRSPKDKYIVRDDVTCDTVWWADQGKGKNDNKPLSQETWSQLKGLVTQQLSGKRLFVVDAFCGANADTRLKVRFITEVAWQAHFVKNMFIRPSDEELVNFTPDFIVMNGAKCTNPQWKEQGLNSENFVAFNLTERMQLIGGTWYGGEMKKGMFSMMNYLLPLKGIASMHCSANVGEEGDVAIFFGLSGTGKTTLSTDPKRKLIGDDEHGWDDDGVFNFEGGCYAKTINLSKEAEPDIYHAICRDALLENVTVLADGTVDFNDGSKTENTRVSYPIYHIENIVKPVSKAGHATKVIFLTADAFGVLPPVSRLTPEQTQYHFLSGFTAKLAGTERGVTEPTPTFSACFGAAFLSLHPTQYAEVLVKRMQASGAKAYLVNTGWNGTGKRISIKDTRAIIDAILNGDIEDVDTIELPIFDLAVPTALPGVDTGILDPRNTYADKSEWDVKAKDLAQRFVDNFDKYTDTAAGAALVKAGPNL

SEQ ID NO: 7787 - protein, 231 aa, Xenorhabdus bovienii
  Coding DNA sequence: Name=SeqID_1679
  Gene classification: Function=Pirin-related protein; Function class=R General function prediction only
  Homolog annotation: Query=1..230bp; Hit=1..230bp; Blast score=359; Percent Identity=73.0; E value=1e-99; Homolog= yhhW COG1741
MIYLRKASERGHANHGWLDSWHTFSFADYYDANFIGFSALRVINEDVIDAGQGFGMHPHKDMEILTYVLSGTVEHRDSMGNQGQISAGEFQIMSAGTGIRHSEYNPHDSNKLHLYQIWIMPEKNDLSPRYEQRCFDSAKGRQLILSPDTRDDSLKVFQDMTLWRWALKNGETDEYNIEKSRKIWIQVVRGEVTINGVQATTSDGIAIWDEFHLQLIASQESEILLFDLPPN

SEQ ID NO: 7788 - protein, 38 aa, Xenorhabdus bovienii
  Coding DNA sequence: Name=SeqID_1680
MIININRISKEMKGKNEAITLPTIPCKDRLFSHTSKFG

SEQ ID NO: 7789 - protein, 44 aa, Xenorhabdus bovienii
  Coding DNA sequence: Name=SeqID_1681
VISLQAICGLTHKRSYLDIFMVTVLAGLLGLVVVIILGSLFGSF

SEQ ID NO: 7790 - protein, 385 aa, Xenorhabdus bovienii
  Coding DNA sequence: Name=SeqID_1682
  Gene classification: Gene name=EutG; Function=Alcohol dehydrogenase IV; Function class=C Energy production and conversion
  Homolog annotation: Query=2..380bp; Hit=4..379bp; Blast score=230; Percent Identity=38.0; E value=2e-60; Homolog= yiaY COG1454
MSTIVLPRIMEVGGGAITRLPQVLQSIRSKKPLIVTDKVMVQLGYLDKLQSILQDAGIESDVYTDTVPEPTAASIQAGIKKMKSDRFDAVIALGGGSAIDSAKAIAVMGKFGGTVNEYRFPRQFNEPGLPIIAIPTTAGTGSECTRVTIITDEKTDEKLLCIGAGFMPIAAIIDYELTISVPARTTADTGIDAMTHAIEAYVSQKANPYSDSQAIAAMKLIGPNLRKVYHDGNNKVAREAMILGSTLAGIAFSNASVALVHGMSRPIGAFFHVPHGLSNAMLLPAVTRFSLDAAKERYAECARALTFAKPTDSDNVACEKLLTTLVDLNEALFVPTPEQFGIDKTCFFAVVETMAKQAEASGSPSNNPRVPTIAEMVTIYKQLWN

SEQ ID NO: 7791 - protein, 496 aa, Xenorhabdus bovienii
  Coding DNA sequence: Name=SeqID_1683
  Gene classification: Gene name=PutA; Function=NAD-dependent aldehyde dehydrogenases; Function class=C Energy production and conversion
  Homolog annotation: Query=1..496bp; Hit=1..496bp; Blast score=685; Percent Identity=63.0; E value=0; Homolog= PA0130 COG1012
MSIVGHFINGKVTDIHSRLQDIYNPATGEVSRQVAIASKATAEEAIAAAQAAFPEWRDTPPIKRARIMFRYKQLLEEHADEICRLIGQEHGKIIHDAAGELQRGIENVEYACGAPEILKGEFSKNVGPGINSWSDFQPLGVVAGITPFNFPAMVPLWMYPLALVCGNTFVLKPSERDPSAPLYIGQLLKKAGLPDGVFNIVNGDKEVVDTLLTDKRVKAVSFVGSTPVARYIYTTATANGKRCQALGGAKNHAIVMPDADMENVVNSLLGAAFGSSGERCMALSVAVAIGDEIADQLVTQLQERMKSLTIGVHSDKNNDFGPVITREHQQKVCGYITSAEQQGAKILVDGRNMKVSGYENGFFVGATLIDDVTTDMDSYKAEIFGPVLQVVRVKTMQEAMDIIDEHEYGNGTCIYTRDGEAANYFADRIQVGMVGINIPLPVPVSYHSFGGWKNSLFGDLYAYGPDGVRFYTRRKTITQRWPSANLREGAEFSMPT

SEQ ID NO: 7792 - protein, 35 aa, Xenorhabdus bovienii
  Coding DNA sequence: Name=SeqID_1684
  Homolog annotation: Query=5..35bp; Hit=1..31bp; Blast score=62; Percent Identity=90.0; E value=1e-09; Homolog= ref|NP_927757.1|
MELCMSYMIYLTLNGKKQGLISAGCSTLDSIGNRY

SEQ ID NO: 7793 - protein, 86 aa, Xenorhabdus bovienii
  Coding DNA sequence: Name=SeqID_1685
  Gene classification: Gene name=Hcp; Function=Hemolysin-coregulated protein (uncharacterized); Function class=R General function prediction only
  Homolog annotation: Query=2..85bp; Hit=75..158bp; Blast score=85; Percent Identity=50.0; E value=7e-18; Homolog= Z0248 COG3157
MAIDSNESLNGGFIFYRTSQIGQLELFYEVKITEATITDISCVYPHSINDHDIMPYEKVTLNYKSISWNHVTAGTSAYSIWEDRIL

SEQ ID NO: 7794 - protein, 89 aa, Xenorhabdus bovienii
  Coding DNA sequence: Name=SeqID_1686
MEDVCSIVFLSFDILFLHFYFLLFVFLKLPKHNNSIFKFLTFFGILGFVISLPVYWYGDFKLKENGYITCYKKSLNAPKKYVKNKKLCD

SEQ ID NO: 7795 - protein, 244 aa, Xenorhabdus bovienii
  Coding DNA sequence: Name=SeqID_1687
  Homolog annotation: Query=4..221bp; Hit=36..252bp; Blast score=141; Percent Identity=35.0; E value=8e-33; Homolog= ref|NP_927759.1|
MKIFMFFLTFEEAIYFVTNICEPNPNLSWKDNLFSVADVVTTYAGNILDGYAFMRLANELSSNFGVRVTEYVNRYGNRMIKLTGNTGVRSFLTATKYRVDHWKVIDIGIGTQAMRSGIITASRRVLIVSFLYRSMELLFRDEYDIYDFFGNITMDVAKTAVGALVGFGVVAGAAIFFEGGAFALGVAIVALGFGAFTTWVLYELDDRYKISKKLINYMREKELAEADKLDYRKQPFGYPYPRIK

SEQ ID NO: 7796 - protein, 68 aa, Xenorhabdus bovienii
  Coding DNA sequence: Name=SeqID_1688
MLCNFMGCQMSRSEFERAFMDGSIGFENGTLVPLSDSKLIREKRYSELQNEFQKKLNDNEDLYVFFNV

SEQ ID NO: 7797 - protein, 77 aa, Xenorhabdus bovienii
  Coding DNA sequence: Name=SeqID_1689
MTLRFKFLDQPISVGYGVEVSVHIFTEEKVGTDTSNNPYRQHCPANHPPKVALKPVITPLEIVLKLPPISSKRGSFF

SEQ ID NO: 7798 - protein, 65 aa, Xenorhabdus bovienii
  Coding DNA sequence: Name=SeqID_1690
MRNTGIMLNMSLVTAFCIYKNVFYGVTMELEFEWDPAKAETNYRKHGIRFEEAALVFDDPFHWSM

SEQ ID NO: 7799 - protein, 57 aa, Xenorhabdus bovienii
  Coding DNA sequence: Name=SeqID_1691
MLITFPLIPFRFSGADNTNNLSPIFKLCRVSDQNNHTSFHSSNRLPAVFAIFKTILH

SEQ ID NO: 7800 - protein, 121 aa, Xenorhabdus bovienii
  Coding DNA sequence: Name=SeqID_1692
  Gene classification: Function=Uncharacterized BCR; Function class=S Function unknown
  Homolog annotation: Query=33..111bp; Hit=11..86bp; Blast score=58; Percent Identity=41.0; E value=9e-10; Homolog= XF0532 COG3514
MGLRLFVLSAPEKRNGMRGNVMSIVRYKRSDLPPLTENRESELKALSGKPDSNIDYSDIAPLNEAFWKNATQGQFYRPVKTQASVRIDADVLAWLKEAGKGYQTRLNAILREAMMRDLHRK

SEQ ID NO: 7801 - protein, 34 aa, Xenorhabdus bovienii
  Coding DNA sequence: Name=SeqID_1693
MPGMKKGTAHLNGVNVLKIPFRERLPKSPIWRAV

SEQ ID NO: 7802 - protein, 36 aa, Xenorhabdus bovienii
  Coding DNA sequence: Name=SeqID_1694
MFPVFCRLSPVNDDNGDRLSPCLELLPSSVSSPEQD

SEQ ID NO: 7803 - protein, 131 aa, Xenorhabdus bovienii
  Coding DNA sequence: Name=SeqID_1695
  Homolog annotation: Query=21..126bp; Hit=26..131bp; Blast score=68; Percent Identity=33.0; E value=1e-11; Homolog= gb|AAC38631.1|
MIIPRLLYFIFFIFFLFGCIQRESQDFLMFKVSDTEFFHLKPQCVNDVIYAGEDEVGNDYIDIHVKKNEYCLGKLDQLLRSNIGAVLTIYFSERKIVSATIQSAIGEKFRITVPDRLTGIRIRDSLLGVRF

SEQ ID NO: 7804 - protein, 94 aa, Xenorhabdus bovienii
  Coding DNA sequence: Name=SeqID_1696
MPSRQVYAPPGFFGPWIDLQGWGGGPHTIRYSFDTNSQAPSTFSVEINYIDEPTSKTIQTLGPGEYLVVSKGGAGIDRIRCRSHSAGQNVIVSW

SEQ ID NO: 7805 - protein, 52 aa, Xenorhabdus bovienii
  Coding DNA sequence: Name=SeqID_1697
VRVPFGVPIYSLTNQLRVHEKYNGIELMRDSQIASVWHQNRSKNGKHCQISI

SEQ ID NO: 7806 - protein, 56 aa, Xenorhabdus bovienii
  Coding DNA sequence: Name=SeqID_1698
VYTKLIRQGVNRNPKGDPHDLLLDDTPTNTLVKGVVNTKWAQHLSPMTKRTNVPGA

SEQ ID NO: 7807 - protein, 100 aa, Xenorhabdus bovienii
  Coding DNA sequence: Name=SeqID_1699
  Gene classification: Gene name=XynA (BS); Function=Predicted membrane protein; Function class=S Function unknown
  Homolog annotation: Query=32..99bp; Hit=1..68bp; Blast score=66; Percent Identity=58.0; E value=5e-12; Homolog= BS_xynAa COG2314
MSNMVYCRGCGKEIHTSASSCPSCGAVQKEEITGEKSRITAALLAFFLGFIGVHKFYLGKIGTGFLYLIFCWTFIPYVISFIEFIIYLCMSDKDFAKKYG

SEQ ID NO: 7808 - protein, 57 aa, Xenorhabdus bovienii
  Coding DNA sequence: Name=SeqID_1700
MIFGCSDIWGRANSFTMNRHLMESSHCQNIHDKPCWMENGNYCTFRAFFNRSRHATD

SEQ ID NO: 7809 - protein, 61 aa, Xenorhabdus bovienii
  Coding DNA sequence: Name=SeqID_1701
MSFTVRFFLFKHQSSKNRSKSFSGLFRGALGDRKSEYVKPVFCNLNTIRRVRQLISYIHFC

SEQ ID NO: 7810 - protein, 512 aa, Xenorhabdus bovienii
  Coding DNA sequence: Name=SeqID_1702
  Gene classification: Gene name=PutA; Function=NAD-dependent aldehyde dehydrogenases; Function class=C Energy production and conversion
  Homolog annotation: Query=43..508bp; Hit=4..471bp; Blast score=432; Percent Identity=47.0; E value=1e-121; Homolog= ydcW COG1012
MISLFYIFATSLTKMQLLNILNHRLYLMHSIHRRVIMPVPTLKHFINGQYIESKGSEYFDLVSPVTGESYARSPNATVADVDDAYASAKEAFKIWGRSTPSARQQALLALADTVEKNAERLIESQSRNTGQLKHLIASEEIATSVDHIRFFAGAARFLEGKATAEYLSDMTSSIRREPLGVVGQVTPWNYPLMMAVWKIAPALAAGNTVVLKPSDTTPESTLLLAELSAPFFPAGTFNVVLGNASAGSLVVSHKTPAMVSITGSVRAGLQVASSAAANLTRAHLELGGKAPVVIFADADVDKAVEIIVTAGYFNAGQDCTAASRVLVHESVYDIFVTKLVAAAKATRFGDPEDKEALYGPLNNVRQLEQVTGFLARLPAHARIETGGRQADRSGYYFEPTVITGLEQEDEMIQTEIFGPVITVQKFLTEQDAIEKANDVKYGLASSVWTRDHGRALRLSRELDFGTVWINTHIPLTAEAPHGGFKNSGYGKDLSAYGFDEYTRIKHVMSSND

SEQ ID NO: 7811 - protein, 260 aa, Xenorhabdus bovienii
  Coding DNA sequence: Name=SeqID_1703
  Homolog annotation: Query=4..260bp; Hit=1..257bp; Blast score=454; Percent Identity=89.0; E value=1e-127; Homolog= ref|NP_929594.1|
MPIMDQNRSSRDLVSRAHHELFTDRDVGALERYFAPNFIEHSPLVKKGLAGLRERVQAHPELHHEMYRVLQDGDLVAIHGRFTGLDEQPLVGFDLYRVADGLIVEHWDGLVPQSAPNASGRTQLDGPTETGYSHDREKNRELVVNFFTRTLIEGHYDEFRNYTNGEEFRQHSPDIPDGTAAVIAFLKQLKDEGQGLHYAKIHHTVADGQFVLSHSEGSIAGARHSYFELWRIENGKVAELWDAITPVPEDAQALHRHGIF

SEQ ID NO: 7812 - protein, 240 aa, Xenorhabdus bovienii
  Coding DNA sequence: Name=SeqID_1704
  Gene classification: Gene name=FadR; Function=Transcriptional regulators; Function class=K Transcription
  Homolog annotation: Query=5..137bp; Hit=2..133bp; Blast score=62; Percent Identity=31.0; E value=5e-10; Homolog= mll6911 COG2186
MTEYSIIYAPLDQATRTEQVVERLSNAIISGILQTDEQLPNENELSRLLGVSPVTVRDALNTLRARQLIDTRRGRHGGSFVCQVPVEAMRKYHPLRLMASGELADFSEFHCAVIGHSARLAAQRSTPGELRKLGQLIDSFAAATQPDARIQTDMRCLLTLASQSQSARLANQELEIQAEWTPLMGLLYREVAVHSEVTAAWRTLLAALYKGDDLACYQLAQKMITQITDHLLECKILAEI

SEQ ID NO: 7813 - protein, 250 aa, Xenorhabdus bovienii
  Coding DNA sequence: Name=SeqID_1705
  Homolog annotation: Query=9..217bp; Hit=44..242bp; Blast score=76; Percent Identity=28.0; E value=3e-13; Homolog= ref|NP_822299.1|
MYNDIHVERARSILDDILVTAQQATAALADKTARILLALPLYHTAGVRLAREQRGALQKHIHDVLRNNAWCNGAGFASYAVPKTVEEEGGYWTLEWWRQEGDTIQYAPLEHNQEQRRRLDFRLFEWFRQPANCHLPVIDGPYVDYVCNGAYTITIAHPVLIGGEFVGVAAVDMLVSTLDRLLLPALGAIGKPALIINDDARVVTSTVPGVRSGSLLKSQSVNRSADGEVPSLRLVILPSSHTESHRAFVC

SEQ ID NO: 7814 - protein, 427 aa, Xenorhabdus bovienii
  Coding DNA sequence: Name=SeqID_1706
  Gene classification: Gene name=ArgD; Function=PLP-dependent aminotransferases; Function class=E Amino acid transport and metabolism
  Homolog annotation: Query=1..422bp; Hit=5..426bp; Blast score=567; Percent Identity=66.0; E value=1e-162; Homolog= mlr5521 COG0160
MTESMLAKRRSAAIAKGVGVTTQVYVERAENAEIWDVQGQRYIDFAAGIAVVNTGHRHPRVIAAAREQLEQFTHTCHQVVPYENYVALAERLNRLVPGNFVKKTVFVTTGAEAVENAVKIARAATGRSGVVAFSGAFHGRTFLGMSLTGKVVPYKMGFGPLVSNVYRIPFPIELHGTSVEQTLNALDNLFKTDIEPTRVAAIIIEPIQGEGGFYPAPPELLKSLREIADRYGIVLIADEIQTGFARTGKLFAMEYHEVAADLTTMAKGLAGGFPLAAVTGRAELMDAVVQGGLGGTYGGNPVAIAASHAVLDVIEEEKLAARATQLGERLKQCLHELRPRVPQIADVRGLGLMIAVEFNRADSQEPDAGFTNAVRQKALERGLILLTCGIHGNVIRFLPPLTIQNDVFDEALNVLESVLLDLNRTAV

SEQ ID NO: 7815 - protein, 132 aa, Xenorhabdus bovienii
  Coding DNA sequence: Name=SeqID_1707
  Gene classification: Function=Uncharacterized membrane protein; Function class=S Function unknown
  Homolog annotation: Query=1..114bp; Hit=1..113bp; Blast score=92; Percent Identity=43.0; E value=1e-19; Homolog= yhaH COG3152
MHWYLNVLKNYACFRGRAQRKAFWYFVLFQILAVLIISFLERLFAVANPEIYMGWFSAIYLLLTFLPALAVNARRLHDINCSAWWLLLHLIPFVGTVILLILAALKGQAGSNKYSSGNRIHSQGNPPSQANG

SEQ ID NO: 7816 - protein, 513 aa, Xenorhabdus bovienii
  Coding DNA sequence: Name=SeqID_1708
  Gene classification: Gene name=DadA; Function=Glycine/D-amino acid oxidases (deaminating); Function class=E Amino acid transport and metabolism
  Homolog annotation: Query=102..488bp; Hit=30..412bp; Blast score=190; Percent Identity=33.0; E value=3e-48; Homolog= PA0534 COG0665
MAMNRRDFISTAAILAGAGALSSLLPTTPLLARTLTAADASAVNIDQLRPMLLQDAQYRTSRLGLDPRIWNWHRDVAAIAMPANYYEASLADWPAFGSFPRDQNCEVVVVGGGLLGASTALHLAEAGVDVILVEKDNIGSGASGRNGGQMTPGIARWEAETMLEKFSPDEAKRLWRFASVEAMNLVDELRERYGFECDRKYGHITAAIHPGHMGPLVANADARRQLGDTAVKVIGPHELREEYVRSNIYHGANIDSIGGQVQPLALLRGLIYGFARLGGRVYDSTKVKGIRQDASSAVIETERGVIRASKAVVLGVHGSTEEFISGPSTTVPFFTYVAVTPPLSVDIKELIPSGLPVYDTQLQIDYYREVRDNRLLFGGQGTGNSWSSRDVNNYLLDRIRTVFPHLEKPELEYSWGGISDLTLNGATDARKSGDSVPVYMVHGWSGHGVAQTVRIGKAISDDLTERNHDFAMLTRIEHSSIPLGSHFSPVAIPLIKGALGVINTVNPADMVSF

SEQ ID NO: 7817 - protein, 37 aa, Xenorhabdus bovienii
  Coding DNA sequence: Name=SeqID_1709
MVNTVCYFPAGSAQSISSSETDIYCLCTEPSKLSIYE

SEQ ID NO: 7818 - protein, 40 aa, Xenorhabdus bovienii
  Coding DNA sequence: Name=SeqID_1710
MIINSFTKKLFFIVKTSGLVRYWQPLGVVMLNYELAKQVS

SEQ ID NO: 7819 - protein, 280 aa, Xenorhabdus bovienii
  Coding DNA sequence: Name=SeqID_1711
MNRILNVCVALCLTVIPVEAVKADITAPIVYLEHVTPSISLNINGKEVNKLSIDTGASGAFYLPQTVFDSIFPELNHRTTAVQNSIDVFGVEKSAVMARAANITVNGEHLSDVNVEIFKTWGNGMLDDNGQLIIDGVLGLGVAKNKTLIINYASKVLTITDHLKALPDGYRWQSIPFTRTRNGIEISVSSGNEKIRRMVIDTGASHTMIFTRSKEGCAKLSQHCPKKAIVTPDGVKLSAFIFQIPDERIDFDGLLGDDFLSNRVLIISNDRLLISLPNNS

SEQ ID NO: 7820 - protein, 391 aa, Xenorhabdus bovienii
  Coding DNA sequence: Name=SeqID_1712
  Gene classification: Gene name=MalY; Function=PLP-dependent aminotransferase; Function class=E Amino acid transport and metabolism
  Homolog annotation: Query=35..386bp; Hit=30..382bp; Blast score=301; Percent Identity=40.0; E value=6e-82; Homolog= BS_patB COG1168
MTYDFDDVIDFSKSHLLKWEYPSPYLPSNTDEAPLPLWIADMDFQCPIEVRNALHNSINQGVFGYSKASDSLFEAIMQWQLQHHRWPVKEEWIIQSPGVVNSLSLIIQTFTQLGDEILIQPPIYSPFYQCALLNGRRIVTAPLVEKELGYTLDLDVFEAAITPNTKLFFLCNPHNPTGYVWNKDELTAMGDICLRHGIMIISDEIHQDLILSTDKNYLPFANICDEFSDTCITCTSPSKTFNMAGLQTSNLFIANKKIRKKLKHTYTCCSLHIPNRLGLVACEAAYRYGASWLAELLRYLRDNRMLLQQCLGQLSKVRLFDADALYLGWMDFRNSGIAPENLQHELLNRAHLWLDDGIKFGADYAGFARINFACSRSTIDTAIQRLNRLFE

SEQ ID NO: 7821 - protein, 319 aa, Xenorhabdus bovienii
  Coding DNA sequence: Name=SeqID_1713
  Gene classification: Gene name=ProP; Function=77 Permeases of the major facilitator superfamily; Function class=G Carbohydrate transport and metabolism
  Homolog annotation: Query=4..304bp; Hit=85..383bp; Blast score=108; Percent Identity=30.0; E value=5e-24; Homolog= VC0069 COG0477
MRGAFYVLGSINVYFIHSFPLLIVLRLIQGCGAGAMYVAIFASVPIRFKGAEVGKVFSMLNGVISLVPILAPMIGGKLAVHYGWRSDFYVLGGVGLLCCLLALWKPLPKRHRNTSLLLVKIFSGYLEVLRHPKFLLGCLTSSFGFATQLIFFSSSPVVLIETLNIPVDRFGYYFAINAIAITVGSLLTARLLGRGKDIAMLYGGALLLLLAMIGFVLTIYLLKISVWSYLISATLGSLGFAILLGTGTTIALSPFSHLSGRASALIATIQMSFSSLIAWIVMRYWSSDWLSMIITYFLLASAILAVIYIYRINNPKSSQ

SEQ ID NO: 7822 - protein, 85 aa, Xenorhabdus bovienii
  Coding DNA sequence: Name=SeqID_1714
MVKKNSIVMQFVWLIPLVIAAPLGLDICLPSIPMISRELGSLPEMNQWLISGFILCLSFSQLFFGPMVDQFGSQRVLLCGGLFMC

SEQ ID NO: 7823 - protein, 380 aa, Xenorhabdus bovienii
  Coding DNA sequence: Name=SeqID_1715
  Homolog annotation: Query=44..352bp; Hit=154..447bp; Blast score=64; Percent Identity=23.0; E value=4e-09; Homolog= ref|NP_930368.1|
MDKPISSYEDISTSIDKSIKIAEDYHLLNSLYQKKQCENPYQVFSLMAQRRYQTSFDIIKKYLSECFFMTNCPVTNVQTFHSDGQWRMPTEIIEQHYHPYNQGYGKCSHSGYHYFDIIPFVLESAISEEKQYDNIDVFATAVRPKDVLSQFSLNDYRKLFGQHTFDKANHYDESQLDSLLGAFGEIDCCSNVSFKHGDKIITTASINLCHNGYSQRNWVTAAGRDLYKGNGRVAHESHVFQQGPFQSIHFHSYKSNEPPVANYRIGTKEHLEIYIFRNHKMLGGEHIEVFNIDDIIAIEGGRKGIKGKAKGKAFYEFISGIRGEIAASNMVSDFSKHEIGSTLTSAIYQSISHQYHRLNPLINRCFHIKQNVPKTEEQIY

SEQ ID NO: 7824 - protein, 103 aa, Xenorhabdus bovienii
  Coding DNA sequence: Name=SeqID_1716
MLNSNHTVNLLLIGFGPHSKRIYYPLLEDAMDDPKLNLCAAVDLISEKKNIKLYLSGKMLQPEVTYLNNVNNNQDELSLDVQIVLNEIVKNTLLMVLLLQLNL

SEQ ID NO: 7825 - protein, 572 aa, Xenorhabdus bovienii
  Coding DNA sequence: Name=SeqID_1717
  Gene classification: Function=Predicted carbamoyl transferase, NodU family; Function class=O Posttranslational modification, protein turnover, chaperones
  Homolog annotation: Query=20..564bp; Hit=26..562bp; Blast score=220; Percent Identity=30.0; E value=3e-57; Homolog= mlr6171 COG2192
MKEIVLAINIPILVDGSVTYDGNVVLADRNQVIMAIAEERVSKKKYDGQVTNAVKEILYRNKLTLDDLSAISVVSFGQPMTSSGAMANNLKKYLDSLFLGFEKIHIVKSHHVAHAMSAVCQTDVKRALVVVADHTGNIIGEITDTKVLENNSAEQVSYYLYENNDLKLLAQDNTQPCDQGYGRFYGDVTCYLGFDSYRESGKTMGLASFGDPAVFSCYPAFTETKTGVVSELKDENYVYDCTKDIQNWFRKQGVHIPERRHKAGVIRPFDMHLAAWAQDQLQKSIINRVKELINKYHIDTVCVTGGVAMNSVMNRKLEEELNINVYVPPSPGDAGLALGAAAEYFWKQDKKISKFNSSPYLGPVYSEDEILESIFSYKNEFVIQKVNDPEYQAARMIANGKIIGWFQDRSEYGPRALGNRSILASASNSWTKEILNSQIKLREWFRPYAPVVLEEKADIYFNMLSPVPYMMKVAPVKAQARLDIPACIHVDGTARLQTVSATSNQKFYNLIKELDKITGIPVVLNTSFNLAGMPIVESPVDAINCFRQSIGMDALFIGNYCLEKNTLFNKNI

SEQ ID NO: 7826 - protein, 277 aa, Xenorhabdus bovienii
  Coding DNA sequence: Name=SeqID_1718
  Gene classification: Gene name=SmtA; Function=SAM-dependent methyltransferases; Function class=Q Secondary metabolites biosynthesis, transport and catabolism
  Homolog annotation: Query=43..235bp; Hit=42..242bp; Blast score=90; Percent Identity=27.0; E value=2e-18; Homolog= PA2454 COG0500
MFKNFYDGKNIQFWDELAKIHFDKSDYNIDSYDPQKYKLKSIEISELGNLTGKKVLHLQCHIGLDSFAIEMLGANVTAIDYSSVAIDTAKCIKRKFGLKTKFYCANVYDLSSLNLGEFDFIFTSYGVIIWIQHLNLWAKTISSHLKSGGEFIIIDDHPFARMLSNPSQDNTSFNNSFISFHHLSGDPIKANYKYSYANRDVLLKNQEQYVYFHSLSEIITSLINEDMQLMKFKEFDKSFYKAFSQLFENEEGWWCFEHNTISIPLMFLLRVKNIKNS

SEQ ID NO: 7827 - protein, 169 aa, Xenorhabdus bovienii
  Coding DNA sequence: Name=SeqID_1719
  Gene classification: Function=Predicted transposase; Function class=L DNA replication, recombination and repair
  Homolog annotation: Query=25..156bp; Hit=1..131bp; Blast score=177; Percent Identity=63.0; E value=3e-45; Homolog= VC0870 COG1943
MGSANKATHGKIRTVIPITEKDLTMSRFKKASHVLWCCQYHIVWTPKYRFRILKNNVGREVYKQIRISCEQLEIEIVELNVQLDHVHLLVKIPPKLSVSQVLGHLKGRTAIRLFNKFPYLRKKKLWGNHFWSRGYCVDTVGVNEEMIRKYVKYQEKHEHEDNQLSLKGM

SEQ ID NO: 7828 - protein, 61 aa, Xenorhabdus bovienii
  Coding DNA sequence: Name=SeqID_1720
MIQGRNELILGVKDKTYYQKLDGFHVLDKPLPAKKICTLLKRRIPFVQTLIRLKDDEKLLK

SEQ ID NO: 7829 - protein, 419 aa, Xenorhabdus bovienii
  Coding DNA sequence: Name=SeqID_1721
  Gene classification: Function=Predicted flavoproteins; Function class= R General function prediction only
  Homolog annotation: Query=1..395bp; Hit=1..395bp; Blast score=632; Percent Identity=76.0; E value=0; Homolog= ZyhiN COG2081
MEKFDVVIIGAGAAGLFCAAQAGQGGLNALVLDNGKKAGRKILMSGGGRCNFTNMYTEPAAYLSANPHFCKSALARYTQWDFIGLVQRHGIAYHEKALGQLFCDDSAQQIIDLLLKECEAGQVTVRLRSEVTQVEKDEQGFVITTAGKKVSTHSLVVASGGLSMPGLGASPLGYRIAEQFGLNILPTHAALVPFTLHKPLLEQLQTLSGVAVPSIVTAKDGTVFRENILFTHRGLSGPAILQISSYWQPGEYVSINLLPDMDLDAFLDKERESHPNQSLKNTLAKLLPKRLVECLQSLEQLPDVSLKQLNPAQKKELIATLQCWQVQPNGTEGYRTAEVTMGGVDTNELSSKTMESHKVKGLYFIGEVVDVTGWLGGYNFQWAWSSAWACAQALLCCVETIKLARKACIVSFSEDDCTN

SEQ ID NO: 7830 - protein, 55 aa, Xenorhabdus bovienii
  Coding DNA sequence: Name=SeqID_1722
LPCLSRTKQTGRASTNNHYIKFFHSFVSFGRVILQEMYFIVGNCPRTTEKKIYLV

SEQ ID NO: 7831 - protein, 509 aa, Xenorhabdus bovienii
  Coding DNA sequence: Name=SeqID_1723
  Gene classification: Gene name=PitA; Function=Phosphate/sulphate permeases; Function class=P Inorganic ion transport and metabolism
  Homolog annotation: Query=14..509bp; Hit=1..499bp; Blast score=624; Percent Identity=70.0; E value=1e-179; Homolog= pitA COG0306
MRRVHVLLTGLTFMLHLFTGLDFYTSLMLVLALLFVLFYEAINGFHDTANAVATVIYTRAMRSQFAVVMAGVFNFLGVLLGGLSVAYAIVHLLPTDLLLNVSSTHGLAMVFSMLLAAIIWNLGTWYFGIPASSSHTLIGSIIGIGLTNAIVTDSSVVDALNITKMIQIFMSLILSPIVGLAIAGAMVFLLRRYWSGTKKRRRIHMTPAEREKQDGKRKPPFWTRTALILSAVGVSFSHGANDGQKGIGLIMLVLIGVAPAGFVVNMNSTSYDITRTHDAVASLQKYYVQHGPALSHAIELTPAASSVEVPVDQMLHCDNAQAQNVLNTAAVMLGSIQNFSELTPDQRNNMRRMLMCAADTAGAVAKLSETSLEDARFLNKLRKDLLNTVEYAPMWIIIAVALALSLGTMVGWKRVAVTIGEKIGKKGMTYAQGVSAQVTAAVSIGVASYTGMPVSTTQVLSSAVAGTMLVDGGGVQSKTIKNIMLAWVLTLPISIGLSGILYWIALQLI

SEQ ID NO: 7832 - protein, 109 aa, Xenorhabdus bovienii
  Coding DNA sequence: Name=SeqID_1724
  Homolog annotation: Query=1..109bp; Hit=1..109bp; Blast score=137; Percent Identity=70.0; E value=5e-32; Homolog= ref|NP_927490.1|
MFNIIAFFWAVSLVGIVNVIRCLSSLRVLLSILRQSDPMLYQSVDGNGFFTTHGQFNKHIRLVHYINSQGYLTHHDTNVIFIYERLRKQFLLTGMLCGAVVLCLIAMAI

SEQ ID NO: 7833 - protein, 143 aa, Xenorhabdus bovienii
  Coding DNA sequence: Name=SeqID_1725
  Gene classification: Gene name=UspA; Function=Universal stress protein UspA and related nucleotide-binding proteins; Function class= T Signal transduction mechanisms
  Homolog annotation: Query=1..143bp; Hit=1..143bp; Blast score=242; Percent Identity=88.0; E value=1e-64; Homolog= uspA COG0589
MAYKHILIAVDLSPESQILVEKAVSMAKPYNAKVSLIHVDVNYSDLYTGLIDVNLGDMQQRIADETRNALKDLSVNADYEIQETLSGCGDLGQVLVDAIKQYDMDLVVCGHHQDFWSKLMSSARQLINTVHVDMLIVPLRDEE

SEQ ID NO: 7834 - protein, 33 aa, Xenorhabdus bovienii
  Coding DNA sequence: Name=SeqID_1726
MQAIFLSEEKMMRLFWKLSKLFLRKLIKIVVEI

SEQ ID NO: 7835 - protein, 447 aa, Xenorhabdus bovienii
  Coding DNA sequence: Name=SeqID_1727
  Gene classification: Gene name=GdhA; Function=Glutamate dehydrogenase/leucine dehydrogenase; Function class=E Amino acid transport and metabolism
  Homolog annotation: Query=1..447bp; Hit=1..447bp; Blast score=759; Percent Identity=82.0; E value=0; Homolog= ZgdhA COG0334
MNISPSLVSFLDSIQSHNPHQPEYLQAVREVLTSLWPFLQQNPQYREQSLLERLIEPERVIQFRVCWVDDQGKVQVNRAWRVQFNSAIGPFKGGMRFHPSVNLSILKFLGFEQTLKNALTTLPMGGAKGGSDFDPKGKSHGEVMRFCQALMTELYRHLGPDTDVPAGDIGVGGREVAFMAGMMKKLSNNTACVFTGKELSFGGSLIRPEATGYGLVYFTHEMLKRHGMGLEGMRVSVSGAGNVAQYTIEKCMELGAKVVTVSDSGGTVLDEEGFTPEKLAHLEEIKNQRYGRVEEYAKERGLTFLKGQDPWSIPVDIALPCATQNELDLDAAKTLIKNGVKVVAEGANMPATISATDAFLEAGVLFAPGKAANAGGVATSGLEMAQNAARLSWKAEKVDVRLHHIMLDIHHACVEYGGEGKQTNYVQGANIAGFVKVADAMLSQGIL

SEQ ID NO: 7836 - protein, 37 aa, Xenorhabdus bovienii
  Coding DNA sequence: Name=SeqID_1728
MRCCRRGFCNSHVINDVSRISPMYKHGACFLNRSRID

SEQ ID NO: 7837 - protein, 247 aa, Xenorhabdus bovienii
  Coding DNA sequence: Name=SeqID_1729
  Gene classification: Gene name=SmtA; Function=SAM-dependent methyltransferases; Function class=Q Secondary metabolites biosynthesis, transport and catabolism
  Homolog annotation: Query=1..245bp; Hit=1..245bp; Blast score=372; Percent Identity=76.0; E value=1e-103; Homolog= yhiQ COG0500
VKICLICEQGADNSALSQLAERWNLVHDEDSVMALILTPERLELHKLDEPKLSGIYVDFVAGTLAHRRRFGGGRGEAVAKAVGIKKGYLPTVVDATAGLGRDAFVLASIGCQVRMLERHPVVAALLDDGLQRGYQNEEIGSWLKERMTLIHTSSITALTDITPPPDVVYLDPMYPHRQKSALVKKEMRVFQSLVGADEDADGLLEPARALAKRRVVVKRPDYAEPLAGVKASAAITTKNHRFDIYPC

SEQ ID NO: 7838 - protein, 680 aa, Xenorhabdus bovienii
  Coding DNA sequence: Name=SeqID_1730
  Gene classification: Gene name=Dcp; Function=Zn-dependent oligopeptidases; Function class=E Amino acid transport and metabolism
  Homolog annotation: Query=1..680bp; Hit=1..680bp; Blast score=1033; Percent Identity=73.0; E value=0; Homolog= ZprlC COG0339
MTNPLLTPSVLPKFAAIEPKHVVPAVKETLANYRQVIEKVLAGNVTFTWDNLCQPISEAKDHLSRVWSPVDHLNAVKNSPELREAYEQSLPLISEFETWMGQHEGLYQAYKALKESEAFKALSQPQRKAIENTLRDFELSGIGLPKEKQKRYGEISARLSELGSQFGNNLLDATMGWTKLITDECDLEGMPDSAKAAAKAAAEAKGLEGWLLTLNGPSYLPVMTYADDSELRQEMYYAYTTRASEQGPNAGQWDNSAVMTEILALRHELALLLGFKNYAENSLATKMAKTPKQVLDFLNDLANRAHGQGERELEELTDFAESHYWVDELEAWDLAYYSEKQKQHDFSISDEQLRPYFPEQRAIEGLFEVIRRIYAITAKERRDVETWHPDVRFFELYDEKQTLLGSFYLDLYAREHKRGGAWMNSYVGRMRHTSGELQTPVAYLTCNFNKPVGDQPALFTHNEVTTLFHEFGHGLHHMLTQVETLDVAGINGVPWDAVEMPSQFMENWCWEPEALAFISGHYETKEPLPKEMLDNMLAAKNYQAAMAILRQLEFGLFDFRLHAEYDPAKGAQILPTLQSVKKQVAVVPSPEWGRFPNTFSHIFNGGYAAGYYSYMWADVLAADAYSRFAEEGIFNRTTGQSFLDNILTRGGSEDPMALFVRFRGREPKLDAMLKSSGISG

SEQ ID NO: 7839 - protein, 88 aa, Xenorhabdus bovienii
  Coding DNA sequence: Name=SeqID_1731
MPHFYADNRGLFISEICEMTNEFRCFVGRAIIPALHRFPYGRSSPPVGRLGFKSRWSRQRLPAGSTPVIFRHFLSITVFLLQQNNSIY

SEQ ID NO: 7840 - protein, 41 aa, Xenorhabdus bovienii
  Coding DNA sequence: Name=SeqID_1732
MMTKRNFFTENLLCSDYKKIPLKYKKHPVNKLNYFAEVKRQ

SEQ ID NO: 7841 - protein, 37 aa, Xenorhabdus bovienii
  Coding DNA sequence: Name=SeqID_1733
MISPCILYLLVQLKNISGQILMPRNERSQPTRCSFLL

SEQ ID NO: 7842 - protein, 30 aa, Xenorhabdus bovienii
  Coding DNA sequence: Name=SeqID_1734
MSLYLRLSSFCFSGYNLKDEGDDYIGFWIE

SEQ ID NO: 7843 - protein, 108 aa, Xenorhabdus bovienii
  Coding DNA sequence: Name=SeqID_1735
  Homolog annotation: Query=1..108bp; Hit=1..109bp; Blast score=121; Percent Identity=56.0; E value=3e-27; Homolog= ref|NP_460206.1|
MKYTLLMLLILSPLSLAASFDCAKAKAPDEKAICTDHRLNDLDIEMSVKYHFLRGLFAMGISGEMHDSQKAWLKQRQKCKGDKTCLLQSYHRRINQLDTLYHSIQKPI

SEQ ID NO: 7844 - protein, 159 aa, Xenorhabdus bovienii
  Coding DNA sequence: Name=SeqID_1736
MSYLKCLNYFGAGFLLFSAFVQAQSPSYQLSTSQQKYLQQQIDKQMTDKSAAKEVEDWSDTKKVAEFICRPLALSVIQREHKEADKVFLGDESPNSIRLIDSRLIGTGMYRNGIGWKNIRFSCELDSKTGKALSFKLLKALPPQLQTGPGPVILPKKGQ

SEQ ID NO: 7845 - protein, 554 aa, Xenorhabdus bovienii
  Coding DNA sequence: Name=SeqID_1737
  Gene classification: Gene name=AmyA; Function=Glycosidases; Function class=G Carbohydrate transport and metabolism
  Homolog annotation: Query=1..549bp; Hit=1..547bp; Blast score=782; Percent Identity=68.0; E value=0; Homolog= ZtreC COG0366
MTEQQPWWLDSVIYQIYPKSFQDSTGSGTGDINGITQRLDYLQHLGVEAIWITPFYPSPQVDNGYDVADYCAINPDYGSMEDFDNLVENAHRRGIRIILDMVFNHTSTEHPWFQAAQDINSPYRQFYIWREGSSDSLPNNWKSKFGGNAWQWHAESQQYYLHLFAVKQADLNWEHEPVRAELKKICEFWADRGVDGLRLDVVNLVSKQQDYPSDDHGDGRRFYTDGPRIHEFLQEMSRDVFQPKGLMTVGEMSSTALEHCLRYSALDSSALSMTFNFHHLKVDYPNGEKWTLAKPDYIALKKIFSTWQQGMHQKAWNALFWCNHDQPRIVSRFGDEHQHHRTSAKMLAMVLHGMQGTPYIYQGEELGMTNPHFERIEEYRDIESLNMYQERIEQNMAPEEILAILAQKSRDNGRTPMQWDASASAGFTSGTPWIAPCDNYPELNAEAALQDKDSVFYCYHELIKLRKQQPILTYGDYLDLLPDHPSLWCYLRRWQNQVMLVIANLSDENQLWSPESSLTDKEWQVLISNYPSPSSMEKEISIKPYESIYLIAAQ

SEQ ID NO: 7846 - protein, 469 aa, Xenorhabdus bovienii
  Coding DNA sequence: Name=SeqID_1738
  Gene classification: Gene name=PtsG; Function=Phosphotransferase system IIC components, glucose/maltose/N-acetylglucosamine-specific; Function class=G Carbohydrate transport and metabolism
  Homolog annotation: Query=98..464bp; Hit=2..368bp; Blast score=554; Percent Identity=80.0; E value=1e-158; Homolog= ZtreB_2 COG1263
MKKNQVNQKDLEKLITLIGGKENIASVSHCITRLRFVLHSPENADAKAIEELSMVKGCFTNAGQFQVVIGTNVDIYYKALLENTGKQSVNKEEVKQVARQNMKWYENAISHFAEIFFPLLPALISGGLILGFRNIIGDIPFSEGKTLAQLYPIWQTIHGFLWLIGEAIFFYLPVGICWSAVKKMGGTPVLGIVLGITLVSPQLMNAYLLGQQTPEVWDFGWFAISKVGYQAQVIPSLLAGLTLGWIETRLKKWVPDYLYLVIVPVVSLLLAVFLAHALIGPVGRAIGDGVAWVVKSLMTGSFAPIGAALFGFFYAPLVITGVHQTTLAIDLQMIQSTGGTPIWPIIALSNIAQGSAVAGIIWASKKQKEREVSIPAAISAYLGVTEPAMYGINLKYRYPMFCAMIGAGLAGLVCGLNHVTANGIGVGGIPGILSIKPQFWMVYLIAMIIAIVVPMLLTVLVYRRNELTH

SEQ ID NO: 7847 - protein, 62 aa, Xenorhabdus bovienii
  Coding DNA sequence: Name=SeqID_1739
MNLFMTTPSRKKFHKGDILKVSLCYHLIFKKMVKLRAGDTADCCDTVIVSSMNISWNYRYDY

SEQ ID NO: 7848 - protein, 163 aa, Xenorhabdus bovienii; identical to SEQ ID NO: 7546
  Coding DNA sequence: Name=SeqID_1740
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293

SEQ ID NO: 7849 - protein, 117 aa, Xenorhabdus bovienii
  Coding DNA sequence: Name=SeqID_1741
  Gene classification: Function=Predicted transposase; Function class=L DNA replication, recombination and repair
  Homolog annotation: Query=1..114bp; Hit=133..247bp; Blast score=82; Percent Identity=40.0; E value=1e-16; Homolog= mll8100 COG3293
MPIRALITSGPTADCSQAEALIDGIDAEHLLADRGYDSNTVVEQAEKQGMAAQIPGRKNRKVKREYDRELYRLRHLVENAFLHLKRWRGIATRYAKNSASFLATVQIRCLALWLNVL

SEQ ID NO: 7850 - protein, 348 aa, Xenorhabdus bovienii
  Coding DNA sequence: Name=SeqID_1742
MNSTNEINISFPHKKTLEAILFLSAFLLFSFTQPVYSIEMKAAPKDSQPQLFRRRPKIKILFAFSIEAAEKLGYVYGSELKDKKAIEQMNEVADLMISVGNRSFRNSYIHFELGRTKVIASYISEKNLMTHEHYLDFNMTGMLKQLPGTRNKNDKKIIYRFKEFYLLEQSRIALKADVVVLIITAKYHFNKNECGSSFDGKKGINRDTAYMVVRLPCMINKENLDFNYHLGHLIGASDSVNSGGISKEDEFFYGHGYIQNKHKPYWRTIMTRAEDCPSCTVINYWSNPLAEVNEIPTGIYRTNNNALLWRVHGRKLVRVYEEFYKNKGKSPVLLLQRPVKNNYISTQN

SEQ ID NO: 7851 - protein, 106 aa, Xenorhabdus bovienii
  Coding DNA sequence: Name=SeqID_1743
MGNNNEKTELVNKDKGIYSKVISIDVGDINGGGGGGADINPIICVKNINNDVIDYYKLAFPEEEINGAATYSVILAAFSYDMPIILKFIGSERIAGVIIDTDIGDK

SEQ ID NO: 7852 - protein, 111 aa, Xenorhabdus bovienii
  Coding DNA sequence: Name=SeqID_1744
MNENDKSEKKLILVRPASDLLVKDVIIVSLETNIAGNNVNVSFKYLKNPNIFTNFFLNYPNYKMGGGGIFATLLSALINQFTVTLKLLDYPYPAEIIYITGILVKGVDTPP

SEQ ID NO: 7853 - protein, 30 aa, Xenorhabdus bovienii
  Coding DNA sequence: Name=SeqID_1745
MGKGRKYGTSEITRWKVRRGLSLNGKKRIP

SEQ ID NO: 7854 - protein, 35 aa, Xenorhabdus bovienii
  Coding DNA sequence: Name=SeqID_1746
MSKKYDCYQKDYSFGLRQHGNDSIWERGENMEHLR

SEQ ID NO: 7855 - protein, 151 aa, Xenorhabdus bovienii
  Coding DNA sequence: Name=SeqID_1747
  Gene classification: Function=Uncharacterized BCR; Function class=S Function unknown
  Homolog annotation: Query=1..149bp; Hit=41..189bp; Blast score=216; Percent Identity=75.0; E value=8e-57; Homolog= yaiI COG1671
MPIWVDADACPKVIKEVLYRAAEREKVQVTFVANQRLSVPASAFLRTLQVPAGFDVADNEIVRRSEIGDLVITADIPLAAEVIEKGAIALNPRGERYSEATIRERLAMRDFMDTMRASGIHTGGPATLNQRDRQQFANELDKWLLQQKRVS

SEQ ID NO: 7856 - protein, 45 aa, Xenorhabdus bovienii
  Coding DNA sequence: Name=SeqID_1748
MLFPPVRKTQIAFTLFFFPDTTRLASSSANSGESPNYQLESDGYF

SEQ ID NO: 7857 - protein, 53 aa, Xenorhabdus bovienii
  Coding DNA sequence: Name=SeqID_1749
MFHDSCLSLNQVITVPYRPETDAAGETTRINPFRWSEKVGDQRTYLVILFLVN

SEQ ID NO: 7858 - protein, 371 aa, Xenorhabdus bovienii
  Coding DNA sequence: Name=SeqID_1750
  Gene classification: Gene name=SelA; Function=Selenocysteine synthase [seryl-tRNASer selenium transferase]; Function class=E Amino acid transport and metabolism
  Homolog annotation: Query=10..307bp; Hit=1..299bp; Blast score=176; Percent Identity=35.0; E value=5e-44; Homolog= mlr3804 COG1921
MKSLYEKYQLRPVINAAGRMTALGVSTPRSDVIEQVATGLNHYFEMADLVDKTGDYIARLLGVDSAIIVSCASAGIAQSIAAVIVKDDDDLLLNLHRSEKPVPREIILPRGHNVNFGAPVDTMITLGGGKVIEAGFANECSATQLAAKITPQTAAILYIKSHHTVQKSMLTVAEAARIAQEHQLPLIVDAAAEEDLTLYYQLGADLVIYSGAKAIEGPTSGLVIGKQPYVNWVKRQSYGIGRAMKIGKEGILGLTLAIERYITDKKESGADMVARMTPFIDRLNRIKGVSAKVVWDSAGRDIARAEITFDEQMIGKNTFDILAQLRQGKTAIYLREYQANKGKVEADIRSVTAVQLDSIASEIRRLILGGK

SEQ ID NO: 7859 - protein, 384 aa, Xenorhabdus bovienii
  Coding DNA sequence: Name=SeqID_1751
  Gene classification: Gene name=PyrC (BS); Function=Dihydroorotase and related cyclic amidohydrolases; Function class=F Nucleotide transport and metabolism
  Homolog annotation: Query=2..369bp; Hit=172..543bp; Blast score=184; Percent Identity=33.0; E value=2e-46; Homolog= mll4451 COG0044
MYDLIIKQGKLINGAIIDIVINDGRIAAIGPLAATGLSAIRYIDLHGHYFVSAGWIDAHTHCYPQSPLYFDEPDLIGAASGVTTVVDAGSAGADDIDHFHSVARRVKTHVYAFLNIARTGMRSQNELADLTKIDASRLQDAVRRHAGFAIGLKARMSKSVVGENGLQPLIQAKALYSKLRQKTSGLPLMVHIGNPPPNLEEIADLLTQGDIITHCFNGKPNRILDDKGNLKPAIQQALSRGVVLDVGHGTESFSFTVAEQAIRFGAYPHMISSDIYQKNRVGGPVYSLANVMTKFLTLGVPPEQILNCVTANPADLLHLPRKGRLERGLDGDITIFELKNQRIELFDAEGQVRIGTQQFIPIAAILAGTHIVVVERSTVDEISL

SEQ ID NO: 7860 - protein, 216 aa, Xenorhabdus bovienii
  Coding DNA sequence: Name=SeqID_1752
  Homolog annotation: Query=10..215bp; Hit=7..212bp; Blast score=249; Percent Identity=77.0; E value=2e-65; Homolog= ref|NP_458861.1|
MNTELNKPDFWYAEWSFPLFVGLLSAGIFAGTHMYVVYGFGAFNEVAFVAMLRAGIDTGAYGTVAAFGASFLFARIVEGSLVGILDIGGALQTGIGLGVPALLLAGGFDFLITHFWAALITGMLLGVGVGLLIILARKFTVAQGNSTFGADVMMGAGNASGRFLGPLIILAAMTASIPIGVGSLIGALLFYVWKKPVAGGAILGAMILGYFFPVTA

SEQ ID NO: 7861 - protein, 263 aa, Xenorhabdus bovienii
  Coding DNA sequence: Name=SeqID_1753
  Homolog annotation: Query=7..263bp; Hit=2..258bp; Blast score=348; Percent Identity=76.0; E value=6e-95; Homolog= ref|NP_458860.1|
MGATASFIEILGMSLVIGGLCGFGLGAGAARMFHAPTVQGMGAFRTLGELNACEGDPASHFSFGLGFFFNAWASSVAAGAFTQDVDHRIIPNWGAAALMIKNRNVAETLHNPKKMAIACGIIGALLVAFLNTTASAVPAALQTTATNVLVPAANLLVNTVMPVLFWLAAMDAGRRSGFWATLFGGCAQLIMGNAIPGLVLGILIGKGVDDSGWNKITRTMLIAVILLFALSGFFREFDLKLLTSFMLDAPGWLQHIHQLMRGK

SEQ ID NO: 7862 - protein, 109 aa, Xenorhabdus bovienii
  Coding DNA sequence: Name=SeqID_1754
  Homolog annotation: Query=1..95bp; Hit=2..96bp; Blast score=89; Percent Identity=53.0; E value=1e-17; Homolog= ref|NP_458859.1|
MKELIETSVRVSGSGDTKQKAIADALNAVQRTVLQGTSHIILRIEPKDVAIVSAISKVTTEKFLFFFLPRQREHYSVVLDVFVNVSLLDVRAIHFKQSTSNHHNHADRK

SEQ ID NO: 7863 - protein, 133 aa, Xenorhabdus bovienii
  Coding DNA sequence: Name=SeqID_1755
  Homolog annotation: Query=9..127bp; Hit=2..120bp; Blast score=155; Percent Identity=75.0; E value=2e-37; Homolog= ref|NP_458858.1|
MTSTKIVKKQIIVVIGDRLGKGKNVAAGVEAAGGKAIVIPGVAADMKLGDVMHHEQADIGISFCGSGGAGAITAQNKYGYPVRHGMRSIEEGETAIREGCTVLGFGFMDKAELGERLVRALIKKQAANHERVD

SEQ ID NO: 7864 - protein, 129 aa, Xenorhabdus bovienii
  Coding DNA sequence: Name=SeqID_1756
  Homolog annotation: Query=59..128bp; Hit=42..111bp; Blast score=90; Percent Identity=65.0; E value=5e-18; Homolog= ref|NP_458857.1|
MAGNSTMRRDRFDWKNFMLKPPMRFNMAKGNLDPEAVSQRLLALIKQWLEAAGAYTTQVQQQMLTTHIRAMVMRAKTGEPLPEVDNSLFDEVSPESIALAAQVVETLPGLAVEEAYLLSVHFEVARSNP

SEQ ID NO: 7865 - protein, 639 aa, Xenorhabdus bovienii
  Coding DNA sequence: Name=SeqID_1757
  Gene classification: Function=Transcriptional antiterminator; Function class=K Transcription
  Homolog annotation: Query=27..465bp; Hit=26..474bp; Blast score=167; Percent Identity=28.0; E value=3e-41; Homolog= BS_licR_1 COG3711
VALFPYPRLAHLFEVIHKERLPQAELAKRFGVSSRTIRTDITELNNALRHYGAQILYKRGSGYSLSIEDHTLFASLPKQKQMIQTIPRTASDRVDALLLKLLLATQPVKLDDIAEAWSISRGTLQHDMGVVREIVSKYPLQLTSIPRLGTRLTGNERIIRSCLTDTLLRRFSLEVEPSLSQFRTDILADIDLSYIETILQNSLTRFGIRLNNEGRQYLIFNCAVSILRITRRHELTQGVVHEWDNAIQNVAYEISQSLICVLGSEISASEAGYLAGQIAAQRIPQHDNPTPHTPNSHQWVDEILNDINTSYNYDLRHDSKLRSDLATHLTVLISRLQQQISTKNPLLADIKQHYPFAYEVTVSALTRIEDQLPFVISEDELGYLAVHIGVGLERHYGGSTHVLVVTDSGNATRRMIEAKIAREFPQLKIQRVLPLHEYNALDYVEENFVITTLRLSEKNKPIVKIAPFPTAYQLEQIGRLTMMEQTRPYILERFFDERYFMVIKEDITQEILFKTLCRKLRAGGYVREDFCPSLIEREAIVSTLLGENIALPHSLGLLALKTVVVTVLAPKGIEWSKETKTRANVIFLLAISKQDYEEAMAIYDLFVTFVREKATKRLLRSRNFHDFQIIAKDSLGRSV

SEQ ID NO: 7866 - protein, 57 aa, Xenorhabdus bovienii
  Coding DNA sequence: Name=SeqID_1758
MHDLNNYFSHIVRKKCASHFPCCGFNAISNIRTTFLCRRFTDMKMSACFSTEITQKG

SEQ ID NO: 7867 - protein, 280 aa, Xenorhabdus bovienii
  Coding DNA sequence: Name=SeqID_1759
MSRFIISRNNKSLLNETVFYLTKGNMLTLKIDGLNSNTKRHLKFQSNNTLVSIFQRDNYLFREQTLQITALSMGVSVVRAVDTDIDYCPYFAEGVAEDCFPPLTIHVLSKISIPTDLTAEQKAILMVLLAETTSPETKKIKYNEKEAKDTMQYMHDVLLNRIRSPKAHELDVPRQGNKLIGLISGPRTIEGFSQYPNIKPSIQDRINGMIASANEGSNSNFLAYRRLIKNAIDIAKSNKISNTEIIAWRTGSAEPPGSNFTKLFSLQGQDFYKLADSYLK

SEQ ID NO: 7868 - protein, 176 aa, Xenorhabdus bovienii
  Coding DNA sequence: Name=SeqID_1760
MKYLIGLCMILFSLTAFSKQDELDFKAWEKTGSWGIYDSKPDNYFKPLKINNYKEGYLRSFSYLIKRFNLQNVNNEYCLIGYKWNKTKDRDERERIIVFWKTANYLIDWDLPDGEDDHRYKAIIFSKPFIDMNESVVPYKEAEGAQALWAKEGVIQMMNDCELNGQKITITPSGVR

SEQ ID NO: 7869 - protein, 58 aa, Xenorhabdus bovienii
  Coding DNA sequence: Name=SeqID_1761
VIFKKPQEFHSESLSGISQFSTNMTVSMAHLGKQLFCIHSMLLLGCNSVISLFRIRPN

SEQ ID NO: 7870 - protein, 197 aa, Xenorhabdus bovienii
  Coding DNA sequence: Name=SeqID_1762
  Homolog annotation: Query=3..197bp; Hit=44..239bp; Blast score=181; Percent Identity=45.0; E value=6e-45; Homolog= ref|NP_103310.1|
MKVPYFSQWESFHLANDIIHHQLPLSHDPLWEQSGADSPEEYAKWANHICGMACLKMLLAARSGKIYPLLKLTKMATEYGAYQIENEHIKGMIYAPVVSMLSEQFGIFSQIVTGMAAEKIHGVFTQDSLYIASVHPSIRWPTRLPEKKGGHLVLVTNATPEEITFHNPSGANTQSQIDVKMSVDIFSRFYAERGILI

SEQ ID NO: 7871 - protein, 275 aa, Xenorhabdus bovienii
  Coding DNA sequence: Name=SeqID_1763
LLIIVLTTLRTLALKKVAERVSPENTAFIIGAGTFLTCLSLLPVAITTGISTPSDFLNLTGISAGLMKGVLLGIMLIAQQNLINKSLSSATYVFPISLGFIALVDILIFGSNLTFASILSINLLFVAGILFTMIGHIKSMHRRSKLMFFIMIFCVIGFAIMDRTGIPTSGWFTYLLFTGIGNIFVVFFYQKNKFSFVPLKFWLSISIIWVLPELFFNYAIATYLPVSYGYLAITLRIPLLMLISVLVYREGKLSEQMLFSFVAVIAILLMFMERL

SEQ ID NO: 7872 - protein, 243 aa, Xenorhabdus bovienii
  Coding DNA sequence: Name=SeqID_1764
  Gene classification: Gene name=RacX (BS); Function=Aspartate racemase; Function class=M Cell envelope biogenesis, outer membrane
  Homolog annotation: Query=4..231bp; Hit=2..224bp; Blast score=167; Percent Identity=39.0; E value=1e-41; Homolog= AF1422 COG1794
MERIGLIGGVSWASTMEYYKRLNMAVQNTGKDFESADLAIISLNFSKILAAQKRDDNETEFNILSKAVHQLAQAEVKKILICSNTTSNTCDRLSKLVNIPIINIIDATANKLLSMKVSNVGLIGTQYVMERDFYKKRLEAKGINVLIPRSRTRQVIHDSIYQDLCRYALTDTSRGIMYRAIDELAELGAEAVILGCTEIPLVVNDRVYQNSIKIIDSIDAHIEAALSLTPENNNTSSMLRPLN

SEQ ID NO: 7873 - protein, 365 aa, Xenorhabdus bovienii
  Coding DNA sequence: Name=SeqID_1765
  Gene classification: Gene name=DdlA; Function=D-alanine-D-alanine ligase and related ATP-grasp enzymes; Function class=M Cell envelope biogenesis, outer membrane
  Homolog annotation: Query=101..333bp; Hit=60..276bp; Blast score=95; Percent Identity=30.0; E value=9e-20; Homolog= aq_521 COG1181
MVYFPSDTKTTIPLSIIFGGISPEHPASVSSFDNLIKNFRELNFDRNINSIYFFDKDGSVLYNTYTPYISPDDFTHSGDKIDLYTAIKRMSEQNEFHINLLHGNLGEDGHIQGVAKYFKIKGTFGSVLPSSLSMSKYHMSHYINSLLPSLRSPKTLLLTEGNLEKAFSLISDNFPEEKIVIKPNSLGASLFTNKYVNLENEKKSILDNLKNIFEYDRFALVQEFIKGKEYSVGCIRIEGKAIALNVIEIITKNGFFGHDEKHRINKAEEILLIQDSGITRTLKDLSIKIFESTGYEFMCRFDFIVTESEEIYFLESNPIPGMMKNSIFPKMLKGHKLSIPSLFIHLSCSSQNISEKKSIFNYIIE

SEQ ID NO: 7874 - protein, 208 aa, Xenorhabdus bovienii
  Coding DNA sequence: Name=SeqID_1766
  Gene classification: Gene name=WbbJ; Function=Acetyltransferases (the isoleucine patch superfamily); Function class=R General function prediction only
  Homolog annotation: Query=1..208bp; Hit=1..208bp; Blast score=290; Percent Identity=69.0; E value=5e-79; Homolog= PA0706 COG0110
MENYFDSPFKGKTLAEQVTNPNIQVGRFSYYSGYYHGHSFDDCARYLYPDSVDVDKLIIGSFCSIGTGVAFMMAGNQGHRLDWVSSFPFFYMSEEPAFADAQNGYQPMRDTVIGNDVWMGAEAIIMPGVNIGDGAVIGTRSLVTKDVEPYTIIGGNPAKVIRKRFSDEQIAMLLEMQWWNWPLEQLKAAMKLLTSADIEGLYRWWKNQ

SEQ ID NO: 7875 - protein, 316 aa, Xenorhabdus bovienii
  Coding DNA sequence: Name=SeqID_1767
  Gene classification: Gene name=PaaX; Function=Phenylacetic acid -responsive transcriptional repressor; Function class=K Transcription
  Homolog annotation: Query=7..312bp; Hit=3..307bp; Blast score=345; Percent Identity=56.0; E value=2e-95; Homolog= paaX COG3327
MEKMAHKLDDFIRHALDAQPISGTSLIISLFGDALSHRGGEVWLGSLSLLLEPMGFSDRFVRTSVFRLQKEGWLAVEKIGRRSYYRITERGMNQFRHAESKIYLSEQPEWDGKWDLLLLEGTTKEERNRLKKELSWLGFGQLNSTLMAAPSSAQSDIPALLGELNASDSVIYFRADYPYPRSEQSLKERVSASWSLDQVVKHYHEFIVSFRPLMKLLQDCSEADLTPERSFQLRLLLIHFYRRVVLRDPLLPDALLPAQWEGQVARNLCTNIYQRIDLTATRYVSERCETTIGTLPQPGAAYYRRFGVLHSESGIV

SEQ ID NO: 7876 - protein, 435 aa, Xenorhabdus bovienii
  Coding DNA sequence: Name=SeqID_1768
  Gene classification: Gene name=PaaK; Function=Coenzyme F390 synthetase; Function class=H Coenzyme metabolism
  Homolog annotation: Query=8..432bp; Hit=7..432bp; Blast score=687; Percent Identity=75.0; E value=0; Homolog= paaK COG1541
MSNNVQHLDSIEFASRDEIQAHQFEQIKWTLHHAYNNVPMYRRKFDTAGIHPSDFKQLEDITKFPYTTKQDLREHYPFDTFAVPMEQIVRIHASSGTTGHPTVVGYTQRDIDHWANLVARCLRFAGASAKDKVHVAYGYGLFTGGLGAHYGAERLGATVIPMSGGQTEKQAQLILDFKPDVIMMTPSYCLTLLDALEQRMGGDASKCSLRVGIFGAEPWTEALRREIETRMGIKALDIYGLSEVMGPGIAMESVEHANGSTIWEDHFYPEVIDPDNLSVLPDGKSGELVFTTLTKEAMPVIRYRTRDLTRLLPGTARHMRRIDRIAGRSDDMLIIRGINVFPSQVEEQIIRFKELSPHYQLEVNRTGNYDCLSVKVELKEPERLDAQQRCDICHQLRHHIKSMIGLSTEVSIVNCGDIPRSEGKAVRVIDHRQHE

SEQ ID NO: 7877 - protein, 38 aa, Xenorhabdus bovienii
  Coding DNA sequence: Name=SeqID_1769
MESRCCTLLLIVSCPFVDLFVTGCCFYVQVWVICQYPI

SEQ ID NO: 7878 - protein, 404 aa, Xenorhabdus bovienii
  Coding DNA sequence: Name=SeqID_1770
  Gene classification: Gene name=PaaJ; Function=Acetyl-CoA acetyltransferases; Function class=I Lipid metabolism
  Homolog annotation: Query=1..403bp; Hit=1..401bp; Blast score=583; Percent Identity=77.0; E value=1e-166; Homolog= paaJ COG0183
MTHAFICDGIRTPIGRYGGALSGLRADDLAALPLQALLARYPSLDWQHIDDIILGCANQAGEDNRNVARMAVLLAGLPYSVSATTLNRLCGSGLDALAFAARAIKAGEAQLMLAGGVESMTRAPFVMGKTDSPFSRQAQIFDTTLGWRFINPLMQQQFGTDSMPETAENVAAQFQISRDDQDAFALRSQQRTASAQQRGILAEEITPVTLPAANKKEVATIVSQDEHPRPETTFEQLQRLKTPFRTDGTITAGNASGVNDGAAALIIASEKAALQQGLTPRARIIATATCGVEPRIMGIGPLPATRKVLELTGLSLNQMDIIELNEAFAAQSLAVMRQLGLSDDAEQVNPNGGAIALGHPLGMSGARLALTATLELERRAGRYALCTMCIGVGQGIAMIIERVS

SEQ ID NO: 7879 - protein, 151 aa, Xenorhabdus bovienii
  Coding DNA sequence: Name=SeqID_1771
  Gene classification: Gene name=PaaI; Function=Uncharacterized protein, possibly involved in aromatic compounds catabolism; Function class=Q Secondary metabolites biosynthesis, transport and catabolism
  Homolog annotation: Query=7..145bp; Hit=2..140bp; Blast score=160; Percent Identity=61.0; E value=3e-40; Homolog= paaI COG2050
MSANASSQLAQRCIEAMYAKDACAQNMGMHIDHVDTGVAQVSMTIKPDMLNGHQSCHGGILFSLADTAFAYACNSEGLAAVASGCSIDFIRPAFSGDHLTATAFMQHQGKTTGLYDVKIINQDGKIVAFFRGHAHRLGHSILKESQGEQQS

SEQ ID NO: 7880 - protein, 532 aa, Xenorhabdus bovienii
  Coding DNA sequence: Name=SeqID_1772
  Gene classification: Gene name=FadB; Function=3-Hydroxyacyl-CoA dehydrogenase; Function class=I Lipid metabolism
  Homolog annotation: Query=15..515bp; Hit=8..473bp; Blast score=445; Percent Identity=48.0; E value=1e-125; Homolog= ydbU COG1250
MNTPAHHRPILHGPIAVIGAGTMGIGIAQVAAQAGHSVLLFDVKGEAAQRALETLHTRLHQRVEAGKAEAGATQALLQRITQVDSLQALAPSALVIEAIIEQLEVKQNLFRQLEPLCSAETIFASNTSSLSITAIARVLASPQRMAGLHFFNPAPLMKLVEIVQGLETSSQTIAALKSLVTDWQKQPVVCRSTPGFIVNRIARPFYAETLRALEENIASPATLDAVMKESGGFAMGALQLTDLIGHDVNYAVTESLFHAFHGDPRFQPSLRQKELVEADHLGRKRGRGFYVYDGKEKHQPLPRLETLQEQIRPTRIQATGDWGTLPHFAALLKPLLPQYGIALEESKNTGSQPPALQLDDVILTLTQGKTSAQLADEIRAPVVQFDLAANHQTASIITLSSACQNTQLQTEKVISFLQSLGKQVVLLPDYPALLTMRTVAMLCNEALDAINKGIASAEDIELAMCYGVNYPIGPLAWGEQLGWRHILSTLENLQQFYGEPRYRPAPLLRQLAAGYVTLHLQRDQDKEHNHVR

SEQ ID NO: 7881 - protein, 265 aa, Xenorhabdus bovienii
  Coding DNA sequence: Name=SeqID_1773
  Gene classification: Gene name=CaiD; Function=Enoyl-CoA hydratase/carnithine racemase; Function class=I Lipid metabolism
  Homolog annotation: Query=4..265bp; Hit=2..262bp; Blast score=335; Percent Identity=65.0; E value=3e-92; Homolog= paaG COG1024
MENMSMILTDIEAGVLSITLNRPERINSFNEEMHQQLSEALKIAEQDESVRCVLLSGAGRGFCAGQDLNDRNAITSEGDVPDLGQSVERFYNPLIRRLTSLPKPVICAVNGVAAGAGVSVALACDIVIASRTASFIQAFCRIGLTPDAGGSWFLPHKIGHARAMGMALLGDKISAEQALEWGMIWQVIEPEALEDKTRELAQHLATQPTVALSCIKKATYAAAANSLDQQLNLERDLQRLCGRSEDFREGVSAFIDKRQPQFKGR

SEQ ID NO: 7882 - protein, 257 aa, Xenorhabdus bovienii
  Coding DNA sequence: Name=SeqID_1774
  Gene classification: Gene name=CaiD; Function=Enoyl-CoA hydratase/carnithine racemase; Function class=I Lipid metabolism
  Homolog annotation: Query=6..256bp; Hit=4..254bp; Blast score=277; Percent Identity=61.0; E value=8e-75; Homolog= ydbS COG1024
MSHEWILCHQQQRVRTLTLNRPEVRNALSNDCLEQLVQQLEQADADTGTGAIVITGSSSYFAAGTDLKELQQQTVATAMTDRRPQLWQRLHNITKPLIAAVNGYALGAGCELVLACDLVICGESARFGLPEITLGLMPGAGGTQRLIRSVGKALANQMILTGEAIDAQKAQQAGLVSEVCIDALTLERAEQIALRISEFSPLALRAAKAALKTAYETSLSQGLLAERQQFVALAGTADRQEGITAFLEKRKPTFKGF

SEQ ID NO: 7883 - protein, 436 aa, Xenorhabdus bovienii
  Coding DNA sequence: Name=SeqID_1775
  Gene classification: Gene name=Hmp; Function=Flavodoxin reductases (ferredoxin-NADPH reductases) family 1; Function class=C Energy production and conversion
  Homolog annotation: Query=83..435bp; Hit=3..351bp; Blast score=414; Percent Identity=56.0; E value=1e-116; Homolog= paaE COG1018
MPSNVCGSPASRLRRAWLVKNRQRQKQSPAHVVAAMRPKKSVNSVPPPAKRSIAVSSVWNPSTISNVFEFREQQKMATFHRPTFHRLSIAAIERETPDAVTVTLHVPDELKALFCYQPGQHLTLKARVDGAELRRCYSICSSPLDNGLQIGIKATYQGRFSTFINQQLKVGDELDVMQPQGNFGHHPDGNKAGNYLAIAAGSGITPILSIIKSTLALEPDSTFTLIYGNRTSRSVMFKEALADLKNRYLHRFQVLYLFSQEITDSPMFNGRIDSEHLQRLGKILLNFSQFEQAFLCGPAAMLDDAKSALEQAGMASERIHTERFNTGRNPSSTAVRPANLAERNETHVEIHLDGRTLNIAMNTEDDSILDAALRQGADLPYACKGGVCATCKCRLKSGEVDMSVNYSLEPDQLAAGYILSCQSWPKGDGVVVDFDI

SEQ ID NO: 7884 - protein, 167 aa, Xenorhabdus bovienii
  Coding DNA sequence: Name=SeqID_1776
  Gene classification: Gene name=PaaD; Function=Predicted metal-sulfur cluster biosynthetic enzyme; Function class=R General function prediction only
  Homolog annotation: Query=3..167bp; Hit=4..167bp; Blast score=201; Percent Identity=60.0; E value=3e-52; Homolog= paaD COG2151
MEQQVNTLQPPAIHQIWQCLHQIADPELPVLSITDLGMVRAVTPQQTGWRVIFTPTYSGCPATEYLINEIQQTLARAGFTPITIEISLTPAWTTDWMNADAKQRLRESGIAPPQGLACEKPTETETITCPRCGSHETEKISEFGSTACKALYRCQQCLEPFDYFKCI

SEQ ID NO: 7885 - protein, 258 aa, Xenorhabdus bovienii
  Coding DNA sequence: Name=SeqID_1777
  Gene classification: Function=Uncharacterized BCR; Function class=S Function unknown
  Homolog annotation: Query=11..258bp; Hit=2..248bp; Blast score=321; Percent Identity=64.0; E value=4e-88; Homolog= ydbP COG3396
MKTHSVAPPNHDLLNYVLRQGDTPLILAQRLCEWCGHTPELEIDLALSNIGLDLLGQSRHFLSYAATLYGMDFDEDRLAFGRDEREYRNLLLVEQPNGGFNDTLVRQFFIDAYHVLLHQVLGQSRDPQLAAISTKSLKEVEYHLRFSRGWMIRLGDGTELSREKIQQSVNQLWRFTGELFYCDEVEQRLTEDGTAVDPRTLYEPWRQIINETFAQATLEIPQETPYRQGGKQGLHTEHLGYMLAEMQYLQRTYPNCNW

SEQ ID NO: 7886 - protein, 95 aa, Xenorhabdus bovienii
  Coding DNA sequence: Name=SeqID_1778
  Gene classification: Function=Uncharacterized enzyme of phenylacetate metabolism; Function class=Q Secondary metabolites biosynthesis, transport and catabolism
  Homolog annotation: Query=1..95bp; Hit=1..95bp; Blast score=161; Percent Identity=77.0; E value=1e-40; Homolog= ynbF COG3460
MIDTDWPLYEVFIRSKQGLAHRHVGSLHAADDQMALENARDVYTRRNEGCSIWVVKSIYLVASQPEERGAFFDPSEDKIYRHPTFYTIPDGIKNM

SEQ ID NO: 7887 - protein, 313 aa, Xenorhabdus bovienii
  Coding DNA sequence: Name=SeqID_1779
  Gene classification: Function=Uncharacterized BCR; Function class=S Function unknown
  Homolog annotation: Query=10..312bp; Hit=7..309bp; Blast score=508; Percent Identity=78.0; E value=1e-144; Homolog= ydbO COG3396
MTTNSLQAYFDAKIAADLSIEAKDWMPDAYRQNLIRQIGQHAHSEIVGMLPEANWITRAPTLRRKAVLLAKVQDEAGHGLYLYSAAETLGCTRQDIYQKLLNGKMKYSSIFNYPTLNWADVGVIGWLVDGAAIINQVALCRASYGPYARAMVKICKEESFHQRQGYEAVMVLAAGNDAQRAMLQDAINRFWWPTLMMFGPNDNDSPNSAQSMAWKIKRFSNDELRQKFIDSTVPQLEALGMTAPDPELAWDETTGHYRFGEIDWDEFYQVLKGQGICNHERLEAKRQAWETGSWVREAASVHAKKMAARKNAA

SEQ ID NO: 7888 - protein, 702 aa, Xenorhabdus bovienii
  Coding DNA sequence: Name=SeqID_1780
  Gene classification: Gene name=PutA; Function=NAD-dependent aldehyde dehydrogenases; Function class=C Energy production and conversion
  Homolog annotation: Query=13..519bp; Hit=1..500bp; Blast score=649; Percent Identity=68.0; E value=0; Homolog= maoC_1 COG1012
MIDSLMRSAEKKMQQLTSYICGAWVYGQGNARAIHHAVSGEALYQVCSDGLPLADSLGYAREKGGKSLSAMTFQQRAQMMKAVAKHLLANKETLYAISAETGATRADGWVDIEGGIATLFSYAGLAGRELPDDTLWPEDEMIPLSKQSQFVARHMLTSRPGVALHINAFNFPCWGMLEKLAPTWMAGMPAIIKPATASAQLTQAMVKMIIDSGLVPEGALQLICGGIGDLFDHLDYQDAVTFTGSAQTGQKLRVHPRLIEKSIPFTMEADSLNCCMLGEDVTPEMPEFGVFIKEVVREMTAKAGQKCTAIRRIIVPVSQLEAVKQALLKRLSGVTVGDPALPEVRMGALISLEQRDEVQAKVDELLSHGCEPLCGGSLDQLVLTGNSSSEGAFYPPTLLYCADPVTHQAVHGTEAFGPVSTLMPYQGTEQAIALVLMGQGSLAGSLVTADEQIAVQVIRATACAHGRMLVLDEAASAESTGHGSPLPMLVHGGPGRAGGGEELGGLRAVKHYMQRTAIQGSPNMLAAIGREWVRGAKVKSDPVHPFRKYFEQLEIGESLLTARRTVTEADIVNFACLSGDHFYAHMDKLGAAESLFGERVAHGYFVVSAAAGLFVDAAVGPVLANYGMENLRFIEPVKIGDTIQVRLTCKKKIKKAQKTPDDKPQGVVVWDVQVLNQEQQPVALYSILTLVERQQGDFTASE

SEQ ID NO: 7889 - protein, 98 aa, Xenorhabdus bovienii
  Coding DNA sequence: Name=SeqID_1781
LSTLILKGNTFDCYIIKSLLSWKNYSENCNSPILQIKFNPNSNFREQPEDHRYFIFFDKYPQAFQFPYSTNLRFVYLNRTYSDAVKSPCCRSTSVRIL

SEQ ID NO: 7890 - protein, 90 aa, Xenorhabdus bovienii
  Coding DNA sequence: Name=SeqID_1782
  Homolog annotation: Query=1..90bp; Hit=1..90bp; Blast score=139; Percent Identity=93.0; E value=7e-33; Homolog= ref|NP_929561.1|
MATSVKLDDNLKSRIQNLAEVRQRSAHWIMREAIRDYVEREEKRESFKQDVLRAWEAYQENGLHLTLEEADDWLAKLEAGDNTELPECHV

SEQ ID NO: 7891 - protein, 43 aa, Xenorhabdus bovienii
  Coding DNA sequence: Name=SeqID_1783
MPRLIWSPAALTDVQKLYRFLVKKDEAAARRAIKTIRASVTPA

SEQ ID NO: 7892 - protein, 125 aa, Xenorhabdus bovienii
  Coding DNA sequence: Name=SeqID_1784
MKQYIEDYIDIRYGLKVTVKEPNTLKKSLNILNSILANGRFPSLLPPTEKTYLNNRASLSPFLDNLVSRFFLVLHRKNCGCFTIKTIQVNIATATKINKPFSEYGIHIFSRASYFRLVSRWHVLF

SEQ ID NO: 7893 - protein, 43 aa, Xenorhabdus bovienii
  Coding DNA sequence: Name=SeqID_1785
LIVRISHGFQGGTSLSLCYGGNRFSEDLDFAGGKDFRPANWGR

SEQ ID NO: 7894 - protein, 178 aa, Xenorhabdus bovienii
  Coding DNA sequence: Name=SeqID_1786
  Homolog annotation: Query=1..173bp; Hit=28..200bp; Blast score=209; Percent Identity=61.0; E value=1e-53; Homolog= ref|NP_798518.1|
MNQTTAIHCLNKLDQQGRYVFTSRDLAKLFSEDSKRSFEAGLSRLVKQGILSRACKGVYVFTLSRHKGLHTLELIAKTMRRGEYNYVSLESALSEYGAISQIPIDRLTVMTTGRKGEYNTPFGTVEFTHTKRAVSDIINHIQDVGRPLRLANKQAAYRDLKRVGRNTHLVEKEMVYEN

SEQ ID NO: 7895 - protein, 345 aa, Xenorhabdus bovienii
  Coding DNA sequence: Name=SeqID_1787
  Gene classification: Function=Predicted transposase; Function class=L DNA replication, recombination and repair
  Homolog annotation: Query=165..332bp; Hit=20..184bp; Blast score=77; Percent Identity=29.0; E value=3e-14; Homolog= BH2520 COG3335
MTITLTDAQKEALELMHDTTRDGRVRDRIKAVLLASEGWTAQMIAQALRIHESTVSRHLKDYVSEEKLAPENGGSESRLSAEQTTELVEYLTANLMHTTAQIVACVWARWQVTFTVAGMTKWLHRQGFSYKKPMGTPHKSDAGKQQHFIETYNALKAECGQNAPILFIDAMHPTQSTKLSYGWMRRGREHVKVVETTGSRTRLNIMGALNLQRIEETIIREYPTINAKNVVLFFGSIRETYPLSQKIHLILDGAGYHRAEIVQFFAEVLNIELHYLPPYSPNLNPIERLWKYANEQVRNNIYFSEAKTFRETLHHFFHVTLPEKAKELTTRLTDNFQTLSPASSS

SEQ ID NO: 7896 - protein, 51 aa, Xenorhabdus bovienii
  Coding DNA sequence: Name=SeqID_1788
MCTQISLYNDIYPSSLKMLDFLFVSDQDRAHDNYSDRCPKRSPRIDARYDS

SEQ ID NO: 7897 - protein, 359 aa, Xenorhabdus bovienii
  Coding DNA sequence: Name=SeqID_1789
  Homolog annotation: Query=1..357bp; Hit=1..357bp; Blast score=502; Percent Identity=71.0; E value=1e-141; Homolog= ref|NP_929263.1|
MKTYPLQSMTMAQAQQQQFKLVDIICRHFPGADFLSQGDLGLVPDLHQPRMTHRIEAVIAEHFGAEAAAFVNGAGTGALRAGLAALVSPNATLLVHDAPIYPTTKISIEQMGLHVVHADFNHTEQIAAAIRQYQPAACLIQHTRQKIDDSYALQDVLAILHQYQIPSLVDDNYAAMKVAHIGCEYGATLSSFSCFKLLGPQGVGLVVGKQTTIETLRRSMYSGGCQIQGYQAMEALRGLVSAPVTHAVQAEVNETLVTRLNQGELPQVKQAFLANAQSKVLLVEFHEPIAEVVLTAAHGLGALPYPVGAESKFEIPPLFYRISGTFRQADPTLEKRMIRINPNRSGAETVIRILRESIL

SEQ ID NO: 7898 - protein, 455 aa, Xenorhabdus bovienii
  Coding DNA sequence: Name=SeqID_1790
  Homolog annotation: Query=18..451bp; Hit=1..438bp; Blast score=594; Percent Identity=78.0; E value=1e-168; Homolog= ref|NP_929262.1|
MSDINATQHLHSFLMSLMEVDPSKAGLLAAIGAIAAMMANRGIAVFHDGLRPLLPEYLEGRMSRKALAATSFALSIGLVVGFGIPFSLAAPIVLVHSLLLGTDMIGIWCANSRRGFIASGIIGALYAIALLAGLRSVVELFAMLPVNFTDDLKKVGDPIVACFALFPAIVVGYQYGYRKGLWVMLTALIGYLATKAIGPLSFGGMIEKPVSLDPNGAALLLSMTAMFYFAMRERPAQSAEQKGANEVLVGLFSTRIERIQKNKWLLILCGGLTASAATMSFSLLAEGPVSLQLMAQGEQTNALLVALARAISFVPLVGTTAIATGVYSPNGMKFVFVAGLATNNPWIAFIAGGITMFIEIQLLAKIAIWLDKYPGVKACSGHIRTAITKMLEVALLVGGMIASNAILPGIGFMIVAGIYLLNRTSKRPLVEMAIGPIATIAVGILANVLYLLGIK

SEQ ID NO: 7899 - protein, 120 aa, Xenorhabdus bovienii
  Coding DNA sequence: Name=SeqID_1791
  Homolog annotation: Query=1..118bp; Hit=1..117bp; Blast score=154; Percent Identity=72.0; E value=3e-37; Homolog= ref|NP_929261.1|
MKFVVGGQIEKERIAEGIRQLAGDKATAITIMNDIEAAMAIKNGDADYYLGACNTGGGGALAIAIALIGLNQCVTISMPGKILSDDEIIAHVKAGKKAFGFTGQDIDVVLPVIINTIVSR

SEQ ID NO: 7900 - protein, 362 aa, Xenorhabdus bovienii
  Coding DNA sequence: Name=SeqID_1792
  Gene classification: Gene name=Php; Function=Predicted metal -dependent hydrolase with the TIM-barrel fold; Function class=R General function prediction only
  Homolog annotation: Query=68..356bp; Hit=4..292bp; Blast score=379; Percent Identity=62.0; E value=1e-105; Homolog= php COG1735
MGYQKQTGNTPTHSAPYSSSRIDEAEDALKQAGYQEYQVKRRGETLLYSSNNQLNNPYPGTKQNTCIDTSGYTYVHEHLHIDLSGAKGSLDCRLDQYDLIVDELRHLYTLGLRNIAEMTNCYMGRNASFLLDLMRDSHINIIASTGYYKEPFFPVHFSELSVQAIADDMIAEIETGIDGTGLKAGVIAEIGSSLDQITTDEKKVFAAAALAHHATGCPISTHTTLSTMGREQLSLLKEFGVSAAHVAIGHCDLKDNLDTIIPLLEEGAWVQFDTIGKNNYYPDSGRIAMLREVAKRGLLSQVMLSQDITRRSHLKSNGGIGFDYLLTVFVPMLLAADFSQTQIDLMLRDNPAQFFRHGFSKT

SEQ ID NO: 7901 - protein, 391 aa, Xenorhabdus bovienii
  Coding DNA sequence: Name=SeqID_1793
  Gene classification: Function=Predicted amino acid racemase; Function class=E Amino acid transport and metabolism
  Homolog annotation: Query=1..383bp; Hit=1..383bp; Blast score=457; Percent Identity=55.0; E value=1e-128; Homolog= yhfX COG3457
MFINALKKQNPKLIEIAKDLWQQGAILPDTYIIDVDQVLDNGRRLLQAAEQYGVELYLMTKQIGRNPWLAQKLIELGYPGVVAVDFREAYTLSQHGIPLCHIGHLVQTPAHLIETMLKQHPGIITVFSIEKAQAISDAAEKLGRVQPIMLKVFDKRDITLPSQEAGILFDELDTTVDILKTMPGIKLSGLTHFPCLEWNVRYQTTLPTINLQTLLRARNRLEQLGIELSQINAPSASSCNTIPLLAKYGATHLEPGHALTGTIPANISGREPEKISMVYITEVSHHYDGNSYCYGGGYYKRGHMKYALVFPECARSPKTVRVLSLGDPCIDYHLPISGIHPIGSPVIMCFRTQIFVTRSDVALVSGIQSGSPKLEGIYDSQGNWKNRGYFQ

SEQ ID NO: 7902 - protein, 47 aa, Xenorhabdus bovienii
  Coding DNA sequence: Name=SeqID_1794
MAAMRHGCVKVKKAEKSKIFIFLNIYSVNKIQGILVASIKPYKFTNR

SEQ ID NO: 7903 - protein, 120 aa, Xenorhabdus bovienii
  Coding DNA sequence: Name=SeqID_1795
  Homolog annotation: Query=2..116bp; Hit=15..129bp; Blast score=111; Percent Identity=49.0; E value=2e-24; Homolog= ref|NP_417841.1|
MVEQRLTILLQGGVIDQDIYDNMLDIVHDLEDIWLIPVHHPQGEMALTHMASAFMRSRRGEIVLPLENNILTKIEQSEHCAQLFKIHRALLEKFTVTLHPNEEGYLLVNLYGLILATKIP

SEQ ID NO: 7904 - protein, 302 aa, Xenorhabdus bovienii
  Coding DNA sequence: Name=SeqID_1796
  Homolog annotation: Query=2..302bp; Hit=1..301bp; Blast score=352; Percent Identity=59.0; E value=6e-96; Homolog= ref|NP_709156.1|
MMSQTFIKKEGIAQSFLARYLLSEQCGNRLKTIELLAKECGLSVGLMQAALKSLEQAQAVGIKRRGRNGSFLSQINHKLLLEYADIGNVVCAMPLPYTRAYEGLASGLKVLCAEIPFYFAHMRGSDIRIECLLNGIYDLAVTSRLAAEQHPENKDLYIALSLGTQSYTDRHRLIFRHGEMDSIRRVGLDSTSADQKIMTNQYFEGKEIEMVEVSYHECLNQIMKGHIDAAIWNVGQGHELIAQGLMTQLPDDSECFIKASEAVILARKDNIPIQQLLHTMVDREVLLTHQQNVVAGTIEPVY

SEQ ID NO: 7905 - protein, 169 aa, Xenorhabdus bovienii
  Coding DNA sequence: Name=SeqID_1797
MLTIREATIRDAVLLSQLIEESYRFHFSHLWHNKAELEEYVAEERSPERISDSLRTPNHKWFIAETDHPIGFGKIAFHEPIPDSDLTGVYLHKLHLMPHQTGQKYGEQVFDHIVKLGQEQGLQWLWLEVLEQNTLAIKFYERKGMRWYKNIIFSSPKQKSTLHIMTKPI

SEQ ID NO: 7906 - protein, 46 aa, Xenorhabdus bovienii
  Coding DNA sequence: Name=SeqID_1798
MVGCRKADLIILPGTGHIHTAAGFGDCPEEKRLINEISDDSLIPNK

SEQ ID NO: 7907 - protein, 501 aa, Xenorhabdus bovienii
  Coding DNA sequence: Name=SeqID_1799
  Gene classification: Gene name=GlpA; Function=Glycerol-3-phosphate dehydrogenase; Function class=C Energy production and conversion
  Homolog annotation: Query=1..495bp; Hit=1..494bp; Blast score=740; Percent Identity=76.0; E value=0; Homolog= ZglpD COG0578
MGTKDLIVIGGGINGAGIAADAAGRGLSVLLLEGQDLASATSSASSKLIHGGLRYLEHYEFRLVSEALAEREVLLRLAPHIAFPMRFRLPHQPHLRPAWMIRIGLFLYDNLGKRVSLPSSKGLKFGANSVLKPSISRGFEYSDCWVDDARLVVLNAQEVQKHGGEVRTRTQVTHAWREKGYWMVEAKDLTTGKTDTWRAKGLVNATGPWVKNFFDDGLKLKSPYGIRLIKGSHIVVPRVHDEPQAYILQNEDNRIVFVIPWNDEFSIIGTTDVEYKGDPKEVKIDDQEIGYLLKVYNDHFKKQLDRSDVVWTYSGVRPLCDDESDSPQAITRDYTLDVQDEQGQMPLLSVFGGKLTTYRKLAEHAMEKLVQYYPNAGKAWTKNGKLPGGELEGHDRDGYARLLRQRHNWLPEGVAQRYARTYGSNCQIILKGAEALTDLGEFFGHGLYEAELRYLVEHEWVTQLDDAIWRRTKLGMWLTDEQKQRVADWLAQNVQSSQAQG

SEQ ID NO: 7908 - protein, 252 aa, Xenorhabdus bovienii
  Coding DNA sequence: Name=SeqID_1800
  Gene classification: Gene name=GlpR; Function=Transcriptional regulators of sugar metabolism; Function class=K Transcription
  Homolog annotation: Query=1..252bp; Hit=1..252bp; Blast score=396; Percent Identity=77.0; E value=1e-110; Homolog= ZglpR COG1349
VKQTQRHDAIIELVRLQGYVSTEELVEHFDVSPQTIRRDLNDLADKNKIQRHHGGAALPSSSVNTAYHDRKIMWSDEKARIARQVATQIPNGATLFIDIGTTPEAVAYALLNHRDLRIVTNNLNVASLFMGKEDFRLIMAGGEVRSRDGGIIGEATLDFISQFRLDFGILGISGIDSDGSLLEFDYHEVRTKRAIIENSRCVMLVADHSKFGRSAMVNLGNMNLIDFLFTDKAPPVSIQKIIEQHSVKLELC

SEQ ID NO: 7909 - protein, 277 aa, Xenorhabdus bovienii
  Coding DNA sequence: Name=SeqID_1801
  Gene classification: Gene name=GlpG; Function=Uncharacterized membrane protein (homolog of Drosophila rhomboid); Function class=R General function prediction only
  Homolog annotation: Query=1..276bp; Hit=1..274bp; Blast score=254; Percent Identity=48.0; E value=9e-68; Homolog= ZglpG COG0705
MIHVTSISNPRLAQAFIDYMATQGINLTMRPTNEPALVELWLEDESRLGFVEQELNQFSRDPLNERYQAASWQAGKSGYSFKYHNSLNLSTLKSQSGPLTISVTALCILVYLWMQAAGDSNVMRWLAWPNGEQYLELWRWVSPALLHFSLTHVLFNLALWWYLGSQVERNMGAGKLFEITIVSAVFTDWAQSLFSGSHFGGLSGVVYALISYVWLTGEISPKRGISVPRGLIAISVIWLLVGYFDMFSLNIANAAHFSGLIIGLLMGLWDNLRKQKN

SEQ ID NO: 7910 - protein, 107 aa, Xenorhabdus bovienii
  Coding DNA sequence: Name=SeqID_1802
  Gene classification: Gene name=PspE; Function=Rhodanese-related sulfurtransferases; Function class=P Inorganic ion transport and metabolism
  Homolog annotation: Query=1..104bp; Hit=1..104bp; Blast score=132; Percent Identity=58.0; E value=5e-32; Homolog= glpE COG0607
MDRFQTINPEQAYQHWLNKTAVMVDIRDPQSFRAGHTTGAFHLTNETLNNLLQEADFDQPVMVMCYHGHSSQGAAQYLVNMGFETVYSVNGGFDVWQRSYPEAVNTL

SEQ ID NO: 7911 - protein, 191 aa, Xenorhabdus bovienii
  Coding DNA sequence: Name=SeqID_1803
  Gene classification: Function=Thioredoxin-like proteins and domains; Function class=O Posttranslational modification, protein turnover, chaperones
  Homolog annotation: Query=97..191bp; Hit=1..95bp; Blast score=187; Percent Identity=92.0; E value=6e-48; Homolog= yhgI_2 COG0694
MINITEAAQAHFAKLLASQEPGTQIRVFVINPGTPTAECGVSYCPPDAVEATDTELKFDQISAYVDEISAPFLVEAVIDFVTDQLGSQLTLKAPNAKMRKVTDDAPLIERVEYVLQSQINPQLAGHGGRVSLMEITDAGYAILQFGGGCNGCSMVDVTLKEGIEKELLNMFPELKGVRDLTEHQRGEHSYY

SEQ ID NO: 7912 - protein, 332 aa, Xenorhabdus bovienii
  Coding DNA sequence: Name=SeqID_1804
  Gene classification: Gene name=ComFC (BS); Function=Predicted amidophosphoribosyltransferases; Function class=R General function prediction only
  Homolog annotation: Query=95..332bp; Hit=6..243bp; Blast score=204; Percent Identity=46.0; E value=2e-52; Homolog= ZyhgH COG1040
MQYGWQPILPATNPATAHYPVPAAIRHPPFPPESLPDTAGCDHTPANPPDAGGSAKPIAFPRNARPQNSTPIRAASQDRVEPHPLSAKTTYSLLFSSYLSSRKEPMLTMVGYCWLCHQSLYFAHHGICHICHQQLKRLQCVCPRCALPAESRDFPCGRCLKNPPPWQHLIAITDYAPPLSRLIQRYKYHGTPQLATVLARLFLLHWLQGYRDGRWNKPDCILGIPLHSKKRWQRGFDQIELITQPLSRWLQCHYQPDLLWRSRATLTQRGLSATQRKTNLKHAFQLRGDFTDQNVAIFDDVITTGTTLHEASQLLIRAGAHSVQAWAICRTL

SEQ ID NO: 7913 - protein, 262 aa, Xenorhabdus bovienii
  Coding DNA sequence: Name=SeqID_1805
  Gene classification: Gene name=MhpC; Function=Predicted hydrolases or acyltransferases (alpha/beta hydrolase superfamily); Function class=R General function prediction only
  Homolog annotation: Query=5..254bp; Hit=1..250bp; Blast score=333; Percent Identity=65.0; E value=1e-91; Homolog= bioH COG0596
MRITMNKLFWQIMGEAPRDLVMLHGWGLNSEVWRSVETRLASHFRLHLVDLPGYGRSQPYPAMTLAEMADAVWQQAPDNALWLGWSLGGLVASRIALDHPAQVAGLITVASSPKFSAEGDWPGIKPTVLQAFEHQLSEDFQKTVERFLALQTLGTDSARQDARLLKSVILSQPMPTVEVLNAGLEILRTDDLRAELAQLRLPFLRLYGYLDGLVPRKIAARLDNEWPHTDSVIMRNAAHAPFISHPDEFVDALMEFVVNAGL

SEQ ID NO: 7914 - protein, 147 aa, Xenorhabdus bovienii
  Coding DNA sequence: Name=SeqID_1806
  Homolog annotation: Query=1..144bp; Hit=1..144bp; Blast score=208; Percent Identity=67.0; E value=1e-53; Homolog= ref|NP_929584.1|
MPKELFTAEIESSGHLKMKCSTRGFSFHVDEPKNLGGTDEAMNPVEALLSAFGACQCIVAKSFARKHKINLIDIQVKMEGELDTDGFTGRNKNAKMGFSKITSKFYIKADNTEQEIRDFIDFVESNCPVLDTILNAPEIVTEVYPSE

SEQ ID NO: 7915 - protein, 79 aa, Xenorhabdus bovienii
  Coding DNA sequence: Name=SeqID_1807
LNSAHHQSLCGDNCITSILHYICNATISINWFFPSFERFSFTQLGSNSGITAVFYCYILHIYRFIFPYERLKSHSPNIN

SEQ ID NO: 7916 - protein, 84 aa, Xenorhabdus bovienii
  Coding DNA sequence: Name=SeqID_1808
  Gene classification: Gene name=RelB; Function=DNA-damage-inducible protein J; Function class=L DNA replication, recombination and repair
  Homolog annotation: Query=1..84bp; Hit=1..79bp; Blast score=72; Percent Identity=50.0; E value=9e-14; Homolog= relB COG3077
MSTIQVRVDEDLKKASYKAFEKLNVSPSDALRLFLRYVAENEKLPFSEVSLIVAENDNDEDILDVVRERIRNPAKRVRVNLDEI

SEQ ID NO: 7917 - protein, 97 aa, Xenorhabdus bovienii
  Coding DNA sequence: Name=SeqID_1809
  Gene classification: Gene name=RelE; Function=Uncharacterized ACR; Function class=S Function unknown
  Homolog annotation: Query=1..95bp; Hit=1..94bp; Blast score=99; Percent Identity=58.0; E value=7e-22; Homolog= relE COG2026
MKFNIDFDERALKEWHKLDKSIREQFKKKLRKLQENPYIESARLHGDLAGCFKIKLCSSGFRLVYQVIDEEIVIWVIAVGKREDSMAYDIAKKRLGV

SEQ ID NO: 7918 - protein, 79 aa, Xenorhabdus bovienii
  Coding DNA sequence: Name=SeqID_1810
  Homolog annotation: Query=1..75bp; Hit=1..75bp; Blast score=95; Percent Identity=65.0; E value=2e-19; Homolog= ref|NP_927571.1|
MISLLKIRDAVALNGRTDARSLSHQFSTPLPMVEAMLKQLVTMGKLEEVDTSSCLSGGCKQCPETQKCAIKVYQLMVKN

SEQ ID NO: 7919 - protein, 771 aa, Xenorhabdus bovienii
  Coding DNA sequence: Name=SeqID_1811
  Gene classification: Gene name=FeoB; Function=Fe2+ transport system; Function class=P Inorganic ion transport and metabolism
  Homolog annotation: Query=2..771bp; Hit=1..773bp; Blast score=1068; Percent Identity=72.0; E value=0; Homolog= feoB COG0370
MMKQLTIGLIGNPNAGKTTLFNQLTSSRQRVGNWAGVTVERKTGRFTTDEHQIELVDLPGTYSLTTISEQTSIDEQIACHYILSGEADMLINVVDASNLERNLYLSLQLIELGIPCIVALNMLDIAKSQHINIDIAALEQRLGCPVIPLVSTRATGIDTLKETIDHYQPSSQPIRVEYPDSLLQEVNHLASQMTQNFNPQQRRWLTLQVLEGDIYSRERAGLTQSQLAESKMRLQQQQLDEPELIIADSRYQAINALCLAVIDTRAATPHKLTQAMDKVILNRWLGVPIFLFIMYLMFVLAINLGGALQPLFDGASTAIFIDGMRWLGHTLHFPDWLTVFLAQGVGGGINTVLPLVPQIGLMYLFLSFLEDSGYMARAAFVMDRLMQSLGLPGKSFVPLIVGFGCNVPSVMGSRTLDAPRERLITIMMAPFMSCGARLAIFAVFAAAFFGKSGASIVFSLYILGITVAVLTGLLLKHTLMRGEASPFVMELPVYHVPHAKTLLLQSWQRLKGFVIRAGKVIVAASMLIGALNSFSFSGKAVDNINESALASVSKVITPLLYPIGVHSDNWQATVGLITGAMAKEVVVGTLNTLYTAENINQAPFNPDEFHLLDELKGAVAETWNSLKETFTLSALSNPIEASKGDGNMDSSAMGTMSAKFGSAISAYSYLIFVLLYVPCVSVMGAIARETSRGWMLFSILWGLDVAYSLAAVFYQVTTFSAHPQSSLITILAVIVFNVLVFIGLRRARSRVTIAFNNTAGRSCECSDSSCH

SEQ ID NO: 7920 - protein, 76 aa, Xenorhabdus bovienii
  Coding DNA sequence: Name=SeqID_1812
  Gene classification: Gene name=FeoA; Function=Fe2+ transport system; Function class=P Inorganic ion transport and metabolism
  Homolog annotation: Query=1..71bp; Hit=1..71bp; Blast score=100; Percent Identity=69.0; E value=3e-22; Homolog= feoA COG1918
MSLLPNRSYKILGFSAQISPAYRQKLLSLGMLPGSTFQVIRVAPLGDPVQIETRRVNLILRKKDLAFITLDNTPLE

SEQ ID NO: 7921 - protein, 40 aa, Xenorhabdus bovienii
  Coding DNA sequence: Name=SeqID_1813
MDIAYYHHSQSKSEIINVLFSCGSCLIRDNNSYNHLPFQF

SEQ ID NO: 7922 - protein, 179 aa, Xenorhabdus bovienii
  Coding DNA sequence: Name=SeqID_1814
MNKYAKSSFDLLSNIRFFSLATHHPDSGSPWSASLLYIPRYDPLRLIWYSKLITRHSHEISINPLVSGSLYRNRVNPDTSLDLAGAQFIGQAHEIPYNELQETYDYYFNFLFPDENIRKKKARPLSEFHGHGRRRFYELDVQEWWVYDSELWHNQQDDGRVFVPLSELAHPPKGKQIHS

SEQ ID NO: 7923 - protein, 158 aa, Xenorhabdus bovienii
  Coding DNA sequence: Name=SeqID_1815
  Gene classification: Function=Predicted transposase; Function class=L DNA replication, recombination and repair
  Homolog annotation: Query=11..115bp; Hit=6..110bp; Blast score=102; Percent Identity=45.0; E value=2e-22; Homolog= CC0928 COG3293
MSTPAHRRHDISDRVWSLLEPHLPGRQGAWGRVAEDNRRFINGVFWILRTGAPWRDLHTDYGDWKNTHRRFCRWRDKGIWEKLLEQWVNDPDFEWLMIDASHIKVHPDAAGAKGGNQDMGLTKGGSIPRYIWPWMRMVCRSELLLQAVPQQIVHKLRP

SEQ ID NO: 7924 - protein, 117 aa, Xenorhabdus bovienii
  Coding DNA sequence: Name=SeqID_1816
  Gene classification: Function=Predicted transposase; Function class=L DNA replication, recombination and repair
  Homolog annotation: Query=1..115bp; Hit=133..248bp; Blast score=81; Percent Identity=39.0; E value=2e-16; Homolog= mll8100 COG3293
MPVRIIITSGTTADCSQAETLIKGLDAEHLLADRGYDSNAIVEKAEQQGMQVQIPSRKNRKAAREYDRELYRLRHLVENTFLHLKRWRGIATRYAKNSASFLAAVQIRCLVLWLKIS

SEQ ID NO: 7925 - protein, 780 aa, Xenorhabdus bovienii
  Coding DNA sequence: Name=SeqID_1817
  Gene classification: Function=Predicted RNA binding protein, contains S1 domain; Function class=R General function prediction only
  Homolog annotation: Query=33..780bp; Hit=1..740bp; Blast score=1173; Percent Identity=80.0; E value=0; Homolog= ZyhgF COG2183
MNESLSRIIAGELQAQPQQVLAAITLFDEGNTVPFVARYRKEATGGLDDTQLRQLESRLGYLRELSDRRQTILKSIEEQGKLTVELAETINTTQSKTELEDLYLPYKPKRRTRGQIAIEAGLEPLADLLWQDPQQTPELAAAAYVDADKGVTDTKAALDGARYILMERFAEDAALLVKVREYLWKNAHLVAKVVEGKEEEGAKFSDYFDHHESIATVPSHRALAMFRGRNEGILQLALNADPQFEEAPKESYCEQIITDHLNLRLNNAPADSWRKAVVSWTWRIKVLLHLETELMGTLREKAEDEAINVFARNLNALMMAAPAGMRATMGLDPGLRTGVKVAVVDSTGKLIATDTVYPHTGQEVKAAAAVAALCTKYQVELVAIGNGTASRETERFFANIQKQYPDVKAQTVIVSEAGASVYSASELAALEFPDLDVSLRGAVSIARRLQDPLAELVKIDPKSIGVGQYQHDVSQTQLAKKLDTVVEDCVNGVGVDLNTASVALLTRVAGLSKSVAQNIVNWRDENGRFDNRNQLLKVNRLGPKAFLQCAGFLRINQGDNPLDASTVHPETYQVVEKILATTEQSLSELMGNPGALRGLQAQDFTTDKFGIPTVTDILKELEKPGRDPRPEFKTATFADGVETMKDLRVGMILEGTVTNVTNFGAFVDIGVHQDGLVHISSLSDRFVENPHTVVKTGDIVKVKVMDIDLNRKRIGLTMRLDEQPGEAPARRSGSQSSNPRNSNERNGNDRNRQTSRSPGSTALSNSAMSDALAAAFGKKR

SEQ ID NO: 7926 - protein, 164 aa, Xenorhabdus bovienii
  Coding DNA sequence: Name=SeqID_1818
  Gene classification: Gene name=GreA; Function=Transcription elongation factor; Function class=K Transcription
  Homolog annotation: Query=1..157bp; Hit=1..157bp; Blast score=239; Percent Identity=77.0; E value=1e-63; Homolog= PM1450 COG0782
MAKSNYITREGWHALDQELKYLWKVERPNVTQAVSDAAALGDRSENAEYIYGKKRLREIDRRVRFLSKRLDALQIVDPDPRQEGKVFFGAWVKVENEKAEEHIFRLVGPDEFDPAKKWISIDSPVARALLGKQVDDEITVMTPNGMAIYWILEIGYQPLGVSLY

SEQ ID NO: 7927 - protein, 239 aa, Xenorhabdus bovienii
  Coding DNA sequence: Name=SeqID_1819
  Gene classification: Gene name=OmpR; Function=Response regulators consisting of a CheY-like receiver domain and a winged-helix DNA -binding domain; Function class=T Signal transduction mechanisms
  Homolog annotation: Query=1..238bp; Hit=1..238bp; Blast score=391; Percent Identity=86.0; E value=1e-109; Homolog= ompR COG0745
MQESYKILVVDDDMRLRALLERYLSEQGFQVRSVANAEQMDRLLTRESIQLIVLDLMLPGEDGLSICRRLRSQHNPIPIIMVSAKGEEVDRIVGLEIGADDYLVKPFNPRELLARMRAVMRRQSHELPGAPRPDNAVVKFGKFKLDLGTREMFHEDEQLSLTSGEFSVLKVLVSHPREPLSRDKLMSLARGREYGAMERSIDVQVSRLRRLIEEDPAHPRYIQTVWGLGYVFVPDGSKV

SEQ ID NO: 7928 - protein, 333 aa, Xenorhabdus bovienii
  Coding DNA sequence: Name=SeqID_1820
  Gene classification: Gene name=BaeS; Function=Signal transduction histidine kinase; Function class=T Signal transduction mechanisms
  Homolog annotation: Query=37..329bp; Hit=149..437bp; Blast score=272; Percent Identity=48.0; E value=4e-73; Homolog= envZ COG0642
MKRLWLSLRALFPHVLYLTLVIVLGSLMISYLAAQRLVEMEKLSFAIVFSYVFASVFTAALTVSIPFWFYLRAQIQLLRTMQKAVRKMEKGKIVAPLPEAGAPAIRSLIRAFNQMLTGHTALETDRASLVAGVSHDLRTPLTRIRLAIELIEGKENFLRESINRDIEECNAIIDQFIDYQRSGQNVPMSCCELNGLLDEAITVENDGVGNIESHLSANPVFIMANPLSIKRALNNMFTNAQRYGQGWIRVSSGVTEKSGWFQVEDNGTGMTEEESATLFQPFTQGQRVHNNGGVGLGLAIIRRIVDIHDGDIEVGKSEKGGLSMRVYIPRVTK

SEQ ID NO: 7929 - protein, 40 aa, Xenorhabdus bovienii
  Coding DNA sequence: Name=SeqID_1821
LVSYSLLLGYASLIKNKRQTTSTTLLLSEKMVQGKNRLIQ

SEQ ID NO: 7930 - protein, 355 aa, Xenorhabdus bovienii
  Coding DNA sequence: Name=SeqID_1822
  Gene classification: Gene name=PstS; Function=ABC-type phosphate transport system, periplasmic component; Function class=P Inorganic ion transport and metabolism
  Homolog annotation: Query=10..355bp; Hit=1..346bp; Blast score=532; Percent Identity=81.0; E value=1e-151; Homolog= pstS COG0226
MMRIPAGGSMKPMRTTVASIMAAALAMTSLSSFAASSLTGAGATFPAPVYTKWADSYQKETGNKINYQGIGSSGGVKQIIAHTVDFGASDAPLSHEKLAADGLFQFPTVIGGIVLAVNISGIKSGQLVLDGKTLGDIYLGNIKKWNDPAIAKLNPDLKLPDQNIAVIRRADGSGTSFVFTSYLSKVNSLWKEKVGVGSTVKWPAGLGGKGNDGIAAFVQRLPGSIGYVEYAYAKQNNLAYTKLISADGKVVAPTEANFSAAAKGADWSKSFAQDLTAQKGDNVWPITSTTFILIHKQQKNAANGIEVLKFFDWAYEQGGKQAKDLDYSVLPQEVIGQVRAAWKRDIKDSSGKPLY
